United States Patent 7,834,146 (RECOMBINANT POLYPEPTIDES ASSOCIATED WITH PLANTS) - sequence listing, part 4

SEQ ID NO: 10987 - DNA, 691 bp, Sorghum bicolor
  Clone ID: SORBI-28MAY03-CLUS66796_1
ccaaaggacaagagatggttgagcaagataatctagctagcatgccatatctaagagcggtggtgaaagagacgctgaggttgcacccaccggcaccactcctgcttcctcacctctcaatggtggactgtgacgtggatggctacagaatcccctcgggaacacgagtcatcatcaacgattgggctatcagtagggatccagagtcatgggagagggcggaggagttcatgccagagaggttcatggacgctgccagcgccgcggccattgacatgaggggaaacgacttccagtttgtgccattcggggctgggcgaaggatctgccctggcctcaactttggcctggctactgttgagattatgttggcaaacctcgtctactgttttgactggggtctgcccattggcatgaaggaagaggatattgacatgacagaggtgtttggattgtcagtccgtcgaaaggagaagctcatcctgctttcggaaccacatgcgtgcacatgttagagttgttcctgcccaccggtctctgatgagtgagtgatccattatatatgctgtggacgatgatgtgctttctgcctcatatacgaatatccatatattatatgtatttgttagcatgggcgtcccgagtaaatatatgagccccacttcaaaacaatatgtggaggcataagtct

SEQ ID NO: 10988 - DNA, 776 bp, Sorghum bicolor
  Clone ID: SORBI-28MAY03-CLUS66840_1
gcttgacgtggtgactatcaatccagggttggtgttcggccccctgctgcagccgacggtgaacgcaagcatccagttcctcatctacttcctcaaaggaggccccgacctggtgaggaacaagctctggcacgtcgtcgatgtccgtgacctcgccgacgcgctgctgctgctctacgaggtgcctgaagcagccggcaggcacatctgcgcgcctcatgttatcagtgcccgcgacctgctggacttgctgaagagcatgtaccctgacaaccctttcattgccaaggagagcatatgtgatagagatcacccagcaccgatgacttctgataagctaaagaagctcgggtggagctgccggccgctggaggagacgatcctggacacagtcgagtgctgccagcgggctgggtttcttgacggtgcggctggggagactccctgtcgtttccctcctatcttcaacaaaatctagcctcggcgaaagcatggattgctggcaatgtttcaacaaaacattgaatcgggtgattgctgcttttatttatcttaataatctggacgagcatcagcttgcatgctgttgtattcggtggtgctgctatgtgtcttgatgttcattcgaacttgtaagacttttatttgtgtttaatttcgagtaaattacactcaccatacgataagtatctaagtgggtgtatgttagtccaacatcttgtaatttgtccaatttaatacaacaacaatataggtgggtgcatactgggcccaaa

SEQ ID NO: 10989 - DNA, 1289 bp, Sorghum bicolor
  Clone ID: SORBI-28MAY03-CLUS6420_1
gcacgagggatccagcgccgcccaagagagggacacctgaggtcctcaaattctctgtcttccaagggaatttggagtcaggtggtaaaggagagaaaaacccaaagaattctaccacgattgctctgcagtcaccattcccagaatacaatggtcgtttcgagatcggtcttggtcaatctatgatggtcccttccaattattcttgtgctgaccagtgctatggcatgcttacgacttatggaatgaaatcgatgtctggtgggagaatgctgttgccactaaatgcgccagccgatgcacccatctatgtgaacccgaagcagtacgaaggcatcctccgtcgtcgccgtgctcgcgctaaggcggagagcgagaacaggcttgccaaagggctgcagccctatctccatgagtcgcgccacctccatgcgatgcgtcgggtgagaggctccggcgggcgcttcctcaacacgaagaaagaaggagggcatggcacggacgttgatgcgaatgggggcagcaagatggcagcagcagcaccatcacgcctcaccatgccccctagctccgagcctccacgaccaccagggctcagcaacattagcaacccgcacttccactcccagagtagcgtctccagcttgtctggctccgatgtgtcaaacatctacggcggcttggagcagccccctcgggcgccacccttcttcaccgtgctgccacccatcatggacggcgaccatggtggcgtcacccacatctcttccttcaagtgggcagccagcgacagctgctgcgagctcctcaaggcatgaaccgaggaggaggggatggctactcagacaaacggccttctccccgatggctggtagtctgtaggcaaatcattcttggctgttctgcattggggtgcaacctccacatcatctacctacctacccaccccctgtccctgaaattccacagtgctttgggttacaggggtcttgtgtgatgatgtggctcccccacatgcctttgctgtaacatattgtacccaaaccactgctacttggtacttctcggtatcattgtctcagtatggattctccgttgtcacagtgtttgaataattgaggcgtcagacttcagggttgctccaattcttggagatgtgtctgggtctgtgtctgtttgaagattgcttggaggtctgaaactttgtgatggcgaagatgctgtgttattgtagtctgaatctgtaagtttgggaccaacattctgttattgtagttgacgcatggcta

SEQ ID NO: 10990 - DNA, 794 bp, Sorghum bicolor
  unsure (1)..(794): unsure at all n locations
  Clone ID: SORBI-28MAY03-CLUS64316_1
cgtccttcagccaccgacaatcgcctctttacttgccattatcattggcatggttcctgtcttgaaagattttgtgtttggggctgatgcaccgctctcattcttcactgacagtttggaaatcctagctgctgctgtggttccatcagtgatgttaattctaggaggcatgcttgcggaaggcccaaaagataatgccttgggcatgaggactatcatcggtataattgtggccaggcttttggttctcccatgcattggcattggtgttgtgaccctagcagacaagttgcatctactcgttgagcaaaaccatatgtaccgctttgtgctttccctccagtactccacaccaagtgctatcctgcttggagcaattgccagtctcagaggctatggtgttaaggaagcatccgcccttctattctggcagcatatttgtgcagtgttctctctttccctctacctgattgtatacttcaagttgttttctttcatttgaagacagcgcccatccatccaattctggcatatatacatagcaatcatttcgggacggcggtggctcagaaataggatactagaagaatgggtttttggtcatgtcccctatcagtcagaagtgtttataatttggtagttatttaaatttcagttgcctatattgtttgcgaacaagagatacagttattttttctgttcatttcagtcaatatattgatgtgcatttcatgatactattgttgtatgcaaatcattacctggataaaattagtagaacanagatagtagtg

SEQ ID NO: 10991 - DNA, 1064 bp, Sorghum bicolor
  Clone ID: SORBI-28MAY03-CLUS6439_1
ctactgggtgctagcctccttttcccttcccccttgaatcgaactgttgggagctcttcgctgtcctaccattcccccctcgctcttttttagcattttgcttgggctctcgactcctccgaaaatccagccttttgtttgcttttctgtctcctgctgattggtgtccccggatccaggattcttgatttgctcctcgggggttggggccatggcgactgctgcgctggcaatggcagagcaggtggtggccgacctccgagcgaagtgtgaggcgccgccgccgatgctgcgcgaggtggcggcggagatggcccgcgagatgggcgcgggactggagaaggaaggcgggagcagggtcaagatgctcctctcctacgttgataagctccccacagggggagaagagggattattctatggattggacctaggagggacgaacttccgcgtcttgaaagtggaactgggtgggaatgagaagcacgtcgtggaccgtgactccagagaagtcattattcctccacatttgatgtcagggagctcctcggagctttttggtttcattgcttctgaattggccaagtttgttgttgatgatgagaagttcatcaatgttttgaatggaaagaagcgagaactagggttcacattttcattcccagtgaagcagcgttctgttgcttccggtacgcttgtcaagtggacaaaggcattttccattaatgatgctgttggtgaagatgtggtggctaaactgcaaacagctatggagaagcaaggtctggacatgcatgtagctgcattgattaatgatgctgttgggactctggctggagcaaggtactacgacaaagatgttgtcgctggtgtaatatttggcactggcacaaatgcagcatatgttgagaaggcaaatgctattccaaaatgggagggtgagctgcccaattcaggagatatggtcatcaacatggaatggggtaacttctgctcagcctatctcccaatcactgaatatgaccaagaattagataaggagagcttaaatccaggagaacaga

SEQ ID NO: 10992 - DNA, 632 bp, Sorghum bicolor
  Clone ID: SORBI-28MAY03-CLUS64644_1
gtcaagaatgggaaggcaccggatttcctgatgtgcgttggcaatgacagatctgatgaggacatgtttgaatgcatcaacggtatgacctccaatgatgccatatcacccacagccccagaggtgtttgcctgttcagttggtcagaagcccagcaaagcaaagtattacgtggacgaccccagtgaagtaatcagattgctcaagaatgtaacccgcgtctcatcgcagcgggaggacgtcaatgccagccatggtcgtgtgaccttcagggacgtactcgactacgtggactagccccccccagttagttacctgaaattattagctgcgaagcatgtaaattcccctgtcttttgtctctcaatggttcattctaggagggtgtgttaatgcagaattctagtgtagccagcatgaatcgtccccattacatgaacagcggaaatgtgagctgaagttcgctgtttcgatgttcaggtgatgtgtgtgtgtacccgtgtaggcaattttggttgggaaggggaagctgttgcttggggttcgcagtgtgaaagcgagcctcttattgccagtaaattggttgtctgaatctattctcctgctgctatattgatgattgtgttggttct

SEQ ID NO: 10993 - DNA, 927 bp, Sorghum bicolor
  Clone ID: SORBI-28MAY03-CLUS64747_1
gctcgagccccccgcgtcaggcgtcgccgcgagctctctctcccggcagctgggcaaccgccgccgcccaactcgaggtgcccaggtcttcgccagcggcgagcatccaccaggcctgtgtgctggtctccgcgggtgtcgttgcaggacaagatggtttccttcgagatgaatgacctcaagaagattgggcttggcctgacaggctttggaatattcttctcctttctgggaatcgttttcttctttgacaaggggctcatcgcaatgggcaatattcttttcctgtcaggtttgggtttgacaattggtctgaaatcaactatgcagttcttcaccaagccaaagaattacaagggtactatctcatttggtgctggcttttttctggttctcattgggtggccgttttttggcatgctcttagaggcatatggctttattgtactcttcagtgggttttggccaacacttgctgtgttcttgcagaggattcctatcattggctggatttttcaacaaccatttgtgacatcgttccttgaccgctacagaggaaaacgtgttccggtctagcaaccttttgctctatatatgcttacttgcggtgtagcaactagcaacctgtgtttttttacgacagtagcaaactggttataccggtgtctgatctttcatgtttatatatgttatgtttagttcccaataggattgttccttgtaaattacagccccaaactggccaaaccaaagctccattcctttgagaccaggatgaaggctcacccatgaattggatctgttgatgaaactcttcagcttgtcgagagcattgtctcttaaagaaaaaggttattgttcttttataggataataagctatatatttcgtgtggactgaatagaacacacaattgcggttcatgcg

SEQ ID NO: 10994 - DNA, 761 bp, Sorghum bicolor
  Clone ID: SORBI-28MAY03-CLUS67723_1
aatattggctggtgctggtcctcaacgctcccgtgttcttgctactctgtacaaggatgaaagatgctcgaagttgaagatatacccaatactgcagaaggtttatcttgaaaggattttgaggaaaccagaaattgatgcttttgcagaggagctgaggccgcatcaaaaagctttattaccagataggtcgactgtgcttgaccgagcaatgatcgagcataatctccttagtgccagtaaactgtacacaaatatcagctttgatgagcttgggacattactggggattgatccaaggaaggctgagaagatagcatcccggatgatttatgaggataggatgcggggttccattgatcaggttgaggctgtgatacattttgatgatgacacggaagagctacagcaatgggatcaacagattgctggactatgtcaagccctgaacgacatccttgacagcatgtcaagcaagggaatagctattccggtgtgaataaatctctcgtcctgttggtagaactgtttcatgcctccagaatccagaatcaacattttgtatagtttgctgctgcaaatgcgtatcttgtgattttggaacctgttataatacaaacgtctaatgcaaaattgggggaggatgcttgcttaagtaacactcaccaggttgtcatcgggttaaatttgtgaatactgcgtctctggacaaacaattatggaaactttaaccattatctgaaatcggatgcctagtctta

SEQ ID NO: 10995 - DNA, 610 bp, Sorghum bicolor
  Clone ID: SORBI-28MAY03-CLUS6774_1
cgcggttccgttcgaggcttcgagcccggcggcgccctcggaggctcaaactgcccgatttcgttcgttcccaaaccccagtttccaatccctagatccctctcaccggcgacgcatttgtcggctgcgctgaggctcaaactgtcagatttcgttcgttcccaaaccccagtttccaatccctagatccctctcaccggcgacgcgtttgtcggctgcgcttgagatggatcgcgacacgccggtgccgaggaggaggagaacggagagcagacatgccggggagccctcttcggctgtggcggtggagacgacgaacggcaagagcaagacaacatggttgtgggaggcgggcgggagactagtggagacccagtccgtcactgccgagcagacgagcgcgaccatcacagaagaggcggaggacgaggagtggacagatgatgccctccccctcatcgcgagcagccgtcctctccctcatagatgccccagtttccccaagggtcgaagccggcaagacatcgcagagtggcacgaggctactagagtggcttacgagaaggctgccaacgatcctgtctccaatcctcctatcttgagggagaca

SEQ ID NO: 10996 - DNA, 950 bp, Sorghum bicolor
  Clone ID: SORBI-28MAY03-CLUS68064_1
cacgtgccggatcagcagccgcaggggtcgccctacaggatgccgtcccagatgaccgcgcctcaggccgccacggtgttctacaatccccaccagtacgggtactggtacccacctgattatccataccaacaggcattgtacaattctcaagtgctacaacattactaccctcagatgtatggtccagcctctccttcaggaccaccctaccaatacatggggtatatgcctggtggcccaagtccaaggactggattctcgccgatgcagcaacccatgcgaccaccgttctttcagcagccaccggcacagatggatggttctttcccaccagggccttcgcttccgcctaatttcagactccagctgcctcctcatgcagtctcaagggaatctgatgatgtatctggctctcagtcagctcagccaacttcttcaactccagctacaatcacaaacaaccaagaagattcgaggcctgtagtgtcagattctgatccaaacacaccaaattgactttctgagaatcctggcaacatgatctgatgccaatctgatgcagacaattggtggtctgtaacagagtccatgatactctcacatcttgactgaaaaagttcccaaagatttgttctttcattatttctaattcttttttgaattcttgcattgcatttcttcatagaatccattgtacggccgactgaattcaagttcaaaattcaggaattcgctagcgtaagttccggtggcatgttagtgttcaaaaaaagtactgccgtcttgttagttcgtatctcaatatgcagtacagtttttcattgaggagccacagccacctagtattattgcaacaataaagttctttcccttgatctagagacgcaccaatttctactgctgttttattacccacagaagaataaaatgatttgcagttcattcgt

SEQ ID NO: 10997 - DNA, 633 bp, Sorghum bicolor
  Clone ID: SORBI-28MAY03-CLUS6780_1
gccccgcgcatcactccaccgctctgaccgacaccgcccatccccatcgccgccgcccggcctcgccatcgcgccggccgcgcctggtccgccgcgcgcgtcctgcccggtccgccgtgcccgcccgaagcgctgcgcccgcctgtccgccgagaagagccacgcccgccagtctgccgagaagagacgcaactgcctggtccgcccgaagcgtcgcgccgccggcctgcaggtccgcccgaagcgccgcgtcggccgcctgcaggtccgccaggaggaaccgccccgttcagcgtcgccaggttcagcgtcgcgagccgtgctacttgggacgatctccgcaacaagcttggggtgctggtgggcccgatctcgagctttgctgacctcgccgcgtcccgcctcgctgttacgtcgtccatggcgcctcctaccgtggccacggcgtcaccagctcctattcctccacaggatgtgccttcgaaggttttggtagcagcctcgagtaagcctgtcaccatctccattcatgctcagatggtgttcgctgaaatgcctgctgaccgaggcgctgtgctgttcgctcgggttgttgcgacgatggctcataccagcatgtcttcgtctgtgtcg

SEQ ID NO: 10998 - DNA, 498 bp, Sorghum bicolor
  unsure (1)..(498): unsure at all n locations
  Clone ID: LIB3476-024-P1-K1-D7
caccgctccgaccgacaccgcccatccccatcaccgccacccggcctcgccatcgcgccggccgcgcctggtccgccgcgcgcgtcctgcccggtccgccgtgtccgcccgaagcgctgcgcccgcctgtccgccgagaagagccacacccgccagtctgcctagaagagacgcgactgcctggtccgcccgaagcgtcgcgccgccggcctgcaggtccgcccgaagcgccgcgtcggccgcctgtaggtccgccaggaggaaccgccccgccgcttccagagatgaataccaggctcaaggcatttgtttttgctgctgctgcacattggttgttgtgtgtcatggcaattgttgctcggcctaggaaaagaaaacgggttgcaagaaagggaggggattacttatgcaccaatatatgaaagggataggaagagaatggaatacctcgatgacaaaatctggaggaataacacaacttgnttaaacatgctgaga

SEQ ID NO: 10999 - DNA, 646 bp, Sorghum bicolor
  Clone ID: SORBI-28MAY03-CLUS68137_1
catgcagcagctgtcatcccacacccgaaccccctcttccagcgcagcgcacagccaactctccaccctcttttgctcgcctgccgtcgtcgtctcccctccctctttctctcttaacatatccatccatccctcctgctccatctctactgagttccgagggggagggacctggaggttatggatgtagtggagaagtatactaggaaacccaaggggagggaggagcaaccgcaaggagggcaggtctttctacgacccaagacgcggctaggccgaaaccactaggaaagagtccgggtctagtttgctgctcgtcccgcccgcaagcatcgatcgcgcggaaccagcagcctaagcccagagccctccgcgcgcctccgcaccgcaccaaagtggaggggggagacgaggcgcagacagcaaatacgtgcggcgcgccgatggcggcttcgtcctcgtcctctggccccggtgggtccccggcccacgcgcctccgggcggcggcggcgggagcggggggccgcataaccaccggtcgcggctccgccacccctccctggcgtacggcgtcgtgggcgggttggcgtgggagacgccgtccgaggggctgcgccagcacttcgaagtttacggcgagatact

SEQ ID NO: 11000 - DNA, 679 bp, Sorghum bicolor
  Clone ID: SORBI-28MAY03-CLUS679_1
cccacgcgtccgcctgaactcctgaagcaatggccatgagggctcttccgctgaccccttccaagacctcctcgtttggagctcaccaaatcaggccgagcagtggcaacctcagatcagttagagcttatgcaaagggaaatgaggaggagggcaacaagcagtccctattcggaagcatcaccgaggcgctggacttctcgcaagtccggtcggagaaggatgccgagctgctgtatgaggccagggagtccaccaaaggtggagggaggatgacgagggaacagtacggagcactgaggcggaagattggtggcacctaccaggatttcttcaagtcatatgttgatgtcgatgggcaatacgtggaggaaggttgggtcgataagacctgcaagatctgcaagaaggacacaaggggggagccaagacaggttgacaaactaggaagatatgctcatgtggcatgcttggagaacccaaaaccgatgaacttctttgccaaaatcttcgccagatgaactatgtaattgtttcactcatggttagatgcaataggtagcgttctggcttcaaagggccaaagtttcgttgtgcacatttttttttccaaatgaattggtatatactgagaatcagcgcattccatagttcacaatttcttcagtgtattcaagta

SEQ ID NO: 11001 - DNA, 387 bp, Sorghum bicolor
  Clone ID: LIB3478-042-P1-K1-B9
gaagcaatggccatgagggctcttccgctgaccccttccaagacctcctcgtttggagctcaccaaatcaggccgagcagtggcaacggcagatcagttagagcttatgcaaagggaaatgaggaggatggcaacaagcagtccctattcggaagcatcaccgaggcgctggacttctcgcaagtccggtcggagaaggatgccgagctgctgtatgaggccagggagtccaccaaaggtggagggaggatgacgagggaacaggtatggaactggaaccactgatgcaaagcaactggggattgataatgttaccatcagtaatctgaatgtcttttcacatgcttgtttgattggcgatgaagtacggagcactgaggcggaaga

SEQ ID NO: 11002 - DNA, 666 bp, Sorghum bicolor
  Clone ID: SORBI-28MAY03-CLUS65717_1
ccgcgggggcggcggctgcagctacgcggggacgtacagcgagaccaagtgccagaccggctgcggcgacgtctcgcagaggtactaccatgtcccgcgctcctggctcaaccccagcggcaacctgctggtggtgctcgaggagttcggcggcgacctgtccggcgtcaagctcgtcaccaggacgacatgattgattttggaaatggagatcaggttgtgaataattaatttgcttgctgggaagagaattagagaagggagaggagggcacacgcacacacacatgacaccaaattctttcttgctcatatggtatctatagatacggcgtacatacggacacaattcgtgctcacaatacgtacgtacaaaaaagattagtactagtattgtctactggagtctggagatcaatctgttcttggagttggccgtcgtccggcacggctgcaggaactgcagctcacggccggccggtatacaagtcgctgttgaatggtggtagtagtatgattttgctctgcagtctgtccacatagacttcattttcttagtagaaatttgcaacaatgagctgcaaaggaggttatttattcctaccatgtatgtatgatatcttattgtgtgaattaatgtcacaaagagaaataatgttctttcccc

SEQ ID NO: 11003 - DNA, 693 bp, Sorghum bicolor
  Clone ID: SORBI-28MAY03-CLUS66216_1
ttggcctcaatggagctgaaatagtgttcaacccatctgcgactgttggtgaactcagtgaaccaatgtggcccattgaggcaaggaacgccgcaattgcaaacagctactttgttggatcaattaaccgggttggcacagaagtgttcccaaatccattcacatctggtgatgggaaacctcaacatgcagacttcggccatttctatggatctagccatttctcagcacctgatgcctcttgcaccccgtcactatcacgctatcgagatggcttgatcatctccgatatggacctcaacctatgccgccagatcaaagacaagtgggccttccgcatgactgctcgttatgagatgtatgcttccttgctctcagagtacttgaaaccagatttcaaacctcaagtcattgttgatcccttgattaataagaaggcataaaactgaggtatgctggatacttgggcttaaaaggaggccactttgtgctttgacttgaacaggaaaggtttaccatttagcagaataatgcctatgttgaaggtgcaaattagaggaagtttcttttttttcctcatcctgtaaaaatgtgtttggtgtagtttgagctacttttactcaatagtcgaaacaataatgcttgttttgttttcattgtataatttgcaagggatttttctgtgaagccatc

SEQ ID NO: 11004 - DNA, 651 bp, Sorghum bicolor
  Clone ID: SORBI-28MAY03-CLUS66338_1
actagaaattgtaagatgcttcaggtgcttcctgtttagtagctattaaatggtatgtttttttcaagtttatgctcaatctatcttttataaaacaacgaatccacaatgtgttcatacttcagtagttgcattgtgggagcactccagtggatagaaatttgttacttattgttctagtatgcttttccttgtttattactctctgtattttgtgttatttgtgataaacgggctttgtgaggaaaggatcaataagaaggaccagtcgtgctgaaaagatttgctttgtcttgcctacctgccgaagtaaagatagaggacaaatggtggcaaacatcagtaaaagcacatcacttgacggagctgaacctgaccatcacagaaaaagtggagtaaaagagcaacctgttgagtgccaaaatgagatcgcgctaaatcaggacagaacatgtagagctagaaaatactgcaaaccaagtgggagaagacccaagttcgaagttttaactgcaatagctatatttcatagtttgtttagtatctttaggaaagattttgaataagatatggttttttatgtctctaatagaatttcagttgccattgtctgtcctggagtagtgctataaataaatttgttgattcaaa

SEQ ID NO: 11005 - DNA, 1095 bp, Sorghum bicolor
  Clone ID: SORBI-28MAY03-CLUS6604_1
tcccgcgacctcctctccttcacggacgcagcaacaaggaggcggctgctcctctccaccaccaccaccaccattgccgccgccatggccgctcctgcttcctcctgcaaggtcatcgattcccacctccacgtctgggccacgccacagcaggccaaggaggagtacccctacttcccaggccaggaacccacgctccgtggcgacgacgaattcttgctcgagtgtatgagtgaagctggagtggacggggctctcattgttcaacctattaatcatatgtttgatcattctttggtaactagtacgttgaagaaatatccatccaagttcattgcttgctgtcttgcgaatcctgcagacgatgggagtgggattaaacagcttgaacacctgattgtacaagaaatatactaagctctgacattaagcacaaacttatcgcctgctggtcaaaagatgaaaaatgacgtcggccgggcattattttcgaaggcaggagaacttggagcgccagttgcaatactgacaatgaagggaattggtccatatattcaagaaatagaggagctctgtagggattatcctgcaactactgttattcttgatcatatgtctttctgcaagccaccaacgaacgatgaagaagagaaggcactctcttcatttctaaacttatctagattcccacaggtttatgtcaaatacagtgctcttttccgcatcacaagagaggcatatccatatgaagacactgctcagcttctttcccgtgcgatatctcactatggagccaatcgaataatgtggggaagtgactttccctatgttgttcctgaatgtggctacaaaggagcaagggaggcaatttctcttgtcgcaggcaagatacctgtttccctgtcagatttggattggatcttggggaaaacggtgagccaactattccaaggtgcatgggttactccatgatcactgtagctggtaggacattgtattccaaatcaactatatcaaggggaatatttgtcctattttccagtgtttacatatactctctccgcttcaaataaaatgtgttttaatattttctag

SEQ ID NO: 11006 - DNA, 657 bp, Sorghum bicolor
  Clone ID: SORBI-28MAY03-CLUS68572_1
tggcagtgctcaagaagcggtggttcctgacggagaagaggaggacggaggattgggaggcccgtgagaggttctcgtcgacggagctcgcggagaagtccgggagcatcgacgaggtggcggtgcagctgacgccggaggagctggacatgtacattgacctccacccgttcaccaacaccacgccgtacaccgtagtggagaccatgtcggtggccaaggccgtggtgctcttccgcacctgcgccctccggcacatgctcatcatcccaaagttccaaggccctgagatagctccaattgttgggattctaacaaggcaggacctgagggcacacaacatccttggtgcatttcctcatctggcaaacaaaaggaaagtacactaaggtctgcacagccatttttggtaatttaatgttctctgcatccaaacaaaaaggtccagctgcttcaagttctgtcatattccttcccccccatgttctatttttttctttaagtagattgagggttaattgcttatcctctgagattgtgtgaataatagcttcccatgtaaaatcacacctgcacttttctgctcgcaatttgaatgttgtaatcaaaaggggcaaacacctgtgatgcaatatagatttttttttggagacgttc

SEQ ID NO: 11007 - DNA, 740 bp, Sorghum bicolor
  Clone ID: SORBI-28MAY03-CLUS69281_1
cgagctccccatcgcgttggacacaggcagggcgggggtggccgttggtcgcccctggctggtctcaccgaaaggtcatacagatgcatgcagtttggtgatcgtatccctgatctcaccaagtgcgctgtccacggttggcgctctccgagcgcaccgagcgcgcttgcccgtccccgatcccaccaataggtcatacacgagcactatgccagtgccgccgcacgtcgagcgccacggcggccgccgcctcttggtgggcgcttggggggggccctctggggggtactgggggggtggccgtctgggcatggcggggtgcgtggccggggccgcgcggcggggtgcatggcttctgtctccctgagtggcgtgtggtcgcgtacgtctgtgtttgccggggagcgtggtggcccgggagtgccggcatggaaagtttcgcgggcgggcctgcagggcgcgtggggcggctgccgggtgacaccgcatcgggtggcgccccggtcactcctcttcctttggcgctccttacttgtggctgcctcctgcgcctggtcattgtatcggcgcggttccttccgctggccctgccgccggctccggctgcgaatggcctgccgagcaagccttgatgtcgctggcctgccgagcaggcttgatgttgcttggaaattacatatttactctaatcaaatcatatatatttaagcatataataatgattgcacttgaaagtagag

SEQ ID NO: 11008 - DNA, 644 bp, Sorghum bicolor
  Clone ID: SORBI-28MAY03-CLUS69344_1
ctcccccagctgcagctccgaccaagctagctgccttcatctatcgagtcaccggtcacatcacagctgatatcgaggcgacgcgccggtcgccggcgaggtgctccatccagctcccaccaaaaaccactaatagccatggcgcggctcctcctcctcctcggggccgccatggtgctcttggcgtccgcggccacggcgcaggactgcctgtccgcgacgttcagcggcgggcggaccttcggcaagtgcaacagcatgccgacgctcagcgccagcctgcactggacgtaccacccggagaacggcaccgcggacgtggcgttccgcgcgccgtcggacaccagcggctgggtcggctggggcatcaaccccactagcggcaacagcatggtcggcagcagcgtcttcatcgcgtcgcaggacagcagcggcgtggtgtccgtcctcatgacctacctggagaccaccagccaacccgcactaaccaacaacaccttcaagttcaacgtgcccgtcggccccgccgccgagtactccgacggcgcctacaccatctacgccaccgtagagcttcccgggaactccacgcagcagtacacggtgtggcaggccggccctaccagcaacggtgccatcgccca

SEQ ID NO: 11009 - DNA, 658 bp, Sorghum bicolor
  Clone ID: SORBI-28MAY03-CLUS6889_1
ccattttctagtacagctgtgcaggaccactggaaaacttctcaagggtggggagcctgatctaacagctgcacccgtgggggtaccccatgacggccgggggggcagcgtcccctctgctgctcccccgccaccccttgctggggttggtgcgtctcagcgggccgtgcctgttccctgccccgaggagcacggtgcaggcagcgacaggactgctgctgccatgaaagccattgcaggaataatttcgtcacagcagaacatgaatgtaccctgccacaaggaacacaatgcagacaacgaagacactgcgagtgaagataacgaagacattgagagtgcagacaacgatgagcatgcagagcaatctgagtaatctttgggtacagatgtggattagagctaatatgtccatgataatgtgtttgtcagcccaggtattgtgtacctacttttaccggtgtgccaggaaaagaaagtttcatgttgatttgaggagcaactgggttcttttttgtaactgtcgtacctgaatctttgtaatagggtagagcagttttgctaggtaactggttgtatcaggatgtttatctgtactgtctactacaaatacagtcacaaaaatttcacttaaagtcaagttgtccctaatttttgt

SEQ ID NO: 11010 - DNA, 339 bp, Sorghum bicolor
  Clone ID: LIB3476-025-P1-K1-G11
cagacaacgatgagcatgcagagcaatctgagtaatctttatgagcatgcagagcaatctgagtaatctttgggtacagatgtggattagagctaatatgtccatgataatgagtttgtcagcccaggtattgtgtacctacttttaccggtgtgccaggaaaagaaagtttcatgttgatttgaggagcaactgggttcttttttgtaactgtcgtacctgaatctttgtaatagggtagagcagttttgctaggtaactggttgtatcaagatgtttatctgtactgtctactacaaatacagtcacaaaaatttcacttaaagtcaagttgtccct

SEQ ID NO: 11011 - DNA, 846 bp, Sorghum bicolor
  Clone ID: SORBI-28MAY03-CLUS6968_1
cggcccggtcccagtccgctccctgtcgcccgccattcgcctctcgcttccatttccgattcgattcgggagccagaggagaggcaaggtagtgatgccgctggctgagccgccccagtggcgccgcaaggccacagatttcttctccacatccagtgtcaagctgaagcaggcagggcaatcggctggggataatatagctgatgttgctgggaaggttgggtccgtggtgaagagtcggtgggctgtcttccaggaggctaggcagcagcagcaacatccaccacacgagacagtgcaagtgcgtatcatcactgctgctgcctccactggtttgcttttcaggaaaggcatttcagagacaaaggagaaggttgcagtgggaaaggtcaaagttgaagaggctgctaaaaaagctgcagataaaagcaagagtatcttgaacaatattgaacgctggcagaagggagtcgcaagcactgatgtgtttggtgttcctattgaagccactgtacaacgagagcaatctggtaaagctgtgcccttggtgctagtgagatgtgctgactacctggttatatcaggtttgaataatgagtacttattcaaatcagaaggcgacaaaaaagttcttcagcagttagtttctctttacaatgaagactctggtgcatctttacctgaaggtgtaaatcctattgatgtaggtgcactggtgaagtgctaccttgccagtattcctgagccgcttactacattttcgctttatgatgaacttcgagctgcgagggttagcattcctgatcttaggaacatattgaagaagctttcaaatgtgaactacat

SEQ ID NO: 11012 - DNA, 1413 bp, Sorghum bicolor
  Clone ID: SORBI-28MAY03-CLUS6979_1
gcggcagcgacagcaaagcgagcacccatctcaagtactgtcttggttgagcaagcacaagcaccagcaccagcaccagcaccaggcaggaggaaggagaggatggaggtggcgggggctcaggcccgcgcggttcccctcctgctccgccaccccgcgtccctgcggagctccgtatccgtctcctgcacgggctcccgccggagctgggcggcggcggcaacggcagagggggacgagacccgcggcttcgacaaggtgcccatggacacccccggcgcgtaccgcctgtggaccgggccaccggtcgcagcgtcatcgtatggggcggcaccgacgacggcgacgaggccgccattccgtccccggcggtgctctccaggaccaggaccaccgaccgcgcacgaggtacaggtgttgggggaggtacaggcatcgggaatttcggcagattgaaggcacagaaaataaaatccttggtcacgaggtcagctcaccgcaagagggagagttctagtcgctcaagcactaaccggtctggtgaatcttctttcgatggctctggtgatgaagaggaaagctattttgagagaagaaagcctgtctcagactcagaacaccgcgcgaagctgagcagtgactacagaaacggaaggactcgaggcgcacattctctgacttctgttttgggccaatacagaggtgctgatgatacgggcttccctgcttcagaggctacttctggttccaaaggatggggtaatgttgccgatgttacttatggacggcagaatcagaagcaaagggagcctctaaatttccctcaaagaaaagggcctctggacagtgggtttttcagtcgcagagcacgaggggagattggctgcagtgacgaaattctagttgtgttgaggaattttgatttccctcgtccgtctcatatccaggctatggcatatggccctatcttggaggggaggagctgtggtattgctgatcaaagtgggtctggcaagacactggcatatctttgcccgatgatacaaaacttaaggagcgaagaagttcaggggctccataaatcatcccctaggaaccccagggtgatagtattgacccctactgctgaacttgcttctcaggtccttaataattgccggttgatatcaaaatctggggttccattcaggtctatggttgcaaccggaggatttcgacagaagacacagttagaaagcctcaaccaagagcttgatgtaattatagcaacaccaggccgattcttgtatctgcttcaggaaggctttgtgcaattagctaacctcagatgtgttgtgttggatgaagtggacattttatttggcgaagaaggttttgagcaagtgcttcatcagttgattactgttgcaccag

SEQ ID NO: 11013 - DNA, 967 bp, Sorghum bicolor
  Clone ID: SORBI-28MAY03-CLUS6689_1
gcacgaggcatcgatccgctcttctcagtcttcagctttaggtccccagcggcggcgaggcgatggcggcgccggtgacggtgtacgggccggtgatctcaccggcggtggcccgcgtggcggcctgcctcctggagaaggacgtgccgttccagatcgagccggtggacatgtccaagggcgagcacaagtcgccgtccttcctcaagctccagcccttcggccaggtccctgccttcaaggaccacctcacaaccgtctttgagtcaagggctatttgccgttacatatgtgatcagtatgcggaccgtggtaaccaggcgctctttggcaagaaagaagatggtgcggttggccgtgctgccattgaacaatggatagagtctgaaggccagagctttaacccaccgagcctggctattatcttccagcttgcatttgcaccaatgatgggccgggccactgacctggctgtggttgagcagaatgaagccaaactcgctaaggtgcttgatgtgtatgaccaacggctgggggagagccagtactttgctggtgatgatttctccctggccgaccttgtgcacttgcccaatgcggatttccttgtgaacaggactaacaaggctggcttgatcaccgaaagaaagaatctggctagatggtgggatgatgtctcggctcgtcctgcatggaaaaaggttactgagatgcagagcacaccgaggtcctcttagagccttttttccttctttgagcagcttctgatggcaattagttgcattctccttgttttgtcatcaagtccttgtttgtaccttttcatgttctcttatcggtcttattggtcttaactcttgatctatgtatcgttggatctgttcttctggtcctttagtttatacatgtatctacaattattcatatggtatgccatccagataatgaagtagcctgattctgtcgc

SEQ ID NO: 11014 - DNA, 1369 bp, Sorghum bicolor
  Clone ID: SORBI-28MAY03-CLUS67155_1
aaccgcactttccccagctagcatctcggcagagttcccccagtccagcaaatcagcaatggccgcagcagctgatccggcggcgtgtgttcttctgccgccgcggcggcgcacgatgaagctgggctcacaggggctggaggtctcggcgcagggcctgggctgcatgggcatgtcggcggcgtacggcgagcgcaagcccgacgccgaaatggtggcgctcctccgccacgccatcgcggctggggtcaccttcctcgacacctccgacgtctacggcccgcacaccaacgaggtcctcatcggcgaggcgctgcggcatggcgcgcgggagaaggtgcagctggccaccaagttcggcatcacgccggagctcaggacggtccgcggcgacccggcgtacgtgcgggcggcgtgcgaggccagcctccggcggctcggcgtcgactgcatcgacctctactaccagcatcgcatcgacaccaccgtgcctgtcgaggtcacgattggcgagctcaagaagttggttgaagaaggcaagataaaatacattggactgtcggaagcgtcggcgtcaacgattagaagagcgcacgctgttcatccaatcactgccgtccagcttgagtggtctctctggacaagagatgctgaacaagatattgtcccaacctgcagagagcttggaattggaattgtggcatatagcccgttaggcagagggttcttctccagtggagccaaacttatcagtgacctgcccgatgacgatttccgcaagaatctaccaagattccagccagagaacatggagaagaacgcgctgatattcgagcgcgtgagccagatggctgcaaggaaaggctgcacatcatcgcagctcgcgttggcctgggttcaccaccaggggagcgatgtctgccccatacctggaaccaccaagatcgccaacttcaaccagaacctaggagcactgtcggtgaagctcacaccagaggagatggccgagctcgagtcctatgctgcaatggacgatggtgtccaaggtgaccgctaccacagcacctttctcaacacctggagagattcagagacgcctccactgtcgtcttggaaaggcaactagatttctgttttcagactagctagcaagtagaggttatcagtgccatatatccaaataaatgttgtaataataaaagtatcgagtgcttgctcccttagtagatatttgaccattgacacatggtagtcaaagctactgatattatttcgaccaatctttggtttattttctgttttttaacatggtcattttaaccatttaaagagacatgggggtgtagttagttttgtgatagatcatgat

SEQ ID NO: 11015 - DNA, 711 bp, Sorghum bicolor
  Clone ID: SORBI-28MAY03-CLUS67201_1
gctactgggggcaagccacacaccacacatcgtcgtgcttgctagctgcacctggcaagcagaatgggcaggtcgtcccgctgcagctgcagcagatcagtggccgccgtgcagctgctggtggccatctcagcggtctgcggcgccgccctctcgtcggccacggtgaccgtgaacgaacccgatatcgcaaacggcctctcctggaggttctacgacgcgtcctgcccgtacgtggaggacatcgtgagctggcacgtcaccgaggcactccgccgcgacatcggcatcgccgccgggctcatccgcatcttcttccacgactgcttcccgcagggctgcgacgcgtccgtgctcctgtcgggtcccaagagcgagcagattgagatacccaaccagacgctgcgtcccgcggcgctgaaactcatcgacgacatccgcgccgacgtccacgccacctgtgggccaaccgtgtcctgcgccgacatcaccacgctagctacccgggacgccgtcgtcgcgtccggcggccccttcttcgacgttcctctggggcgtcgcgacggtctggcgccggcgtcgagcgacctggtgggcaccctgccggcgcccttcttcgacgttccgacgctgatctcggcgttcgagaaccgcggcctgaacaaggcggacctggtggctctctccggcgcgcacaccgtgggccgcggc

SEQ ID NO: 11016 - DNA, 1024 bp, Sorghum bicolor
  Clone ID: SORBI-28MAY03-CLUS67231_1
acgtggctccgagtccgactgagagcaagcgggggatacgagaggcgacttccactcccgtcgcacagtcgccgccggaggccgcgcgcgccgccgtctcgccacgaactgaatcgcgctctgttgatgggcagcttgcgcgccccgccgccgccggcgcagctcgtcggaagcactagggttgccttccgttctgggattcgcttttcctccgacacagtcctcaaatacagaggattaactaccagcggcgcgatgaaatcatatagactatccgagctcagcgacactgaggttagcggcctcaaggctcgtccccgcatcgatttctcgtccatattcggcacggtgaatccaatcgttgaggatgtccgtgtcagaggagatgcagcaggtaggcactacacagaaaagtttgacaaggtcacgctcgatgatgttgttgttcgtgttagcgatcttccagatgcagagcttgatccagctgtgaaggaagccttcgatgttgcatatgacaatatatatgccttccatgtttcacaaaaattacccgagaagacagttgaaaatatgaaaggggtaagatgtaagagaataacaaggtgcattggttctgtcgggctgtatgtcccaggtggcactgcggtcttgccttcgactgcattgatgcttgctgtgcctgcacagattgctggatgcaaaactattgtccttgccacaccacctagccgtgatggtagcatatgcaaggaggtgctatactgtgcaaagaaagcgggtgtgacacacatattgaaagctggaggagctcaggcaatctcagcaatggcatggggaactgcatcgtgcccaaaggttgagaagatttttgggcctggtaaccagtatgtaacagctgccaaaatgattcttcagaacagtgaagctatggtatctatagacatgcctgctggcccttctgaagttttagtcattgctgataaatacgcgaacccagttcatgttgctgctgatctgctatctc

SEQ ID NO: 11017 - DNA, 1027 bp, Sorghum bicolor
  Clone ID: SORBI-28MAY03-CLUS677_1
gcccgccggccgccgccgccgccggcgctccggcctcggcggcccgcgccccggccccgccgggcggcgcgcccgggcgcgcgcccggcggccgcaggcaggaggtcaccggcttcttcggcacgcagaccggcaccgccgaggggttcgccaaggcgcttgctgaggaggcgaaggcaagatatgacaaggcaatcttcaaagttgtggacttggatgattatgcagcagaggatgaggaatatgaggagaagttgaagaaggagaagctagcattgttcttcgtggcaacgtgagacatttattcgctgttgcaccctgtatcttactgaatagtgcaattaaatttggagcggttgccaaggtggtttatgagatcctaacagaacaaggtggaaagcgccttgttccagttggtcttggagacgatgaccaatgcattgaggatgacttcaatgcatggaaagaagctctctggccagagttggatcgattacttcgggatgaaaatgatgcctctacaggcactacatacacagctgctattcctgaataccgggttgaattcatcaaacctgaggaggcagctcatttggagagaaacttcagccttgcaaatggccatgcagtccatgatgcccagcatccttgccaggctaatgtggctgtgcggcgggagctccacacccctgcttctgatcgttcatgcacccatttggagttcgacattgctggaactggtctcacgtatgagactggggaccatgttggtgtatacaccgagaactgccctgaggttgtagaggaggcagagaggttgttgggctactcgccagacacatttttcaccatccatgcagacaaagaggatggtactccactaagtggcagttctcttgctcctccattcccctccccaatcacagtgaggaatgcacttgctagatatgctgaccttctaaattcaccgaagaagacttctctggttgcattagctacttatgcttcagatccggctgaggctgac

SEQ ID NO: 11018 - DNA, 1635 bp, Sorghum bicolor
  Clone ID: SORBI-28MAY03-CLUS72092_1
tttccttcgcctcctcctcctccatcgcggtcgcggccaaggccaacgaaccaatcccccctacggcccacaccttcctcctccccgcgtgccatcctcccatcccggcagggcgtctcctcctccctcctttccatcccgcctctatcgccgcctccatctccaggccgcgtcgaatttctccatccaccgcctccatctccaggaggaggatgctgggcgccgcgaggaggcagcttggatccggtcccatgctgggacaggttttgcgaaggctccgcccagcggcggcggcggctgaggtggcgaggggctactccgccgcggcgaaggagatgaatgtccgtgatgcgttgaactctgcactggatgaagagatgtctgctgatccttcagtttttctgatgggagaagaggttggagagtatcaaggtgcatacaagatttctaagggcttgcttgacaaatatggtcctgatagggttcttgacacacctatcacagaggctggctttactggcattggtgttggtgcagcttatcatggtcttcggcctattatagaatttatgacatttaatttctcgatgcaggctattgatcatatcatcaattcagctgccaagtcaaactatatgtcagctggtcagatatctgttcctattgtttttagaggaccaaacggagctgctgctggagttggtgctcaacactcacagtgttatgcagcttggtatgcacatgtaccaggacttaaggttctcacaccatactcttcagaagatgcccgaggcttgctcaaagctgctattagggatcctgatcctgttatttttctggaaaatgaattgctttatggagaatctttcccagtttctgctgaagtgcttgattctagtttttgcctaccgattgggaaagctaagatagaacgtgaaggtaaagatgttaccattactacctactccaagatggttggctatgctctccaggctgcagagatactgtccaaggaaggaatcagtgctgaggtgatcaaccttcgatcgattagaccacttgacagggctgctattaatgcatctgtcaggaaaaccaaccgattggtgactgttgaagaagggttcccccaacatgggattggtgccgagatatgcatgtctgttgtagaagaaagcttcgagtaccttgatgcaccagttgagaggattgctggagctgatgtacctatgccttatgctgccaaccttgagagaatggctgttccacaggtcgatgacattgtgcgggccgcaaagcgggcctgctacagggcagtaccaatggcagcagctgcctgattggtggacaagcctttctgttttccttccctcggctttcgctctctagccagagacatgtagtattcataaggtgcaggcaaattggccggaccccagactccaagcgagctaattttgtagatctgccatggtgtgctttattccgttagtcgatatttgctgcattctttctagtatcgagtccatttgcttttctatgacttctacacacggccaaataatcttgctaaggtcctgattgaatgcagagtattttttggagtttaggaatggttttgtgaaatacttggtt

SEQ ID NO: 11019 - DNA, 1060 bp, Sorghum bicolor
  unsure (1)..(1060): unsure at all n locations
  Clone ID: SORBI-28MAY03-CLUS722_1
ccgggatacacttttgtaataaagggacttactttgcatgaacacctacgaaatcgccagcgtcgatggagatgaagctatggctgctccactcgtatgacgtctcactgcacgctcatcgtgggcgcattcaccaataaagctatattgtcctggaggaatacgatatgaagccaacacatattatatgtctccatctttacggattgaagacagctatgatatgccgactgatgtgccccctgcagaagatgaaccacactatgaaaattgtctttctatcggactgccgatgcagccatcctcagtggttctcctcctagggaatcgaacaaaacaacatgggggttctcatgtgacacacagcatgcaagttcctctttcctatgctgatgctgtgataggatcagccggtgccagtatcagctacatccgcaggcatagtggagcaactataagtattcaagaaggtgctcctggggagatgacagtggagataacaggaagtgcttcacaagtacagactgctcaacagctaatcaagaacttcatggctgaagcttccccccagggaccaccggctccagctccacccgctcaaccagtggacacaggttacagctcgtatccaccttacggtggagcatcatatggatctcctcctggcgccccagctccagctcctcacaacggcggaagctatggcgcgtacccaccgagctatggatactaatccggagcaggagctggattcagacttagggaaggagggttatgttatgggttcgcttgtctgttcatcttttgagaactcaacctcgttaggacttctgaacttacttttggtgttgtaagctgctttcttatgccacatgccagtgccgattcttctcttgatactctctctgctctatggttgctgagtttatctttaaccctgtatttttaatattcaagagaaaaacaaaaaaaaataattaagaactccnnnnnnnannannnnnannnnaannaaaaaaaaaaaaaaaaaaaaccccaaaaaaaaaaaaaaaggccccta

SEQ ID NO: 11020 - DNA, 972 bp, Sorghum bicolor
  unsure (1)..(972): unsure at all n locations
  Clone ID: SORBI-28MAY03-CLUS7179_1
tgcggcgctcgagccggccggtccggnntnttnnnaaaannnnnnnnatccccatccatatctaccgcacgactgagagggcaaagagagaaggcgccagagacatggcggacctcgtgcgcggcatcgaactgccccaggaggagcagcagcgtcgggagatgagggttcgcgaggcgggtcccttcttacagctgatgaatctcccgctctccggagacgacgacgacgacaacaacaacaacatagagatccgccgcgttctccctaaccgcgaggttctcaagaaaatcgctgatgcgtgcgacctagtcctcctgcttcaggatccgctcctcccatctgttcgccgcctccccaccgacgccacccatctcctcatgatggacgcctgcgccaacaaactggaggagtacgcccgggcggttggcggatccttcaacgtctcctgtacggagtttgcccagcgcatcaactcctacaccgccgatgcccgcggccacccgggctacagcaccgacgactcactgcgcaactccatcgatgatctcctgtgccaggcaagtcgatttctcgacatgacctatacccccgacgaggcggaggcttgagggcgaggcaggcggctactactgacccagatctatgcatggttggtagttcaatcctcatcagaatgttaggatgttagtgtttacttaaaatcttcagatctatgcgcggttggtagttcccaatcttcatcagaatgtgtggttggtatggttatctatcttcagtagtagtagtagagatgcccgagtggtttggtcgaattggttggccagatcttactggtctatggagatggaaaccaaactggtgatggtgttgattgatgcatttcgatctgtttctcaatatgtgaaatgttatcggaaaaaaaaaaaaaaaaaaaaaaaaaaaaaaaaaaaaaaaaaaaaaaaaaaaaaa

SEQ ID NO: 11021 - DNA, 433 bp, Sorghum bicolor
  Clone ID: LIB3476-030-P1-K1-D9
cccacgcgtccggacccacgcgtccgctttcgatggtaggataggggcctaccatggtggtgacgagaggcggaggcttgagggcgaggcaggcggctactactgacccagatctatgcatggttggtagttcaatcctcatcagaatgttaggatgttagtgtttacttaaaatcttcagatctatgcgcggttggtagttcccaatcttcatcagaatgtgtggttggtatggttatctatcttcagtagtagtagtagtagagatgcccgagtggtttggtcgaattggttggccagatcttactggtctatggagatggaaaccaaactggtgatggtgcatttcgatctgtttctcaatatgtgaaatgttatcggaatcgatggttgatttgtctgccttttagggtgaaaatattaaaattaaata

SEQ ID NO: 11022 - DNA, 812 bp, Sorghum bicolor
  Clone ID: SORBI-28MAY03-CLUS72206_1
gttgcattctcgattatcgtggatccccaaatccttgtgcttcagatcggtgacggagccgcttgcttcgcagcaggatcgaccggaaggcgggcagccaggcggcaggtggcggcggcgagagcacgggtggcaccgcctgcacggacgccgtggatctcggcggttcttcgcgggcttgcgcgaagcgcgtgcgcgacgagctccgccgtccgactaccagcgcctgaggcagacagcacggagcggcggcgatgagcggcggcggcgggagccccaacaacacggagtggcgcttcaaccagaccctccggaacgtgcaaggaatgctcaaaggacgcagctttcctgggaaggttttgctaacccggcgatctgagcctctttcccctcctgattattctccaagatttgagagtgagcacgacgaagatgagcgcaaggagggttctcaggagggagaaggtcaagcgtctggaaactcatttgacagtacaagttcaaagaaatcaaatcttctgtcaacaggtagttcaaattcattgccagatgcccaggggctagtttctggggctagagctaccgattctgcaagaattgctaaattcacaacggaactatctaggccagctgttatattagacaaattgcgtgaattatcttggagcggtgtgcccccatatatgcgacctaatgtatggaggcttcttttgggatatgcaccgcctaataaagatagacgagaaggtgttctaacaaggaaaagactagagtacgtggaatgtgtttctcaatactatgatattccagat

SEQ ID NO: 11023 - DNA, 800 bp, Sorghum bicolor
  Clone ID: SORBI-28MAY03-CLUS7271_1
aaggcataaagcaaccgtggctgaatttctctccaacaattatgattggttctttgaagaattcaactctaggttgctgtcatcaaccaactatattacaaaaaggcaagctatcaagttgttgggagatatgctgctggatagatcaaatgctgcagtcatgatgcgctatgttagttccaaagacaacctgatgattcttatgaatctcttaagggattcgagtaaaaatattcaaattgaggcatttcacgtgttcaagctatttgctgcgaataaaaacaaaccgcctgaggtcgtgaacatactagtcaccaatagaagcaaactacttcggttttttgctggattcaagattgacaaagaggacgaacagtttgaagcagacaaggagcaggtcataaaggaaatatcggccctttgagtatgtttgatgttgtaattagtcattatgatgatttttcttttgttaagaaagtgcatgtgaaataatgaacttctgtgtattattttgttgggcttagaggagcaatacattgactcgagttgcgcttggatactgtcagcaaatgtgataatttttaatagattgtgtggttgtccatgcccttttttatgggcgtgtttcaatgacatacaaaatattaaaggatttagaggaaaatatgatatgaaggacataataatatgtaatctcgagcaaacatggccttgtttagatgcgaaatgtttttggaattcgctattgtagcacttttgtttgtttgtgacaaatattattcaatcatggattaactagg

SEQ ID NO: 11024 - DNA, 673 bp, Sorghum bicolor
  Clone ID: SORBI-28MAY03-CLUS72903_1
ggttggttgccgacagtatgggtaagctcagggagaagcacgtcgacgtgcgggagatccggtgcgatgacttcgccgtgagcgccgagctcctggcggggagggtgccggggttgacccgggccttcgccgacgcgctggtggacgtgcttcgccggaagggcttcgtggatgagaaggggttcctgaagaaagacgggaggaaaacactgtggaaggaggcggctaaggaggccaaggtattgcctgaggggttcggtctggagaggcatgtcaccgaggagttcaatgttgcctatgcgtaccatgagttcaccagcctcaagaatactgaaatcttcgaatggtttgaatcccatatgaatcattaggactgatgcccaactggctttcatgccatagtgaaccgagcaaatttgctgattgtttgaagatcaacttttgaccatgatctcaataggagaaagttagagcaagaccttgtgtaagacttctgctcacagcttatagtttacaacttccactcatagttttagtttctggtatgattgtatttctctttactacttgttagtgcaaattacggaaagcaagaaaatgtgttgattacactcattattgttgtacttgtactatttatctttggaaagcaagaaaatgtgttgattcactc

SEQ ID NO: 11025 - DNA, 1487 bp, Sorghum bicolor
  Clone ID: SORBI-28MAY03-CLUS6835_1
tggatttcagactgaaagtcattggtggcgaaatttcttctgtacctggaatttcagatgctcttgaggacactataaaaaatgctattgaagattcaattacatggccagtaaggaaagtcattcctattatacctggagattacagtgatctggaactgaagcctgttggtaccttggaagtcaagcttgtgcaggcaagagatttgacaaacaaagatctgataggaaaatcggatccttttgccattgtatatgtgcgcccattaccagacaaaatgaagagaagtaaaacaattaacaatgatctgaaccctatctggaatgaacactttgagtttactattgaagatgctgatactcagaatgtaaccgtgaagatttatgatgatgatggcattcaagaatctgaattgattggctgtgctcaagtcaggctgaaggatctacaaccaggcaaagtgaaggatgtctggttaaaacttgtaaaagatctggagattcaaagggacaggaaagatcggggtcaggtgcaccttgagctgctctattgtccatttgacatgaaggaagaagcaccaaatccctttcaaccaacagttttcgatgacttcattggagagaacaatgacaagcatggaaaatggatcagggggctctagttttgctaggctgtcttctagaaagaaaagggaaattatcatacgaggagttctttcagtaacagtgatatccggggaggatctgcctgcgatggatatgaatggaaaatctgacccatatgtagtactttctctcaagaagacaaagacaaagtacaagacaagggttgtgaacgaaagcttgaacccagtatggaatcagacttttgattttgtcgttgaagatggcttacatgacatgcttatgctggaagtatatgaccatgacacttttcgtagagattacatggggcggtgcatcctgaccttgacaaaagttttgctggaagaagagtacaaggaaagcttcaacctggagggagcaaagagtgggaagctgaacttgcatctgaagtggtcgccacaaccaatcatgcgtgattcgcgagaagtggacagcttaaggttcagataagtccagtaagtttgcacgcatgggtgcacgtctatttttgggggctgggctggctgctgtccatgatttgatggttctggcttggcctcgagacctgcttggttgagcgtttgtaaattcaggtgcaaattgatccgttgcacatatacatgcggcttcttcaggtgcaaattgttccgttgcacatatatacatgcggctgttatgtttcgatcgtttaagctcgggtatgttaatgtagtcggcggctgggcgcatcgcaatggtttgtccgtatcctctttgtaatgccatattcaaagtagaaaaatgtataaatcaggaatctagtggaaaacaaatttatggcagttgaacggatggttgctcct

SEQ ID NO: 11026 - DNA, 888 bp, Sorghum bicolor
  Clone ID: SORBI-28MAY03-CLUS6837_1
gctgtgttggtcgaggtgggtcttggagcaggttgactggacggcttcggcgagcgacaggctgcctgggcgagcagcggaccgggggtgccccatgcagcgccctgctaagagctgacgcaccgcggtttctaatgtcgtccgccgcccagaacacagccggcacaccaatgcccggcacgcaaggagggcaggcggtggcgttccgcatctccggcgacaaggccttcttcttcggctgcgggttctacggcgcgcaggacacgctgtgcgacgacgccggccggcactacttccgcgactgctacatccagggctcccatcgacttcgtcgttctggcaaccgcccgtctaccctctaccaccgactagcgaggctgcacatcgacggatgccgcggtttcgggtcggtggcggcgcaactggcggtacgaccctcgcgagcgcacgggctgtctgtcagtctgtgcaattcaaattgttccgggaggctctacgtagggcgagccatgggccagtactcgcgcatcgtctacgcctacacctacttcgacagcgtcatcgcgcccggcggatgggatgactgggatcacaccagcaacaagagcatgacggcgttcttcgggatgtacaggaactggggccccggagtcgacgccgtgcacggtgtgtcgtgggcgctggagcttgactactttgccgaccggccctttctaggtatgagcttcgtcaacggataccactggctcacacctgatgtctgaaaaaacacacacacacacacacgcattcgagagtcaggacacagattgattacagcaaaccagattctattcgtacagaacatacacggaacaaaacaccattttaccagcttatatatatgta

SEQ ID NO: 11027 - DNA, 965 bp, Sorghum bicolor
  Clone ID: SORBI-28MAY03-CLUS6839_1
agaagaaatgctgctgcgctgccgtgccgtcctgctcctccccctcccgctccctccgccgcctcgcttgcttcgccgcctgccgcacccgcgcgccctctcgtcctcgtccgggtcctccccactcccgccgccggggatggaggcttcctacaagttcgggccctacaagatcgacgccagggaggtcttccacgccacgcccctctcctacgccatggtcaatctccgcccgctgctccccggtcatgttcttgtgtgccccaagcgtgaagcgaaaagatttgctgatctaagctctgatgagattagtgacttatgggttactgcaaaggaagttggtgcgcgtcttgagcagtaccacaaagcatcttcacttacctttgctatccaggatggtcctcaagctggccaaacagttgcacatgtccacattcacctcatcccaaggaagaaaggggattttgagaaaaatgatgaaatatatgacgcgattgatgtgaaagaaaaagaattgaaggagaagcttgacctggacattgagaggaaagatagaaccatggaagaaatggctcatgaggccaatgagtaccgtgctctattctcctagaattacatggtctaatatagtggttagtttctaagttgagctgactgtttgctagaataaggcttgctactggttcttccttgtcgcagttcagttatgattgcgcactgacaatgtcatggtgtccagttctggtgttatgttctatactgtggagaaataatcatttgttgcaaggaatgcattcctagtgccaaccctttttgatttggaactatttttatgtgtgtactacaaagcttcaactgttttctggaagaattatgtctttactgcagtctttttctttatggaattgtaagagaggatgtaccattagacacaagttacactgacagcagtttatgcagcatta

SEQ ID NO: 11028 - DNA, 566 bp, Sorghum bicolor
  Clone ID: SORBI-28MAY03-CLUS69211_1
gcccgaggcctcggagcgggggagtgggaagcatgaaacagcacaccatgacatctatctcgaagtttctgcttctcctgctgtgcagctatctctgtctcgttgctcacgcagcagaccatcgcacacacaaggttctgtccgttggctctctcaagtctgccgccacctgctccgagcccaaagcgactcctccatcaaccagcggcggcatcacggtgccgttgcaccaccggcacgggccatgctcgcctgtaccctccaacaagatgcccgccagcttggaggagaggctccagcgtgatcagcttcgagccgcctacatcaaacggaagttctctggcgccaagggtggcgacgtcgagcaatcggacgccgcgaccgtgccgaccacgctgggcacctccctgagcacgttggagtacgtgatcaccgttggcatcggctccccggccgtgacccagaccatgtccatggacaccggccgcgacgtgtcgtgggtgcagtgcaaaccgtggccgcggcgccccgccaaggtggactcgctcttcgaccccagcgcgtcg

SEQ ID NO: 11029 - DNA, 1547 bp, Sorghum bicolor
  unsure (1)..(1547): unsure at all n locations
  Clone ID: SORBI-28MAY03-CLUS73625_1
aacgcccaacaaacctgacacgatgtgatttctttaaagctttttagccaacaaacgagccaaggaccgggcaacaacagctgctaatcagccgctgacaccataattactagggggatgctctcttgccttcgtcctccgctgcctcgttcctgctcctccttactctacctgaccagccgggacagagtccacgacgacgacgacctttctttcccccttgtgcctctctccggatcctagctctcttgctcgctcgatcgactccctcgtcgccgagtccagcccccggaaaaaatcagatcgaccgagtcgccgtgaagccaccgcggacagagagcacacagcgagcgagcgcgggcggcatgaagtctatgggcacccgcgacaagctcgcggcggcgtcgggccaccgccgcgtcctcttcgtcgtcttcgcctcctgcttcgccttcgccaccttcctcaccttcctctacaccacctccnacgccccggccgcgcccggctctgcctccgcatccacagcgagctcaaccaccaccacctcctccggctccagcggcggcggtggccaagccgggcttccgctgccggtgttcgaggcgctggtccacttcgcgtcgatctcgaacgcgacgcaccggatgtcggacacggacatccgcgccatctccgcggtcctccgcgcgcgcgcgccctgcaacctgctggtgttcgggctgggcgcggagtcccctctctggctagctctcaaccacggcgggcggacggtggcccggggggagaacgagttctacgtcaagtacctggagccgcgtcacccggggatggaagcctacgacgtgtcctacaccaccaaggtgcgggacttccgtgacctgctggcggcggcgcgggcgtcgcggcggaaggagtgccgccccatccagaacctgctcttctccgagtgccgcctcgccatcaacgacctacccaacgacctctacgacgtgccctgggacatggtcctcatcgacggaccctccgggtggaaccccaactcgcccggccggatgccgtccatcttcaccaccgccgtgctggcgcggtccggcgccacggcagccaagggccgacccaccgacgtgctggtccacgacttccagttcgaggtggagcaggtgctcagcagggagtttctgtgcgacgagaaccgcgtcgccggcagcggcaccccgtcgctcggccacttcgtcatccccggtgccggggccggagctggcgacgccttctgcgccggacaggaggacggcggctcgtcggaggagtcgggggagaagacgcgccgccgccgccgccgccgcaagtaaaatttacttgtcagtcaaaggcattagccgacagccacggagtcgcccttcttggcttggctagctaatcttcaccgctcctcctcactcagctgttaattttttttttgggtatttttttcttgcatatatatatttgttgttttgtttactggggagtaagaaactgtaagaacaaccctggtaatacgattc

SEQ ID NO: 11030 - DNA, 807 bp, Sorghum bicolor
  Clone ID: SORBI-28MAY03-CLUS7422_1
gcacgaggccactttgtgttccacaacgcgagccgcaaggtgcggctgtgccccctccattgatcgaggcggcggtggctcttcaaatccaaggagtacgaggctgcggcggtcaaggtgtggatcgcgcgagggaggcatcgatctgccatccctcccccccgccccgcagcgctcgccacttgccccgcaccactcgctcggccctcccaatcctcgcgcctccacttcgtgttccacaacgcgagccgcaaggtgcggctgtgccccctccattgatcgaggcggcggtggctcttcaaatccaaggagtacgaggctgcggcggtcaaggtgtggatctggtgagggaggcatcgatctgccatctgttcccgaaggcgtgttggatccggtgagggaggacgcattcaggatgaggcagctggagtggcaacgagctcgagcctaggagttggcggcagaagagggtgctcgaccattcctcccctgcatgacgtgcttcattccatggctggagctgcacccgtcaagcaagcacgagcccagcagttagcgccggtcagctctgtcggacgccgaccctctcttgttaatcagtttagcctaatttgcttttcatattccacagcgatacagtgccattgatcttcatgtgcaaagcgatttgtgcaaatctcaacacatgaaaattagctttttgggttagagtacatataatgcaactcatatttcttggtccagtgagcatatatttagcaatgaactccggacatcttgcaagacttcggacttaatttctctgaa

SEQ ID NO: 11031 - DNA, 543 bp, Sorghum bicolor
  Clone ID: SORBI-28MAY03-CLUS74352_1
agcacgaggagccgcggggcatgcatgggcatggcggacaccagcatcttctccctctcgcctcctctgctgcgcctgcgcctgcgcatgagccaccacccccacacatcatcatcatcagctattcctcctgttcctgctgctgcatcatccaccagttccagcccgcggccgcggcggctgctcatcaagcagcagaggagcattattggtaataatcattcatcgccaacccggcaaagatcactattactgtcgtcgtctcgtgcttctgcttctgcttcttcttcttcttcttcttcttcttcttctgtggcgacggcgacggcgacggcgacggcaccggcgcagaacgagaacgagaaagacgtcgtcttcgtggctggcgccaccggcagagttgggtcccgggccgtaagggagctcatcaagcttggcttccgtgtgcgcgctgccgtcaggaacgcacagagggccacgtccctggtgcagagcgtccagcaactgaaactagaggcgcagcctgagctggagcttgtggag

SEQ ID NO: 11032 - DNA, 797 bp, Sorghum bicolor
  unsure (1)..(797): unsure at all n locations
  Clone ID: SORBI-28MAY03-CLUS74510_1
tggtgncggccacgagcctccgacacaggggcggggctacccaccaccataccaaggaggtcatcatgggggcggcggctatggcggaggggcgcaaatggggttgccagtgccagcacctcccggtggagcttatgctacttatggagcataccacaagcatcacggcggatatggtgacggtggctatggcgtatacggtggcggcggctatggcggcggcggaggttacggccatggcaagtacaagcacggacaccagggcaagtttaagcagtattctcaccaccagggcaaatactaacaagcatatgcagcatgatgatgatgggtgagctagtaggtagcaaaagttcggtgccggccggtccggggacccagtcacggcatgatatgtcagagttcaccatagtacgtacgtacgtacgtgtgcatcctgatgcgcatggatgctaatatgactactaaataaagcttgttatggtgtaggcttccctttaaggattgccacatcgatctgcttggcaggagattgaattagcctaatgccttaggcgatggataagtgtatgtatttaactagctactatatatactaccttagcagtgtgatacttgatcaatgtcctacctctatatcttgccatatgaagctttactttgctttctagaatatgcagcacagcaggactgcatacctgtgtatatgtaatatatgtatgtaaaccaatctagcggtttgcttgtaagaccacatgcatcacatcacatgcatggtttgctgaataagcacggag

SEQ ID NO: 11033 - DNA, 1407 bp, Sorghum bicolor
  Clone ID: SORBI-28MAY03-CLUS75063_1
acattctcattcgctgcaagcgcaagcgcggcagtcgagcgagcgagccgagctcgcgatcaccggccgcgcgctcgccatggacccctgcgcgttcgtgcgcctcaccgtggaccagctcctcctcaagctccccgccgtgccgcgccccagctccggcgccggggtgcacccttccaactcgccctgcttctgcacgctcaccctccaggaccacccctcctcctcgctctcccgcaccgcgctgctgccgctcgcgtccgcctccgccgcctcgggacccggcgcggcagcggcgtacgccgaccccgtcgtgctcagcctcgacgccgaggccgtgcggaggctctcggcgcgccccgccgagctggtggtgtccgtgcacgcgggcccgacggggagcagctgcggcgtgagcgcctctcgcgcgctgggccgggtgcgcgttgccatcgacgtggcgcgcgccgcggccggggagaccgtcgtcgcccgagacggctgggttgacgtgggaaagcccgcgtcgtcggcttcttcgtcggccgtctccgtgcgcgcgcagatccacatggtcgtgcgggccgagcccgacccgcggtacgtgttccagttcggcggcgagccggagtgcgggcccgtcgtgtaccaggtgcccggaggagccgccggtggagggcagcagcggcagccggtcttcacctgccggttcagcgccggccggagggcggccaggagcaggttggtatagcttcgcctgccgtttacgtgacacatatatttatgttgtgtgccacttgcaacatcttcatcaatttgcttgctcattcagttatcctttgtcttcgcgctgtcagtaatttgtttgatcgtcgttcatcgtttgaatctgatttcacagctactaagtgcttgtatagttcatagttgcagacatgcactggaccaggactgctagctagacattagggggcaagggtggagcattaactgttggtccaaatgaacagatggatacaattaagtggcttaagagattgatatagaaatccaatagtcaaaagtttaaaactcaaggataaacatataactctaaattggacaaacaaaataagtttacaataatggagtttggtcatcagatagcggatggaaatttataaataagctagtgccagttgccatgagctaaacaaatgaagtgtatatatctgcctgtaactagtttgcataattctattatgtcctttcaaagcatcccccctttcttttctattttgattttgattttttcttccccccttttcatgataggatgccagctcttagatactttgttggttatcataggagtactacaagcattatatatatattggcaaagcctgcgtttaatttatctattcg

SEQ ID NO: 11034 - DNA, 1052 bp, Sorghum bicolor
  Clone ID: SORBI-28MAY03-CLUS7049_1
attaccagccacagttggcagcgcccctgattctttcatccatggtagtgttactgaccaaggaactgtcaatgatttgatggctggtttgaaccttaatggaacaggccaggctcagtctgcagttaaagcagagcccagtagcaacttcagtggttcacagttctttgatacaaacaacgagaccagccatgtggcaagtgctgcagcattgaatggcattcttggtcaaaattcattttaccaacagcagcagactcccttgcagtacaacttccctcaacatatgatgatcaatcaatcatttcctgggcaacaattaaactatggtgccatggggattcttcttgctcagcagcagcagttactgcaaaatcttggaaatttcaatgctggacttgggaattcttctttcaattcgatgcacagtggaaatgcatctgtgcttccagatattttcaattcaagtaatcaacctcaaaatcatgttgcagtgatgagcagttcgaagaaagatgacactaaagcttttgattttgtttcggatcaccttgcagcagcacgtggttcaagaaagtgaaccaggatgcagtgagcatgtccagatgctggcaagagctcaagacctcaagtgcttgatggacacaaaagctgggaattccaaaagctgcatctcgtcacagcctcgcagattggctgcatgattcacacggctggtttggcatgggatcggtgcatgtttgaacagatgagaagggttgttccatacggttggaagacgagatgttgtgttgtactatgtatttagacaaagactggttttttacgctgaaaaataaattgcatcttccaactttccttatgttctgcccttttctctcaccttttttaaagaaaaaaatgcactgtatacatatttgttacctgcaggttttatctttttttttctttggtttctgtacaagtggaggatgattttttgtggcaattgtaaagctttggaacgtgaataagagggtgcaatatgatatgagctgctacatgatccttgc

SEQ ID NO: 11035 - DNA, 935 bp, Sorghum bicolor
  Clone ID: SORBI-28MAY03-CLUS7126_1
gcacgcgcctgccagcctccctcgcctccccttcgctcgccatggccatggcgacctccaccttctccccgcgccccgccaccctcaacaagcccctgcgacctggcgccaagcccgccagcctcctacccttcccgtgccgccgtgccggcagactcgtctgcgccaccgctgccggggaggcgccgcccgtcgaggtcgagcagcgggacgaggcggagccggcccccgccgcggcctccaacggggccgccgtcaaggccgaggcgcccgccccaaaggccgtgcaggctgaggccccgccggcgcccgcgccggtcccggccttccgggacgccaggtgggtcaacggcacctgggacctcacccagttcgacaagggcggcgtcgtcgactgggacgccgtcatcgacgccgaggccaggagaaggaaatggcttgaagattatccagaggccactagcacagacgaggctgtcgtcttcgacacttcaattatcccatggtgggcatggatgaagcgattccaccttcctgaagccgagaagctaaatggtcgcgctgccatggttggcttcttcatggcatactttgtggatagcttgacgggcgtgggccttgttgaccaaatgggcaacttcttctgcaaaacgctgctgtttgttgccgtcgctggtgtactgctaatcaggaaaaatgaggacattgaatcactgaagaagcttatcgacgagactacgttctatgacaagcaatggcaggcaacctggcaagatgattccactgggggaccaaagaattagttcagcattgggatacagatgcagaatcgttcttgtgatgtactttacctctttcttcggcctttttgtttcgccgtctcgtgaggcttggaggaacattttgacaaaccgtaataatctacgtgatcctgt

SEQ ID NO: 11036 - DNA, 776 bp, Sorghum bicolor
  Clone ID: SORBI-28MAY03-CLUS7099_1
tatgatgccaatattggcagcaacgatacagcctaaaagaaggaattcctagtttccttacgaatgttgctgcaatgattctaacaacaggaaagtatcttaatgttatgagagaatgtgggcacaatgttcaggtttccttgtcagacaatactaagcttatgagctttggctcaaaccaccaatatcttgaatgtataaaatctgcatatgattttgcaagtggtgaattgttgactctgatgaaagataagtatgatctcatcgggaaactgcgatccctgaagcgctatctactccttgaccaaggtgactttttggttcattttatggatattgctcgagaggagcttacaaagaaaccagaagaaatatctgctgaaaaacttcagtctctgcttgacattgctttgcggagtactgcagctgcttcagatccaagccatgaggaattaatctgctgcgtggaaagaagttccctccttaagaaactgggcactctgaaagacttggattgtgcttaccctgcagataagcttgctgcagcagatgttgatcagtcaatgcaattaagcattacgggtttggaaacattctgccttagcaataaggtccagtggcctttatctcttgtaatttcaaggaaggctttgacaaaataccaattgatctttcgcctattgttccactgcaagcatgttagtcgccagctgtgtgcagcatggcaaatacaacaagtattccggtctgtcaagattctagggacaccaatttta

SEQ ID NO: 11037 - DNA, 442 bp, Sorghum bicolor
  Clone ID: LIB3476-050-P1-K1-D12
caaggctcccatggacaccgccgtctccaccctcaccgctctcgccatcttcgcgagcaccgtcgagcacgccgtctacaggagcgtgcacgggtacagggtggtcgggaggaaacgcggcgggtgggttcggtgggagaggtgggtggagacttagattgtgcttaccctgtagataagctcgctgctagagatgttgatcagtcaatgcaattaagcattactggtttggaaacattctgccttagcaataaggtccagtggcctttatctcttgtaatttcaaggaaggctttgacaaaataccaattgatctttcgcctattgttccactgcaagcatgttagtcgtcagctgtgtgcagcatggcaaatacaacaagtatgtcgggctgttaagattctagggacaccaattttacggtcattaattctttgttgta

SEQ ID NO: 11038 - DNA, 686 bp, Sorghum bicolor
  Clone ID: SORBI-28MAY03-CLUS71374_1
cgactccatggagctcaccaccaccacacacgggagatagcaagcaagccaagcagagcgacgacttccttagcagctagctagctaactagccatgctgccgtccttcgtgtcgccgacggcgagcgcctcggtgacgcctccgccgcggccgataccaggcagccacgggccgccggtgctgggcccgctgcgggaccgcctggactacttctggttccagagccaggacgagttcttccggaagcgcgcggcggcgcaccgcagcaccgtgttccgcaccaacatcccgcccaccttccccttcttcgtcggcatcgacccgcgcgtcgtcgccatcgtcgacgccgccgccttcaccgcgctcttcgacccggacctcgtcgacaagcgcgacatcctcatcgggccctacaacccgggcaccggcttcaccggcggcacccgcgtcggcgtctacctcgacacccaggaggccgagcacacgcgcatcaagaccttcgccatggacctcctccaccgcagcgcgcgcagctggcccgccgagttccgcgccggcgttggcgccatgctcgacgccgtggacgccgacttcgccgccaacaaggcatcttccgccagctacctcgtcccgctccagcaatgcatcttccgctgccgccgttcctcatctggccgggctacta

SEQ ID NO: 11039 - DNA, 1126 bp, Sorghum bicolor
  Clone ID: SORBI-28MAY03-CLUS7135_1
cggacgcgtgggtcccccgtgacctctctccccttccccaaatccaatcatttgagtcgagccttctgcccctcctccgccgccaggcacaggcagcagagttgccggacgtccccagccaccacagtcctgccgccacctgccatcaccaccgtctctcagccattagcctccgctcctacccaccagacccgtcgtccctgctgccagcacgagatccagcgctcgctgcccccaggcctcggccaccaaaaaggtcgccccaagatcccaagcgcgacgtccgcattctctggatctatcataagattttaaagtttaattcataagtgcagaacaactgttagaatcatagttatcaggttggctttgtccattttgtttgctaacactgctgtagcaacaggagcagctgcaacaagctctggcaattagaatgtcaaaatgtagccaggtagcaaagtccatagtttctgatgtaattgatatatgttcataataagcatataacctgctctggcaatttttgttctgaatactagaactataatggactggacagttaatgcatataacctgctaatatatgtcgctttcggatgcattttgtcaacctgctggttatgcagtaatcatttcgcaccaagaactaattgtgctgctataggaagagggggaggctgcatatgcatatagttatccttctagtatcagcagtggccttcacaattttgaagtttatggcatagattacaaagcaccatggcgtggacctattttccgtctgtcaagtactgtattaaatcctattactctatttggagagcctgtcagtttcaaacatttcttttcaatctggtattgattgctactgcctactaagtcttttttgcttaagttatatatatctttgttttggcagtacacttatatgcatagaatgtgtgctatttttctcccactcaaccgttacagtctttacattggactttcaggatctgagctttttaaagaatgtcagtttgggctgcaatgaggtgagttcttgagcttatagattcagtgaatgaagcttttcgttcacaaaaaaagggaaggaacttttacacttgcaggacatggagaa

SEQ ID NO: 11040 - DNA, 1041 bp, Sorghum bicolor
  Clone ID: SORBI-28MAY03-CLUS7610_1
agatcctggaccgtgcaaaacaaaagatgggtattgatgcaaaagttatccaggctgggttgtttaacacaacttccacagcacaggacagacgagcattgctgcaggagatcctcaggagggggacaagctcgctgggaacagatatccccagtgagcgtgagataaatcgtttggctgcacgaactgatgaagaattctggttgtttgagaagatggatgaagaaaggaggcttagagaaaactacaaatctagacttatggatgggaatgaggttccagattgggtgtttgccaacaatgatttacccaagagaactgtggcagatgaattccagaatataatagttggtgcgaagcgacgtagaaaggaggttgtctattcggactcttttggtgatcagtggatgaaatctgatgagggatttggagacgttccaaaggcaactccaaggccgaagaggactgcttactcatctgacctccaagttgagtttagtgaaaggaggaaaaggcctaggtctgtagaaaacagcgcagatggtgcgagcaacccaacgtggacacctgacaaaggaagggctggagtttcatcatacagcaaggacgagactgaagatgatggtgaagacgaagtcattactagtggcttacagaagggaaacagtttcacatggaatacccttggaagaagaaggtcaagccacttcagctcgacgtcggactccaaagggcgcccatcattctaatatcagcatacatgaatgttatggcctggacctgtttgtttgatggaagtccttcaacactggagttggagtacccctgtagactaggcagcagggctactacgactacgactgagaagtaccttcaagcttatggactttattaggattattactatagtatactgtatggactcgttggcatgagtttgtaactcctttaaatattaatttcgttacacatcaaaccgaaattgggggttgcttatttattggtaaataacccggtggtggttggttacttcaattctgc

SEQ ID NO: 11041 - DNA, 774 bp, Sorghum bicolor
  Clone ID: SORBI-28MAY03-CLUS770_1
gcgcgagggcccgctctagttctccatctcccatcttcaattcctcgcttcctcctcccttctctagttctggggagtgttcgttccgatcctcagcagcaagctcactagctcagcacaccggcgatggcctccaccgccaccttcctgtccaccctcgccaccaggtccgcggcaaccgttagcccgcgcagcgccgccgagccgtccggcgccaagatcgtcaggttcttgcccgcccagatcagccgcacggggcgcgcggcggcggtgctgcccacgccgagggcggcggtctcgggcaccgagaagcaggcgccgtcgagcaagcacgagcgcgtggtcagggtgcacagcacccaggagttcgacgacgcgctcaaggccgccaagaaccggctggtggtggtggagttcgcggcgagcgacagcgagagcagcagccagatctacccgaccatggtgcagctcagccgcacctgcggcgacgtcgacttcctgctcgtcctgggcgacgagtcggaggcaaccaaggagctgttccggcgggagggcatcacgcaggtgccccacttcaacttctacaagggcgccgagaaggtgcacgaggaggaggccatggccatcggccccgagcggctcgccggcgacgtcctctactacggcgacagccactcggcggtggtgcagctgcactcgcgggaggacgtggaggcgctcatcgacgagcaccgcggcgacaagggcaagctcgtcgttctggacgtcggcctc

SEQ ID NO: 11042 - DNA, 1220 bp, Sorghum bicolor
  Clone ID: SORBI-28MAY03-CLUS7704_1
gcgcgaggggggccagaacgaggctcgagttttatgcgtgaatcatacgcttctggatgttagatagaaaatgttgtgacagcacctataacttcttattgatctgaacctgaattttcttattgaagtaaacaacatgatggcttgtattttagacagtcaagttgctattcatgttattttcagcatatgatgcttcctaggttattcatgttaatcaatgtgctttaaggtgtacaaattgtgtatagtattcatattgttttcagcataattaggacagtcaagttgctttcaatgttattttaggacagcacctgcaagtattgagcctgaatgctactaatgcaagcttgcaggcaaaattagtttgtttctatatgaatattaagatccttgtcctaccacttgatgcaatggcacaagataaggaggccaaaaagatggagaagaaaaatgctaaaaagaataccatagaaaaaaactataagaatgtgttaaataaaaaatataaggataagaagaccccaacaacggatgaaactttcatgaaaaatattgtatataaggaggtcctaacgccataaacgaggtattttcaattggcatctgttatattacttgccatgcattttcacggactcttggtgggattacacttactgtgttcgattagatgatgctaccaatgacatatcgtccgtcgtctttggtcagttgctgacaaccatgatcaaatagctgcaagacaaaaaaggcaaacaatttgaagcagttccagacttgacggcgctaggtggagcggaggtgcggactcgcgccggcgtctgtcggccacgtgttgagttctcggcttctcgtgctgacgccacggtccgccgtccacggtccaggaaccaccgtgacactacattgatcaatcagatcagaatacggagaggaggcctaggctagcttccctttcccttcgtgtctggtggtaatcgaggacactgatgaggcccatcaagtggaacggagtccgtcacacattcaggcgtatctagctttctatccctccgccgtacgagtgtataagtatatgtccatttcatgtacgtatcaaatactctatattatttgtttttttggtaaggcggccgccaaggctcaccacatatctacctctgccactgctcaatattttcatgtatataagttcaaaatatatataaataatt

SEQ ID NO: 11043 - DNA, 995 bp, Sorghum bicolor
  Clone ID: SORBI-28MAY03-CLUS7717_1
cgtacgccgactcctcgctgcaggcggcgctgtcgcaggactccctcgccgtcgccggcgacgccgtgaagacctacaccttcgggtgcctgcagaaggccaccggcacggccgcgccgccgcaggggctgctggggctcggccgcggcccgctgtcgttcctgtcgcagaccagggacatgtaccagggcaccttctcgtactgcctcccaagcttcaagtcgctcaacttctccgggacgctccggctcgggcgcaacggccagccgccgcgcatcaagacgacgccgctgctggcgaacccgcaccggtcgtcgctctactacgtgaacatgaccggcatccgcgtgggcaggaaggtggtgcccatcccgccgccggcgctggcgttcgacccggcgacgggggcgggcacagtgctcgactccggcaccatgttcacccggctggtggcgccggcgtacgtggccgtgcgggacgaggtccggcgccgcgtcggcgcacccgtgtcctcgctgggaggcttcgacacgtgcttcaacaccaccgccgtcgcatggccgcccgtgacgctgctgttcgacggcatgcaggtgacgctgccggaggagaacgtggtgatccacagcacgtacgggaccatcagctgcctggccatggccgcggcgcccgacggcgtcaacaccgtgctcaacgtcatcgccagcatgcagcagcagaaccaccgcgtcctcttcgacgtgcccaacgggcgcgttggcttcgcgcgcgagcgctgcaccgccgtttgatttagcttgctgtttgctcgcctgcgcagggcccggattcgaattacgtacgtttatttagtttaacctgcgttctacggttgtgggtgtcatgcacggctgttggtgtgggtgattagtattttagtgatttttgttttccatttttaccggtcagtgtaatctcgatgctctccagaattaccatatgtatttcacttcacg

SEQ ID NO: 11044 - DNA, 649 bp, Sorghum bicolor
  Clone ID: SORBI-28MAY03-CLUS7770_1
tggaccccgagccgagccagtcctgccgtccatccatcatcgtccccgcctgctcctcgtcgcgagcatccaaagctgtacttgcggcaaaagctctcgcaaaatcctactcccaccgccgaccgactcgtaccctcctccgctcctccccaatccgccatcttccttccttccacccttcccttgcttctccgggagggaaggcacccgggaggccgccccgccacccatcgcaaaagccacgcgccaccaaactcttttttcccccctcacggcctcaccccgtcgctttcgcgttcagcgcgagccgagacgagccgagccgacacggtgggtcggtcgctggaggcggagccataaagaaaggcgtcggcgatgatgagcggcagatcgggcgggagggacgccgagggcgagtgggaggtccggcccggcgggatgctggtgcagcgcagggacggcgaggcggccggccccgtcatcaggatcagggtctcccacggcgccagcttccgcgaggtcctcgtccccgcgcaggctaccttcggtgagttgaagagtatccttgctcagactactggcttggagcctgagaggcagaggctcttcttccgtgggaaggagaagagtgacagagagttcctgcaca

SEQ ID NO: 11045 - DNA, 1075 bp, Sorghum bicolor
  Clone ID: SORBI-28MAY03-CLUS7743_1
gaaacctctacacttctgctgaactgccagcaggtttatttcgtgtgagagttcgatcaaagacctacattgtatcagtagatttgaagaagcagctgccattaagtcaactctcagagttacctgtgcctagagaggtcttgcagggtcttgatgttgttgtgcgtgaggcctccagatggcgcaagattatccttggtagaggattttactcaccaagcagcagtgtagacattgggcagggtgctgtagctatgaaaggaacccagcagacccttaaatacactcagcaagggctgatcctatgtgttgactattcagttatgccattttacaaagctgggccggtgatggatattgttcagaaattagtaccccaccttgattaccggacaacactgaacaggaggcaactggaaaatctgattgaggagctcaaaggccgacgtgtgactgtggttcatcggaggactaatcagaagtacacagtgcaaggcttgacacccttacctgccatccagatgacctttgtggatgctgaatctggccaaacgaaggcacgaggggattattatgctcagaaacatgacaaggtgattgagtaccagatgcttccatgcttggatttgagcaagagcaaggacaaaccaaatcatgtaccaattgagctctgcactcttcttgaaggacagaggtttccaaaagcaaacttggataagaattctgacaggatactgaaaggaaaggctctaattcctccatctcatcggaggaatgagattcaagacttggtgaatgcttcggatggaccttgcagaggagaaattgcacagcaatttgggatttccttggatttacgaatgacagaagtcacgggtaggatccttcccccaccaaatctcaaacttggggcatccaatggccacatgtccaaattcagtatggatcagaactgccagtggaatcttgtgaagaagagactagtagagggccgggatcttcagtgctggggcattgtcgacttcagtgctgagccgtctcacccccggcaggagcccctcaatggaaggatgtt

SEQ ID NO: 11046 - DNA, 877 bp, Sorghum bicolor
  Clone ID: SORBI-28MAY03-CLUS73014_1
atttgtccaagcaaattcagcaacatttcaatctgacaataacctagggctggtgaagcaagtgctctcctcgatgtacaaacggaacatccaaaggctgacccagacttatttaactctttcacttgaagatattgctaggtctgttcaacttgaaacaccaagggatgctgaaatgcatgtacttcgcatgatcgaagatggagagatccatgcaaccataaaccagaaggatggaatggtcagctttcatgaagatcctgaacaatataaaagtgtcgagatggtggagcatattgactcgtctatccagagattgacggcattatccaagaagttggcttcaattgatgagaacatgtcatgcgatcctgcatatttgatgaagacgggaagggatcgtggaagattcgatggaagattcgactacgatgactacgactctgttccacacaagtttttttgagttgatctgagccttatgtgattctgaagtacgatcatcaacgtagcaggcattccataaagttatcattagtttgatcgatcaatggctttgaaaattgaaatgctgtaaattctggtttaaagaatgggtctgtggagaaggtagatactgctatccagtcagtggaaatcgatcgtggctttaatctgcatctgcttgctgttgctagcatgtttctccctcaattctgagacaagatttcgtttgtaaatcattttgctcggtagagtttgaccaacaatgcaaatttcacgcaatcatcctggataccaatctagtgttccaggttcattcatcttgaaaggcttgcgcacaaagttccgtttttgtacaaattgaagttgatcatggtgctgctgcatcatcaca

SEQ ID NO: 11047 - DNA, 966 bp, Sorghum bicolor
  Clone ID: SORBI-28MAY03-CLUS73166_1
ctactgaatcggttagctagtccgttggctttcacagtctcgacagatcgtggctgctgctgacctgctgtggtgagtgcgtgcgtgcacaagctgttgcgcacggtcaccactcttgcatgctcgccgccgcgctgccctcctctgctcttgtcttgtctgctctgctctgctcagaactaaacgacaccagcgcgctccgtggcgcccacgaaacctcatcggcgtcatcctcctcctcctcctcatccccgtcggtccaggataaccatgatccaccaccatctctgactcatccctgcctcctcagtgcctctgccgtgtaggactggagtgtcgtggactctacactctccgtctccaagtcatcacatttccccaataatttaatctccaccgccgccgccgccgtcaactaaacccacgccgacggccgaccaaccatggcgtcctcgctgctctcctcccccgctaaacctttctgctccaccaccaaaacgacccccgcaccaaaagccacccgctttccatccccaagattcctctcctccgcccatgtcctctccgccgcgcgccgcctccgtgcggtctccgcccgagcgtcgcagcagcagtctccgccgccgcgggggcagcagcagcggcggccggagtacgtcccgaaccgcatcgacgacccaaactacgtgcgaatcttcgacaccacgctgcgcgacggggagcagtccccgggcgccacgatgacgagcgcgcagaagctcgtcgtcgcgcgccagctggcccgcctcggcgtcgacatcatcgaggccgggttcccggcttcctcccccgacgacctcgacgccgtgcgctccatcgccatcgaggtcggcaaccccgcacccgccggggaggacggtggcgccgacgccacgcacgtgccggtcatctgtggcctctcgcggtgcaacaggaaggacatcgacg

SEQ ID NO: 11048 - DNA, 1321 bp, Sorghum bicolor
  Clone ID: SORBI-28MAY03-CLUS7324_1
aaaaaaaaaaaaaaatccaccattggagctcgaggcttctccatgggacaccgagcctcgtagacgaagcagaggagaccagagaaatcgaagagcaaggaagcaagaagcagggagccatggcgttcctccttcccaagctcacaacgccgtcaggcccgtcatgcaagttgcccccgagtcccctcctcaagccccagctcgcccagccgggccacagcggcggcaagatccaaggctccgtctccggcgctggcgctgcgcaggtcgcggccccgggccacctcagtctccttctcctactcagcgccccgcagcaggcagcggacccagcgtccaagtccacggcgaccaagaaccggggcaagggcggcggggatccgcaaaggtcggatttttacctcaacctcgggacggcggtgcgcacgctgcgggacgacctgcccgacgtcttcgaccgggaacccaactacgatatctaccgtgaagacatcacatttgtcgacccactaaacacttttcatgggattgacaactacaagactatcttctgggcacttagattccatgggcgcctactattcagagaaattgggcttgatgtatcacgcatttggcaactgacagagacttcaatagttgtccggtgggagctgtggggcactccacgtgtcccatgggaatcatatggctgcttcagtgggacgtcgagatacaaggttgacaggaatgggaaaatttacgagcacaaagtcgacaacttggcattggacttcccacgatcagtagcgaaagtgggcagcattgctgacatggtagtcgccacaccaagccccaatttaacgttttggaatgtggttgggccaggtgatggttgctcatggacaaagctttatgaagccgtggtggaagctgtggaacgggaagaacatggttccactggcattggcgttggaggtctacctgtcccctgcagcttcggctgcggctgtggctgcagtttttgaagtgcaaactactgtagcttgaactgctgcagccgcagccatagctgcaaccagctcaaacgagcagccagctcaagcgaataggccatcacttgttcataggatggaatgagctccagaactagttgcttggtagttcctaggggaaatgtatagaatatatatgggcacatgaatcacgattctactaatatctctttgtatattgtagctatagggcagttaatttagataaaacacatactagatggctatattttgattgcccttgtggcattgtctcgtacagggaaaattcactgctttcttatgcg

SEQ ID NO: 11049 - DNA, 760 bp, Sorghum bicolor
  Clone ID: SORBI-28MAY03-CLUS73243_1
atgatttagtaattgttataggggctactaataaacctcaagagttggatgacgctgttcttcgaagactggtaaaaagaatatatgtgccactacctgatccaaatgtacggaagctacttctgaaaaatcagctcagaggacaagcattcaaattgtcgaactatgatttcgaaagacttgctgtggagactgaaggatattctggaagtgatctgagagccttgtgcgaagaagctgcaatgatgccaataagagagctcggtccacagaatattcttactattaaagcaaatcagttgcgacctttgaggtacgaggatttcaagaacgcaatgacggtgattagaccaagcttgcagaagagcaaatgggacgagctggagaaatggaacgaggaattcggttcgagctgacggcgatgcatgctgcctgatgatgatgaagcggctctatttccatctgtacatgatttatgtctcccgcaacacaagaggtcacacacacacgcccattgatgccgtccttgttgggaacacagaagctgaaggtatattgctgggaacagtccctataaagtagagccattgaaatgctgctgcccaagttatttttaaaaaaaaacctcgtgtgtgttattagtcgatgagctactttgaccgtagagggcgaaatcgaagtgccatcgtcattgtgtaaaaagacaaacagaaaaaaaaaggcttaatgacatatatatatatatatatatatatatatt

SEQ ID NO: 11050 - DNA, 938 bp, Sorghum bicolor
  Clone ID: SORBI-28MAY03-CLUS7420_1
cgtcaacctagtcaggagatcacatcagaagagaaaacacttaccatcccctcaactaaagatcaaatgaatggttcaatgcatgaaaatgatgactattctgctcatgacattagacgttctattcgtgaagctgctttatcaaagccattgaggaatacagagaggccacaagataaaaatagtgatgatgcttcagagcacttctttattccgctgtcaactggtgctgcaaagaaggatatggattcagtgacaaatggacataaccgaagattaggcttgttgccatctcagatgaagttctcaaagagcacaagtggcatttactacaatgcggatagcccaatatacacaagtccagttctgttaagtgaactgaatgggcatgattcgatcagtgccatgagttttcttgacccggctggtggtctggcacatcagtcctttctcactgatgatgctctggatcaagtattctcccctcctctattattggaatcttcgttgtttcacgatgcagacgaggacctacttgcaccattgtcagagactgaggcagcattaatggaacattaagcttcacatgtacactatgtaatattttgaccactggctggacacagcccggaggttcttgtggcttatgtttgtcttattgaggatatattcggctagttgcttgcgagtgcaaccaggttgagatacaggtgcttccgcaccagaatttgggtgggttctattgcgggggataagttgactattgatgtggggaaaggtgatatagctgctggtgttttttctctggacaaggctatagatgccggtgttgtaccaagggtagtgtgcacagtaggaaagctcaatcttgtatatttagttactctacatcagctgtatttgtgctgtaataatctatcgacctgctcaagtttgtt

SEQ ID NO: 11051 - DNA, 1467 bp, Sorghum bicolor
  Clone ID: SORBI-28MAY03-CLUS79112_1
acgtgtgggttacgtgagagtgaagaagagccgccggcaacgccgccgcggcacgtctcctccagctgcctcttgcgtcctccgccgcctcttttcctgctcgctggcagccgcggatccatcgagaatcgagaggtggggggggggagagtgagcccgaggggagagggctctagtcgggttccgccgaagagatgggcggcgcggcggcgggtaccaagtggatccaccacatccagcgcctcagcgcggcgaaggtgtcgacggaggcggtggagcggggccagagccgcgtcatcgacgcctcactcaccctcatccgcgagcgcgcaaagctcaaggcagagttgctgcgtgctctgggtggcgtgaaagcttcagcgtcgctcttaggggtccctcttggtcacaactcatcctttttacaaggccctgcatttgctcctccacgcataagggaggccatttggtgtggaagcacaaactctagcacagaggaaggcaaagaattgaatgatcctcgggtgctaactgatgttggagatgtccccattcaagagatccgtgactgtggcgtcgaagatgacagattgatgcatgtaattagtgagtctgtcaaaacagtgatggaggaggagcctcttcgaccgttggtgttaggaggcgatcactcgatatcttatccagtggttagagctgtgtctgaaaagcttggaggacctgttgacattcttcatcttgatgcacatccagatatctatgactgttttgaagggaacacttattcacatgcctcttcatttgccagaataatggaaggtggttatgccaggagactgctacaggttggattgagatcaattaccaaagaagggcgtgagcaagggaagagatttggtgtggaacagtatgagatgcgaaccttctcaaaggaccgagagaagcttgagaatctgaaacttggggaaggtgtaaagggagtgtatgtctcagttgatgtggactgccttgacccagcgtttgctcccggtgtctctcacattgagccaggaggcctctcgttccgcgatgtgctcaacatcctccagaatttgcagggtgacgttgtcgccgccgatgtggtggagttcaacccacagcgtgacacggtggatgggatgacagccatggtcgccgcgaaactggtccgggagctcactgctaagatttccaagtgagacggtcaggatcacaccattcttcgtgaagcaatgtgaaagtgtggattttgatgtctcggtggtttcttggtcttggttcatttgtatcgagcaccaaacgcttcgacatgtgacaaagcttatgttaatgttaacaacgtaaagtggttctctcctactcctatttagatcattctagatgcttaccatgtatttagggtggggattatgaaaccaaacatgccagattctagaacaaatgctccga

SEQ ID NO: 11052 - DNA, 684 bp, Sorghum bicolor
  Clone ID: SORBI-28MAY03-CLUS79686_1
acacagtggacacgaatcactagtagacacagcaagcaagaaaccaaacattccactgcccttaccgttgcatgcagacaagtgcagcccggcgatgacgagggtgagctcaagggcggtggcggcggcgttcttggtgctcgcggtcgcctggccgctgctggcctcggcgcagccagcgccgagcatgcctccgccgtccccgcctgcggcggcggccacgaacaactcccggttggagaaggcgtacgttgcgctgcaggcgctgaagcgcgccatcacggacgaccccaagaagctgaccaagaactggtgcgggcccgacgtgtgcaactacttcggcgtgtactgcgcgccggcgcccgacgacccctgccagcgcacggtggctggcgtggacctcaaccacggcgacctcgccggcacgctccctgaggagctgggcctcctgtccgacctcgccgtcttccacctcaactccaaccgcttctgcggctccctcccccagtccctccgctccctccacctcctccacgagatcgatgtcagcaacaaccagttgtccggccccttcccgtcgcagcttctctgcctccccaatgtccagtacgtcgacatcaggtttaacaacttctgcggcgaggtgccggcggccatcttcgacaagaagaccgacgcgctttt

SEQ ID NO: 11053 - DNA, 698 bp, Sorghum bicolor
  Clone ID: SORBI-28MAY03-CLUS80056_1
atctcgaactgtcgtgaacttttgaactgtcgtgaacttttgtgacctcaaatccctgctctcgagaaaattccttccgagagccaatccgactgaaaatccccaaacacggatcaacccttacaaaaccccactacggcctcgaaccgaaccggctaaaatcgacctgagaagaacggactcgagtgacgaattgacgacaggaagcacaggatccggcagcaagatgttcttcttcttcgtaggcggcgtggagcaaggggccgggcgggtcctgaaggaggcggcggggcggtgcctccggtgcggcggcgcggcggacctggtggagacggagaaggtactcaagctcttcttcgtccccgtctggcggtggcccgggaaggaccccgcctacctctgccgcgactgcggcctcctcgcgccgggctccctcggcgcggagccgggaccgggacgctcctcgctgctgctgccccgggaggcgaggtgcggcgcctgcagccgcgccgtcgatccgcagttccggttctgccccttctgcggctcctccctctgaagagattgccggtggcgactacagagcagaggtgacgactgacgcctgaggtttgctcgtgtcgtgtgaaaactatagtatgtactgtatatcatcacaaaatggcaaacgaaataaaggaaatcatcagcaccgtttc

SEQ ID NO: 11054 - DNA, 665 bp, Sorghum bicolor
  Clone ID: SORBI-28MAY03-CLUS80343_1
aacaggcaacatcatagcataggcaaaaccaccaattctagcaaagcctcggagcttggggtggtagccacaccagtagccagagcagtcatggggtcgctgccgacggaggagcgggagaggcgccagcagcagccgccgcacgtggtgatggtcccgtacccggcgcagggccatgtcacgccgatgctgcagctggccaagctactccacacgcgcggcttccacgtcaccttcgtcaacaacgagttcaaccaccgccgccacctgcgcgcgcgcgggcctggagcgctcgacggcgcgccggggttccgcttcgtcgccatcgacgacggccttccacgctccgacgccgacgccacgcaggacgtccccgcgctctgctactccaccatgaccacctgcctgccccggtttaaggacctcgtcgcccggaccaatgccgaggccgaggcccagggacggcccgccgtgacgtgcgtcgtcgccgacagcgtcatgaccttcgctctccgcggcgcgcgggagctcggcctccgctgcgccacgctctggaccgccagcgcctgcggcttcatcggctactactactaccgccacctcggtggagcggggcatcgtcccgctccagaacgaggcgcagctcaccgacgggtacctggacg

SEQ ID NO: 11055 - DNA, 794 bp, Sorghum bicolor
  Clone ID: SORBI-28MAY03-CLUS81473_1
accgcgaccaggacagtgctcccgtccccaaagacaaacaaacagggcaagcagcaagcacacgcctctccctcctcgccctgcctagctgcattcccccacacctcccctcgacacagacaagccaatctagcaaagcacacagctgaagcagacaacactcgtcggaggaggagatccagtagcaccaaataatggggagggctccgtgctgcgagaagatggggctcaagaaggggccatggacgcccgaggaggacaagatcctggtcaaccacatccagagcttcggccacagcaactggcgcgcgctgcccaagcaagccgggctgctgcggtgcggcaagagctgccggctccggtggatcaactacctgcgcccggacatcaagcgcggcaacttcagcaaggaggaagaggacgccatcatcaccctccacgagcagctcggcaacaggtggtccgcgatcgccgccaggctgcccgggcggacggacaacgagatcaagaacgtctggcacacgcacctcaagaagcggctggagcccaccaccaagccggaggagcagcacggggcgcaggcaggtggcgccggcaagaagcacaggcccaagcgcggggccgccaagaagacgacggccgacgacgtcgccgtcgtcccagctaccaccgcgccggtgtcgcctgaacggtcgccggcctcgtcgtcggtgaccgagtcgtcgtccatgacggagcaggagcaggagcagggcaacacggggagctcggccggcgggttccccatcaaggag

SEQ ID NO: 11056 - DNA, 972 bp, Sorghum bicolor
  Clone ID: SORBI-28MAY03-CLUS80_1
ccggccgggtcgccctcctttgagagaattagaaaaataccaagtgaaacgaactagcaacgtccttccaacaatggctaccaagatattcgccctccttgcgctccatgctcttttagtgagcggtacaactgcggccattattccacagtgctcacttgctcctaatgctattattccacagttcatcccacctgttactgctttagggaatgaacacctagctgtgcaggcctatgggctacagcaggtgctttcggcgagcatcttacaacaaccaattgcccaattgcagcagcaatccttggcccatctaaccgtacagaccatcacagcgcagcagcagcagcaacaacaacaacaacaacaacaacaacagttcttgtcatcactcagtgcactagccgtggcgaaccaggccgcctacttgcaacaacagctgcttacatccaacccacattctctggctaatgctgctgcataccagcaacaacaacagttgcaactagccatggcgaatccaaccgcctacgtacaacaacaactgcttctatccaacccacaggctgccaccaatgccgctacatacctacaacaacaacaatttcaacagatcttaccggcgctcagtcaactagccatggcaaaccctaccgcttacttgcaacagcaacagttgcttccaatcaaccaactggctctggcaaacactgacgcatacttgcaacaacaacagctgcttccggttaatccactggtagttgccaatccattagttgccgccttcctacagcaacaacaattgtcgtcattcaaccagatatctttggttaaccctgccttgtcgtggcagcaacccatcattggtggtgccatcttctagattacatatgagttgttgtacttgataacaaagctctcataccggcatgggcaactttcctaaaataatcaatatattggttgagattg

SEQ ID NO: 11057 - DNA, 605 bp, Sorghum bicolor
  Clone ID: SORBI-28MAY03-CLUS18140_1
ttggggcttgggccgggaaaaccctaatcctgatcggcgccagcgactccctctgctcgagccgcagcaaacgagcgacgacaaccgctgctctgctcgaaccgtgccgactagcggcgacaaccgcctgctgtgctctccgatggcgactgtgccagttaacccaaaacctttcctgaacaacctgacagggaagtttgtaattgtcaaactcaagtggggtatggagtacaaaggttatcttgcttcggtggactcctatatgaacctccagcttgccaacactgaggagtacattgatgggcaattctctggaaacctgggagagattctgatcaggtgcaacaacgttttgtatctccgaggcgttccagaggatgcagagatacaggatgcagaatgagaaatccgtgttagattgataaatgtaatatgattctgacatgtatggttgaatatgccgttgacaactagacctagcagatactagctatgatcttttgggtgatgaaacgtgatgacaatagggcccaggtgctgttcaaactgctttcagttagaccatgctgccattctgctgaatgtgatgagtatcagctttcttg

SEQ ID NO: 11058 - DNA, 560 bp, Sorghum bicolor
  unsure (1)..(560): unsure at all n locations
  Clone ID: LIB5047-002-R1-XP1-E9
gccggccgggccttggaagccccccgctttgcccggtcgtctactcgctgccgccttcctcgacccgcaccgcacccgcagaagctaatggcgactgtgccagttaacccaaaacctttcttgaacaatctgactgggaagactgtaattgtcaaacttaagtggggtatggagtacaaagggtatcttacttctgttgactcatacatgaaccttcagcttgctaacacagaggagtacattgatggacaattctctggaaacctgggtgagattctgatcagatgcaacaatgtcctttatctccgaggtgttccagaagatacagagatagaggatgcagagtgaggagccgggagtgggggaccatgccttaagattggttctgataaccatgtattagctgtcatcttaagattggttgatgatatttcagatgcgcactactgaatacaaaattgctgatgcatttgcctgcttgcacggcacgacaagacattgtgaaatcatttggccatgtagtacggactatattccaatcttgtatggtttggctcang

SEQ ID NO: 11059 - DNA, 1179 bp, Sorghum bicolor
  Clone ID: SORBI-28MAY03-CLUS18403_1
gccggccgggacacgaacccgagacgctaacccaaacccaatcagaccgaatgggcgccgcatcaccggactccggcgaccttatcgtggtggagccggcgaggccgggatctccggtagccgtggtgaccatcaaccggcccgcggcgctcaacgcgctgaccaagcccatgatgatctccctggcggctgcgttccggcggctgggcgccgacgactccgtggccgcggtcgtgctcgcgggccgcggtcgcgcgttctgctctggggtggacctgacgacggcggaggaggtgttcaagggcgacgtgaaggacgtcgccaccgaccccgtcgcgcagatggagctctgccggaagcccatcgttggcgccatcgccgggttcgccgtcaccgccgggttcgagatcgccctagcctgtgacgtcctcgtcgccggacgctccgccaagttcctggacacccacgccaagtttgggatatttccttcctggagtctttcacagaagctttctcgcatcattgggccgaatagagcaagggaagtgtcactaacttgcatgcctgttactgctgaaatggcagagaggtggggccttgttaaccacgtcgtggatgacaatgaggtgctgagtaaggcgatagaggttgccgaggctattgcgaggaacaaccgcaacttagttgtattatacaaatcggttataaatgatgggtttaagctggatttggaacatgctcaggcacttgagaaggaaagaggtcacaactattacaatggaatgacaaaggagcaattcacgaatatgcagaaattcatccagggccggagttctaaaacaccatcaaagctgtaacttgttgatgacattttccgtggtccgtgtacgatgtacaactactgaaagcgtgtgcagtagtctgaaaaataaagatgccggtgtggcaatatacagatactgtcttctcatattatggaaagagacatacttctacctaagtttactaatcagtgctcacgagtcaggaccttgcaaacacgtgttgtagttagttgccaaaccgtgttgctttctctttttctgatgctaaaaccgatcaggtgctgggaatatattgtatcttccctgtctcccatcttccgccaagtggtttaatggaaaaatggtgtgttgaggt

SEQ ID NO: 11060 - DNA, 778 bp, Sorghum bicolor
  Clone ID: SORBI-28MAY03-CLUS18441_1
atatatggggatatatgtacagcaatgagaaggaaattgtgacgtacatcgctaaaatgttgccgatcctcgggatatctttcttcatagatgggcttcatagctctctttcaggggtgctcacaggctgcggaaagcaaaagattggcgcagccgttaatctcggcgcgttctacttgttaggcatcccaatgtctgtactgcttgcattcatcttccatctgaatggaatgggcctctggcttggcatcgtctgcggtagcgtcaccaagctggtttttcttttgtttgtaacatgttccatcgactgggataatgaggcagtcaaggcgaagtacagagtgctaagctcatctctcccattagtatgaaaaatgatagtgttacatggaaatttgaaggctgttgaccacaactcagcaaaagaagtgtggatcggatctgtgtggaaaactttctacagttcggaaaactgaccgacatctcaaagtcatcaaactatgggaagacaagaagaaccagatccagtaactttggattcatcttcattggcaacaagtgataggacagagcactctctatgtagggagtgttaagttttgtaacactgtaatggttttccggaaatatacttagcttgattgagtcaaatgacagtggtgcatgatagtttttcacgttctgacaaaagatatgtgatagctacgaatggtccaattggagttttgtgtgtatactaaacgtcatcgtccaaaaaaaaaaaaaaaaaaggccccta

SEQ ID NO: 11061 - DNA, 1092 bp, Sorghum bicolor
  Clone ID: SORBI-28MAY03-CLUS18544_1
aactccaagccgaccggactgcgagtcgagagagaccgccgaccggacgaagacgcgagagagaccggggctccgcctcgcgccgccgccgccggcgaccatgtccctggcgtctatcttcgtcttcctcttcgtgttcgcgctgcagctggtcgaccgctacctcgacctcgccagaaagaggggagcgcatagtgatgagctgacgaaactgcggcttgaaatcaagcaacttttgaaggaggccgatcagttgtcaacgccgtccacatttgcacaagctgctaaactcaagcgcttggctgctgccaaggagaaggaactggcaaaaatgcaggaacaggaccttaaagggaagcaatcgttatacgacaaatacgcaaagtttttgttggttactaaggtaataatttatgccgtgctcgttctgtgcttctggagtactcctgttactacagttccccaacatcttctacagccctttggaaaaatgttttcatgttggaggtgttgatactgccaccggccatgttgtggttggaatactcccatggctgtttttgacctctcgggtcagcaagctgctatgctggtatttcgggaagaagtaacatcattacgttggtggagttaactttgcttacttgtgtatgtatgaaagtggattgttcattggatgatcggagaaaactacttgccccaaatttcccaagtagcccttgaacattatgttacttgtgtgcagcgtcactttgtagaaatctgcacctccttgtttttttcgcagtccctgatttggtggttgccccctttggtgcaggttggaatactcccatggctgtttttgacctctcgggtcagcaagctgctgtgccaaaaattcggcttcgtcctcgtgcgtccgtagcttgtttccacgagaaagtcagcaagttgctgcacctaaacaagcttctagatctttgtataatcacttgctcacttgttgcccacatttgttctgccgtgcccgtgtgctcaagcggatacgtgtaagaacttgattttttataagttactagtaactgtggatgatgtgtgctcttggttctc

SEQ ID NO: 11062 - DNA, 1285 bp, Sorghum bicolor
  Clone ID: SORBI-28MAY03-CLUS8302_1
ctactgagacgcagacgctgctagcgctagcgactcgcaacttcccctcacacacacccgcagcaccgccgccccggacaagggacaaccatggcgtcgtcgaagctgcagctgccggctgacgacagcgtcctcctgctcgtcacccactccaatctctccaccttcgcagccgacatccgcgtctcgcaacagaccaccgtcgaggcgctcaaggacaagctctggcgcaagaccggcaccgccgtcgcctccatgcgtctccagctccgcgacgacaccggcgccaagatcgccgacctcgatgacgacgccgcgccgctcgcggcctacgccccctacaacggctaccggatccatgttgttgatctcgatccttcctcactcacctcgggtggctggttggaagacacttcccttgtcgacaagtacaaaatgtccgatgaagcatacgataagctcgacactaactttcgaaaattcaaagaaaagatggtcccgaaaaactctccgtcagaggataaagaacaattagaaaagcatatggaggaactatgctccaaaatcaaggtgggagatagatgtgaagtcgaacctggtgccaagaggggcactgtaaaatttgttggtagagctgaagcccttggacgtggattctggggtggagtgcaatatgatgagccacttggaaagcatgatggcatggtgaaaggcattcgcttctttgagtgccctcaaggtcatggggcaattgtgagaccagagaaagtaaaggttggcgacttcccggagagagacccatttgaagatgacgagatataggcaaccgaggaggggtgcatgtgcatttgaaaagggtgggaggtccttgttgagttgcattcgaaacgtgtgtaaaattaatttggagatttgagtgcgcgcacttgctgttactatcttgttagttatgtactctcttcatcccaaattgtaagtcattttaaaaatcttgtagagtcaaagcattttcacgtttgatcaaaattataaagtgaaatactaagatttgtaacgtaaagtgagtatactatgaaaatataattaaggaagaatctaatgatatttagttggtatcataataattattattttattatataaatttggtcaaactttaaaaagtttgactctaagatttttggaatgacttacaatttgggatgaaggagtacattccagagatggtacaatgctatctggctgttttttggggctgatgctgatatgttataagagagaaaaa

SEQ ID NO: 11063 - DNA, 1143 bp, Sorghum bicolor
  Clone ID: SORBI-28MAY03-CLUS8331_1
gcacgaggctcatgtagaagtgccccaggagaacttggcatcagtttgtgagtcctcatttgaggatgaacaagaaagtatcccgagatattcgaacacaggaggaaatatggatgatgttgtgttatctaaggctgcccgccctgtgaagtctgcacgggcaatcgaggattttgagacatggcaacggattattcgtttggatgcagtccgtgctaacgatgaatgggtttcctactctccatcccaagcttcagtttccaaggagagagcaattgaatctgctaaagctgtttttctcaaagactatgaccacttagaaccatatcggatccatcatgcgtcacgccttgttgctattcttgaggcctatgcaatctatgaccaagagattggatattgccagggaatgagtgacctgcttgcacctctccttgctgttctagaggaagatgacgaagccttctggtgctttgctggttttatgaggaaagcccgccacaattttaggcttgatgaagtgggtatacgccggcaactcaatatggtagctaggataatcaaatacaaggacttccatctctacagacatttggagatgctccaagccgaagactgcttttttgtttacagaatggtagttgtgatgttccggagggagctcaccttcgagcagaccctatgtctctgggaggtgatgtgggctgatcaggcagcaaaccgtgctgagattgcaaaatcttcctggcggaaattgcagttgggagcacctccaacagatgacctgttactgtatgcaattgctgctagtgtgttgcagaagcggaaactgataatagaaagctacagcagcatggatgagatcataagggagtgtaacagcatggctggacagctggacatttggaagctcctggacgacgcgcacgatctagtggtgacccttcacgataggattgagtagctgtggtctttgttgcttgtgctatctgtcaagttaccatactatcattatacccaatctctttgtatgttaagtatgtaccgacagtgaatagaagcacgttgatggagttagctaggtagcaatgccggcaatttttttgaactgagcatgcatactggacgtgggcgaagagcccc

SEQ ID NO: 11064 - DNA, 728 bp, Sorghum bicolor
  Clone ID: SORBI-28MAY03-CLUS83411_1
aacaacccggcgctgcagcagtccctctgcccgttcccgctgcgccgccccgtgatgagcgccgtgccgtccatcaccacgcgggagctgcgcccgggggaccggttcctcatcttcgcgtcggacgggctgtgggagcagctcagcgacgaggccgcggtgggcgtcgtggcgagcagcccgaggaaaggcgtggccatgcgcctggtgcgtgccgcgcagctggaggcggcgcggaagaaggaggtcaagtacgacaagatccggaccatcgagaagggccagcgccggcacttccacgacgacatcaccgtcgtcgtgctcttcctcgacaagtgcaggggcgccgccaggtccggccccgaggacatcgacggcacctatgcgccgctggacgtgttctcctacagccccgccggcgatcacgaggacccgaccaagcccgtcctgcgtcgttgagacggatcgatccgtgttccgctccgcgtgttcttccattgctttgcttcgctctctaaacgagagaggtgtacataggaaccatgcttgagttgtttcgtttggaatgcaggaatctttgccgattcttgcatgaattgagttgtttcccgttcaaggacaattcgcttgtaaagaaattaatacagtgtcaggtcatgtgtcattagattgtaaatcttcatcaatctcttctcactctcttttttttaaaaaaaatctattcatcc

SEQ ID NO: 11065 - DNA, 805 bp, Sorghum bicolor
  Clone ID: SORBI-28MAY03-CLUS84008_1
gctcgggcccgtccacggggcagtgcgtgcccccggcaaagcaaggaggagagaggtggacgacgaagaagatgagcaggctggacacgaagacgctcaaggacgagctgacgagcatggacagacggtgcctcctggacctcggccacccgctcctcaaccgcgtcgccgacagcttcatccgcgccgccggtgtcggggcggccagggccgtctccagggaggcctacttcgtcaccgtcgaagggctttcatgagactcgtccgggctggaccccgacggcggcaagaggagccatttctccagcatcagaggtgatgacggccagaggtcgctcgacgcagtggtaaaaacggctggcaaggaggccttccagtgggggttggcagccggagtctattccgggctcacgtacggcctgagggaggccaggggatgccacgactggaagaacagcgcaattgcaggtgcaatcgctggggcggcggtggcgctcacgggtgacgccgccggcctctccgccgggctcgcccacggccccagcgccgccgcggcgcgccccggcgccgcgagctgcccatccgccggtgcctgcgcgggcccggcgctcccgcccccgggtcgcgcccgcggccacgcccttaatccagggttttagcatgaaaggttgaattcaggctatcaatgaaatgtatttctaggtccctgtcagcagcttcctgccactcctgcactttggacttccactgtaatccttgcttcgtgtatgagtttttcccatgaaaggttaattcaggctatcaa

SEQ ID NO: 11066 - DNA, 1081 bp, Sorghum bicolor
  Clone ID: SORBI-28MAY03-CLUS8427_1
gcacgagggttacagccagtgagcggcccagtcggtcggtcgagcgagggagctggacccctacccctgcccccgcgttatatctgctgcgctgcgctgcacagacagactccagccccgccggtcactagtgatagtggatagctcgcctcgcccgccagccgccccgctagaagctcgcatcgatcgcgccccagatcccaatgcgccccgccgcgtcgctctaggccgcggaagatagctgtgtgacacgccgtgcagccatcatcagccatgaaggtcctcgccgtgctggcgctcgtcgccgccgccgcgccgttcctccgcgccgccggccagggcgaggaaggggccgggccgctgccgttcgcggtgggcgcggcgccggcgggctgcgacgtcgcacagggcgagtgggtgcgcgacgacgacgcccgcccgttgtaccaggagtgggagtgcccctacatccagccgcagctgacgtgccaggcgcacggccgccccgacaaggcgtaccagagctggcgctggcagccgcgcggctgctccctgcccagcttcaacgcgacgctgatgctggagatgctgcgtgggaagcggatgctgttcgtgggcgactcgctgaaccgggggcagtacgtgtccctgctgtgcctcctgcaccgtgccatccccgacggcgccaagtcgttcgagacggtggactcgctgagcatcttcagggcgaaggactacgacgccaccatcgagttctactgggcgcccatgctggctgagtccaactccgacgacgccgtggtgcactccgccgacgaccgcctcatccgcggcgcgcccatggacaggcactccagcttctggaagggcgccgacgtcctcgtcttcaactcatacctctggtgggtcgccggggacaagatccagatcctgaggggcgccgacaatgacccgagcaaggacatcgtggagatgaaatcggaggaggcctacaggctggtgctgtaccaggtggtccggtggctggagcgcaacgtggacgccaagaagtcgcgggtgttcttcgtcaccgcgtcgtcaa

SEQ ID NO: 11067 - DNA, 1385 bp, Sorghum bicolor
  Clone ID: SORBI-28MAY03-CLUS84471_1
cctactggagcaggccgtgcagaaggatcagtgatcgtccccagaatgcccttcccgccacggccgtaacaacctcctcccgcaattactccaacttgtgcccacaccacacgcggagcccatccatggacgcgagcctccgcacgctgcccccggccggcagcagcttccccggcgaggtccggtccgccgtgtcgtcgctgctcctctcctccccgggcggcaccagcgccctcgacaccgtcttctcgcacctcccgccgcccgtcaccatcccgccgctcggctccagcgtctactaccgccagtgcgagctcctccgccacttcgccgcgtcacagacgcaccagccggccaccgccaccgccgccgcatgctcgtcctcttcctcgtcgtcctccgccgcctcggccagcttccagttccagccccaggcgccgcccgacgacgcggcggcggcggcggccatgctgcggcagaagctgtaccgcggcgtgcggcagcggcagtggggcaagtgggtggcggagatccggctgccgcagaaccgggtgcgcgtgtggctcggcacctacgactcccccgagaccgcggcgcacgcctacgaccgcgccgcctacaggctccgcggcgagtacgcgcgcctcaactttccgggcgtcatggacgcgccggacacggactgccccgaccaccttcgccagctccgcgccgccgtcgacgccaagatccaggccatccgcgcccgcatggcgcggaagcgcgcccgcgcgcgcaagcagcgcgaggagaaggagagcgcccgctccggttccggtgccaacagcagcaagccagccgccgcgcgcccggtcgcctctgagggcgccgcaacgacgacgacgactaccaccacctccgagacgtcaaccacgccgtacgggtcgccggacggggttctgtccgtgagcgcggtctcggccgagggcgactgcccgctggagcggatgccgtcgttcgacccggagctcatctgggagatgcttaacttctagccggctaactgcacggcgcgtgtcgatcgatcaacgggaccgccatggacaccgggaccaaacgacgtcaaggtccttgcttggacatggctgccccgcgtagagctcgcatctaggtgctgttcctttttcaaattatgagcgtatatacatatataacaaactattagtagaaggatgatgataccatgagcaataaaatgcccaagaaaacctgggcctgctagccatgattagtactagtatctgaatactcgaatcgtcgtgtgttttcagattgatcgacgagttgtaaagactgatcgctgattcactgtctatctctacatgcataagcattccattacagct

SEQ ID NO: 11068 - DNA, 650 bp, Sorghum bicolor
  Clone ID: SORBI-28MAY03-CLUS7778_1
gcaccagccacgaagcccgccccgccaccccacggagcgcccgcccacccgcgacgcacgcctcccgcgcggcccgcccaccccgcgcgcgtgcgccagtccgcctcccgtttgccgcctccaccgcaacgcggcgcgcggggtggcggtgccctcgcgatcctcgtgtcgattccagcggcgggggtacctttccctttccctcccctggccgttgcccgcgcctcgcggtcgcgcaccggaaccggagccccgcggcgaatctaggtttgcctccgccccgccctctcctcccgacactcccggcggctggaattaggacgagggtaacaggggacggaggctgcgagggacgccccctcgtcgaatgcaccggcgaccgatctgtttaggaggagtcggagcacgcaggaggggagcgttgttgaggggaaagcattgaaaatgtcatctactgtgccgaagtcatcaagtatcttctggcgtgattgtccagttggcaagactcatcgcccgaagcttctccagcagaaaccctgcggtgtctgtaagacgagcctgggtggttccggagttatttccctgcccgggccgtttacctgtgggcacttcggtttcccacttgggggcaatggcaatcatgtcagggg

SEQ ID NO: 11069 - DNA, 969 bp, Sorghum bicolor
  Clone ID: SORBI-28MAY03-CLUS77992_1
gcccggggctccgtcgccgtcccgcccccgcccctcgccctcgtccaccacagccgccccgtttcctcctccgcgctactccgcctccccagaaccgccagcgccaggtcgccgcgctccgcctcctgctcgacctccgcgccgccgccgccgccgccgccgccgctcccgttcgtcgccgtcgcatccatggacgcgccgccccagggctaccggaccaacgtcggcatctgcctcgccgacccatccctcaccaagattttctcggcttctaggctcgacattcctagcgcctggcagatgcctcagggtggtatagatgcaggggaagaaccaagggcggctgccttcagggaattgagagaagaaactggtgtcacatccgcagagatcgtggctgaggctcctaactggttaacatatgacttcccgccggatgtgagagacaagctgaatgctaggtggggaaccgattggaaaggccaagctcaaaaatggtttttatttagacttactggaaatgatgatgagattaaccttaatggtgatgggtctgagaagccagagtttggtgaatggacatggatgactccccaggaagttattgaaaaggcagttgaatttaagaaacctgtatatgaggaagcattgaaacattttgctccctacctacagtcagatccagccgcttcatcatagatttgatcagtttgcatatatttattttttatttggagctaccctgttgtatctgaaccccaataatttgacacgacgcaatgaagccattgagatggaggtgtgctacaaattgatagtgtatggcctatttcagtcaattattatgccagcattggatcctcatcctttatagtcacgtagtacaataagtcgtgtaaacagtgactgtaattgccactacagcttccccggcataattgcatcgcaatctagtttctgccaatttgg

SEQ ID NO: 11070 - DNA, 909 bp, Sorghum bicolor
  Clone ID: SORBI-28MAY03-CLUS7837_1
tcgccaaaatggtcatgcagaacctccccaaatgtatggtcttagccacagaaaacttttgcgtcagcttatcatgagtggggatatcgactctgcattcaaaagacttggggagtggtatccacaagtgataaaggatgagaaatcggttatttgcttcctactccattctcaaagattcatagaatatatcagggctgaacaactggaggatgctgtgaaatatggtcgtgctaacctggcaagcttcttgacacacaaagcttttgagggactgctgaaggatagtgtggccctacttgcgtatgagaagcctgcagaatcatgcatgggatacctgatggactctccccagcgtgaattcgtggcggacgcagtgaacgcagctgtcctgtcgacaaaccccaccatgaaggaccctgagagctgcctttactcgtgtctcgagaggttactaaggcagctcacagtttgtagctttgagcggcgtgcattcaacaacgaccaaggagatgcattcttactccacaaagaagtgcagaattatgaaaggtccaggcgctcatagccatcatcaggtttgatgcgcatctgagaagtagactcagatgctagactcccgactcctgtttgaagggacgaagattcatgacggagtggttgaccatggctagcacagatccttccctttgaaggtctgcagtgcccctcagctttggcaagggggaacaccaaattgcacagacagagctcaggcgcttcggaaggtgttctatcctccctgtaatcagaaaactcattgtgacatacggccaacgtttcagtttccttaatttgttggttggctactatgctgtttgacattgtgaaacgggagcgcaaaaaaagtaaagacgcttcaaggtaaaa

SEQ ID NO: 11071 - DNA, 726 bp, Sorghum bicolor
  Clone ID: SORBI-28MAY03-CLUS78664_1
cgacgacgcaccagcagcgaggagctgagctgagctgagcagcggcaacggcagcgccgcaccccacgcgcgcgcgcgcgcatctcctacctagctcacgatggcgcctgcccgccgctgctccttgctcgcgctcgccctctcgctgtcgctctgctccgtcttcgctgccgcggcgcagcagcaggtggacgccgtggccgcggcgcagcaggcggccgaccgcgtggccggcctccccggccagccccccctcgggttcgcccactgcgccggctacgtgtccgtgaacgaggcgcacgcccgcgcgcgcttctacgggttcttcgaggccacctcctcgcccgacaacaagcccctggtgctctggctcaacgccgcgcctggcggcccgccgctggggggcgggggggcggtcgtgctcgggcccctctccgtcctcacgggccgccccgcccgccgcggggtccccctccccgcgcccccgcaggcgctcccgctcttccgcgactccccggccggcgccggcttcccccccacggcctcccgctccctcccgccgcccattgtccgccaaagctggctgatctgggcttttccttttcgcctcctaccaaacatgtgattccaattcgattgggggcaagacggttcaggaataaaagtcatagtgctgggcccacgcctcccgctccaccctcccaatcatccgcaagctcgtcgccg

SEQ ID NO: 11072 - DNA, 757 bp, Sorghum bicolor
  Clone ID: SORBI-28MAY03-CLUS79364_1
ccactgctccgtaccatccgtcgccgccggcgcaccgcgatggccgcctccgccacggccgcgaggcctctcgctggggccgccgccgtcccgctcccgctgccagcgcggccgcgaaccgccagggtggccttgctgcccctgacccctgttccgggccagcgcctcgctctcgggcgggccgggcaggagcggctgccggcgcgcggccggtcggtgcggtgcctggcggcgctgagcccggagatgcgggcgacgctggacaaggtcgtggggtccagcaaggtggtgctgttcatgaagggcaccaaggacttcccgcagtgcggcttctcccacaccgtcgtgcagatcctgcgctcgctcgacgtgcccttcgacacgctcgacgtgctcgccaacgaggcgctccggcaggggctcaaggagtactccagctggcccaccttcccgcagctctacatcgacggcgagttcttcggcggatgtgacatcaccgttgaggcatacaagagtggagaactgcaggaaactcttgagaaagcaatgtgttcataggaaaaaaaaattgaacaaggaccacacaggatactgttgatcaaaatgttatagtatttgctgtacgattcagccatgttaagctggagatgctaagttgtagacaatttcgtgtccagatgttcagtgcacttcgaatacttttttctggaataagcaaccagctgatgttgatgctgaaaaaaaaaaaaaaaaaaaa

SEQ ID NO: 11073 - DNA, 735 bp, Sorghum bicolor
  Clone ID: SORBI-28MAY03-CLUS8635_1
ctagttctagatcgcgagcgggccgccctttttttttttttttttacaaagccaattacataatatattcccaattaaactcatgaactgtgcacagaacaaggaagtagtttcagttctcagcctggtcagctttactaattgcagcgctcctactacacagcagccactgccaagctcttggtacctagctagaaacagaataaaataccaccacacacacaaccactgccatagagaaaaagacagtcgagcaaagcctctatttgctaaacatgtacacgctgcacgcacatacaagaagcttgaatcccacaatccatcctggtcactgactacgtcttctcaattgaagagcagtcaccatgacaatgtacgcagagaccaacagtagaagcaccatgcatttgaatttcaatctgataaattggtatgtacttatagcaactgcattaaacaaaaaacaatcttcaaatcaataaataatgactctatttcaaacagtaagtttaaaattaacattcagatcatacagttgctataacgcatggcactgcacttatagtaaaatcttacatttcctactaataatctaacactgtttgctacaaaattattgatacacctcaagtaaaccatcactactgcaagtatgaacaggttctgctggaggataataaaagctgaaaaatacagaaccattttaagttatacttaccatctatcctgtgaaca

SEQ ID NO: 11074 - DNA, 1195 bp, Sorghum bicolor
  Clone ID: SORBI-28MAY03-CLUS8633_1
tttaccttctcaaatttgagaaccagtgcaattttcatctttacagcggtattggtagtggtttgctcatggcatccggctgggctagatttgcttcgtcagcaaactaactagccatgtcagcaagctccctcatataatgattcacaaggattacagggtaaaagcatagataattttccttcatgtcttatgtgttctctctacttttcctatatctgaatgctaagagggatccacagcaacattacaatactactttgagaactatattgaagagttagttgtacaatgctttggcttggaaaatgggtattaaaaacctgcttttctagaggatctaatcaggagttcaggactttaatgaaactaaaaaggggcaagttggatatttctagtctttatatgtcattccctactctggttcaagcaaaaaatgagataaaacttagcggcgccagtgcccctcttccctctcccccgtcgtcctcttcttccctgcaattgcgcattcgctcccctcccccaacaaacccccctctccctctcccctcgcatcgcatccctggaagtcaggaaggaaacccgttgccgacacgaccccggcgtgcgagcgccacggaaatcatccggctccctcccccacgtccggccgcggcggcggccgagcaacggtgatggctcctaacatggagacgtatactacagatgacgcacttaccatgatggggtttgggaaattccaagcgcttgttctgttctacgctgggatgggctgggtcgcagaagccatggagctcatgctcttgtcgtttcttggtccgttcattcgagaggaatggaacgtctccccggagaacgagggcctcctttcaagtgttgtctttgctggcatgctgttaggtgcctgtgctgggcgctttgtttccgacaaatatggacggaggactggtttaatcttttcaactctgtttactagtggaatgggttttctaagtgctttatctcctaactacttgtgctggggggcgctgcgggttctcgccgcccttccaggcggccgctgccatgtgtttatatcttggtttttggaatttgttcctgcacaaaatcgtggcacttggatggttattttttcccttttctggactctcggcacaatcttggaagcttcacttgcatgggttgtattacc

SEQ ID NO: 11075 - DNA, 725 bp, Sorghum bicolor
  Clone ID: SORBI-28MAY03-CLUS8641_1
gcacgaggctccgcctccgcctccgctctcgcctccggtggttggctcgtgcctccacaccacgcgtcgcccgacttcccgctctccctgtcagctcaccgcccgccccagatctcctctccgcccaaacagaaccaagcttcgcagcgcagcggatccgccccgcgctttgccgccggcaaccagccatggcgacggccttcgatgccttcaccgacaagaacgccgtcttccgccgcctcaaggccaagcccgagaacaagatgtgcttcgactgcaacgctaagaaccccacctgggcctccgtcacctacggcatcttcctctgcctcgactgctccgccgtccaccggagcctcggggtccacatcaccttcgtcaggtcaacgaaccttgactcatggactcctgaccagctgaagatgatggctttcggaggcaacaaccgggcacatgctttcttcaagcagcatggatggaccgatggtggaaaggttgaggcaaagtacacatcgagagctgctgaactgtacaggcagatgcttaacaaggaggtcgctaagagtgccatgactgataatgccctgccatcctcacctgtcacatctgaggcttccaagccatccgatgatttccctgaattcaagctcccagatgtgccagcaccactggcagagaatctgaatgggaagcatgagccccagtcccccaaagccgctccccgt

SEQ ID NO: 11076 - DNA, 600 bp, Sorghum bicolor
  Clone ID: SORBI-28MAY03-CLUS8665_1
agagtatgctcagaagatgaattaccccattccatcttatatttgcactaagcaagctcgcggtgtagctcctttcatatgcaccggcggagattggtggcatacaatacattggtgctgccccgagaacaaagaatgcagcagagataaaagctggccgaactgctcttcttgcaatccagggtcaatggtggggttgtgcaaatggttctagaaagtacattggtggtcctggacgaaggcagagataaaagacagccgaaaaaccaactgtgcaacccaaaccacttaaagtgaataaacgtggttccaaaaggaaatggtacatgttgaaagacgtggggatggctagccaaattgttgatgctcaactgaatgtaccaaggcacggaatgtgaagacagtatgaccataaaggagctggaacaagaagatatgagtgaggatggcatactaaaatgttgatgctcaaaaggatgtagaggggcttggaatgcttctacagtatgaccatgaggaagctggaagaatagaatatgagttatctagagatactgcaatggttcaatttaacaaggaagttatagtgatgcaacctgg

SEQ ID NO: 11077 - DNA, 679 bp, Sorghum bicolor
  Clone ID: SORBI-28MAY03-CLUS86905_1
ccattggagggcaagtctggtgccagcagccgcggtaattccagctccaatagcgtatatttaagttgttgcagttaaaaagcgcacagcagcaagaacaagagcagcagcaaagttagggagagagattgatgatgatgaagaagggcggcgccggaataatggtggcggtggcggtggcgttggtcgtcctggtagcggcggcgtcgtcgtcggtggcgagggcggacgtgagctgcgcggacgtggacgcgaacctgcgggcctgcgtcgggtacgtgacgggcaaggaggcggccccgggcggcgagtgctgcgccggcgtgaggcggatcaggggcatgccgtccggcacggcggagcggcggcaggcgtgcgagtgcgtcaagcaggcggcggcggggtaccagccgctcaacgccgacgccatccgcgacctccccaagcagtgcggcgcgccgctgccgttcccgctcaccctcaacttcgactgcaccacaattccatgaattaccacatgaatgcagaggagtcatcctgaaaatggagaaaaataaagagaggggaagtacaaataagacatgttcattcgaaatgaactagctactcttgtaaacgcctctagtgtaataaagagagggaagtacaaataagaacatgtgcaagcagctttttatcc

SEQ ID NO: 11078 - DNA, 818 bp, Sorghum bicolor
  Clone ID: SORBI-28MAY03-CLUS8674_1
gctcgcggctgccttgctgctggtacctttattctggtttatttgtgtgcaaccttgtaatcgttttgtacctttccgcccgcctcgcctggaggtggctaggcgcccgaggccttgcccgtctccgccgggcggtctttctctgacattgcgtggccgtcctgccttcctaggctttctcccgggccgggggtagtccgtgtcccgccctccctctctggccgtccccggccgcctgcgcccttggtctcttggtggtcctgggggccgggcctcctgtcctgcctgggctgctctgcctgcgtgcacccatcaataagagataatactgattgcctgtcacatactatgcggctggaactggctctcgattatgagatttgaggttgtgttgccattgtctttgataatttcttcctttgcctgtttgttacgtgtgagcattgcctgtgatgacatactattgcttctgagcacatgccctatcccgatgattacattggcatacactttggttgtgtgcagtcacttttagtttacctatttctttgttctccccggcgcatggttcctctgcttgggggtgctccgacggcttcttccttggtccatctattgtccttgttgttatttttgcgaacattggtgatgcttggttggtacttggcaccaagggatgatgaattcaagattcacccaatgaacttcctgtccgactataaaccgtagacttacatgaccaatttcgtaaatgcaaagtgctatttcctttgtagcattaatttttccttgagcagtactgaaattgctacacccca

SEQ ID NO: 11079 - DNA, 450 bp, Sorghum bicolor
  Clone ID: LIB3476-052-P1-K1-E11
gcaccataaattaggtttatttgtgttccatgtaatgatcattatgtacctttccataggttacatcttgatgtctttagatgcctgaggcaatgctcatgacctaagatcactcttcctcttacatcttttttctatatcgacaacttaggcaatcaccatggtcagtgttggtgctatttttgccaactctttctagctgtcccatgatagcagaggcaatggtcaattggttgtctatgttttcttgcatctattcctgcctcatctgttttgtcacatactatgcggctgaaatttgctcttggttatgagatctgaggttgtgttgccattgcctgtgataatttttttgctttgcctgtttgttacgtatgagcattgcctgtgatgacatactatttcttctgagcacatgccctattccaatgattacattggcatacactt

SEQ ID NO: 11080 - DNA, 283 bp, Sorghum bicolor
  unsure (1)..(283): unsure at all n locations
  Clone ID: LIB3478-050-P1-K1-E11
cgtgtccctctctgcttctatgttcttcttcgtccgcatacacactatgtctcttggtgttcctttgggaaggtactgctgagcagagagggcttctcatcctgtgttcatccaaagtgcgtgggagatcgtctgacgtacatgggagacagacaggaacgatggctnggcatgggttgaggactagggagtgctatgctggtgggtgtggcaccaagggatgatgaantcaagatcacccaatgaacttctgtcgactataaccgagactacatgacaattc

SEQ ID NO: 11081 - DNA, 1168 bp, Sorghum bicolor
  Clone ID: SORBI-28MAY03-CLUS8195_1
gcacgaggcacaagcatatagttcgggcatgtgccttctctgaggacacccaccttttactcactggaggcatggaaaagactttgcgtgtgtatgatatgaatcgtcctgatgcagctccaagagagcttgacaaatcgcctggttctgtccgaactgctgcttggcttcattagtgaccaaactatattaagttcctgcactgacatgggtggagtaagactatgggatgtgagaactggaaaaattgtccaaactcttgaaaccaaggcatctgtcactagtgcagaagtaagccaggatggcaggttcatcactacagctgatggctcaagtgtaaaattctgggatgcaaatcacttcggccttgttaaaagctatgatatgccgtgcaatgtggagtcggcttcacttgaacctaagtctgggagtaaatttgtagctggaggagaagatttgtgggttcatgtattcgatttcttcactggtgaagaaatagcttgtaacaaagggcatcatggtccagtccactgtgtccggtttgcacctggtggtgaatcatatgcatcaggttcggaagatggcaccattcggatctggcagcttagcccggctaattctgatgacaacgaggcggccaatgcaaatggcaagacaactgctggggtgaacgaggttacaaccaagatagaaggcttccacattcccaaggaggggcagaccgaggggtaggacctcatgtgctttgtggtgcttgtggttcttattgcgaggagattgccctcagagctgcggtggttattcagtttctccctgcagagtcatcaacgcctgtttttgatccaagggtatcctggcttcatgagtcatcatcacagctctggggaaaaaccatacccctcataagcaaatggtggtgggtttttggatggggccctcgctttgatagcacatagcaactgtagtgtcaaaaataaacgagaatgcaacttaggtagtttagggaccgtgtctgcgttcattaaagtgaagtattctgtatctcagctggtaaccttgattgttttgactcgtttttttggctcactgtgttcaagtcccctaaaatactgagggcttcatttgtaaacttgtggctttggtggttggaacgccgatcttcaaagct

SEQ ID NO: 11082 - DNA, 1184 bp, Sorghum bicolor
  Clone ID: SORBI-28MAY03-CLUS82080_1
ctactggatggaggtgatggcattagcattaagtggtagtttggcaatggcagcggccacaaggtttccaggtttggtataaacacaaacacagataaagatggtgggtttgattggagacagggacgaggcagagcatgggatggggccatcaacaacaaaatttccaatttccgtttgcttgcccacaaaatggagggacttgtcaggagaggtatcaggcagagagaaggtgcctccctggtgaaacggtgatggcctgagagagctcagctggtgtcctggtgttgttgcttcctcccctgcactgcctcttccctggctccccaccgtcgcccttgcccatcatcatcatctctgtctctctctcgttatgcttttgtgtgtttttgcctgcattcttttctcagtagcaatattactttcagttgtctttgcaatagttctaacaaacactgcagtgcaggtctgcagcagattcccatagttctaacaaaaactaagcactgtacaccatttattccaccatgacgggctaccgtggcaaattatcccttgttttctgctaatcatacttaagaatcttcttctgccttagagtgtactttcaggaaggggaaaaaaaaaatatttgttcgatctgcatagcctgcatggacaattggacatcacgtcgctcctaatcacagagctcgacgctcaaggacgaaggagactgcccaaggtgccagcgatcttcaccatgccagacaggagaccgaacgtgagcttccgatgcctcggtgcccaaagagccggatgaaaggcgagaaacgaggatcccatcagtgctcccgaaggttactctgctgaagttcgtcaacaaccaaagatggcttcgagaagaatgattaggaggggcaaagcagccatagtctcagagtggttcatctttcccggcttttccaaccaactttttcatcttagtccaattcaacacccggggattgagatggatacgagtaatatcggaagtcccagtacaattctattcttaacatttaatctagatctaatgcgcggcctaagtttctgcccgcaacataagtttctaagaattggctcctgtcgaacggactccgtatgcccgcatcctctcatacttcagtatatataatacaatgctgaaatccagtgttgagtgc

SEQ ID NO: 11083 - DNA, 1111 bp, Sorghum bicolor
  Clone ID: SORBI-28MAY03-CLUS82465_1
aactccttccccactcgcgctcagcggcgctcaggctcggctcggcggcggcgtcggcgtcggcggctcccccttccgcctctcgccagtcgcctcgcgccctcgcctccgtcctccgcgcaccggccggcgaccctgcgtacgcacctccctctcccctcccgcctctgctgtaccgtgggagcccggccagctgcccagggtagccgggccttggctccgccggtggtggtgcctgctccgtgctgcccatgttgcttggctattgcaaaaatttcagctttgctctgggctgtggcatctgtcacccacgagattaccacgctctagataacggatttaccccctattagacggctacaacaattctttgcttcgggtttagaggcacatcatgtcttcaggggagctgagaactagctttccagatttggctgtgggttcgcctgccttgacagagggccaaactaaatcttcaggtgacttgtcatccgagggggcactgcaagtaacttgtttcacagaggaccttcatgatgtcatacttcattttcagatagtgaggttcgctaaacagatctatgtgtgggttggatgcaacacaacaaagtttggccatttatatgctgctgcaaccactaggccggatagcagagtgagtgtcacctctgtactaggtggaacatctgataacaccggatcaagcatggcccgccgtctagtgctgaagactggtctgaacatagtcctggcatgcaacatcccaaaagacagccccatgctggaggctgctgcggagaggaagctggtggagaagctgaaaggtttgggttacgtcggaaccgctgctgataaggctagcacttccactgcacattgatgcgttgtgtgattttagtgacaagtgcgtgagcattttgtcaaagtgtagtttcatcattaggtgcaggagtaacactttgtgatatttgctgggctcagttgatggggaattgttctgtaaggctcgtgcgcaaagctggcctgcgatttacgtggatgctgagactggaatggatggaacgtgtacagttgtaacacctcagaaatgcagactgttcggtgatttcct

SEQ ID NO: 11084 - DNA, 1144 bp, Sorghum bicolor
  Clone ID: SORBI-28MAY03-CLUS8180_1
aagctatgcagtaaacaatcggcaccacttccgggtgccgccgcccattttcctgttgccttcgcttctcatgtgacattccagagcgatacatgttttaacaatcgctggtttatttccattatgcaacatgttaggctacaggatgaaactcttttacagctatattacgaaggtctatcattcaatggttgatttcaaaatacatcggcctatgtacccttttctctttcgtgttcaattttcttttgttggaccatgctactcgctgtctgtttagagctgcatcggactgacttcacaagacaaggaaggtttttgaagggtgggtttgtagtttcacctgactagatactgatgcttcatctataaagattcttcctacatacctttggtcaattttctattagaattggaaacactgatacaggttttgtgatgagcacaggaaagactcttctcaagattcacccgactcctacacgttgccttcttccaccagcttgcaacaatcaaagaccacatccaagacaaatggagaatcacaacctcatatgctacacggtgaaacatcaacatctgcaccatatgcctacacttatgtagtgtaaccatcctataaatatctatctgcctcacgacctcactgtgtgtacatcactagaaattcctaagctatgcagtaaacaatcggcaccactaccgtgtgcctccacctatataatttttgcatactgtaaatatgtaacaatcaaggtactttaactatgtaaatgaccagcgtatgtagcatatagattttgcatgtatgaaccaaaacatgctccattgcccttgcgcgcccaagggcgcgcgctttccactattgcttttatacacagacgatgaagcaaactcggcactacaaaccctaggtataacacaggctacccttgtaaataccagtttctacttccagggtctttaaacatatataaaataagccctcctcatacttactttcaaataacattatcatgtcttagcagatgatactacatactgggcacgaagcaactcaatggagtatgagccaggctgcgaatccgaccgcaacatgaattactgattgctcttacccttttccaccatttcagtattctac

SEQ ID NO: 11085 - DNA, 532 bp, Sorghum bicolor
  Clone ID: LIB3476-045-P1-K1-B1
cccacgcgtccgcccacgcgtccgtgatgcttcatctataaagattcttcctacatacctttggtcaattttctattagaattggaaacactgatacaggttttgtgatgagcacaggaaagactcttctcaaggtatgtccatagtccttgctactcccagataagtttttaaaattagtcttagacaatgacaggatggaattgtttagtaaaatattattgttgattaaataatagaaacagtgggtgtcatatctaatatttcagttagcactatattttccttttagtgaaacaatacatgatgtcttcttttcattcactaaggtaggatcttttttcccctcaattctgacatgtacatccaaatctatccaatatcaacattgtcttcatcaatgttgtttagcctatcccttgctctcttagtgctctttctcattgccgtagttgttgtggacagattcacccgactcctacacgttgcattcttccaccagcttgcaacaatcaaagaccacatccaagac

SEQ ID NO: 11086 - DNA, 601 bp, Sorghum bicolor
  Clone ID: SORBI-28MAY03-CLUS8297_1
agcggacgaggccaaaggctcccccaacccaaccgttcccccgccctcgttcctttgctcctcccttccttcctcgggaagcctagggtttagggcttcaaccgccgcgatgtacggcggcggcggcgggcactacgacggcggcggtggcggtggcgccgccaacgccaactcgctcttcggcggcgggggcttcatgccctcacagtccacggcggtcccggagagcagcggcctctccaagggtcggagcgcgcagacgctgctcccgctcaccgtgaaacagatcatggacgcggcgcaggccagcgatgacaaatctaatttcgccatcgacggcgttgaggtgtccacggttaggcttgttggacgcatgttgaataaggttcaccgtgtcacagatgttcaattcactcttcatgatggtaccggcaagatagatgtgaatcgttgggaaaatgagccttccgacgctaaggaaatggctgatgtcaatgacggggactatgttatagtcaatggcggttcaagggaaaatgagtcttccgacgctaaggaaatggctgatgtcaatgacggggactatgttatagtcaatggc

SEQ ID NO: 11087 - DNA, 1248 bp, Sorghum bicolor
  Clone ID: SORBI-28MAY03-CLUS89977_1
gcgcgcgcacgggaaagaatcccaaaagcaaatcacgcacccaccgcccaccgccaccgcacgccatgcggccgcccccttgctaaccacggcgccgccgcctgccgccatggccgccgccgctgactcctctaagcccgcgcgcgccgccgtgctccccgcccgcccgctcctcctcgcgctccccttcctctccctcctcctcttgctgtaggtctactccccctcctcccgccctgtcctctccgcaacatccgtcgctgcctccaccaccaccaccaccgtcgtgccgctgaccccatccccgccgaccccacacatccggatgcggcgttcccggtacgcctcctacgacgactacctccgtcaccagctcaacaagacgctggacccgcgcctccgccgcgtctgggcgacccgtgactggcaacggaaggtggacgccttcgcgcggctcttcacgggtctgcgtgccgagggcctcctctccacccccccccgcgcgccccgccccggcccgcggctaggcctgctcgtcgccgccctgccgccggtgggcgtccgcgacgcgctcggcatcgacctcgcgcccgcgccgccgcgcgtcgcgcgcggggacttccacaaccagccgttcgacaacgacaccttcgacttcgagttctccaacgtcttcgaccacgcgctgtacccggaccggttcgccgccgaggtcgagcgtaccctgcgccccgggggtgtcgcggtgctccacgtcgccgtgcaccgccgtggggataagtactctgccaatgacttgcttgatgtgcgcggcctcgttgggttgttcccaaggtgcgacgttgtgagggtgtcgaaggttgatgcgttcgggctcgacaccgaggtcatcctccgcaagaagaggccgtcgtctcgtcgtcgtcgtcgtcggcggcggctctagccgtgcggacatccatccgttcttctgttgggtgtggtacttgggtcctcaagaacagtcaccggccgaccacacgatccaatcttggctttggcttgcaaattacgccaaagaaaaaaagggtaattttaggcatcgatttttgtttttgttttttactagtactgattgtggccttgtaattctaggtactaaggtaggaggtgattttttggtgacccaccacaacagtacgcatcccatccatcttgtattcttgctcttgtatacctaggcagcgaattggtagcaataacagttga

SEQ ID NO: 11088 - DNA, 974 bp, Sorghum bicolor
  Clone ID: SORBI-28MAY03-CLUS9058_1
cccacgcgtccgaacacaatgagcttgtcgcttctccagggctactcctccgctgaggaggacgacgaccccgccgccggcaccgagctaagcgagtccggtgattcgtcagccgaggaagccggatcggacggagacgaggggtccgctcctcaaaagccggcccccaagccccgccgccgaccaaaccctaaggggggagatgccggaggcggcgacggggactcctcgctgccctccgcgctggaggccttcgccgatgtctcgggaccaccggactttctgaggcatagggttgccgagcccgaggaagggacggaggccctcggtgtactcgatcgccgtgggaaagaggggagcaagcacccgcctccaggtgctgttgtggtggcgaaaccgcagttagttgccatccgcgagcgagttaccacaactggagccaacccctcaggttcagtgacatctggttctgttgatggaaaaagaataataggtgctgcaaatcctgggccagaagatgcagctgatcttctgaggatgtgtctccaatgtggtgtaccaaagacctattcacatggtaagggtatggtttgccctcagtgtggtgatagccctgtgcagacaaaagagcccgaaaagaaaaagggttcccctgtcaaggacaaggagaagatcaagaggatgagggggcaatcgtcgcatgcatcctggaagagtgaaacggagatggctcttcggcagcaatttgactgataactagttagcatggccaatatttagactgagtgcttggtaaactgtacgctgggtaaacctttttaagcctgtgtagtgtaccatatgatgccccttgtgcctcacacgaagttccagagagcgagagtgtgtgttgtatgtgctgcatttttctgctaggaacgattttgtttgttaagctgtcagaattgaatctgagcatgttcgcttgagctttc

SEQ ID NO: 11089 - DNA, 760 bp, Sorghum bicolor
  Clone ID: SORBI-28MAY03-CLUS9048_1
cggccggatccggtcgaccacgcgtccggactagttctagatcgcggccgctcgcgatctagaactagttcctgacaccgaagtacctgagccagatgaagatcaagatgatccagatgaacggcatgatcctgactctgatatggaagtggatgatcacaaggctgtggaagagtcagcgaggaggagcattccaggtataaaagttaagagagaatttggtgaaaatgagaccaaagtgcaggatggtggcagaattgcatctgaccatagaggagtggaacccatggcagaagacattggttcttccaagcaagctcctcaggcggatgccagtgcgatggctgttgatgagccaagcaatgttaagaatgaacctgagagctcaactaaattgcaagatcaagcagctgcataccacaagccataactgcgacatctggagttgccgggtttctgctgggcagcagcttcctgcgtgcttttgacagtccgaagaccgaagtgaatctgcaatacaaccccgccatttcaaatttgacttgagctataccatacctatctgtatgtgtaatatgttaatgtgatgggattccatggcggggtagtgcagtttccatgagtccacctgggattgcttgaggttgacgaggtaaacggtagtctgacccatgtatacatgaagcgtatgagttaagttgtacagtcattagttaatgcaaatatgcagtaaacttctgggtaaaatctttgcgtgtga

SEQ ID NO: 11090 - DNA, 688 bp, Sorghum bicolor
  Clone ID: SORBI-28MAY03-CLUS9180_1
cgtcagccttatctccataccatttcaaaatctcctctcctgaacctctcctttctctgttgatccggtggcatctcctcctttctctcattctctcagatccagattggctgctcatcgaggcggagggcttcagtcggcggcgatccctgccaccgcggcctcctcatccccaacagcggcggcacctccttcgccccctcaagcatccacgactgctactccccgaccggcaaccgcgacgctcctggtggccgcacggctaggcccactcggggaaggctacggcggcacgatgcaccatcagcacgtttgctggggcccttccgttccaacgatggcggcgcccttcgtgtacggacacgccgcgtgcagggcaatgctgtccacgccggattgcatggcctgcctccgctccatcgtgagccatatggacgcggcgccagggccgtgcttcttgactgcagcttgcgctatgagcagtacgtgttcatggattaattaactaatccagtgccatgcccgccggtgcctccattgcccacccgcttcctcctcatgcaagtatggattgaataggcaacatgtgggatcagggcagcattaggaggcgacctgtgatttcctccacctcccttccaaatccggtgttgaatcgagaagcagatctgatgctaactcatttatt

SEQ ID NO: 11091 - DNA, 771 bp, Sorghum bicolor
  Clone ID: SORBI-28MAY03-CLUS9182_1
cgcaaaacttcccttcttccaccagatactagaaaggctgcatatcttgctgtgatgcgaactgttagcacctcaaacagatccggttatgatgctctccttaaaatctacagagaagcatctgaaccacaggaaaaatcacgtgtcttaggttccctgtcttcatcaccggataaggatattgttttggaggcattgaactttatgtttactgatgaggtgcggaatcaagattcattttacatccttggtggtattagcttagaaggacgagaagtagcatggacctggctgaaggaaaactgggattacgtgttgaagacatggaaatcgagttcactcatatcagacttcatcgagtccattgtcccaccgttcacctccgaggagaaagctaccgaggttaccgagttctttgctggccgcatcaagccttcattcgagagagcactgaagcagagccttgagagggtgcggatcagcgcgaggtggatccagagcatcaggagtgagcccaagcttggtgagacagtgcaggagctgctgcaggccgaggcgtaaacatgtggccctcaaggtagctgtccctcagtgcgatcatctcataggagtcccgctggacgacaatgtttttgaaaaggttggcagttgcttgcgttgcgtatgatctgttgccggaaaaaatattgtaatgacgtttgtttcagagtggtgtgctgattatagtactattgacagtaataaagaaactaaagggatgtttagtccgtt

SEQ ID NO: 11092 - DNA, 710 bp, Sorghum bicolor
  Clone ID: SORBI-28MAY03-CLUS92704_1
ggttcagtggtacatacacctacaatggtgaggaatatgaagcaacagcgccaccggaaggcgcatcctatgatacatgtagagacgaagcaatcgcagcactaaacataggtgcccactgcgaagcaaagaattgcaccttcaatggcgtgtggaatggaggcggtggcgccggtcaggccgacctctacgtcgcgtcctacttctacgatagggcctcgcaagtcgggatcatcgacggcgacgcgccgaatggaaagagcactccggccgcattcgcagatgctgcgctcaaggtctgctcctttagcattgacgatgccaaagctgcgtaccccaatgcatgggacgcggagtacctctgcatggaccttgtctacgagtacacactgcttgtggacggctttggtttggagccgagcaaagagttcacgctggtgacaaaggtgaagtacggagaatactacgttgacgcagcgtggccgctaggcgatgcaatagaaaccttgtcgtcccagaagctgaaccaaatcgcatgatcaataatgcttaacacagtgtctgataaaaataatgatgtttaaataatgtactacagttgatgtaatgaagagacaaatgaactctttacttgatcaaagctctttccatcgaacaaatgtttatggaccagcacattctgatagcaagcttgcttttgtcacctggct

SEQ ID NO: 11093 - DNA, 913 bp, Sorghum bicolor
  Clone ID: SORBI-28MAY03-CLUS84635_1
taatcttcaagctgcgtacgctgctgctttcaagaatatcagaccaagtgctgataacttgcccgaggagttgtcagaaatcctaacatcctgctggaaggaagacccaaacaacagaccaaccttcacacagatagtccaaatgctcctacattacctatccaccctttcgccacaagaaaccttggcccctcaccgcacattcagttcggagaacacaatccttcctccagaatctcctgggacgagctcactaatggcttctcggggtgacctcggtgagacaccgaagggcaagatggaagacaagccaaggggcttctttttctgcttcagtgagtgctattagcacagccccaaagggaactctgagaagttgcaaatactgaatgaacatcgtcccctgatgccctgtgactctaccatggtcagtcgatcaagtctcggcatccatagtccataccctgaagaatggaagtgtagttgaactgttgtttctgctaatcaggtctcctgcatcactgacatgttgacatatcagcagggtaaaacgggtaaccttttgactccagatagtaatgatggaaatagcttatccctgtattttcggcgcaccatgtattgagttactaagagtgcgactatagatttccacctgtcttgcctgccatcgtatagaaataaatcaataattcacatttattggtttgtctgctgcaaaggatactggaagctgtcagttctgtggagcactttgtgttcttgttctggcagtggtttgtgttcttggaggacaagacataggactttaggctgcaagatttgtgtaggagaaactgttgaagcaatgtgtttgtgttgcagcactgcagcagcagcagccgctccagcaattattttatgcacataattt

SEQ ID NO: 11094 - DNA, 707 bp, Sorghum bicolor
  Clone ID: SORBI-28MAY03-CLUS84949_1
cagccccgggctagccggcttcctcaagagccgctgcccggccaacccgacgagcagcggcaacgaccccacggtgatgcaggacgtggtgacgcccaacgccatggacaaccagcactacaagaacgtgctgtcgcacaccgtgctcttcacctccgacgccgatctcctcacgtcggcgcagacggccaagctggtgctggacaacgccaatatccccgggtggtgggaggacaagttcgagaaggccatggtgaagatggccagcatcgaagtcaagaccggctaccaaggccaggtgaggaagaactgcagggcgatcaatcactactagctacatattgatcaacttgccgcagtgcaatgtggaacaccttgagaaaaaaaaaactgcacggtgaggatcagtcggtccaggttgttgttggtgaaaaaaagtgcacggtgttctctcaaaaaaaaagtgcacggtgattggtgaaggatcaatcggtccaggttttgttaattgttggtgtttaatttgttcatgagctgcaagcgtgttgttgtacgacatggcaactgttgttattttttttggtgtcttcttcatttgcctatgatttgttcaaaacatggagagttttgtatctgttatatatattctttgggttgtgtttcggtatttgggttgttattgtgaatataaagtttccccagttcag

SEQ ID NO: 11095 - DNA, 1114 bp, Sorghum bicolor
  Clone ID: SORBI-28MAY03-CLUS85627_1
ttctggaaaacgtcaaaccagcgggggcgaaaggggaagaaaaaataagaaaaagaaaaatggcggtgctactccgccgcgccgcggccgtcgcagcggcggtcctcgtcgtcgcggccgtctgcgcggacggcgcctccacgttctactcctccgaccccaacctcgggtccgcccgtgtcgtcttccagacaaattatggtgatatcgagtttggcttctttcctcatgttgcacctaagactgttgaacacattttcaaacttgtgcggcttggatgctacaacacaaatcacttcttcagggttgacaagggtttcgttgcacaagttgctgatgttatgtcaggtcgaactgcccctatgaatgcagagcagaaaagagaagcagagaaaacaatcattggtgaatttagtagtgtcaagcatgtcaggggaatcctctccatgggaaggcactccgatccagacagcgctggctcttccttttctatccttctgggcaattcaccacaccttgatggccagtatgctgtattcgggagggtcactaaaggtgatgatacattaagtaaactagagaggcttccaacccggagagaagggatttttgtaatgccgatcgagcgtatcgacatcctatcaacttactattatgatattgatgtggagagctgtgaagcagaaaaaactattcttcggaggagactttctgaatcagcatcagaagtggaaagatggagaagaaaatgctttgcttaatgctggaattagaatgcaggagcaggactacaggttccatctggggctggatggctggagcagactacggacagtaaaaaggaacccttgaacgtgcatgctgtgtgctcttatactagcgaagtgttacatgagtcgatgctatcactgtgatactgaagtggatgggtcctaggttccatgtggatcttgtttgttacacatgagcagagttgttatataccggttacaataaacctccaattcgttttccttttttctttatataaacaatgtatgtatgttaattactggcagacacatgtaacatctcagggggaaaaaaaattactagtgcatgaatggctttagtg

SEQ ID NO: 11096 - DNA, 625 bp, Sorghum bicolor
  Clone ID: SORBI-28MAY03-CLUS84696_1
ggccgtggacgggttctgcatgtcccggtgcggcacgcacggcgcgtccccgcggtcccgctccggccggttcgcgtacgtgtgggtgggcaacccggcgtcgcagtgccccgggcagtgcgcgtggccgttccaccagcccgtgtacggcccgcaggcggcgccgctcaccccgcccaacggcgacgtcggggtcgacggcatggtcatctcgctggcgtccatgatcgtcggcacggtcaccaacccgttcggcaacgggttctaccaggagggctcggctgacgcgccgctggaggccgcaacggcgtgcgccggcgtgtacggcaagggcgcgtaccccggctacgcgggctcgctgctggtggaccaggctagcggggccagcttcaatgccaacggggcccatgggaggaagtacctggtcccggcgctcgtggacccggacacgtcgtcgtgcgccacattggggtagatttcgctggtcgtaattaacggttgtgattgtgatgaggcggtggtgatggggtgtggagagtgttccacgcggctaaaatttgtactttgtagtagtgtccatggtggattctttcattggttcaatgaaaatgaaatatttccacgc

SEQ ID NO: 11097 - DNA, 815 bp, Sorghum bicolor
  Clone ID: SORBI-28MAY03-CLUS9787_1
caacagaattgccagtaacttcaaagtttggatccctgtgcttccacgcgtccgcggctgtctaagcatgacaccgcaggccacgcagtgcgcgtggactcttctgccgagcggcctgcaactgcaatagagatgccgtctgcgtcggcatcggcgccggcgtcaccccagcgctataaatccgtcacctcgccccacccacccgccgtgccgtgcagggcagtgctctcaagtctcatctgcgtacacagtctctgtctgtcagtcagtagttgagtgagtgagtgaggcagcggcgaggaggatggggaagggagcgcaagggagcgacgcggcggtggcggcggcggcggcggctggggctggcgaggtggaggagaacatggcggcgtggctggtggccaagaacaccctcaagatcatgcccttccagctcccgccccttggccctcatgatgtccgcgtgcgcatgaaggcagtggggatttgcggcagcgatgtgcactacctcagggagatgcgcatcgcgcacttcgtggtgaaggagccgatggtgatcggacacgagtgcgcgggcgtgatcgaggaggtgggcgccggcgtgacgcacctcaccgtgggtgaccgcgtggcgctggagcccggggtgagctgctggcgctgccgccactgcaagggcgggcggtacaacctgtgcccggacatgaagttcttcgccaccccgccgagtagtcaggaatcgaagatttggatcagcctcggcgttttcttcccccttttgggatggaattagggcatgttcttcttcttttttt

SEQ ID NO: 11098 - DNA, 1066 bp, Sorghum bicolor
  Clone ID: SORBI-28MAY03-CLUS982_1
aaaaggagtactcctccgtagactacgacatcgtccgtcgaggcggcgaggaggcggaggcggaggcggaggcgaagatgaggaagaagctcggcacccggttccccgcggctcgaatcaaaaagattatgcaagcagatgaggatgtcggaaagattgcactagcggtgcctgttttagtctcgagggctcttgaattgtttttacaagatttaattgaccggacttatgaaattactcttcaaagtggagcaaagacactgaattccttccacctgagcccgtgggtgaagaggtacagttcttttgatttcctaactgaagttgtcaacaaggtaccacatcttggtggcgctgattcctgtggagatgaaagaggattacctacaagaagaaagtcaaatggcagtgacccacagaatgatgaatcaagatctagtaaaatggtcataagaaatgcaaacatcagccccagaggacgtgggaggggtcgaggcagagggcgaggtcggccaccaaccaagagaaaggaagttggttatgtgcaatttgaagatgagagcagcatgtttgctgaacaaggtgaacccttaccaggagaggaaacagttcaagagatcaacaatggcaacgagatcatgcctcaaagcacgcaacctccagtagaggctccgccaacagcccctgcacaagctacaagttctaaggtggaagaagcgaacaccaatcatcagtcagattggcctatgccagatgccattggaagcatcggtgtcggtccgtctggttttgggcatctgacagtgcaggtcgatgaagacgaggactacgacaatgaggactagtcagggccattctcattgtatgcactaacaggactgttctggtgttgtaaaatgtaaatatagtttgaaatagttgcccgcagcttagctgtgattgtctgttgtgcggttattatgtagtactgtgtaacttctgtttttccaataattgcttggtagttgctttttgtttacatgatcgactgtctaagcgttttgtcatatttaacaccgtaatttga

SEQ ID NO: 11099 - DNA, 477 bp, Sorghum bicolor
  Clone ID: SORBI-28MAY03-CLUS98916_1
gtcgtcgtcttcgtggtccctgccgctgccgccgcaggagtcggtgcggtggcggtcgcggcgtcactggacctcagcctggcgctgccggctgatgcggcggcggccgtgaagccctaccagctgttcatggacccgacggctgcgctggcgctgcgtcagttgttgccgccgaggagcgaggaagagcggaggagccgctccgcacggtggtcatcgtcgtcgtcgtcgtctgcggggcaggtggtgggcttggggcttcttgacctcaacctgcccccgcccgtcgagatggtcatgtagtagcgaccgaaatgagcatcaccaatttcgaaggtgtcatcagccaggcagctaccgtgtgtaacaccaatgtaaataggcagctgttactgttagctagcgtgcttttgtagatcactcttttccccgatcatgcaaggcaagaacttccagcaaaaaaaaaaaaaaaaaaaa

SEQ ID NO: 11100 - DNA, 656 bp, Sorghum bicolor
  Clone ID: SORBI-28MAY03-CLUS991_1
gcacgagcgcgtcgccctcgagcccgagcaaaggagaaaggcggacgcggcgccggcggcggagcggagatggcggagaggaagcgcggcgccggcacccgcaaggatgaggtggtaacccgcgagtacaccatcaacctccacaagcgcctccacggatgcaccttcaagaagaaggccccaaatgccatcaaggagatcaggaagtttgctcagaaggccatgggtactacagatgtcaggattgatgtgaagctcaacaagcacatctggagcagtggtatccgtagtgtgccgaggcgagtccgtgtcagaattgcccgcaagaggaacgacgaggaagatgctaaggaggaactctactccctggtcacagttgctgagatccctccggagggtctcaaaggtttgggaactaaggttgttgaggatgaggattaagtcctcgatggttcaattgtctagcacttaatggataccatgagagcaaatttaagaatgctgcttcagattattgttatctactgccgatgacttatgtaatagaagattcgagactttgctcctttcaagtgcttgaaattttgactactttgctatgtctggtatctaccccgtacattgcattctaaatataccctgcctttctgtctgtc

SEQ ID NO: 11101 - DNA, 923 bp, Sorghum bicolor
  Clone ID: SORBI-28MAY03-CLUS99177_1
ccccgacgctcatctctctgcccctgacgcccatcgtcaagcagcctctgggccccggctccgaccccccaccctcttgccctgccggccctgtcggcgatcgcctgttcccccggcaagcccctttgatgcccccccgtcactccccatactcgcgcggcgtcgccttcctgaagattcagttccccacggactaccccttcaaacccccgaaagtccacttctctaccagaatctaccaccccaacatcaacagcaacggcagcatctgtctcgacattctgagagaccagtggagccctgctctgaccatttctaaagttctgctttctatctgctctatgctcacagacccgaaccccgatgatccgctcgtgcccgagattgcgcacgtgtacaagaccgaccggccccgatacgaggccaccgctcgggagtggacccgcaagtatgccgtctaggcaagatcaaacggtttcttttggggggtttgatggcgctgggtgtttgacgtcctctatcacgaaatgacggtgcggcatgtttggcgacccttttgcgttgtaaccggtcgagtgggatggtagtgggaagcggacagaccaagcttttccctttgctgttctatcattccttcaagcacactgggtgaatgatgtcaggggcgagccgcatggccggcggacaggtggcagactagacagatatatccgctattctaagggcttatgcggctggttaactttgggtttgcagcgattattaggcaatgagcgacggtacgaagcgacctgaggggaggaacaactccagacaaacagactagtttaggcagggatatcatgcggctggatggatgttgggtttgcattgacgagtgtttttggcatccagaaacaagcagcgtatacaatttttttttt

SEQ ID NO: 11102 - DNA, 860 bp, Sorghum bicolor
  Clone ID: SORBI-28MAY03-CLUS102053_1
gcacgaggccgaggcccatctcctctgccgcgtgcgactcgcgcttctcctcctcctcgtttgctcttggtggctcctcccccggtccgatgccaggaggacgctggtggcgccggggcttcccatccgcgctgtgaacctcggcggctggctcctgacggagggctggatattgccatccctcttcgatgacattccgaacaaagacctactggatggcacccagctccagttcaagtccgtgacacagaacaggtacctcgtcgctgaccaggggcacgaggcggccatcctcgccgaccgggtccaggcgtccggctgggagaccttcaagctgtggaggattaacgagaccacgttcaacttgcgcgtcttcggcaaccagttcgtgggcgtcaacagcaccgccggagtcgtggcgacggccaacacgccggggccctcggagacgttccagctcgtgcgctggaacagcgacaagagccgagtgcgcatcagggcgcccaatggcctcttcttgcaggccaagaccatggaatcggtgacagcagaccacaaagaggacacagactggggtgacgatgacccatcagtttttctgacgaataatgtgggcggcttacaaggggagtaccagatatgcaacggctatggcataacagaggcgacacaagtactcaggaaccactggagcacatacataaatgagagcgactttagcttcgtcgcatcaagcggactgaacgcggtgagaatcccagtgggatggtggattgccagtgacccctaccctccacatcctttcgttggaggatctctccaggccttggataacgcattcagctgggcagagaagtaca

SEQ ID NO: 11103 - DNA, 680 bp, Sorghum bicolor
  Clone ID: SORBI-28MAY03-CLUS8830_1
cgcggggtacgcgctccccaacgtcgggcagctcctggcgcccggcccgcccacggacaaggcggtggtcctcggcgacggcgacaccaaggtggtgttcgtggaggagggggacatcgggacgtacacggtgctggccgccgacgacccgcgcgccgagaacaagacgctgtacatcaagccccccgccaacacgctgtcgcacaacgagctgctgtcgctgtgggagaagaagaccggcaagacgttccagcgggagtacgtgcctgaggaagccgtgctcaagcagatccaagagtcgccgatcccgctgaacatcatcctggcgatcgggcacgcggcgtacgtgcggggggagcagacgggcttcgagatcgacccggccaagagggtggacgccaccgagctgtacccggacgtcaagtacaccaccgtcgacgagtacctgaaccgcttcctctgaagtctgaaaaaacaggacgacgatgtgtgatgtggacgtcccaatcgtgatgatgagttcgtcagctgctactgctagtcactagcgacgacgtgtgtctgatggatctagcgtgcctactttttgttgctttgagggatctagcgtgcctgcttgttgtaatggcctcaccttttcctcgattctacgccaatataataagaacccggcttccttc

SEQ ID NO: 11104 - DNA, 628 bp, Sorghum bicolor
  Clone ID: SORBI-28MAY03-CLUS8825_1
agtgcgttcggttctgtaaaaaatccccttctctgtactcctgcatctcgaccgcaccggcggcggtatcaacgatggtggagctgctgggccggcggatcggggtggcggcggcagctgccgcgttcatcgccctcgcggcgttcggatccgcctcgtcctcgcccaaatccttcgtgaagtccaccgtctccgcccacgacgttgtcatcttctccaagtcatactgcccgtactgcaaaagagcaaaggccgtgtttaaggagcttcagttgaagaaagagccatatgtcgtggagcttgatcagcgagaggatggttcggagattcaggatgccttacgtgacatagttggcaggcgtactgttcctcaagtttttgtccatggaaagcacttgggaggctctgacgatactgttgacgcttatgaaagtggaaaactggctaaacttctgaacattggagtcaaggatgatctttgagtgacattctagcatcagtggtctcttgttttgagttatcagtggatttttatgcgactctgattaacatataaatgatatgtaactgaatgatttattatagtttataccctttgaaccaaaaaaaaaaaaaaaaaaggccccta

SEQ ID NO: 11105 - DNA, 831 bp, Sorghum bicolor
  Clone ID: SORBI-28MAY03-CLUS8757_1
gcacgaggctgcgctctcgctccgtccctctgctcaagcggccaagcccgctgcccgcccatggagacctcgctgcgcctgcgcagtggcggcggcctccgcatccacgccaaggagaagctgcccctcggccacagctcgctgctgcaggctcatgcggagctcgacctccacacaagccccgccggagttactgccccgagttacctcgctctctttgtcaggcacttctacccccagctatcagccaacctcggaccttattgtcgggcttaataatgtattcatgcgcccgcgcgaaagacagtggaagaggaaccctttgttgggtgtggtgtggtggtggcatctctagtgcctgaagaagactgaaatctgaaaaggcctgagtgagtgtgtggtaggctagtttttttttttttgaaccaaagccaaaatttattattagcagcaggaggctgcaatatttgggactgagtcgctggcgtccagttgcacaacggcgatgacctcacctacagccttcgcgccaagaaggccgtcctcttcagaccagacaatggctttctaggcctaaacctcaaaggacgcctacttatcgacaaagagttcaagccgacaaagacatctggagccgttgaattggcctggaccatacttgacttcaaacagggccaagatgtaaggctcaaagttggctacgaattggatgacaaggtgccttatttccagcttagagaaaacagttggacgctgaatggctatatggatgggaaattgggatgttagattgaaatgtgatgagaatccacttttcagtagcattattat

SEQ ID NO: 11106 - DNA, 552 bp, Sorghum bicolor
  Clone ID: SORBI-28MAY03-CLUS8855_1
cttgccttcgcacgaggtctcgctcccctcctctcctttcgcatccccatcgcatcacaccacgactccacaccgccggttggcttcgctgctccgacctcgatcttccacctcccgcctccgcctcgtgaagcgcgtggggactgggcctctggggttcgcctctcggcgcggcggccgagtgcctgcgtcctctacggagagggatcggcggcggggatggcgagggagcggcgggagataaagaggatagagagcgcggcggcgcggcaggtcacgttctccaagcgccgccgcggcctcttcaagaaggccgaggagctctccgtgctgtgcgatgccgacgtcgcgctcatcgtcttctcctccacggggaagctctcccagttcgccagctccagtatgaatgagatcattgacaagtacaacacacattctaaaaacctggggaaagcagaagagccttctcttgacttgaacttagaacatagcaaatacgcaaatttgaacgagcaacttgtggaagcaagccttagactcaggcagatgaga

SEQ ID NO: 11107 - DNA, 866 bp, Sorghum bicolor
  Clone ID: SORBI-28MAY03-CLUS8939_1
cccacgcgtccgaagaaaaggaccttttcgatgcacttgctaagctttctgaagtatcatatgatgttgtttatttcggtgctgaccataaccatcggtcggtcaacctcaatgagcacgacaatggcaagggcgatgaggcagtgctgttaaagcttgtgagttcaagtgacgagatgtcatctgagattaacaaggtaaagatccagggcgttgcttccgtccccctcagctgtgaccctcaccggtggcactgccagcttatctccgctcctcctagcgccgccactgctcgtggctgcgtcttccgcctctggcccactgatggccgtggggttgaccttcgtgccctcggctctgtgcaagaagcggtccttaattgaccaagctcacggcggagaggagaggatgctggagttcgctcgacactttaggtggcgcatccacaaggccagtgcggaagctattgacgccttttgcgcccatattggtgtccccggaactggatgagcaaaaacatgcacctcgcctccacgctgatcgtgcccgtgcgtgggaggttccaacgcctaaagctcacggcggaccaagcctaaagttcagagtacaaaaatttgggaacaggaggttccaacgcctcaacaagctatttgattgttgtactgtccaatcattttttaatatctaacattatctttattagttgtttttggaatctctaatggtgtgtgatctactgcgttcaaataatttgccctcaaatccaattgatagcctaatccaaccgctctgcgggatggtatggagatatggtgaaacttattcatggatttactgacgcatgaaaaaataaatattggagattt

SEQ ID NO: 11108 - DNA, 1060 bp, Sorghum bicolor
  Clone ID: SORBI-28MAY03-CLUS100758_1
tcgcgacctccatcaaattccaatcccatctgcacggagaatcgactaatggcggaggaggggtacaaggtgacgctgaacgtgtacgacctcagcaacggcctcgcgcggcagctgtccacctccttcctcggcaagcccatcgaggccatctggcacacgggcgtggtggtgtacgggaacgagtactacttcggcggcgggatccagtcgtcgcccgccgggacgacgccgtacgggcggccgctgcggacggtggagctgggcgtcacgcacatcccgcgcgaggtgttcgaggactacctccgtgacatcgcgccccggtacactgccgagacgtaccgcctcctcacccacaactgcaacaacttcagccacgaggcacgagggttcctcgtcggcaccggcgccggcgtgcccgactacatcctcaacctccccgctgaggtcatgtccagccccatgggcccgctcatcatgcccatgatccagaacctcgagtccacgctccgggccaacaccgcgccgcaggccacgcagttcgtgcccacgcccgcatccgtctctgcgcccgcgcccgctcccgctgcggctcctgccaagcgagaagcgccggcgccagcgccggcggagaaggcttcgaaggaagctccctcttctgctccagcgcctgctcctgccgctgacccgctcgggagcgctagggggaaggtgcaggaggaggtgatgagggagttcgcggccattatggccagtggcacgctgcgtgccagcgaggcggcggcgctggccatgcgccgggtcatggagcgccacggcgacggcgccaccatgcagcaaggctagacggcgcgtcgtggacaggctgcgccgggcctgatgaacattgtgagcgcgttggttgcagctccatgggaatttgtcatccgcatgcttctgctgccgccgtatggaaattgttatgttcgtgcgattgtttgggttgttgattgcgaccgaacttattacccatcgtttatatgggtggttaatttaggggagatgataatttacgttggct

SEQ ID NO: 11109 - DNA, 642 bp, Sorghum bicolor
  Clone ID: SORBI-28MAY03-CLUS10076_1
cgaacgcgtggagtcgcttgtgaagagggtgattgtggctgagtctgaagctgctaatgagaaagagaaggtgaggatggggttggaagagatcaggagaaagacgttgcaggtcgagactatgtctgccaaagtcgaggagatggagaagtttgcggtgggtacgaatgggatgttgaatgagatgaggcaaagggttgaggatatggtgctggagaccactcggcagagacagcgggctgctgagaatgagcaggagcttagtcgggtaaagcaggattttgagtcactgagaacttatgttagcactctggttagtgtcagggaaactcttctctcatcagaaaagcaatttgaaacaatggagaaactctttgacagattagttgccaagactaaccagcccgagagtgggacagctcagaaagaagctgccgtccacaaggtcctggaggataatgttggccttcgcgatttgcgtgacaaggagggagcgcagcaacagagaaagaagaaacaccgcaagatgagacccctgccgagccaccacttgcagggccctgactttcggcgccgacactcgtcctgctaacggtccttctctactgcacttgcactctgacaatttttttttcatgataa

SEQ ID NO: 11110 - DNA, 910 bp, Sorghum bicolor
  Clone ID: SORBI-28MAY03-CLUS10094_1
gcgggtgactcttgtagagcatgaggcaaacacaaacacggcacctttctttcttagatacatggagactcttgattattacacagcaatgtttgaggcaatagatgttgcttgccccagggatgataagaagcgcattggcacagagcagcactgtgttgcaagggatatcgtcaatttaattgcttgtgaaggtacagaaagaatagagaggcatgagccttttggaaaatggagggcaaggcttgcaatggctgggtttagaccatacccgttaagtccagtggtgaacagaaccatcaaaacactgctcgacagttaccacagctattacaggcttgaggagagagatggcatcctttatcttggctggaagaacagaaagctggtcgtatcttctgcctggtgctgatatttccattttttttgaagaagctttgttaaggtgctttcgcggctttgtgttcagcacatgaatccaaaggtggaacctaaacttaaatatgatgactaaacaatcataaacaagctggttgcttccttactgtttgttgcccagctttgcaactctcccatgctcaccatcatctcggactagctggttcatctctgatgtacttaccatatgactcagttccatccttatataggtgcaaacagtagtttcatcaccctcttgtactggtcttaatacttaccatatgactcagttccatccttatatgttgctagaatctggtatcagcttccgaatctggactgctgaatcatgtatgttccatttagccaggatttgatagtaggcacaaggagtgccattagattgtgtatgtacaacctgcttcagttggtgtattgtacgtacttatacagtctgggtgatttactttggtcctatgactggttttgt

SEQ ID NO: 11111 - DNA, 715 bp, Sorghum bicolor
  Clone ID: SORBI-28MAY03-CLUS101586_1
gctactgaacgagccatgggcgccgggcgccaccctgtccagcctgaccaagtactaccaggaaggctacaacgccgtgcggcggcacacatccgcggcgtatgtgatcatgtccaacaggctatccgcagacgcgacggagctcctccagttcgccggaggcttctcgggcgccgtcctcgacgtgcactactacaacctgtttagcagcgtcttcaacagcctcacggtggagcagaacatcgacttcgtgaggaacaaccgctccaccgacatcgccaccgtcaccaaccagaatggacgccctctcacgttcgtgggggagtgggtagccgagtgggacgtgcaaggtgcgaataagacggactaccagaggtttgcgcaagtgcagcaggatgtatacgggcgagctacttttggatggtcctattggacgctcaagaatgtcaataaccattggagtatgcagtggatgatccaaaatggatacatctcacttaaaagctagatatatacagaccaagtgaactaattaaatagtaacacaaagaagtcgtaatgggaaaataaattacgtatatatatgtatgcaatgtgcagtggcacaagtggatgcaatgggccggggagaaactcctacaccaaatttgtcttctacatgacgtcctgagaatactcaaataaatttgtacgtccagtggtagttgacgatttt

SEQ ID NO: 11112 - DNA, 1067 bp, Sorghum bicolor
  Clone ID: SORBI-28MAY03-CLUS1017_1
ccggaacatcctcacaagaaccaatccttgattacagccagcttagcaaaagccatctgcaggatatacgaccttctgaacgcgacaaacacgaggcagagttcaaaaaaagaacaggtgtgctactggctgatattgagcgcactgctcctaatctaaaagcactggatcaatatgatgcactccaaagaaaggaaaaggaggttactgaaaggtttgaagcagctaggaaagaagaacgagagatagctgataaatataactcagtcaagcaaaggaggtatgagctgtttatggaggcctttgatcacatatctaaaggcattgacaaaatctataagcagctgacaaaaagccatacacatccacttggaggaacagcatatttaaatctagaaaatgaagacgaaccatttctacatggaatcaagtacacagctatgccacctaccaaacggtttagagatatggaacagttatctggtggggagaagactgttgcagcactggccttgctttttgccattcacagtttcaggccatcaccgttcttcatattggatgaagtagatgctgctctagacaatttaaatgtggccaaggttgctgggtttatcagatcaaaatcatgtgaccgtgtcgctgatgaacaaggcagtgatggagcatgtggttttcagagcatagtcatatcactgaaggatagtttttatgacaaggccgaagcacttgttggtgtttatagggactcagaacgaagttgctcgagcactctcaccttcgacctcagaaagtatagggaagcatgaaacaacttttgttggatatatatatagttgccactgtatgtgattgcttttttttagataaagaactgtatgtgattgctagctagctgtcgtgaaccttagacgttttaactacttgtgtacatagtcgcgtaagctattagctgaacaggacacttgaatattcctgattcatgtggtaggttttatggcttgatgtttaccaacatgcatgtacctttttacctattaattattatttatccccacggttcgccc

SEQ ID NO: 11113 - DNA, 620 bp, Sorghum bicolor
  Clone ID: SORBI-28MAY03-CLUS93943_1
aggcggctcgaggcacagcgcagaaaaccaacacaaaaaggatacattgagcaacatacaatataatggcagctcaggcttcatccattatagtccccaccgacgccgagctgctgcaggcacaggctgatctatggcaaaacagcctgtgctacctcaaatccatggcgctcaagtgcgcagctgagctcggcatacccactgccatctaccgcctcggcggtgctgcctcgcttgccgacctgatcgccgcactgtcactcccacaggctaagctgccgttccttggtcgtctcatgaggctgctggcctcgtcgggcgccttcgccgtggttgggtctactgatgaggctgtctactcgctcacaccactgtcatacctcctggtggatggcatcgctggcgatagtaaccacatggaccatgcacctttcctgctgacagtgacttcgacgcactacattgacttggcaatggacctagctgattggttcaagaaggaagacaagacaccccctttcgatcacaagcacggagcatcgctgttcgaggacagcatggagcgcacggatcccgggttccacaagatgtcaaagctgggtttactggtccacgacaac

SEQ ID NO: 11114 - DNA, 580 bp, Sorghum bicolor
  Clone ID: SORBI-28MAY03-CLUS94211_1
tccctctccactggaccacatcctcgcctcgcccgcggcccagactcgcatagctccccctctgccaatctctgcaacatcatcgattccccaggcgaataatttactctggactttttgtcttcaatcagaggaggagggtagattggattggtcagattattcaatctccactgcagtctctcggaagagaagaggccaatccagcccagcctttccgcaattcctggagaaatcctcactcagtgcgtgaagcagcttgattcgcctgcgcaactcatagaagagagccaggagcccaggagcttgttcttggctgcttgaccgattcttgtgctgctgcggatctcgccggagggccaagagcttgttcttgtgtcggggaattcttggtcagccgtgccggataagggtgagggtgccatgtcagcatcgcagtcctcgatgagcggcgccgccggggagccggggatgcggacggtggtctggttcaggcgagacctgcgcgtggaggacaacccggcgctggcggcagccgctcggacggccggagaggtcgtgccggcgtacgtgtgggcgc

SEQ ID NO: 11115 - DNA, 1150 bp, Sorghum bicolor
  Clone ID: SORBI-28MAY03-CLUS9461_1
gcacgaggtgacccttttcccttacgttgatagcatatgtgataaattggattttatcggcatcaactactatgggcaggaggtgatatcaggccctggtctaaagctcgtggacaatgacgagtacagtgaatctggtcgtggtgtttatcctgctcggcggtttcgtatcctgattcagtttaatgaacgatacaagagcttaaatataccttttataataactgaaaatggagtttctgacgagactgatctgattcggaaaccatatattctggagcacctgttagccatttatgctgcaatcattatgggtgtgcctgtgcttggttatctattctggacgatgtcagataattgggaatgggcagatggctatggtcctaagtttgggcttgtggctgttgatcgtgctaacaacctagcacggaaacctaggccttcatactatttattctccaaggttgttacaactgggaaaattacaagacaggacaggctgggtgcttggagggagctgcaacaagcagcatttcagaagaaaacacgcccatttttcagggcagtagataaacatggtcggatgtatgcagggggtttagatcggcctatccagagaccattcatattgcgggattggcgatttggtcattatgaaatggaaggcttgcaggatcctttcagtcgctttataagatccattttttcaccaattttgcgcaagaagaagattcattacattgagtatgaggatatttcttatgctatttccccctgatgcttgttactctagttggtaagtagcatgatttgtcctctagataaagtaaacaaaaagtcctgtgaagcagaagtttctctttttttgttgataaattgcaatgtgcactatttatcctggcacaacgtaccggaactccaggccggcctacggttctattttttgctcctctcgtgtaatgcgcactatttatccttgctgtgactgtcggatcggctgccctggcatccattggacccgtgtcctgcccattgttcgtttacctcccctatgaagtccatgtgcaatctcgcctcccgcattgtgttatgtacttggtgtcaaccgatttaactgacttggttgagtaatggaatccaaattctccct

SEQ ID NO: 11116 - DNA, 868 bp, Sorghum bicolor
  Clone ID: SORBI-28MAY03-CLUS9466_1
gatcactgaaagctacaaatccaagctcaagtctattgattgcaagtactttgcccttgggactggctcatgcccctttggaacaagttgtttctacaggcatgcctacagagagtactacggcatcgaggttgtactacggcatcttgatgctgatgatggaagtacagtaattgcaaaagacatcaggttatcagacttcctcggtaggatgcatctttagggaccagcagctgtatagatatcaaatgctttctgggatatcgttatccaccaattatttacaatattccgaagagcagtttagaagaagtcatcttacaattgtgcagctttgccaaaacagaagcaatactgtttatagacttcactatatgtgctctatgtatcagatgctggtcttcctggccaccatgggattaaatggtagacgcactagtttacttcccttttacctcaatgttgttctcatattgtggaatggtactgcaccaatgggtcgaataaggtcatttggttgtattacttaatatacaaaaaaaaagggtatagcagatgaaatacagaatgtcaatggcaggcgtataagtttacttcccttttacctcaatgttgttctcatattgtggaatggtactgcaccaatgggtcgaataaggtcatttggttgtattacttaatatacaaaaaaaaaaggtatagcagatgaaataccctcgggcaattgtaatgcagtattgttgaatgtgagcgtgagcggtgcttttcatctatgacctgctaagtaaggtcctcttagtagcaggtgaactgagatattttttgcttatatacagcataaatgtacgagaagaatagcttttttttt

SEQ ID NO: 11117 - DNA, 1158 bp, Sorghum bicolor
  Clone ID: SORBI-28MAY03-CLUS9783_1
gcacgaggcacagtggaattcttcaatcacctttactatgttgcagagtcttatcatgatgaacctgaaaagcaaactgagttggcgaagcttggaaatgattgtgtagatgctctacaagctcatgatgatacaacagggagccttgaagctttgaatgctgcagaactgaagttaaaagatatacttaattcaccttcagtggatgctgcttgcagaaagattgatgacttggctgagaagaaagaactggattctgcattagtgttgatgctttcaaaagcttggtcagctgcaaagggcactgacatcacaaaatctgaggcaaaggatataatgtttcacctatatatgactgcggtggccaatctccagagacaatggccgaaggatatcagaatactgaagcatcttataatgatagaggatccagaagaacggttaagtgcacttaatgatgcttttactcctggtcctgaacttcaaggggacaatgttgatacattatacacgagtccagatgcgatgcacacttgggcaagagctatagttgatgcatattataatagcagagaaggcactctccttgggcaagcaagagacatgatgaatcctaaagtcattaagagagtcgaagagatagtgaagataatcaaggacaaatacctttaagttttggtcatcataaaattggggtttaacatttctacttactgtgtaagtcttgtgccatgaccttaggatgatggtcttttacagactgctccctgcaaaactactgccatcattccagttgaactctgatcgcaaaacattccagttgaactcttcaccgctgccgaaacaatcagtggttcatagattaaggggaatgcaagttgttgtaactcattacagtgaaaaggtgattgtagcatgtagtatcagttagatattaggggagtactagtagctgtcttaactgctaacagtgttgtaactgtactagtatagaaccaggagtcatatgtatgtgcccaaatattcttgtgatgagctagtgatctcaacaactgtacggttgatgctgattcaaaccatttaagacttgtttcaggaagccaaatgtttctggacatatttgagctgaataatgtcataataccttgctttaaaaaa

SEQ ID NO: 11118 - DNA, 971 bp, Sorghum bicolor
  Clone ID: SORBI-28MAY03-CLUS10478_1
cggcatcaccatcgactacggctcggcgttcccgctcaacctccggcgcgccacgcagctggacatcgaggcggagttccagctcgaccgccgcgccgtcatgtcgctcaacgaggccgacgtggggtacaactgcagcacgagcggtggcgccgcggcccgcggtgccctcggccccttcggcctgctcgtcctcgccgacaagcacctgcgcgagcagacggccgtctacttctacgtggccaagggcctggacggctccctcaccacgcacttctgccaggacgagtcccggtcctccagcgccaacgacatcgtcaagcgcgtcgtcggcagctccgtccccgtgctggacgacgagaccacgctctcgctccgcgtgctcgtcgaccactccatcgtcgagagcttcgcgcagggcggaaggtcgacggcaacctcgcgcgtctaccccaccgaggccatctacgccaacgccggcgtgttcctcttcaacaacgccaccgccgcgcgcgtcaccgccaagaagctcgtcgtccacgagatggactcatcctacaaccacgactacatggtcacggacatctgatgctgctgctgatccgtcgatcgtccatccaacccaccgctgcatgcacctaattttttgaacagcaaagcatcttcttgtacctatcaattcatatcctcgcttccctctccaattttgttatttccctgccataattttgggttttttttccttcttcttctttcttctgattgctactatatatgtatcgctcgaggcttagcttccggttgcaatagtagctatccagtggaagacgccacgtcgatgcaagacaagaggctacatatgtaatagtgtagcctgtagttgtacatgtatgatggtgtgccaccacaccaattgagttataaatataaatgtttttagcccctaaaaaaaaaaaaaaaaaaggccccta

SEQ ID NO: 11119 - DNA, 1177 bp, Sorghum bicolor
  Clone ID: SORBI-28MAY03-CLUS1059_1
acccacgcgtgcgtccacgcgtccgaataaataaatggcataataaatctctcctctatcgacgaaagctgtggaggaaaaccaaggatctccccgtgcttgtgtatgccaggtcgcctgctctccgtccgcatcccgtccctcgcgaagctcggcgctcccaggtgtgcaaaattcatggcttcagacactggcaagaagctcattcagatcgatgtgagctcggatacagtgtgcccttggtgcttcgtcggtaaaaagaaccttgagaaagcaatggagcaaagcaaggacaagtttgatttcgaggtccgttggcatccgttctttctgaaccctgatgcgcctaaggagggcgtcaggaaaactgacttcttcagggcgaagtttggtcctgttcaatatgagcgtgcaatttctcgcatgactgagatatttcgaggactcgggcttgaatatgacatgtcggggctgacagggaatacaatggatagtcataggctcataacacttgctggacaccaaggctatgacaagcaaaatgctcttgttgaagaattattcctcaattacttttgccaaggaaagtatattggtgacaagcaggttttgctggatgctgcaagaaaggtgggcatagaaggggccgaagaacttcttgaagatcccagcaaaggagtcgacgaggttcaggaagaacttaagaagtactcatctggcatctccggggtcccgcgcacgaggatcaataataaatatcaactcagtggtggccagcctccaaatgtattcatgagggcgtttgagatggctgcaaaagatggagcttaatggtgttttaaaagagctcctctagtagtcttcacatatgttcgaaaggaataagagcagaatttaagaataaagttccagttatggaaccagttgtatttccataattttgatgtggtgacaattagtggtgaagatggtgtggatgttcacttttgaataaaaatctaggtgattggatatggcatatggtttagaatgtcccataaatagagcccagtctgtacttatatttgatttggccagtctgtatttatatttgatttgatgggatgtgtgcaagatatcagaaacaggaaaactcagattcgatgtgtgaaaggaataaaaaaacaagcatttaaat

SEQ ID NO: 11120 - DNA, 889 bp, Sorghum bicolor
  Clone ID: SORBI-28MAY03-CLUS10512_1
tgggaggttttgtggcctgcagagctctttcacagagaaacagtgatccagcaaaagcttctcgaccttgggatgtggatcgggatggatttgttatgggagaagggtctggtgtgcttgttttggaagaacttgagcatgcaaagcaaagaggtgcagaaatatatgctgaatttctaggaggaagtttcacatgtgatgcataccatatgacagagcctcatcctgaagggaaaggggttattctttgtattgaaaacgcattagcagattctggagtaacaaaggaggacattaactatataaatgctcatgcaacatctacacagatgggtgatttgaaggaatttgaagctctcaaccgttgttttggccagaatcctcagatacgagtgaactcaacgaagtcgatgacaggccatctgctaggagctgctggtggaatagaagctgttgctgctatacaagctataagaacaggttgggtgcatccaaatgtcaatttggataatccagagaaaaatgtggatgtcagcatgctggtgggtccacagaaggagagatgcgatgtgaaggtggcactgtcaaactcatttggatttggtgggcacaactcatcgattctatttgcaccattcaagtgatagttggcaattttcttgtggtggttacacatcgtcggccttatatataagagaagaataccaggctctgcaacatcttgtgtactgcaaaattaggaagaaatccaaaagcttagtaggattatatattgccacacaacctactaaagattgcaaatggcttcctttgtaatagcaaatcaaaaaattatgtcgagctgagaagagcatccaatcaaatgtcccatgtacccttttggcgcgtt

SEQ ID NO: 11121 - DNA, 739 bp, Sorghum bicolor
  Clone ID: SORBI-28MAY03-CLUS10641_1
gcacgagggccagccgacggccgcccccccgccaagctccgatcagatcgtttccgatctcctgaaaagcagagaggaacacccttcctcgccatttccgtccaagtgttaccccgaggagtcgtgcgttagcgtgcctgccgggttgggtaggcgttgcggcggcggcggggcgggagcatcgctggccgcgcgcggcggagcccggtgctcgatcgagtctcttctcttctcttctctccgggagacgacagcctttactgtgacaatctcatataagatagtttcctatctataatgtgctcatataaagaaatcaagtacaaatgaagaagcacatctctgcccactatttgatgactgaagacaggtagcactatggtagctgctacaactgcggggatgtttcttgtgtgttttgagtccctctgcccctgttttcgctcaaaaaggaaggatggaagcgaagaccatgttcttgcagaacattccaattccttgaattcttctgaaatgaggtcgatttctgatagaattcctgcaagcccgcttcgagtacctgcaagtccatctagattttcattgtcttcttcgccaccaagtagaaacgagcctttaaacctcagtcttgagcatgttgttaaactgacacataacttcgcgccggccttaatgattggcgaaggttactttggaaaggtctacagagtggagctgcgagatgggcgtgtcgtagcta

SEQ ID NO: 11122 - DNA, 760 bp, Sorghum bicolor
  Clone ID: SORBI-28MAY03-CLUS10796_1
gcacgagggaagactcggaaccagtacaccactacaccagctttccgtctcccagggaaagaccgaagactcggaaccagtacaccaccacaccagctttccttctctcctactctcgcttctgcggcgaattttcttggcccgcgccggccgccgtggctaccctgcgccaccgcccccttccgacgccttccgggaagacaaaaggtcttggctaagtttgaacatgtcgtgcttggcatgctgtggaggcgaagatactcaaagaacacctgataatggaggtccataccctggtggctacccagcaagggatgatgcttatcgcactgctgatccaactcccaggggtgctcaacctttgaaagtgcagccaattgctgtccccactattcctgtagaagaaattagagaggtcacaaaggcttttggcgatgaagctttgattggcgaggggtcttttggcagagtatattttggtgtactagaaaatggtaggagtgctgcgataaaaaagttagattcaagcaagcagccagagcaagagtttttagcacaggtctccatggtgtcaaggcttaagcatgacaatgtcgtagagttgcttggttactgtgttgatgggaacacccgcatccttgcttatgaatttgctactatgggttctcttcacgatatgcttcatggacgcaaaggtgtgaaaggagctcagcctggtccagtcttgtcctggatacacgagtgaagattgctgttggag

SEQ ID NO: 11123 - DNA, 667 bp, Sorghum bicolor
  Clone ID: SORBI-28MAY03-CLUS99532_1
tcctggccgggcgcacccccgccctccccgccgcccccgcccagtcgtacgagcttcccgacggtcaggtcatcaccatcggtaacgagcgcttccgctgcccccgaggccctcttccagccgtcgttcctcggcatggaggccgccggtatccacgagaccacctacaactcgatcatgaagtgcgacgtcgacatccgtaaggacctgtacggcaacgtcgtcctgtcgggcggtacctcgatgttcccgggcattgccgaccgcatgcagaaggagctcaccgccctggccccgtcgcccatgaagatcaagatcatcgctccccccgagcgcaagtactctgtctggattggcggctccatcctggcctcgctgtccaccttccagcagatgtggatctccaaggaggagtacgacgagagcggaccctcgattgtccaccgcaagtgcttctaacaagtttgttccttgagcctttgtatcacccagccccctatacatccaccccgccggttgttgctttgttccggcaagctgaagtgtagcttctcttcctattctttacccgcacccttcaagtggggaggcgtgatgagcatagtgtatgctctccgccccgtccttcttgttggggctgtacaaagttaccccttataaatgcacc

SEQ ID NO: 11124 - DNA, 842 bp, Sorghum bicolor
  Clone ID: SORBI-28MAY03-CLUS9971_1
cttagtgttgacattgaacaaaatagttctatcacaagctgcctgaaaaatttctgttctactgagactttaaatgcagaggataaattcttctgcgacaaatgctgcagtttgcaagaagcacagaagagaatgaagatcaagaaggctccccacatattggtgatccatctaaagcgtttcaagtacattgagcagcttggccggtataagaagctttcataccgggttgtattccccatggaactgaagctcagtaatacatccgacgatgtagacactgagtactccctctttgctgtcgtggtccatgtcggaagtggccccaaccatgggcattatgtaagccttgtcaaaagccacaaccactggttgttcttcgacgacgaaaacgtcgagatggttgaagagcagaccctacaaacattcttcggttcctcacatgaatactcaggaaacacagaccatgggtatatcttattttacgaggggcttggcgggaagagttagatggggtttattcaccttccctgttccttttctcctttttctctttggagcttgcaagttcactcttgtacctacacagctactatttcattacctccatggaatcgaagaggttgtatgaggtgaggacgccagattttgggtggtttcagtgtacaggggataatggaatctagctcccaacgatgaaataaggtgtaatttttaagttcgcctgaccagtttcttctcagggctaacatcttttgttaaagagtgggactttactattggacacactgtacatcaattctagttcataactctgcgcatttaccagtcctgatccatgt

SEQ ID NO: 11125 - DNA, 1189 bp, Sorghum bicolor
  unsure (1)..(1189): unsure at all n locations
  Clone ID: SORBI-28MAY03-CLUS10023_1
cgatgcggagcgccatcgagggtatgaacggcaaggagctcgacggccgcaacgtcatggccgccgccgtgcgcggtgactacgacacctgcgccctgtacgccgaccagctgaagcggcgctccgccgagcagttcaaggagggagttcttggcctggagcaccttgccgcggtggacgccttctgcgagctcgtcgcccgcggcatgggcgcgcccgagccgccgcgcacctaccacatcaacctgtccgtgttcacctccctgccggacatgtgggccatcgggcagcagttccccatcatcccgatccagcgcctgcaggagcgccccgccgtcgacggtgtcctctcggacctcacctgcgacagcgacggcaaggtcagcgagttcatcggcgggaggcacagcctgccgctgcacgagctccccacccacgccacccgcggctactacctgggcatgttcctcggtggcgcctaccaggaggccctcggcgggctgcacaacctcttcggcgggcccagcgtggtgcgcgtgtcgcagtgcgacggcccccactgcttcgccgtgacgcgcgctgccgcgggcggacgcgtggccgacgtgctccgcgcgatgcagcacgagcccgaggtgatgtacgaggtgctgaagcagaggaccgacggcgccacggccgccgccctcgccagagccttcggcgcaatgccgtacctggtgttcgacccggaggccgcggtgttgtccagcggcgagagtagcggcatgagcagcgactcggaagggtcagccgccggcgccgccgaggaggaagacgatgaggagtgggagttcatgcgcggcctcaccgtctgatgcatggctgcagcagcagcgcccctgttcccgtgtccgtcctggtgaaacaagtccagtcgccagcaagttgtcaagtcgccggccggcgttggtaatctaacccccaccgcccggtgttgtatcgtgtcatggtcgtagtcgtcgggtgtctcgtcgtcgccggagttcatggcgccacctttttattccgaatgcgtcagtgtccactgttcgcctttttttttatttctctctttttcttaccatggganataacatgaaggaactaatagcaagtttctctgcaactgttttctagtttcgtttttcaagaattcattcagctttgt

SEQ ID NO: 11126 - DNA, 1091 bp, Sorghum bicolor
  Clone ID: SORBI-28MAY03-CLUS100460_1
gcacgaggcagtcttctcttctcacttctcactcaccaaccaaccgagcaacttggctcgtcgtacctgcgacacgccgaggagagcgcgcgcgtgctgaggctgagctgtcggagctaagctagccagaacaaaccatggcgacgacgacgacgacgacgacgacgatgaaggcgagcgacccggggtccgcgtggttcggcagcggcgccagccggacaccgtcggcggcggggacgggcggccacaacgcgcgcctcatcaccaccgcggtcgcggcgttcgtgtccgtgctcgggctcgccctcttcctccatctctacgtctgccacgtccgccgccgtaaccggcgccgcgcggaggcggccagagccgccgtgctgccgaccacggcggcggctccggcgaagtgcgggctggatgccgcggccatcgcggcgctgccgaccaccatctacagggacgacgtgggcggcgaggcggccaccgacgagtgcaccatctgcctcggcgccgtggaggacggcgaggtggtgcgggcgctcccggcctgcggccacgtgttccacgtcccctgcgtcgacacctggctcgcgtcgagctcgtcgtgcccggtctgccgcgccgaggtggagccgccgccgccgacggccacggtgggctcagctcggttcgtgctggagaaggtgcaggacgctgtcaaggaggaagccggcagctgcagctccacgccggagcgggggatcggtgcctgtgcgtcgctgatgaagatgctgagcagggagaggccggcggcgccgcgaaggccacaacagggagcctacgccgacgccggggacttggacgacttggaacggcagcagtatgctgttgctgtgaataattaatcttttttttttcaaaaaaaaatgacggcctttttagtttggtcgttttccacatcatgtgtacatcccgcacgtaagtggtgcagtactaagacaagtctgtgagctcttaatttttttgatgaatgtaagggcccgtttgaaattaaagaattgatatgcttcgaatctctacaatttagttcaaatctgaactaaatcctt

SEQ ID NO: 11127 - DNA, 929 bp, Sorghum bicolor
  Clone ID: SORBI-28MAY03-CLUS1000_1
ctccaccgcaaacctcaagtacctactcgttccatattaccttgcggaaatgactgagaagatagcacaagaggatcggatcccggttcttaaggcgtcacaggaccacttgaaggaattcattgctctatgtgaagtactagagcttattccagaggatgagctagaattgtctaggcagaagcagcctgatactatggcaaacaggagagcacagaaggttgcccggttcaaacgtcaaaaggctgcagaaacgaagctccaagagatcagagagagaaaagaaaggcgtggacgctcattgagagcagctgctttatctgccccaattgaagctggagaggaagatgacctggaggatgatggagaggaagaaagagaggcttggttagctaccatctcattggctctctgcaaggcgtttgatcttctcgacatgctaaagaaggaagaagaaatgcttctagctgtaaaggaaaggaaggcaaaggtttggtatgaccacctagcagtggtactacctctcagagatgcaactctagaaaccagttcaggagtcaatatcctttttgtgttgaccagttcagcaaggacttatacatatttgcatggaaaactatttcaatggttactgattaagcaatatactcgccggggctggtaggcctgttttcctgctggtccacctcaacgggaacggccttgcggccggcgcatgcctgtgggggtccttgcagattcctccctgccgggtgttgctacttccttcgccctttgcctgttctgtcgagtgtgtccactctctcaaccatgacaaatgttagtctggtttccaatatttcctatacatggcttagcctttgattaaccatttcgatcattaattaaccattttcatctagatccatctatttcatctaataagcata

SEQ ID NO: 11128 - DNA, 1076 bp, Sorghum bicolor
  Clone ID: SORBI-28MAY03-CLUS11412_1
gcacgaggcgccccgccccgccccgcccgccggcgtcccccgccgtcgcgccgtccgccccccccccccgccgcccgccctcccccgccgcctccagccccccgcccccccccgcccccccccgcccctccgcggcccgcgccccctcgccctccgtctccgccccccttgtcccttcgccccctgtagcctccagccccgcgcccgccggggccgcctgcggcagctccccgagggttcgggacacggagagcagcctggagaaggtgaagcggcagctgtcgtcggggtccgggaggtacctgctgcaagggcccctgctcaagcgatctgagacgttacggaaatggaatgaacgttgggtcatattggatccgacatctggaaagatggaatacaaactccggagaaatgaaactgctattaaggggaccattctgtttgacgcctcaagcaccattactttatctcctgtgaactttcaagggatgccaaaatatgatggctgctgcttctacattggaactcctcaaaagaaggattactttctttgtgctgaaactcctggtgccgcaaaagcttgggtatctacactacatgcaacccagttagtcttacgagctcataaagaggcagtaaattctttggctgggaatggctcttcagctacattaggcacagttgctactgcagttgctaatgctaatgcaacagccatggaggctaccaaggagatagaagctgcactaaaggtttccatgagggcagctcttgggctgggtacaaataactccaacgagggccaacttgatgacctaacaatcatgaaggagactctaagagtgaaagatgaggaattgcaacatttggcgaaggatatccgctctcgagattctacaataaaggaaatagcagacaaattaacagaaactgcagaggctgcagaagctgctgcttcggcagctcatacaatggatgaacagagacgacttttgtgtttggagattgagcgactaaaacaagccttggaaagacaaatagaacaatcaatgcttaagcttggacactctgaagag

SEQ ID NO: 11129 - DNA, 931 bp, Sorghum bicolor
  Clone ID: SORBI-28MAY03-CLUS11418_1
agaaactcatccacaacatcccgaatcccaactttgtctgttctgcttcgctcgcgggcgcgctcctctccactcctccgatggcgccgccgcccaccagctcctcattcctccgcccgccgccgctgccacaccacccgcaccctcgcctccatttccgcccaccctccgcctccttccgcgtctccgagatacttggcggtcggggcctctgcaacggcgaggtcggcgtccgcaaagaactcacctccggctcctccgcctccaccaccacctcctcgcccgcgccgtctccttctccttcgacggagtctcctccgcccgcggttgatctggacgcgttcgacaaggagatgatgggcctcacaggcggcttccccggcggcgaggtcggtctcaaggacttcgtcgccaagaacccgccgcctcctcgttccaagaaatcaaattcccagcttgttgccccccaagccaccacgctctccgcgccaccgcggacgccggagttgccgctgttcctgccgggcatggtggtactggtcaagaaccccaagcacgaggactacatgtactgcggcatcgtgcagcgcgtcaccgacggcaaggtcgccgtgctcttcgagggaggaatctgggacaggctcatcaccttcaatctcgacgagcttgagggcagggagaagggaccgcccatggtcaaccccaagtccgtcgtgctagaggatattgtcgcgcagcttgaggatgacgatgatgataaggaggacgaagcggccaagaaggagaaggaacctgagggcgccgcggcagcggcatgaccacgcttcttgttcctgttatatcatcctctgtgtgtgtgtatgtatgtatacagctaaaataaaatgtttggggctaattaaagggaacgataaaaaaaaaaaaaaaaaaa

SEQ ID NO: 11130 - DNA, 906 bp, Sorghum bicolor
  Clone ID: SORBI-28MAY03-CLUS11041_1
ttacaggtcctgttttctaattgatgctcacttcgttgcaattcatggtgtggtgagtaaatgtaaacttgaaaagctttcgctcagctcaaactaccaagagttcctccaggcaaaaccaccagctacaccgtcaactgcaacctataagtagatcagcgtctcttcttgcttgcttttgagccgctctttgatgggctcgcgacgaggtagataaacagtccaacaaacgagacaacagacaccagtcacccgtctttcgccccttcccgcttagcctgctctccgtgtgacaggtcctccgagttaggtctctgacggagccccagaattaccacccaaacttccaggtcctgttttctaattgatgctcacttcgttgcaattcatggtgtggtgagtaaatgtaaacttgaaaagctttcgctcagctcaaactaccaagagttcctccaggcaaaaccaccagctacaccgtcaactgcaacctataagtagatcagcgtctctgtcttgcttgcttttgagccgctctttgatgggctcgcgacgaggtagataaacagtccaacaaacgagacaacagacacaagtgacccgtatttcgccacaagcctcttagcccattcaaacttcttctctggaggtctctcagcaagaatatccagtgggaagatgggagttgagtaggcctcctgaagagctgtctttgtgggaacacggtatgtaatcctagctggtgaaccctggaacctgccctgtgtcttggtctcgaggacaaatgtgtgtgaagcagtggcaccagggccaagcctttctaatgtcttcgatttctctccagtgacaagctcaaacgcttctgttggccaagagtcatcattaatggagacgtcataggcagtcgcg

SEQ ID NO: 11131 - DNA, 393 bp, Sorghum bicolor
  Clone ID: LIB3478-022-P1-K1-C8
accatgaattgcaacgaagtgagcatcaattagaaaacaggacctgtaaacttgaaaagctttcgctcagctcagactaccaagagttcctccaggcaaaaccaccagctacaccgtcaactgcaacctataagtagatcagcgtctcttcttgcttgcttttgagccgctctttgatgggctcgcgacgaggtagataaacagtccaacaaacgagacaacagacacaagtgacccgtatttcgccacaagcctcttagcccattcaaacttcttctctggaggtctctcagcaagaatatccagtgggaagatgggagttgagtaggcctcctgaagagctgtctttgtgggaacacggtatgtaataatagctggtgaaccctggaacct

SEQ ID NO: 11132 - DNA, 1188 bp, Sorghum bicolor
  unsure (1)..(1188): unsure at all n locations
  Clone ID: SORBI-28MAY03-CLUS1125_1
gcttgcattctntcgcgttgtccgcatcgccccntccctcgntttcacctttcctccctcgcacccacccaccngccgcaccngccgcaccnngctcgtgatnnctcccgcgcgcctacctngcggnnccggagagatgagctccacgngcggccgacgtcnctcccgngcgctgccgcncgatcaggacgaccacgngcgccggcgcccgcctgctcgtcggcggcctcgtcgtcgacggcgccggcgccggacgcggagtccgtagccttgcctgcggcggagaagcagcagcagatggaggtggaggtggaggccagctcggaggcccaggagcaggaggctgaggcggaggcggagcccacgacgccgacgtcggaggggacccggctgcggccgctggccgagtgccccccggcgccgcggaagccgccatgggcgcctccgccgccttcgacgcccgccaagcgcaagttcccgtcgtccgcggcgccgtcgccgcgccgggccttcttccccgtcgtgcgcgacctcaccaccgtgttccgcgccctgccgcccaagaagcggatccgcgcgggctgacggccggacgcgggcccgatccgcgccgccgcggctcaggtggccgccaattggggtcctaaggcacctggcgtacgtgcaggacggtgcaccagcatccactcctgtgcagcggtcgcggatctgggtgtcctccgccagggacgacgaccaccacggcgtctcgtccaccgctccgccgacctcttctcctcttcaccgcctccgccgaaagccggccgcgtgccgtgcccgtagtgcacctgcacctcgatcgtccttggagctggaggaggacgaccatgattgcaaaagagcttggtgttgttgctcatggactcttggagttcttgcactccttggcttctccttccgaccactccccctctgttctaatcatggtttgcaaggccatgacatggtacaaagctctcgtacagtgtgttcggtttattattttttttcctctgcttttttagtggggttgcgttgagtagaaactgtagaattggaaaaaggctgtttatttataggggttaatgaatcggaaaaaaaattggaaagtctgtaagagggagaattcccagagatctgttcattatattcgttatataaactatggtt

SEQ ID NO: 11133 - DNA, 696 bp, Sorghum bicolor
  Clone ID: SORBI-28MAY03-CLUS114279_1
gcagcacgaggacttggcatacagcagtccatccccacatatcctctctccggccactccatccgaagcaaccgagcggagaacaacaaggccggccggccatgggcaagcaggcgacggcgacggcgctggcgctgctgtgcgtcgtgctgctggcggcgacggcggtggacgacgcggcggcggcggcgtcgtgcaacccgtcggcgctgagcgcgtgctcgggcgcgctgttcggcggggcggtgacgcaggggtgctgcgcgtcgctgcgggcgcagcagccgtgcctctgccagtacaagcgcgaccccgcgtaccgcggctacgtcaacggccccgtcgcgcagagcgtcacccgcgcctgcggcctccccatgatgaagtgctgatgaacgagagaaactgctccgtcgtcgtcgtcgtcgtcgccgccggccacatactatactacatacactacgtactatcgagtccggcgcccggcggatccatgggcagtcatacacacatatatacgtgcgtctaaataaacgcgagctctagttgttgcagctcgccatgctccggcaactcgtagtcaacctcgggagtgaggctatgcatgatgccggtggatttggctgttttcgttacgttttccgagttatttcgtatgagtaaaatcgtgctgccgtgctgtgtgtgtcccagcgt

SEQ ID NO: 11134 - DNA, 965 bp, Sorghum bicolor
  Clone ID: SORBI-28MAY03-CLUS1019_1
ccacccctcgcctcgcgtgctcgatttttcccccactgccgccccgcgcacaccaacaccgtccaccagacacgccgcccgccgccgccccccatccctgtctccgttccggctcccgcgcgcgcccgccgcatccgtccgtccgggcttcctcgtctccgccgcttccgctgccgcaggtctatttgccctttcagaaactgaagctcagctcaaaacctcaccgtttccctctcattcttgaaagtggcgaaaaatggatcgtgatgatgtggctggctttgttagtggaggttgcaaacattcctgccgagacttctaacccagtacagtagatgacagtagagttttgatttccggcagtcaggcagcgggttcttttcttttcatctttggttatgtttcttgattggaatggacagggcctccctaaaccttggatctggtggtaacattaactccttgaacgatccttgtcactggagcacaggtcagcaagcagttgagtacaaaggtactgccattggcacactagtgtattccaacttctctaggggcgttctggccgcgctggtgccgccggcggctctgacggcggcgccgcgacgtcctctgcctcccccgcccgcccgtggtcggggccggtcgccatgttcctccgggatcggcccatcgggttcctgggctggaggtgtgagtactgtcgtgtttgtctcagggatcgccaaaactgtcgctgccgcaacgcttggatcccgcataaacagctgccccatgtagcagaaataaagagggtggccaggtcatagtgtgaagtctatccagttattgttgtaattagtactgattagtgccgttgtggtggtgtctctgtgtagcgtggcgtccagattctgtattgcccgtgattgactgctctattagcagacagaatgctctagttgctgtcggctttcccatggttg

SEQ ID NO: 11135 - DNA, 463 bp, Sorghum bicolor
  Clone ID: LIB3476-017-P1-K1-A10
gtgcccaaagagtgtccatggtgggacgcagtactgtgttgctcacggtggtgggaagaggtgcttagtctcaggctgtaccaagagtgccagagggaggacagaatactgtgtccgccacggcggtggcaagaggtgcaagtttgagggctgtgccaagagtgcgcatgggagcactgatttctgcaaggcccatggtggaggcaaacgctgctcatggggccaggagggctcaagctttggggtcggtgggccagcgtgtgacaagtttgctcgtagcaagattggtctttgtgcaagtcacagcgctttggttgaggatcactgcgtacacggtggtggcttcgtaggtactgcgatcagacagttgacagctgattgcaaccctgatgagattcaagccgctgcaatgaaagatgatgctgatatggcgaatggagaagacgaaacttttctgggatgg

SEQ ID NO: 11136 - DNA, 1416 bp, Sorghum bicolor
  Clone ID: SORBI-28MAY03-CLUS10276_1
taggggccttttttttttttttttttgagtgaaaatcacgataataatcatgccgaagagtctttagttacagcttttgtaaaacgagcgtggtagtcgagggcttgaggccactggatggtaagaaatccgtttctagatgtgtctcttcttctaatgtgagctttgggtcaaggccctccgtgggatgatatagaacccaccaagttgtccatggaagcctccgtggaaagcaatcaagctacggagtatggaatggagctagcttgcaagtacaattgtacaaacaggccacgccgccgccgccgcggcgctaggcggcggccgtctgcagctctaccaacagtcgactgaggcaaacaaacacaaaagccggcgacacgccggtcggccggcctacggctacgacgacgaggaggcgacgggcacggcttcgaagagcttggcgaagtagaactgcgtggagatgaagccgcggttggcgacgcgccatccggcctgtcggagcgcgtcctcaatgtcggcctcggcgtgcaggtaggcgcgcgtggccttggacgggcccgggaacagctcgccgacgcgcttgaggaagtcgaagtagagcgtcctgggcgcgaagctgatgagcagccgcttgtccgccagcgacgcgaggtggcggatcatggctttcgcctcctcccgcgggtagtggatgagcacgtccaggcacaccaccacgtcgtaccgcccctccaggctctccaggtcgcggacctcgaaccggggcatccggaacgtcgtcgaccccggcgccgttgcctgcgccagcgacgcctgccgctgcgcctccgacaccatggccgccgagatgtcggaggccaggacgtcggcgccctcggccgcgagcgggatggccagcgaccccgtcccgcacccggcgtcgcacaccgtggtgcccgccagctccagcggggagtcgcggagcatggacagcgccgccgccaccgtctgcgcgtggccctcgcggatgtccagctgcacgcggttcacgccctccgtcgccgacccgtagatcttgcgccaccgccccgtccccgtcgagttgaagtaggcgcggaccgcctccttgtccccgccgcccgccgcctcggcctgcgcgcgccgccggcgctcggggtcggagagagaaaccgccgcagccagcgcggccgccgcggcggccgcggccgggagggatagctccgggaggtccgcggccgtcggtagcgccgccgcggtggtggcgggcgccttgcgctcctggggacggaggaggaggacgttcggctgcgggttgtggaggagggaaggccgtggtggaagggagtggaggcgggagagcggcgcggtggagacgccggcgcgcgccatggccggaccggagcctcgtgc

SEQ ID NO: 11137 - DNA, 973 bp, Sorghum bicolor
  Clone ID: SORBI-28MAY03-CLUS1038_1
gcgtcaggcgcacgaggctcacacacacttgaaccgcagcccgcaggcaaaggaaagggaaggagtagagctagcaagacacacacacacacacggtcgtcgtcgtcgatggcgcggtggtcggcggcggtgctggtgctggtgctggcggcgggcatcatgggcatggcgtcggtggcggtcggcgacatgaacgcggacaagacggagtgcgcggaccagctggtggggctggcgccgtgcctgcagtacgtgcaggggcaggcccgcgcgccgccgcccgactgctgcggcggcctgcggcaggtgctcgggaagagccccaagtgcctgtgcgtgctcgtcaaggacaaggacgaccccaacctgggcatcaagatcaacgccaccctcgcgctcgcgctccccaacgcctgcggcgccacccgcgccaacgtctcccactgcgctcagctgctgcatattcctccgggctccaaagacgccgccgtcttcagccccggcggcgacaagggctccaccgccgcaccagccaaggacaactcgacggcgacgaccgactcccgcgcgctgcaggcgaccaacggaggcggcgtctcctcctcggcggcgaccgccggtgctgcactgacggcggtgctgctcgccggctaccttctcctgctcgtgcctgagctgtcgcctagctcattctagacctctgtcaagttgtgccaccaaaaaaaattaccagaagaatgtgatgtgttgttgttctagtacgtgacgtgacagacaatttactgctgctgttggagttgttgtagtagtgtagttgtgctgtgtttcctgttctgttatgtgtacgagatgttactgcatgtgttaagctaggctaaggcgatggggttagggtattgctaatgtagtacactgtaccagactaccagtactttacctgtcatctggttgccaatccttcttgttattggca

SEQ ID NO: 11138 - DNA, 1115 bp, Sorghum bicolor
  Clone ID: SORBI-28MAY03-CLUS10241_1
gcacgagggctcttgcttggtcgtcgtctctgtagccgatcgatcagcgtagtagccactgtcgtcacagtttctttatttatttcccatcatctgtcggagcacgtaaatcggctgcgggcgatcgaccggcgacgccatgtccaaggtacataccaaggcctcgctcgtggcctccttgctcggcctcgccgcagccgtgccctctgcggacgagccgcggtcgtctctgcgtccttgcccctgccccatcatctgtcgctgctcctagctcgcccgcggccgttcgtccggcgtcgccttgtcccagcaaaagactgtgatcaggctgggcgtacccaacgccaagaaccggtctaaagccatgcagctcgcatccaaagctgtcggtacacatccatcacactctagcttgctattgtcttggtgatcgtcgtgtgcgcactgcggtgtgcgggatcgatctgtccacatatccatgaacaacagtatacactcatcttgttcatcagtagtacttaccacctctcgcctcgatgtatatgcaggagtgaactcggtggccatcgccggcgaagccaaggaccagctggaggtggtaggagaaagcgtcgacatcacctgtctgatcaatcacctgcgcaagaaggtctgccgcgccgacatcgtcgtggtggaggaagtgaaggacaagaagaaggaggaggaggagaagaagaagaaggaggaagaagccaagaagaagaaggcggaggaagataagaagaaggcggaggaagcaaggaagaaggcggaagaagagttcaagaagctctgggcggcgtgcccgccgccgccgtacaacggtggttattatagttaccccgggccgccggcgacgtttgtatgcgaggaacagccagcagcaggctgccacatcatgtgaactggagctgcgtacttaagatggattttgcccggcgtgtatatgcttaatatgtttgtgattttggttctgaacttctgacctctccgtgaatcgtgctgggcgcatgtgcacaaaccatcactggcagttggcagaaatgaaagcaaaccagaaccacatccagatgtaaactatgaaagcatatttc

SEQ ID NO: 11139 - DNA, 466 bp, Sorghum bicolor
  unsure (1)..(466): unsure at all n locations
  Clone ID: LIB3478-012-P1-K1-A2
gtcgtctctgtagccgatcgatcagcgtagtagccactgtcgtcacagtttctttatttatttcccatcatctgtcggagcacgtaaatcggctgcgggcgatcgaccggcgacgccatgtccaagcaaaagactgtgatcaggctgggcgtacccaacgccaagaaccggtctaaagccatgcagctcgcatccaaagctgtcggagtgaactcggtggccatcgccggcgaagccaaggaccagctggaggtggtaggagaaagcgtcgacatcacctgtctgatcaatcacctgcgcaagaaggtctgccgcgccgacatcgtcgtggtggaggaagtgaaggacangaagaaggaggaggaggagaagaagaagaaggaggaagaagccaagaagaagaaggcggaggaagataagaagaaggcggaggatgcaaggaagaaggcggaagaagagttcaaga

SEQ ID NO: 11140 - DNA, 1004 bp, Sorghum bicolor
  Clone ID: SORBI-28MAY03-CLUS10425_1
gaaaccattacatcatgatgatgtcattctcgagaaaataagatccatacatactaataacatacagaatataatctttgtgccattacgaatgtcaccaatccatgttttttcaatctgtactaacctgatttattctaggaaagaagtactatttaactatgcatgtacgtgcccctgcgtggaaatgtacatccagtgatgcaacatgagctagctaattggactatataccaatgaccagcagagaggcgagtgttttattgctcaattcttcagaaattgtcgcagttggctggctggaaggacagcatcgacttctccacatcgtaccggatgtgatagttcatttgcatgatgttcccaacaatggacaggctcggcgacttctgcacgatccagcagctgacgctgtcgtccacggccccgaagtagttctccgtcggcagatccatgtcgccgccgtcgaagtgcagcaccatggacgggaagacggcgccggacgtctggaagcagacctcgtacccgtccctgccggacgccatggtgaggttcgtcgtctgcgacaggaccgcctccttggccagcgtgtacgccggctccgcgaggaacgccaccgtggtgccggagtcgaagatgatgccgctgcttccagtcccggccgtcgtcgcggcgccgatcgagatgctctccaggttcaccgtgtagtagtaggtggatgtccgcagcagcggcgtcgactggacgccggcgcccgtcaaggcgccggagccgaacaggagagggctcgtcttggcggcgtcactggtgaggcagtaggagaaggcgccgacgttgagctgcgagacgagggacagcggcccgcggccgaggccgacgaggccggagcccgagccgtacccgccctccgacatggtggtgcagccgaagccgatgccgggcacggcgtcgctgccgagcgtgaaggtctcgctcccgaggtaaccttgtgtgtagtgatgcgg

SEQ ID NO: 11141 - DNA, 1009 bp, Sorghum bicolor
  Clone ID: SORBI-28MAY03-CLUS18624_1
gccggccggcacgaggcttcggtcgcatacgcctctcctctgaaacccttctatcgcctctccgccgccgcgccgccacttcccctctcccgtcgacgcgagatcgagctagcgttgggggttcccgagaccggctgcgatggcgacagagcaagcggcggagaactacacggtggaggacctcgtggccctgaacccctacaaccccgacatcctcaacgacctcgagaagttcgtcaacgagcaggtctcgtctcaaacatataacctggatgcaaatctcagccttcttcgcctgtaccagttcgagccagaaaggatgagtatacagattgtggcccacatactgattaaggctctcatggcaatgccggccccggacttcagtctttgcttattcttaatacctgaacatgtgcaaatggaggagcagttcaagacattgatagttctttctcactacctagagactgctaggttcagtcagttttgggatgaagcagcaaagaaccgccacatattggaagcagttccaggttttgaacaggcaatccaatcctatgcgattcatgtactttccttgacataccagaaagttccaaggcctattcttgcagaggcaatcaacattgaaggtcttgcgttggacaagtttcttgagtatcatgctgcaaactcaggttgggtgattgagaagggtgggcagtctcaagtgattgttcttccacgcaatgagttcaatcacccagagctcaagaagaacccagctgatatcgttccctttgagcacgtaacacgcatattccctgtccttagctgattcaggcgagctgagagatttatataaaactcagcgagtgaagcttctctaagcaatcgtatcgtctgttttgtagtgtgctgtatcttgagattttgagattatatctcggtgtacctgttttttttttttgtctgaattggtccctgcaacttatggttattactactctaacgaaatgatcagtta

SEQ ID NO: 11142 - DNA, 784 bp, Sorghum bicolor
  Clone ID: SORBI-28MAY03-CLUS12023_1
tttgccttctggaaactatgtgaggagcaactcaactggtacaattggtgagccattttctgcatcaaccaatgcatatgaatcgaacaatccaggtgcatatggcagcagctctatttatggtgactcaacctggaggtttaactcatctgaggttgatatgcctccttttggtcatgatcttggaaatgttgatccggatatcaaatcagaaatatcagcaagctacatgggcaactatactgttaataataatcagacaagcagaggtatcacttcctagggagagtactattaaattcatatatgacttgggataggtgaaacacccactactatatcaggctttcaggtgcatgactgtgaattggtgatgtcagattaatatacaggttagttgcttgtttctaggtaaccagaggtgtggtttacaacaccaaaaatgctagaggagcggatacaaacattttgtgaagctttcagattttagtttaatttctacatctattaggcctttgttttttgaatgagatgtgcagtgttgattgcggcacatacttagaagtgttccaacataagctggaattctgtcatacggatggataaacttgtataccaaaggaatgctgtattatctttgcccatttatggctacattagcttgcttgtttttattctctttaaccattccatttgtatactagagagttgcttggcttgttcaaactattgggggtacaaagccatatgagacccagtaataaagccaccaaaagtatacaaa

SEQ ID NO: 11143 - DNA, 542 bp, Sorghum bicolor
  Clone ID: SORBI-28MAY03-CLUS12041_1
gcacgaggatcaccacccgcaccacagacgagcacccgcgacgactgacaaggcgaggcgagcagtcggcggcgatgggcggcggcggcgcacatggcggcaccacctacaagggctacacaatcccgcacaacaagcgctggcacaccgtcgccggcaagggcctctgcgccgtgatgtggttctgggtcttctacagggctaagcaggacggtgccacgctcttgggtttgcgtcatccttgggatgggcatgatgaccactctcatggtcatggacatgggcatgaggcatcgtcatcgtcgtcttcacattaacttccctactcgtggctgacggtgattcagtgcttggcatgttccaacaactaaagattgagttaataaattctaccatcctgcatgggactcatgttgttcgcaacttgtttagcacaaactggttttgttacgattgtgcttatgtatttgatctgcagcttcagttcatatgttgtggaaaagaatcttgtgtaacaaaaaaaaaaaaaaaaaaggccccta

SEQ ID NO: 11144 - DNA, 729 bp, Sorghum bicolor
  unsure (1)..(729): unsure at all n locations
  Clone ID: SORBI-28MAY03-CLUS12132_1
gccggccgggttccggtaccntggttgatcaccaacaacggccatggccacggcacaccctcgccggtgggcgctcctcctgcagctcggcatcgcccttggcatcctgctcgcggcggctgaggcttggacgggggagatcagcggccgcgtcgtctgcgacgtctgcggcgacgcagccatcggcccggaggaccacgccctcgaaggtgcggaggttgctgtcctctgcatcacaaaatccggtgaggttatcaactaccaagccttcacaaactctaagggcatgtatactgttgccgagactatgccagagagtgacaggtgggactcgtgcttggcaaggcctatcagcagtttccatctgcattgcacacggaggggtgatgctcactctggggtaaagttcacttacaacaaaccatctgggaactctcacactgtcaagactttcctctacaagccagccaccgcccctctgtattgtagctaaacagttccatcacattttgttggaaggcaaaatatagaaacataacaggaaggacactgtttccgttgtaaatcaaagattcagttgtcaatgggaatgtgttgtcctagtgtctggttacccatacctgcaaggaaacagatgttgtgtgcttcatatgttgataaatcagtgtttttcaactgttgtaaatgttttgcgagtgctatcaaaaaaaaaaaaaaaaaaggccccta

SEQ ID NO: 11145 - DNA, 734 bp, Sorghum bicolor
  Clone ID: SORBI-28MAY03-CLUS12158_1
aaagaggtgacttgtatcagagaaactacacacatgctagtgaagctattttatcgatcctactggacaaggacaaaagcagctcgacaatcctctcactgaaaaaggctggtccggagatcactgaacttttaacgcagtgctctattggcatagctggaactggattggctgttcttctgtcagttatgtgcaagatggctactggcgtgaggactccatttgcttcggctcggctgcttagcaccagtgttggattcggactcttttggctatcctgggcagtcaatggattgcgtgataccattgccagcatttttagaagccctagtaacatgaatatcgaggatgatgaggtcgcagtgaaaatagagaaaagtgtgaacgaaattctcttcagggccttaactctcttggcaatcactgcactgaagtttgcatgagcagttatcataattttaatagttttgtcgacctacttgttatatgtagttcacctatatgtggttcaggaatcaggatcaggagtgtagtattgctgcagtactgcttctgtaggaccaagttccacctgccaaatcatgattatagtctctcattgatcttgtggaaaatgagccaagttgtaaattgtacagaattttgcaggaagctcagtgtatattgtaaaagatgaatgttacttctctgtgaacattggatattctaatgcccagagcttatttaattttttc

SEQ ID NO: 11146 - DNA, 993 bp, Sorghum bicolor
  unsure (1)..(993): unsure at all n locations
  Clone ID: SORBI-28MAY03-CLUS123170_1
gcacgagggtcctccgccgcatcccacctcgttcgttcttgattcgattccattccattcgcccaccaggcaggcgatggcgaacggcggcgccgaggcgtcgggctccgggcctgccgccgggccgctgcggccccagacccagaggcgcgccggcggggacccgctcctcgtcgtctgccgctgcttcggcgtcgtcacggccgccgtcgcgctgctctgcgtcgccgccaacgtcctctccgcggtctactccttccgcggcggcgccgacatcatcggcggcgtgttccggtgctacgcggtggtgttctccgtcttcgtcgccgtgctcgagaccgagtgggcacccatcatcaggctctggaagatatttgagtacttgccggcaaggggaatgctacagatctttgttgctatcatgaccaaggcgtacccaaatgttgagaggaacgaactgattttgctccaggagattgctacctacatgcttcttgcgtgtggagctgtctacataatcgcaggtatactgtgccttggtgtgttaaaacgttctaggcagcataaagcaacatcacaggagcaagctgtcaaggatctggaggagctagagaagaggagagaagagcttgagtctctgttaattgctgagcggccagagacggcctgatgtcaaccacaatgacctaccatcactcttctggcgtaaataagtgttttttctgttgaatgttgacatgttgatagcatactgctttgtcacggccatcggtttcatctgtgggtcactttgttgacgtgtatcgccttctctacttcctctaccttgcggctttcctccgggcctccgtctgaattatggatctccagtttcagaacgtttgtgccatcgcattgtcttggaacatgttgtttcnagttgtgtaatgtagttgtatactcccatgatgatttccctgttgtatgtgttgctgcataatgcgcctgaattta

SEQ ID NO: 11147 - DNA, 1268 bp, Sorghum bicolor
  Clone ID: SORBI-28MAY03-CLUS12123_1
gcacgagggaggaggcaccggcagcgtaccaacagcggcaggtctgaaccacatgggctgggctgacagcagcggcacggtcggcggcgccgttgaggtaggcgaagaagcgagcttttggtggcatcaaaggaaagacagcgaccccccaacaaaatcaccttctccaacgccatcgcccgcagatcttcctcacatcgggcagccgcggtcttcacatctccccgcccccgcagtgccgtaccagccatgcgtatcttcgtgctgtccgggcagagtaacatggccggccgtggcggcgtgcaccgccggcactgggacggcgtggtacccccggattgcgcgccggatccgtctatcctccgcctctccgcggcgctgcagtgggaggaagcccgcgagccgctccacgccgacatcgacaccaccaagacctgcggcatcgggcccgggatggccttcgcccgcgctgtgctcccgcgcctgcaggaggacacccccggcgcggggacccggaccgggatcgggctcgtgccgtgcgccgtcggtgggacggccatcacggaatggtctcgcggggaacacctgtacgagcagatggtatgccgggcgcgcgtcgcggccgggtacggcgagatcgaggccgtgttgtggtaccagggggagagcgacgccgagtccgatgccgacacgggtgcgtacttggagaacgtcgagagactcatcggtaatgtcagggctgatcttgggatgccgcagttaccctttattcaggttgctcttgcatctgggaataaaaggaacattgaaaaagttagaaatgctcagtttagtgttaacctgcccaatgtggtaactgtcgatccgatgggtatggcattgaacgaagacaacctgcatcttgccaccgagtcacaagtgaagcttggcaaaatgcttgcagaagcctacatcatgaacttcttaacagcaacttgttaggtgaatacaaggctctcaagtctcaacatcttcaacccacagtaagtatatatttgacaagatcacccagctacaagactgtcatgtgcccaagcacttaatcaatcgacgacactaccaatcgctaaagagcctcaattcatggatttcaaactcgcttcataacatttccctccatattgtaataatggttgctgccgtttggtttttcttgcgaaacttgtactaaagaaaaggtcccgcacttggcttgccctaaagaaaatttagaaaaaaaaaaaatagcc

SEQ ID NO: 11148 - DNA, 431 bp, Sorghum bicolor
  Clone ID: LIB3478-038-P1-K1-H12
cttgacacataatgttttactcatattctgctcaattcttaactggtaaagttatgctttttacttgctacttataatatttaagcactaggatttgcaattgtgttgtttaagtaaaacaggaattgatttcactattaataccttcgcccttttcggattacgcaatcatcctttattttcctagataccacttgcagtgtctagtacctttttgatactatgtcagtattatttattatgatctgagcaggttgctcttgcatctgggaataaaaggaacattgaaaaagttagaaatgctcagtttagtgttaacctgcccaatgtggtaactgtcgatccgatgggtatggcattgaacgaagacaacctgcatcttgcaccgagtcaaaagtgagcttggcaaatgcttgagagccacatatgac

SEQ ID NO: 11149 - DNA, 1045 bp, Sorghum bicolor
  Clone ID: SORBI-28MAY03-CLUS27756_1
gcacgaggagagcgctcgctgccccaagtgagccgcggcgacgtgccggcgggagaggtggggactggggagctagcgttcccggcccctgtcggcgcagaccactctgagggtggcgggcgcgcgcgagagccaggggctggaatgactcctctcctacgccgacggtctcgtgcgcgtccgcaccggccgcacccgccgcgcccgccacgccgccgccggccgcgggctgcggcgcgccctgccagccgacccagccgacgccgaccaccgcgtcctggagcgccaggaggatccggacatcagcaacgacgccactgacaaggctgacggtgcaaccgttgaggccgatgctcttgatgcactggagcccctggggaacaaaaaccaacaggaagagaagcagcttcgtcaagagctaagagaagttcgtgactcagttgttgtattcttctgaaaattttaccttacggattaagtatttgatatgccgatgtccttcatcctatcaacacagtgctacttgatgagcttgatgacctagaccaccaaagagtttctataaaagaaagaacggatgctgtcaagaagaaaaagaaagacacgcagaaagcaaaacgtctgctttccatgtgcatgtcagttacaaatgtcgtcccaaatttggaagaccaagataaggtttcaggaaagattatcgaccagaacagcaggagaatggagaaattcgagtttgagaacacgaagccaccagttgagatatgcgacgagctctggaagaagatttagcacgtgcagatcattcttgttgtaaggcggtggaaactatgccggtgtattgtcgcgggttggtggtcctcccatcaagaaggatgcagttcgccatgttgtttgtatcgtcgagaagttgtactgttttttcggttaagggccccttggaacagacaaaaatctcaaagtttcaaaggcggcctaactggtcagattagtttgttccacgtacactatttgatctttgccagacgtttgctgggcccctagaagc

SEQ ID NO: 11150 - DNA, 1071 bp, Sorghum bicolor
  Clone ID: SORBI-28MAY03-CLUS27780_1
gcacgagggtgctatccgctagggtttatctgctcgaggaatggcgtcgctgcaggtctccggcgcgggggttggcgccgcggccttcgctgcgaaggggaaggcctccatcggtgcgctccggcttccatctacggtgaccgtcggcgaggtctgcccggcccggcgggcgttccgcggcctcgtcgtcagggccgccaccgtcgtcgctcccaagtatacaacacttaagcctttggccgatagagtgcttgtaaagattaactcttccgaggagaagacaactggtggaattttgctccctacaactgctcagtccaaacctcagggtggtgaggtagttgctgttggagaaggaaggataattggggataagaaagttgatgtcagcattcaggttggagctcaagttgtatattcaaagtatgctggaaccgaggttgagttgaatgactacaaccatctggttctcaaagaggatgacattataggtatcttagaaactgatgacgtgaaagacatgaagcctcttaatgaccgtgtactaatcaaggttgctgaagctgaagtcaaaactccaggcggtctattgcttactgaaactagcaaggagaagccatctatcggaacggtcgtagcggttggcccgggccccctggacgaggaaggcaagaggagcccgctgtctgtgtccgcggggagcactgtcctgtactccaagtacgccggcagcgagttcaagggcgctgatggcacgaactacatcgtgctgagggtgtcggatctgatggccgtcctctcctgagctgggctggaggatagaggcgcaggagcaggatgccatgccattgccagtgccagccagccagtggtaccacaaccacaactcccagttgctgcatcggcgcatcgccattttttgtgggaatgggggttccctggcggcctaccagtactgtaggtttcctcgcggctttccgttttttttttttcttcttacttggtcgtcttgtctgactgccctccgaggaacaacaataagcgagcatcagaaattcggtcgcacgatga

SEQ ID NO: 11151 - DNA, 1383 bp, Sorghum bicolor
  Clone ID: SORBI-28MAY03-CLUS2789_1
acccaatcccgtgcggcagcagcacacgcccagcggcgcccgcctcgcttcacctcttgccaaagcatccccatctccacagaattccgctccctcctcgtctcctcctcccgcggccgcgcgtcgtgaggtgaggtctgaccccgaggctgcaatggcgacagcggaggtggtggtggtcgccaacggctccggcagcgccgacaccaaggccgcgtttaaggagcccgacggcaagctcaaggaggagatgctccaggaccccgccttcgagttcaccgacgagtcgctccagtggatcgaccgcatggtggattacaatgtgctcggtggaaagtgcaaccgtgggctctctgtcatcgatagctacaagatattgaagggtgttgatgttctgagcaaggaggagacatttcttgcctgcacccttggctggtgtatcgaatggcttcaagcttattttcttgtgcttgatgatattatggacaactcccagacacggcgtggccagccttgctggtttagagtgccacaggttggccttattgctgtaaatgatgggattatccttcgcaatcatatttcacgaatccttcaacgccacttcaaaggaaagccatattatgttgatcttattgacctattcaatgaggttgagttcaagacggcctcggcgcctttgttggatcttatcactacccacgagggtgaaaaggatctaactaaatataacttgacagttcaccgccgcatcgttcagtacaagacagcttattattcattttaccttcctgttgcatgtgcattgctgctggctggtgagaacttggacaactttggtgatgtaaagaacattctcgttgaaatgggaacatactttcaagttcaggatgattatctggattgttttggtgatcctgaattcattggcaagatcggaactgacattgaagactacaaatgttcctggctagttgtgcaagctcttgaacgtgctgatgagaaccaaaagagcattctgtgtgaaaattatggaaagtctgatccagcgtgtgttgcaaaggtgaaggacttgtacaaagagcttaaactggaggaggttttccatgagtacgagagggagagttacaacaagctgattgccgacatcgaggcccagccgagcaaggcagtccagactgttttgaagtccttccttcacaagatctacaagagggacaagtagacccagatcgtggagaagctgctccatcgacgcttgcatcaagttactatacttgattgatgcggtcgagtaatttgtactatgttgttttgtgttttcattctcctgttgtaccgtacacctgaatataataaagcacagtgctattagggatgtgt

SEQ ID NO: 11152 - DNA, 729 bp, Sorghum bicolor
  Clone ID: SORBI-28MAY03-CLUS2802_1
gtactcaagcaaactccatcacatcattggggcaaataaaacagtcaagactacagcattggtgctcgtcgctcttctcggactgccactctcgatcacttatagcgttccattttctgtgactgctgagctgactgctggtacaggaggtggacaaggtctggccacaggagtcctaaatctcgctattgttgttccccagatagtagtgtcactcggagcaggtccatgggatgctctatatgggggaggaaacatcccagcgttcgccttggcttcggtcttctccctggcggcaggtgtgctcgcagttctcaagctaccaaagctgtcgaactcgtaccaatctgccggtttccatggatttggctgatgctcatgcccaaagccgtctgccatgtaacatccagatacacaccaacacttagccccattttgccattcgtttacagagaaatgattctttgtcctcgtacccctacagaataatgatagtgaaagtagaaaacttaggttagagaggctagttaggttgatgtgcatacaagccaatgcaaaggtgtaaaagctgtatcttcgtttttttgacagtacgtgtatgtaagagctgcccatatggtggagaaattttacaggtggtgtaacatgttttgttcctaacctgccctctttttacattgtactactaccactaccactgctgcatgcttacaagtgttggtcagattc

SEQ ID NO: 11153 - DNA, 845 bp, Sorghum bicolor
  Clone ID: SORBI-28MAY03-CLUS28208_1
gaggctatatatgtatacatattagtatgtatgcatgcatggttgcttcatcagtcgtcgtcgtcgtcgtccatcatggtcatcatcaccacttcaccggtcaccgctatggatcccacccaacccatcatcacatgcattggtttcagtcagcatccatccagtcccagtccatcgccgggcatcctggcgttgttagttcattaggtctttttttcatcgggggctagtgttattttacctttcttcttttttgtctattggttaattggttcccccctgaatgttttttgtttgtatagagagagaaagagagaggagggtgagaggaggggcaggagaaatagatgaatcagagtggttgctgcattgcaattgcagttgcttgcaagttaggtaaggtgagaaggagagctaaaccagcagcagagggagacagatttagagaggaagcacgagggctagtcagtcagtgagtcacttagaagaaaacaaggagagtgctttaagcaagtgaaaggggaatttgttggtttgctaattagaagggaggttatgtcaggtcaggtcaggtagtagctatcagcatcatccatgaggattttcaaacttaaaaagagggggacagccatcatccatcatagtctgtatctggagcttggtgtactgaactctgaaaattctttttgcagttcatctatgtttagggattgataagtgttgtttggtttcttctatactagtagtgcttccttttagccaataattaattatatatgattttgctcttgttctttaaaaaaaaaaaaaaaaaaaaaatctatatacaaaagctgtgaccatca

SEQ ID NO: 11154 - DNA, 1596 bp, Sorghum bicolor
  Clone ID: SORBI-28MAY03-CLUS13646_1
tgttgcaaggattggtggtcgtcattccccagattctgagcatagattgtcaaaatccttgaggtctcctaactatgaagaaaggaactccaaacgtgatagctctttcaagaactcaggcaaacatatacctagtcagggcagcgcagatacaagtggagatgaggaaggcagtcgtgctagagagaatgcccgaaaagcaaattcagctcgtaggaaaacaaaggatttctcggcaggtctggaacttaagaaagttggtgccggtgactcaagccctagagaaaaatctccattcagtttacgacagagtggcaagggtgtccagaagaaacaccctgatcaactgtcagaatcatcagaagacgagcttgttggtacaggaataaagcgtcaaactgattcacctgaagactctcatgggaaacaatgttcccctactagaattgaaaatgatgccacttattcgaaggatggtagaaacagtgagcatgtcatgagaggtttgcgtgatgattctgatgatgctattgatgcaaagaaatatttatctaaagtcaatgaggactcccaattggaagatggaagccctttgaaaaaaactaagaaaagaacatatggtaatagccacaatgattctggtagttcagggtctgaagaacgtgacaaacatagatcccactctgagaagcgaaggcacaagaaagctcataagcataagaaacagtatgatgatagttctgagtctgattctgagccagatggcaaagaggcaaagaagagaaggaaggaagagaagaggctaagaaaagaggaaagacgtcgaagacgtgaagaacgataccgcagaagggcggaacgccatgccagcaagcaaaaattaaagaatactgatactgctgctgtgccttcagactctgagaaggatcgggattctgattcagatgttgctgttaggaaaagaggttctcatgctggcagagaagagtctgatcagaagaaactagaaattgaacttcgtgagaaggcccttgaaactcttagagcaaagaaagccatcaacaactagcctgagaaattccttgcgacacatttgaatttctattttcaagagcttttctcaatgttatggaagtgtgtttatatgatacctatttaatgttctgtgtgtttacgtggcagttgatctgaggattcctgagctgtttccttgatgcagatgcattcaggcttagcagccagttatctggttagctccgcgtccacaggcttgtttggttcttcacgctgatatcgacgcctctacgttagcgtgctggtaacatattgattggaaaatctgctaaagcattcctacttaccagttgtttggttggtgctgcttagtttcaggttcggcagcagtcaatatatctgattaccaggttcttatcagcaaaatattccaagcagttaataatttgcaatgcctaagtcatcattacttttcagtaacttatttctaatgttgactgagaaatagaggccttatgccacattatttcacacattgaatcagcaaaccagctggttatttgagttgcaattaagatttgc

SEQ ID NO: 11155 - DNA, 663 bp, Sorghum bicolor
  Clone ID: SORBI-28MAY03-CLUS13422_1
gcgcgcgcctctcctcctcttcggccagagacagacagggagcgggggaagttcggtcgacgacacgatcgcagtgccggccgcagattctcccgtcgcttcgccgtcgcacgaggccgacactagcagcgcccgccctcgccctcgccctcgccctcgcccggcggtccagtccaggacacaggaggccactctgactctgagcttcgcatcacctgctgacggacgccatgggagaggtcgcggacatgtacacccaagacgggacggtggacaggaaggggaatcccgccctgaagaaggacaccggcaactggagggcatgcccctacatcctcgcgaacgagtgctgcgagaggctggcctactatggcatgagcaccaaccttgttcactacatgaagacccggcttggccaggtgaacagcgtcgcctccaacaacgtcaccaactggtcagggacgtgctacatcacgccactcatcggcgccttcttcgccgacgcgtacctggggaggttctggaccatcgccagcttcatggtcatctacattttcggactggcgctgctgacgatggcgtcgtcggtgaaggggctggtgcctacgtcgtgtgacaatgacggcgtgtgccacccgacggacgcgcagtcggcggtggtgt

SEQ ID NO: 11156 - DNA, 531 bp, Sorghum bicolor
  unsure (1)..(531): unsure at all n locations
  Clone ID: LIB3478-058-Q6-K1-D11
nccacgcgtgcggcatctccccacggctacgagacgagacaggccgtgcgcttcttgccctagcccagggagcagcaggacacaggaggccactctgactctgagcttcgcatcacctgctgacggacgccatgggagaggtcgcggacatgtacacccaagacgggacggtggacaggaaggggaatcccgccctgaagaaggacaccggcaactggagggcatgcccctacatcctcgcgaacgagtgctgcgagaggctggcctactatggcatgagcaccaaccttgttcactacatgaagacccggcttggccaggtgaacagcgtcgcctccaacaacgtcaccaactggtcagggacgtgctacatcacgccactcatcggcgccttcttcgccgacgcgtacctggggaggttctggaccatcgccagcttcatggtcatctacattntcggactggcgctgatgacgatggcgtcgtccgtgaaggggctggtgcctacgtcgtgtgacaatgacggcgtgt

SEQ ID NO: 11157 - DNA, 684 bp, Sorghum bicolor
  Clone ID: SORBI-28MAY03-CLUS13687_1
tgacgttaggcaaattcctccagctgaagttcctggagattacattgtctgcttcaaatttttctccagacttcgactttagctccctggtatcttttcttgatgcatctcctgccttggagacgttcatcttacgtatttcgatgccaaccattaggcacgattcaattctcgaagatcctgatggtgattcctcactactacaatgcctctcagattgctaccacgacaacctcaagaatgtgatgataacagggttttgctccgcaaagagcatggtccagctcactatccacattatgcagaaagcaaggtcgctagactgtcttacgttagacactacccgtggccatgacaggaggtttgccaacattgataggtgctggccactcactgaggaggcacttgtagaggctggaaaggctcgtgttgccattgaaagatacattgaggcaggagtgcccccatctgtgaacctgaagattatcgagccgtgcagcaagtgcacatacagataaacgatggaggttcacatgaataaagcccttatgtgcacgaatttaatgttttgacgttttgttgacttgttaaaagagactaaactttgcacccctgcgggatagatggctcaatagtactatttatctacttattctaccaagttaatctaagtgtgcctttctc

SEQ ID NO: 11158 - DNA, 790 bp, Sorghum bicolor
  Clone ID: SORBI-28MAY03-CLUS13792_1
caaagtcaaagagatcagacatggctgtcatgattctaagatacttcaatgtcattggttctgacccagaaggcagattgggtgaagctcctagacctgaattgcgtgagcatggccgtatatcgggggcatgctttgacgcagcactgggaatcattccaggtttaaaggttaaaggtaccgactatgaaacacctgacggcacttgtgtaagagattacattgatgtcaccgaccttgttgatgcccatgtgaaggcgctcaacaaggcacaaagaggcagagttggtatatacaatgttggcactggaaaaggtcggtcagtgaaggagttcgttgatgcctgcaagaaggcaactggagtcgacatcaaggttgactacttccctcgcagaccaggcgactacgcggaggtatacagcgaccctgccaagatcaacaaggagctgaactggacggcgcagcgcaccgacctccatgagagcctcagggtggcgtggacatggcagaaggcgcacaggagtggctatgagccgccacaggctatgattttgtgaagaggttctggatgggtgaagtttaggtgaacatagttttactagagacctctcctcgagggctcttagtcactcacaggcgtcagttcatatattatatatagccattcgttcgattcttcaggattcatatttatcgcgggcattagctgatgaatgtaataagattcatatttataacaggcattattaactgataaatgtaatatcatcataatatagacatattcgtt

SEQ ID NO: 11159 - DNA, 1076 bp, Sorghum bicolor
  Clone ID: SORBI-28MAY03-CLUS1382_1
gcacgaggcctagcacaagtaacaagctccgatggcacatagcagtttcaggtttaaaagttgtggcggtccactgcatgatgcagtccgcggcgctgctggtgcaaagcagtggtagcagttggtgacgtgcagtccatggtcatggtgctggtgcgcacggggccgccctccacgtgctcccattgtccaaacatatgtcctgtcctcgcaatgcagcggccgcccaaccgttatccatcattggtgctaggtccggcaggctgccagcggtgtacatgatagccaattttgatggggtttctctacaattcatgggctaacaccatggaggacgtgcgatgtggccagagaagacggagaagaagccgacgagttggcggtccgaggcccacgacgtgctgttgcgggctcaagctcaagcggtgctccttcccaggcgatggaaattggtggtttgcggcaaatgaagacctagcatggtcatggttctatgcatatagtcaaaactttatgcgacggctccctcttccctcccctccagtaaatcgaaagacaaccagcctagtggagaatgaacatgactagtgccatggtgttgatgagattctagacaaggacacatccagcgtggcagccaaaagtgacgctagcacatttcatgctggtagcagcgggcctcttacggagccttcttctatatcgtttggcttattgatgtgcaagagaatagccggtcggttgttgatacttatggaaaagttccagcaaaaaccttttcttctacactaaaaaacaaactgatttacaattacagacaatcatagttgtgtcaggtggaatgtccatcaaatggagaagtttttacgcagcaatgaaattaatttttattcattgaactactaatttgtatgcaacgtggcactaaaaacctttatgcgcatcttgactattgattctatgtacctactaggtcatcacatgccaacattcaaattttaaatttcgaagaatacaagttcgtctcccatgtggagatgtttctatgtggtaacaaaattgattattatttatcc

SEQ ID NO: 11160 - DNA, 703 bp, Sorghum bicolor
  Clone ID: SORBI-28MAY03-CLUS11549_1
ccttatctggttaatcagaatgctatgggagttagctcaagaccaccaggtgttctaaagactgagagcactgactcgctgagtcgtagttatggctatattggtggtagtaccagtgtggactctgtcttgctgtcttctcagtccaaaaatgcacagtatggtttactgcagagtcaaaatgatgttagcggcagctggtcgccttcacaagattttgatagttttggaaattctcttgggcaaggccaccctggttccacttcatctaacttccagagttctgcccttggcaagctacctgaccaaggacgagggaggaatcatgggtttgtcgggaaaggcacttgcattccaagccgctttgcagtggatgaggttgaatctccaactaacaacttgagccacagcattggaaacagtggagacatagtgaaccccgacatattcggatttagtggacagatgtgaaactttcttgaatttgtaagtagggttgatcattgagcactggaaacaaatttagtggtttgatgaatggttgctcatattttcctttcttcctttttttcttctgtaattggtttataaagggaataatctttgtgacagcatgtggaatcttgctttatagaagtttgttcagtttaaaggacgtaaaatttaatcagtcccttgtcatagggctccttttcctttcttc

SEQ ID NO: 11161 - DNA, 729 bp, Sorghum bicolor
  Clone ID: SORBI-28MAY03-CLUS11600_1
ctctttcagaagaagtgatgagcaaccgcattatgcacatatgcaatgaagaaggtctcaatcttgatgctcaggcactgtccacactgagtgccatttctcaaggtgatcttcgtcgtgctataacctatcttcagagtgcagctcgcttatttggatcttctatctcttccagtgacttgatcagtgtttcgggggttatccctgaagatgttgtcaagtcactgcttgcagcttgcagatctggtgaatttgacgtggcaaacaaggaagttagcaacattatagcagatggatatccagtctcacagctgatggcacagtttctagatgtcattgttggcgcggatgatattccagatgatcaaaaggcaaggatatgtaaaaagcttggggaaactgacaagtgcttggttgatggggcagatgagtatctacagctgttggatgtcgccagcgagactattcgtgctcttttcaacatgccacaaacgctggtcttctaagttcataaagaggaaaggtggttacgattgcgatccctggcgaaagcttttcctgactcttagatgctgcccgaggctaatctgcctcggcatgctgttccgatgttgctagctttgtgatgggttgaaaagcgatgaactcgccctaaaatcctgctgaactatgtgcctgtggatgtccaatatgacaatgaacatttctgaacttcacatcttgagtgtt

SEQ ID NO: 11162 - DNA, 791 bp, Sorghum bicolor
  Clone ID: SORBI-28MAY03-CLUS118763_1
gctaaacctgcatcagaaacctaaccaccagcattagctttttcagtcaacaagagcgtcgccgtgatcgatcgatggccatcacccacgacgactacgtctccctttgcctcatggcgctcgcggccgcgggaggcggaggccaagctgcaggtttaacgacgcagtacgctctgacgaacacggctgcctgctggacggcgacggcgcaagagtccgagctccgcttccggtgctccgtctgtggcaaggccttcgcgtcgcaccaggcgctgggcgggcacaaggccagccaccggaaaccgacgcctgtactacaggcacaagcgtcgtcgtcgtcagccggaggtgcggcggcgtcgtcgtcggggataacgacctcggccggcggcagcagcgggcaggggaggcacaggtgcacggtgtgccatcggagcttcgcgacggggcaggcgctcggcgggcacaagaggtgccattactgggacgggctctcggtgtcgctcaccgcgtcgtctgcgccatcgggttccgggtcgaccgtgaagggatttgatctgaatttggtgccggcgccggcggcgacggcggccaacgcggcgacaaggtggagagaggaggaagaggtgcagagccccttgccggtcaagaagaggcggctgtccggcccgtccctggaccttagtttaacgatctagagttccgtttgatgaggcatgtgtagagtttttcctaccttcattcgtttttttagttggattttggtttggtgttttgccctggtgaataat

SEQ ID NO: 11163 - DNA, 1214 bp, Sorghum bicolor
  Clone ID: SORBI-28MAY03-CLUS1155_1
cggacgcgtgggcggacgcgtgggcttgtgtgcatactctagtgttgacggtggtggaactctgtttgtccttgggtcagaagatgagatggatactttcacccgaggtgttgaagaagagacacttaagaatacacttaaatgtggtgtaggatatgtgcatgagggtctaagtgagcttgatcaagaacttgtaacccagttgttccttggtgggaggatccaagtgtgtgttgcaagcagcacaatgtgttggggaagaccattgcctgctcatttggttgttgtcatggggactcagtattatgatggccgggagaatgctcacactgattatccaattacagatctgcttcaaatgatgggtcacgccagcagaccacttcaagataactcagggaaatgtgttatattgtgtcatgcacctcgcaaagagtactacaagaagttcctttttgaggccttccctgttgagagcaatcttcaccatttcttgcatgatcacatgaatgctgaggtggtggttggtgttgtagaaaataagcaagatgctgtggattatcttacttggactttcatgtatcggcggttgacaaagaatcctaacttctacaatcttcagggtgtaagtcacaggcatctgtcagatcatctttctgagctagttgagactgtcctgaatgatcttgaatcaagcaagtgtgtggctatagaggaggacatgtacctgaagcccctgaaccttggccttattgcttcatactactatattagctacacaactattgagcgttttagttctatgctgacccagaagactaaggtgaaaggactcctagagattctagcatctgcttcagaatatgcagagcttctgggtcgtcctggtgaggaagaattcattgagaggcttgttcgccaccagaggttctctatcgagaaacccaagtatggcgatccacatgtgaaggccaatgctctgctgcaagcccatttttcaaggcacacagtggttgggaacctggcagctgatcagcgcgagattctcctttctgctcataggttgctccaggcaatggttgatgttatatccagcaatggttggcttagtcttgctcttagtgcaatggagctgagtcagatggtgacacaaggcatgtgggatcgggattctgtgctgcttcaagttccacacttcacaaaggacttggctc

SEQ ID NO: 11164 - DNA, 1002 bp, Sorghum bicolor
  Clone ID: SORBI-28MAY03-CLUS11883_1
ccaggggaaaggagctcaatcgtttggcaggaattagtggaacctgtgattttgtcaaggcagacttcatgaaaatgccgttcgatgacaacactttcgatgctgtttatgccattgaggcgacatgtcatgcacctgatccagttggttgctataaggagatatatcgtgtgttgaagcctggtcagtgctttgctgtgtatgagtggtgcattactgatcactatgatcctaacaatgcaacccacaaaaggatcaaggatgaaattgagcttggcaatggcctgccagatatcagaagcactcggcaatgtcttcaagcagtaaaagatgctgggtttgaggttgtttgggataaggatcttgctgaagattcccccttgccttggtacttgcccttggatccaagccgattttccctgagtagcttccgtttgacttctgtgggacgcatgattactcgcacaatggtcaaggccttggaatatgttggtcttgctccacagggcagtgagagggtctctaatttcctagagaaggctgcagaaggtctcgtagagggcggaaagaaggagatcttcacaccaatgtacttctttcttgctcagaagccggtttcggaatgagctcttggatcactttccagagagaaagcaaggaggcatttcaaagaagctgagggggaaccctgcaattcaagaaaatatggttcttctgtgtaggaagaaaattaacgatcagtgtagtaactgttaagctttgtgtttgtttagttgttttgctgcttgagattattggtttttagggggctgacaatgtgaaatccttttcatcataagctctacaaataagatggtttgtataagactccatggatacagtaaaatgttttctgaggtaaataaactggggcggtgtggtggtgattaggagatgcctgcaatcaagtgtaattcctctgtattactaccattgattgattatgtgcctgagacccatttg

SEQ ID NO: 11165 - DNA, 705 bp, Sorghum bicolor
  Clone ID: SORBI-28MAY03-CLUS13960_2
ttcgggacacttgggccctttccttggtttcacacctgtctctcttctccgtccagctccgtcgacgagggccgccgcacctgcactgcacgcacgagccgtagagaggcgaggccaagggaccggagagagagagagagagaggaacccgaggaaggcgaagatgatctaccgcaactggtcgctgctctcgtcgacggtcgtcatctggggcggcgtcgccaccgccggcctcgccgggatcttcctcttcggcggcaaggagaaattcaataactatctgtgccgcgaaggcgagaggcttaggcagcaggacagagccgcgatgggccgacgctagagagggagcatcaacttatcaaatgcacaagattcttgcctccctactggaacaagtccctttctaggatggaatccttctactggctttcactttgctgagcaaaacttgctccgatatgtcaataataataaactgactctggttttctgttctttctgcaacctgcgcgctgtactaaaaatcattgagaacaaggggctttggcatcattgagaacaacgggctttgggtggccttttggcccctggtttgtcaagagttcagtacttgtttggcgccaacttgtgcgacatgatgatgtgcaacttgtctctttggtatagttactctgaataaaggttgttgcatttgatgggactccg

SEQ ID NO: 11166 - DNA, 687 bp, Sorghum bicolor
  unsure (1)..(687): unsure at all n locations
  Clone ID: SORBI-28MAY03-CLUS13960_1
gccggccgggccgggctgcttccccttcttctccatccagcttccagcattccagctccatcgaggagggcagccgcacctgcactgcacgcgccgtagcgaggcgaggccaagggtcgggagagtgaaagagaggcgaagatgatctaccgcaactggtcgctgctctcgtcgacggtcgtcatctggggcggtgtcgccaccgccggcctcgccggcatcttcctcttcggcggcaaggagaaattcaatgactatctttgccgcgaaggcgagaggcttaggcagcaggacagagccgcgatcggccgaagctagagaggaagctgtagcttgattgatatcaatagagcaataacttttcaaatttacaaggaagaatcctgcctccctactagaacaagctgtctaggatggaatccatctactagctttcactttcctgagcaaaacttgctgcatataacaataaataaattgactctggtttctgttctttctgcaacctgcacagagttccttgattttgttttaaaatttaaagggatacgacctatttctattttttcaccttctgattctgattatttgttttgtaatgctctgtgtatcagttcataataagcacaatgataaagttcctttgtgtgattggagcttcatatcctatttcaaaaaggcccctan

SEQ ID NO: 11167 - DNA, 1272 bp, Sorghum bicolor
  Clone ID: SORBI-28MAY03-CLUS14375_1
cggccgggccgggaatacgcctggaacacagtggcgaacgttttgtacctggagagccccgtgggcgtagggttctcgtacgccgccaacacggacgtgtacaaggggatgggcgacaacatgacggcggacgactcgctgcagttcctggtcaagtggctggaccggttcccggagtacaagggccgggacttcttcatcgtcggcgagagctacgcggggcactacgtcccggagctcgccaccgccatcatcgccgccaagaacgccggcatcaacctcaaggggatcgcggtggggaacgcgatcctggagttcgcggcggagcaggcggcgctgtacgagtacctgtggcagcacgcgttcctgtcggactcggcgcacacgctcatcgcccagcgctgcaagaacgccgaggacaactcgccgctctgctcgggggccagggacacggcatacaaccagctcggcaacatcgacgtgtacaacatctattccagcacctgccatgacaagaataaagtcaagcccacaggatccaactgcatggacttggctgatccttgtgctcaatactacgtggaggcgtacctgaaccagccagaggtgttgaaggtcatccgtgccaacacagagctcaaatacaaatggactagatgcaggcaaacgttctacagcctgctcaaattcggcgactcgccgacgaaatcgatgctgccgtacatcaaggccgtcgtcgccggcggcgtccgcgtgtgggtcttcagtggcgacctggacgcgatggttcctgtgatcgcgacgaagcagtccatggagaagctcggcctcggcgtcgtagcggactggcgcccctggtccatcgaccccaaggacccggaggtcgccgggtacgtgatcgagtacaagggcgtggtgttcgcgacggtgcgcgggtccggccacatggtgccgatcgacagcccggcccgcggcctcgcgctcttctcgtccttcatcaagggggagccgctccccaaggccgcgccgatggtcgacggatgaagaggcacgccaggccacctgcggctgtgccccgcgcgcggtggcattcaattctctgttcatgttcaaggatcggagccgccacggacgttgagacttcattgttgcgcggcgtctcattctcctctctcttaatccatactgtttccgtttccacgttaactaccacacagtactgactaactaagctctgtgacctcaactgttgtatgaatgttttggtgactc

SEQ ID NO: 11168 - DNA, 845 bp, Sorghum bicolor
  Clone ID: SORBI-28MAY03-CLUS14475_1
cccaaaagaggacaattacaaagcagatcaggagcatttaacacatatcgatttttctgccgatggaagacatgggtggttcgatacagagatacgaggttacagacaactaaaacactagtaatttcgttcggtgaatcgaacgctacttcatcccaaaagcaaatgacagcttaggccgcgacttgttcttgcccagcagcttcatctggttttgcctctgctgctcttcctccatttttttccgcttcatggcctcctctctttctttctgaagcctctccaactcctgataccgctctagctctttctgctgctgttccatcgcttctttcatcaatgcctcttcagctttctttcgttcttcttcaagctttttctctagctcctcccgctcctttttttctcgttccactttcagtttggcttcatttaaagccgcctccttttctttctcaatctggattgctacctcctcatgtatccttttccgcccttcctcaattcgacgttgtatttcatgcttaatttcatcacaattcagactgtcctcaaccttcctcctaatagcttgctcaactctttttgacgtctcctcctctaatagtctcagttcaacttccttttggcgcccctcgtgcatatagcaagtcaatgaaatgtactacccaaggcaaggcatgaccaaagccaatttttttttttttaattcaaactcttcaaggccataaaagcagcaaaaagcaaagcacatgatttaaaatctaaacactatctatgctctactatgcctttcatcagcatagttttgactacaagctaatgcattttaggcatcctcgtgc

SEQ ID NO: 11169 - DNA, 832 bp, Sorghum bicolor
  Clone ID: SORBI-28MAY03-CLUS145_1
gagaatgtattccagagagacctgaccaacctgaatgtcagttctatatgaagaccggagactgcaagtttggtgctgtatgcaagttccatcatcctagctgtccgataattcctactcccaattgtgcactgagtccattaggcctacccttgcgcccgggagaaccaatatgcagtttctataatcgctatggcatgtgcaagtttggtccaaattgcaaattcgatcatccaatgggaagtgctatgtatggccatgcttcatcgccaactagtgaggccccaacttctctgcgtatgctggcacatgtaccatcgcatccagaagtatcacctgacagtggctcgggaaggtctaggaggattgcccattctgattcccagcaaataccctctgttgaaaggagcactgagagagaggcgtcctaagccatcctcggtgttttcgttcatgctgcctcccattcttgactggagtaattatctgcaacaacatttgaggatccgaagctgtacaggtcttttgcctcacctttgagctttacataccggagcttgcttcaacatgtattgcattcaggcaggaaaaagttcttgcctgttcgggatgctcatttgccccccattgaaaacgggaacaaacctaccttatttaaacatatgtatggaaccaactcacacctctggacattcaaacccattcgagtaatgtgccctggtcccggtgttgtagttatagaggctgtgtttcgatggacaatgcttttgcgaaactgactggggatgcgcaagcataacctcttttgttaattattatctcgttttttctt

SEQ ID NO: 11170 - DNA, 1251 bp, Sorghum bicolor
  Clone ID: SORBI-28MAY03-CLUS14706_1
gcacgagggtccactcgatagttcggaaattcgagtctgatagccggagtcgcagcacagttagctttcttgtttactgcgctgaagttcttgcctccctgcctttcacatgctccgatgaaccactttacttgatctatgatataaatcgagttattcaccttagagctggaggagttgagggcaatttgaaaaggtggacttctatgtctcaaccgcaagatacggcgggtgtgccaacattgccaagagagagtcatgttgtcatgcaagagcctggcggatattacgatagtgtgggatatgttcgtgaaagggtgaatgacaacaatccttgcagtacttctaacgtggacatggccaaagtgcaggtggatgtggacgtggccaaagtgcaggtggatgtggacatgaccaaagttcagggagattgccatgatgcaatagccctccagctactactgaaattgaagagacatttgaaagttgtttatagtttagatgatgcccgctgtcaggcattttctctaaaggagcctcctaaatctggagaagcattctccaggcagaatgttccttttaatattggcaacactaacatcagtctgccgagctgcctgcaggatgtagcttctgtttaccaggatttcaagacagcgctccgcgaagattccatggactttgctgtgttcatcccttcagtccagactaggaagcgcccaactccaagaagtgcggcgaacccaaccccaagaagtacgacgagagtcaggagaacggctgccccgagtgttacaaaagcccgtggtggtgcacggggtgacgattctgatgatgctgatgatgatgactggactgggggcccaagaatgctcgacttcagtgggggtggccgtgtgacaaggcagagagtccaagtatgatgatgactggtcttggtgcttttgtacattctagggaaacctatagcagctgacttcagttagggctgagttttaggtttaaagtcgtttagggtacatagaagcagaaaggaaaggaagatagctttttatttagatgccattaatttggagcactccttttcttgctctgcctctgtcctgtttgtaattcccatcgggctttggcaaaactgacaaacgggttgtgctccggcttctgatctgattcaatgggaatgaagctattccttttgttaaattgttcttttgcctgtataacagttaccctatgtttcgtttaaaaaaa

SEQ ID NO: 11171 - DNA, 932 bp, Sorghum bicolor
  Clone ID: SORBI-28MAY03-CLUS1241_1
gcacgagggtctacttctccctcctcccgatcatcggtggatgcgcgctctccgccgtcaccgagctcaatttcaacatggttggattcatgggggcaatgatctcgaacctggcattcgtcttccggactatcttctccaagaaggggatgaagggcaagtccgtcagtgggatgaactactacgcctgcctctccatcatgtcgctggtgatcctcctccccttccgtccggccatggaggggcccaaggtgtgggcagcgggctggcagaacgcagtcgccgagatcggtcccaacttcgtctggtgggtggcagcgcagagcgtgttctaccacttgtacaaccaagtatcctacatgtcgctggatgagatctcgccgcttacattctccattggcaacaccatgaagaggatttctgtcattgtcgcctccatcataatcttccaaacgcccgtccaacccatcaacgcgctcggagccgccatcgccattcttggaaccttcatctactcccaggcaaagcagtaacgccttgtcaagaccactgttccagctgctgcctgctgctgcatgagtattgctgagaatatgcaactgttggatggctgaaagctgcagctgcaactagcagccgaacaagcactagatggcctcagttcaccgtgaatcaactcggtgctcgaacataacaacttatgactattgagaatatctactaagaacccctctgtataatattactagatcctctttttttgtattttctttcctaggactagcttccagtattcctgagctcctcatttccttgtgttctcattatgactatgatggtgtagagagagatggatccatctaaataaaagtgcaagatttttatttcaaaaaaaaaaaaaaaagggccggccggccttttttttttttttt

SEQ ID NO: 11172 - DNA, 1048 bp, Sorghum bicolor
  Clone ID: SORBI-28MAY03-CLUS13127_1
gcacgaggcagcaactgaaaagcgaccgaaaagcggggaggaggggaagggacggtgaggccgatccaatcatcaatccaccatcgtcactgagaggcgaaggaaggtagcctacgactggctcgatcgagttcccggtgggaggtcctctcgaatcgcccccaatcgagaccctacacgaaccgaggatccaagatgagtttcctgttcgggaagcggaagacgcccgccgagttgttaagagaaaacaagagaatgctggatcgatccattagggaaattgagcgggagaggcaaggattgcaggcccaggagaaaaagctcatcactgagatcaagaaaacagctaaagaaggccagatgggagctgtcaaagtaatggccaaagatcttattcgtaccaggcatcagataacaaagttctaccaacttaaatctcagctccaaggagtttctctaagagttcagacactaaagtcaactcaagctatgggtgatgccatgaagggtgttacaaaggcaatgggtcaaatgaacaggcagctaaatctgccaggattgcagaggataatgcaagagtttgaacgacagaacgagaggatggagatggtgagcgaagtgatgggagatgccatagatgatgctttggaaggagatgaggaagaagaagaaactgaggagcttgtgaatcaagtacttgatgaaattggcattgatatcaaccaagagcttgttggagcaccgtcggccgctgttgctcaacctgcttctgccggaagggtcgcccaggccgaaggtactgggaatgctgacagtggaatcgacgccgatttgcaggcaaggctggacaatctgaggagaatgtaggtgctgcagtagcaaaagagtagcgccttctagcactgttgcctgcggatgtgaatgtgaatgaatacccagccaatcaaagcaaagtttacaagccaagtgtgtatgttgaaatgaatcaagtgttcaatatgccggtagtgatgacaaatgttaataaatatattttgttacatgtatg

SEQ ID NO: 11173 - DNA, 1326 bp, Sorghum bicolor
  Clone ID: SORBI-28MAY03-CLUS13226_1
tttcgatacatacatacacccccgcgcacgtacgtcgttcgtcccgcagctggttcatgcactacctcatgcccaagcggggcatcctctcgctgcactccggctgcaatatgggcaaggacggtgacgtcgccctcttctttgggctctcaggtaccgggaagacgacgctgtcgacggatcacaataggctgctgatcggcgacgatgagcactgctggagcaacaatggcgtgtccaacattgagggcggctgctatgccaagtgcatagacctctcccaggagaaagaacctgatatttggaatgccatcaagtttggaactgtgctggagaacgttgtcttcgatgagcatactcgtgaagttgactacaccgacaaatctgtcaccgagaacactcgggctgcttacccgatcgagtacatccccaacgccaagataccatgcgtcggtccgcaccccaagaacgtgatcctcctggcgtgcgacgccttcggcgtgctcccgccggtgagcaagctgaacctggcgcagaccatgtaccacttcatcagtggctacactgccctggtcgccggcacggaggacggcatcaaggagccacaggccaccttctccgcctgctttggcgcggccttcatcatgctccacccgaccaagtacgccgccatgctcgccgagaagatgcagaagtacggcgccaccgggtggcttgtcaacaccggctggtctggtggcaggtacggcgtgggcaagaggatcaggcttccctacaccaggaagatcatcgacgccatccactccggcgagctcctcactgccaactaccagaagaccgaggtctttggccttgagatccccactgagatcaagggcgtgccgtcggaaatccttgacccaatcaacacctggacggacaaggccgcgtacaaggagacgctcctgaggcttgccgggctcttcaagaagaacttcgaggtgttcgccagctacaagatcggggacgacagcagcctgactgacgagatcctcgccgcaggccccaacttttgaactacagcagtggatccggatgaataaaacggtggtgtgcgtgcgtgtgtgcgtgtgatgtgtgaagatgatgatgatgacgaaaaaagtgttggatcgatgagccagcatagtatagactagttcggtatattgtcatgggtgcgtctggtgttgttaccttggtttgttccatcagcttgttcagaacagtttgcgcgtgcttgcatcttgcccctgtatgtctctggtttcagaatttgaatatacgaaacagcaagatcgggttcat

SEQ ID NO: 11174 - DNA, 922 bp, Sorghum bicolor
  unsure (1)..(922): unsure at all n locations
  Clone ID: SORBI-28MAY03-CLUS13492_1
gccggccgggccgggaaaccataattaattaaccaatcatgtctggtcgtcgtcgtcgttcgtggacaatatgggcgcctctcctggcgtcgctgctgctcgccgggctggcgctgtcggccaaggtggtggacgaggaggaggcggaggcggacggcgacgacggtggtggcgccagcaagaagaagaagccccacgttaaccacggcaagttcaaggcggacccgtggacggacgggcacgcgacgttctacggcgggcgcgacgggtccggcaccacggacggcggcgcatgcggctacaagggcgagctgggaaaggactacggcgcgctcacggcggccgtgggcccgtcgctctacaccaacggcgccgggtgcggcgcgtgctacgagctcaagggctccaagggcaccgtggtcgtgacggccaccaaccaggccccgccgccggtcagcgggcagaagggcgagcacttcgacctcaccatgccggcgttcctcaagatcgacgaggagaaggccggcatcgtgcccatcacctatcgcaaggtggcgtgcgcgaggcaaggcggcatccggtacaccatcacggggaacccgaactacaacatggtgatggtgaccaacgtgggcggcgccggggacgtggtggcgctgtcggtgaagggcaacaagcgcgtcaagtggacgccgatgaagcgcagctggggacagctctggatcacggaggtcaacctcaccggcgagtcgctgacgttccgcgtcatgaccggcgaccaccgcaaggccacctcctggcacgtcgcgccccgcgactggaagtacgacaaaacataccaggccaccaagaacttctaggatcggatcatcttccggccggcctcttctttatgcatgcatattttgtatttttgtatatn

SEQ ID NO: 11175 - DNA, 738 bp, Sorghum bicolor
  Clone ID: SORBI-28MAY03-CLUS13543_1
cccttgatggagctaatgttgaaataagggaggaggtaggagaagataatttcctccttttcggtgccaaagctgatcagattgctgggctgaggaaggacagagaaaatggcctgttcaaaccagacccacgttttgaagaagccaagcaggttataaggagtggcgcttttggcagctatgactatgaacctctcttggattcccttgaagggaattctggatttgggcgtggtgattatttccttgttggctatgacttcccaagctacattgatgcacaggaccgggtggacgcagcctacaaggataagaagaaatggatcaagatgtccatcttgaacacggctgggagtggcaaattcagcagcgatcgcaccatcgcccagtatgccaaggagatatgggacatcaaggctagccctgttgcgtgaacgagggggacgtgattcaacatcaagcatagtttcttcggatgctacaataataaggatgaataatgacccacggtgcttgacgcccacttctggtgcttgacgcccacttccgatgtaggcatggaacggggcacgaagcttgttcttcctcgcggtctattttgaagtgcatgctatatgcaactgttttttttttttggttctttttttcccttgtatgaaacaagatccttttgatctgtgttggattatttatcctgcaataaaataattcaattaggatatttgtcgcaaaaagaat

SEQ ID NO: 11176 - DNA, 804 bp, Sorghum bicolor
  Clone ID: SORBI-28MAY03-CLUS15003_1
gccggccgggcctggatatatgtcacacttgttgtggtttggtcgccaaggagaggggaaagtgccgtcgtctctgaccctctgaatctctccctctccctctgcaacgcatcaagaaaaggaactgcagccagcgatcgaggaacacaagcaccggcggcaaacatggttcacgggaagctggaggtcctcctcgtctccgccaagggcctcgaggacaccgatttcctcaataacatggaccccttcgtgatccttacatgccgcacacaggagcagaaaagcagcgtcgcaaatggagcaggaagtgagcctgaatggaacgagaccttcatcttcaccgtctctgatgaaaccccgcagctccatctcaagatcatggacagcgatgtcactaacgatgattttgttggtgaagcaaccatccctctggaggttgtgtttcaggaaggcagccttcctccggcagttcatccggtcgtcaaggaggagaaatactgcggagagatcaagcttgcactcaccttcactccagcagaggaaactcgaagccctgatgacagcgtctggagttgatctgcctggaatgcccgcatcgagcaagatgataatcttctgaagaattagtattatttgttatgcgtccctatatatgctttgtcatgaactgaatgtttgcatgtaattcccagcattgcgataactattcatcagagttgtttggtatgtgtaactcaccgggatatatgcatgggctgcagaactatcatcatctctctaaaaaaaaaaaaaaaaaggccccta

SEQ ID NO: 11177 - DNA, 385 bp, Sorghum bicolor
  unsure (1)..(385): unsure at all n locations
  Clone ID: LIB3480-054-P1-K1-B3
gtttcaggaaggcagccttcctccggcagttcatccggtcgtcaaggaggagaaatactgcggagagatcaagcttgcactcaccttcactccagcagaggaaactcgaagccctgatgacagcgtctggagttgatctgcctggaatgcccgcatcgagcaagatgataatcttctgaagaattagtattatttgttatgcgtccctatatatgctttgtcatgaactgaatgtttgcatgtaattcccagcattgcgataactattcatcagagttgtttggtatgtgtaactcaccgggnnttaaaaaaaaaaaaaaaaaaaaaaaaaaaaaaaaaaaaaaaaaaaaaaaaaaaanaaaaaaaaaaaaaaaaaaaccccccc

SEQ ID NO: 11178 - DNA, 649 bp, Sorghum bicolor
  Clone ID: SORBI-28MAY03-CLUS15385_1
aagtactatgccataaatcggcataagatgactgttttgacaccatcttatcatgctgagagctattcaccagaggacaataggttcgaccttcgccagtttctgtacaactcaaggtggccctaccagtttcggaagatcaatgagcttgtgcaagagatggacaaagatggcaaatgggaaacttctgcagaagggaagctgagagggcagacaggtgcgcagggaagcggaatgggagttgtggcggcgggatctgccaatcccagtgctgggttctgaagagaaccatactaacacacgggggctggttcctcaagaataatgcaccggcccccaggacacgggctgccaatgtaaatttgtctgcttggttcccttgtactgcatttcttctccctgataagagagctgaagttgctctggtaacacaaatcggactgatgcaaaatgtaggctaccagttctttttctcccattttgtctaatgtctagtacgatctacaaagtgggcaaccaaaaaacatgtgaaaataagatggaatccctttactaaacagattgtcgatccaaagtgaaaaggaaagcattagtgtaaagatctacttaaactgatatttctttgttatgtacagtaagtgtcctttct

SEQ ID NO: 11179 - DNA, 1342 bp, Sorghum bicolor
  Clone ID: SORBI-28MAY03-CLUS15394_1
gcacgaggaggatatattatctgaggataaatcaaatgatggctcagataatgaaggcgacgatgaagatgatggcattcctgttggttctgatgaagatgagaatgttgaggttagacagaaagtcccggccgttgatcctaaggagcaagaagactttgatcgagagctcaaagcccttcttcaggagagcttggagtcacgcaaatcagaggcccgttcaaggctccctttgaatatgatggtaccgatgaatgtccttgagggttcaaaggactcaagggccacagaatctgagagtggagaagaaacagtagatgaagagggtggcaatgctgggagtagcagcaaggtgcgtgttaaggtgctaatgaagaaaggacacaaacaacagacaagacaaatgctaattcccgctgatagttcaattgtgcaaagcacgaagcagcaagaagccgctgagcttgaggagaagcagagcattaagcgaaggatcctcgaatacaatgaaagggaggaggaagaactgaatggagcatcacaaatggggaactggggtcaaggagctaccaataccagcagtatcagatcaggtggccggggcagctgggatggttcaacacggggaggtggtcgacaacggcaccacatcgcgggttctggtggtttctatcacagttatggcaggagaagataagtttgctgcgtgagtgtgtcctgatgggaggtggtcgacagcggcaccgcaccgcgggttctggtggtttctatcacagatatggcaggaggagataagtttgctgtgtgagctatttgtcctgagctttttggcagggcaatgcttctctctatttaaccgcctaacatacatacatcagattaacagtgaagggatttcggggaggttaacacagcttgatggatgattgcttccaccaccctaatctgaaaagaagacaattctaccactgatgggagatagcaatgccttgaaggagctatttttttttccctgatggtccgaatgatctcaagttgctacggtgctttggtaaagctggtagttatggctgtacctggagagcacatatactccggttgcgcatgtacatatatataacgtaacataatatggcaaggagtgtaggtcgtttggaagattgtgttttgtagcaatgtagcgtgcgcacatgtggataccatggtggtacttgcatagtttacatgggcatactgtttcgacgccatgtggggcggattcgatcacgatttaactgtttgacgcccattctaatttagtggagtatttttactggcaatgtcgaacaagcatcgcatctcg

SEQ ID NO: 11180 - DNA, 730 bp, Sorghum bicolor
  Clone ID: SORBI-28MAY03-CLUS1503_1
gccggccgggcacaacgcaatcgttgtctcccaccctccagtaaccctagcgacagcctcggctcgtttgatccccgcggggagctgtagatctgcaagcgggcggtccggcgtccggatcgggcagcgaagatgacggaatccctggtgcggaacaagccggggatggccagcatcaaggagatgccggtggtgcaggacgggccgccgcccggcggtttcgcgcccgtgcgctacgcccgccggatccccacctccgggcccagcgccaccgccatcttcctcaccaccttcggtgccttcgcgtatggcatgtaccaggtcggccaggggaacaaggtccgccgggcactcaaagaagagaaaattgctgctcgtagtgctatactgccaatgctccaagctgaagaggatgaaagatttgtcaaagagtggaagaagtatcttgaagaggaggcgaggatcatgaaagatgttccagggtggaaggttggcgagagcgtgtacaattccgggaaatggatgcccccggctactggtgagctccgccctgaggtttggtaagggcctgttgtagacattgagaatgccatcatcatgtcgtgagggcatgaataaggctttcaaacctgggcatccttcaattttcactaaggaacagttgcttaaacacatgtatttggttgggctcttttgaaatttggctggttaataattgcacatatgaagg

SEQ ID NO: 11181 - DNA, 345 bp, Sorghum bicolor
  Clone ID: LIB3478-026-P1-K1-A7
caccctccagtaaccctagcgacagcctcggctcgtttgatccccgcggggagctgtagatctgcaagcgggcggtccggcgtccggatccccaccaccttcggtgccttcgcgtatggcatgtaccaggtcggccaggggaacaaggtccgccgggcactcaaagaagagaaaattgctgctcgtagtgctatactgccaatgctccaagctgaagaggatgaaagatttgtcaaagactggaagaagtatcttgaagaggaggcgaggatcatgaaagatgttccagggtggaaggttggccagagcgtgtacaatttccggaaatggatgcccccggctact

SEQ ID NO: 11182 - DNA, 1123 bp, Sorghum bicolor
  unsure (1)..(1123): unsure at all n locations
  Clone ID: SORBI-28MAY03-CLUS154_1
gcgtccgntgagttcatgcctctaggaagtgggggggggggttattttcaaggttatggtgcccttccgtggtcgacagatgaaaatgcgctcggtgctgcaaaaggacttgcttttctgcatgaagctgagaagccagtcatctatagggactttaagacatcaaacatattgctagatgaggaatacaatgcaaaactatctgactttgggcttgcaaaagatggaccagttggcgataaatcccatgtttcaactcgtattatgggtacctacggttatgctgcaccagagtacattatgacagggcatctaacagcgatgagcgatgtctacagctatggtgttgtactactggagctcctcacgggccggaagtcactcgacaagtcccgacctgtcagggagcagatgttggcagactgggcattcccgctgttgacacagaagaagaaggtacttggcatagtagacccaaggcttgccgaggactacccagtaaaggcggtgcagaagacatcgatgttggcataccattgccttagccacaacccaaaggctaggccgctgatgcgtgacatcgtggcgactttggagcctcttcagcagctggaggagacccctagtgacagtgtggcgatgacacttcaagggacttgaagtgttcatcacttcagagttcacgcacagctcaggaaatacaaagtgccacgtacttaatacatgtgtgtgataatagtagctaactagtgttcttgatctgcagatgatttcttgattgtttaattaatccatggagacagtagttttgttgagcagaaagttagtatatatctctgtaggccggtttaggtgtgtatccagatctagtcctggcatagcgatttccccgacatttcggatgtgggcaagtctgtgcaatctgcaatgtttgttgcccacaaaggaagtttgcttaccagtgtttgtaacctagtattgagcagctcatgatctatgcatgctgagtaatgtagatatatctattcctgggattgaaacaaaaaccacacgctttatttcctctttgtgattaaggggttacaggttatagacttatagtcgttattggttttgtggctgt

SEQ ID NO: 11183 - DNA, 844 bp, Sorghum bicolor
  Clone ID: SORBI-28MAY03-CLUS15466_1
gcacgaggcttccttcccaacccggaaaagagaaagccgagcaccaattcgccgaggagaggaaacagacacagaacagagccaaggagaaatggcgcactaccaccccaaggaggcttacggagacctcgaggccggcttctccggccactcctcctcctcctcctcccctctgaagccggcggcctcgccgaggcggcccggccgcatgttctgcgacccctgcgacgacgccgacgagctccacggccaccaccactacctcgacatctgcttccgctgccggaaactcctgtccggcaacagggacatcttcatgtacagaggtgacatgccgttctgcagcgaggagtgccggcaggagcagatcgagatcgacgaggcgagggagcagcggctgaagcagacggggcgcgccgagcagcagcggcagcggcagcagaagcagaacccccagaggatccccatctgggcgtggtgatgctgatgctgagaaaatttttgggcgccgggaaacgtacgaacgaacctagtaggatttagcttcacctcaagaacaagaagaacaccaagcaagggcggcgatggtgcgtgcggatcgccgccggctggacggaggagaaggccacggcacaggcctgctgcgtcttttactccgttgattgatcggatcctcttgatctccgaaagatggagacggaagggttggtttgagcgtgagtttgcacgggttctgctgttcctcttgcacgagtgaaaagggtgtgcgtgctgcgtgtgggattgctgccgtgtaacctgtcgatacgtatgaaacaagtgcagaggcctaaagaagtcctcg

SEQ ID NO: 11184 - DNA, 856 bp, Sorghum bicolor
  Clone ID: SORBI-28MAY03-CLUS13907_1
gcacgaggccgcgccgcggcgcggggcgcggcccccgggggttctccccccccccgccccgctgcgccccaccacgaggatccaactcaggcaagcgtcgccgtctccccctacccccgaatctgatgcttcatcgattggttccaatcctcaccacctccatagtcatgcacgagattgcgcgtgattaggaacagggaccaatcagattgcattcagatttgggggagcaggaggagccattgtcggtgttcttgtcgtcgtcggaggtcgagggatggtaggggtgctgtcgaatcgcgtggatcgggacgacctcaaggccggggatcacatctacacttggcgggctgcctacatctacgcccaccacgggatatatgctggacatggcatggttatccattttacaagggcagctggacatgagattggaacaggaacattcttggattggttcctttatagctcctctccggcagcaactgagggtcctccctgccagaaatgtggccacctagttaagtctgatggggtcatcacttcttgcctcgattgcttcttagatgggggtagcctgtacctgtttgactatgccgtgtcgcctgctttcttccttgccaaagctcgtggaggaacctgcaccctggctgcctctgaccccagtgatgttgtgatccaccgtgcacgatacctcctggacaatgggtttggcatgtactccctgttcaagaacaactgcgaggactttgccatatactgcaagactgggctgcttgtggagactgctttcagtgttggccgtagcgggcagcttgcttctctgactgctgccttcagtgctgtggcctcatcg

SEQ ID NO: 11185 - DNA, 1856 bp, Sorghum bicolor
  Clone ID: SORBI-28MAY03-CLUS13911_1
gctctccagtctccatcctcatccctgcttcaatcgacatcttcttcttcttcctttctccatgggaacccacaccatttgagacagctcctcacttcctctccccccccacgaaatcctctcttttctccacaccacacttgttcgtcatctttcgtcttcacggtcaattccccaaccaattccaatcccaaccgggcacactacagcgacgcgtctgccaatttctcttccaacaaatccgtacgtccgcgtgcctccctcctccgcctcaaagttctaccggcaggcgctgcagtgcacgccccgcccggccgccggcctcgtcgtcgaatggggtgcttcacgttcaggagcggcggcgggtccaaatcccagcacccgcggtccggcgcccggacgccggcggccaagtcgaccccggcgtcgtcgtcctcctcctctccctcctcttccggcggcgcgcgcggcaagaccaaggcgtcggcggcgtccacgcccacgcggaccatccaggagctgtcggaggagcggggcgcgcagcggctccgggtgttcgacctcgacgagctcggcagcgccaccaacggcaattcagccgcgcgctcaagctcggcgagggcggcttcggctccgtctaccgcgccttcttccgctccgcctccggcgcccgcgtcgtgctcgccgtcaagcgcctcaaccagcgcagcctccaggggcacaagcaatggcttgctgaagtccaattccttggtgttcttgagcacccgaatctcgtaaagctgatcggctattgcgcagtggattcagaagcaagcaagcacaggctgctggtctacgagttcatgcccaacaagagtttggatgaccacctgttcaaccgagcacatcctcccctttcatggagacagaggctgcagatcatgatcggtgctgcacggggtctggattacctccatgaaggagtgcctgaagttcaggtgatctacagggatttcaaagcgtccaacatccttctagacgccgaattcaagccaaaactgtcggattttggcctggcaagggagggtccaaccgaagggaaaacacacgtctccaccgcggtggtgggaacgcacgggtacgcggcgccagactacatcgagacagggcacttgacggcaaagagcgacgtgtggagcttcggcgtggtgctgtacgagatcctgacggggccggcggtcgctggagcgcagccgccccgcggaggagcagaagctgctggggtgggtgcggcagcacccgccggacagtgctgggttccgggccatcatggacccgcggctgggcggccggtacccgctggctgccgcgcgcgaggtggccagactcgctgaccgctgccttggcaagaaccccaaggagcggccgtcgatgagggacgtcgtcgaggagctcgaacgggtgctgcagatggagccgccaccgccgctggccgctgacaaaaagaaaggaggcgacggcagactgccgacgaagaggtgacagtggcggcgggagtgttgccggaatacactccggcgtcccgttctggccctcctccggctgtcttccaaattccgaagtttgtgtgtataggaggtatatacagcaggagaaaagaacaattctctgaacaggctatactacatgtgaagatcgattgtgaatttgtgatttcaatacgcaaatgaaaattcagcaagaattctcatacccaacgtgtgttgcagacgtgcatgaggagtggtatgagtctggtgtgtgctaactgttactccttagccaattttttgaaaccaacttctggacttatctttaatcaatttttaaaactt

SEQ ID NO: 11186 - DNA, 708 bp, Sorghum bicolor
  Clone ID: SORBI-28MAY03-CLUS14001_1
tccccggggggaaaagggactagttctagatcgcgagggccgccctttttttttttttttttttttttttttttttttttgacattgaaaaaacacaatcattataattgagtaattttgcatcagaggaagtaagccatcagattcagagcccataattggtgtcttacattggtaataatccatcagatccattgtgaacccacattttattacaaaaccacagttgaaatgtggagctgagacaacaactaagacgatgggggatcctcagtcctcaccatgtgtactgacaacatgttgcaaaaaatacaggtcgctggcaaacaaatctggacatctattcatcatcatcaatgtagcgttgctcgttggctagcctggcacgctcaagcatcttgtcgaggtcctccttaagcttctcgtcaaactttaccagctggttcacaaacactgcaccgagacccattcccaacacatgctcccatggatggcgcatgtaggggagcttgcggagggcgttggagtacatctgggtgcctaaccccaggagggcaccgatgatcgtcggggtcgccggcatcctgctgctctccggtcctgtcggggcgaacggcgcggctgcggcgggggccgggggactggacggcaaggtcggggagagtgctgtgggaacttgtggtggtgagttgtcccggcccggccggc

SEQ ID NO: 11187 - DNA, 1053 bp, Sorghum bicolor
  Clone ID: SORBI-28MAY03-CLUS13925_1
gccggccgggctgcgattagcactataataatccgggcgccatggcgaagactacgatcctcctcctcctcctcctcctcctccttagtagtatccttgttgtcgcggatcaagctgctacaacggcaacacaattgtctcctgccgctgaaaagtccattggcgacctcaatttagaggttgagaaggttatcgatgttgtcgtctctgctgccccacctgcgaagcagatggaaacaatgcatgccgctttgaagcatctccaacccatcaaatctgctctcgccaaggccaaggagtcaggagatgagaagaaaatcgccaaactcgtctttagggtggagatagccgctgccatcatcaatgctgcgccggcagacaagaagctaatgatgatggaggactccttcaactcggtagctgcacccagcccgctagattgccccaccgtcgacaaggcctactgcgagacggactccaagattcagaaggcctttgatggagtcgtcgcggctgccccagtagagaaaaggttggaggtcagagctaccatcctcaagaaaacaatgtacaccgctggctccactatcaacaaggcgtatgcggatggagatgagaaaaagatcgctcaagtccttgctgcctacagtaaggcagctgatgaggtcattgcagccgctcctgctgacaagctcactatcatggagaagacgttcattgctgccgccgccactgggaactgaatcgttgattgatcggagtcgtccaccagtgtcatcaccgtgaccacttcctcgatatgatacatactacgaggcattaattgaggcaaaacctccgctctacccattgttcgatctcataactaggtttatccatgattttttatagacaaatattttttacacgctttataatatatgaattttactttttaaatagcaattgttttcagaaaaaacaaagaacgacttatctcccggtcacatgcacacagtctatttggagggcgttatggcttttaatattattatattaagataaagtattctg

SEQ ID NO: 11188 - DNA, 434 bp, Sorghum bicolor
  Clone ID: LIB3480-009-P1-K1-C12
cggacgcgtgggtctagatcgcgagctagaactagtcgaagactacgatcctcctcctgctggtgctcctccttagtagtatccttgttgtcgcggatcaagctgctacaacggcaacacaattgtctcctgccgctaaaaagtccattggcgacctcaatttagaggttgagaaggttatcgatgttgtcgtctctgctgccccacctgcgaagcagatggaaacaatgcatgccgctgccatcatcaatgctgcgcctgcagacaagaagctaatgatgatggaggactccttcaactcggtagctgcacccagcccgctagattgccccaccgtcgacaaggcctactgcgagacggactccaagatatagaaggcctttgatggagtcgtcgcggctgccccagtagagaaaaagttggaggtcagagct

SEQ ID NO: 11189 - DNA, 817 bp, Sorghum bicolor
  unsure (1)..(817): unsure at all n locations
  Clone ID: SORBI-28MAY03-CLUS14278_1
gcggcgccggggctgatcgtgttggttcgggatgcttctgggttcgcacgcgtgggggtgtgccttgtttgatggctaacctgtcgttattaatgcagcgcgtgttatttgcttgcttttcgcagtgcatcctagccttgcgctcgtgctggtggcctcccctctgcactggtgcgacggttcttgttgtattgctgattgctaatggaattattatgatatcaagatcaattttatttttgatgtactaaaaattgcactatttattcagctttttatgatggaatttgtatgctgggtctgggagaatcgctgtattgcctaccttagtccctactggcccagctgttccattgtcgcagtccatgccctgctgcagttcctgattgccgcgtgctacagactggcggggcgccgctgccttgatatgtgcatgctgcatgaacaagtttggactttgcattcaccagttgcactcatccgtcagactctctaaaagcattttctatttaatgttcttgtgtactgacttgcggatgtgaagaccgtcaggatggaaaggggtgtgaaggccgtcaggactaactcgcctcaacttttgctgggttaactagctctaatcacagcttgtacagttgccggctatagatttttatgccttttcaattttttatcttaatgtgtcccgtgcttcaaattaaataagttaattatactatgcgagacatgactttattatgtctcattatgcatgagtatttttttgtattatatgtatggtcacatataattgcatactatgcgagacatgacttnn

SEQ ID NO: 11190 - DNA, 882 bp, Sorghum bicolor
  unsure (1)..(882): unsure at all n locations
  Clone ID: SORBI-28MAY03-CLUS16112_1
acctancaaatgaaatctacaacaaagttgaatatctcaagtctatcatgggaagaaatcaagatgccatattagctgcatgtctatatattgcttgtagacaagaagatcggcctagaactgtgaaagaaatatgttcagttgctaatggggccacaaagaaagaaattggcagagcaaaagaatttatagtgaaacaactggaagttgagatggggcaatctatggagatgggaacaattcatgctggagattttctgaggcgtttctgctcaactcttgggatgaacaatcaagctgttaaggcagcccaggaggcagttcagcgctcagaggagcttgatataaggaggagcccaatctcaattgcagcagctgtcatttatatgataacccaactctcagaggacaagaagccacttaaagatatatccttggctactggtgtggcagaaggcaccatcagaaattcgtacaaggatctatatccctatgccgcaaggctcatcccaaatacctacgccaaggaagaagacctgaagaatctctgcacaccttaggaagcttatttttcccccttttgttgcataaatcggaattagatttgtcaaagaggagtgagtgaagttgttcctggttgtgactgtgccgggcaatgtgtcgtcgctgccgtgcttaactttatgtggatggaccaatgagaacagaagttgtcctcatcagatcgaatttcttttcagagcacctaccacctgaagatttgtgggatagccaaggtgtcgttttcgtatactcccttgggaaagaatgtagatagcaagcagttcttggacaagcacaagattttactttaaaaacaggatttggccatcttctgaagaa

SEQ ID NO: 11191 - DNA, 1390 bp, Sorghum bicolor
  Clone ID: SORBI-28MAY03-CLUS16318_1
ctttcctctcctccaagccagcgcgcggcgcccacctccggcaccggccttctctcctttttatacctccgccgcggcgacgcacgccagccaaccccaaccttcgattcccaatcctccccacctataaccccccaaaactctcgaaatcacaggacgcggatccaaaactcagaggcccccctgttgtcctctcccccaccaccaccaccacaccctgctgcctgccgccatgtcggcgaccgccacggacgaggccgcggtggaggcgcgcctccaggcgctgcggcagaggctcgggaagaagcagcacttcgaggaggccgtgaacgaactcgccgccgccgtccgggaccgctacgccggcgcctcacccaccctccgcaaatcgatgtattcgacggtttgccgtgttgcaacagtgctccaaaccagatatacagctccggggttctggcgtgctggtctgaacctcttcatgggaacagagaagctggtaagcaatcctgctgaaaaggagcacctgaagacctgcatttcaagggcccgtgagcatcttgatgaaaaagaaaatgaggattccatgccaagcagcagagaagcagacaccagatttctttttgaagggcaccttactgtgggacaggaacctccacctccagcatggcttgttgcccagaatttaacacgggaattgagcatactcactgaatcctctggagatcaagatgggaacagcaatagaacagtgcctagagccgaggagattacacctgctataatgaaccttctagaatccatatcaggcgacagggatctagaaactgctttggaagaatcactgcagggaatcattgagcatccaccaagagcacccccggcttcaaaggaagttgttgccaatctacctgtcattgctgttaccgaggaagtcatcgctagattgggcagtgagacggagtgtgctgtctgccgtgaaaacttggttgtggatgacaagatgcaggagcttccttgcaagcatctcttccatcctccttgtctgaagccatggctggatgagaacaactcctgtcctatctgtcggcatgagctgaggacggatgaccatgtgtatgagagcaggaaggagcgtgaaaaggaggaggaagaagatagaaggggtgcggcaaatgctgtcaggggtggggaattcatgtatatctgaactcaacagtaccataatgtaatccctttgatgaactttgtgattctctgacgcattacaattgtacacctcttgtcccccacaaatactatgtatgtcgcttattacctctgatctgtactatgtgctgtctgtgttttcttttatcgtggtgactagatcaacaacataaagtcgatatgt

SEQ ID NO: 11192 - DNA, 1272 bp, Sorghum bicolor
  Clone ID: SORBI-28MAY03-CLUS16401_1
gcacggcgcccacctcctttctcgctcttgttccctgcttcgcttcgcctccgtccccttcctttgcttccacctccacccccctcctcggtcgtagagagagagagagagagagagagagagggagcccggaggagaccgccgccagggagcgcgaggaggcggaggagtagcatggcggcgccgccgtcgaggtcccggggcgactacgaccacctgattaagctcctgctcatcggcgacagcggagttggaaagagttgcttgctgctgcggttctctgatgacacattcacaacaagttttatcaccaccattggcattgatttcaaggtcaggacagttgagcttgatggaaagcgtgtaaaattacaaatctgggatactgctggtcaagaacgtttccgaacaattaccacagcttactacagaggagctatgggcattctgcttgtatatgatgtcacagacgaatcatccttcaataacattagaaattggattcgcaacatagagcagcacgcatctgataatgtcaacaagatcttggtgggcaacaaggttgatatggatgcaaagcgggtagtgtccacagctcaaggtcagaagctcgcagatgaatatgggatcaagtttttcgagacgagtgcaaaaacgaatcaaaatgtggagcaggttttcttcaccatggcaagggacataaagcaaagactcaccgagactgtagccgctgcgactgagcccccaactattcagattagcaggccagatcccgaccaggctggcacggcctcgtcaaggtggtcatcctgctgtaacacctgatctgcagcgtggtggcgtaatcgcacagccgtctgtcttgatgtgtgactgctagggttgctgcttatcgtgtgtgtttacactccggtgccaaagccaagatgtaaatttcgctcggttgatgatatctagtgcaagagaccaacaactctgaccactatgggtgctgtgattcttcagtgaggtgttccggtgttcccgcttcacatgttattgtcgccttgttgtagtagccccagtggcttgcgctaattaatgtatgcttgggaactcagtgccttttagctccagatttgccagagcaaacaaacgtctaagcagataagctggtggattgatttgctcctgtcatcatgtaaacaaaaccttggagagacagacagcagtagtgtctgattgtgtggaaaacatggttgtacattattatttagtgcattactgctatct

SEQ ID NO: 11193 - DNA, 916 bp, Sorghum bicolor
  Clone ID: SORBI-28MAY03-CLUS165_1
cccacagagcgaccagctccaccaatcgcagcacctctgccttccacctttatgcctccacctcatcctccatggacgagccggcggtccattcaccactactcggccacgccctcaccaccggcgagtagcagagcgcctcgctgcccttgccttcacggatccaaattatcggaagagaagttttgataccccctgccttcatccgtaccacgacggcggattctctgggcttctcctcgatgtccgcggcggcggccgggcaggaggtggcgccggccatcgtggccgtagccgaggcggaggagtgggaggtgtgcgcgtgctgcgggctcagggaggagtgcacgccggcgtacgcggccggcgtgcgcgcgcggtacgtcgggcactggctgtgcgggctctgcggcgacgccgtgggcgaggaggtcgccgccgggggcgggtcggtgctggaggtcgaggcggcgatcgcggggcacgccgccttctgccgcgcgcttggtggggggacgccggccgcggccgagcggctcatcgcggcggtgcggcggctgctccgcaacgccgacgcgggcgccaagcaggaggacaaggctgtggtggtggtggagttccaggaggccgcctcttgaccgcctgaagctgaatgggacggatcgaagatttgttcttgcaggcggcgctagctagctactctactctgctagtcctatttttcgtaatttaaatttttattagttctgaatatttgtatgcttaaaattcggacatgaacgctgaaatttctccagcccttgtacaagccctaggagatgtggaacatcagaaattttggagaaaaggggctgtgagaaatttgaagtatatatacaagctagtacaagatgggagaatccctctttcatgtcat

SEQ ID NO: 11194 - DNA, 906 bp, Sorghum bicolor
  Clone ID: SORBI-28MAY03-CLUS16501_1
gttgagcgtgtccggcaggagctaaagcatgagcttaagcaggggtacagagacaaacttgtggatattcgggaaggcacgtggcggaagcgaagagctgggaaactccctggcgacactgcttctaccttaaaagcttggtggcaagctcattctaagtggccatacccaactgaggaagacaaggctcgactggtgcaggaaacagggctacaactgaagcagatcaataactggtttatcaaccagcgtaagcggaactggcacaacaatccggcgtcatcctcgtcggacaaaagcaagagaaaaaggagcactgcaggtgatggcaacgcagaacaatcctggtagtgcactgttggggaacaaattatatgtaaataataatgcttctactgtgaagagtgtcatcatatttgttgctccagaaacgacccttcagaccgccgtttcctgagcccatattcatataaagacatcacacgatgaataatgttgcaagtagtcacataaactaaataacttgtatagtgaatgactagaaactagcattcatcgtttggtactgtatagtactatagtgtaattgtttggtcggactgtctcttgtataatggtgtaaggttcaaatgtactttgacctagcattcgatgttgtattttgtgatgtaaaaaccatggagtgtatttggattcgttttgtgttttatgtggaatagagacactctgctagtgttgccctcagatcggcagtgtcgtgttgtcaacttcatattaaaatattaaactaagtattttagcactgttcattgactaaaaaagccaaagatgcctaagaattcggtactcttgaatttggcacggacgtgaacaatgttaacttttgagcatttaaattaaactttt

SEQ ID NO: 11195 - DNA, 1670 bp, Sorghum bicolor
  Clone ID: SORBI-28MAY03-CLUS14824_1
cacccttttcgcatttcgcctcctccggtccgctccgctcctccctcccctccccttccctacaaaagccgcgagaaggcggggggggccgggggagaccggccgaccgctcgagtgcccgacccccccttacccctattgcgcttgccgcttggggccccccctcccgttcggcgcattcgcgttccgcacccgcaaggaggccggagcagcagccatgggcgtggaggaggcggggcgcgccgccaccggcaagaagctggcgctggcgagcatcggcttcgcggacgtccgcgtgggcgccgccgtgcccgggggtgccggcgtgtacaaggacggcttgctcgtcgtgggcctgcccgtgcccaaggacgacggcctcgacgccgccgcccgcgtcgtcggggacctcgccgccaggctgcccgacgttggcgccgccgctaggacttttctgaggaatagagaagtcgcagaattcgtgagtggagcattggctggtgcaatgactaaggctgttcttgctcccttagaaactatcaggacaagaatggttgtaggtgtaggatcaaaacatatttttggtagctttgtggagattgttgaacataatggctggcaaggactctgggcaggtaatacaataaatatgctccggattatcccaactcaagcaattgagctcgggacatttgaatgtgtcaaaaggactatggcatcagcacaagagaaatggaaagaggatggatgcccaaagatacaacttggcaatttgaaaattgagctgccatttcacttactatcgccaattgcaattggaggtgcggcagctggaatagctagcactttagtgtgccatcctcttgaggttcttaaggatcgcatgactgttaatcgtcaggcttatcctagtattgccattgccatcaacaagatctaccggactgatggacttggtggtctttatgctggcctctgcccaacgttggttggcatgcttccatatagcacatgctactatttcatgtacgagaccatcaagacttcctactgccgtgcacataaaaagaaatctttgaaccgtcctgagctgctgatcattggggctctttcaggtctaactgcaagcacaatcagcttccctctagaagtggcaagaaagcggctaatggtgggatccctacaagggaagtgcccaccccacatgattgcagcattagctgaggtggtccaagaggagggcgtcaagggtcttttccgaggttgggcggcgagctccctgaaggtcatgccgacgtctggtgtcacctggatgttttatgaggcatggaaggagcttcttttgggttcacggctccatgcctaagcaggaacctgacgaagtcaggctcttgcattgttacagaataaatttgttgtgctgtgtgggattttcaacatttttttctccttaaaaaatcccacacatgccaaccatttaggagagaagaaggccatcttgtgctggttgcactcatgattagcagtattagtcaattggcctttgctaacctggattatctaactactagcaactctgagcagagtcaacccggactgggtatgcattggccccaggcattgttattgtgaaatttgtctactaatgaaaggactatttcatagttccg

SEQ ID NO: 11196 - DNA, 1741 bp, Sorghum bicolor
  Clone ID: SORBI-28MAY03-CLUS14977_1
tctgggcggcctcccccacttcctccctcgccccgccggtggtgcctatggagctccacgccggcaaccgcgaccgcctcgttgccgcgctccgcggccacctctccgcctccgcccgcccgctccacggcctcgtcctcctccagggcggggaggagaagacgcggtactgcaccgatcacctcgagctcttcaggcaggagagctacttcgcttatctctttggagtgcgtgaaccagggttctactgagcaattgacatcgcctctggacagtcaattttgtttgctccaagattgccagctgactatgctgtttggatgggtgaaatacaacctttgtcgtacttcagggatacatacaaggtcaatatggtattctatgttgatgagattgcacaggttgtgcaagatcgtttcggggaccatggaaagcctcttctgtttctgctacatgggaggaatactgactctggaaatttctcaaagcctgctagttttgaggggattgagaagtttgatactgatttaagtacacttcatccaattttgaccgaatgccgtgtgattaaatctgatctggagcttgctctcatccagtatgctaatgatgtcagttctgaagctcacattgaggttatgagacgagcaaggccaggcatgaaggaatatcagttagaaagtatcttccttcaccatgtttatatgtatggaggttgccgacattgctcttatacatgtatatgtgctactggagataatagtgctgttctacattatggacacgcggcagcgccaaatgaccggactttgaatgatggagacatggcactaatggatatggggagctgagtaccatttctatggatctgatatcacatgctcataccctataaatgggaaattcaacagcagtcagataataatatacaatgctgtgcttaaggctcataatgctgttatatcacacatgcggcctggagttaattggatggatatgcacaaattagcagaacgggcaatacttgaatctcttaggaaggaacaaattgtccaaggggatgttgatgatatgatggttcaaaggttaggggctgttttcatgcctcatggtcttggccacttacttgggattgacacccatgatccaggaggctaccctgagggattggagaggcccaaggatccaggattgagctccttgcggaccacaagagaactgaaagaaggaatggttatcacagtggagccaggctgctatttcattgatgctttgctgaataaaacaagggatgatccaatttcctcaaagttcttcaactggcaagaggttgaaaagtatagaaactttggtggcgttcgcattgaaagtgatgtgtatgtgacagctcaaggatgccggaacctcacaaactgccctcgagagacctgggagatcgaggctgtaatggctggcgcagcatggcctctgccggcttcaagttccatggcggcggcagcagcagagaatagaaatggcatatccaaagcattgtaactttctccatgctgaatccatatcctaagttgaaccaaattcgatctagattcttatattcaataaatagtgaggccgaggcacaaaactgttggattgatgaccaataaccattaaggctggaaaacattccgtacgctcagttaatttgtaatctttcggttttgtggtgagatcgttgagaaacgtttagctattcaaatgc

SEQ ID NO: 11197 - DNA, 1330 bp, Sorghum bicolor
  unsure (1)..(1330): unsure at all n locations
  Clone ID: SORBI-28MAY03-CLUS1494_1
agaacccccctgccccaatggaggccaccacagcgctcgcgctctcctcgtcgctcgccaccgcacgccgctcgccggagaaggcggccgctgcttcgtccctccgcctccgaaacttctccgctacctcctcgctccaccacctccgcgctgcccggagcccagcgcctcgctcccacccgtcgtcgtcacccttccagggatggaggcggcgggggagggcgggagggctggtggttcgcgcggagatgttcggccagctcaccaccggccttgagtccgcctggaacaagttgaggggagtcgatatattgacaaaggaaaacatagccgaaccaatgcgggatatcagaagagcacttttggaggcagatgtaagtttgccagtagtaagaagatttattgagtctgtaagtgaaaaggccgtaggcactgatgtgatccgaggtgtccgacctgaccagcagttggtgaaggttgtgaatgatgaactggtacaactgatgggcggggaggtatcagatttggtgtttgcaaaatctgggccaactattatcttgttggcaggtctgcaaggtgttggaaaaactactgtttgtgcgaagcttgccttctatctaaaaaaaatgggcaagagttgcatgctagttgctgcagatgtttacaggcctgctgctattgatcaactcactattctgggtaaaaaggttggtgtaccagtttactcagaaggaactgaagcaaaaccttcacaaatagccaaaaacggtttgaaggaggcaaaagtcaataaggctgacgtaattatagtggacacggctggaagactgcaggtagataaatcaatgatgaatgagttgaaagaagtaaaaaaagcagtgaatcctacagaagttcttcttgtggttgatgccatgactggccaagaagctgcagggttggtcagctccttcaatgatgagattggtataactggtgctattctgacaaagctggatggtgactcaagaggtggagctgcactgagtgttaaagaggtgtctggaaagccaattaaatttgtaggacaaggagagcgtattgaagatctagagcctttctacccagatcgtatggcacaacgtatcctgggaatgggagatgtgctttcatttgttgaaaaagcacaagaagtgatgcgtcaagaagatgccgaggaattacagaagaagatcttgagtgcaaaatttaactttaacgactttctgaagcaaacacanatgatcgcccaaatgggttcatttcagcgtttaattggcatgattccaggcatgaacaaggtacccctgca

SEQ ID NO: 11198 - DNA, 1428 bp, Sorghum bicolor
  Clone ID: SORBI-28MAY03-CLUS14826_1
ggactctcgtaagtccgtatctcatggcattaccgggagcaactcatacgcacaacacagctaccaccccatcaagccaacatccaagcaagtggtcctcgagccaggcgcccagcacgcttccagtccacgccatgcttccgcgtcagccccaggaaccctcatgcgcccaaaggtcacctagagagtccgccaaaattctgctgtccattcatactccaccgaaagcgatttgcagtatgctcatttggagccatgaaccttgcgtgcaaatgtcgcagccacaacaagcgggaaagcgatacttgcatcgcagtgcacctttacaggttttgctgaacccttgatctttccccatgagactgcttcatcaggctgtgctccagaatcgctaccatcaaactcttgagccgtgttaatatagacagcataatctgcaccattgcggaacatattggcattgcatatatgatgctttggaagtcctccaccaagaactataatccctgtcttccttggtgttgcatggatggcttccccattcatcagtcgtatatcttgtacaatgtcaataataaggccaggattacgaactgcatgacagaacagcatgtctccaagtgatccatcagtcaacgctggttagtatacaggaatgttattcttgtatgcccaataaagataggagctttcatcatttatttctttgccaagactagctatcacctttgacggtgtccaaacattctcagtagattgctccagaagcatctggtcaaagagtggcatgatccagttctcaaacttgcaatagttatcgttgggcaccaacagatttcctatccggttcagtccttttgaccgcagcagtgctccaggtaaagaaaaatcacctctataagttggtgcaaggcatttaatgagatcctcctctatacccccagcacttgtaacaataacatccaccatgtgatgctgagctagaaaacggattatatcccggatgccagaagacacgaggtttgaagtgaagcccagaaatatcttgcacttcacagattctctatatttagggtcaagttctgcgtcatcacaatcctcactgggcttctcatgcgacaacctccaatctaacatctggttgacgacgtcgatggcgtcgccgaggttggacgcctggaaccccgtgctcgcaagcgaggcgagcagcccctcgagcccgaggcccgggtcgttgaagtcggcgccggcgatcctcgtgaaccgcgactcgtcgagcgactccgacggctttagcacgatggagcgcacgccgtccagcgcctccacgtcgcggaccacgccgccgcccccgctgcctcccgcgccggccatccctggagcccggagcccgaaccgccgccgccgccgcagccgcctccctcgcgc

SEQ ID NO: 11199 - DNA, 362 bp, Sorghum bicolor
  Clone ID: LIB3480-026-P1-K1-G7
ggctgcgagtcaccgaataagcttgcacatgatgtcatgatccctgtgcaggtggagtagacctcgtgctccaaaaggtggattggagagttcaacataattctgctgtccattcatactcaaccgaaagcgattcagtttgttcatttggagctgtgaaccttacgtgcaaatgtcgcagcaacaagaagcgggaaagcgatgcttgcatcgcagtgcacctttacaggttttgctgaacccttgatcttgccccatgagactgcttcatcagggtgtgctccggaatcgctaccatcaaactcttgggccgggttaatatagacagcataatctgcaccattggggaacatattggcatt

SEQ ID NO: 11200 - DNA, 1210 bp, Sorghum bicolor
  Clone ID: SORBI-28MAY03-CLUS15014_1
aaaaaaaaaaaaaaaaaaaaagccgccgccaaaaacgggggccaagacagatggtgcttctgcgcgtctgccaccgcttcggccgccccccgcgcttcctctccttcctctccatggcggcgccccagcaacctggtaaaaccctgccgcgcccctgtccttcgcctcccctctccgggtcggcgcccaagaggttcagggcgatggccacagacgtcgcggcggcggcggtggatcctccagccgccaggggctgccccgctatgaaggcggagttcgccaagcacgccgagtacctcaacgccctgaatgacaagagagaaaggcttgtgaaagctagtcgggatgtgacaatgaacagcaaaaaggtcatctttcaggtccacagaatcacgaaagttaacagggacgaagttctctccaaggcagaaaatgatcttgctgcagtggttaatcaatacattgcaaaactagtaaaagaattacaaggaactgacttctggaagctcagaagagcctacacctttggtgtacaagaatatgtcgaagctgcaacactgtgtagattttgcaagactggcactctattaagtcttgctgaaattaatgattctttactagcactaagtgataaatctgatgagcccttacagttaaatgtgcttgactatcttttaggggttgctgatttgtcaggagagcttatgaggctcgcaataggccgtatatctgatggggaagttgaatatgcaaaaactatctgtgcttttgtacgtgatatttacagggagctgactcttgtggtacctctaatggatgacaataatgagatgaagaagaaaatggaggtcatgctgcaaagtgtagtaaaaattgagaatgcttgcttcagtgttcatgtgagaggttcagagtacattcctctgctaggatcatcaggagacccagattattcctttttcggtgcctcagactttgaccaatgaatgttttgaagcaagaagaactaattgagtgttaaaggagcttagatcgatttaaggagcgtggttgcgttaggtgtttgatttttattgccagtttatgttgcacatcttggagtctgtaaatcttgccctaaggtggtaacctgggagaataatgttgcaagactaccctttttatggtgcagcctgtttgatctgtgctaataacagtgttcgtaatagcg

SEQ ID NO: 11201 - DNA, 572 bp, Sorghum bicolor
  Clone ID: SORBI-28MAY03-CLUS17010_1
gccggccgggccgggactacttgttgccgctcgcggtccgttccgcacacggcgacgactggggactgggaagaaaccgctacctcgccccctccaccagccgccggaaaccctagagcgcccgacacccatggatccgcagcagccggagcccgtcagctacctctgcggagattgtggagctgagaacaccctgaagcccggagatgtcatccagtgccgtgagtgtggctaccgcatcctctacaagaagcgcacccgccggattgtccaatatgaagcgcgctgaagagtgaagacaagggaaaacactaaagatggttgatctattactcgccactgtgtacctatgtaaagagtcttgtgatggaaatgaaaatgtcagacataatgtttgaaatgtcgtatgcctcctttggacttgagctttagtctgtaacgcttgaactggggactgatttgagaattgagatactgcagtaatatgttgatgggtcgtggcgaatctaatgcatgcgtgttatgcctgcgttatttattgacaagaaaaaaaaaaaaagaaacctacccta

SEQ ID NO: 11202 - DNA, 964 bp, Sorghum bicolor
  Clone ID: SORBI-28MAY03-CLUS17043_1
gctggcccggcggtccttctcgactcgttcccttttgcggcttctcgcagcgccgcgaatcccaaatcagagccgatccgacgcgaatcgatcgagaggcaggaggcagcacgattcggattgagccgagcgccatgaacccgagaggctaccgtagcaacagaacttctctcttcgatggcattgaggagggtggaatcagagcaacatcctattcttcccatgagatagatgagcaagaaaatgatcgagctattgatggactgcaggatcgtgtcagcattctcaagcggttgtcaggtgatatccatgaagaggtggagactcataacagaatgctagaccgaatggggaatgatatggatgcatcaaggggttttctctctggaaccgtggacaaattcaagatggtgtttgagaccaaatcaagtcggaggatgggaaccctcgtcgcatcatttgttgctctttttctgctggtttactacttgaccaggtagaagcatccgctgtgaaagctctgtgggctggcgtgctcaagaacatgctgagaatggatgtgctgatctaggcagatgccgtatataccttgaaaactcactgtcctgagtgcaaagcatgttgatgtgggtttcgtgaactctgcactgtataacacgactacagcgtgttgggtcgatcctctgctctgttgctggagctacagaaaatggattcaagtttgttgtccgttcctttggcatgttatgtttatggatatatggtattagtaatagtagtatgtggaatctctaccgtgatgtatctcacgttggttgccttgtggctggacttgtttaattgtagaagctttgtttgagcactatgtgaggtcgactcgtggcccctggcatctggccaaacaaatccagatggaaggaatgataatgtggttgcaccatgaacaactggtataataacaatt

SEQ ID NO: 11203 - DNA, 1347 bp, Sorghum bicolor
  Clone ID: SORBI-28MAY03-CLUS17099_1
cccgccgccgcccccccccccccccctcccccccaagccgaccccgccccccgccgccccggcccgggcctccccgcctccgcctgccggggcccccgccgccgtggccggggtccccggggtccgcccgccccccccccgccccgccccccggggggcccccccgccgccggcccccggccggcccccgggccgcctcccgggggcccgcccccgccggccccccgggccgccggcccgggtggaggccccccggcccccccccctccgccccccccgccgcccccagcccccccacccccgccgcctcccccgccgccgcctccggcccccccgccccccccacccccccctccgggccctccggcccccccgcccccccccccccccccgccgccgccccctccgcccccccccccgccccccccccccccgccgggtggccggccaggcctccgcccgcacggtgcacggcgtgatcgttgcccgccccggcgtgctcccctcccccccgcgccgcccgcccctctcgtgcccgcgcgggccgtgccacgcccgccggtgcgccgggccggggtcaaggcctacgcggagaagatgcacgacgtgatcgttggcgtcgccggcgagctggcctccagcctggggctggagaagcactcgttccaggactggccgtgccagttccgcatcaaccggtacaactacacgcaggagacggtgggctcctccggcgtgcagacccacacggactcgggcttcctcaccgtgctccaggaggacgagtgcgtgggcggcctcgaggtgctggaccccgccaccggcgagttcgtgcccgtggaccccgtcgcgggctccttcgtcgtcaacatcggcgacgtcggcacggcgtggagcaacgggaggctgcacaacgtgaagcaccgggtgcggtgcgtcgcgcccgtgccccgcatctccgtcgccatgttcctgctcgcgcccaaggacgacggcgtgagcgcgccggaggcgttcgtcgacgaggaccacccgcgccggtacaaggcgttcaactacgacgactaccgcaggctccggctgtccaccggcgagcgcgcaggcgaggcgctcgcgcggatggcggcgtgacgtggtgcagctgcaaattggaagccggcagcgacaagccgttaattataggcttaccgtgggaccgccatacgcctacacgagcagagtattccatatcggttttctcgttgatccgttgtattaatcgtgtggggagaaggattatatgtacctaatttgctctactgcttaatgaaagacatgcccagcacgatctaaaaaaaaaaaaaaaaa

SEQ ID NO: 11204 - DNA, 1434 bp, Sorghum bicolor
  Clone ID: SORBI-28MAY03-CLUS17223_1
gccggccgggccgggaccattaaggacggacgcgagagcgaaggccgaaagcgaaacgcccaaaccccaggaggtcccatcggatcctccaaaccctaaccctagcgcccccgactcgccgcggggagatggcgatggacgcggagcggcggcaggcggagctgatcgcgcagttctccgctcaggcggcggcgctgtcgtccgcgccgcagctcgccgcgctggtgcttgaggccacctcccacccggccctcttcgccttctccgagctcctcaccctcccggccctctccaagctcgctggcacgcagtacgcgtcgtcactggacttgctccggctcttcgcctacggcaccttgaaggactacaagagtaattctggatcccttccagcattgttgcctgaccaggtccggaagctaaagcaactcagtgtgctaactctggcagagtcaactaagatactaccgtatgatcagctcatgcaagagttggacgtttccaacgtaagagaactcgaagatttcctaatcaatgagtgcatgtactcgggtatcgttagaggcaaactggatcagctgagaaggtgctttgaggtacaatttgcagctggaagagatcttacacctgatcagctaaacaacatgatagagaccttgtctgactggttgggaacatcagatagcctgttgcatcaaattcaggagaaaatcaagtgggctgatacaatgagtgaggtgaacaagaagccccagaaagaatttgaagacagagtggaagaggccaaaaaatcaatcaagaagttgaacaatttaagcaggcagacatcgacttacgggggcatgacgactttctctctgaatctggaggaataatggattttgaagaggcccgcgtccgaccaaaaaggaggcgacaaccaccggcgtagtttcaattaagctcttaccaatttctcccagaatgggagctgctgataccttgattgagacattttgacgccagagttgaggaaactttgtacatctgtcatgccatgcctccattgtagcgagtctgttattttgccttctggtcaaactgctcgtttgtgtctttggtagggatgtacaaggtcaaacataaacgttatgttgcatttatttggcagtaaatggcccatggcagagatagcgctgttatgattgtggcactggtttattctcaagttacattttgtgtgttgaggtgctcgcaggttcgtttccatgggcactgcaggtgcccaattggcgattgatgtgacgtgaatcttcagcgtttttatttttcagatttcagatgatagaggcccgcgacatttttttggtgaagcgtgacttcagaaattttgtatcagacaaccggattcaagttctttcgattgtgtctagtattccctgttatgttttgctg

SEQ ID NO: 11205 - DNA, 1764 bp, Sorghum bicolor
  Clone ID: SORBI-28MAY03-CLUS17328_1
gcacgaggtggataaaaaccttggttccaacaatgaccgctggatagttgcaagaaatgaaagcgatgcaaaccttgaggcacagaaaaagtatccaggaacaaaattacgtctagatcaagaccctgatgtgctggacacatggttttcatctggtcttttccccttaacagtacttggttggccgtctgataccgctgacctccgtgctttctaccctacatcggtactagaaactggacttgatattctcttcttttgggtagcaaggatggtgatgatgggaatacaacttggtggtgatgtgccatttcagaaggtttatttacatcctatgattcgggatgcacatggccgaaagatgtcaaaatcacgcgcgagcgttgttgaccctcttgaggtgataaatggcatgtcactggatggtcttctgaaacgtttggaagaaggcaatctggatccaaatgaactaaatatcgcaagagatgggaagaagaaggatttccctgatggcatagcagaatgtggtaccgatgccctccgcttcgcactgatatcgtacacttcccagtctgacaggataaatcttgatatcaagagggtggttggatacagacaatggtgcaacaaattatggaatgccatccgttttgcgatgggcaaactgggtgatcattacattccgccagcaactgttgatgtgtctcttatgccaccaatctgcaagtggatactctcggtgcttaacaaagctgttgggaaaaccgttacttctttagaagcatacaaattgtctgatgcaacatctgctatatactcatggtggcagtatcagctatgtgatgtgccggcccggccgggcaaaccttacttcttcaacgattctcaagagtttgaatcagcaagagctgcctccagagataccctgtggatttgcctggagactggtctacgcctgctccacccattcatgccctatgtaacagaagagctctggcagcgtcttccacagcccaaagattcttgcaggaaagattcaattatgatttcagagtatccatctcctgttgaggaatggagtaatggcggacttgaaaatgaaatggacattgtcttggatgctgtcaacaaaataaggtctctgaagccaccaacagattcaaacgaaagacggcctgcttttgcactttgccgagggcaagagattgctgccactatccaatgctatcaatctctaatcgtgtttctttcttccatatcacatctcaagatcctgacggagaacgatgaaactccagctgattctgcaactgctgttgtcaacaaagacttgtctgtgtaccttcagctccaaggagctttaaatgcagatgctgaacgtgaaaagctaaggaagaaaaaagacgaaattcaaaagctacaaaatgcactggcacaaaaaatggacgcctctggctatcgcgagaaggctccacagagcgtgcaggaagaggacatgagaaagctcaccgctttgttggaacaactagaggtcatcagtgaagctgagaagaaattagatgcaaactgagtctgtgtgacctgtgttgaagacgccctgattgtaccgaagttagtccccacatttttcttgtttgcaaaaagctcagctatgttcttgattgctcaggtttacaattgatggttcagatggaagccacacttttgcagcgtgtaagaatattcactaaccatattttttagatgttctatttttctcaagtt

SEQ ID NO: 11206 - DNA, 944 bp, Sorghum bicolor
  unsure (1)..(944): unsure at all n locations
  Clone ID: SORBI-28MAY03-CLUS17410_1
ttggcctctgggcggcaccggccacctttacacctcattcccaccgccaccaccaccaccacctccacctccacgctccaccgttgccaccccangcacgctctcgccgtcgccacgccctatatctcgcgcctctcgcctccggccggttctggatccgcccgctcgcctccctgctacgcttcgtgccgccgccgcaacctcctccttcccgtcccgttccagaattgcagattacaggtcaattaacataaatggctgacgcagaggacattcagccccttgtctgtgacaatggaactggaatggtcaaggctggctttgctggagatgatgctccccgtgctgttttcccaagtatagttggtcgtccacgccacactggtgtcatggttgggatgggacagaaggatgcttatgttggtgacgaggcccaatccaagaggggtatcctgactttgaagtaccccatcgagcatggaatcgtaagcaactgggatgacatggaaaagatctggcatcacaccttctacaatgagcttcgtgtagcaccagaagagcatccagttcttcttacagaggctcctcttaaccctaaggctaacagggagaagatgacacaaatcatgtttgaaaccttcagtgttcctgctatgtatgtcgctattcaagccgtcctttccctatatgctagtggccgtaccactggtatcgtcctggattctggagatggtgtcagtcatactgtcccaatctatgaaggctatgccctcccacatgccattcttcgtctcgatcttgctggtagggacctcacagattccctcatgaagatcctgaccgagaggggatactctttcaccaccactgctgaacgggaaattgtccgtgacatcaaggaaaagcttgcatacgtcgcgctcgactatgaacaagaactcgag

SEQ ID NO: 11207 - DNA, 1348 bp, Sorghum bicolor
  Clone ID: SORBI-28MAY03-CLUS15631_1
gggattaaaattccattcaaacagctatgtgaattacatccagttgctagaatgatgtcctgacctcgatcagcatccgcagacccaacattaggccaatattaagagaattcccctagtgcaaattcggcgagcagttagtcaagttatgctacaagttgtacacggaatttattttgcattctgcaacaaattcccagtaccagacgctacctatcttaataaacaactaaatgtcaccaaatttgaagaatagagaaagactaaaaaccttggcagaaccacgctatctatcttaataaacaactaaatgtcacaaaatttgaagaatagagaagactaaaaagcttggcagaaccaaaggcgtcaagccatacatagagaccagcacgtggtaacaaatgcccccacctttaatgtgtgtgtatatacatgtacatgcgctgctgacagtcggcgtatcggtgatcatgaaaaaaaaggttagactaatgtacattagaaatctttgtacaacatccatacaagtgatttcttatttgaaacctgcatgaactttatccagaaggcatggcatcatggcaaggttgaaaagaagaaaaaaaacgactagccatttcttggttagcacaattagttggctttgctgtcctctcccatcaaaattgtcaagtggcgacacatcatcttgtactgctcaaaggaaactatgatactgactctttagccataagccagccttgatggagattcacaacttacatcatgtaggaagagaatgctcagtagcaagctactttccagataacaatgaatcatcaactgcatgcgcaagagcatccttcttcctctgaactattacaagcgttgagcagtgtgaagctcatcttcacttgtgtccctcgctaactaaaccatccaagtggatatgcaactatgtatactaactgggtgtcatcatcaaagtaaaaaaaaggaagaagaattccatgaccagtctctgtacaaattgacctagttctagatcgcgaaagaactatgcttttgcactgttgaactattcagcttcatgctacttcatcaagaacaaagttaattggattaaacatccaacaggaactttcatcagatggcgttttctcagattctgaacacgtcagcagctgatagcctccattgaaatcctcacaagccttagtagatcattcacacttcggaagttaaaatccagtactgtttttactgaagaaagaccatcatctccattttcatgattggcagcagcagaagcaattgccatttgtgacttccgagtagcctcaaaggcactattgacatcattgtataa

SEQ ID NO: 11208 - DNA, 1662 bp, Sorghum bicolor
  Clone ID: SORBI-28MAY03-CLUS15869_1
gcacgagggccccctctccgctccgctccccgcgcggcgccagatctgcggcggcggccggttggacgccacgccgcgcgtgccggtgcgtgtggcgcgctcaactccccagtccccgcgttcgaattcccaccgcagctcacgctcacgaccccgtccttgtcttgcgcgtgcagtgaggcggatcctgcccggccgtgccagccaggtgatgagagcgtaggcgcgcggcggacgaacgcgcgcgccccctggccccccctccgagaaaatggcgatgatggtggatccccccaatggcatggcgagtcaaggaaagcattactatactatgtggcagacactatttgagatcgacaccaagtatgtgccaatcaagcccattggaagaggagcttacgggatcgtttgctcatctgttaaccgtgagactaatgaaaaagtagcaataaaaaagataaacaacgtctttgacaaccgtgtggatgcgctgaggacactgagggaactgaaacttcttcggcacctaaggcatgagaatgttattgctctcaaggatataatgatgccagcgcatagaaggagcttcaaggacgtttacttggtttatgagctcatggacactgatctgcatcaaataattaagtcatctcaaccactttccaatgatcactgccagtatttcctttttcagctgctccgaggcctcaagtaccttcattcagctggaatactccatagagacctaaagccagggaatctcctggttaatgcaaattgtgatttgaagatatgtgattttgggcttgcccgcacaaacaacaccaaaggtcagtttatgacagaatatgttgtcacccgctggtacagggcccctgagctgctgctatgctgtgacaactacggtacctccatagatgtctggtcagttggctgcatatttgcagagctacttggccgcaagccgatttttccaggaaccgagtgcctcaatcaactcaagctcattgtcaatgttcttggcaccatgagcgaggctgaccttgagttcatcgacaacccaaaagcccgcaagtatatcaagtctcttccatacaccccaggcattcccctcaccagcatgtacccacaagcacaccctcttgccatcgatctgttgcagaagatgcttgtctttgatccctccaaaagaattagtgtcaccgaggctctagagcacccgtacatgtctccgctctatgatccaagtgcaaaccctcctgctcaggtgccaattgatcttgacatagatgaaaatctcggcgtagacatgatccgggaaatgatgtggcaggagatgatccactaccatcccgaggtcctcacaagaatgaccatgtgacaggcagcgatgaacatgtggcagaggtctgctgtaccaggattataacatgttcgccttttttatgagcttactgtgattacggcagagagtcaagttatcactatatgtatcagactgtcaggtgatctcttttgtaaatatgcgctcaataagatgtgtggcaatctcttgtttttgtagtacatggactacgttgttgtatgagtatgtgaagtggaactcggtacttaagacttgtaattttagaccctagattccgttgtatggaaactctcaag

SEQ ID NO: 11209 - DNA, 1307 bp, Sorghum bicolor
  Clone ID: SORBI-28MAY03-CLUS15872_1
gcgaccgcggcaccaacgccagggtccagaagggcttcgtcgtcaaagacgccggcggcgctggcatggttctcgccaacaccgccgccaacggcgaggagctcgtcgctgacgcgcacgttctcccgggctccggcgtgggggagaaagccggcaacgccatgagggactacgccatgtcggatccgaaggcgacggccaccattgtgttcgccggcacgaaggtcggcatcaagccgtctcccgtcgttgcggccttctcctccaggggccccaacactgtgacgtcgagcatcctgaagccggacgtcatcgcgcccggcgtgaacattctggcggcgtggtcggggtccgtcggcccctcggggctccccggcgacagcacgagggtgggcttcaacatcatctccgggacgtccatgtcgtgcccgcacgtgagcgggcttgcggcgctgctccgcgcggcgcacccggagtggagcccggcagccatccggtcggcgctgatgacgacggcgtacaacgattacccaggcggcgctggcatcctggacgtggccacgggccggccggccacgccgctggacgtgggcgccggccacgtcgaccccgcgaaggccgtggacccggggctggtgtacgacatcagccgggccgactacatcgacttcctctgcgccaacaactacgagccggcgcagatcgcggcgctcaccaggcagcacccgtccgaggggtgcagcgccaaccgcacgtacacggtgaccgcgctcaactacccgtccttctccgtggcgttcccggccgccggcggcacggtgaagcacacccgcacggtgaccaacgtcgggcagcctggaacgtacaaggtgaccgccagcgccgccgccggcagcgccccggtgacggtgtccgtggagccgtcgacgctgagcttcagcaaggccggcgagaagcagagctacacggtgagcttcacggcgggcgggatggcgtcgggcaccaacgggttcggacggctcgtctggtccagcgaccaccacgtggtcgccagcccgatcgcggcgacatggacctaatagctagcggccggtagcaatggcgagataaatctccgattggggatggcaatggcgagcggcattcttgaacgcaagagacggcggatatcgtcgaggagtgctgtttgtattgtatcagttgattagctccggtgtgtaagctgccggtgtaatgtaatctgtaactgacccgattgtggtgatgcagcaattaatctcaaagggttgcagtcttgcaggctttcc

SEQ ID NO: 11210 - DNA, 907 bp, Sorghum bicolor
  Clone ID: SORBI-28MAY03-CLUS16_1
ctctacttctacttgcagcaattcgacagaagcacggtatttcgctgcagttgttccactcttgaactccataaggcttctgatatatggactccgtctctacactgatgaagctctagtaaaatcagtgacacgtgaaggaaaaccagagtaaatcctattgactgaaaaaaccgtatgatcctttagcttgctgctctgacaatgatgactttgcttctttacagggaattgctgagaggtccactgtattatgtgttggtgctgttgttcagtgttttagtcttctggcgggagtcccctgttgggattgtctctttgtcaatgatgagtggtggcgatgggttcgctgacattgttgggagaaggtatggctcagtgaagctgccattcaataagaagaagagctgggccgggagcatctctatgttcatttctggttttctgctgtccgcgatgatgatgttctacttctcaagccttggttacattgatgttatttggcaggaggcacttggtaagctggcgcttgttgcactggcagcaaccgtagtggagtgtattcctgtgactgaagttgtagatgacaatatatctgttcctttggccaccatgctggtagcttttctattgtttagctccaacgcacaatgattaatcaatactactagtactagtagattatttgtctatgttcatttctggttttctgctgtccgcgatgatgatgttctacttctcaagccttggttacattgatgttatttggcaggaggcacttggtaagctggcgcttgttgcactggcagcaaccgtagtggagtgtattcctgtgactgaagttgtagatgacaatatatctgttcctttggccaccatgaggtagattttatattgtttagctcca

SEQ ID NO: 11211 - DNA, 1662 bp, Sorghum bicolor
  Clone ID: SORBI-28MAY03-CLUS1608_1
gcacgaggggagcagcagcccgccgaggagtaggaagtctaatgacgataacaaaatgaagccaccaattccaacttctaaacagacagctagcatggcagatgatccattcgttgttctagaaacagcctctgcttcaggctcttcatatacatccccaggaagatccacagatactgtggaagatctggataagtctgcaagatttgatggcaaagctgccaataatattgctgatgacgatagtttattcgaggaatcaagtgcttttgatcaggctccaaaatcagaccctttgtttacctctgaattcaatggtcatgccaaggacacagacccaccaagcggcgcgcgggattccagtcctctacaccattcaatggacagaaatccagcacgtcaatcttctatggaagactttagtaacaccatgcccaattcacagtctgcaaggtattctgacattcgtggtaatgatatggaggatcagtcaccaaggtctactgaatctgaagatgatatatggcttaccgcgtcggagattccccttttcacagcgccaactactgctccaccaccctccagatcaccaccttttcttaaacgaaagccactgggagcaactgcaaatggaaaggagaatggacatgctcgtcagtctagccaaaatcgcaactattacacggatttgccaaagcaaccagaggtttcttctatagatgacgtggaaggttttgccatgggcaaacctcaaatgcctgcttatgacaacaatgctttcgatgaagactttgaaagaagctcatcagatcctgaagagagagacaggcaggcacgaggggagaaagaaagggaaatgaagcagagggaggaaatggagagagagcggagaaggcttgaaaaggagagggagttggaacaacagagagaaagagagagagaacggcaggcagtggagagggctacaaaggaggcacgggagagagcagctgctgaagctcgtgcaaaagctgaaagagaggcacgccagcgtgcacagcgtgctgctgtgcaaagggctcaacaggaagcccgtgagagggctgcagttgatgcgaaagaaagagcagctagggttgctgcagaagcaagggagagagccgctgcagaagcaagggacaaggcagctgcagaagccagggagaaggcagctgctgaagccaaggagagggagcggactgctgctagggagagggctgcagcagaaagagctgctactgaaagagctcagcaagaagcaaggaagagagctgaacgagctgcagtggaaagagctgctgctgaggctcgagaaaggcaggcagctgcagctgctgccgccgccgctgcttcaagagaaaagcagagcacaccagatgatcttgagtcattcttcggtgtaggtgctcgtgccaacagtgcaccaaagcagagggctccaacacctacagtggattctatgttcggctttggagctcaaggcacaggaaccactaatggatcacagagagcagcatcaacttcggctcctgtgagaaaagtggcatcagccacaagttttggcgatgatctgtctgacttatttggagctcctgcatcttctgacgtatttcaagaagttcagggagaaagtgaagaaagaag

SEQ ID NO: 11212 - DNA, 778 bp, Sorghum bicolor
  Clone ID: SORBI-28MAY03-CLUS17862_1
agaggcgagccggccgggcccgggataaattcctcgccaccaccgctcgacctaccatacccgtccgtcctagctcatccgagcctgccctccgatcccctccatcacagcagctgctgcgtctgcgtgcgccgtcgccaccagacctcaatcccctcgctcgtcgtcctcgtccaacgacttcccctcgatcagttcccattcccaccgcaccctcgctcgtcgtgtctagctagcggagattgctacgaccagatcggagagcttagctcagcccaaccccaggagtcactcggaggaagaagcgaagcgaagcgaatcgaagcggcaggcggtgtgtggtggttgctgccggcgcgttcctgggccatggatccgtcgggcggcgcgttcctgccgcagctgcaagctgggagctcctccttcccgcggtcctccagcaacacgtcgctcgccaggaccggtagcgccggccgcgggaggggcggcaccaggggcaggaagatgatgcgcagggtctgccgcggcgtcatcaccttcatcttcgccatcgctgggctgttcctgggagcggtgaccggcggtctgatcgggctggcgacggagagcgggctgttccgcggcaccgggatcggcgccatcaccggcgcgctcgtctccatcgaggtcgtcgactcctccatccggctctggcagtcgcggcgctccgggatctggagcatcctctacgtgctgaacgtgatctacagcctcctgaccggcaggctggtgcgcgaga

SEQ ID NO: 11213 - DNA, 666 bp, Sorghum bicolor
  Clone ID: SORBI-28MAY03-CLUS18098_1
gccggccgggctgcgaatggtgccggccgggcctggaaaagagaaagcaaaaaataccaaaccttggaagacaacaaataaggggagctagataccacgcatatctaaacatgccgtcccgcaacaagatcagcgtggccatgctgagcttggccctgatgggtctgctcctttgccacctcgccaccaccgcctccgccgccaccgacagcgaagacggctcggtgagagacggcggcagccccgcccccgactccggcgaaggccgcgtcgtctatgcggatatgaggttggctgattcagaatccagctcatccgatgcgccggcgtcggcgctggcgccgtcgtccagttgaacgaagcgacggtggtggttaaaaacttatcaggtcacgtgtggccggctactattttttccgtaagtaaagataggcaaagcgtggccaaataattttataagcaagtaataagtgtgatgggttaatcgaaatgatcaatgtatgacgtgtgggccaggagttatggcttgcctagccacatgttattctacgtctcctatcttcgttgcacgtctttttttccccttgggttattatatatatcttgagttcttgatggattccgacttaccaattgtttgttcaacttcattattcattactttta

SEQ ID NO: 11214 - DNA, 584 bp, Sorghum bicolor
  Clone ID: SORBI-28MAY03-CLUS17897_1
gccggccgggccgggactcccatagaccacaagcccacacatcttaatataatcttcattcactctctcttcactcgtgcagatagtaggcatggtgaaagcggtggcaatagtagtggccttagccctggccatggtagtggcaatgagtgtaggcagggtgtcagcaaactgcaacatcgcgctgctagcagtttgcaagacggcggtcatcggaggtttaaaacccactgtgacgtgctgctccatcctgcgagcacaggaggcatgcttgtgcaaataccagaaagaccccaagtatggcatgtacattaaccctgcccgcaaaatgattacctcctgcggcatggccatccccaactgctaggtgcccttcccatgcccccaccgtgtcagtgttggatgtgtgccttgttacctcttgtgtgcatgtaacatgccttatatataaataaataatttcggcaaaaaaaaaaaaaaaaaaagggaccttgcataggtctacgcatgtcgatcaatctctgtatgtttgtattcaatttacaccttatatggaccatcatatagcactaagagtgatggtg

SEQ ID NO: 11215 - DNA, 762 bp, Sorghum bicolor
  Clone ID: SORBI-28MAY03-CLUS1839_1
ccgccggcgccggggcgccacgctcgtccgtgccggctccagggtcacctgggaggggttcagcgacgcctccgacgcggaccttattgccgagcacgagatctgggccgccgtcgatccattcgccaagaacgaggccttcaactgcagcaacggggatatcttcaagtggaagcagctgtggccgatcctcgccgatcacttcggggtggaatgggctggctacgaaggggaggcccacgggctcggcctcgagcgtgccctgccccggcagcaacccggctggccgcaggtggtcgcggcggtggcccttcctcccccggcgcttcgcgggggcgccggctgggggtccggcggtgccgtgccggccctcgcgccccggcgcctgggccgcgtgggcccccgcgtgggccgtggccgccggggcgtcccggcccctgccgccgctgccgcctcagggggccagctggtggtgcgccgccagattgttccttgattcgtccctgcaattcagttctctactgttgctttcacatcctttctgcgcgcgccttattatcttgcccatttatcaacttccaggtctcttgtaatttagttctgtttcatacattttgctatctttgccaggtttgcatgttgtatactgttgtatactaggaacaaataaagatgatcaacacattcaacatgtgtgctcatgcctcatgagtcatgaaggggctaaaatcttatataataataaaagacttaataagtatt

SEQ ID NO: 11216 - DNA, 1027 bp, Sorghum bicolor
  Clone ID: SORBI-28MAY03-CLUS17946_1
atcggccgagacagggcacatgtagaaactgccccgcctccactgccgccgcccgcgcctgctcgtcgcctctgcgccttctcggcgacgccccggttgccgagctccctgagcacggcgatggccgccgccgccctccgttcctccgccgcacgccggctcctgcgcctcgccccggcagcgtcgtcggctctgtccgctgcttcccggcccaccgccggggttgcgccgctctcgcgcccgttcgccgcgctctcaggtggcaacaatcctatctcatggaaaccgagacgcttcttcagttcaaatgaaaagcacttgcctgcaatatctgatccagagatagaatctgcatttaaggacttgttggctgctagttggaatgaacttccagattctctcgtagaggaagcaaagaaagcagaatctaaagccaccgatgacaatgctggtcaagaggctttgaaaaatgtatttcgtgcagctgaggcatgtgaagaatttagtggaaccttggttaccctaagaatggctcttgatgatctttgtggcctgactggcgaaaatgtgggtcccttgcctggttatattgaagatgctgttaaagctgcatataatcgctacatgacatatctggagtcctttggccctgaggaaaattatctaagaaagaaggtggagactgagttggggacaaaaatgatacacctcaaaatgagatgcagtggcataggttctgaatggggaaagatctccctgattggcacctcagggatctcaggttcctacgttgagctaagggcatgatgggaagtttgcagatcagaaccatggaaatcatcgatgaagtctgtagatcagaatatgttgatctgcattttcctttcccctttgtagctaccatggcaataacaatgagatcatcaaacagctgtgcattttaagtaactccagatactgacctctttgtgtctgtaataagaacgtgtttactttgttcatgaagcgctgatcatatttcgctcgc

SEQ ID NO: 11217 - DNA, 1354 bp, Sorghum bicolor
  Clone ID: SORBI-28MAY03-CLUS16656_1
gcacgaggcgccatgggggccgcagcggcctccgcgcctttcctcctctccggcgacctgactccctgccgcagcgtctacgacggcgtctcccccggctccctggccctcagccgctgcggctgccgggcctgcacggggacctgcgtgcccctggcggactcgggcgccaccgtcttcccgcccctggccctcagctacgaggacacgtccaatacctgtttccagttgtacggggttcggcccaggccacattggatcaccactgaatatggtggatataaaattgataaggtgctgaagaggtttgggagcaacatcatcttctccaacggattgcgagacccatggagtcgaggcggggtgctcaaggacatctcatccagcatcgtcgcacttgtcacagagaaaggggctcatcatttggacctgagatctacttgcaataagatagaggatggagacgacccgcatggcctcgatggctggcaatggcaggcctgcacagagatgatcatgccaatgacggtctccaacgagagcatgttcccaccatcctccttcagctatgatgaaaggtccgatgaatgtttccagagctggggggttcgaccgagaccgcattggatcacaactgaatatggtggatataaaattgataaggtgctcaagaggtttgggagcaacatcatcttctctaatggaatgcgagacccatggagtcgaggcggggttctcaagaacatctcatccagtatcattgcccttgtcacagagaaaggtgctcatcatttagacttcagatcttcaacaaagggtgatccagactgggttatagaacaaaggagacaagaagttgacatcattcagggatggattgatcagtatcatcaggacatggcggaaacatcttcctgacaaagcgccattgcggttacagtcagggaaaacaaatatttggatccatggaaaaaataaaggccaaaaaaggaatttgtattcttacacatgatcaacagggcaagttaacagaaggtgaaaaaaatcaataatttacgcacttagcatcagaaaccgctaaatcttacaaaaagcaagcccccctttatcaattagaaggggtggtgcaggttctgggactccaacccgcaccggagcagtgattgactgatcgtgcaggcctctggccagtagatcaaagcagtcttggctcagtttctgtttattaactatattgcttctgttgtgctcagcaaggaacagtggtgctatatcgacactttctctctgtttcatggatatagaagggctatccatatttcgagaaataacagtaattgtatggctgtccaaa

SEQ ID NO: 11218 - DNA, 888 bp, Sorghum bicolor
  Clone ID: SORBI-28MAY03-CLUS16711_1
aacgtcttatactagcgtaactaattataacttcttatcactccaggcaaagttcaaggcgagggcgaccgtgatcatggcgaccttcttctccctcaccgctcccatgggcatcgcgctagggatcgccatcacttccagctacagcaagcacagcgacaccgccctggtcgttgagggggtcttcaacgcagctgcagcagggatcttgatctatatgtccctggtagatctcctagcagctgatttcagcaacccaaggctgcaaacgaacatgaagcttcagctggcgacctacatcgcccttttcctcggcgcagggctcatgtcattgctcgccaaatgggcatagaagatagtcagatacatctccagagatgctgaggaggaggactgtaattctccgcattgtcgccgctaaggaccccggatgcagtttatggccagcggggtatatcttgtcgtagtgctacacaccaatttctgtagaatctccatcaaccagaatcttggtgcactgagaggtgagaaagaaggcctggatgtgaccaagttctagagtggaaggacattgctagagaagtcaaaatgtgaatcttgcataatggtgtgctcccatgaggatgccaaccaaataggtgtagtaatatacaagaatgaaatagtggtggagaacagttgttcttcaatgatctttgggggctaaatatctgtagaagggaaggatcgacttcctttttggagggaacggcaatgtatataattgttatcccgtttcctcctttttgctggattaaacttccatggaatttgttcactgaagaatcaatttaaacccaagaatggtactaaaaaaaaaaaaaaaaaaaaaaagggtctagatcgcga

SEQ ID NO: 11219 - DNA, 849 bp, Sorghum bicolor
  Clone ID: SORBI-28MAY03-CLUS1700_1
cgcgtccgcaatcagctatgcactggacatagctcatgcaatggactgtttacatgccaatggcataatacatagagacctgaagcctgataatttattgcttacagcaaatcgtaagaaactgaaacttactgattttggacttgcacgtgaagaaactgtgactgaaatgatgacggctgaaacagggacttaccgatggatggccccagagctatacagcacagtcacacttcgacgtggtgagaaaaagcattacacaaataaagtggatgtgtacagctttggcattgttttgtgggaattgttgaccaatagaatgccatttgaaggcatgtcaaatctacaagctgcatatgctgctgcttttcagcaaaagcgcccagctctccctgaggagaccccccaggagcttgtgttcatagtacaatcatgctgggtcgaggatcctgcgatgcgacccagtttcagccagatcatccgaatgcttgaaactttcctgatgacaatacctccacctccgatttcagaaccaaacgaagatgaggaatcggaggaaacaaggtcgtcactgagcagtaggagctcctctggctcctcgctcgtttctcgcgcaacaagcaagctctcggtcgtccgccacctcttcgcctcaaagaagacaggcaatgggaaggcgtgatgcgccatgccctgagacgttttccttcggtgctgtaaagatgctagcctaggtgatgcgtaatacaagagggaacttgttcagtgtagagtagctgttgtattgatgatacaaaaggaaagttgaagcgcaacttttgcaagctatgtatagctcgcagctgcttt

SEQ ID NO: 11220 - DNA, 995 bp, Sorghum bicolor
  Clone ID: SORBI-28MAY03-CLUS16822_1
attgcttcttagctttgaggaaaagagaagctaggtgtttcagagagagcgagggcacgaggctgaaactgcagcagatagtagggtagaagatgagctcgtcgatcagcatgatggaggcgagaatgcccccggggttcaggttccatcccagggacgacgagctcgtgctggactacctcctcgacaagctctccggccatggccatggcggcggcgcagccatcgtcgacgtcgacctcaacaagtgcgagccatgggaccttccagaatctgcgtgcgtcggtgggaaggagtggtacttcttcaacctgcgcgaccgcaagtacgcgacggggcagcgcaccaaccgcgccacgcgctccggctactggaaggccaccggcaaggaccgcgccgtcgtcgccggcggcgacggcggcgaggatgcggcggcggtggtggggatgcgcaagacgctggtgttctaccggggccgagcgcccaaggggaggaagacggagtgggtgatgcacgagttccgcctccatccacacgccgcgccgtccctaccagctgcggcaacgaaggtaataacctggatctgcaaacacatactgctgcacacatcatatatttaggtcttgtttagttgccaaaaatttttaaaaaaagtttcatcgaattttgcgcacatgcatggagcattaaatatagatcaaaataataactaattgcagtttacctgtaatttgccagacgaatattttgagtctagttagttcatgattggacaatatttgtcaaatacaaactgaaagtgataataattttttttggaagtaaacaaggcatgactgggtgctatgcagggtgttctacaagagcagaacaaccaccccaaggccagcatctgacgatgcccaggacggcaccccatcagctgagccacaactgtctgctgccctgccgcttgggccgctggctgacacatacactgccttcggtggtgcccc

SEQ ID NO: 11221 - DNA, 699 bp, Sorghum bicolor
  Clone ID: SORBI-28MAY03-CLUS16979_1
tgccggccgggccgggtcgcacaggtaaccatagagcaaacaacaccaagcagcatcgatcgatctatccgtgtctctggtctctctcgtgcaagctaggaaagcccgcacgtacgcgaagccgagaagcttccaccatggccagcacatcagccagcgggcggctgctcttctcgctctcgctcgtcgtccttgtgctcctcgtggagaccactgctccccatggacaggctgaggccatcgactgcggcgcgagctgcgcgtaccggtgcagcaagtcggggcggcccaagatgtgccttcgggcgtgcggcacctgctgccagcgctgcggctgcgtcccgccgggcacctccggcaacgagaacgtctgcccctgctacgccaacatgacaacccacaacggcaagcacaagtgcccgtgaaccaaccgtgcatcctactcatcactcccggccggccagcagcatcatctatatacatatcagcctaccaagacatgcacgatatgcatgcatgatactgcttcatcctacctatatatatacgccatccgtcaattgtgtacgcgtgctttcagcctacgtgcagtatactaccattactctgaattgcgcaaaaatcagagctctctgtattccgatcatacgtacacgtacataataaacagaagattaaaaaaaaaaaaaaaaggcccct

SEQ ID NO: 11222 - DNA, 1385 bp, Sorghum bicolor
  Clone ID: SORBI-28MAY03-CLUS18716_1
tgggagttcatttcgctcgcgctataaagagagaggcaactcggagtgccggcgcggccgtcaccgccaatcgcagcaccgccaccactcttctccgcttctccagtccagctcacagccacctcccgctgctgattgcgaatcaagccgccgcggcgcaacgattatggcaccggtggaggcggagcagcacccgcggacggcgctggcgctcgcggcgcacgacgcctccggccgcgtctcccccatccgcatctcgcgaagggacactggagatgatgatgttgccatacagatactgtactgcgggatatgccactctgatctgcacaccatcaagaatgagtggaagaatgccaactaccctgttgtccctgggcacgagatcgctggactgatcactgaggttggcaagaatgcgaagaagttcaacgtcggagacaaggttggagtcgggtgcatggtcaacacttgccaatcctgcgagagctgtgaggaaggacacgagaaccactgctccaagatcatctttgcctacaactcccatgacagggacggcaccatcacctacggtggctactctgacatggtcgtcgtgaacgagcgctttgtcatcaggttccctgatggtgtgccccttgacaaaggtgcgccactgctctgtgctgggataaccgtgtacaaccccatgaagtaccatgggctgaacgaactgggcaagcacattggcgtggttggccttggggggcttgggcatgttgctgtgaagtttgcaaaggcgttcgggatgagggtgaccgtgatcagcacgtccccggagaagagggaggaggctatggagacgcttggtgcagacgcctttgttgttagcagtgatgctaatcaaatgaaggctgtgaagggcacaatgcatggcattctgaacacggcctctgcaagcatgtccatgtacgcttaccttgctctcctcaagccccagggcaagatgatcttgcttggcctgcctgagaagcctctgcagatctctgccttctctttggttactggtggcaagactctggccgggagctgtatggggagcatcagggacacgcaggagatgatggacttcgcagccaagcatgggctggtggcggacatcgagctgatcggcaccgaagaagtaaatgaggccatggagcgcctcgccaagggcgaggtcaggtaccgcttcgtcatcgacgtcggcaacaccctcagcgcggcgtcactagcgagctcaccggtcccagctctgtagttacttcctgcttggatcaacaaatgatcacctaaacatattgtcgtgtgtcgatatatcgtgtgtaagtgaagtatatttgaataaaaaggaagttctatatagc

SEQ ID NO: 11223 - DNA, 908 bp, Sorghum bicolor
  Clone ID: SORBI-28MAY03-CLUS18784_1
aagccccgggcccatcaaccaaaaagccttcgtcttctacctctggtcctcttcaaacgccccgtgagagaggcgaaactttccctcgaaaccctagcctagccactgcccctcgcctccttcccgctcccgcccgctaggaagaggaagatatgggcgccgaggaggacgccgctgcacggcgcgagcgtctccgcgccctccgcgccgccaaggagctcctctccacccccgacggcgcccccacccccgctaccgacggagaacagcaaaatggcaaccatgagatggcagaagagctagcattaccaggtcctcaggatgcatctgacgaggctgctaaagaggatggtagccccactgaggaggccgaggaggttgaagatgatggtgagcttccagccatgaagttcagaaactatcttccccatgatgagcaactccgaggtggcaagctggctccagtgtctcttcctaagtttgaagacccaattagtgctgaaactgcagaaccaaaggaagtggagaatccttttggaaacatagccccaaagaatccaaattgggatctgaaacgtcatgtgcagaagagaattgataaactggaaaggcgcacacagaaagcgttggctgagattgcattggagcagcagagggagaaggaagccttggaggaatctcaagattgaccgacctgtctaagtgaccggtggctcatagatgatggttcgtctctcaagcagaggtcgtaatatgtaatatacctttgggatgcttggtgtgaactcaaggatgtagcaacttaaaaaacatgagatgtgcagtcctgttctgtgtagacctgaccaaacaaagcttactgaatacaaagcacgccatgctgtgttgagcagagtgcatttttctct

SEQ ID NO: 11224 - DNA, 1068 bp, Sorghum bicolor
  Clone ID: SORBI-28MAY03-CLUS18840_1
gccggccgggccgggaaagggggaaggaaattgaattggaagcgcaagcaatccgcaaaccctttctagtgtcttccccctcctcgattcgcgcggcttcatcatcggcggcggcggcgatggcgcggaagaggaagacggacgccgcgccgcggctggacgaggccgatcgcacgctctactccaccttctgcggcgccgccaactccctgtcgcagctctacacgcaggccatggcccagcagaagctctccttccaggccggcgagcgccacgccttagaaaagctctaccagtggatcttgaggaagcacgatgaagaggcaaggctcactgtagctgaaataatgtctcatatccagcatgagatagattatggaggtactgatgcacatgtctccccaagagtaaatcagcatcctcagattgcaaatccattcaccaattcagttgtcccacctggaactggtttgtatgggcaatcagcacctgggtttgctcctagacccagcgtcactgaccagtcaaagaatacaatattctctaatgccttatcaagcccagtgcgcaggagtctccagaactatcacatcactcaaggtgctggcaatggaggccggaatgctgaagcaaacttagcaggggctaatagagagaccaattctgcaagctccaacgacacttctatggatatggttgcagacagcgccgggaatgaattctaccagtgatttgcagtcagatgtttctgcgatcaagaagtgtcgcatgccagtattgtctgtgcttttttggcctgccttttgttgatattttcacctaagctctcaccttatgtgagcaatgtagctgcacatctggtgattctggtttgtttaagttatttggtattttataagttgaaacgtgttgggcatgctttatttcccacagtgtgttcgtgagttcaatattatgaatgtaaatgcagattgtgttgtgatatattctgatataggaagactgaactcgctgaaactcgataaaacttctcaatgcggggcagcagaacattagtaagagtaaaag

SEQ ID NO: 11225 - DNA, 1190 bp, Sorghum bicolor
  unsure (1)..(1190): unsure at all n locations
  Clone ID: SORBI-28MAY03-CLUS1916_1
ccaaaacctgcccaggagggggggaaaaaaaaagaacactcgctactgctgttgacacacggcggagaaagagcgcgggggagagatgtctctgcagtgcgtggcgcacgcggtccgagcgctcgccgtgcttccggcgccagcctcccctcgccgccggacaagccatgtgtccctatcccttccgtcccggcggccagggctcgccgttgcgccggtccgcgcggcggagtcgtcctctccgcccgccgtgcccgcctcagcggccggcaaggccgtcgtcccggacgacgagttctccctcgccaaggtgtccttcggtgtgattgggctcggggttgggctctcgctcctgtcgtacggattcgggtcgtatttcaacctgcttcctggttcggagtggtcagctttgctactcacctacggatttcctctcacaatcatcggcatggccttgaagtatgcagagctgaaaccggtaccctgcataacctatgctgatgcctttgctctaagagaaaagtgtgctacccctattctgaagcaggtcaggagtgatgttacacgttttagatatggtgatgagcaacacctggatgaagcactacagagaatctttcaatatggtttgggtggtggcatccctagacgtagtgcacctatattacaaaagattcgagaagaagtaactgaggatgggaaatacagtttagtacttgtatttgaagccaaagcattggagctatccgattttgagaagagacaggctaaattcacctccttttttggtgttgggattaaggcagaaattggaaaagatggcaatgatctatatgaagttcgtcttatctcagagactacttaaaaacaaactttgggaattttctctaatacaatactaaacgtattcctttttttccctttgatccactgattttgcatatatgatgttaatagtatcagattttacccttgtttttgttgtgcctctgagctttgatatatattggttgttgattcttgactgcgacctggcaccttcatacactccatggacatgtacaaagaaaaagctgttgtaatatagatgtaaatggatttgattcaaaaaaaaaaaaaaaaaaaaaaaaaaaaaaaannnnnnnnnnnnnnnnnnnnnnnnnnnnnnnnnnnnnnnnnnnnnnnnnnnn

SEQ ID NO: 11226 - DNA, 839 bp, Sorghum bicolor
  Clone ID: SORBI-28MAY03-CLUS1944_1
gaactagttccagcagcaagtgatgattgtttcaaatgtggccgccctggacattgggctcgtgaatgcccttactcagatggaagtggtagaactggaacgtccgctcccgcttcaggtatggtggcggcactggtggacgtggtgaccgctttggaggatcagatcgttttgctcgctatgatgatgatcgatatgatggtggccgctatgtagacagcagggatacttactatggtgctgggcgtgatcgttatgctagtgatcgctatgcgccagcagcagaccgctattctggtgacaggtacagtggtgcagatcgttatgcgtccagtggctttgccagagaaaggagctatgagagagatggagggaggtccaatggagggtactaccgtgatgatccgaggggcactggtggctatggcagaggtggttcacgtggcggcggtggcggtggtgggcctgctcgctttggtgggagttaccgagataggcctgctccatatgaccgtcctagcaggggaggaggggcagctcgtgcttatgatgatcgttactaaagagtgtttccttgaagcagaacagagatatctgtttatttcagttacacatcagtatttacatttgccaggttgatccttcaattagttattcagcagtgcagtttgttttattagtctctgaagacaatggttcagtatgtgagttattagtatgttggtaccataatctgtaggcagtgtgatcctggttcatttggcatctttgtgtaattacttcggagtttgcactaaataatgaactaattgcagtatgtgatctttgaattaaaaaaa

SEQ ID NO: 11227 - DNA, 842 bp, Sorghum bicolor
  Clone ID: SORBI-28MAY03-CLUS17495_1
gcacgaggccgcggcctcccccccccgcctcccctccccccccctcccccgccatctcccgcctggctgcgccgcacacccacacagcttcatcgtgcgcagtcgggggggcgcggccacgaccatgggcttcatctcgttcgtcggccgggtgctcttcgcctccctcttcctcctctccgcctaccaagagttcattgaatttggaaatgatggtggaccggcagcgaagaccttgaagccaaagttcaatctcttcgtcaagctagtgtccaagaataccggattgggggtgccgcatattgatataaaaactgtcattgcggctaccatgtttcttaaaggctttggtggtcttctgttcatattcagcagctcatttggagcattcctcctgctcatttacttggcgtttatgacccctatcgtgtatgatttctacaactatgaaatggagtcagagcagtttgtccagctttttttcaagttcacacagaacttggcgtttatcggtgccctgcttttcttcctggggatgaagaactcgattccaagaaggcgctccaagggaaggacaacaaaaaccaagacaaactgatgtcagttattgtaggaggggaagcaattgagctcattatgtttgcatactatacaggagtagatgtcccacttttgttcttggtgcgccaattgaattgtgaatcgggacttacaggacttagcatgtaggatatttaagttatcttgcacaattctattttcgcatgctgcgaaaaaaaatgtcatgtaccattttgctacaagaactgctttgccagtgaaaaatggtaagttgcatagtc

SEQ ID NO: 11228 - DNA, 642 bp, Sorghum bicolor
  Clone ID: SORBI-28MAY03-CLUS17535_1
acgtacagactagggcaggccgggccgggagctagcacttgctcactcactgcatcccaaagctatcagtcacctacgagcatcagcacatatatcacaggaggtcgatcgagatcgacatggctcgcagcatgaagcttgctgtggcgatcgccgtcgtggcggcggtggcggcggcgacgacctcggaggccgccgtgacatgcggtcaggtgagctccgccatcgggccctgcctgtcctacgcccgcggccagggctctggaccctccgcaggctgctgcagcggcgtcaggagcctcaactccgccgcccgcaccaccgccgacaggcgcgccgcctgcaactgcctcaagaacgccgcccgtggcatccgcggcctcaacgtcggcaaggccgccagcatcccctccaagtgcggcgtcagcatcccctacaccatcagcacctccaccgactgctccagggtgagctaaaccgaaacgacgacctgatgatcgtcgatcgatgatccattccgccgccgtcgtcggtgccggagcatcgacgacgaccatgcttgagtctctatctatctacgggtgatgatgagttgtctactatatatactgctacgtcgtatactgaataaaaaatctctcc

SEQ ID NO: 11229 - DNA, 1408 bp, Sorghum bicolor
  unsure (1)..(1408): unsure at all n locations
  Clone ID: SORBI-28MAY03-CLUS1756_1
cgtccggcacagccgacgccgctccacctccacctcactagccggccacaacgaccacggcggggaggatgccggcgacggctcgctcggcgacgcctcgcggggaggcgctgttcgtgctggcgcanctgggccggaagctcgacagcctgccgtctgatctcgccgccgccatcgagagcggccggatcgggggcgacatcggggcccgcttcaacgaactcgaggccaacggtttcatcaaatggctcctcaccttcaagggcttcagggagagactcctcgccgacgaactcttcctcaccaagctcggcatagagtgcggcatcggtctcgtcgccaagactgccgctgagttgcagaagaggggggacaatttcttcaaagagattgaagttgtcatatctgatgtggtcatggcgatagttgcggatgtcatgcttgtctatcttcctgctccaactattggtttacagcctccaattgcaagaaatgcctcagctattgccagttttttctctagctgccctgataatgctttccaaacgtccgtggctggaagatcattcacacttgtgcagaggattggagcttttgtgaggaacgctgcaaagcttttggtagtgggaactactgcttctttggttggcactagtgtcaccagtgcagcgctcaaagcaaaggcggctgttaacaaggatgaagccgtggaaattccagttctccaaactagcattgcctatggtatatacatgtcaatttctagtaacctcaggtatcagcttctggctggtgtgctcgaacagaggatcctggagccgttgctgcataaccagaaactattactgagtgcaatgtgcttcatggttcgttcgggcaacacattccttggatctttgctctggattgactatgccagatggataggcgtccaaaagggtcacgatcacgaagaggcctaaaagttgtagcagcttgtctgcatgttcttctgtcagtggggcatgttcacaataccatcgatgatggcttgcctgcctctagaatgccgctcaactcttcattggattggaggccccccctatatataggacaaatcccaattttgttcggaaaaccacaagtagggatatatccgtcgaattctcgtatgcaacgacaacgtcgttttacccctcaacttttcttttctagcttgcaacttgcaacaagggctgtcattgttcaaaattcaaatatatgttacattggggattccatgctgactacctaaactctaggaagtttcgcttgtcctatttcatctgtatgtatgcattgtagctagccttgttgtatttcctcaatgccttggctgttttgtcggttagagttcttgacaactgttccagagattctgtcgcagtat

SEQ ID NO: 11230 - DNA, 942 bp, Sorghum bicolor
  Clone ID: SORBI-28MAY03-CLUS17624_1
cgggcggccgggccatcacccatactattgagaccaactagcaacatacaaagtgaagtacactagcaacatcttagcaacaatggccgctaagtcgttggtcgtccttgcgctccttgctcttttggcaagtgctagtgccaacgattctgctccttactcttccttacttattccacagtgctcacaatctcctattgccactggtatcccactgctaccgacaatcaatcaagtagctgcggcgaaccttattgcttacctccagcaacgacagtttctttcattcaatcaactagctggagcgaaccctgtggcctacttgcagacacaacagctactaccattgaaccagcttgctattgtgagccctgctagtctcttgcagcagcaacagtttcttccattcaatcaactagttggagtgaaccccattgcctacttgcagccacaacaactactaccattcaaccagcttgctcttgggagccctgctgctttcttgcaacaacaacaactgttggcactctacccacaggctatggcaaacattgccgccttcttgcagcaacaacaattgctcccattctacccgcaagttgtggcaaacattgtccccttcttgcagcaacaacaacaacaattgatgccattctacccgcaggttgtgccaaacattgacgccttcttgcaacaacaacaattgctgccattcagccaactacctttgacgaaccctactgccttattgcaacaacccatcattcgtggtgccatcttctagattgcatatgatttgtagtgtaataatgaagttttcatgctgacgcatgtgacttctcgataataagaaattatagatctatattctaaatttcaatgtatctaagtgtgttctatattttttgttgccctaagaccgaatatcaaaaccttgaatac

SEQ ID NO: 11231 - DNA, 1486 bp, Sorghum bicolor
  unsure (1)..(1486): unsure at all n locations
  Clone ID: SORBI-28MAY03-CLUS17849_1
gccggccgggccggggcgacaattcagctgcatatcaagcagctactccgcccccaaatgctcgccggcatatcccgtttcctcactcgccaccgtccgccctttccacttgccgctaccgccaccgccgcagcagcagccatgtcgtcgtcgtccacggcagcgaacgtctccgatcgtccgatctctccggacaccacccgcgtggcctgggtggggacgggcgtcatgggccagtccatggccggccacctcctctccgccggctacgctctcaccgtcttcaaccgcacggcatccaaaacccagagcctcgtctcccgcggcgccagcctcgcggacagcccgcgcgcggccgcttcggctgccgatgtaatcttcctcatggtcggcttcccctccgacgtccgctccaccgccctcgatccatccaccggcgccctctccggcctcgccccaggcggtatcctcgtcgacatgactacctccgaccccaccctcgccgccgagatagccgcggccgctgccgccgccggctgctcggccgtcgacgcccccgtctccggcggcgaccgaggggcccgcaacgccgccctctccatcttcgcgggcggcgacgccgccgtcgttgctcgcctggcgccgctcttcaagctcatgggaaacgcgctgtacatgggcgggcccggcgcggggcagcgcgcgaagctgggcaaccagatcgccatcgcgtccacaatggtggggctcgtggagggcatggtgtacgcgcacaaggccgggcttgacgtggccaagtggctggaggccatctccaccggcgcggcggggtccaagtcgctggaactgtacgggaagcggatcctggagagggatatggcggctggcttctatgtccggcacttcgtcaaggacctcggtatctgcctgtcggaatgccaggccatggggctgtcgctgccggggctcgcgctcgcgcaacagctgtatgtgtcgctgatggcgcacggcgagggcgggctcggtacacaggcactcatactagccgtcgagcggctgaacaacaccagcctcgagaagaaggacgaatgaaaggctccaggctccaggtctgatgaacttgtgggaagctttgcttggtgcaagtatgcaagaccgaggtgaatgttaaggtgtctttcggagttctacagttgttcacttttgtggtagtatatatgctgtgcaaaaaattgcgccggcttggatgcttgcttactttgatctaattgtttacatccgccatgagttcaaataagattttgcaaacaatgtgccatcccttgcatggttgcattggttgtgcccaagatgtaatgactctgtttagctatggtgtttgaaataccagatttagacatagctatattcagcaccatggttattatacaagacacatttcatggtagtcagtactcacccttgaatcctggatatggagtttncg

SEQ ID NO: 11232 - DNA, 1300 bp, Sorghum bicolor
  Clone ID: SORBI-28MAY03-CLUS1993_1
agcacgaggctacaccctctccgcgtccgcttttccggccggttcttgctccatccatggcgatggcggcggagtggtgggatgcggcgacggcggccgtcgcggcgtacactgggatgactcctgcggcgttcttcacggccgtggcggtggccgcggcgctgtacgtcgcgatttcaggactgctcgcgcggccggcgcagacgtcgtcgacgaggcaggaggtggcggcggcggaggaggaggagagggcgttcgaaccactgccgccgccggtgcagctcggcgaggtgacggaggaggagctgcgagcttacgatgggtccgaccccaacaaaccgctgctcatggccatcaagggccaaatctacgacgtcacgcagagcaggatattttatggacctggtggcccgtacgcattgttcgctggcagagacgcgagtagggctttggcaaagatgtcgtttgaagcaagtgacttaactggtgacatttcggggttaggtccgttcgaggtcgaggccttgcaagaatgggagcacaaattcaagagcaagtacgtccgcccacgcgtccgcaagaagactgttccactctcagagggagatgatactgcaaggaacgctgtgacaactgaaagagacatagacgctagtactaccgaaagcaacaatgtgccagaaccaaatgaaactggaataacagaccaagggagtgtagcagagaagatagcggaatcacctgatgtcgacgttaacacaagcagccatgaagatacagaggagaaggcaaaggaattgccagattcagatgtgacaaatacaatcggccaagttgatgcagtggagaagccagagggaacaccaaacgcagttgtaaagaacaggagaagcattgaagatgccgttgagccaaaggaaacacctcaggtagtagatgggaaagatacatgtgaacctgaaggtgcaacagtgaagccagaagaagcagcagatgccatagaattaaagaacacaaccagtcatgaagatgctaagcaaccaaaggaaatacggaatgaagatgaaaaggatgtaaccagctatcaacatggtgaggagaacccaaaagaaacttcagatgtagaggttaataatgcatagagttgccgctgttgctgggaagctttctggccgtctgagccagttaacataatagagtgtaatgcacattgtggccagaattcagttatgaattcttgtatggagtacaattacatttaaactaaactaatgataataataatgaatgtacactctga

SEQ ID NO: 11233 - DNA, 1082 bp, Sorghum bicolor
  Clone ID: SORBI-28MAY03-CLUS20200_1
gccggccgggctgcggcagcagtcccacccccaccctcctcgtcctcgcatcccaccccatcgcgccgctcccgacgagagccaggaggaggtggcggcggcgccgcgaggaaggaagggatcgatcgaggatggtggacgtctcgcgcgtgcagaaggagctcaccgagtgcaaccgcgaccgggaggtgtcgggcgtctccatcgcgctccacgacggcgccaacatctcccacctcaccggcaccatcgccgggcccgctgacagcccctacgagggcggcaccttcgtcatcgacatccgcctccccggtggatatccctttgagcctccgaagatgcagtttgtcaccaaagtatggcatcctaacatcagcagccaaaatggagcaatttgcttggatattctgaaagatcagtggagcccagcccttaccttgaagacggcactcctttcccttcaagctctgctttcttctcctgcacctgatgatcctcaggatgctgttgttgcacaacagtacctgcgtgactatccaacatttgctgctacggctcgctactggacagaggccttcgcaaagagtgcgtcaactggcatggaagagaaggtgcagaagctggttgagatgggcttcccagaggacctggtgagaagtaccctgaagagtgtggatggcgatgagaacatggctcttgaaaagctctgctctgggtgaaccatctggccagtacatgagctgtaaattgcatccccattgattatataatataagaacacaatgcctgctaatgctcctgctcagccatttcagtgtggccattttattaagacaatatatataggggaggtcgtgccatggcccatgggactcgagtgaaattcgacttcttcagagttcgttcgctttgtttgcttttttttttctcaacttttgcttttgtgtctggtagcctgaatcatcaactctttgcccatggaactctggtaatatctgatgcaaaagaaacatcagattgacataaaccccttgcaacctggatgtgatggcctgatggataacatctcatatttgattctc

SEQ ID NO: 11234 - DNA, 990 bp, Sorghum bicolor
  Clone ID: SORBI-28MAY03-CLUS20240_1
gccggccggttccaggtgctccgctaaaccgtgttgaaccgagctccttcctccgtctccgtctccgtctccgcaccgcggccctcgtctccggctctccgctccgctctagtcgctccttccgccggcgagtggccgttgctgcagcgaggagaagagagcggagatgggcgacgagcgggtgaaggcggaggcgctgcagatcctgggcctcttccaggtgctcccacgcctcgtcgtcttcgacctcgactacaccctatggcccttctactgcgagtgccggtccaagagggattcgccgagccttttcaggcacgccaggggcatcatttacgcgctcaaggagaaggggatcgacatggcgattgcgtctcgctcgcccaccccggacaaagccaaggtattcctcgacaagttggagctccagtccatgttcgtcgcccaagaaatattctccagctggacccacaagactgagcatttccaaaagatccagaggaaaactggaattccctacaaatccatgcttttctttgatgacgaggacaggaatattgatccggtatcaaatttgggggtgacgagtgttttagtagagaacggggtgaaccttgacatgtttaagctgggtctcagtaactttgcaacaaaatatgctgcctccagcagaaaggaagacgaataacctcgaggaggagtgatacattagaaggaaataccttcaaaacattgtacttgaatttcttgtgatcaattgccactatattcatggacaatttgtggatgaaggatgaccacacagacttagcttttgaactgatgcaacgcctgtctagtatatttatttgaaggcaaaacactgtgtgtctttatttcacgtgccaaaacaatatatcggtgcatctattttgctttatttttgtgtcagaattttcttgtgccttgtaacgccgcaagtattttctgttgacctgcgtttttcatgtt

SEQ ID NO: 11235 - DNA, 830 bp, Sorghum bicolor
  Clone ID: SORBI-28MAY03-CLUS2042_1
gcacgaggcttcattcttgttccttccatcttcgaaccttgtggtctaacacagcttattgctatgcgctatggatccgtccggattgttcggaaaactggaggcctgtatgacactgtctttgacgtcgacaatgataaggatcgggctcaagcacaaggcctcgagccaaatggattcagtttcgaaggagctgatagcagtggtgtggattatgctctcgatagagctataaccacattttatgatgcccgcgactggttcaattccctctgcaagcgggtaatggagcaagattggtcatggaacagacctgctctagattacatggaattgtaccattctgctcgcaaaaactgatataccttttatcaaaagggaaaacaccctcggtttgcccaggttaggagcatctaaatgttgtcctgagtttctgatgaagactcgacttcggagttcggaccagttctgggaaagcaaagcgaaaagccttgcgtcaaaaaagtgccaagtttgagcctctgcttacgcttttctttatagctctggatgggcagatttgacatgggggcgcggcagtgaggagatggccgcgcgagtgatggacgcccgatgctacacagcgcgcatatatggtttagagaatgttacttcgtacgttacatgcatgtatatacgcatggtagtggcagctagctagtagcttgcaaaacaacagtacgtcagtaatgtatcccggaaaccctgcctgaggtatataggctatatagtgtatcgatatgcgaagtatgtatacacatcttaattgttttactagtagtttcttctcc

SEQ ID NO: 11236 - DNA, 1256 bp, Sorghum bicolor
  Clone ID: SORBI-28MAY03-CLUS20505_1
gccggccgggcttccgccgcacgtacaaatacgcgacgggaacggtcagggcccaaccctaaacccccgcctccgcctccgctgcatcccatggcggccgtgcagcgactcctccgggcagccgcctccggtggttcggcggcggccaggaggcgcatgacgtcgctggcgacggagcaggcgccgtctgcggccgccgggttcccgttcgcggcggaggagagggcaaggcggctgccgatggcggagaggaacgtgcagtgggtgttcctgggctgcccgggcgtgggcaagggcacctacgcgagccgcctctcgcgcctcctcggcgtgccccacatcgcgacgggggaccttgttcgcgacgagctcgcctccaccgggccacttgctacgcagcttgctgaaattgttaatcaggggaaattggtttctgatgaaattatcttcaaccttttgtcaaaaaggcttaagaaaggagaagaccagggagaatcaggatttattcttgatggttttccccgtacagtaaaacaagcggaaattcttgatggcgttacagacattgatatggtggttaatctaaaactaagagaagatgttctagtagagaagtgcctcggcagaaggatttgcggccaatgtggaaagaacttcaatttggcctgcattgatgttaagggtgaaaatgggctaccagcaatctacatggaaccactgttgcccccaaacaactgcatgtcaaagcttattacccgcgctgatgataccgaagaggtagtcagaaatcggcttcggatatataacgacatgagtcaacctgtggaaggtttctaccgggagcaggggaagctcttggaatttgacttgcctggtgggatccctgaatcttggccaaagctgctccaggttctaaacctcgaggaccaagaggagttgaagctggctgcagcataggtctctggaggacctacatacttgaaaaaagaccaaaccacatttttttgaataatggagaagaggaaacttactccatgatttagtgccttttgcagaagtaatagttttcttgtcaaaagcgagttgttggttttcaccggcgttttgatgagctggtactatgtaacgttgacgttagttgtaaacagtaccccatttttgcttgggacccagtttggagcccatcaagacatgctgtagtgctattcattcataacaaacttgtggtaaatgagaggctcttttctgtgttgcgt

SEQ ID NO: 11237 - DNA, 1384 bp, Sorghum bicolor
  Clone ID: SORBI-28MAY03-CLUS20542_1
gctcgtggccctcctcctcgcgccccttggtgtccttgagccgtccggccggggggctcttctcgctgccctcgtccgcttccccgctctgacgtccggttttgctgcattcactgcctctgcttcccagctgcttcccctggcaactttctgcgtccgcctccctcttgtggctggctgctttccctgcggcccgcgcgccctgtcttccgccctccttgtcaccgttgctcttgcgtccggtgctgctgcagcctcgccctccgcctccttcctgctcctggtccgcacctgcgggcttgtccccgctcctctcctcgtcttgggtcgttccgccgcggctgtgtgttttcccgtcgtccctgccccctgccgctcagccatctacccgtggctggcccctcagcctccgggcctcccttcctcccttcctctgtccgcaatgccggggctcctcccttccggcccactgcacctcggcctgtccgccctatctgccgcactatgctcatctgggcacttgtaacctctcctctccttgtgttgggtggtcttgccccgcatcattgtcactccctttgccacgccccctcccgcgcacccccggccccctggggaggccctcggctgccgggggaccgctgccccgtgccgcagatggcaatggcagggttcctccctttcagcgcaatttacatcgagctgtactacatatttgccagtatctgggggcataagatatacaccatggccagcattctctttattgtgttcattatcctcatcattgtcactgcctttgtcacagtggcacttacgtacttccagcttgctgttgaggatcatgagtggtggtggagatctgtcctgtgtggaggctccacgggcatattcatcttcttctactgcatctactactaccatgcgcggtccgacatgtcaggcttcatgcagacatccttcttcttcggctacatgacctgcgtctgctttggcttcttcctcatgctgggcaccgtcggtttccgcgcatcgctcttcttcgtgcggcacatctaccgctccatcaagtgcgagtaaacattgactgttgccagatgtgctcacgtggtccgacatgtgaaccagttgggttgtgcctgaattatgcccaagcgctagcatgcgctcaatatgaacctcttcgcctttagcctttagcctttatatgttgcagctccctgaaaggaggatgtatgtagtgtaggactgttaccagaggcagtgtctgtattattatctacacttgtagtccagtcagtgtcaccctataattttgttgctaaaccctgtgtcttgctcagtagagccctgttcgcttgaaggccatttacagtgtgtttgc

SEQ ID NO: 11238 - DNA, 718 bp, Sorghum bicolor
  Clone ID: SORBI-28MAY03-CLUS36351_1
tccacatccagaatgttgtccccccatgttctgggtgaggatcactacaagcacgagggtggtgttcagaaggttcttcagaattacaagaatctccaagatattattgccattctgggaatggatgagctcagtgaagatgacaagttgacggtcgctcgtgctaggaagattcagcggttccttagccagccattccatgttgctgaagttttcacgggtgcacctggaaagtatgttgagctgaaggagagtgtcaaaagtttccagggtgttttggatggcaagtatgatgaccttccagaacagtcattctacatggttggaggaatagaggaggtcatcgccaaggcagagaagattgccaaggaaaatgcatcataaacagtctccacaggcaatgcaaatttaactttggaggtcaacatgttgtgccttttattctgcgttatcaagaacatgtatttacgtgagcaggaggccctgccctgccaatggatgtgttttccctccgtttccccccataataaggattcactatgacattttcatttggcttactgccctttgaggaagaattatcctttttgatgacggcgaaactatgaacttgttaattctcaaagaaatactgtagtctcacatgttcatagctgttttgaggttacctgttcaatttttttctgaaccgattccacagtttgttaactgtgcagtc

SEQ ID NO: 11239 - DNA, 873 bp, Sorghum bicolor
  Clone ID: SORBI-28MAY03-CLUS36364_1
ggtcttgaaggatagtgtgcccaacatatctgagatcataagtactggttctccagacaatctaaccaaggaagataggttccaaaccttggcaccgtccggtgttgaacaagaagcacctaagctggggcatgctccaagggcgccctcctcaccatggatgcccttttcaatgctttttgctgccatttccacaaaagtgcctcgttcagacatggatttggtcatcagatactatgaagaatttaagaggaaagggataagcaggagcgacttggtgatacggataaggcaaatagtcggagataagatattggtttctacaataatgaggcttcaccagaagtccccacaggtggcagcagctgggctaccaagagcactcgcaagggggaagagggagtagccgagtaagatttgtttaagccttgtcttttgagaaatatagagtacagatgctttgtcgacatggccagactcaacaagtcgatggaggcaaaaaaaaaacgagggagatgagcaactgttgtagtatagtctcagactcaaaagtatttaggtcttgacatactaaaactcagataaactttactctaagtagtgtaattccgctggtcgattgcctctgtaaaatccggacagctatcaatatgccttgtgcttttcaccctgtactccttttttttttattcgctgttcttttcaacttttttttcttgcaatggcaaatggactgcctgcccctttcagcttcttccatgcttcatcagttttatttctctcatgctaaacgttcagcttgctggctcatgtaccgtcagatggaaacagtggtctggtgttttccttgcctaaataacgagccagtgatgc

SEQ ID NO: 11240 - DNA, 1473 bp, Sorghum bicolor
  Clone ID: SORBI-28MAY03-CLUS36625_1
atccatcccaactggtaaaataagatcccgttccttcccatcacgcccatcgttttccgctctccattccgttctgcatccgtcaatccaccccccacggcgccgacgactcgggctcccggctcccccccttggactcggacgggaacagcacgtcggggaaaggaagcaagcgtccgcgagtaggaacagtgacgagtgacggcagcagggggagggacgggacacgggaggaggggaggggacagaggaggagcttgggcggtggagctggtggactggtggtatatagctaggcgggcgggccgtgggccggcagccaatgccgtcgggcgcgcagggctaggaggatgggcggagggggcgcgatcgtccacggcttccgccgctggttccaccgccggaacggctccacctccggctccaaccagtcgtccgtcgccggcgagggggacgacggctcgtccgatctcgaggtcatcgaggacccggatctcgtcgcactccgcgccatccgcgtgcccaagcgcaagatgccgctgcccgtcgagagccacaggaagaactcggtggaaatggagttcttcacagagtacggagaggcaagccagtaccagatccaagaagtcattggtaaagggagctacggagtagttgctgcagctgtagatacccgcaccggtgagcgggttgctatcaagaagatcaatgatgtgtttgagcacgtctcggatgccacacgcatactgcgggagatcaagctccttcggttgcttcgccacccagacatagttgagattaagcacattatgctccctccgccccggggggagttccaagacatctatgttgtttttgagctcatggagtcggatctccatcaagtgatcaaggcaaatgatgacctcacccctgaacatcaccagtttttcttgtaccaacttcttcgtgctctaaagtacatacatgctgctaatgtatttcatcgcgacctaaagcccaagaatatactggctaactcggactgcaaactgaaaatatgtgacttcggacttgcccgtgcatcatttaatgatgccccttcagctatattttggacagattatgtggcaacaaggtggtaccgggcacctgaactttgtggttcctttttctccaaagccatccctccagttcttgtttgcacccttggttcatattttccgaaccttctcccggcaggcccttcttgccggggctgatgcttgtgctcctcaactgtgtagagcatcatatttcccttttagtaaatcttcttgtagtatactcctgcaattatgtattctttatattcttgtagtaaactgtgctggaaactgaggtgtaaagtttgtttagacaagattatgttgcaaaatccttatgttacagctatcgaattctgacatgttttaatttatatgcagtacactcctgcaattgatatttggagca

SEQ ID NO: 11241 - DNA, 940 bp, Sorghum bicolor
  Clone ID: SORBI-28MAY03-CLUS36647_1
ggtaaaccctctcctccgcagtcctactcggctactcctacccgcgcggccgccgccgacccgcgccctcgcagcgctccccctccgcttctcctcctcaccaggaatggcgtcggcgggattcccctcccgaatcgccgggattagtgtccgtcccgactccagttcggcctgccttattcacaaggttggagcgccgtcgaattctctccctggagcggtggctgttcaggttcaaggccaccagaacagggtccgcaatggccaagctatcaggtgtgcaatggcaactggaaaagagcagggtgcaatttccactgctagtagtggtgatcaaaccaagggtggattgcgtggaaaattaaataaagttgttttagcttatagtggtggtttggatacttccgttattgttccatggctcagggagaactatggttgtgaagtcatctgtttcactgctgatgttggccagggtgccattgaattggaagggttagagaagaaggcaaaagccagtggtgcatgccagcttgttgtgaaggacctgagagaagaatttgttagtgaatatatatacccctgcctgcgtgcaggtgcagtttatgaaagaaagtatctgcttgggacttcgatggctaggcctgttattgctaaggcaatggttgatgttgccaaggaagttggtgcagatgcagttgcccatggatgcactgggaaaggcaatgatcaggttcgctttgagcttacgttctatgctttaaatcctgaacttaaagtggtggcaccttggagggagtgggatatcacaggacgtgaagatgctattgaatatgcaaagaaacataatgtacctgttccagtttcaaagaaatcaatatacagccgagatcgaaacttgtggcaccttagccatgagggtgacatcctggaggaccca

SEQ ID NO: 11242 - DNA, 1416 bp, Sorghum bicolor
  unsure (1)..(1416): unsure at all n locations
  Clone ID: SORBI-28MAY03-CLUS21072_1
gccggccgggtcgggccccccacttgctctctctctctctctctctctctctctctctctctctcatttcgttcctgctgcctccaattggaaacccatcatcagccatccgcaagaagcaagcagcaataggctattcatgccaatagccaagagccagccaagcttccacctctaacccaacccattccattgagcataatactagtgccagttctagcttaattaatccttttctttatactgcctccctcgtggcctcgtcgcctcagctccacctccatctccacttgcgccctccaaatccgatcgatctccgcagcctccagatccccggcgggcggaggagacagcgagctccagccggtgaaccccacctcgctgcactcctctcctctcactctccaaatcctttaccaggaaagaaaggaaaaaaacgttgcctgccctggtgtagcagctgaattacccagtttgatggtgaagaaagagttttagatggtctaaagatggagatgatgagataaaaagtaccaaaagtgtacagtggatagcaaggatatgactgtcatgattcctcagcgccaccgggctacagccaagaagcccatgtggataatcgtgctcttgtctatggtttgcatcgtgttgattggggcttatgtcttcccaccgcggcgcttctctaagtgctacctctctgcttcaagtgtatgtacgaatttcaaggattggctcccttccatgggccatcgggagcggactgacgaggagattatttcatctgtagttattagggatatccctttcatgccgatggctgtgttccactgcattcatttgattatgtgtataactacctgatgggaacaaatgttagcttcgtggattgtttcaaggatccaggtccacatggcagtggaaggtacgctcctgagatgtatcctgaaatagatgagagggattttagaaagggtgcccagtggtttgcagttacaaggagacatgctttaatgattctggctgacaacctgtactacaagaagttcaagctatactgcaaggtatatttatttatcttagataaaggaaggattttattaattcacaatcattacatcgagttggtacaataaaactagataccaagtatcttatcttagtaggaaacatgcatagaatacaacaatgacttaatttagatatgtgctcaatattaatttatgtctgttactttgtttgatgtaaggttggcagtaaggtcaatatatatttttcaatatgaattatagtcttcttgtagtgaaacttcagtgcagaaatttgacacctacctcgaaaaccttgtttggatatggtagtaacataaaaagaaccaattcnaaatgcaaaatggacttcaaccaatccatacna

SEQ ID NO: 11243 - DNA, 919 bp, Sorghum bicolor
  Clone ID: SORBI-28MAY03-CLUS2112_1
gccgtccgcgaaggcagagcagagcaaagcaggaggagcagaggaagaatatatccatcatccacacaccccacacacataccttgttctccggcgtttcttgctgggcatccagaaatctcctcggagttgcaacaagcatgggcgggttcagcggcgctacgggtctcgcggtgtaccgcgaagaggacgacgaggagctgttcgagacatcgtcttcgatctccggcggcgactccgagcgccggctccggggccccggcccagttctccgccccggagctcggcgccgccgcccgggtgcgccgccggcgcacccgccgcccgcgccggcagccggtgcggacagcctcttcggtctgtcgtctatgatggcacagctccctgtcaagtaagtcatccgacttctctttctttttacatgtaaatcatcaaaacaaatctgcaagcatcaaattaaagggaaaaattctcaactcgtgttgtcctctctctctctgcaggaaagggctgtccaaatactatgacggcaagtcccaatcgttcgcgtgtatgtctgaagtgaggtgcctggaggatctgcgcaagaaagagacgccctacaagaagatgaagccatccaggagttatgtggcattagacgaagagcaggactgtcatgtgccgggtcctaacagcaggggttcttgcgcgaatctggtggctcggaagaacagcaaaaacatgctctacagacctcccgcaatccctgtaaacaagagtggataccatcagtaggctctaggacatgactgtgtttctatccagggtttcacctctgttctttttttttgtcctttcatttagagggattttgttgacaagcgtattggcctgtactcagttgtaagaggttttccttctctgctctcaatagagt

SEQ ID NO: 11244 - DNA, 1369 bp, Sorghum bicolor
  Clone ID: SORBI-28MAY03-CLUS21133_1
agcttcctcgctccggcaccggcatcgctgttaacaactcgcatgcccactctcggcaccgcttcgtcgctcctgctcacccaccgccaccgcctcctcgccgcccggacccactcccgctccgcctccgcctccatcaagatggcgcggtcggcgctggacgaggtcaccgataccggcgccttcgaccggtcgccgtccaccttccggagctccgtttccagggacggccggttccccgtcgtggcggggcggtaccacctctacgtctcctacgcgtgcccctgggcgtcccggtgcctcgccttcctcaagctcaagggcctcgaccacgccatcggcgtcacggccgtgaagcccatcttcgagcggaccaaggagaccgacgaccatctgggctgggtgttccccgccgccgccgatgaggagcccggcgccgagcccgacactctcaacggcgccaggagcgtcagggagctctacgagatcgccagctccaactacgccgggaagccaaccgtccccgtcctgtgggacaagcagctcaagacggtggtgaacaacgagagctccgagatcatccggatgctcaacaccgagttcaacgacatcgccgggaaccccgggctggacctctacccgcctcacctccgggcctccatcgacgaggccaatgagctggtctacgacgccatcaacaacggcgtctacaagtgcggattcgccaagaagcaggggccatacgacgaggccgtggcgagattatatgaggctctggacaaatgtgaggagattcttggcaagcaacgctatatttgtggcaaccagctgactgaggctgatattcgcctgtttgtgactctcattcgattcgatgaggtctatgccgttcacttcaaatgcaacaagaagctgctgagggaatacccaaacctattcaactacaccaaggacatctaccagatccctggcattagcagcactgtcaacatggagcacatcaggaagcactactacggaagccatccgtccataaacccctatgggattatccccgctggacctaacatcgactacaatgccccacatgacagggagaggtttggcgcctgactgcgtgagggaccttttgtaccgatcgtgcttgtttctgcaggaggccggagccgtactatgcagtgttgtgttgtggttgaggcccttgagggtcttgtgcttggcacttggcaccggcagtgtcaagaggctgcaagtatcccttatatactgctataaatacttttgtattgtgtgtgtgtgtgtgtgtctctgtttgaggccctgtttagctcccaaaattttccaagaatcctcatctcattgatttttg

SEQ ID NO: 11245 - DNA, 996 bp, Sorghum bicolor
  Clone ID: SORBI-28MAY03-CLUS2134_1
ttcggcacgagggtcctctcggcccgcgggttcctcttccactacctgaggcgccgctggttctccggcggcggcagcggcgccaccgtcccgagggcgcctgccaaatcgcggcggaccatggcggccgccaagtggagcgagacggccatgctcgtcatcgacatggtccaggacttcgttgacccggcgatgcgcagcccgatgctggtggccggcggcgaggccgtcgtccctgccgttgccgaggccgtcgccgtcgcaagggagcgcggcattttcctcgtctgggttgtcagagagcatgatccttctggaagagatgttgaacttttccgcaggcagcattactctgggggaaagggtccaacagtgaaaggtctgaaaggagcggagctggctgatgggcttgttattaaagaaggggaatacaagttagtgaagactagatttagtgctttctttgcgacgcaccttgattctgtcctgaaaactgcaggaataaagaacttggttattgttggagttcaaacaccaaattgcattcggcagactgtctttgatgctgtagcattggactatgagaaagttacagttcttattgatgcaacagctgctgcaagaccagaaatccatttgtcaaatatcagggatatgaagaacatcggagtggatacgccaaccgtggaagaatggcgccgctagggtccgctgccacctcaccctgtctcttggcagcaccagcaaagagagatgacctgatgtatgagatgcatgcagcacctccctccctgcatctatttcctttttctaatctccgtctaattgcgtgactgcacgtacgtagctgtagtgttataccctgtgactgtgaggtagaacaatgccagatggtggtatatagtgctatatgcaaacttgtaattgtaatccctctgtgtagagttctgttcagcataccatgtgcttcgaatacggcactgaatcctgtgcgcg

SEQ ID NO: 11246 - DNA, 723 bp, Sorghum bicolor
  unsure (1)..(723): unsure at all n locations
  Clone ID: SORBI-28MAY03-CLUS21617_1
cntatgttgttgtgacccatcagcatagcacaataagaagagctgttgatagattgctatttcttcacgaggggaaggtagtttgggaaggaatgacaaatgagtttacaacatcaactaatccaattgttcaacagtttgcatctgggagcttggatgggcccataaaatatttttaagacctgacctagtagtcaatgaagcataggtgttttattacaccctcttacagatcatgccaacaaaatctagagcatcaataatccaacaatatctggagcatcaagaatctgaaatgggctcactatggtggttgggagatgtaaacgcgttaggtttggcactgttccattgagtttaacaggcatctgcagcatcatcatttggccacctcaccctctatacacatagttggagtaccagcttgtcaaataagcgttagcttctatacatcattctttgggggaaactgtgcaatcaagcaaaaagaaactatattctttgggaaaactgcacgatcatgtgaaaaaaaaactttagtaaacacccttctttttatcctttacatgcgaacctgatgtaaatgtaactgtagttgttgcttatgatatagcaatgtcagtccctcagtttctcagatgattgtatttatacgcttgtctgaactgaagatggtaacagtgtgtactctatttgcgcacacaagttgatttgacattgacg

SEQ ID NO: 11247 - DNA, 793 bp, Sorghum bicolor
  Clone ID: SORBI-28MAY03-CLUS19479_1
ctttcgacgtatgagctcaccgtcctacgcaacaggggaccaaggagaatgcaatgcactatgcactcgataccagccgagtgcattcaggagggtgggaaggcccctacccctaccggcaccattcagtcgcttgatgagccagtgtccacttcacctagtaccaaagggaaagaagtggctttagaattttcttcgacaagcctcagtgctgatctgtctggactggcactggcctgcgcgaatgaaacacctctggttctgaagaacaaagcacctcgttggcatgagcagctgcagtgttggtgcctcaacttccgggggcgcgtcaccgtcgcatcagtgaagaacttccagctcgttgcctctgttgatccttccctaaacatccctgcagcagaacaggagaaggtgatcctccagttcgggaagatagggaaggatatattcaccatggactaccggtacccactctcggcgttccaggccttcgcaatctgcctgaccagcttcgacaccaaaccagcctgcgaataactgacgatagtataaaatccaggtggtggaggtctcttatgtatgtctatgttcttcctgggcgatgtaaattcttgatcttctcattctgagcctctacccgggcaaaatggtagtttgtgagcgaagatgagcaatggcatctgtggccattggaagagatttgggcgacctggtttatccaactgctacatgtattattgttgggatgtttggctgtgaaatatcactgccttaatcgccactaaacgttgtg

SEQ ID NO: 11248 - DNA, 1097 bp, Sorghum bicolor
  Clone ID: SORBI-28MAY03-CLUS1934_1
tgcgtccgatagtgtaaaaatgtgtgtgtgccttgccctactatttaaacaaatacataaattattgatcttgatttcatgtttttaaatgccaacttaaattgcactcaatggtgtcaatttcctttgatgccatgtttgttaagcaaaactaaaaatgctccttgtgtaatgtgtatctcggttctcttggagctattttggtagtaccattaatattttggttctattttcatttagttaatacttcggctctttaggaatggcaattttgtgtcgttgaagtatcatatatagctgaacattactccatacagaatgctatccccttatttttggtcaaaaagttttagaatgtttcttgaacactcatgattatgcctgttgctaaccatgactgctgtgttgccttcacgacaagccaagtgccatatgtctgatttcaggaacctgcaggagcactgctcctgcggcggtgggtcagttgcttcctctgcctgctttgacctggcgtactttggtggctgttctgcgccccaccaatgtttatctgtatgtagcgtacctagctttttcggccactgcttttgtttgataatcggtctacatttgcacgtacctgtatttgagcaatttagtgacaatcagtggcacatcaggtgccattgatcgtcctatacttgagcaggttcatgtgaaccccttggggcaacaggccccttatctcccttgaaaatgaaaattgttacaaattggttgaggttaaagatcgatctaatggattggcgtacttatggtcatggtcgatgttgtttgaagacaaagcaaataaacttaagaatcatatcgatgcaaaagatatagtgcttcacaggttccgcaacctaatgtagcctgcaacttgcctgcgttttcatctcgagatgctgaaatcgagagtttagggtgctgctatgtacttcatgatcaatctgttggtattgacagcaatgtcttccgtgacattggttcctattgacttattcgattataataatctggcatcacctaatattaggtttgagttcacctaatattaggttttgagtttcaccatt

SEQ ID NO: 11249 - DNA, 1001 bp, Sorghum bicolor
  Clone ID: SORBI-28MAY03-CLUS19625_1
gccggccgagccccatccccgcctccgcggcatcccgtcgagcacccatggcggcggcggtaaccctcctccgccttcctctcgcccgtctctcctaccacctccgctccgtaccttcctctcgtctcccgccccctcgcctccgtatcttgacctcccatcgctttttctcctccctggaccacggctccgcctccgcctccgcctccgcagccgtggccgaggttgtaggcgtgccggacgcggaggagtcggtagaggaggaatctgcggccgaggctgaggctgaggctgaatctgaggcgcccaggtcgttcgtgcttccgcggctaccgcggccgaagctgagcgtgaaggagcggaaggagctggcctcgtacgcgcacggcctcggcaagaagctcaagtcgcagcaggtcggcaagagcggcgtcacacccaaccttgtctccgccttcagtgacaacctcgagtccaacgagctcctaaagctaaaaattcatgggaactgccctggggagctacctgatgtgatacttcaacttgaagagtcgacaggatccattgctgttgatcaaattggccgctctgttattctgtataggcctagcaccagcaagatgaaaaagaaacaacaagttgctgaaaatgctaggagtatttcccgacctgaagcaggaaatgctaggaacaacgtaaaatctgaaatatcatttgatttacgacttctgaacagctcaatcctaggaggtttgtaaatctggatctacaattagaggaaagcagtacaaacagctcaggcagaagatttgttggatctggatctacatttaggggtcaacagaacaggagatcaatggcatccaaggggtcttcatatagccgaggatagcagtggcacaaaacgctatattcttgttttccgtgttatctggactccggaccctggattgatcatgtaaaattttagacaaactaattggaatacaatgctactgttt

SEQ ID NO: 11250 - DNA, 926 bp, Sorghum bicolor
  unsure (1)..(926): unsure at all n locations
  Clone ID: SORBI-28MAY03-CLUS1969_1
cgtccgnattccgggtcgcccagcgtccgcccgcctaccctgcagccattgctctcctctcgccgtctcgcgtcgtgcagagtccaagctcccacgattgactccaccgcgaccgagggaggctgagagagagagagagacgcccgcctccagatcggctggcggggatggcggcgtcggtctttccggcgctgctgctcgccgtggcggcggcggcggcgctgctgctcctaccggcggcggaggccgtgtggctcgagctgccgccgtcggggaccaagtgcgtctccgaggagatccagcccaacgtcgtggtgctcgccgactactcgatcatgtacgagtcccaccccagctcgcaccccaccgtcgccgtcaaggttacgtcaccctatggaaatactgtacatcataatgaaaatgctacaatgggtcagtttgctttcactacttcagaagctggaaactaccttgcatgtttctggatagacagtgtggagaaaggatcaggaacatctctaaatcttgattggaagatagggattgctgcaaaggattgggatactattgctaagaaagaaaaaattgagggcgtagaactagagcttaggaaacttgaagctgcagttgaatccatacatcataacttgctgtatctcaaagcaagggaagcggaaatgcgaacagtgagcgagaaaacaaattcaagggttgcctggttcagcatcctgtcactgggagtctgcgttgccgtctctgtgctgcagttgtggcaccttcaagggttcttccggaagaagaagctcatttaaatccacgttttatcagtgtgtacttccccgtgttaactaccttaggaggacagttttgtcatatttatttcaaaagcaaactcatatgatggacaaaacggctggttgatgata

SEQ ID NO: 11251 - DNA, 681 bp, Sorghum bicolor
  unsure (1)..(681): unsure at all n locations
  Clone ID: SORBI-28MAY03-CLUS19785_1
tatatntaagttgttgcagttaaaaagctcgtagttggaccttgggccgggtcggccggtcgccggcacggcgagaacctatgagcagggctgaccgggctcggcagcaaccgcatcggatccctagggtttaagccgcacagcctccacagctcgaaaccctcgccgccgatcggattcggagaaagagacgcgaaacaagatgttcctcggcgcggtcccgcgtcgcccgagcaaggaggctgcgtacaagcagctgcggtcgcacctcgtcatcatggcctcctgcgccgccgtcatccgcgccgccccctacatcctccacttcctcacccgcgacggcgatgtccaggagctcaagctcgagctctaggcccctcagttcccatgccacctccaaaggttctacaaaggcaatcgtcatttgagactactgcaaagtaatatgaagtcagcgaccccagtgctacttaagtttctttgttctttcaaatttagtgacaatggtgtagtaactggcttgtgactgtgaccagtattgcattttgcctatctgtatggtctagacttgtctgcattggtggatctgcagagatgttatcattcaaccattctctgagctcagttgccaaaaaaaaaaaaaaaaaaggcttgctattgttatgtgtctgagctattctt

SEQ ID NO: 11252 - DNA, 890 bp, Sorghum bicolor
  Clone ID: SORBI-28MAY03-CLUS22230_1
gatactcatattgtcaacctcttctcattctcaaaggcttatggaatgatggggtggcgtgtaggatacattgcatttccaaatgaagctgatggcttccacgatcagctcctcaaagtgcaagacaacatacctatctgtgcctccatcatcgggcagcgcctggcgctctactcactggaggctggccccgagtggatcaaagaaagggtgaaagacttggtgaaaaaccgagcactgctcgtggaggcgctgtccccgctcggtgaggacaatgtgaagggcggggagggcgccatctacctctgggccaaactgccggacaactgctccaacgattttgaagttgtcaggtggcttgcaaacaagcacggtgtcgctgtgatccctggcagcgccagtggaggccccggatacatccgcgtctccttcggagggctcaaagaagaagacaccaggctcgctgctgagaggctaaggcgcggcttgcaggagctggtgactgatggaatggtacagtaactggtcccttggtgtaagtaaaaacgtagcattgaagttttacagaactccaattttccaatggtataattctataccgggattaattcgagagaagactattttcaagaatacattgttcggacgagagccggggacagaataaataaaaggtatccggtctgcagagtaacctatgttataaaatataaatagtacatatatcatcagtgagtacttgtttctgtttgacattcagttatctatattactgatggcagcaattgtacacagtcaaaagtataagcaagaattgtgagctgctcttgacgtacagagctgcctgttggtaatttgcttggcttagcttgagaatgaatactaattcc

SEQ ID NO: 11253 - DNA, 504 bp, Sorghum bicolor
  Clone ID: LIB5048-003-R1-XP2-E9
aggctgggattttcagaatacattgttcggacgagagccggggacagaataaataaaaggtatccggtctgcagagtaacctacgttataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacctgggggcgcccccggcagggggcccttgactttgccttgcccgggccgggggggttggggaaaaaaagggtttgcttttgttgtgggacgggaatccgggggccaattttgccctccccttggaagggggaaaaaccaggggtggtggaccggcctcgattttggggggccccgccctggttgttgaaccttgaagggggaggaactttcgttttttccgttttggccggtaaccccaaaaaaaatcttgtggttggggatagggggttccgggggaacctatttttccctgaaagggggagcggccccgttccggg

SEQ ID NO: 11254 - DNA, 734 bp, Sorghum bicolor
  Clone ID: SORBI-28MAY03-CLUS223_1
tgccccgcgggaaaaccggccgccaccaatggtttcttcaacccaacagggtcggacttccagcgagttctctaacatgcatcaggctggcgctggctcaccaataatcttatacggtgatagtaataaccagcttggccagtgcagtgcaatcgatgtacaccgctaaaccttcaccgcccggggttctacttctcaggttctacttcttcgaaattttgcctcttcccgtttgaaggttgcctcggcagtttctgatcctcgccttctggtcaaggccaccttgtcacggtcaccttagctccgaagccacctcagcccatcacccttgcccttaacctgtccccattaacagattggccgcacactgcacatgagctatcatcaagaacaaatccaccagcacaagtggggaacgcctcccccccggtgaccttggctgaagcactgcccccaggtatcttaagtgcctacgctccgttgcgtaccattggttgaaatggaactcacagcgttgccgaccactgcatcaatgctatcccccgaaattttattaccagcaaaccccctgccggttggtgcaagacctgctttggctgcagcactgcccccacgtacctaaggatcggaggaatacccgttaggaaaacggggaagccagtgcaagcgaacatctacagcatcctgtttggatgacaaaatagaaaggtaccagtgattttcagtttacctta

SEQ ID NO: 11255 - DNA, 916 bp, Sorghum bicolor
  Clone ID: SORBI-28MAY03-CLUS2226_1
gccggcaatccaatatggaacctatgagaggagtccttggtagaagactcatatctgcagaggacttgccacctatggacattggtggcaaggctgacccatttgtggtcctgtacttgaagaagggagaaaccaaaaagaagacaagggttgtgacagacacgctaaatccaatatggaaccagacatttgatttcatggtagaagatgcactgcatgatttgctcatggtggaagtatgggaccatgatacatttggaaaggattacgtagggaggtgcatcttgacactcacgagagttatacttgaaggtgaattccaagatacctttgtcttgcaaggtgccaaatcgggaaaactgaacctgcacttcaagtggacgccacagccaatctatcgagatcgtgaccgggaccagtgagacctgtaaacgagaaggcagataaacacttatccccaacggtgcatgcatattagctgtcctgtacacaaatcgacagttcttggagccacacgaccgaaaacaaatgaaccgatcgacaaacttggagttgaatggagtttgataaattttgatagctgcatgttcaaaaaaatttgtgggaaaagttggtagttcttacgttaagaatgaagaatcatgtacccttgctagggtacttgtatattgatagtcctttttgtttggctgataagccatgacaaaattgatatgttgtgggagaaaaatactgttgaatgactggtagattcggttgataagtttaaacgaacagattgaacaatataaaaattagactagtttgttcaattatcactatctaagtgatgatgtaagcattcttgtatttgatacccatccaaagagccattttgagccattataaatgaaagagtctccccccgttgaccttc

SEQ ID NO: 11256 - DNA, 557 bp, Sorghum bicolor
  Clone ID: LIB3481-005-Q6-K1-D9
cgtccgccaagatacctttgtcttgcaaggtgccaaatcgggaaaactgaacctgcacttcaagtggacgccacagccaatctatcgagatcgtgaccgggaccagtgagacctgtaaacgagaaggcagataaacacttatccccaacggtgcatgcatattagctgtcctgtacacaaatcgacagttcttggagccacacgaccgaaaacaaatgaaccgatcgacaaacttggagttgaatggagtttgataaattttgatagctgcatgttcaaaaaaatttgtgggaaaagttggtagttcttacgttaagaatgaagaatcatgtacccttgctagggtacttgtatattgatagtcctttttgtttggctgataagccatgacaaaattgatatgttgtgggagaaaaatactgttgaatgactggtagattcggttgataagtttaaacgaacagattgaacaatataaaaattagactagtttgttcaaaaaaaaaaaaaaaaaaaaaaaaaaaaaaagggcgggcggccttttttttttttttttt

SEQ ID NO: 11257 - DNA, 949 bp, Sorghum bicolor
  unsure (1)..(949): unsure at all n locations
  Clone ID: SORBI-28MAY03-CLUS22361_1
gcctactctcgattccccattcctaaccctttcctttcccctcccgggccggctcccgcgcctctcgtcttccacggcctgcccagccagcaatcagtccacggagcatggagatggacccgccgccgccgccgcccctgcacgccgacaaccgccgccgccgccgctgccgcgagtacctgctcgcgctggaggaggaggagcgcaagatccgggtgttccagcgcgagctgccgctctgcctcgacctcgtcacgcagactatcgaggagatgaggagccacatggacagcgtggtggtcggcagcgaggaggagacggtcagcgaccacggcggcgggcccgtgctcgaggagttcatgccgctcaagcccaccctctcgtcctcctcttccgaggacgacgacgacgatgagcacgacagctcccgccaccaccaacaccgcgctgccggcgttggtgatgacgacaagaagaacgacgaggcatcgggagatccggagacggcggcagccttagccagcagcaggcggccgttgttgccacagccggagaccaagaaggcgatgccggactggctacagtccgtgcagctctggagtaaccaacaacagccgccgccgcagcagcagcaccaggacgagctgctgctgccgtgccggccggtggcgctcaacgcctaccggaagcccgggggcgcgttccagccgttcgagaaggacaaggacaaggagaagcagcgcggcgaactgccgctgccggcctcgtcgtcggccgcggcgagctcggccgtggtcggtgacagctgctgcgacagggccggcggcgccaccgacaccgacacggcggagaatataataatagtaaggcgagcatcanaggcggcaaggacaaggaggctcagtcgtcgtcgcaggcgcccggccggaagccgcgcccggtgctgggc

SEQ ID NO: 11258 - DNA, 656 bp, Sorghum bicolor
  Clone ID: SORBI-28MAY03-CLUS22727_1
cctcgccggccacttctgaacagcagaacaaggcagcaatggcgacgaggtgcctcgcagtcgcagggtctcttcccctcctctccgcatccacagccgccgccgcggcggccagggcccagcctctcccctccgccgctgcgccccgccgcgccctaacacgcctttcggttgccacgggcggggatcagcagctcgtcaccgcgcaggatccggcgcacgaacctgactatggagtcattagccttcatcatgttggcattctgtgcgaaaatcttgaaaggtcgatggcattctacaaggacctcctaggtctggaggttaatccagctaggccaaatgacaagcttccatacaggggtgcttggctctgggttggctctgagatgatccatttaatggagctgccaaatcctgatccactgacaggacgccccgagcatggtggacgtgatcgtcatacttgtatagcaattaaagatgttttgaagctaaaagaaatatttgacaaagctggaatcagctacacactcagcaaatccgggaggccagcgatctttgcaagagacccagacgggaatgcgttggagttcacccaagtttagctactggaagactccttttacgctgtagaacttttcgtagcctttttcccc

SEQ ID NO: 11259 - DNA, 731 bp, Sorghum bicolor
  unsure (1)..(731): unsure at all n locations
  Clone ID: SORBI-28MAY03-CLUS2459_1
cacatatatatgcatgatttcatccttcccaaccgtgcagcgcatcaaaaagaagttaattacaacaacatacaatgtggttgtggtctgcatggtgcgaataacttttctttttttggtctacaaacaaaaacagacggcaaaatgctggatatatcgattcaagcaccaagaaggagctctcaaaagtttacgtgtctcagctctgtacctcaggaggattgtaagctaaaattagaagcaaagtcggcgatcaacggcgttcattacgcagaggtggtctgcgacgacgacgacgacacggccggcgacccagagcaggcgtccccactgcgccgcccgccggagcagctgctggactgcctctccggacgcggctgcagcagtccgggcgttgtcaacgtcgtcgccaccggagcgtacaccttgttggcggtcgccgtcggcgttcctgacgcgtcgccggtgctggctaggtgcggcgcctgctgcggctgcgatgccgccgccgccgccgccgcagcagcagctgccgcagccgcggcagcgtactccggcggtggcacccagatgcctcccaccacgacgaactgtggcgccgtcggcggcgcgacgacgctggtgcccccgctctggaccgcgaccgccgtcgtcgagttcggccgcctcgtgtgcaagcgatacttctgaacaccaccagttcaaacatcacgcgtgggtcgaccnggaat

SEQ ID NO: 11260 - DNA, 239 bp, Sorghum bicolor
  Clone ID: LIB3481-009-Q6-K1-E9
cgtccgcggacgcgtgggttttttttacatcacatatatatgcatgatttcatccttcccaaccgtgcagcgcatcaaaaagaagttaattacaacaacatacaatgtggttgtggtctgcagctagtacacaagctagcagtctcctcgatcccagtctcgatcagaattcagacaccaagaacatcgacgacatggctcggcttgctgtggcgatcgccgtggtggcggcggcggcg

SEQ ID NO: 11261 - DNA, 1674 bp, Sorghum bicolor
  Clone ID: SORBI-28MAY03-CLUS2047_1
gttggtttccccgtttgggatccacgcaaaaatcctcgtgatagatgtcatcatatgcccattataacccctgcatacccgtgcatgaactcgagctataatgtttccacaagcacgctgagggttatggtggaacaattccagtttggtaataaaatttgccaggaaattgaaatgaataaggccagctggtctgctctgtttgagccttttcaatttttcgaagcatacaagaattatctacaggttgacatcattgccgaggatgatgaagaccttagactttggaaaggatgggttgaatctcgattgcggcaactaactttgaagattgaacgtgatacatatggaatgctacagtgccatccttacccacatgagtatgcagacccttctaggcagtgtgctcattgtgctttcttcatgggcttatcaaggaaagaaggtgtgaaaatacaggaaggacaacagtttgatattcgtggaactgtggatgagtttaggcatgacatcaatttgtatatgttctggaagcctggaatggagttagctgtttctcatgttcggaggaagcagatcccagcttatgtgtttccagagggttataaaagacctcgcccttcaagacatgtgaaccatcagtctgataaaaatgacagtgaagatggcacagtgacccggtctccggacagtcagctgaagagaaagcatgattctgttggaactgatgatattgaacccaacaggtctgctaagaggtcatcggtcagcccagttcatccgaaaaattcacctcaatctgggagcactggcgatgagactagatgtaacaaccaaataaaaagggctcctagtgatgcaagtggtggcagtccggcttcacctcaagcatcagagagaagcccagataccattgtgtcttcccctatgtgtacgacaacaggagcagtgtgttctggtgatgcaattagtaagcatggtgttcctcttgttgagaactgcaccactccaactgtagcagtgtgcacaactttgaagcgtgtagctgagaaagttgtatcagagctagttggaagtgaaaggttggggagcaacaacagtgctgaattgctggagagtatggaaaaggatgttcttgctgaaaatgtttgttttggcgggaatggagttacacaaggtggccttccagaagagttagtggtatgctgtttggtatttgttggaagtcatttggcaggtttggtggcatcaactgcacaagattgggggaaaaatgttgtagagatggacaagttctacttcttgctggatggaatggtaagtagctcaactcacaagtttccttctggacacagattagcaattgcggggtttctctctgatgggagatggtcgaatatcatgccttgcaacggcatggcaaaaaacaacaaagaagatttcgtggaagggcatggtcgaatatcatgtgtattgctggtgcactctagatcagcatggaccttcagtttttggtttttccttgttgagcagctggctcttgtgtatgaactgagctgcagcgggcttcccagagttgatttgtttgagtctgagatgcccctgccatgctgtaggtctagaatagaactagatgacatgatgtgttccctaaggcccgtttgtacccctcct

SEQ ID NO: 11262 - DNA, 496 bp, Sorghum bicolor
  unsure (1)..(496): unsure at all n locations
  Clone ID: LIB3481-006-Q6-K1-G1
cgtccgctacattgctctgttttctttatactcggctgtttggtatttgtctgctactttttggcaggtttggtggcatcaactgcacaagattgggggaaaaatgttgtagagatggacaagttctacttcttgctggatggaatggtaagtagctcaactcacaagtttccttctggacacagattagcaattgcggggtttctctctgatgggagatggtcgaatatcatgccttgcaacggcatggcaaaaaacaacaaagaagatttcgtggaagggcatggtcgaatatcatgtgtattgctggtgcactctagatcagcatggaccttcagtttttggtttttccttgttgagcagctggctcttgtgtatgaactgagctgcagcgggcttnccagagttgatttgtttgagtctgagatgcccctgccatgctgtaggtctagaatagaactagatgacatgatgtgttccctaaggcccgtttgta

SEQ ID NO: 11263 - DNA, 806 bp, Sorghum bicolor
  Clone ID: SORBI-28MAY03-CLUS20929_1
gccggccgggtccgcagagaggacgaccgcgaaaggaacggacccagggaaagatcgagaggagcgaaaaaaagagagaaactcttcgcttttggacttcgaatccatcgtgatctcatagtcgcgagcacatgaggatccacccagcatctcccaccgtcgtcggcggcggtggcggcaagaaggacctccggcgtctgccgcacgtgtacagcaaggtgctggagctgccgctcccggcggacaccgacgtcgaggtgttcgaaggccccgacgccttccacttcgtcgcggcgccgcccgccggcggtggtgcgcgtggcgccggcgtcgtgcgggtgcgcaccgtcaggatccaccccggggtcaccaaggtcgtcgtgcaggccggcgacgccgccgagggggttgctgacgacgacgacgccggcgacagcatggagctcgacaggtggcggtcccgcctgcccgagccgagctgtccggccatggcggtggctgggtacgtcgacggccagctcgtcgtgacagtgcccaagggccccggtggcggtgaaggcggcgacggcgggcaaggtgaggttacctggaggtgcagtggcggggggaagattagtggaagactggtgcttgtacagtaggagcagtggagaagtagatgtcttgccatctttgtttttttggtaaagatgagctgttcatcatgagctttgttcttcttactgcttctcaagcatatggaaagcagctactgtaaattatctttggttgccttgaaatcaaatgtaaattctggataaaactgt

SEQ ID NO: 11264 - DNA, 677 bp, Sorghum bicolor
  unsure (1)..(677): unsure at all n locations
  Clone ID: SORBI-28MAY03-CLUS20996_1
ccggccgggcctggggtgtcaaccaaccatagcacgaggtcatcccctgcatgcattatcagtctttaggaagagggacgaccatgggtgccaagctcctcctcgttgtctttctcgtcatcaccactgccggccatcccatctgggcgcaggagggaatcacgcaagaaacagctgatcttgtgcagcagacaatcgaggctggattgcagaccttgtctgggacggtaaaagcaggactggcagctacagccacgacggtgagggcgcttctgctcgacggggtgatcgggtagcctatagcggcagcaccggtggcgatgatgggacctactgcgatagccgatgggacaaatccttagttaagtacttgcataatcagttattaataaataactgcttataataagcttgttatggagtactctgaacttatcctcgcattgcatatatacggtggtgacctaaccactcacatgtgtgcactgcatgtatccctatagaatgatgaatatctatatgtaattatgtatggtgtcatatccactaataaaatggtaagcgcgcgctagtctagtggtggttgccttcaacatggtgtgtactacttgccaagaggcagatcgaagtatattgttgagtttgtctacaaaaaaaaaaaaaaaaaaggcccctan

SEQ ID NO: 11265 - DNA, 457 bp, Sorghum bicolor
  Clone ID: SORBI-28MAY03-CLUS2054_2
cgtccgaaagttttgggcagttcagtccgatggattgcaagaaaagttctcactgacagttcaccaaagcttcgatcaactttgcagactcttctttacaaggatggcactttccaaattgatcgcctggaatctttgttaactgagtcacttcgtgccagaacagagcaatcactggtcagaaatcaacaagaagatgttgacagtacgagatatgcaattaagcaagtcttgtcattcacactcgctgaccagggtgcctttgtgaaggatttacttcttcaggagattgctaagggaatagatgcacttggtgtagccacattaagctctgcaacgtctgcagcaccctccagattgccattcgctggtgtcccatccccattgacctcactagacgatgaggatgccaccaacttaagaaatctgtatcgcctgctcctactttaatctaagg

SEQ ID NO: 11266 - DNA, 1041 bp, Sorghum bicolor
  Clone ID: SORBI-28MAY03-CLUS2054_1
ttatgcattttgcctcaaaacatggattcatgtcattgcttgtttcacaatctgacatagtgaaaattgaaatgacaataccatgctatgccctaatgtccccatcaaccattcattgagataaataacaaattagcattgtcttaactgaaagctatttacttattcatttgcacaagtacaaactcaaacggtcctctttcatgttgaacaacactgcagaaagagtttatgcaaaggtatatgtacaattaaacaaacaagggccatatgttgtgagcatccttttgctcacatacaagcaatcagtttctgaccatggtcttctcggtaagaaaactttccatctttagcaatgcctcaatggcgatggcactaggtgtaagtatagtgacatcattatggccttgttttaatgcaatatgttcaagtgaaactctggcatcagcattagcatacgagtccattctttgctcaaaaagtgatgtaagtttcgcataagcctttgcataagggtcaccagattcctgatgcaagagtggtcgagatgcggttcctacagcagcaattcttcttgcaagtgcatccagtggaacgtctaaccacacagtcagccctttcttcatgtaactccaattgattggtcggatcactgcaccacctccggttgcaacaaccaaccgatgcattgatggccggtccctctggaccccacgctcgtgttctcgcaagggtgcttctccatggaaacaaacaagggccatatgttgtgagcatccttttgctcacatacaagcaatcagtttctgaccatggtcttctcggtaagaaaactttccatctttagcaatgcctgaaagagttgaggtgaaaatctcagttagataggtagacatagttgtgaagaccaattctgctaagacagaacaggaagaaaatagaatttcagaatacctcaatggcgatggcactaggtgtaagtatagtgacatcattatggccttgttttaatgcaatatctgcatcataaagaatttggtc

SEQ ID NO: 11267 - DNA, 1082 bp, Sorghum bicolor
  Clone ID: SORBI-28MAY03-CLUS21040_1
gcacgaggccagctgcgacttcctcgccggcccagctccacgaccgatcgagaggcacgcgcaagatgccgaggcccgcgcgcgcgccgctgctccggcgcctgctcctcctggcggccgtcgcggcgtcctgctcctactacctcctcttcctgcaggcgcaggcctccgtcccgccgcggtacgacgggttcgcctacggcggcggcgccgcggcggcctggaaggacgccgtcctcgtcgaggcgtttctcgacccgctctgccccgacagccgcgactcctggcacccgctcaagctcgccatcgagcgatacgcgccgcgggtctcactcatcgtccaccccttcccgctaccataccacacatatgcattccatgcctgccgtgcgctttacatagctaacaagttgaattcatcatcaacatatccattgctggagctgttcttcaagaaccaggaaaagttctacaattctgccacatcatcgctctcaagcccttctgtagctgtagaaatgtcgaagatggctgcgcagactgttggtaattcagtatccgagttcctgtcaggcttcagtgacacgaagacagattcggcagcgagagtttctttcaagtatgggtgcacgaggggagtttatggcgcgccattcttctttgtgaatggtttccttcagcctgggggtggatcgcctatcgactacagcacatggatcggcatcctggacccccttgtttcccagaatggagaacgaattgagatgtttacttcgatgtaacgtaactaagtgcttgaagtggccttattatgaaggatacagtcgtacagatgttttggccagtgctgaacggctgataagcaaacagctcttatgccagttgtaagctctgcagtatacgctgatgaatatcataccactttgcctgttgtattgttaagctagcatttgtgtgagactggctaaactaatggataaagcccttgcatatagggttataggagcctgcaatatgttaaacttcgtataatcccgtattccaaccattcgctataaaaaaaaaaaaaaaaaaggccccta

SEQ ID NO: 11268 - DNA, 889 bp, Sorghum bicolor
  Clone ID: SORBI-28MAY03-CLUS23887_1
gcacgagggcatcctcgtcctggtgatcacacgcagatcaaatcctatccaaatttgttgttggaccatggctgaagagaagagcgttccacggctgaacgagcggatcatgtccaccctctcaaagcgatcggttgctgcgcattcctggcatgaccttgagataggacctggagcccctgctgttttcaattgtgttgttgagatcacaaagggcagtaaagtgaaatatgaactagacaagaagactggaatgatcaaggttgacagggtgctatactcatcagtagtctatccacacaactatggtttcattccacgaacattgtgtgaagatggagatccaatggatgtgctggtgttgatgcaggaaccggtgatacctggttgttttcttcgggcgagagccatcggccttatgcccatgattgatcagggagagaaagatgataagataattgcagtttgtgttgatgatcctgaataccgtcacttaaccgatctcaaggagctttctccacatcgcctcaatgaaattcgtcgcttctttgaagactataagaagaacgagaacaaggaagttgctgtgaacgatttcttaccaccaactacttccctggaggccattcaacactcaatggacttgtacgctgaatacatcctacacagtttgaggcgctagatctggtttcgagatggaacagtccctctcctggtctcggggaaaaataagcaataaccgaccagcctcctagcttttgtttcaggagccgttttgcggtatatataactaaatcaagggataatgtgattcttctgcaagttgttgcatgtaatatgctaaccatgagatatatattgtctattccgtacgttttcaaatcaacga

SEQ ID NO: 11269 - DNA, 1014 bp, Sorghum bicolor
  Clone ID: SORBI-28MAY03-CLUS24319_1
gcacgaggctatgatgattggagtcttgacagcgatgttgccaagaaaatagtcgagattgagaggattcctaggtttctgcataaaatgatccttgagggtggtagcattcatgtagatggagaaggtacatgcataacaacagaagagtgcttgttgaatcctaacagaaaccccaacatgaccaaactggagatagagaatgagctaaaggattttcttggagtctcaaaggtcatctggatacctcgtggactttacggtgatgaggatacgaatggccacgttgacaatatgtgctgtttcattaaacccggtgtgatcctactgtcgtggaccgatgatgagaaggaccctcagtatgaacggtcagtcgaggcactgtctgttctctctcagtccattgacgcgaaaggacggcagctcgaagtggtgaagatccacgtccctgggcctctgtacatgacaaaagaagaggcagagggtgttgtttcaacggggcatgctgtgccgagggaaccaggcacgagattggccgcctcgtatgtgaacttctacatcgccaatggcgggattgtagcaccttctttcggcgacaacaagtgggacaaggaggcatatgcggttctccagaaggcgtttcctgatcacgaggtggtgatggttgaaggcgctcgagagatcgtgctgggaggtggaaacattcactgcatcacgcagcagcagcccgtgcgcccgtcgtcctaggtgcaaccgacgtcgacgcgaaggcgatgaagagcatgctggtagcgtcattttgtatactactagtatttagtaggtgaattgatctcgctctagagatacaaaaataattcccgtttcctccaggcccatgtgacgcagaagcgtcctggctgcgctaggagagaaaacggcgatgtaggacgagcgcgtgagtggggtaatcaaacaatttcttcgtgtagcttggctgaaaaaaaaaataagcaaattacccactccattctg

SEQ ID NO: 11270 - DNA, 1165 bp, Sorghum bicolor
  Clone ID: SORBI-28MAY03-CLUS2444_1
cgcgggtcacgcagctggcgcgcatgggcgtgggcctcgtcgtgctcacgctcgccatgctcgccgcgggggcgctcggagtggcgcggcgcggcgtcatcgcgcgccacggcatgtacgacaccaacaccggcggaggaggggacgacgggcggtacctgccgctgtccatcttctggcaggtgccgcagtacgtggtggtgggcgcgtcggaggtgttcacgttcatcgggcagatggagttcttctacgaccaggcgcccgacgcgatgcggagcctctgctcgggcctctccatgacgtccttcgcgctcggcaactacgtcagctccgcgctcgtcaccgtcgtggcgcgcgccaccgcgcggggcggacgggacgggtggatccccgacgacatcaaccgggcgcacctcgactacttcttctggctgctcgccatgctctgcgtcggcaacttcggcgtctacctgctcatcgcgcgctggtacacgtacaagaagagtgttgggtgatgcgaatcgacgggcccgggggaaacagaaaagcgctgttgaacaataactgggcttggcccggtccaataaagcttactagtttagtagggtttggcccggtccatggatagacgaactatcacagtgatgatgatgatgatgatgctgcgatacgagtgaggctgaggcgtgcagctgcagcctgctgcatgtgcctgcagctgtttcaaacatctctgacaaggcaaagggatcaagattcataagggatcatcatccaggtttcgcaacgctgagattccactcaacatcgagttcgaattaatgcaagattcataacggatcatccgtggtttgtttctacttctacatatatataaacccttctcgtgctttgcgttaagttgtgcagtgtcgtcagacgacgtgcaaagacctcatcaagcaccttcgacctcatcggtggtaacgacaggttaggggttgctgatcgatggatgacggaatacggaccaatggctccgtggtttcgccacgggcgacaccgtagctttgcgtcactagtgacgacctgttacctggtcctacctctcacttgtagtatatagcatatcagtcgccgtcgacacaatgcaaatgcatgcgatgggccatgcacggaatttcag

SEQ ID NO: 11271 - DNA, 718 bp, Sorghum bicolor
  Clone ID: SORBI-28MAY03-CLUS24567_1
gaccgacgggcctggctgatcggtggcgaggtgccccttgcaggtctcggtgcagctgctgcctctggcaaccctgcagcagctggtggatgctgccaaggtaatggtggcttcacctgctgccaaactgacttgccaaaggaaaaacaggacaagagcatcgcagctgagcagaaccccaagagctccgaggagaatgacaaggagggtggtgctggcagcaagaaggggaatacaaagacttgcccgatgcccacctggtttgagacctgggagagagctgacacctatgctgctcttgctgttgtcgcagctgctgcagcggtgtttgtctctttcagaatctacaagaacctcaactgaagaacttgagagatctttgaagaggtgccgaaaacaagtctaggtgaaacagcatactgtggtaaaacagtctgggatgagaataatatttacctgtgcatagtaatgcgagacttagaaccttaaagtagcgtttctggagatggtgatgaaaaggtccactgctatcgtgtgtgaacgtccactgctatcgaagttttcgttgccttagctgttgttaatcataagcaaggcgatggtctgggcatcaacattcactgtgatgatgttttcttttgtttggcttttggatgttctggagcatctagatattaaaacaatgccaggttgaatggaaaatatgttcatctgatgc

SEQ ID NO: 11272 - DNA, 1500 bp, Sorghum bicolor
  Clone ID: SORBI-28MAY03-CLUS24734_1
gaaaaccccctcgttttatttcctctgctccctctccgcctctctccaccatcctgcccggcaccactcgcatcgtgttctgagatccccatcctgcatttcccaaggccaggctagttggtattgaagacgatggctgcttctgcagctgctggtgtgcagatggtggctgcacgcccttgcatctcagcctcgcaaggaattcatgctgcaagggtagcggtttctaggactgactgcatgctcagtaccactgctacattccccaaaatcagttgctcctggcctctagattctaagcgcaatggtgttcttgtagcacgaggatcaggagagagtggccggcaggggcttcccattgatctcagaggtaaaagggcatttattgctggagttgctgatgataatggctatggatgggcaattgcaaaggcacttgctgcggctggtgctgaaattcttgttggtacatgggtgccggcacttaacatatttgagacaagtctgaggcgtggaaagtttgatgaatcacggaagctgccagatggatcccttatggatattgttaaagtctatccactcgatgctgtctacgattcccctgatgatgttcctgaagatgtcaaatcgaacaaaagatatgcagggtcatcaaactggacagtaaaggaagttgttgaatcagtgaagaatgattttggcagcattgacatactagtgcattctcttgctaatggcccagaagtaacgaagcctttgttggaaacatcaagaagaggctatcttgcggcaatttcagcatccagttactcctatgtttcattgcttcagcacttccttcctataatgaatcccggtggtgctagcatctctctaacatacattgcatctgaaagggcgattcctgggtatggtggtggcatgagttctgctaaagcagctcttgagagtgatacacgggtgcttgcttttgaagctggccgaaaaggcaaaatcagagttaacaccatatcagcaggccctcttgggagccgagctgctaaggcaattggatttattgagaagatgatagagtactcatatgttaattcaccattgcagaaggaactgttggctgatgaggtggggaacacggctgcgttcctggtttcttcattggcttctgccatcactggctcaacggtttatgttgacaatggactcaatacaatggggattgcaattgacagccctaccataacgtcatagatgtggctgtggtagatagacgatcattcctgctgcattgtggtgtgattcttgaataaagatcttaattagttattactatgagaggtaagggcaggaaagggacaaaaatatgaaggaactggtcttttgccccttctgtcttggagaccaacattagagtaatttccagaaatgatggggtacctggtacatgctggttttaaacgatccagaagccagtacaatatttcccctatagtatgtttttgg

SEQ ID NO: 11273 - DNA, 1158 bp, Sorghum bicolor
  Clone ID: SORBI-28MAY03-CLUS2125_1
gcacgaggcttttcttctcccgtcccccctgcgtctctctgctcgcgctctcgtcgagctactacgtgacagccgctgccgccggccgccgctgcctccctaagccacttgctcggtctagcctcgccggctccttcgcaaggttggcccgtcgccggcggccaacacccaccaggttcagagatggcagagacggtgttcaccccctctctggaagggatgaagcatgtcaaggcacagaacggagtcattctcaccaagcccttccttgatgtctgcaagcaaatcctgcctgtcctccataaatttggagctgctatggcacttgtaaaaactgatatcggtggcaatatcacaagactggaaacaaagtattcttcagatccatcaaagtatgaacacttgtacagcatggttcaggaagaagttcaaaacaagacagcaaaaggttcctcaagctgcacaaatgggcttctgtggctcacgagggccatggatttccttgttgagttgtttcgtaaccttcttgagcatgcagactggaccatgactcaagcttgcactgattcatacaccaagactctgaagaaatttcatggctggcttgccagttctagttttacggtggccatgaagcttgctcctaatagagataaatttatggaggtcattagtggaactggtgacatcaatgcagatattgagaaattttgcacaaccttctcacctttcctcaaagaaaatcacaactttctggcgagcgtcggtcttgatgacatgaaggcttcatagagtaatctccatgctaattacaataaaataaacatgtcttatgaaactcaagtgttcccgaggatatacctgttttctgtagccatcttccccttggaaaactatacaggatggtaataatttgtcagcgtgatcgaccatggctacttacactgttacacagagaattgacagtactcaacaaatttagtttccaaactctccaaaaaaaaaaaaaaaaaagtcccctgttacagaaaatttacatatgattatgtggaactcttgtgttgtatagttctctatcctcaaatcttgcaacaggtaaattcctgcgaaaatcagaaacgttaccacctagcaaataatgtgtctgccacgccagag

SEQ ID NO: 11274 - DNA, 670 bp, Sorghum bicolor
  Clone ID: SORBI-28MAY03-CLUS21798_1
gagtacgtgccgacctacgagggcaaggacggcgactggatgctcgtcggcgacgtgccgtgggagatgttcgtcgagtcatgcaagcgccttcggatcatgaaaggatcagaagccattggcctcgcaccaagggccatggagaaatgcaagaacagaagctgaggagaagattgaaagcttgcattgcatctgaacaccatggatgggtgcaagaagaaccaatctccatagcttttgcagctctgctcgcctctgtatcatatcgtccctgctctccaactccaagcctctatatctcctgatcaatgaagtcattttggtgtgtcaactgttctatcatatctgtgccagtttgtcagtaaacgagtcgatcactcagtgttcaagtctcatcttgtcctatactacagaagagaagccatgaacatgtacctgtcctataacaatgtctttttgcactacctgttctctcctcctcttctttttttttggtggcacaaaatgcaaaggcaccctgctcctaatcaaggggcccttttgcatcttatccatcaaaagttgtttaattataattaccacggtgtgtcagtggaacaaataactgttgcaagctgttaaaaaaaagttgtgttgtaatatgatcatcgctctccctctcttcctgttt

SEQ ID NO: 11275 - DNA, 690 bp, Sorghum bicolor
  Clone ID: SORBI-28MAY03-CLUS2197_1
tgaactgcaagaaatatatggcatagggaactccatggaaggtgatgctgatgcaaatgatccagggaaagaatgtgttatttgcctctcagagccaagggatactactgtcctcccatgtaggcatatgtgcatgtgcagtgagtgtgccaaggtcctgaggtaccaaaccactcggtcgtccgtctgcaggcagcctgttgagcgtctcctcgagatcaaagtgaacaacaaatctgaagagcagcagcagacgccccaatcgccaccgctcccagccccggctccgcagcaggaagaggtgtagctgtgatcaaagtcagttctgagacattatatggctctagtttgcggcccttcaggcctttccctaaaggtttgttctctcatctgagcaacggggaatgtaaccggtactttacctttagcctatgtaagcttctggcatcgcatggctttgccgacctctgctgtacctgactatctggaggtcgggagaccaagatgccaaggagagtgtgtaccatatatatgcaccatgcatgcgtgtgccgtggctacctgaagaagtgtagcgaggaggtttcctcatgcctccaggggaaaaagggcaagagaaggtggtctcttgaatttgtacaaaaatgactgtatttcaccttgattccataccttctctgtgatgccctg

SEQ ID NO: 11276 - DNA, 1061 bp, Sorghum bicolor
  Clone ID: SORBI-28MAY03-CLUS22123_1
gcacgaggggcaccgggagtttctttgtcaccgtcctcggaggggaaggagcaatggcagcagcagcagcctccgtgtggctgcagctgcaggtccctccccatcgtctccacagtcccccggtgctctccctaccaagcaaccattcttcctcacatgcatgccctccagtatacaaatacaagaaacatgcggcgccagggagaggaaaccttcttctctgcagggcctctggcgcctcctcctcctctgtggtgaccaaggagcaggagggagcggccagcgatccttcgtcagaggagggatattctgagcctcaaatctatagttacaaggatgaccccaacttcaggggctgcaagggctgcggcagagacgagcttgagaggggttgcaatggcgaagggcggatccagggcggcatagctgccgtcccgggcttcggctggtggcccatcaaggcgtaccggccgtgccctggcttcgtcgcgtccggcggccgctatcggcgccagggccaaagcatggacgacgttgcatccggcaggggaaagaagaaaccctctcccgccaaaaagaagagcgacaacaagtaatcccagcccaaggaactgcagtgttgacaatgctaggaagtgtgttgtgttattcaggccagggtgaccaatgagattcggctgtcactgtctgcatcagcagtagataatgtttcttaccagaaattcagaatctatccaagatgaaatctgggaatgtttgccattaccatggtggaattggggaagctcaagttattcagaaacaacagttttggtccacaatggcaatatatatgcactagttgggactggttgtagaaacatcaagaatgtagggtgcagtgttgttctcctaggctccatgtactgtttcgatttcaattgtaatagtagtagcttggaacatctgactggaccgcctgtattattgtcttcaagtagaactaggtgagatctgtgccaggcaaggcaacccatgtattctcgtccataacaagatataaacgtgcataatgagcatcc

SEQ ID NO: 11277 - DNA, 1021 bp, Sorghum bicolor
  Clone ID: SORBI-28MAY03-CLUS2218_1
gcacgaggcctccccacccgtccccctccccgtccgtctctcgcctgccttcgcacgggtgcgccgcccggtcgacggccacgtcacgccgcgccgcgctgcccagctgatccggcacccgctcttcctcgccgagctccggatcgacgcctcccgcgcccgttccgggctccccatccgccgcctccccattctgcagcaggagaccagcacccgcgccttccccctcgccgtcgcgcgccccacgctcaattttactatgtctgggatggcatctgatgatgcacctgctcaagtgagtgttgaaggagatgtttcagataaaaaagtagaagttcaagaccagaatgaagtgagtgggatgccctcacgacaagaggaggaggcggtaattaagaaaaagtatggaggaatattacccagaaagactccacttatatctaaggaccatgaacgagcttactttgattctgctgattgggctctaggaaagcaaggtggtgtccccaacaagcctaaaggtcctcttgaagcacttcgaccaaagcttcagcctactcaacagaatgcccgtgcccgtcgaacttcatatgcatctgcggacagtgatgagactttgaacttgtctcctgaggatctgatcccgcaaggagagcccagccagcaaggagaacctgtcgaggacaagaacaaggaataagcatgctcagcatagctgttgtgtactccttttatacagaagatgccatttgccgccctcacactaaaaaacttttttgccttgataataagtagtgtggactcagtccaacaatcccgttgagggtgaggttgagatgtgcagattgaactggatgtgagatgtggtatatgcagtatccgctacactgggctgttggcgtccttgcgacgcctgaaacaatgttgctggcgatttttacattgctgtacctgaacgacctgtatgcaaacacatgcaaattcgatgatcagagactcgaaactcccgtcgaggtcgagc

SEQ ID NO: 11278 - DNA, 988 bp, Sorghum bicolor
  Clone ID: SORBI-28MAY03-CLUS22103_1
tggtcgggactcggtttttaaccgcaaggcagtagtgagccatccactaatccagccacacagttacagtaattcagagcgacgtcaagcaccacgaccaccaccagtccaccaccaccacctcgtgctcgagctccaagaagccatggcgaagcgccgccgctcgtcgtcgtcccttcccctggccctgctgccgccgctgctgctgctgcttctacttgcagccggatcgctcgcagtggcagccgcgcttgacatctccccggaggcacgtcgtggtcgaagcctgcagcagctgccaaccccgctgccgcagcctgtgccacagccgcagccaaccccagtgccacagcccctgccgcaaccaaatccaaacccacagccgcagccccttccacagcccgatccaaacccacagcctctgcctcagcccctaccgcagcccgatccaaacccacagcctcagcccctcccacaaccacagccaggcccaatcccgccgcagcctctgccgcagcccgacccaaacccacagcccgtaccacagcccctcccacaaccacagccaggcccaatcccgccgcagcctttgccgcagcctgacccaaaccagcctctgccacagccgcagccggcaccggggacccaacctgtttcgacccaaaatccacaaccgcaggctgaccagctctctggaggtccgcagccactctcggacggcggattaagaatgttgaacctgcagtacgtgaagtacatatttttagatcttatcgttctgatactgtaactctacactgtactttttttcttttatttttttcttacgcatggagtggtaatagtaaagtcattttttcttatgttttgcgagagtgtatgccatgcaacgtgcctgtataggttattagtactatcattttcatattttgatgtaccttgattgtatatgattatataactatgtagtgagtttgtccgcttgagc

SEQ ID NO: 11279 - DNA, 506 bp, Sorghum bicolor
  Clone ID: LIB5121-011-A1-PF1-D8
atatcacgcatagggctccagacaccaccgcctcggccggctagctaccattagcagtaggagcatagcatggcaatactgccgcggcctacggcggtgcttgttgcggcgctggccgtggcgctggcgttcgggatggcgtcggcgcagggtccggccgcctcccttcccctgaccctgctgacgccgctgctgctgctgcttctacttgcatacggatcgctcagcagtgacagccgcgcttgacatctccccgaaggcacatcttgctcgaatcctgtcaacagctgccaaccccgctgccgcagcctgtgccacagccgcatccaaccccactgccacagcccctgccgcaaccaaatccaaacccacagccgcagccccttccacagtccgatccaaacccacagccctctgcctcagcccctaccgcaaccttatccaaacccacagtctcagtccctcccacaaccacagccaggcccaatcccctcatagcctctgcc

SEQ ID NO: 11280 - DNA, 726 bp, Sorghum bicolor
  Clone ID: SORBI-28MAY03-CLUS25307_1
gcacgagggagagagaggcgctatctttggcaagggcttgggcagaggaggaagccaaaaaggcccgggagcatgcacgagcccttgaggatgcccggaaccaatgggagcgtcaaggaatcaaagttgttgttgaaggaggactccaggatgacgcttcagcaggagtcacatgggctaacgctggcaaagaacatccagttgatgaggttatcaaccgggcagaatctttgctggagaagctaaagtcaatgtcagctgagatgaaagtgcggtctcgtggtgcgctggagagggtgatgcaacacgtgaggtccttcattgcaagcctaaagcagcaagctgcagatgcaaggcagtggtgttccgagtttggggcttctgctgcttccaaggcactcatggtatcagcagaagtgcagggcagtgtatctgcgtttggtgcaacccttggagataagtcgaagagggtaatggaagagtgcaaggacggcctggaaaagttttcacacagattcaagacatcagactagagggaggctgtgtcgcctctgtaccaagaacaatagtaaattcccttggaataaatttttggggtggtgggtgttacagagtttactgaagtcatgctggaacgaacagtagttcccgtggaataagtccgtgctgtgtacagacaggattgatgaatcctcatacaggcaggatgagctgccgcttcttgtt

SEQ ID NO: 11281 - DNA, 756 bp, Sorghum bicolor
  Clone ID: SORBI-28MAY03-CLUS25360_1
acgtgtgcatcggctggccgggatccatgcccgacgaccaggtgctggagaagtcgatgctccaccagcgggcggcggccgggatgatgcacgagtcgtggctggtgggtggcgccagctacccgctcatggactgggtgctggtgccgtacacgcaccccaacctgacgtggacgcagcacgcgttcaacgagaaggtcggggagctccggcgagtggcggtggaggcgttcgcgcggctcaaggcacggtgggcgtgcctgcagaagcgcaccgaggtgaagctgcaggacctccccgtggtgctgggagcctgctgcgtgctccacaacatctgcgagctgcggggcgaggaggtggacccggccatccgatgcgagctggtcgacgacgagaccacgccggagaaccccgtgcggtcggagacggccaagcacgccagagacaacatcgcgcacaacctgctccatcggggcttcggcggaaccacattcttctgaagttgtgtgatccatcggcttctttctttgctttgctattctagagtacagtagtacaaatttgggccggaaatagggattcttttagccggtagcttaattacaatagaagaagattttggtaggattatttatactgctgctgctgctgttagcagctggtgaaggaatcacttgattgatctagatggcaaatgacccacacaggaccatgtaattaatttaagtgacgcgataggttttcttatgttgcaga

SEQ ID NO: 11282 - DNA, 1375 bp, Sorghum bicolor
  Clone ID: SORBI-28MAY03-CLUS2540_1
gtgcgccgctcgagccggccgggctgcggtctgcttccccttccgtccgctgtcctcctccttcttcccccttctgcctctctcgctcggcgctcgctcccctctcgctcccagacgactgttgggccgccgccgccgcctaggccaggtgctgaggctttcttggtctcttcgccggcgacgagcacctaccaggacactgaagtggtgaacacagaaggttgtcatatttgttaagttaaagttagatcggtggaacaatgccacctcataagattgaaactgggcatcaagatgtggtgcatgatatcgccatggattactatgggaagcgcctagctacagcctcctctgataacacaataaagatcattggcgtaagtggaaactcacaccagcagcttgcaactttgagtggacaccagggcccagtatggcaagtcgcatgggctcatcccaagtttggttccatgctcgcatcctgcagctacgacggccgggtgatcatctggaaggaaggaagcaagcctgatgaatgggcactggtacacacctttgctgagcacaagtcctccgtgaattccatcgcatgggcgcctcatgagctgggtctatgcttggcttgtggttcatcagatgggaacatttcagtcttcactgctcgttctgatggaggctgggacaccacacgtattgatcaggcgcatccagtcggtgtgacctcagtttcttgggccccagcaatggcaccgggagctctaatcagtgcaggatcttctggtcagtttgagtatgttcagaaactcgcttctggtggctgcgacaacacggtgaaggtgtggaagctcaacaatgggagttggcggatggactgtttccctgccttacagatgcacaaggactgggtgagagatgttgcgtgggcgccaaacctgggccttccaaagtccaccattgccagcgcctctcaggatggaacagttgttatctggacagcagcaaaagaaggcgagcagtgggaaggccaggtgctgtatgatttcaggacccctgtgtggaggctgtcatggtcacttactgggaacatattggcggtgtctgatggcaacaacaatgtgaccctgtggaaggaagctgtcgatggcgaatggcagcaagtgacgactgttgagccataataggtccatagaggtctctagagttgttcctcaccaatattccataaataattatatttttcgtgtaaggtaaagatatgtccctccctgtggagctgtttgtggttcatacctgttgggaaggcatgactgcgttagacaggtttcaggctctggccgaagtgaaaaattgactatgtggatcatctgtttctcga

SEQ ID NO: 11283 - DNA, 1172 bp, Sorghum bicolor
  Clone ID: SORBI-28MAY03-CLUS25514_1
gcacgaggctcctccttcaaatcctctcctcgcaccacccaatgacaaggagcacgagggagaagccgaccaccgccgccgcctccgcctccgactccgccatggacaagatcgccgccacggccttcgcccttctcctctgcctctgcttctcctccacgcccgccgccatggccctcaccccggacggcgaggcgttgctggagctcaagctggccttcaacgccaccgtgcagcgtctcaccagctggcggcccagtgaccctaacccctgcggttgggagggcatctcctgctccgttcccgacctcagggtccaatccataaacctcccctacatgcagctcgggggcatcatttcgcccagcatcgggaggctcgacaagctgcagagactagctctgcaccagaacagcttgcacggcccaatccctgcagagatcaagaactgcaccgagctcagggcaatttacctgagagccaactacctgcaaggaggcatcccttcagagattggcgagctcttgcacctcacaatcttggacctatcaagcaatctgttgaggggcacaataccggcctcgattggaagtcttactcaccttcgctttctgaacctgtctacaaatttcttctccggagagatcccaaatgttggtgtcctcggaaccttcaaaagcagctcgttcgttggaaatctggagctttgtggcttgtccatccagaaggcttgccgtggaacactcggctttcctgctgtgctgccacactccgatccgctctcttcagctggcgtttctccaatcaataacaacaagacatcacactttctgaatggcatcgtgatcggctcaatgtcaaccttggctcttgccttgatagctgtactcggattcctatgggtttgcttgctgtccaggaaaaagagcattggtggaaactatgtaaagatggacaagcaaaccgttcctgatggtgcaaagcttgtgacataccagtggaaccttccatattcgtcaagtgagattattagaaggttggagctgcttgatgaagaagatgtggttggctgtgggggatttggcacagtgtacaaaatggtgatggatgatggcacgtcatttgccgtcaagaggatcgacctcagccgcgaaagtcgtgacaggaccttc

SEQ ID NO: 11284 - DNA, 833 bp, Sorghum bicolor
  Clone ID: SORBI-28MAY03-CLUS25626_1
gagaaagacggtacaattgggcactcactggggccccaggagactgacgcttcttcgtggcacacagtagagttgcaaatgctgccaccgcaacagcccaagctgacaaaaagaaatctgcaaaggcaggaaataaacatacagtagatgctactgctgatgacacagaagggacctcaaaggttgatgaggaacctgcccctgagagcaagaaggcctctgaatcagcagactatggagcatcccagttgcacgagttttcccaggtcgaagttggtgatgcccatgcccctgtagagggtgctggtgaggaagatggtgacatcgacatcgtgggtggccaaggtgccctgcctgatgtgctaatgacaccttctggaagtgaacttggagcagaacaggaagatgaggacgatgatgattcagagaggcgaaaccaatcaatcggcaagaaactatggtcattcttcactacatgacggctgaagatgccgctgaataggttgtttctagcttttgtgctttcgattcatgataccccattcttggaactggagggcgtgtgcttttggtgattaagtactagatttcccacttaattgttcttctctcccgtgtaattgaaatatacttgtagtagacatagcttgatggcactcacagaagtagctgatgagatgtacaatggcgatgatgatatgccctgtaacaccagtagtagcttggtttgtaattgttgttccttttgccccggttcaggttacttcgttgacctcaccgctgttgtgaattctgtcgtacggggaaatattttagtgctctgatgatggtct

SEQ ID NO: 11285 - DNA, 947 bp, Sorghum bicolor
  Clone ID: SORBI-28MAY03-CLUS2282_1
gcacgaggcttcctctcctcccccaccgagtcgccgccccctcgctttcacccaacgcggaagcaagaattcgtcgtcaaattcccaccttgcgcgtgtttctgtggatttctttttttggccgcttccttgctcctatgggcctttgatccggagcttcgtggatcttgggaagaggaggtgtggtgggcagccggcggcgatctggcggggaggatatggccggcgggaaggagccgatcgaggtcaggttccggctcttcgacggcacggacatcgggcctaccaagtacgatccctccaccacagtctcctcgctcaaggagttcatcctcgctcggtggccacaagataaggatgtagctccaaaaactgttaacgacttgaagcttatcaatgctggaaggatattggagaataaccggacacttgcagagtcccgtgttccagtaggagaggtcccaggaggtgtaattacaatgcatgtggtagtgcgacctccacaagctgacaaaaatagtgagaagcagcttgccaactctcccaagcagaacagatgtggatgcaccattctctgataagacgcctgcttgatgctgtacaatctgtgtagtcataggattttgtatctgctttgctgtgttcacacaagcgtgaattcattttgatatccaattcttgaagccatttgaatcccagaaacatacatactgaaagtccatcaaatacgaagatttctggaggctgaatttggatcgccttgttctagagtggaggattggatgcttcctgctgtataaattgtgttgtcaaaactgaaaaagctcctcttttttcttttctgctttgttgactttatatcgattctttttagctcggttgctttgtctcgtgtaacagaaatattgtactcagatatatgtaacttgcaaaaggagtaatgtatg

SEQ ID NO: 11286 - DNA, 943 bp, Sorghum bicolor
  Clone ID: SORBI-28MAY03-CLUS2335_1
ggtctagtgatgtgtatacaatggacttgagtgaagaagagccttgctggcgatgcctcactggtagtggaatgcctggggctggaaatcctgctggtgcaggtccacctcctcgtctcgatcatgttgctgtgagtctgccaggtggaagaattttgatatttggtggctcagtggcaggtcttcactcagcatcacagctttatctgttggatccaactgaagataagccaacctggagaatactgaatgtccctgggcgccctcctcgattcgcctggggccacagcacctgtgttgttggagggacaaaagcaatcgtgcttggtgggcaaactggagaagagtggatgcttacagaaatacatgagctttctttggcaagcaactcagtttgagttcaaattaatgcgcttctctcatgcaacctgaagcttgattgtcttcaccagcagaactagaagaatggacgatgagcatactgaatcttctggcagctacttggatttacttgggagatgaaatggtttccactggtttgctgctttatgtagacacaaagggtagtgatatgttcatttttattgccgtttgtttggccttttttaccagataattacaattcataagctactattgtggaatgagtaccaaattttatatgtattctcagatgtttcttacttgcaatatgttaggaaaacaaaagactacctgtatatagtttaatcttttgatgtacggtacatggaaaaattgaggctgctgtcttgtggctcagacgcacagcttggtggcatgatgtatggtgatcacccatcaaccgtgttttttgtagaacttgtaaatgtagaagtttcagtctggtgggcttagctcagtatcggtttacttgtcttctactgtatttcacatcttttgtattatcatggacatgatgagc

SEQ ID NO: 11287 - DNA, 1002 bp, Sorghum bicolor
  Clone ID: SORBI-28MAY03-CLUS23484_1
tactggacgtttccggcccccaattcgaaagcttccctccctgtttctcccttccttgtctaggcggcaacgccccccgtgctttataaccgagcggcccctcccgcgtgaggcaaccgggacgagaccagcagacgggtcagcccatccgaactccgcttcttcctcctccggctttcgcgtgaggttgtgtgctgctgaggaggaggaggaggaggaggaggaggcagcgccatggaggcggagaagaagacgccggcggtgtccgatgtgggcgcgtgggcgatgaacgtcgtcagctccgtcagtctcatcatggccaacaagcagctcatgtcctcctccggctacgccttcgccttcgccaccacgctgaccgggttccacttcacggtcacggcgctcgtcgggtggatctccaacgccaccggctactccgtctccaagcacgtcccgctctgggagctcgtctggttctcgctcgtcgccaacacctccatcaccgggatgaacctcagcctcatgctcaactccgtcggcttctaccagatctccaaattgagcatgattccggtcgtctgcctgatggaatgggtgctgaacagcaagcactacaccactaaggtcatatcggcagtgattgtcgtggccgccggtgtcgggatttgcacggtcacggatgtcgaggtcaatgccaagggattcatctgcgcttgcgtggcagtgttctgcacgtcgcttcaacagattacaattggctcctttcagaagaagtacaacattggatcatttgagctgctgagcaaaactgcaccaattcaggcactttcgcttgttatactgggcccctttgtggactactatctaaatggacggtcattgttgaactaccctttttcaggaggggcaactttcttcatacttctttcctgctccctggctgtcttttgcaacatgagccaatacctctgcatcggtcgggtctcagcggactcattccag

SEQ ID NO: 11288 - DNA, 757 bp, Sorghum bicolor
  Clone ID: SORBI-28MAY03-CLUS2297_1
agttccccacgcgtccgggcgggagggagtagcgcgcgcgtcaagcatggctccggcagcggtggccgctcccgtggcttcagtctcccctggcggcggcgccgtccgctccgccaggaggatagcctccctgcatccttgccattcttccaccaaaatcgtgctgctgccacccccgaacggcctgctcagatcggtcaggcagaggaggcgcttcgcggcacggagcagcatctcggaaagcagcaccgatgactcccaatccccgaaacaagagaaggcgccgttcgggtacacgaggaaagacgtgctgctgatcggccttggcgtcaccgccttcggcgtcggcctcaagtacgggctcgagctcctgggagtggacccattgcaggccgggaacgtggtgcagctgctggtggtgctcgggatgacggtggggtggatctccacctacatgttccgggtggccaacaaggacatgacctacgcgcaccagctcagggactacgagaagcaagtcatggagaaacggctggagagcttgacggaggctgagctgcaagctctgctcgagcaggtggaggaggagaagcagcgcatgccgtccgtcccggaagagcctaacgctattaccttcaagaagaaatgagggacaccgtcttccttcgacatgtttatagcgtagctttattagctagctccatcgatctcttttaagatctgtacaatacgctagggcactagtgctgtcaaacat

SEQ ID NO: 11289 - DNA, 807 bp, Sorghum bicolor
  unsure (1)..(807): unsure at all n locations
  Clone ID: SORBI-28MAY03-CLUS23811_1
ctactggaagctactacctccaagcgcgcgccgctgtgcagtgttcagtgacatcgatcaggatcaccagacacagacactgacactgacagcgcgcgccgcccgctatggcgtccccgacctgccgcctcgtgtccctcgtgctctgcctgggggcgctcgccgtgctcctggcggcgcggggcgccgacgcggcccgcgccttcttcgtcttcggcgactccctcgtcgacaacggcaacaacaactacctcatcacggcggcgcgcgccgactcgccgccctacggcatcgacacgccggaccaccgcgccacggggcggttcagcaacggcaagaacgtgccggacattatcagtgagcacctcggcgcggagcccgtgctgccgtacctgagccccgagctcgacggcgagaagatgctcgtcggcgccaacttcgcgtccgccggcgtgggcatcctcaacgacaccggaatccaattcgccaacatcatccacatcgccaagcagctgcgctacttcgagcagtaccagaagcgtctgacggcgctgatcggcgcggacgcggcgacccggctggtgcgcggcgcgctggtgctcatcacgctgggcggcaacgacttcgtgaacaactactacctggtgccctactcggcgcggtcgcgtgagttctcgctgccggactacgtctcctacatcctgtcagagtacgcccaggtcctggagcacatgtacgatctcggcgcccggcnggtgctggtgcaggccgtcggccccattgggtgcgtcccggccgagttggcgc

SEQ ID NO: 11290 - DNA, 884 bp, Sorghum bicolor
  unsure (1)..(884): unsure at all n locations
  Clone ID: SORBI-28MAY03-CLUS258_1
gcgtccggncggcttgtgtggcaccatattaatatgtgcatcaagttatatatatgctaacttcagtttagcttgatccttgtaatctgtatagttccgtaatatgaatatgcaagtaatagatctatatcaactactcccagtttcaaattccatgttcaggtatatatatatatatatatactgtgtctctgaggttgtcacatccttcttccccgtgctcttggaattctcttgtatgaaatgttgtatggacgtacaccttttcgaggaaagaacaggaaaaggacatttcataatatcctgcacaaagatcttacatttccaagtagcattccggttagtcttgcggctaagcaattaatccatgggttgcttcagagagatccctcttctcgacttggttcaagtgccggtgcaaatgatatcaagcaacatcccttttttaaagatatatactggccactcatccgttgcatggagcccccagagcttgatgttccactgaaactaactcggaaggaacctgaactaacagtgaagcctgaggaggatactcatgctcagattcttgacacattttaagggcaggctgtaccaataccaaccccggcgccccgcgtggaaagaacgttgttgagcatgtacatattaataaaagagttttcatcggcaagcaggatttccaacctgaattgcactagaggtcgttgtgtacttgaggcattcttttggttaggtcaagtgaatagtacatcaataggataaagttcttgtaaattaatgtaccgttttttgtgcatatggctgaataaaatgtagtgattatttatataacatcgaaaaattttgaatgaagtgaagtgctctgggtttcttaagtt

SEQ ID NO: 11291 - DNA, 432 bp, Sorghum bicolor
  Clone ID: LIB3481-024-P1-K1-B8
cgtccgcccacgcgtccggcggctaagcaattaatccatgggttgcttcagagagatccctcttctcgacttggttcaagtgccggtgcaggggatatcaagcaacatcccttttttaaagatatatactggccactcatccgttgcatggtgatctggaaattgagcctttgaaaagtatcttggataattgtttggtacatcactaataaagaacataacttcgcatgtgcaggagcccccagagcttgatgttccactgaaactaactcggaaggaacctgaactaacagtgaagcctgaggaggatactcatgctcagattcttgacacattttaagggcaggctgtaccaataccaaccccggcgccccgcgtggaaagaacgttgttgagcatgtacatattaataaaagagttttcatcggcaag

SEQ ID NO: 11292 - DNA, 763 bp, Sorghum bicolor
  Clone ID: SORBI-28MAY03-CLUS26039_1
tgttcaaatttaagattgaattgggctcctcctttatttggtgtacttgaagctcattgcttgttccattgcgtaccaactaatacatttggtcgtgctggcatgccacgctaaaagaactcgcgaaaggaccccaactcctggaaaatactgtggtcgaagaggaggatctcaaaggagcccatcaccttaccgccctcgcagaagggagcgatcccgctcaagggaacgcagaagggagcggtcccgttcaagggatcgaagggaacggtctcgctcaagggaacgccggagggagcggtcccgctcaagggaccggagggagcggtctcgctcaagggaccgccggagggaccggtcccgttcaagggaccgcagaagggagcgctcacgctcaagagaccgcaggggcagttcaccccatgacagaaggcgtggagaccggtccagatcacccaccacgaatgggaaccataaggcagactaggaagcgcttccctagtatggaaccttttcgtttcgagactagtcgtgattgtgtgaacaatggaacttgtaattgctaccttcaaatggtctgactgagacgatagcatgggttgtagtggtgttgctgtattttattgttgtttcattaaaagtactctattatgttagctttggatcgaaatatcgaatgattttgtttgttattgtttatgaaactatgacattcttgtgtgtttgcttaaggtcgttttggcatgtactaagtgtacttgct

SEQ ID NO: 11293 - DNA, 777 bp, Sorghum bicolor
  Clone ID: SORBI-28MAY03-CLUS26401_1
ttcggcacgagggcaagagcgagcgaggagaaggagaccaccaggcggcgaccaagaaaaggaacgatggcggcgagagcggtggccaccctggcggcgtcgtcggcgatggtgctggcggtcctgctactggccggcggcgcgtcggcgcagtcgtcgccgtcgagccagtgcacgacggtgctggtgagcctgtcgccgtgcctgaactacatctccgggaacgagtcgagtgcgccggcgacgtgctgcacgcagctggccaaagtggtgcagtcggacccgcagtgcctgtgcgtggcgctgagcgccgacccagcgtcgctggggctcaccgtcaaccgcacccgcgcgctgggcctccccgacgcctgcaaggtcaagacgcccgacgtcagcaactgcaagggcggcgctgccgccgccggagcaccggtcacctcgcccggcgggacgacgacgacgacgacgacacccgccacggggtccaagacgacgcccacgacgacgtctgtgccagaaaccgcagctgcgtcgccgcggggctcggctggtgtggttgccggcttcgtcgtcgcggccgttgtcgtcgccggcttcgccgtgtgatgatcggatgctagcttctcggtactgttggttggtgtgtaggaattgcagcggattttgtgttgtttcattggtggcgcctcggctcgatcgatcagccttttgcccattcgtgatttgttcttcgcctgagagagcttattcatcgatcgacttgattgctcactg

SEQ ID NO: 11294 - DNA, 725 bp, Sorghum bicolor
  unsure (1)..(725): unsure at all n locations
  Clone ID: SORBI-28MAY03-CLUS26501_1
taagtgattgcattcatgttttttttgtgccccctcatatgtgagctcacatcatgtgagtgctgcacgttggcaggaaatacagctcgtttgtttcccgaaatctataagtacatctcatttctcctctttggatcgaggtagacaacaggattttgaagggcctatgagtgacgatatgcacagtttgctgtttaactcttttctgcaggtgcatttgcagcagaagcattaattatttctaactatctatattttcgaatgctttgcctgggctgcctggctgaactccttgcgcaggaccctcctcatgaccttgttagaggcggttctagggagagacgggaccacgacgaccgaggataccttgaagagagggttcagtttcttcagagcaacgttgaacgctagtttcagttggttccagtcctctaattgtgagctctggtctttcaacacgacggctatggttagttgttcggggccaccccctacaggtggaaccccgatagctgctgtttcaacgatggcatcatgtactctgttgcagatcctctcaatctcaatggaactaaccttaattccaccgaggttcattgtatcatctgcacgcccatgagccctgtaatacccgtcagaagtacgctcaaattcatctccatgcntgcggaggattttcccgtgccattctggcattctgttgaagtaaacctcctgatggaatt

SEQ ID NO: 11295 - DNA, 814 bp, Sorghum bicolor
  Clone ID: SORBI-28MAY03-CLUS26554_1
gtagaagtgagaatattcagggtccatgcctattgattgtcggagatatgcaaggggctgtgtttggtggcttattgaacagtcctctgcggccaacagagaaaaggaaatatcagggaacaaaccagacgtttgtgttcacaacgatacatggtgaacctagacttttcagaccaacgggtgcaaacagattctattatttgtgcttgaatgatgctttagcatttggaggtggtggaagcttcgcattgtgtgttgatgaagatctgttacatggaagcagtggatcatgtgagacatttggaaactcatgcttggcacatagtccagagtttgaactaaagaatgtggagctatggggattcacgcattcatggaaccgttcgacataactgatgctagctgtcctcatttatgacctggcaacagatggaaaggggcatgagaaggctagttggaattgctaaagggtattcacttaatcacttgggaaatgtttagtctcattctattgtttggcttgtggagggaattaagtatgggagctgtatagggaattcatgtcctttgtttggtgagtgagatttggagtggaaaatcgtgtcatgactaatgagtcatgatacatacatgttccacttaatgtccaattaccaccaatccctgtggtcagtgggaaataaccttccatttccttgcaccaattatcgatacacaatgtgtacttgatcactgtaacgtcacgtattcattcattcaattaacacgtttcatatttgtacacgtttttctgttcaaaataattactcgaatc

SEQ ID NO: 11296 - DNA, 788 bp, Sorghum bicolor
  Clone ID: SORBI-28MAY03-CLUS26654_1
gtcaaatagggagtctgctagacgatcaaggctgagaaaacaggctgagacagaggagttggctacacaagtggagtcccttactacagagaacacgtcccttaggtctgaaatcggcaggctaacagagagctcggagaagctcagattagaaaattccgctctaatggtgaagctgaaggacactgcagcactgacccctgcagaaccatctccgcacacagcagtcacatcctcgtcctctccgggtgccgccgcggaaaatttcctttccatgatcgacagcgccaaggcggccggcgtcagcaggcacacggagcacggcgagcccaagctccggcagctcctggactccagtccggcaacagacgtcgctgccgtaagctgatgacgatccggctaatattacagcacagcacatgcatgtggcctggggatttcacaagctcatgctgcgcaccataaatgtcagagttattacagacttagtacaccagtttaggcactgattccagtaaagtaactgaggacaccggtaattttatctgctccgctgagtgccggactgcgacctctcctagtgtaccagtgttgtaacatagggtgttgtgctgcatgccaacctttgaaacttcgagatcgtcctccttgggaccattttcggcgtaataacaaaatatagttcggagtttgtacaacagaataagacggatactggtgtgtgctgtgtgcaatcctcttactgcagtgttggtttgttctcaaatgtagtttcattcttcttctct

SEQ ID NO: 11297 - DNA, 1366 bp, Sorghum bicolor
  Clone ID: SORBI-28MAY03-CLUS24774_1
gcacgaggccagagtccacgccctcgccacgccacgccgcccacgccgcacgccgcacgccgcgccccgcgtcccccgcacgtcgtgccgcgacgatgtcatccggacgcccttccgaatctgccatggacgccgacgcagcgcccgcggcgtccttccctctcagatcgaagaagcggctgccccgcacgggcgacggcaactcgagcccaaaccctagcccccgcggctcccccgcccgcggtagcgagcttaagcgcaggcgccgcacatctgcggagtccgccgcgctcgcgctcgccacggccgccgcgcgcgcgtccgcgtccggcgtccgctccgacgcgggcgacggcgccgtcggcacgcggagacgcccgcgcgcccgcgccgaaggaggcgacggggccatccggatgctcggagccgccgccgcccgcgtcggtggaggccgcggcgccgcccagaaacaatggagcgacgacgacgagttcacgctcctcaccgcagccgttgccttccgcgagcgcaacggccgagccccgcgcctcccggacatggccgagctgttcgagtccattagggactccatctcctcgcacatcgaccagttcatggtgtactacaagattaagcgcctgaagagcaagttccagcactcctccggcccgcgcgaccgtcgcctgcgcgatctgtgctccgtactatggggcgtcggcgtcgtgccctcttccgaggaagactcggacgtcggcgagcgacgtgctgtccctgatgcggcagccatgatgccggtggtcaccgaggtgctcggcgagtactggaaaacgaatgagcgagccatggcaggggtgtcgcttgagaaaggcctgtcactactggggaaaaaagagggcagacttattgaaaccaaatggaggcagcagcttgatcaagagatgcaatctcagatgcggcggcatgatctggctaaggaagtctgcggcttgctcactgatgccatcaaaggcctcggcccttagctcggcttgcatctggtttgtaggagacttccttctctagtttacttgtttgttggtgtgattggtttaaacctgttgctcatctcagattaaatgttgggtcaattacagcagaagttcttcagaggaagctggaaactgaaattccctatttgttgtaacattttctcaaaaacttgtaacacagttgcattgtctgacttctgtaacaaaacaggacggcaagaatgccctgcttatactagcttgttagtgaattagtagtgatgttctattcagctggcctgtaaaaggactaagcttcggcaaacctaaccatcttgttttcagtttgtttaccttca

SEQ ID NO: 11298 - DNA, 1339 bp, Sorghum bicolor
  Clone ID: SORBI-28MAY03-CLUS25021_1
aagcagaagaaatcgagataacgagagctagggttttgattccagacgcacgccgcatcctgtccccttcctactgcccctccctccgcgacaccgcctccgccctcaccctctcttcccggcatctgcggaggcgcgaggaggctgaggccgggagcgccgccccgaagaatattctccaccccaatcgccgacacccctgcgcgccgcgagagttgccattgtactgttgtagcttgccagttggttattggctgtgtaacaactttgagctatgtcatattacgaaagaaggggtggagataggggtagtggccgtattcaaggaagtggtgggcgaggtggacatgtcctgcgtggaagatcaggattgcctccccgaggacctcttggggttaactcccgtccatctgcacgcactattgctaagtcatttagcagaaccaaagacatgacctggagacctgatctatttagtgatagcatggcggctagtggaatagaaactggtacaaaattgtacatttcaaacttggactatggggtttctaatgaggatataaaggagctgttttcggaagttggccatttgaaacgctttgctgttcactatgatggttatggccgcccaaatggcactgcagaggtggtgtttacacgaaggagcgatgcaattgctgcactgaagcgttacaataatgttctacttgatggaaaagctatgaagatagaagtcattggaagtgacttaggcttgcctatgacacctcgtataaatgtcgttggtgcttctaatggcagagctacaagaacagttgttatgacgcctgagtttagtcaacgtggcaggggttcaagcagtagacctctaagtaatccaagcaacaggtttaacaaccgtggtggtttccaagctggtcgaggccgtggccagttccaggcccgtggcaggggccgtggccagttccagagccggggcaggggccgtggccagttccagggccgtggcagagggaggaagcctgagaagactgcagatgagttggataaagacctggaaagctatcacgcagaggccatgaaaaccgattgatagcaagacggtagatggcgtctgctgcaagattgtggttttatccgtcattttctgggagcaaggaacattctttgtgctttggtttcaggaaaactagaccccctgtagtaaactcgaacaaaatattgccagtgtgtagtgtttgcatgaagtttgcaacctgatgtgtttatttttgtatcggttgcttgagatggtgttaattgttaggttcatgcttagaataattgtcattagccaaaa

SEQ ID NO: 11299 - DNA, 892 bp, Sorghum bicolor
  Clone ID: SORBI-28MAY03-CLUS25085_1
ctactggagcacggcacgaggctccgtcggagttcagagtccagagagcggacgcaacagcccactctccccaacgatcgaagtgagcagcgcagtgaagccagccgccctcgccgccgatgagccgcctactctcccggcggcaaattgacgccgtccgtcgatccgcacccctcgcgtgcgtgtccaggtggctgcacacgccgtcatttgcgacggtgtctccgcacgaggtttcaggttccagccccgcagaagtgcagaattttgtgcagggaagctggacagcatctgctaactggaactggatagttgatcccttgaacggtgaccaattcatcaaagttgctgaggttcagggaacagaaataaagccatttgtggagagtttatctaaatgcccaaagcatggacttcacaatccacttaaagctccagagaggtacctcatgtatggagatatatctgcaaaagctgcacatatgctgggccaacctgcagtctcagatttctttgctaaacttatccagagggtatctccaaagagctaccaacaagctcttgcagaagttcaagtttctcaaaagtttttggaaaacttttgtggagatcaggtacgttttctggcaaggtcatttgctgtacctggcaaccatcttggacaaagaagtaatggctaccgttggccatatggcccagttgcaattatcacaccattcaattttccattggagattcccttactgcaagtaatgggagcactatacatgggaaataaaccagtactcaaggttgacagcaaggttagcattgtgatggaacaaatgattaggttgcttcatgattgtggattgccagcggaggatatggatttcataaattctgatggtgt

SEQ ID NO: 11300 - DNA, 874 bp, Sorghum bicolor
  Clone ID: SORBI-28MAY03-CLUS25228_1
agctagcggttttctctcgccgacggccgaccaccgcacacgcacacgttcagcgatttcgcgggggaatttgcattgattccgtggagttccatccgcccgctgtagccgcgattggggatcggggggcttgcgggccgtggaggagccagaagaaggtagcggcggagaagcttcttgatccggggacggacggggcctttggagattcgtccgtcgatcgggtctcatctgcggaagccgggtcagaaaaaatcgttgcgactggaggaggcggcgcgagggcatgggggcgtgggtctcggtcctgctcgggatggacgacggagccgcggcggcggctgccgccaggcctgctgctgtgggcctgggcgacctgccggagctctgcgccgcccaggtgctgctccggctcgacccgccggagatctgcagtctcgcggggctcaaccacgcgttccgcggcgccgcgggggcggacttcgtctgggaggccaagctgcctgagaactacagctacctgatggagttcgtcggggggagcggcgacgaggggaggcggcggcggcggcgggccggcaagaaagagatctatgccaggctcgccaggcctgtgcctttcggtgacggccagaaggaattctggttggacaagagcaaaggcatgatctgtatggcactgtcgtccaaagcactggtgataactgggattgatgacagaagatactggcaacacatgccaacttcagaatcaaggtgaattatggctttgagatcacatttactaatatttgtttgttcagtttatgatagttttctgaaaacaaagatgatttggtggcattaattgcgatggaatgggctgaagatattt

SEQ ID NO: 11301 - DNA, 668 bp, Sorghum bicolor
  Clone ID: SORBI-28MAY03-CLUS25237_1
agaagaggagacaccctagccggtgacgtagcccctaaggttccccatactcctccagcccatgccgcttctccacctaaggttcctgccaggcccccccgatccgacgttgtccccaattgggacccaacccgcggcgagcatgacccggcacgccccacccgcccccggcgaggaggtccccggcgctgctcccgcggccccgctgcaggcgccgggcggtcggaggtgggcacgcgcccccccgctcctcggtctaaggaaggcacgaaactagaggatgttctgggcgagttggcactggctgtcccgagtctaatggagatggcaccggtccagtttcttttgtctatataccatagagtggaggaggatgcggattataacaatgtaaactatgtgccgccttcatagctgcagagttggtaagtaggattagcaggccagctgtaggttcatcttgtctccgtagcagttctcatgtttcatcgtatcatagccgcccgaagctgctgatgtagcttacaatgttccagaggttaaggtcgttcgactggttgactgtaatggtctaaagttagattcctgtgaacagctagtgctgctgcagatagtaccagttgtacgtcccacttgcgttccggtttaatgttaattaggctttgctc

SEQ ID NO: 11302 - DNA, 719 bp, Sorghum bicolor
  Clone ID: SORBI-28MAY03-CLUS27199_1
gctacacatgcggcagctagtatcactacagcacaatcgccaggcttgcattatttgcttccttcacaagcctcaacggtttctgggatgcttgctgatgctcatggtggcactggttctataggaaggtccacaagccttgtaaacccgtcacttttctcaccattgacgtcttcacagacaacaatgatgcgcagtaatcctgcagtaccaactgctccacctcaacatcctcgtactgctcagcagccgcaaagtgctcccttgcttcagccttttccgttacccacagcttcaccatctccaccatatgggactccattacttcaaccgtttccgccacctaatccgtcgccatctcttgcgtctgcaccagtcttgagcccagcactgtctagagacaaagtcagagatgcattactgagacttgttgagaatgatgaatttgtcgatttagtctaccgcgagatcatgaacagacagtaatggattttcaaggtacagtcctctccatcaggctagtttgtgttggattctctgattatctgttgtctagcctattccaagttatcctgtaaattcattgatgaaatccttcgattggtggagtttgtactattaatgtactttctacatctgtaaatggttacaaaatctgtgctgtattcgtggtgcagaaaagttttgttctgagtatatcttgaaacttctgctgaacc

SEQ ID NO: 11303 - DNA, 726 bp, Sorghum bicolor
  Clone ID: SORBI-28MAY03-CLUS27279_1
gcacgaggcgcaactgcaaggcaccgaaggagaactcaccaggaagcaacgacgccgacgacgcggaaagaggaatccacgggtcagagaagccgctcttgttggatattctgttcgtcagttccgtcgcggagggcttctccttccaccggcgtcgacctctactggtgctggactgccgtggggtggagatcggcttggatcaactcttattttaggttctgttgttggtgcgaaaatgagtgataacctgatggacaaggttagcgcctttggcgagcgcctgaagatcaccgggacggaggtcagcaaaaagatgacggctggaatgagctccatgagtttcaagatgaaggagttgttccaggggcagaccccggctgacaagattgttgaggacgccacctcggagaatctggacgggcctgactggaactcaaacctggagatttgcgacttgatcaacacggagaaggttaacagtgtggagcttatacgtgggatcaagaagaggatcatgctgaaggatgcgagggtccagtacctctccttggtcctgcttgagactattgtgaagaactgtgagaaagccttctcagaggttgcggccgagcgtgttcttgatgagatgggcaggttgattgatgaccctcagactgtggtgaataacaggagcaagacccttatgctgattgaagcatggggggagtctggcgatgaactccg

SEQ ID NO: 11304 - DNA, 1322 bp, Sorghum bicolor
  Clone ID: SORBI-28MAY03-CLUS2734_1
gcacgagggtcgcacatctgccattgcggccagcgcgtctccccagctgccgccgtccccccccaggccgccccgaccccgtccgaccgcccgccgaccgccttccgcgccctcggggccgccaccaacttcagtctgggcgactacgaggatgatttgaagcagatgaggaattggaccaaggaggaattcgtgcacatactccggcggcagagcacagggttcgcgaggggaagctcgaagtatcgtggcgtgacgctgcacaagtgcggccgctgggaagctaggatggggcaacttcttggcaagaagtgcagcttgggggggctcttaagcaatgccgtcggctcacccgtccgcgcgctccgctcccagggcctccaggctgttggttttgatgtagatgtccgcaagcaggaggatgcggacagagttctcgctgcgacagttgcgcatttcggcaagcttgacattcttgtaaatggtgcagccggcaacttccttgcttccccggaggatttgacacccaagggattccggactgttcttgagattgacactttgggtacatacacaatgtgctatgaagccctcaagtatctgaaaaagggtgggcctggaaaaggcccgtccactggtggcctaatcattaacataagtgcaacactgcattacactgcgtcttggtaccaaattcatgtctctgctgctaaggctggggttgatagcatcacaagatcactggctctggaatggggaacagattatgacattagagtcaatgggattgcacctggaccaattcaagacaccccatgagtgaggaaacttgcacctgaagagatgagcaaggggctgcgagaactgatgccattattcaaatttggggagaagcaggacatagcaatggctgcactctaccttgcttctgatgcaggcaaatatgtaaatgggactacactagtggttgatggaggtctttggttaagtcaccctcgccatattcccaaagaggaagtgagggagctttcaaaggttgtcgagaaaaaagttaggacctctggtgttggtgcgccgaccagcaaattgtgattgcatttgtgtgatctgtagtatcaatcaatattttactatgaaactttattgtctatgtggttcttgtattctaactagcgagtttgtttacgtgagtaagttcaaatatttatagtacgttttcacttctaagttccattgggaatgttttgattgataagtggtgccagccaagatgtttgtcaccgaatgttcacatatgtcacaaaatacagcattatgtcctc

SEQ ID NO: 11305 - DNA, 618 bp, Sorghum bicolor
  Clone ID: SORBI-28MAY03-CLUS27587_1
cttctttcctgctgttggaccaaggaagtatgactttacaaagaaacagctctttgctctgtcaccaaccgaggttggaagcttgataagtcttgggcctgctgaatcctgtgaatttttccatgacccatccatgaaatcaagtaatgaaggaatggtgaaaaaatcgctgtcgatcactccacttggcagtgacagtggatactttgttaatataactgttgtgaacagcgtggagaagactaatgatcgtctttcagtccctatcacaaaagctgagtttgctgtgatgcgcacaactctgagttttgcattgccgcacatcatgggttgggatcaggctttaaccaatcaccacccatctcctccagctatcagcaagcccagggtagagcgtccacacccggattctgaatgggaaaggtgaagcttgtagcggctagatgttggaggctttggacttcagtagaagttgctggaggtatggagcattggtgtgcttgaacagtgtgccattagaattctggaacttaaagacttaaggccggatgaagcacgatgaactattgtgtttgttgagtgcatgtataactctaccacgccttctaaatgcatatc

SEQ ID NO: 11306 - DNA, 1269 bp, Sorghum bicolor
  Clone ID: SORBI-28MAY03-CLUS27593_1
gcacgaggggcgctataacgaagcagcactgaaaaaggaagttcaagaattaattgtttcatggaagtcatactttgagacatgtgtttgtgccttcatttatgctccatctaagaaccgacagatgctcttcgatggggagaagactcagtcagtaattcagtcatgtgatattcgtccagttccattgactgtccatcgtcccactttgaaggaagctaagcgggtatattgtaacctaacacaactctactatgagatggaatgttcaaccacagatgaaaccttacctgatgctggaagtgtgaaaaatgttgaacaaagtcaaggaaaaaagaaggaagtggacgcagaccctgaggaatctatttctgacttgtctgccaggttggaattgttgaataagaatgaatcagcaacaataccatcatctaagaacgaaacaacacctcttcatgaggcagcaaagtgtggcaatgctcagctgaccctggagttactcgagcagggtttggatccttgcataaaagatgcaagaggaaagacaccttattcgctggcttcagataaggaagttagaaatacattcagaagatttatggcactcaaccttgacaaatgggattggcatgccgcagatgtgcctagtgcactaacaaaagaaatggaagaatcacaagctgcaaaacaagcagacaaggatgccaaaaggaaagcacgtgcaaaggagttgaagaaattaaaaaaagcaagagaaaaggaagagaaggaaaaggagaaggctaaggctcaagcatcgcagtcacaaactgatgttaaaggcacttcaagtggccaaatggctaacagaactgcatcagtgccaggccttaaaccaaagcatcagacgccacagcaaatacttatagcaaaggaggaggaacgacagcgaaaacaagctgaagaaagagagaagagagcagctgcagcagagagaagacttgcagctcttgctgcccaatctgctggagccggcgcgtcaggtgcagcagcaacaaactgctcagcacagagggcagtaccagatgacaattcgtgttcatgctgttttgcttccttggctggcaaggtgccattccaccgatacaactacaaatactgcagcacgacatgtatgcatcttcattcagaaatgctgcaagatgattaagaaaaccacatgacgcgatcacatgattttgatgttattttacctcatataatcaataaaataacaggctttcttcttcc

SEQ ID NO: 11307 - DNA, 697 bp, Sorghum bicolor
  Clone ID: SORBI-28MAY03-CLUS2565_1
caggcagaacatggtccagatagtcaggtcgttctagttattgctggagatggtgttaatttgggtgccattgaggcagaggttagcaagcagtgcaacgcgcttccaagaggtgaatttgcttcaaaagcacttagccacagcttcactgtgtttgccaaagatatggttgaggcgatatcattctcaaatctgtatgcccctgaacatttgatcatcaatgtaaaggatgctgagcagtgggaggagctcgttgagaatgcagggtcagttttcttgggccaatggaccccagagagcgtgggcgattatgcaagcggaacaaaccatgtccttccaacctatggttacgcaaggatgtacagtggtgtatcactgaactctttcctcaaatacattactgtccaatccctaacagaggaaggactgagaaagctgggtccatacgtcgcgaagatggccgaagtggaagggctagaagcgcacaagagagccgttacccttaggctgcaagaggttgaggcctctgtaaccgtatagctgctgtcatgattcattgtaatgttcaaagtcggtgtgggatgttggaattgaactattgatctggaatgttagaaagaggcgtttcaactggtactacaaataatgctcattgcactctgatatgtttcacgaataaacatgagcacaaccagaa

SEQ ID NO: 11308 - DNA, 865 bp, Sorghum bicolor
  Clone ID: SORBI-28MAY03-CLUS2578_1
cggacgcgtgggattatggctcctgaagatctccgtgtctttacacagttatcaacagctaacatcactcagcgcattgcagtcccttattgtggttcttttgaagtcataaagtacagactgaagcaaatatatgagagcgtggagtcagcaacagaagaatctgatgttccagcattgattgtgcatgaaagagtgacagttcgcctagattcagaaagttatgttacgctgcagtggtcatctgatcccatcagtgacatggtgtctgattctgtggtggctatgatcttgaacattggtcgtgaaggtccaaaagttgttccggttgaagaagcagttaagaccaaagaagagacggagaaggttgctcaaaaggtggtatatgctcttatgacatcacttttcggtgatgttaaagttacagcggaagggaaatttgtcatatctgtagatggaaatgtggcacacttggatgggatgagtggcgatgttaaatgtgaaaatgctacactgaaggaacggatcaagactgcattccgtcgcatacagagcgccgtgagaccaatcccactttcagcctcttgattggagggcaatgtttaaacttgtttgacatttcccagtttttcaatgtaagattatctgtctggacttggatagcagttctttttcgaaaagaatgcccaattgcattgtaccgcaagctactcaagaggatcgttgatctgggattgccactgaaacgccagttgtaacattgtaacatgaactaactcattttcattatctgtcctgtttccttttcatacccaaatttgaaatacttaggcatgatgttccaagttctgtttggacatgtttc

SEQ ID NO: 11309 - DNA, 673 bp, Sorghum bicolor
  Clone ID: SORBI-28MAY03-CLUS25846_1
gcacgcacgaggcactcgtcaagccatggccacctcggtctccgccgtggccgccctagccgttttctcggctccaagaagcctccttcagcgcccggcccagctgccgtcccgccagaacgtcgtgtcgttcttcgtcgggccggcgcgggcgcaccgccggttggtggccgtggcggccagctcgccggccacgccgccggatcttgccaacaaggtgtccgagagcatcaagcaggccaaggagacgtgcgcggatgacccggtgagcgccgagtgcgtggcggcgtgggacgaggtggaggagctcagcgcggccgccagccacgcgcgcgaccggcagaagggcgtcgacccgctcgaggagtactgcaaggacaaccccgagaccgacgagtgccgcacgtacgaggactgaaacgcgcgaggctggcctccggcttccgccatcgctgtcgcttgatctagctagcttggcatgatggcaatttgcaggcatgcaatggatgatggttctgccccttcgtcacctttggtgcttgagtttggtttcttcgtttttttagtctttggcttggtgtggaataaagcgaggtttgttatttataagaaacatttaggaactcctaatgtaattccaagtaggatgtaatccttagaaatatatttgctg

SEQ ID NO: 11310 - DNA, 746 bp, Sorghum bicolor
  unsure (1)..(746): unsure at all n locations
  Clone ID: SORBI-28MAY03-CLUS25937_1
tggcaganaatgcaacagctgtactatcagtggaagaaatgcttccagcagttgcccaaggtgctattggaatagcttgccgaagcaacgatgacaaaatgatggagtatctatcctcgttgaaccatgaagataccagattagctgttgcatgtgaaagagaattcttggcagttcttgatggtaactgccgaactccgattgcagcctatgcttaccgtgataaggatgggaattgctcattccggggtctgttggcttccccagacggatctaaagtatttgagacaacaagaagtggaccatactcttttgacgacatggttgagttgggcaaagatgctggtcatgagctgaaggcaaaggctgggcctggcttctttgatagcttgcaatgaaaagaatgagcgaccatgtgcaatttcagttaccactcttttggttagaaacggagggtctaagtagagtattgagaggtttgtttttgtttcttctttctcctactatagttctgctagagccttgtactaccactcatattgagcaggcccattgagctttgttgtgtctcctgttcttctagcactctgggttagagccttagaggtatctgcaaagcacagctatgttttgtcgaagaggtaccagcacagctacgttgtacacttgtaatgttgtacttggatgtgactttgctgatagttgttgtttcaagaataattgagctcccggtaaccagggagaaa

SEQ ID NO: 11311 - DNA, 750 bp, Sorghum bicolor
  Clone ID: SORBI-28MAY03-CLUS2594_1
tcgaccacgcgtccgtatttttgaggacgatcaaaccagacatgtcacaagccgcatcattggaacacgaggttacatgtccccagaatatgccatgcgtggacagtactcggccaagctagacatatttagcttcggtgttctagtcctggagatagtgacaggccgaagaaacaactacgcagtgaactctgagcattctccaaacctcttctgtcttgtgtggaagcactgggtggagggaacaatcgcacagatagcagaccctagtctgggcaggcactaccccatggccgaggttctcaaatgcatcaatattgggctgctttgtgtccagcagagccctacggaccggccatcgatgtcggcgatcgtagtcatgctcagcagcgacaccgttgccgtggaagctccctacaggccagcttatgtcgacaggagcaggagctacacggagatgacagtagagcttatcaaggaaaaggaagagctgtgttcgcctcagtcgtccatcacagagctcatgccaaggtagacagagaatttcccagagtaaatatccatctgcaggaacatatataagcagcccagcaggcataactatatttatttcataaattccaatcaaacaattgcacgatcggcataggcgtatactgtattcagtgtgtaactgtgtatactgcataaatacttaggtgatgtaattggactgtatactgctcaaatgcttacataatgatgttcttc

SEQ ID NO: 11312 - DNA, 1315 bp, Sorghum bicolor
  Clone ID: SORBI-28MAY03-CLUS28324_1
acggcagagtcctggcttttgcccccttgcccccggccccccccgaaaccacttccgatcccaatccccgtatccggcgagcgcgcgccgcggccatgcgcagttgctgagagaggagcgagcgcaacgacgccaccggccatggacgagggctacgccaacctccccaccagccacctcctcggctccgtccccgctgtgacacaggacgacaggaaacccgtcccccccgccgcccaagatgcagctgccacctctcggttgcaggagttcccgcctgctcctggtggtaatggaggagggtatcgtccaccaagtggccctgcagatggagatgtagaaaaccaagcagattggaaaggatacttcaatgttgcatcttatgctccatacttcaatgttgatactgatgttgtagttgacaggctcatcagttcaatttatccaatggatgggttttacaggaaaattgatgctaatcctgacatgtatgggcctttatggatcaccactactctggttttcatgctagctgcgtttggtaactatgccacttatctgatgcaaaataaaaaggatctggacatatggaactttgatgttggttatttcagttgggcagcatcagtcatgtatggttatgctatcattgtgcccgctctgttctttttcctgtttcagtattttggatcacgccaaagtcttgttcgattttggtgtatgtggggctattctctgtttgtcttcatacctgcatctgtacttttgcttattcctgtggaatttcttcgatgggtcatcatagctcttgctggtggtgcatcatcttggttcatcgctttaaatttgaaggaatgcactgaaggagctgatctgatggttctgatagctagtgcatcggtgctgcaagttgctctggcactgttcatcaaagttttcttttttgcctgaggtttgcttgttgattttgcaaaaggtgacctgatgcgctctgtgtccacggcttgttctggaaaacatctttggaaagggcaagggcagacagacctgttttactcgacaacttgacatacatattgaccctagattgttgtgccttgggcattcttcatttgaagtggctaatttgcaagttcttctccagctagctagtaacagaattttactgcgtgccttacagagtttactgagttcggcaccaaaaagtcttcccgcgttgcttagtgagaacgtgcacagtcctacactttgatttgcatacaatcctttcttgggtaacagtattctcatgatctatacatgtgtatatgtgcgc

SEQ ID NO: 11313 - DNA, 673 bp, Sorghum bicolor
  Clone ID: SORBI-28MAY03-CLUS28328_1
gtggcagctgaggtaacacacaagttcaaaaccaaggagaactatttcacagttgggagctcccatgcccttgatccttcaacattgctaaagacgcgattcagcaactccgggaaggtcggtcttctctgtcagcatgagtggaggccaaagtcccttgtgactctttcagcagagtatgatccaaaggtggtaagtgcgccttcaagaatcggagtggccatatctctcaagccttgagatgagtcaaatcatcttctgtaaaacagtacaagcgttacatactgatactgtctccaagaacataagctttggagcgatacctagaacaaccctccattttagcctttttttggtaagagtcctgtggcaaaggagtattgtctgggagttggacttgttttgtggaatgtttccattagagtcaactccacaccgagcattgaaaatacagaggtttgtattagagcagaagcttcagtctgcgatataattttcccccccatgttttcctagtcgtcgcaaaatgattttggaggtgattgaacacctaacatcttgagttgatggtagttttaacagctctggagataaaaggggcatttgtacccagcaacagcagaattagctcttgaaattggttgttttggttaaacttatttttttgtggggt

SEQ ID NO: 11314 - DNA, 598 bp, Sorghum bicolor
  Clone ID: SORBI-28MAY03-CLUS2829_1
cggccgccgccgccgccctgacgagccggagcgatggacgtcagacgccaaggcgttggatgcgttcaaaagattcggaagccggctggtggagattgagacccggatcaagacgatgaacgacaacccgcccttgaagaaccgaaaggggccggtggaaatgccgtacatgctgctgtaccccaacacgtcggacgttaccggcgagaagggcgaggggcttactgccatgggcattcccaacagcatctccatatgagcctgggcagattgtatctttcgtaggacggtatgtaaatgttttgatgcgccgtgcaatgtgtttcttcgttggtttcgtcagtttcagggttgtgggtggagatgaggattgttatctgttaccataatctgtagggttgagaacaggagccacgcctgaataatattgtcatgtatgttttttttcttttttttttggaaatttgtatgttttttttcttggttaagaataaaagttcgtcagctcatttcttagcctatcagactactgtaactcttcagatggggtgaatggcccgatcggtaatcaaatatatatagagacagtaaacacaca

SEQ ID NO: 11315 - DNA, 477 bp, Sorghum bicolor
  Clone ID: LIB3481-014-P1-K1-G12
cgtccgcacgcctccgacgaggtgtacctcggccagcgcgacgagccggagcgctggacgtcagacgccaaggcgctggacgcgttcaagaggttcggcagccggctggtggagatcgagaagcggatcgagaagatgaacgctgacccggcgctcaagaaccggaacgggccggtgaaggttccctacatgctgctgtaccccaacacgtcggacgccaccggcgagaagggcgaggggcttactgccatgggcatccccaacagcatctctatctgagcagagatttgttttgtcccgccgtggatgatactacgtgctgcttattggtagctatatatatgcgttcgctattgtcagcgtgtgatgtgttgatgtgtttcaacttttaattcgtcaaaaaaaaaaaacgttgacaggggcgtttttggtggaaattaaataaacataaattatttgtcttatttatactataaa

SEQ ID NO: 11316 - DNA, 1021 bp, Sorghum bicolor
  Clone ID: SORBI-28MAY03-CLUS28473_1
aggagatgccaagccagctgagcatgaagctgtggctccagctccagtaagcaacccaactgagaactcagctcctgctcctgctgagcctgctgttgttcctgctccagcacctgaaaccaaatcagatgccgagcctgttgctgttgatgctccggcacctgaaaccaaatcagatgccgatcttgctgctgtcactgctccagcacctgaagccaaattagatgctgagcctgctgctgtcgttgctccagcgtctgaaaccaaaccagatgctgagcctgctgctgtcactgctccagcacctgaagccaaatcagatgctgagcctgctagcaaatcagatgctgttgctgctgatctagcgcctggaaccaaggcagatgctgctgccgctgatccagcacctggagccaagctagacgctgctgctccagtagagaactccaccaacaaaggcggaaaccaggagagccagcccgtgaacaacgggcaggtgccgcactcaacggtgaagtgcatctgaagctggaaccggaagcctgaaccccttctgggttccggcgcccgtgtatctcatttaggaacaaaacaaacatttgcatttgcattctgcattgtaatcagttaaagagtcgatggatcggtaagcatgttaattagtcagtctctgacgctgctgggtgacaggttggtaattagacttctgcatcttagctgttctgtatggtcgctgtcgccgccgtacatgtatccaccaccttcatcttcttggttgtattgtacctaactctgcgtaagcatattaatcttaggccatgtatactccgctctaatgtctgtggtccgtgtacctgtgctctgtgtattgtgaaacttgcataactagttgcatgttgttatgaaaataaagagtggctgggggtatgcatgggatggatgctggtatacccatccagcaccaataaacccagccaggaacagcaggatgagaatctcatccgaacctgatgctattgtt

SEQ ID NO: 11317 - DNA, 582 bp, Sorghum bicolor
  Clone ID: SORBI-28MAY03-CLUS28512_1
gccttcctgaggttcatgggagatgacgcagaagcaaagaactacagctacagcctggaggtagggggcactgggcgcaagatgatctggcaaggggtgccccggagcatcagagacagcccccggaaggtccgggatagctacgacgggctcatcatccagaggaacatggccctgttcttctcgggcggtgacaggaaggagctcaagctgcgcgtcactgggagaatctggaaggaacaatgcacgaggggtcagctaatacatctcttctgctccactgctgccagagcctttttgccatgcgtaggaatcgacaactctgtgattcattccttttttcagctcttctggcttgctattgcctcttgagtcttggctcttgcaaggtgctggtggatgtagatcgtgtagggaggttggtggttgctactgatgcagagttcgtagagatttcctctattttatttgaactgtctcggagtcgccattgtgtggtataggagaatctagtggcaactcataactcaagattgaactggtttatgcatgagaagttaatgtaaaaaaaaaaaaaaaaaa

SEQ ID NO: 11318 - DNA, 1235 bp, Sorghum bicolor
  Clone ID: SORBI-28MAY03-CLUS1334_1
cctgctgtccacgaaatcctcgttctacttgcacgcgtcgattaccgtcttgttgcgcgacagtattggagaatcgagagtgctctcccagggtcgaggtggtgtaggcgctcgcggagcagccgaggcgttggagtttgaggaggagaagatggtcgtgctggtggtggccacgacgtcggacccggcgtccattgggcccgccgccgccttcctcgccatgcccggatggtcccccggcccgcccatcgccgaggggatggaaagttttactaatgggaatgttcgattattgaagcatgagcatagcattatcgcagaggatgatcttgaccagcgatggcaggaagccactggagagtctgtttctgaggtcatatttctcagcaaacacactgcagtctccaaacgtccagcactcacagtgcatccaattggtgtgccacatctgaaggaggatgaaaccccaccccaaggagggattcctggatgggcagcaattccaagtcctcgcattggcccttggctccggctgatgcaaaagatagctgcagaacaaggcctcgttccagagtttgagattacgcttgaggctactcaccatggaccagttaccagcacacccaccatgtttgttgagataggaagtacagaagaccactggggtagacaagatgctgcgcaggcaattgctctagttctatggaaagggcttggtctggaggatggagatgctgttggaagttggcaaaggaactgtgaaaaggttctactaggtataggaggtggtcactatgttcctcgtcacatggatattgtcatcaaagatggtgtatgggtcggtcatttactctctggctactccttgccaatggacacaccatcacaagtaaatggaaagacttatggagaggttgctggaatgtggaagcatgccatcaaagtttcctacgaagccacaaaggcagcatttcctggtggtgaagttattgcacatcttgatcacaagagcttcaagggctggcagaaaaatgctgtcacatcctttttgcaggagcagaacattaggataggaaagcctagtgatttcttctgatgtactgcaacagtaattgacacgaaatgttgggggaggttgtgaatgcttgagctgatttccctgggcacacgtacgctgagtaaatatgatgaaataagactagagaatacaagtgattcaagagcttgaatttccc

SEQ ID NO: 11319 - DNA, 945 bp, Sorghum bicolor
  Clone ID: SORBI-28MAY03-CLUS26678_1
gcacgcccccgctctctgcatccacatgtgcacccggccgcattcctcagatccagattcgagccccagctagccccggctcgagatccagctaagctctctctagcaagcttccggcggggcgctcggcgagcgagaagatgaagcggaagacgcggaacaaggtcatcgtgtggacgctggccctggccgcggcgccgctcccggtggacgcctcgatcgcgctggtgctcacggcggggacgtggaaggcccagataaagaagtcgcaggagaagatctgcaacaaggggtgggagtgctcgggcagcaagtactgctgcaacgacaccatcaccgacttcttcaaggtgtaccagttcgagaacctcttcgccaagcgcaacacccccgtcgcgcacgccgtcggcttctgggactaccaggccttcatcaccgccgcggcgctcttcgagccccaggggttctgcaccaccggcggcaagcagatgcagatgatggagctctgcgcgtttctcgggcacgtcggcgccaagacttcatgtgggtatggcgtggccaccggcgggccgacggcgtgggggctatgctacaaccacgagatgagccccgaccagacctactgtgacaagacctacagcttctcccgcgccggtgaagccgcagcgtgctgcggccgcggcgcgtggccggtctcctggctctacgtcctggccgccgcaggtgtcgggttcgtggtcgtcctgccccgccgcccagagttagtttgttttggtttctttggttctgtcaggtacattatacacatgtttaaagaggattgaacataccagggcccttttttttctgaacttctgtatgtctgcttgctattgaaacatcgactagctttttctcaactttttgtatgtcttgtattattaggtatttaggttatccggtgct

SEQ ID NO: 11320 - DNA, 1004 bp, Sorghum bicolor
  unsure (1)..(1004): unsure at all n locations
  Clone ID: SORBI-28MAY03-CLUS2700_1
agaaggctgcattggatagattaagtcgtccggaagaattagttggtgatgatgatgtttcaagagctcttcttggtgcctgtaaaggtcttcctgaacctgtacttgctgtatatgatcaactgttatctaatggtgcaatcataccctcactaaatctgaagttgcgcctgctgcgatcagttcttgcaatcctccgtgagtgggggatatctgtcgttgcacataggctaggcaccacaagtgctggggcttcattctttcttgatggaacattctcaatgaaccaaacagggactgcaaatcaaggtgctcgagataaaataattagtttggcgaacaggtacatgactgaggtgaggcgattaaaccttccacagaaccaaacggaggatgtctaccgcggtttccgtgaacttgaggagaaattactatctccttattaggcaattttcagttggtcctcaagatggtaaaggatgatcctgcatctgttgtaccacaaaccaaggaatagagtcgagggcttctggattcaccttagcatgatatctattgttccttacacttatctgcaagaacccaaggctgctttaatcattattaatcagaggttatccatgacagtgtgcagccttcttttatttgacttcgagccagtatgaattacagagctcccgatgtggaaaattgtctgtgttcgttacttgctaatctagtggtagatgctgctgattctgttttacctgaattcgggaaacaactagagaactcaggccggactttgaaccagaacgaaatttagctgttgaatacaagttggttttcatgttggaaattgaaatttattatgtaccatgacattgtacagttggatagtagattatcatagtgttgtaagctttatagcttatgtgtttgttgttatcaaggtatcatttcagtagctgaaaaagtaaacgttagattgtcaganaatgtggaattctaggtccttttgttcc

SEQ ID NO: 11321 - DNA, 659 bp, Sorghum bicolor
  Clone ID: SORBI-28MAY03-CLUS26774_1
cagcgtcttcgcccacatatacactttcccagttgtgggcttcatcatcctgtcgtgcctgatcgcggtgtcggtgaacttcagcacgttcctggtgatcgggacgacgtcgccggtgacgtaccaggtgctgggccacctcaagacgtgcctggtcctgtcgttcggctacacgctgctgcacgaccccttcaccgcgcggaacatcctgggcatcctcgtcgccatcttcggcatggcgctctactccgtcttctcggtgcgtgagggcaagaagaagtccgcgggcgacgccctcccggtgtcacagatgcctgacaaggaaacggagccgctggtggcgaccaaggacaacagcgacaccaaaaaagccaacggggtagctcacgactgctaagatgtccccgttgcttatatagcttgattagcgcagctctagtgttactacgcactgtctgttctgaatctcagaaggtcagggaagaagccatattccttttgtttcttataatactgtatgtgtagtagcaccattttttttaatggcagtgggggtgttttagcacggtgtacaatttgatgcagcagctcttaaactgttactctgtttccgcgcgactcagcggattgggagtgtacccaccaagctagcaaaaaaa

SEQ ID NO: 11322 - DNA, 923 bp, Sorghum bicolor
  Clone ID: SORBI-28MAY03-CLUS27083_1
gcacgaggcccgagcatttctttccaacaaatctccagcctctgctgctgctaataaactgatcgatcgcgttgttcttgataatcatcagtcgaccgatcgcgatcgggatggcgaagcctagcgtggcggcggtgccggaggttgttggcgtgccagcagcagcgcaggcgacgacgctgttcccgtacccgccaccgcgtggcgccgggatcacagccgccgtcgtgcgccgcaagtgcctgcaggtggagctcggcgcgggggcggccgggccgctgctgggcggcgcgtgctggggcgtggagtcgatgcgcgcgtcgtcccccacgcacgccaaggccgccgccgcgctcgccgccggcgtcgacgaggagcgccgcgccgcctggacggtgcggcacccgtcggcgctgggcaagttcgagcagatcgtggcggcgtccgagggcaagcggatcgtcatgttcctcgactacgacggcacgctgtcgcccatcgtggacgaccccgacgccgccttcatgagcgagacgatgcggatggccgtgcgtagcgtcgccaagcatttcccgacggcgatcgtgagcgggcggtgccgggacaaggtgttcgagttcgtgaagctggcggagctgtactacgccggcagccacggcatggacatcagaggcccagccaaggcctcttcccggcacgcaaaggccaaggcaaaaggcgttctgttccagccggcgagcgagttcctgcccatgatcgaggaggtgcacgaccgccttgtcgagacgacgcgctgcatcccgggggccaaggtggagaacaacaagttctgcgtctccgtccacttcagatgcgtcgacgaaaagatgtggggcgagctgtcagagtcggtgaagggcgtgctgcgggagtacccgaagctg

SEQ ID NO: 11323 - DNA, 619 bp, Sorghum bicolor
  Clone ID: SORBI-28MAY03-CLUS27089_1
gcacggcacgagggcggaacggaaccaccagcgccattagaggccacaccacaccaacgctcctaccttctctcgcgcgcatatacgcatgtatgaggagatactagcaggaggactgctgcaaaggagagggacctgttgatttgaaagatcaatttgaagtagcagattcagaagtgcgtagccgaagcccgaagggcagcatacacagcagctggccaagatgactgccggtttccagctcggtgtgattgggtctcttacgctctccgtcgcgtcatcggttgccattgtcatctgcaacaaagccctcatcagcactctaggctttccatttgctacaactttgacaagctggcacctgatggtgaccttctgcacccttcacgtcgcgcagcgtctgcgcttcttcgagcccaaggccattgatgggcagacggtagttttgtttgggttgctaaatggaacctcgattggccttctgaaccttagcttaggattcaattccattggattctaccagatgacaaagttggccataatacccttcacagtgctattggagactatattcctcaagaaaagattcagtgagacaatcaagttttctcttctggtc

SEQ ID NO: 11324 - DNA, 1083 bp, Sorghum bicolor
  Clone ID: SORBI-28MAY03-CLUS29394_1
gcacgaggccttggcatagttcgggttcctggtattggattgatttacacagagctggtcactggtgtaccctccatcttctcacattttgtcacaaacctccctgccttccatgaagtcctagtcttcctttgtgtgaagtcagtgccagtgccatatgtttcacaagatgagcgataccttgtgggtaggattggacctaaagaatatcggatgtaccgttgcattgttagatatggttacaaagacgtgcagagagatgatgacaattttgagaacatgttagttatgagcattgcaaagttcattatgatggaagccgaggatgcttcttcttcaccaagttatgatatcgctaatgaaggaaggatggcggtcataacaaccactgatgcctctggcagtccattggccatgagggatttcaacggcctagctgactccatgactacgaggagcagcaaatcagaaagccttcgaagtttgcaatcctcttacgagcaagaatccccaagtgtaagccggcgccgccgtgttcgctttgaggtcccagaggaggatgacatgggtcagcaagtgaaagaagaactcatggcactagtggaagcgaaacatgctggggtggcatacatcatgggtcattcttatatcaaagctaggaggagctcaagtttcctgaagaagtttgctattgatgttggctactctttcctccggaagaactgcagaggtccatcagtcactctgcacattccacacattagtctgatagaagtcggcatgatctactatgtttaacctgaagcccattgtataagttcacatgtggatacccgattgggacaaagcttgtgctatctgccgattttcatctggagttcaggcctgtgctttctgggccaaggatcctcgtgtgcttaagtttcagcttgtagagagaaggcagacttccttgttaatattatttttagcctaaataaaccagcagaatgttgccggttacgtttctcatttggcatatttgcatgcatgctctgtaattttttctgcgagctatgtgatggaaatatatgcattctcttt

SEQ ID NO: 11325 - DNA, 1211 bp, Sorghum bicolor
  Clone ID: SORBI-28MAY03-CLUS2896_1
cgtccgggcgtatgcttctcctcttgaacctgttcttccagatgtgtctgttctgatctctggacctcccattaaagatccaggtgctttattgagatatgctttaccaatagataataaagctattcgtgaagttcaaaagccactggaggatatcaccgacagcctcaaggttgctggtgttagagccttggattcagttgaaagaaatatcaagcaagcatcaagagcactgaacaatgggagaagcttaattcttgctggtcttgctgaaccaaaaagagcaaatggagaagagttattgaataagttggctgttggacttgaggagcttcaaagaattgtggaagacagaaatagggatgcgtccgagtagctccaaagcagaaagaacttctccagtatgttggaacctgagatcttgctgggacattgcatttctgcagtgtagaagaagacatggttgatggctttccgtatgaaataccagaagaatacagcaccatgcctcttctcaaaggaagagctaccgtggatatgaaggttaaaattaaggacaatcccaacgtagaagattgtgtatttcggatagttctggatggatataatgctcctgtgaccgctgggaacttcatagatctggtcgaacggaaattctatgatggcatggaaatccaaagagctgatggctttgttgttcaaactggagatccagaggggccagctgagggttttatcgatcccagcaccggcaaaattcgtacagtacctcttgaaataatggttgatggtgataaggctcctgtgtatggtgaaacacttgaagaacttggccgctacaaggctcaaacaaagcttccttttaacgcctttggaacaatggctatggctagagaagaatttgatgacaattctgcttctagtcaaatattttggctcttgaaagagagtgagctaacaccaagcaatgccaatatattggatgggcggtacgcggtatttggatatgtaactgaaaatgaggattacttggcggatgtcaaagttgggggtgtcatcgaatcaatccaagtcgtctcaggcttggacaaccttgtcaacccaagctacaaaattgtaggataacatgcttggtatcagagttccttgtcttcgaatctggtttcgagtcgatgtaaagcgctatatacatctaactctcatatccttct

SEQ ID NO: 11326 - DNA, 367 bp, Sorghum bicolor
  Clone ID: LIB3478-018-P1-K1-C11
ctggaggatatcaccgacagcctcaaggttgctggtgttagagcttggattcagttgaaagaaatatcaagcaagcatcaagagcactgaacaatgggagaagcttaattcttgctggtcttgctgaaccaaaaagagcaaatggagaagagttattgaataagttggctgttggacttgaggagcttcaaagaattgtggaagacagaaatagggatgcagtagctccaaagcagaaagaacttctccagtatgttggaactgtagaagaagacatggttgatggctttccgtatgaaataccagaagaatacatgaccatgcctcttctcaaaggaagagctaccgtggatttgaagttaaaatt

SEQ ID NO: 11327 - DNA, 1104 bp, Sorghum bicolor
  Clone ID: SORBI-28MAY03-CLUS29505_1
gcacgaggatatcttgggctattcgacagcgaagtagaggctgcaagggcttacgataaggccgcaatcaaatgcaatggtagagaggccgtgacgaatttcgagccaagcacatatgatggggagctgctgactgaagttagcactgaagttgctgaagttgatctgaacttgagcatatctcaaccggcatctcagagccccaaaagagataagagctgcctaggcctgcagctccaccatggatcatttgagggctccgaatcgaaaaaaacaaagattgatactccctctgagctgtcgggccaccctcatcggttccctcttatgactgagcatccaccggcctggcctgctcaatctcaccccttcttcacaaatcatgagagtacatcatcgagagaccttaacaggaggcctgaggggggtgctcctagctgggcatggaaggtgacagcagctcctcctcacaccctgccattgccgctgttctcttcgtcatcgtcatccgctgcagcatcatcaggattctccaataccgccacgacagctgccccatcggcctccctccggttcgatgcaccgccatcgtcgtcatcgagccatcatcatcgccgctgagaatcaagaagccacactgtaaatctgctgggaagctggcatttttcccccctctgggcgttgcaactttttcggttttgcgccggctggggtggtttcttgtagtggatcgattggattcttcataactgtatttgcacactgtcatactgcccaagtgaaaatgctcctctctttacactacacagtacacacactgctgctcttggagctactgttgctgctagagattgactaacttaagcatctgagatactttgattgatctatatatacattgtgtagagaatatatcattgctgaaactattgacagaagtatatacaggtttgttccaggtcactcaccactagcttggtaatttgtaatctctgctacaagggttcttttatagctacgtcatgtaattctcttaatcttaatgaaacatgggctatattcccccatcgcggaaaattaacagaagtattatatacagttttc

SEQ ID NO: 11328 - DNA, 844 bp, Sorghum bicolor
  Clone ID: SORBI-28MAY03-CLUS29502_1
gcacgagggtcatcttctgggtgcccgtctacgaccgcgtcatcgtgcccgtcgtgcgctcctacaccggccgtccccgagggttcacgcagctgcagcggatgggcatcggcctcgtcgtctccatcttctccatggtggcggcgggcgtgctggacatcgtgcggctgaacgccgtggcgcggcacggcctgtacggcaaggacgaccacgtgcccatctccatcttctggcagataccgcagtacttcatcatcgggtgcgcggaggtgttcaccttcgtggggcagctggagttcttctacgaccaggcgcccgacgccatgaggagcatgtgctccgcgctgtcgctcaccaccgtcgcgctcggcaactacctcagcacggtgctggtgaccatcgtcacgcacatcaccaccaggaacggcaacatcgggtggatcccggagaacctcaaccggggccacctcgactacttcttctggctgctcgccgtgctcagcctcctcaacttcctcgtctacctcgtcatcgccacctggtacaagtacaagaagacggccgatgatatcccggacgccaaaggggagcactgatgggcagggcagttgacacttgacactactacagcatgatggccgactcagtgaaccgagatggcgaaaatgaagtgatttctctctgtggtcgttagctgccggtttgttttgccagagtctgtgtgcttaaacgatacttttagttcactgtagatgcctggggcgaatccattgttcagatgtcatgtgttggttttatatgcgcaatgctcgatcccaatgatcattcctagatctatgaaata

SEQ ID NO: 11329 - DNA, 1387 bp, Sorghum bicolor
  Clone ID: SORBI-28MAY03-CLUS29668_1
gcacgaggagacgatggccatgttgccagtgccagcacaacggaaagacctgtggtagctccagctgaaaggagaaccaggagcgggactcctcaccgaaaaagaccgaagtccaaagtgtgggaggaatttacaaaaatttttagagacggaaaacttcaagcagcagtctgtaaacattgtgaaagttcccttagtgcaaaaactacaggaggaacaagccatctgaaacgacatctgcagtcctgtcctggacgaccttcaacaggtcgggtgcagctgcaacggccattttcacatcctaattcatctgttcagaagaatttgaatttagatcaaaacaagtctcttgaattgctcatcaaggttttagtgtccaaccttttcccctctccatttacaagcagcacaatttttaggcagttttgggctggcatcagtcctactaatgatatggtatcgccagctgctattgaagagaagtttctcagtatttttcagactgaaaagcttaagcttcaggaggaaatagaacttgcacctggtggagtttttctgacagttgctggcagttctcttgaacttaagtgcgtcatctttttgatggtgcacttcattgataaagaatggaacttgaataggaaaatcattagatgttgctttacagggtgtgaagactctgatgctgagtattatgctagcatgtttccctttttgaaatcgtactattatatctttaatgggaatgtgagagcagtccaaatagaaatagtgaaagaggtagtacaaaattggaagcctgtgtgcaagctgctcgggtggtcctcggccaagtcattagataccttgaaggagagcttattcctcaaaatgccaattttgatattttgaaatggtggaaggaaaatgcttcaacatatccagctctttccaggctggctcgcgacatcttagcgattcctggatctgcggtctctgccgaatctgcatttgatgaaactgatgaacggacgagccttttcaatcggaagctgagccctgaactaattgaggccctcatctgtacccaggattggatcaaatcttcagaaataatttctgacgaagttggtggaaacataaacatgcctgcttaatgcacagcaagctcctccagccttttcactggttcaataaaaactgaagagcccttccgaccttatctgcatcttgccttctcagtataatgcatgacagaagtctaactggcaatggtttgtaataacttgttttgttgcatcattcagcatggaacatatgaacaatattagtttttaagttaattgcacagtacatgaaaggctgaaatatatacaaaacttcaaaaaccaacagttggttttgctgt

SEQ ID NO: 11330 - DNA, 696 bp, Sorghum bicolor
  Clone ID: SORBI-28MAY03-CLUS29694_1
tcaaccttcacaaagccacaggaaacccagtcctggtatgcatggtagctggaagattcgcatacgagatcgagaagctgtctgatgaagaatccgtcaactttgttatgtcccagctcaggaaaatgctaccgcaggcaactgaaccggttcagtatttggtttcacgttggggcagtgacccaaactcacttggctcctactcgtgcgacctggtggggaaaccggctgacctgtatgaaagattctgtgctccggttggcaacctgttcttcgctggggaggccgcctgcattgaccactccgggtcggtgcatggagcttattcgtcaggcattgccgctgcagaggactgccgaaggcgtctgtcgacgcagctaggcatctccgacctgttccaggtcgcgaaggttgtcatgagggaggagatgaatgaagtcatggttccctttcagatatcgaggctgtaagagagaacaccaacaccgtgttgtgtagtgatgattgtgccatcctgaagctgacgcggcagacaaggttaacgcggaacaatatagctgccttcaattcacggcatatattgccttcaaaactgttgtattgtcgcatgcagtttgttgttcgacgtaactctatctaaaataatgtaagacctttgttgttggaagatcaaaaaaaaaaaaaaaaaaggccaca

SEQ ID NO: 11331 - DNA, 674 bp, Sorghum bicolor
  Clone ID: SORBI-28MAY03-CLUS46569_1
tctggctgcgatgcaaccctccctccagcaccccgcccgactctctctcttgcgacgaaaaaaggaaacaaactcgcagatccgcccccctcccagatcctgctcggcgcctgcgcccgcgtcttcctgcaatcgccgccgcggaagccacccctccctccttcccccggtggccggtgctcagatcggcgcaaggacgaagcaacccagtcgcgccgctggtgaggaggacgcctgcttctcccccaaaggcgacgacccatgccgccatctcccgtgccaacgacaccgcccccgacagcgatgaggccccaccaccgtctcccacggcaacgccaccggtcaacagctcgcccgcgacgcgtctcctcgccctcacgctcacgctacgcgctgccacctcgacgccattccacgacctggcccgttgatgccaccggacaggccaccgccttcacgccaccagacgcgccaaagcttccatgatctacccctttgacgttgattcaaaccaccaccttcacgacgccggaaacaccgccacctccacaccctgccttgccgtcagtgcttcacgccgtcgctgctccatgccaccggatgccagcctctagccagcaacgagggcccaacaggtatggcatatcttctcttcactgtgactaactttgatc

SEQ ID NO: 11332 - DNA, 730 bp, Sorghum bicolor
  Clone ID: SORBI-28MAY03-CLUS4661_1
tgcggtgcgattcctccggggtgcggcaggcgcggggtgcggcaggtactccgaccccatcggttgaccgtcctccaccaaaccgacctgacctgtgccgcctataaatccaacccaccccggcggccttcttcctttcgttgatagatagatgaaccgcgtggtcgggatccctcttccttccttccttccctgttctctcgtcggtgcgccatgggggtggatgggtaagtggtaggtaaggcgcagttgttgttggtttcgatctgacgcgtctctctgtttctcgaattcataaggtgtgacggactgaactagccggatggatggatccatttcttttaggttggatggttgttagctattttctctgtacccgtcgtcgggtgtcctactaattaccatttgctgattgacttatatatctaggttattatgctgttgtttacgatgactagggctgtgcagttattttgattcgattgccgttcattctggtgggaggataaggcgtctcggttggtgatctgttgatagcactttgtgttgagtcagatctatttgattggttagcctggatgtttttggcatgatcggatcaagatgaattgaagggtgtgtggtttttggttcgtccatgctgtgatctgttcagttgctgtgatctgtttcagttgaaggttgttgattggctgcttgtatctcttcttccttaggatgctgattttgt

SEQ ID NO: 11333 - DNA, 1029 bp, Sorghum bicolor
  Clone ID: SORBI-28MAY03-CLUS46780_1
gcacgaggagaaagagacatcacaacacacatttctgggaaataccaaggacaagacacctccacaaagtcttccagagccatcgaagaaaccaagaaagtttcaggcaccacttactaaggatgatatgaaagatataaagtgtggtatggagattggtctcacatctccaaatagtaaaaagctggtggcactagggactgttcagaaaactgataggaaagctaaagctaatgatggtcaaccattggcggattatattgaggtactagtcagtattgtttataaacaaacaaccatattgcctcgttcacatgggaagatacaaaatctgggaagtgctactgctcgctgcataccatggccgccccgggttatcatttgtagagatggcactccgttgcactctaaacaggtttgtagccccattagcaaaatcaccccaaacacaagaggaactgtaggaccaaaaaggtcaacatcaaaagctgatgctacaaggttggacaaaggccaagttgcttcacagggtttgctagaaaataagcaagcaaagaggaatgtgagtaaagaagaaacagagcaacttacatcatccaagtatgtagagggccacaaaagcaacatacatataacaacgtctcgatgttagtacaattaaaagagcaattgacaagtgaggacaacagacatgtatatagctggatgtgggcatgtcattttcaagcaggagtaacataatttggtttctgaacattgatggccagtactgtggcaacatagtatatttagatggatttatacttacatatatatatatatatagctgtgatgtggacactcttataaaaggagaaagaaacttgcatcaggaatggggacctagacatcaggacttggaacatcatttgaattgactatttttcaaccttattgattgtgtttggttacaaatataactgtgtatagcctgaaaggttaaatgtttggatcatgttgttaacgtgtatttctattggttaatttctc

SEQ ID NO: 11334 - DNA, 671 bp, Sorghum bicolor
  Clone ID: SORBI-28MAY03-CLUS46987_1
atacttgatggggagacacaacttgcttgtagaagtcccttgcaggggcacggtaagaacattcaatcgctttgttgggattctgctggtgaatatctggcgtctgtcagtgaagactcggtcagaatatggtcattcagttctggacgtgatggtgaatttgtgcacgaattgaatcgcagtggaaatcaattccattcatgtgttttccacccaacttatcaatcattgctagtgattggttgttatgagtctttggaactttgggacataagggataagaacaccatgaccttcaatgcgcacgacggtttggttgcagccctggcagcatccagtgcaacagggaaggttgcctctgtaagccatgataggactctcaagctctggaaatgacttgtataatagcggccgatgttggacttttacattctggctgttagatgatagagaaacaagacgattttcttccaaagatgaccacatgacgaaaaggtagctaacaagatactctggagccgcgtgggctcaaagaactaacggtgttttgttttgtggtcgtcgttgtgtgctgttcaatatgctactgaagcttgtaactcctaatagagatgttggttgttaatgacttaaagtttgtcccttggccacattgccaatacttgttccct

SEQ ID NO: 11335 - DNA, 668 bp, Sorghum bicolor
  Clone ID: SORBI-28MAY03-CLUS30134_1
tgcaaacgtgcaaaccaaggggaccagaggacaggcccctctccctctctctccccaatctccacaggacttgttgagcttttaagcagctagtagcctagagcactagcagtccttttggattttggtttgggaaacaaggcgtcccagtcccaaatctcaagcaagcaagcaagcaatctgcagatggcaacacagtggttctccaacatggtgatggacgagccgagcttcttccaccagtggcagtcggacgcgctgctagagcagtacacggagcagcagatcgcggtggcgttcgggcagggggaggtggaccacgccgtggcggcggcgctgtcgacgatgccgcagcagcagcagcagcagcaacccgcggtggcggccgagcaccgcccgcgcaaggcggccaaggtcaacaccagctgggactcgtgcatcacggagcagggctcccccgcggactcctcctcgccgcccctcctctccttcggcggccacgccgcggccgcgttcgccaagccggagccgcacccgcaccaggcgcccagcgccgccgcgtactacggcgccgcggcggcggccgccaaggcgccgaagcaggaggtgctggacgccgccgcgctgccgttcccggctaagcgttcctacgacgacatggccgaggc

SEQ ID NO: 11336 - DNA, 738 bp, Sorghum bicolor
  Clone ID: SORBI-28MAY03-CLUS3016_1
cgtccgctgctgatcaccatattcattactttgacttacgtaatccaagtgcgcctgtccatatttttggtggccacaagaaagcagtatcgtatgtgaaattcttatctaacaatgagcttgcatctgcatcaacagatagcacattacgcttatgggatgtcaaggataattgtccggtacggacgttcagagggcacaaaaatgaaaagaacttcgttgggttgtctgtgaacaatgagtatattgcttgtggaagtgaaacaaatgaggtttttgtttatcacaaggctatctcaaaaccggcagcaagccatagatttgtatcctctgacctggatgatgccgatgatgatcctggttcttatttcattagtgctgtctgctggaagagtgatagccctaccatgttaaccgctaacagtcagggaaccataaaagttcttgtacttgctccttgatgttatggaaggcgttcaagagatttacagccagcttgtatgtcttaatgtccagttgtttcctttcatgccattatatttccccaaaagtgggaacggaggcattgctgatctccggttagggcatgaagttttgcagatggtcagctgacgtagggttttgaggtatcagaatgtgcataatcatgttaatgtcgtataggtgtaaagcagccaagttatcggttacaagtgtaacacgagaaatacacattaataaaactccagcccgtttgtc

SEQ ID NO: 11337 - DNA, 1339 bp, Sorghum bicolor
  Clone ID: SORBI-28MAY03-CLUS3039_1
tgggtcggcaactgaaaaaaaggaggttctgttagaagatcatgaccctgtctggcttgagcttaggcatgcacatatagcagatgcaagtgagagactacatgataaaatgactaacttcatttcaaagaacaaagctgcacaattgcaccaagcacgaaccggtggggaattatctacaagagatttacaaaaaatggttcaggctcttccacagtacaatgatcaaattgataagctttccctgcatgttgagattgcaggaaaactcaataacataatacgggaacaatgtcttcgggatgttggacaactagagcaagatcttgtgtttggtgatgctggaacaaaagaactaatcaactttttgagaacacaattggttgtaagtcgtgaaaataagttgcgcttgctgatgatttatgcagcacttaacccggagaagtttgaaagcgacaagggtgcaaaattaatgcagttcgtcggattatctgctgatgacatgattgctgtaaataatatgcgttgcttatgtgggcctgataccaaaaagtcttcagtagggggttttgcactgaaatttgatgtccataagaagaagcacgcacatcgaaaagagcgaacaggggaagaatcagcatgggcactatcccgattttatcctattttggaggaattgattgaaaagcttagcaaaggtgagcttccaaaagatgaatataactgtatgaacgaccctagtcctagtgctcatggaccgccaaccagtagctctgcccgatcaagtcccgctcactctatgcgatccagacgaacaggtggcacatgggctagacctcgtggctctgatgatggatattcaagtgattctgtgttgaaacatgcctccagtgacttcaggaagcttggtcagcgtatatttgtttttgtaataggcggtgctactcgatcagagttacgtgctgcacacaagctttcatccaagctgaagcgagacatcatccttggttcatctagccttgatgatcctccccagttcatcacaaaattaaagttgatgtcagcagaagaattgacacttgatgatcttcagctgtaaatggcgtcatcgccccctttgaatgggttagttcaatatgaactttcgccataagttgtatgtaacctttttattttctttttagttttctgtccgctcttgtttgtgcgggcatatcatattcattcggtgaaatgtattcttaacaccacttttactggtgaatgtatataaatagtggccgacataactatacggatcagtttttttagattgggttggtttgttgtttccttctct

SEQ ID NO: 11338 - DNA, 792 bp, Sorghum bicolor
  Clone ID: SORBI-28MAY03-CLUS30493_1
gctcgcacgagggctgacttttgcttaggaccttggacgccttcgctgtccttgcttccgcgctcgctccccgccgacccgccgctcccaaatcccatccaaattcttccgcgtctttcaaagatcggattttgggaggggcaccgcccccagatcggggaggaatccccgttcggtctggtgggttggcctccgctgctcgcttctttgctcttttctcctctcacaagggcggctcttggatgggctgcctgccgtgcttcgggtcggctggtgagggggcggccaagaaggttggtgcgcggaaggacggttcgtcggatcgtcgcgtcacccgggttgaatcagataaatcaaaagcacatggtggaccagactctaagaaggatgcagtcatcctgagggatgggagcaatcaacatattgcagcacacactttcacttttcgtgaacttgcagctgccactaagaacttcagacaagattgcttattgggtgagggaggttttggtcgtgtttataaaggacgtttggagaatgggcaggttgttgcagtgaagcaacttgatcgcaatggtcttcaaggaaacagggagtttctggttgaggttctaatgcttagtctgttgcaccatgacaacctagtgaacctaattggatactgtgctgatggggaccaacgtcttcttgtatacgagtttatgccattgggatcacttgaggatcatttgcatgatattccacctgaaaaggaacctctggactggaatacacgtatgaagattgctgctg

SEQ ID NO: 11339 - DNA, 1075 bp, Sorghum bicolor
  Clone ID: SORBI-28MAY03-CLUS30483_1
gcacgaggagtgtgcacaaccatccgcccccgaactccgcctccgcagtcggcctccacctccacctgcggccccacctccccccctgtgcttgtccgctcccgccggtccccgattccactcccggctgctgctccgctttcctctccactctgctgccgctgggcctgctggatctgcaccgagcccggcagactagcggcgccgccttcgactctacctgacccggccgccagccggctgccgtgcaggtgcaggtgcgccaatcccggcgccgctcctgccctccacccgcggcagcaggcccccgcactggccccccgccagatcctgctcctcccccttgtccgagttcatggtcctgtcggcgtcggaacccgacgcgcaagccgcggtctccccaggtcctcatcaagctttagcatattgccgactctttcgaggacaagttcagcctcgacctatcccacactaacacgactgacatggccggcacggttgttctccatccatgcgcctggggtcacgcacgtgctagtcaccggtggcgctggctacatcggctcgcacgccgctcttcgcctgctcaaggactccttcagagtcaccatagtggtcgatcctccttgcttccttcttcactcctccgcgacctcccgtctcctgctcctgctcaaatcctgcgtcgttcctgtccgagttttccatatctgggatgcttacggttatggtacacacttgtgctgtctccaggacaatctttcgagagggaatatcggggcgatcaaagttctccagaacctgtttccagagcctgggcggttgcagttcatacaggctgatttaggagatccagaagctgtatcctgattgcttttaattctctgtgcaatgcaaataatcgaatgcctccgtacgtactctcatattccgtttaattagaacacattaaatatgacaagaaaaaaaaaagattactcttgtgatttcatttccttaataacatatcctctcaggttaatagaatatttgcagagaacgcatttgatgctggtatgcactttgctgctgtggc

SEQ ID NO: 11340 - DNA, 615 bp, Sorghum bicolor
  Clone ID: SORBI-28MAY03-CLUS31439_1
gcacgaggcacaagtcaagtcagtccgagccccgcaggtgtcgacaccgcgccgcgagggtggggggaaggggggaactggggaccatgagcgcgcccgggcgagctccgtgcggcctgccgcgcatcgggctgggcacggcggtgcagggcccgcggccggaccccgtccgcgccgcggtgctccgcgccatccagctcggctaccgccacttcgacacggccgcgcactacgccaccgaggcgcccatcggggaggccgccgccgaggccgtgcgtgcgggggtcgtcgcctcccgcgaggagctcttcatcacgtccaaggtctggtgcgccgacgcgcacccggacagggtgctcccggcgctccgccggacgctcagcaatctccagatggagtacgtggatctgtacatggtccactggcccgtgaccatgaaggccgggaggtacacggcccccttcacgcccgaggacttcgagccgttcgacatgcgatccgtgtgggaggccatggaggagtgccaccgcctgggcctcgccaaggccatcggcgtctgcaacttctcctgcaagaagctcgacaccctgctgtccttcgccaccatccctcccc

SEQ ID NO: 11341 - DNA, 988 bp, Sorghum bicolor
  Clone ID: SORBI-28MAY03-CLUS28620_1
gcacgagggtgctccagcagcacggccacggccccgtccgcggccacggcggcggaggggagccccccgccacggccgcgtccatcgccgcgctgcccacggtcgaggtggccgagcccactcgccgtctgcgccatctgcaaggacgacctgccgctcgcctccgaggcaaggaagctcccctgcgcccacctctaccactccttctgcatcgtcacctggctccagatgcacaactcctgccccgtctgccgcttccgcatccccgacgacgaggccgcgccgttggagcaggaccccgcgccgcccaccacgcggatcaccatccgcttcacgaccaccacgcgccgccgcgtccgcgtcggcggcgacgcgacgctggcggcggctcctatctcggcgtcgcccacgcagctcgctcaggctattaccggggatggagctggtggacctgccaatagcggcgagactgtgtcgtctgagtggcctccgcaccccgagtccgatacagtcatgtcggaggcacgcgagggggatgccatttttgattgagccagaggttccagtcgtcaggtgataaggtagctgttgttagctgtcagccaacaagagtgaaaggaggccaccatatgcttcctgtctttgtttggacgaggtttctcgcaagatgatggcatgttgttacagctgaactaagttgtcctgttaggagaacaagagcattcgttgcatgggttctcggtgtcttgtatattggtggttaaacatatttattcataataaatatagtcatgtacaatatgcagtatttcgcttccccattaccctgcaacttgacctgcattggtaggtaaatatggaatgcattggtgtccagtggatatggattatactctgttgatgaagctgccttcttgctcgaaggcgagttagactgggagcctgggattgtagcaatgaagttatgacccctgaattctatggaggt

SEQ ID NO: 11342 - DNA, 909 bp, Sorghum bicolor
  Clone ID: SORBI-28MAY03-CLUS28714_1
gcaccagcgggaagagatagggttcttggcaccaacagaggctgggcgtgcagcgtgcacgcttggacgatgccgctccagcatggccctcgacttcgaatggccgcagcctccggcgcggctcgtcgtccccgcagtcgtctccccggccgacctacaagcctcccgtgcggcggcagcaggacaaggacgacggcgctggttcttgtagccgcaacgacaagagaaggggcgaagacgacggcggcagtggccacggccacggcggcggacgtggtgagggcgttctacgacggcgtgaaccggcgggacctggcggcggtggagccgctcatcgcggagggctgcgtgtacgaggacctggtgttcccgcggcccttcgtggggcgggagcggatcatcggcttcttcggcgagttcatgggcaccatcagccccgacctccagttcgtcatcgacgacatctccgccgacgactccgccgccgtcggggtcacctggcacctggagtggagggggaagccgtttcctttcagcaggggatgcagcttctaccgcttgctcgccggctcggagtcggagtcggagcagcagccgctgcagattgtgtatggccgagactgcgtggagcctgccgccaagcctggggatttggcactggtgatcatcaggggagtgacatggatccttgaacgatttccaagccttgcaagcaggttcatgatgaccttttatgagcacaaccgcgaaggcgccaactgaggcaatagctacaggctaggctacgcagcttgttcaaaatgtccggtgagagcaagcgtgtataatgttgagtagtactcgttctaaattataaaaggtgtgttattttcgagatgcattattttaactatgtacttagatacatag

SEQ ID NO: 11343 - DNA, 763 bp, Sorghum bicolor
  Clone ID: SORBI-28MAY03-CLUS28664_1
gcacgagggcacaacatatatacagtaccaaagcacgaggcttccccctaaagcagcatcagctactataccactgactcttgcacacacagttctgcacaaacaggacagatatatcaagtgaccgaccatggcatcccaggccatcgagagccaccgtgccggcgctgaggtcgtcaccggaggagacgccatctgcaggaagaagctaatcgagctgctggaggagctcggcctccccaaaggcttcctgcccctcgaggacatccaggagttcggtttcaaccgccagacagggttcatgtggctggtgcaggggaagaagaaggtggagcacaccttcaagaagatcaagcagaccgtgtcgtacgccgccgaggtaacggcatttgctgacaagggtaagctgagtaagatcaccggcgtaaagacaaaggagctgatgctttggctcagcgtcgtcgaggtgtacgtccccgaggcatcgccagagaaggttaccttcaagaccggcactggcctctctgacacctttgatgcctctgcctttgcgttaggagagtaatcagctgtcacatgaatggttggcttcagaaaatgttgagtgagctgcataatttttcttttgtatttgtaaacttccatgtatgtatcatgtatcttgtgacgaatttgtacctaggagtactcatactcattcatgggctagggtcattgcaaacctttctacgcaatttcttgttctgcagtatatataagcgtt

SEQ ID NO: 11344 - DNA, 756 bp, Sorghum bicolor
  Clone ID: SORBI-28MAY03-CLUS28731_1
gcgcgcggggcgtggcggagcgccttgcccaggccacaggctgctgccgtggacagggtggttccatgcacatgttctctgctccccacaacctccttggaggctttgccttcatcggagagggcatccctgttgccactggtgcagcctttgcagctaaggaccgtcatgagcggctcctgagctgaagagcattgaaaagaagattgatgatgttgttgaggaggctgttgagtttgctgacgcaagcccgcatccaccacggggccagcgctcggctttcgtggctgccgaccccgtgggctgtggtgtccgccctgtgggcaagtgcagtggcgcgcctcccggcttcacccgacccacagctctggttgaaggcgccttctttgggggtgcctctgctccctcttcctcggttcctcggcccgctggtctggtcgaaccaatgtcatgttaaggatactgtacgcataaggcggttaatttatttcgattcttaggcgtgtgtctgatattattgtgtaatttgttcaaatgctcatactgatgcgtgccccaggttttatgaaatgtgcggtacctcagcttgttcaggaacagctcagtttcaacatctataaaagtatgtgaaatggcttcggggttgttacggaggttgttcggctctcccgccccccggtccgcggggctctagctgtgtcgaaccaatgtcatgttaaggatactgtacgcataaggcggttaatttatttcgat

SEQ ID NO: 11345 - DNA, 1429 bp, Sorghum bicolor
  Clone ID: SORBI-28MAY03-CLUS29299_1
gcacgaggcagaaccccagatccaccgctccccatttcgatccgcggccatggcctccgccgacgccgacgccgggacctgcccgtgggacgccctcccgtcgcacctccaggagcgcatcctctccctcctccccatcaccgagctacttcccgtcgccgcggtgtcccgcgcgctccgccgcctcctgcggtccccggcgttccacgccctcctatccccgcaccgcctcgacgccttcttcctcctttccccacggctcgccgtccacccgctgtcccgccgcgtcctcactttgcctgcgctcgccgcgctctctcccccttcctacccgctcgtctcctccccgtccccatcgctcctcatcacctgcgcctcactccagttcctcccgccgatccccgacggagcctacctcctctccgttatcgtcccgtcgcgccgctcctccccctcctgcaccctcgtcgctgtcaccaccggcgcagccgtgcgttctcacaccctggacaccggcgatccctccccgcgttgggcgtctagaggcgatctcccgctgtctctcacgatcctgggaaacgccgcagtcgcccgtgaccgcggcaagctcttcgtcctcggccgtggtcccgacgcgctcttggcttttgatctcgtgacggggacatgggaaggtgccgcctgttgtgatgccacaaggtctcactacggcgcacctgtttgtttttgatgggagcctgttcttagtaggtgggatcgagagctttggagaagtggagcgggtggtggtctggcggctggacgtcgataaggaggaggtgtggtggtggagggaggtgagcgagatgccgaccgaggttttcgatgagttgctggctggtaggtttggcagtttctggcattttcaggctgcggacagattggggattgtttgcttgtacaatgccgtggatgggaggctggtcatgtttgatgcatctgatggcgcgtggactgtgctgccacgattgtctgggttggatgcagacgagagcctcaggtggtttggacatgtcttggagccaggagttgaaatcttgatgggactacgttgatctcatgttcacgtcattaaactcacaaagctgaagttactaaaagaggtgtatgcaagttgctggcaattaccaatgcattagagctcctgaaggtttcttttactcagctcatcatcgtgttcagaagcacaagctgcattaatgtgtaacttttcacagagcaaaattcttaccatcctttccttttggagagagagagaagaacttcatggttagaatgtgtaacttatctatcaatatatcatatctctctcttttcgtttctttgctatgctgtacccagctttgatctgtacgtcccccatgttacatatgaaaaatcaaatttattg

SEQ ID NO: 11346 - DNA, 1264 bp, Sorghum bicolor
  Clone ID: SORBI-28MAY03-CLUS30790_1
gcacgaggcaatcaccaagcagtggaactcagatgatcacttagcactacgctttcccatcaggttgaggactgaagcaattaaaggtaactcatgaagtttcacccaatccaagattgaaggatgaattggttaacttatctcatatattatatttcatcatgataaccagtggttgtaataaaatacatataggacgctagtagaagtaacagattttgctcccatgtgtgctaatattgagatttttgtataccgagaatcttgaactgaatattaactgctagctatcccttcagatgacagaccggagtatgcatctcttcaagcagtcctgtttggaccatttgttcttgctggcctatccaccggtgactgggatgcaaaagctggcaatggcagtgcaatttcagattggatcaccgctgtccctccagcgcacaactcacagctggtaaccttcagtcaagtatcaaatgggaaaacatttgtcctctcaagcgcaaatgggaccctgacaatgcaagagcgacctgaagttgatggcactgacactgccatccatgcaacattcagggcacatcctcaggactcaacagagctgcatgacatctaccgaacaattgcaaagggagcatcgattctgatcgaaccatttgacttgccaggaacagtgatcaccaataacctcactctatctgcacagaagagcacagattgcctcttcaacctagtgcccgggcttgatgggaatcctaactcagtttcccttgagcttgggaccagaccaggatgcttcctggtgacaggcacgaattattctgcggggacgaagattcaagtcagctgcaagagttcccttgagagcattggtgggatactcgagcaagcggcgagcttttcacaaactgatccattaaggcagtaccacccaatcagcttcgttgctaaggggatgaccaggaacttcctccttgagccattgtacagtttgagggacgaattctacacggtttatttcaacatcggggcctgagtcctgaaacttacacttgcagtagaaataatacagaataaataatgggcgacctttttcttctcatacactgtagcttagaacagccaatgaaagagtaaatgagttgtttcatgtgtattcctcgcatatattcacttatgtgaaatcacttattatgcaataccaagcaattcataccccgctttttttaccatttgagtaaggaagttatttgtgataacgtgg

SEQ ID NO: 11347 - DNA, 733 bp, Sorghum bicolor
  Clone ID: SORBI-28MAY03-CLUS30797_1
catcagataaggtagccttcattttcgatctgattaaactctatgaggatgacccaaaaacattggacagctgcttgaggcgtattatgtgttcatctaagatactaaagcttggctatgacattcaatgtgatcttcatcaactaacgcaatcctatggagaattggattgttttcagtcctatgaaatgctacttgatatgcagaagctgtttaaaggggttactggtggcctctctggattgtcgaaggaaatattaggagctggtttgaataagtcccggcgtaatagcaactgggagcaacggccgctaacccaaaatcagaaagagtatgctgctcttgacgctgtggtccttgtgcatatattccatgaacacatgcggaggcaagcacagtttggtgtctctgagggaagcaaagtggaatggaagtctcatgttgtttcccgagtgaatagcatgcgtaggccattgcgtttctagtagggttagacaagctgattaatgctggagtgaatatttctaacatctacatgtgccgtcttttggagcataaacttccgaggagccagctttgtttcctttgacagttctctggcatcataggctcatagttgatccccagaatctagtgctgcgacttcgttactcttgccttgtatatatttacctccatcagaagtttttactttccctgctgtatcgcattcatgctgagtgcaatcgcgccc

SEQ ID NO: 11348 - DNA, 780 bp, Sorghum bicolor
  Clone ID: SORBI-28MAY03-CLUS30804_1
ccttggcggtgtgtgttctgcgggacttttggtcgcccagaatgccgggttcccttggcgcgttgagtacctggtttggctcggggacccagaatgcctggcctgggtgaggcgggcagtgtctcacttgccgcgtctcctgttatccccttgccgggggggatggcgcgccggggctccccccgcgcctcctgaaagggcaccggtggttgtaacggcgacccggcggtgcccgggcccccagctgtcggggtctgccatgctgggcctgcactaggcggagctggcctccccatttgtcaagatgttccatgctgggacagcactagacgaagatggcaatcttgtcgccgttggaggccgagttcttggtgtcactgccaagggcaaggacatcgaagaagcaagggcaagagcatatgatgcggtagatgctgttgattggccagaagggttcttcaggcgtgacattggttggcgagcactgaggcacaagcaagtggctaactgcctatgactatggggttttcacagagaaccacaactaaggtgatcttgtagtgttataaggaataaaaaaagggaaacgtgtaaccttcactgtttttggttgtggaaagacaatgtattgctggtcaaacagcagcatgttcaaattttaacacctgctggtttcagtatatgtagatgttttgtgttcacagagtgaaaacgtgctgaattctgaccaattgtgtcttcaattttcagacaagtggatcttctcccaaataattgtga

SEQ ID NO: 11349 - DNA, 976 bp, Sorghum bicolor
  Clone ID: SORBI-28MAY03-CLUS31231_1
gcacgaggcatataacagaggtattctaaacaatttcctagagatattctgcactgctattcccccttcgaagaacaatttccgggcaagggtgacagtagagcaagggctacaccaaacgcgctcacagtctagaggtttcatgagccctagcatgggcaagcccattggagatcttgaaatgggtaggaagccagtagcaccctgggacgagccaaggacggcagctgatatcagggacttggaaacagggctcgggggcatgtttgatgagaaagagggcagagtggcccatgcgtccccagatctgagcagagatcttccggcagagtttgtggaagggcgatctggcatgcactcgaggcagtcaagttgggttcagagagcaggtgatgcattcgaagcatcgatggtgcaaatggctaatgcccgcacagccgaagctagcaacaatgttgcccggagcggcacacgttagcctgaaaaagggggtgggaaagagtggaactacggtgtgtttcagttgtgtctcaaggtgggtgttggtggtggtgatgtctcgaggtgaactgccatgtgtttattgccacgtgtgccagggcccgcaaggccctggatcattgtaatcctaaacacaagctttctgttgttgtttcatccctggtagcgcatctgatccctgtttgtttgtttgtttgggtgttttcacaaattaaggtagccgcgagcttaggctcctgcccggtctggctgatgtatctgtatatatataataactaaattattatcaggttgcaacggatgctgtgtttggtttgccacaccgctgcttgtgctttggttactcggagtggcggcatctgggtgcccccatgtaagattactcttggtgtaaccacggtggaagcacctggaaatctggcactgttgtattatattatgcggatggtctgtatggttgtcaaaaaaaaaaaaa

SEQ ID NO: 11350 - DNA, 976 bp, Sorghum bicolor
  Clone ID: SORBI-28MAY03-CLUS31121_1
gcacgaggctctctcctcgctctcggcgatggatgggcgaccgccgccgccgtactacgccaggtcttccgcgcttcccgagggctacgccaggcctttcgccggtgaagaacacccatcagattcccgagttggttatcctaattatcttgcacctgagggctctgtagcatcgtactatacttcaagaccttctgttctaccgggtggaccagatgttcttagaaatgatgtaatgttgcaaccaagtggatatggttatgatggtccggtaggagtgatgaatcctgctttggttggcgcacgaggactacctgttggagctatgccgcgagggtctagtgctttggaagacccatctttggctgggctgagtgtacgtgctccagccagggcactgggacctagtcctttgaaagaagaaccagatgtagtagggagaagttcttctctagtcccaggtgctagtattccagatgttgagcgccacagcacacttcaaaactttgatgggccctcagaagatgaatccaacattctttttgttgattgtcttcctactgattgcacaaggagagaagtagctcatttgttccgtgtttttcctggcttcaaggacatcagagtagtgcactagggacccagacgtagtggtgacaaggcttatgttctgtgctttgtggagtttgagaatgcaaaatgtgcaggctgtcctatgagagagttacaaggatactgctttgatgaccggaagcctgacagccctcgtcttaagatccaattcgcaaggttccctttcgctttgcctgccgcccaggatcatcataagaaacgctagcagtgtagcctgtgcaatgggcaccgtagatggtctatgatcagcctgtatgtaaaactgttttagtgagcagttaaaactgtcaggaatttcgtgtgacaccaacacatggaatgataggaatgtgccttcttttcc

SEQ ID NO: 11351 - DNA, 636 bp, Sorghum bicolor
  Clone ID: SORBI-28MAY03-CLUS29797_1
ctactcaaagaccctgacttctgtaggcgaccaagtagtccagtgcagcgccgcaagtttctctccagatcagatcagttcattcgcaacgtcacaggtggattacatcctgggagacaatccaaagggcatgtcgtacatggtgggcttcagctccaagttcccaaggcggattcaccaccgcggctcctccatcccgtccatcaaggttctccccaggaaggtcacctgcaacgagggcttctcgtcatggttcccgaccagcaacgccaaccctaacaaccatgtcggcgccatcgtcggcggacctgacgggaacgaccagttcagtgacaacagggaggactccacgcactccgagccagcaacgtacatcaacgccgcatttgtgggtgcctgcgctgctgccctcgggcagcagaaccagctcaaggagcctgtggacaacatagccccagtggacatcatctaactagagcagaaaggtacacagcatatgttaaggactaaggacatggtctgtcaaaagttccaatcatgctatcgccttgtaacatcaaggtttacttatatctacccctacccttgatcatcctgtatgacatgataagaagaaataaataaatataaggcccc

SEQ ID NO: 11352 - DNA, 886 bp, Sorghum bicolor
  unsure (1)..(886): unsure at all n locations
  Clone ID: SORBI-28MAY03-CLUS2984_1
gtgcggcgctcgagncnngccnggttcgggagtttgccgctctgctgcgcctcagcagccagtttctcccgtctgggacaggaaagtgagcagagaaccaggaggagctgatggcgtccaactacgtcgacaccgtggtggaggagagcaggttccacggccaccaccaccaccaccaccaccaccaccacagcagcagcacgacgccgaccggcgcggcggcgtcgcccaagacgatgcggaggagctggtcgtccgcctcgtccgcccacagccacggctccacgcccaagtgcgtgtgtgcgccggccactcacgcaggctccttcaagtgccgcctccaccgcagcagctcccacagccacccggcgtcccctccgtccccggccaccacctccgccgcgccgccgccggccgcggccgcgtcctcctcccgtaccgtcgcggcgcagtgacggcgcggcgcccgtctgtgtcaaccaagaaacgccggcccaccacagcagtgaggaggagaggagaagagagaaacggaaaaaaagggaaaacgtactcaccctctgttatgtgacacaagaaagggagcttatttcttcctcccttcatcttcatgccaatggccaaacaaaattcccaattcctttcactttctcccttcgtctttttgttgttgggatcgattgatcgagtctccctagattggccttccctttccctccctccatcagaagaaattctcctgcttgtactaggcatcccgctcgcctcctccactgaaatggaacgggcccgattggtagagtatgtgtgatggtgacatggagttcacttatgtaattaccatttcagtaaatcaatgttcttgcacggaactgtgattttggtg

SEQ ID NO: 11353 - DNA, 759 bp, Sorghum bicolor
  Clone ID: SORBI-28MAY03-CLUS29829_1
gtgctggaaaaaaatgctgggcctcatgaccgtttggttcatgtctatcacttcgacctggagcgtcgtgtgctgcagtttgcggacccttgcttcttgctgaggcgtgatggtgaagctttgtcggatatcaaagtacggattcagaagagacttcaagttcctgatgagcagtttataaagtggaaatttgctcatgttacattcagtaggccagaatacctccaagattcagatattgtattgaaccgattccataaacagaaacctgtttatggagcttgggaacaacaccttggattggagcatacagccactaccccaagaaggtcgtactttggcagtcagaaccgccattcttttgagaggcctgtgaagatttacaactaaaactggcaatattttttgcatgtgatgaatgatgaacaggatatgatggcagtcttgttccaaaaggagtctcttatgtttttggtgatgtacatggtggaggttttgcatagagtagtttatgtggcaatttatcagaagaattttcatttggtggatgtacagggttcgtatagcaacatttccttgtagcaagttgaagctgtatatcgagggtcgataacctgtgtttttgtcgtttcgtccccaagcctctggggagctgtgaaccatagcctcgtgcgtcgtgcgccgctgttgttgccgtgtcgtccccgtggctctggggagctgtgaaccatagcctcgtgcgtcgtgttgggctctggc

SEQ ID NO: 11354 - DNA, 670 bp, Sorghum bicolor
  Clone ID: SORBI-28MAY03-CLUS29972_1
gcacgaggggctggcgccacccccatactatactccccgtcgacccccgaccgcctcgatcgtctcctcctcaactgcagtgcagccctgcaggtcagcgggcgcccgagctctgcggtggcgatggactactcgggcaccaaggagggggtttggtggtcgagggagacggtggccgtggtgaccggcgcgaaccgtggcatcggccacgcgctcgccgcgcgcctggccgagcacggcctcaccgtggtgctcaccgcgcgtgacggcgagcgcggcgaggccgccgccgcgccgctcctcgcgcgcgggctcgccgtcgtcttccgcaggctcgacgtctccgaccccgcctccgtctccgagttcgccgcctggatccgcgacgccgtcggcggcctcgacatcctggtgaacaacgcagccgtttcgtttaacgagatcgacaccaactcggtggagcacgccgagactgtcctcaggaccaacttctacggggccaagatgctcaccgaagcgctcctgccactgttccggcagtcgtcggcgaccagcaggatcctcaacatcagctcgcagcttggccttctcaacaaggtgagcgacccgtcgctgaaagcgctgctcctggacgaggaccggctgacggaggccgggatcgaggcgatgg

SEQ ID NO: 11355 - DNA, 711 bp, Sorghum bicolor
  Clone ID: SORBI-28MAY03-CLUS30112_1
gcacgaggcggaggttgaggaggaggaagtggaggagccgccgccgccgtcggcgacggcggaggaggcgaaggcggcgctggggtcggaggggtcccgcccgttcaccatgcgcgagctcctcggcgagctcaaggaggacggcgagacggcggccggcggcggcagcgcgagatctgcgttcggcgatgggaacggcgtcggatccgctgatgcagagggctcgtcctatagccaagacagcacacaacagttttcatcccaccatgatgtagctatggacttgataaatagtgtaactggagttgacgaggaaggacgttctcgccaaaggattctttcatttgctgccaaaaggtatgtaaatgcaattgaaaggaatcctgatgaccctgatgcatattataattgggctcttgtcctccaggagagtgcagacaatgtggatcccaattctagttcctctaaagatgcattgcttgaggaagcttgcaaaaagtatgctgaagctacccgactttgtccaactctttatgatgcatattataactgggctattgctattgctgatcgggctaaaatgcgaggtcggacaaaagaagccgaagaactctggaagcaggcaatactgaactatgagaaggctgtccagcttaattggaatagcccacaggctctcaataactggggtcttggtctacaggagctgag

SEQ ID NO: 11356 - DNA, 940 bp, Sorghum bicolor
  Clone ID: SORBI-28MAY03-CLUS32166_1
gctcggcgcccgcggcctgcgcccgggctcctctcccgcctctccgcccctcgctccgcccccttggggaccacccgcctctggtgctgcctcttcgtctaccgcacacactaccccgcccggatcatgttcatccttgggatgggcttcctttggaagccagttgctatccttgctgcttttatgactggacttagcatcgcatttctcaatgatagttttgcagtcactttcaatgagaaagtcacaaggaccgtaagacagttttcaccacatttagctgcaaagatgaggccaccaataactcctgttcttcgcggtcgacctagctcgaagagatcaattcatatttgtgggcgacctcgctgggtgtttgtcctgttcttttctgcagttagctgtatgctctggttgacttcatgcagtcttctcacagtcctctgggcacttctcattgctctatttgcaactgtgctccatgcaagcttcagaacaccaaatctgaaagcacgtctgaatacattcagagaggaattccgggctgtttggcggaattatagtgagctttaaggtctcctttgtttctctcatgttcatgtggtaaggaaaggtgtctcgtgctgaaacgtccatgctgtttgtgagttgtgctaggacatctagtggaaggtgaaacgccattggacattactacatggattacttgctctttcgggaggtggggattttggttcggttgactccggatgcgatgctatgccttgcacacgatccctcaagaacaataatttttctttcagatttctccctaaccgagcattggagagaggacagcatgtaaaggatgtaaaaatgtacctgttctcgatcaaaacgtatgttgtttgttgaaattattactaattcgtattgcatccacttttggaaaaaaaaaaaaaaa

SEQ ID NO: 11357 - DNA, 719 bp, Sorghum bicolor
  Clone ID: SORBI-28MAY03-CLUS3192_1
cctccgttcccctccgccactcatcgtaacttccatcgccatcgcgtcacaggctggggacggacgcctccccgcccgaccaccgccgacgccgacgacgacgacgaaccaccgccgcattccatccgcctgcagagcattccatccgcctgcaggcgctgcaagaaacatcaatggctgtgtaccagcactacaaacgcgcagccgggaactagctacactacagacccctgctcaccactctaggcgtatcttgaattcttgatctgggtggtgtgtggcgttcacagctacaaaagcttgtgcgtgcatggctagcaacatgtatggcaccacggtggcatgtaggatgtgctacagggatcagtacgggacgccggtgccgcgcgacgtcgcctgtctggccaagaaaccggaggccaggaggtgggggtacgggtaccacctcatctccaggatttgtcagtggaagcccagaggcagcaagtcagctgatggttcactgctcgggcacggtggctgcgatgttcgctgctactcttgtgggtctcataacagctgcgaatgcgaaaccgaagaatgcgatgctgtggaaggtggcgccagcccttacagtggtttacaatgatgctaagtttgtaaatgaaagggctcaaaatgacattctattgctttcacggctgaacgaacgtgcatgccaggatgctgctgttttgggc

SEQ ID NO: 11358 - DNA, 277 bp, Sorghum bicolor
  Clone ID: LIB3481-019-P1-K1-C3
cgtgcggaaatcctcaattttcacatgatcaagttccaccgaagaagtcagcctatgctagtcaagggttggctgaagcctgcaaatttgtgtggcgatgatgctaagtttgtaaatgaaagggctcaaaatgacattctattgctttcacgtggcataacaaggctgaacgaacgtgcatgccaggatgctgctgttttgggcttgggggttctcaagcttgatgctcgtgcacgaaaggatacttaaaagattgaccacacttgtgaagagagag

SEQ ID NO: 11359 - DNA, 892 bp, Sorghum bicolor
  Clone ID: SORBI-28MAY03-CLUS32747_1
gcacgaggcttgtaggttgctggagatcttctgaagcaataccaggagaaattcaagggagggacactttcagttacctggaattacttgagagactccatgggtacttacctgtcccagcctaatcctgtcactgcccgatgggagggcgaagatcatctgcgggatcctaatttccagctggatgcattcagataccgaacatctcggttgctacatagcgtcgctgctcggctacagaaacatagcaagacacttggaggttttggtgcgtggaatagatgtttgaatcatctgcttacacttgcagaatcacacattgaatctgtcatccttgcaaagttcattgaatcagtgaaaagttgccctgatgaaaaaacacgcgaagcattgaagctggtatgtgacctttatgcgctcgacaggatctggaaagatattggaacatatcggaatgtagactatgttgccccaaacaaagctaaggctattcataagctgacagactacctcagttaccaagtgaggcttgtggcacgagaactcattgatgcatttgaccttccagatctcatcatccgtgccccgattggcatgcaatcggaggcctatgcacagtacacccagtatgttggcttttagagtatatacgtacaaacaatatagattggataagttcatatattattaggttgcaattaaggtatatagatagatgagcaaataagtttcagttctagtatatgtaaacagcagctgtgaagcactggctccttgtgaataaattgtcagattttttttggccgaattgttcctaatgaagatttttatcagttctagtacatgtaaacagcaactgtgaagcactagctccttgattttcacttggttc

SEQ ID NO: 11360 - DNA, 670 bp, Sorghum bicolor
  Clone ID: SORBI-28MAY03-CLUS32732_1
agagcgaacctgctggttcaggcccacgtgaagcatggtggaagcagcagcttttgtccctgtacaagaatgcaaaggaaagtaataatttctggcctattgtcgcgaccgctgctgccttggtgggcctggcatattttgggcggcgctggcataagggcaagctgcagtttcagctggtcaaagtaccgccttctagcaacaaggagaaaatcagtgatgctgttggtccattaaaccgtatcaaggacattcttgttgctggcagccacccaagtcagggtatccatgggcatgcccgtgcaagctgaatgtcatcagtctgtgatcccatcagcatcctgaatccataatgtatcgcttgagaatcggctcaaaatgaagacaatccatagggcaaaactggagcaatggtccaaggattgaggatgtttatgcaaacgcaagtatgtttggtggctatgtaaattccaaaagtccttttgggtatgtaaatatatgagtttagtgtgattgcttttcttttggtcatctcatggaacctctgctggtttcgttgttgctatcaactactgtacccaccgtataactgtccggttcgctcatgcatgcatatatgatatgaatatatgatgggggcatggtatgagtgaattttatttcaccttta

SEQ ID NO: 11361 - DNA, 711 bp, Sorghum bicolor
  Clone ID: SORBI-28MAY03-CLUS32780_1
tccggtgcggtccatctggtgctggtcctctgcggaagccctcgctgagttgggtgccccctgctgtctcgggcggtcgcctggcagccgcgccttcccttgatcctgaaatggaggtagatccatggaacttgctcgaagatggcacaagctgcccctccacaacatctggaagcaatggtgcaagtggagtgacgggtgaccatgctaatctgaaagcgtgcagctggctcaagggtgctgtgagggtgaggaggacagaactgacctacattgggtctttagatgatgacagctgacgcatggtgaattggaggctagggtattagtctcacttgttggtgctgaagtgatggtatttgacatttgtgctgtgttcaaattaaaacaccaactacatcgaattctttgggagttctgtaccacaagatggaaaccatggctttaggttggtgttggtgtagaatacattgccgcccccattttgttttaggacctgtgggggcgactgtatataatggaaaacattgatccattgttgaggcatgcatggcccgagaagacatccaatggggagctgtgttccagaattaggaagtcatgctgtagattttagccaaaagccgtctaattgttttttgtttgagatgtaatctagtgaatgtcacatatattcttttgatccaagggctaatccaagttgcatcactc

SEQ ID NO: 11362 - DNA, 759 bp, Sorghum bicolor
  Clone ID: SORBI-28MAY03-CLUS32846_1
tacacgtgtgatatgtatggtacagttgagatgtgggcagagccaccccatgcatggccagacgaggaagtcacgcatcggtggaggtttcgctgtcttatagagacccctgctggtgatctgattagggttaagcgcctgtgtcagaataagtttgctgtttggatattggacaaggggaccttttcctgggttggaaccgagaacattggggatcttgcactgtttgtgagccattacaactcattctgtttccctgccaatgaccaccccaacctgaaagcgaactgcatctacttcattgacatgtacaataacctgtgtgcattcaaccttgagcatgggactaaggaacttgtccaaactcttgctatcggccaaggccaagggcgcaatgactactaccgtcggcctcagcgagaccagatcttatggtttatcccttcactggaataaatactaaatgaataggtaatggtgaaagttgcatgtccgtttacccccgagatggagctcatatagtattgtaggctcctatgtctcctatggatggccatttatcccaagatggaggccatatagtattccgtatttccaaagtattggatgttgcacatgcaaccgcaggtttatgtatatgaatttctgaagtattggacatctttgtaattgtggctaaatcaactgctttaactatttgcagtgggagtgtatgtgaatttgaaacttcgtttcaagctgttttgggctggtaactat

SEQ ID NO: 11363 - DNA, 711 bp, Sorghum bicolor
  Clone ID: SORBI-28MAY03-CLUS30573_1
gaagctcaaggttgacccccctccaccaccagctgctcctattagcccagctgctgccacaagggcacctcctgttccacagacacaggctaatcaaagtgtgccacgccaggctgctacaccaaaagagcaactgccacctccacctccccttgctaagccccctatcgctgacccagctgcattagtgagagagaggcttccgcccactccaaagaagccagagcctcctgttgtgacacttgatgatctcttcaagaagacacagtcctctccgaggatctattatctgcctttatcagaagaggaggtggctgccaagcttgctgcacagggcaaaggaaaaaaggaataggaggtattagcttggagtttgttgcggaacatggcgtggggtggtcacagcagctgacaggtactactgctgcagaccatttgaaataaccggcggcggtgactgctgcagcaaaagagtagttgtagggttgttctgtggaaatggactagggtaggagcagcagcggcttgtatttcctaaagagattattagtcttgattgggtatccgactagagtgtgtgcgaaagttatttgagctacatgaagtgtcagaggtacttggtttaaatttatgctgtcaggtactgttaaaagatactggttttagttttgagtctatggagcgtactgttactctggaaatgcttttctt

SEQ ID NO: 11364 - DNA, 1304 bp, Sorghum bicolor
  Clone ID: SORBI-28MAY03-CLUS3063_1
cccacgcgtccgggacatagcaaactataatcagcttgacaaccaggatgaggctcaggaagaaactggatggaagttagtgcatggtgatgtattccggcctcctgttcactcaggcctcctttgtgtctatgttggcactggtgttcagttctttgggatgacacttgtaaccatgatgtttgctcttcttggattcttatcgcctgcaaaccgtggaggacttatgactgctatggtccttttgtgggtgttcatgggtgtattggcaggatacacctcatctcgcctgtacaagatgttcaaaggcactgaatggaagaagatcaccctcaaaactgccttcatgtttcctggtattatcttttccgggttcttcttcctgatgcactgatctggggtgagaaatcatctggtgcagttccttttggaacaatgttcgcattgttcctcctctggtttggcatctctgtgccactggtctttgttggaagtttcttgggattcaagcagccagccattgaggacggagtgatgggaaacaagattcccaggcaaattcctgagcaagcatggtacctgcagccagcttttgcaatactagctggcggcatattgccatttggggctgtctttattgagcggacctgcatcctgacatctatctggctgaaccagttctactacatctttggcttcctcttcatagtctttgtcatcctcattgtgacatgtgctgagatcacaattgtgctatgctacttccagctgtgcagtgaggattaccactggtggtggagggcatacctgactgcaggctcgtcagcactctatttgtttgcttatgctatcttctacttcttcaataagttggagatcacaaagctcgtctcaggcatcctgtactttggttacatgctgatcatctcttatgccttctttgtgctgactggtaccattggcttctatgcctgcttctggttcgtgaggaagatatatgcttctgtgaagatcgactgattaaacaaccagtgtctagagaaaccttttttctgctcatagagtaccttctaccaaggttttgctgcaatgtcgtgcatggtgctgctggattgacatataaaggaaactggggttctggatgggattccatgggttttggtagaatatgtgtagcctgttaggagcaagaactggtggaagttcaagtgcgatctagatacgcgatgttgtagtgcaacatggattttgtacgcctaaagatgttcagtgctgcattgtaatataccttgatttgccctgct

SEQ ID NO: 11365 - DNA, 878 bp, Sorghum bicolor
  Clone ID: SORBI-28MAY03-CLUS30661_1
atgctgcaccctaccctgctttttgttcttcctccatcgcccccagcgtgtgcgcagcgcagccccccaacccacacgactgggccgcccgtcgctaacgccccgcttcggccccttcgccggcgacgagcaccaccagtcaccatgtcatcatatcctgtgctaaacaaccgaccaatcgatcagtggagagtcactgatctgaaggatgagctccgtaaaaggaagcttcctgttaaaggtttgaaagacgaactcgttaggcgactctttgactccattcagagtgaaagagaagctgaggaaactgaagaagctgatgaggatgtgggagtgaatgtggatgatcagttacctgatgccaatgctagtgaggaaaatacagttactgttacagaagttcatcaggaaactgtggttcatatcactcagcaagttgaagctcctacaaccgaagttggtcaggaatctgctctttctcccactagaggggcccccagtgttgatgttgaagaggcctcaacagccaaaggagaagtacctgaatcatttgctggaacatttgaagaagtgcaagtgcagactgaaagtactaatgagcctcttcatgagaagacctcagacattgacaccaatgaggaagtcattgtcaatgatgcaatcgatgtgaattcagacttgacccctgctgaagtcaagcttggtactatggaagcaagcaaaattgaagaacaggatttccccccagcacctgtagatgccataacttcagatgcttctggtcctatggatactgatgttgtcacagctgcaacttcagatgctggtcctatggatactgatgttgtcacagctgcaccagttagcgacgatgggga

SEQ ID NO: 11366 - DNA, 1365 bp, Sorghum bicolor
  Clone ID: SORBI-28MAY03-CLUS30738_1
gcacgaggcacctgccccgtcacccacgcgccgctccgccacgaggacctcgtccccaaccacgccatccgccgcgtcatccaggactggtgcgtcgccaaccgctcccgcggcgtcgagcgcatccccacgcccaagatccccgtcacccccgtccaggcctccgagctcctcttcgacctcgcggggtgcgcgcgccgccgcgacgccgccgcgcccgcgcggtgcgccgaggtggtcgccaagatcaaggccctcgccagggacagcgagcggaacaggcgctgcttcgcgtccatcggcacgggccgcgtgctcgccgccgcgttcgagtcgctcgcttctgctgctgctgctgacgctgcgccggcggggcgcgtccttgaggacatcctcgcggcattggtctgcatgatgccgttggacgagcacgccgccaggacgctgggcttgccgagctcgctggggtctctggtcgccattgctgagaacgggaccttggcgggaaggctgaacgccgtgctggcgatcaaagaggtcgtctcatgcgacggagcgttcactgatctgagcggaaaggtcgacgagatcgtagacgcgctggcaaagatcatcaagtctccgatctgcccacaggcaaccaaggccggcatggtcgccacctatcacctggcgctatacgacgagcgcgtcgcggcgcgccttgccgccgccgggctcgtccccgtgctcatcgaggccctcgtagacgccgacaagagcatgtccgagaaggcactggctgtgctcgacgcggtgctcgcctcggaggaaggccgcgcaagcgcgcgggcgcacgcgctcgccgtgcccatgctcgtcaagaagatgttccgcgtgtccgacctggcgacccaactcgcggtgtcggcgatgtggcgccttggaaaggcgcacagcgacggcgaggaggaggagaatgcggtgacgcggtgccttgtcgaggcgctgcgggttggggcgttccagaaactgctcctgctcttgcaggtcggctgcagggacgcaaccaaggagaaggccaccgagctgctcaagttgctcaacaagtacaagagcgtaggcgaatgcgtcgacgctgtggatttcagagggctgaacaagctgtcatcttaaatcaaagggaactgtgatgtaaaaaggtggattttgtaaaatagagagacgatttaacttgtaagtagctaggatagttgcaattttgctgggcttgcttccatgttagtatttcagcagcataggcgcttaggtccaaatgaaaacaaaaacatagatctgattttcgttttgtgacgaacttgtgtgtaaattttttgctgggcggct

SEQ ID NO: 11367 - DNA, 615 bp, Sorghum bicolor
  Clone ID: SORBI-28MAY03-CLUS30789_1
ggctaaatacagcaatggccattaatggtttgacaacattgctcattgcaagacttgaccatcgagaagctattgcccgcttgactctgctgaaactcataaaggttgtctatgagcaccatcctcgaccaaagcagctcatagtagagaatgacctccctcagaagctacagaacctcatcgaagaacgcagggatggacaacggggcggccaacaagtgctggtcaaacaaatggccacctcattgctgaaagcgctgcacatcaatacagtattgtgattttagtgggttatgtgttttcctctcaagttgtatatgtttgccctagaggaaaatgtgtcttttttctttttgcctacttttctgctgtggtgaattcgcatgagcaccagactcccttgttgtacctgatccctcttttttccgggagaaaggttcaacgtttaggtgcaggataaactgggctttctatccttcagggttgtttatatttagcgtatgttagtgaaaaaattgtaaattagacatctaattaaaaatacaaaacccaacttgacattttgttgcatgttagtaaattttgcaaaaaaactcgagactagttccctcgtgc

SEQ ID NO: 11368 - DNA, 822 bp, Sorghum bicolor
  Clone ID: SORBI-28MAY03-CLUS34250_1
tgttgatcttctcatcaggctacttgagcatctgtacacaaagaaaattttcaagactcaagatctggaagccggttgcttgttatacggtgctctgctggatgacattggcattgacctccctaaagctccaacacaatttggtgaaattattgctcgcctgactttgttgggcgccttgagatttgaagctgtggaggaggttttaaagaaaatggaggatacattctaccgcaagcaagtttttaatgctgtcatgaaaaccttggaagcaaacccatcaggtcaggctatcttaggctcacaggctgctgtaatagacgcttgcaacagccttttgaaataatcgtcctagcagctttggcctatcaactttttcagatgctgtatcctgcagaagccagcgtcatgtattctctatagtttaggtgtccaaggaactcggtaccaaagatgtgaggaacagccagttttgagctgtataattttgcgagatcagatgagtgttgattattattgtttcgaccaggaaggaaagaaagaagccatggattttgctcttgggcggccagcttaatttgctggagccccagatgaacaaggctaaatgtgatgtttttgtgtccacctaaaatgttgttagttctttttctgtgactacacattttgtaacattgtactatggttttggaatgtttcgtcggttacaatatattgtgttatttaggagtcattgctcgatctgcctaggtcctggtttacccagttgctgccatgatgttcttgggctttggttttccatgctgtttaactggagatttg

SEQ ID NO: 11369 - DNA, 1040 bp, Sorghum bicolor
  Clone ID: SORBI-28MAY03-CLUS3427_1
gcacgaggaaaacaaaccagcacattatgaaggagccttcaagccacgtaactccacgcgctgacggcatgcagattgatggaaatgaagatagtgctgataaatcagttgaagaatatcctacaaaacgcagacggttattttcttccatggatgctaccacttcattaatggagcagttagcgctcctgaccacaacagctagcccagatgttgttgctgcagctgctgatgctgcaattaaagcgttcagcaatgaaaacccacaagcaaagaaagcctttcgcctcagcgagcgagaatataagactaaggccttcggttctaatcatgtccaacagatcgaccgcaaaatcggcgataaggatgtgaaaatgcatggccagcctggttctgataagcaggaaaagaagttcattgctaatgcatatcaattgagggcagctgttgctactgctgttggtgtagctgctgcccgtgctaaaatgcttgcagaccaggaggagcgagaaatggagctcctaatggcatctgtgattgaaactcagttaagaaagatgcaatacaagatcaaacactttgaggagctagagtcagtcatggatcaagagtacaccactatacaacaaatgaaaggatccctcatgaatgaatggctaaaggtccttgagcatgcattccgggctggagtctcactaccgagagatgaattgctcacaaagctgttcctgaactagcccaccccatgaggaagctggctgtagtctgagtagccctcctctgatgtgcatcatcctgactgttgctggtagatagcttcctgcgtgtatgagggtgcgtctgtaaaggtgctgattgagctttcgatttcacagaattttgggcccggggatcccaacaaccctttgtaacatctttgccctgttgtaccaactaggttagatggcataattgctgaaattttccctgtagttgttgacatgtatggtttcgttcctatggatggatggatgtgaaaatgttacttcagttttggagtt

SEQ ID NO: 11370 - DNA, 717 bp, Sorghum bicolor
  unsure (1)..(717): unsure at all n locations
  Clone ID: SORBI-28MAY03-CLUS34290_1
gctccaccgctgctgataacgactctggtgtgagatactatgacatggagagattccagctgttcaagcattttcagtttgaatggccagtgaaccatacttcgttgagtcctgacagaaaggtagttgttattgtgggggatgatcctgatggtctacttattgatgccaactctggaaagacgcttcattccataaaaggacatcgggactattcatttgcatcggcttggagccctgatgggcgaacatttgctactggcaaccaagacaagacatgccgaatctgggacgtgaggaatctatcaaaatccgtccatgtgttgaggggtaaccttggagccatccggtcgatccgcttcacctcggatggccagttcatgtccatggccgaacctgctgactttgtgcacatctacgacgtgaagagtgactacaacaaaaggcaggagctggacttctttggcgagatatccggcacgtcattcagcccagacactgatacacttttcgttggtgtgtgggataggatgtatggcagcctgcttcagtttggccgcctgtacaactactcttatcttgactccttgttttgatgtggaaccaaacgggtgttgggtctggtgtaccgcattgctcttaatgttgtcagcataaattaggtggtcatccttaaaccgacaaagataattgaattaataaatgttgtactgtgnc

SEQ ID NO: 11371 - DNA, 782 bp, Sorghum bicolor
  unsure (1)..(782): unsure at all n locations
  Clone ID: SORBI-28MAY03-CLUS3432_1
cgtgcccttccaactgtgattgccaaacttcatgctgccaagcacgatatttggtcacattcctgggttttctcctaccctgccatctgtgagggccaaactcaatgctgccaaggacaagtatctatcaccaccaacaccagtctcaccgtcctcacaaatggaggagaaacagtggaatttctcttttacattggtttggaactctatagtgtggcttgtgcttctgaacttcttcattaagataatcacgtcaacagctcaggattatctcaaaaagcagcaggatatggagatggaactgatttctgattccccgaccctggaacaaaactgactactggtgcaactagtggtgtttatttcagctgctagctgcaaaagattctcctctgtagccttaacaactggctaagcccctgcagatgattccaagttccaacaattatcaaggcggcctccttgtgtctctgctcctctgccggcggtttctcgggctggctttctggccgggtgtcggccgtgtgcccgggctggcagttcggggtggtgatgcaccccggtcggctttcccacatcgtctcgctcagaccggtgcctttgtttttggggcacgggtggcgctttgccaacccggggcgcccatagctgtttctatttattttggaattgctatagaaacatgtaaggattcattcaacaatgatacgctctgttgtcaagtttactgtgtatttggtttgcaatttgtgcccgganaagagcaaactnatagttcatct

SEQ ID NO: 11372 - DNA, 1255 bp, Sorghum bicolor
  Clone ID: SORBI-28MAY03-CLUS34374_1
gcacgaggctcagtgcttggttcaggttgaagtttcctcacttgacatgtggaagcctagcaagttcaggagttgttcttgctcgaggcaactttactgattttgacaaacagattgggatctctgctggtcctgagtgcaaggcagcacttcaagaaataacaggacttgttgatggacagcttcagtctggccgtaattcagttaaggagctgtttggagcaccaaagttagaaaatgatggtgacttcctctacttactggcggatgctgctgctattgcgttccaatatggtaatcctgatgtcttatgctccccactagctgaagcaaagaagaatgggacagacttggtggaaacatttgctagttacgtcaaagattattacattggaaaatttggcgcatcagtagcatcatatgatcaagaatatttgaagaacacaactcctgctgaatcctcatataggctatggtggtaccaagtttgcagtgaggttgcatatttccaggtggcaccaaaaaaatgatagtgttcgctccccaaagattgacacaaggtaccatttggacttgtgcagaaatgtttttggtgaaggagtctaccctgatgtcttcatgacaaacttatactatggaggcacaggaattgcaggttctaaaattgtttttgcaaatggatctcaagacccatggcgacatgcttctaagcagaaatcctcagacgaattgccatcatacttaattgaatgcgaaaactgcggacattgcagtgatctctctggatgccctcaagctccttcaaacattgaaggcgattcatccaagtgctcacctcctgaatctctgaacaaagtaaggaaggagattgtcgatcacatcgacctgtggttatcagaatgccaagagcaaggacatgacaaggagccatcactgggaagcagatgggccatatctactatttgatcaatctgtaaagctataagcatgtgctgctagacctaggcaaatatgtttccttttcttgcagtactgtggtagtataccgtttccgcgaacaatacaggctgctgagtaattcaccggtggctaataaataaaagaggcagttctcagtctctcggcatcatgggatgcttgcttgcggtgctcagacgtgagaaatgtccaccgttttggacttggatgcgttgacctgtagagacgatgccatgatttgaaaatgtttaacgatctgcacactgacaagttcgtt

SEQ ID NO: 11373 - DNA, 975 bp, Sorghum bicolor
  Clone ID: SORBI-28MAY03-CLUS31508_1
gccccaccccctcccgcgccccccctcctcccccccgcccccccctccccgccgcccccgcccccccctgccccggccgccccgccgcgccctcccccccccggcgcggacgcgccgcccacgcctcgcggccgcgggccgggccccgcgcccacccctccccgccccccccggccgccctcgccgctccccgcgcccccccccaggccgccggccctcctccccgctccccccccctgggtgtcgcgccgcccctcgtcgcgcgcggccggggtctggctcgggcatgcgaccctcctccgcggcgcctccccaaccaggcaaccacagtaagcccctgccccttcctccccgacgcgcgctccccctcatggcgaggaggcgctgctgatgcctcgcggcgtcggatcggacgcggcggccacgacacgctgccgcttgcggtggcgctcgccgatccctacgcacgcgcccaatccgccgacgctgctcctcggatcccccccgagggattcgggcctcgtctcgtctcgtgctgcctaggtgcaaggataggcaaccagtgtccaacaacacgtctgtggatcaattgacctgtatttcggcctttcagttgaggattaaactagagctttaagaagcttgataattggcatcatctcaagaatacattgaagtgcaagatgccaaaaataaagaatctctctaatgcatgtaaagtatcattttctccacaaggtcccatatctgaagaggcgcttgagagagtccgtgcactgttagatgagataagacctctagatgtcggcctagataatgaagcacaaattgcacgcaattggactagtactacgcgtccatcaaatgggagacgaggacgtaatggggctaaccagttcgctgctccaatcaaatatttgcacattcatgaatctgagagtttctctatgggtatattttgtatgccaccttctt

SEQ ID NO: 11374 - DNA, 770 bp, Sorghum bicolor
  Clone ID: SORBI-28MAY03-CLUS3156_1
cggtcgaccacgcgtcgctcaagtccagcctcagcagcctcagccgaaaggaagtaaaaccgccgccgccaccgagctcgacacggtcgccgcggggcgccgggtgtcctacggtggcgccaacgccaaggcctccaccggaggtgcgcggcgcacgttcctgccgtaccggcaggacctcgtggggctgttcgccaacgtgcgcgggctcagccggagccaccacccgttctgaagcggatccggtgagccacgacgcgccgtggaagcggacccgttccaagcagtgccgacttcaagtttgaaatcgggatttgaaatttcagacgttttgacttggagatcccctgcaaagatgctctgtgaagattactactgttattagtattaccaatacgtgtgggatcaaagcaattacgcaagtgaaaaagacaaggtgtgaagtcagagaaaaacaggggaaatgtgaggcctccatttcaggattcggctcggaatcgtggtctcgagtcggtggctaaccacctgcctgccctgcgatttgtcaaggtggtctaggcgggtacacatatacgcacatgttggtgttggacaagaagtttacattctgtatatgctggtatatatagtagctttgtacatatacatacaatctataatgtatagagtagttagaagtaggtgggtttgtttgcgaggaatttgggtttccttgtttgcaatctgcagttttgtgttgtcgcatctctaatctaattttttacttaatt

SEQ ID NO: 11375 - DNA, 1067 bp, Sorghum bicolor
  Clone ID: SORBI-28MAY03-CLUS3169_1
gcccggcccagcgcaccaacacaacaaccaccgccaccgcaccgccgagcgctgcgccgctgcccaacacttggcatcgtcctccgccgccgtcactccttccatggcgcccaagaacgctctccccgccgccagcgccgtgaccgacggcatgatggagcccaggttccgcggcgtcaggaagcgcccgtggggccgctacgcggcggagatccgggacccggccaggaaggcccgcgtgtggctcggcaccttcgacaccgccgaggccgcggcgcgcgcctacgacgccgccgcgctccacttccgcggtcccaaggccaagaccaacttccccgtcgcgttcgccgcggccgcgcacgcgcaagcgctcgcgctcccgctcccgctgccgccgccgcccaagaagctggccgtgagccccagcagcagcaccgtggagtcctcgtcccgggactcgcccgccacgccgcccagggctcggtctccgtctccggccccgacggtgatgcctgcgccgtcgctcgacctttgtctcggcatgccggccatggtggctgcgcagccgttcctgttcctggacccgaggctcgcggtgaccgtggccgtgccggcgcccgtggcctgccggccgaccgctgttgccgccggtgccaagaagcagacagcaccaacatcctgcggtggagacgaggagcagagtgacacagggtcgtcgtcatctgtggtggacgcctccccggaagcggtttgcgtggggtttgacctcaacatgccaccgccggccgaggtggcgtagatggcggacctgccgcagcgcccgatgacacacggctcctccaacgttgtcgagtatgcgtagatgattagcacttgtattagtatgaggttggttgctcgatcgtttaatttgctacgatgagttactactaggtgtacatagatgttctttttgcatcggcggctaggtataacaaaagttactgcttgccgatgttacaaaacaaaatactacgaaaatgttttgttcttcgttgtttgtaacatattaatttgctgattaacga

SEQ ID NO: 11376 - DNA, 1187 bp, Sorghum bicolor
  Clone ID: SORBI-28MAY03-CLUS32149_1
gcacgaggcttgggcccgacgcacggggccaggccgccgccgccgccgccgccgccctactcccagcagcagccttcgccggcgacttgcgcccaccacggaaggatggcgacgctgaggaacctgaagatcaagacgtcgacgtgcaagaggatcgtgaaggagctgcgctcgtacgagaaggaggtggagaaggaggcggccaagaccgccgacatgaaggacaagggcgccgatccctacgatctcaaacaacaggaaaatgttttagctgagtcgaggatgatggtcccagactgccacaagcgacttgaaactgcactggctgacttgaaagcaacactggctgaactgaaggagtcaaatgagcaaggtgctgagattggagaagctgagagtacaatcgcagaggttgaagcagttgtcaagccaacagaagattaaatttaaaactctcagtttgctgaactgttagcacgcatcctgttttatcctgttgagcccttgtgagctcgttaccagatgtgtaaagtctgaactcctgtaccagtatcattacttcaagtcttcaaccttgaaaattgaaagatgctgtccggaagaccggagttggtgtttgctgctctccgcgttgctgttttctttgtcctagcattaaaccgatttcgcatttctcacattgctcttttctttgtcctagcattaaaccgatttctcatttctcagatgcattgtgtttatcaggccacatgagaagtggttttctccttttcatgtaactgaggttgtgaaaaggtcattgttgaaattgtctgctgttctgatcccagaactcacaagtatgtcaaaaacttaacttcacctatgcaggaaaatgttttagctgagtcgaggatgatggtcccagactgccacaagcgacttgaaactgcactggctgacttgaaagcaacactggctgaactgaaggagtcaaatgagcaaggtgctgagattggagaagctgagagtacaatcgcagaggttgaagcagttgtcaagccaacagaagattaaatttaaaactctcagtttgctgaactgttagcacgcatcctgttttatcctgttgagcccttgtgagctcgttaccagatgtgtaaagtctgaactcctgtaccagtatcattacttcaagtcttcaacct

SEQ ID NO: 11377 - DNA, 1374 bp, Sorghum bicolor
  Clone ID: SORBI-28MAY03-CLUS347_1
atcagagccgactcgcccgccgcgccccctgcctcccgcccccgcgcccgcccccccccccccgcgcgcccgctccgcgcccacccaccaatccaagcccgcaggcagctccgtctcagatcggtcgctgtgctgcgcgccatggagctgcagctgctggtacgacccgcggcgaccgcgccctcctccgcgcgagcgcgacccccgctgcggctccccgcccctgccgcgggcccatcccgtccccgtcggcccgggttccctactctccgcgccgccgccgccgcagccgcggcgatcgccgcggagccggaaacaaaagagcagcagcaaaatagcattatggaaactgaggtgtttgcctgccctgtctgctacgaaccactgatgagaaaagggccaccaggcataaacttgccagcaatttataggtcgggattcaagtgttcaaagtgcaacaagtcatttaccagcaaagacatcttcttggacctcactgtaactgcagggacaaaagaatatagtgaacagaagcccgctagaactgagctgttccggagtccacttgtctcatttctttatgagagagggtggcgacaaaactttaatcggagtggtttccctggtcttgatgaagagtttgaaatggctcaagactattttcaacccgttgctggtggtatccttcttgatgtcagctgtggcagtggcttgtttactaggaagtttgcaaaatctgggacatactcagctgtgattgctttggacttctctgagaatatgctccgccaatgctatgagttcattaagcaagatgatactctcctcaatgcgaatctagcacttgtgagagcagatatttcaaggctccctttcgcttcttgttcagtagatgccattcatgctggagcggctatccattgttggccctcaccctctaatgcggtagctgaaataagccgtgtcctgaggcctggtggagtttttgtgggaaccacctttttatcctctcccaggaacaacccattctctgttgaagcactaaggccacttagacagattgttggaccagttaacaccagctacaactattttactgaaggagagctcgaagacttgtgcaaatcctgtggccttgtcaactacagcagcaaagttcagagatcgtttataatgttctctggacaaaagccatattgaagaactctgtccaagtccaagctcttttgtttcttcaggattccttgtaaaacacgtttaaaagtatttgcatatatttgtgccatattgtgcataggttccttaatttctgtacattgttcctgatcgtattcagtacaaaaatgcacaaaaaaatgcatgctgcagactctg

SEQ ID NO: 11378 - DNA, 800 bp, Sorghum bicolor
  Clone ID: SORBI-28MAY03-CLUS34845_1
tcaacgagtttatgacattactgaggaatccgctttacctgtttgccatatttgtgatttatcttgttggaaaaaccatttgggtgcagtcagaaattggcagggaattccaacacggatttcttcctgccatcctttcactgtcgacgaaatttgttcccactgtaatgaacatcttgaagagattagccgacgctggtcaagaacctgcagcagccccagacaggcaaagagagctggagctccaaccaaaatccaccaggaacggttcatacagcaatgtgacatcggcagggtcatccagcgtaacgacttcggagattggacccgaatattcaagcccggtggcgcaatgatttgagtgatctttagcttttggctggatacccactctagcagttgaggaaaacagggtgcctcgagaacataggaagattgaggtgcgttgcagtttttgtaagcttgcccttcccaaactgatgcaaggtgatgagatggcactgcccatcactattatttaaggaatttttgggctgggggtttgtttgtaagagcattttagaataacttgtttcattttttttttggtttctgtaacatgaatacatgatatatgatggttgtatagaagatctggcagtctgtggagcgtagcagtgcattctacactgctacagtgggcagtgggttgcatagtcgcgagaagcatgtaaatgtctttaaactgccatcatattgcgatggagtagtattcgtgttctggaataatacagagaggaacgtgtgagtttgcgagccaa

SEQ ID NO: 11379 - DNA, 660 bp, Sorghum bicolor
  Clone ID: SORBI-28MAY03-CLUS34869_1
ccagagggagatacctgctgcaagctttgtttcacgccagcagtatggttcagtgggtgaagaattccctcacattgatattataaatgacttgcttgatgaagaccaaagcagtgcgcatatggcagtctctcccctccatgagtatcatacatttggtttgcccttttcttcaggaggcaatatggcagactcagaaacagcttccgtaagtagttctgtccggtttgacttgaccgacctttactatgacgagggttacaggagggcctatgacacgcagaatgctctgcgtaggttggatgcttaccccaacggaaggttggactcaactgcaccgcagcgttggccatataaccatccaaatccagctgtgaaccttggaaatagttctaatgtatttccacagcagttgggagagtatactaatttagctagtgggagggtgaatggggaatatttagattatatgtatcgccgtgccaatgggcaatggtgatgcctgtatacgacccataataatacttgtaacaaaccatggtgccaagtctaaagttcgccatgtcctttaatttgaattgtttcaagttcaaaataggaaagaacgaatacaccatgtaaaattttacctgcattcagcctatctcgtgcttgtacgtt

SEQ ID NO: 11380 - DNA, 760 bp, Sorghum bicolor
  Clone ID: SORBI-28MAY03-CLUS34721_1
ggtataagcatgaacctgccaatatcccggatgcagcgtgacctgacagactcaactgttttgagaaacttgggtatgggattaggtcattctctattggcttacaaagctaccatacgtggaatcagcaaagttcaggtgaatgaatcacgtttagctgaagacttggagcaaacttgggaggtccttgctgagccaatacagacagtgatgcgaagatatggaatacctgaaccttatgagaagctgaaggaactgacgagaggtcaagctgtgaccaaggacagcatgcagcaattcattgatggtctagacataccagaggaggttcgatcaaagctttcgaagctaaccccccattcttatactgggctagcggaggatttggccagagacatcgagaagtgggttgatctggaatctggatttcaaatcaagtgagcttccatttaaaaatggataatcctccccacttttttcctctttgacaatgacaaaaaaaataacagacgggagccctagaaaacgaaaattttaatgggttgtggcctctgaattgtcgaccaagataatttacgtggttctcatttatgataatttttggcacatgtaaaatgcgcctcaaggaacttatgctagctgtatcttggtgaaaaattatcgagctaaaaaagttgcttgctcgatttcttataagtacggagttgttttgcaacgcctggtgcggtaaaaaaaaaaaaaaaaactcgagggggggccc

SEQ ID NO: 11381 - DNA, 677 bp, Sorghum bicolor
  Clone ID: SORBI-28MAY03-CLUS34943_1
tgcttgagaagcctgcccctgccaacatagagcagaaggtggagcctgtggttatggatgagagcatgatgaaggcatgtgaggctgttgctcgtgttcgagctgaagttgataagctgtctgctaaggtgtgtgacttggagaagaatgtgcttggagggagaaaggttgaggataaagaatttgtcgtcttgacggagctgcttatgatgcaactgctgaaactcgatggcatagaagctgaaggagaagcaagggcacagaggaaggctgaggtgcgccgagttcagtcccttgtggagaccttggacaagctgaaagcaagaaatgcaaaccccttcagcgaccataacaaagctgtttcagtaacaacgcagtgggagacgtttgagaacggcatgggcagcttgagcgctccccctccccgtgtttcttcgacacaagttaacactgactgggagcagttcgactaggctcagacgaagttcttgatgtatcatgaagtttgtgggatcggtatggacattcctttgcaggcagcgaggtgttgtgtatatgcgccacgtttgtatatgcaccacgtttgatgcctttggtgtcccaactgcctgtgaattttaccagatcataccatactgccatgtgaattgcatcgctcgttgaggggatcatgtttc

SEQ ID NO: 11382 - DNA, 692 bp, Sorghum bicolor
  Clone ID: SORBI-28MAY03-CLUS34973_1
accggcacgagcggccattgcaccgttgaatacagcatgctgtctccgaaccaatccgctgaaaaatggataccactccaaggggtaaaaagcggagaaatccatgtaaagatcgcacggagagtatcagtaccagactccgagaagaaaaacatactcgggacagatccatctggcaagggacacaagatatcgacacagatgagagacagcctgaagaaattcacaggcttgatcgacgacggaggtgacccggaggccctggcgctggcggtgacagagatggaaggcatccagggcgagcaggaagagtacatagaaaccctggagcgggagaaggcgatgctgctgcacaagatacatgagcttggttccgaaatcattaggacatcatctggtcctccaaggacgcggtactagttagatctgcaaatgcaaccccactgaacatatatttattttttgggaaggtgaagacctgatttgtacgtacgtagaactctatacctgtgtatataccagtgagcagtacagcttgtaactaggccagatgtgtagaaaagcacagttggatgttgtagtgctaaaatttgctcaagcatcaaagaggtggagcttacataagttgctcgactttgtacacactctgataattgtacccagttgattcctgaaatgatgttccaatactt

SEQ ID NO: 11383 - DNA, 402 bp, Sorghum bicolor
  Clone ID: SORBI-28MAY03-CLUS3249_2
gcacgaggcatgtcagcaagatccttgtccagtcgtccgccctgttacatggctaactaatgtgatttataattttattcaggggctgaatccattaatgtttgcctttgctttagtgggaaattcaacatacgtaggaaggtaatccatgaacccaattccataggtttatttttttcccagtagtatctttccaagctacagggtacaatttctatagaataattttcttaacttaattgcatctggttggatttttacaaaaggagttgtatgccattctgtctaagtgattttgtgagacattagcttatattattgtgttatgtaagttgcacaagttaacactggtctcacatgtcatttggatttactctaatggacaagcacgccatatttttt

SEQ ID NO: 11384 - DNA, 795 bp, Sorghum bicolor
  Clone ID: SORBI-28MAY03-CLUS3249_1
tttgtatatataaataataacataaacctcatagtatgttctgacttctgaacttcctttactaccctgcagatgcaaagaggccatgttgaggggctgaatccattaatgtttgcctttgctttagtgggaaattcaacatacgtaggaagtatacttgtaaatagcatggactggtcgaaacttagaccaaatctcccgtggcttgtagacgctggaggatgtgttttgctggattcttttattattcttcagtttctttatttccattatcggaagcaaagggagccttcggatgagcatgacgatgcagataaagcttaactgatagagatcgtttcttctccggtccaaaggacttgcaatctgagtgctgtgtaaatctgagtgtcgtgatagactgaagtacggagatagaacctatgcatattcagcagaactgaagctgaaatgggtacctcatacaacaggctttgggtagcagcatcattgttacctgaagaccaccagtccaccgctcaccctcgggacagttttggagcgtcatttcactggttgctgcttggagggcagttctcacggcgtcatgtcttgtggagaggcttgtgcactttatttgtcttgtatgtagtatcaaaatgtcttgtattacattacatttatctatatcagatattagatgtcggctggtctgcttttgttttatattcatttttcccgtgctgatattttgtgctgcagaaacttgcacgagaaatgtatattcgtcgaatgaaaatgtgctgcttttcgttt

SEQ ID NO: 11385 - DNA, 363 bp, Sorghum bicolor
  unsure (1)..(363): unsure at all n locations
  Clone ID: LIB3478-034-P1-K1-H7
gngaaatgccaagtggaactgtcataccagttggaagaaggcttttactgtttgtggatgatcatggaaattcatctctcagccatggtagtggaagtgaaattggaagctttcttggttgggctatggcaataatttatatgggtgggcggcttccccagattntgttaaatatgcaaagaggccatgttgaggggctgaatccattaatgtnttgccttgcttagtggaaatcaacatacgtagaagatactgtaatagcatgactggcaaactagccatattccgggctgaacctggagaggttgtgatcttatatctcagtcttattatatggagaaggagctcgatacatacatcaat

SEQ ID NO: 11386 - DNA, 615 bp, Sorghum bicolor
  Clone ID: SORBI-28MAY03-CLUS32953_1
gctcgacgcaggcttcactgatgagtgcccacttgtttgtggtctgcagcaagcgctagtggacgcacgcgccgctcccaaccgaggcgacgagccgcccaaggcgacgagcctgccattactcccgttcccaatcccactctctcaccacgcaggcaggcacccgcattgtttcaaaattctcgaatcggccccctggtgtgtggtggcagccgcgccggcggcggcgagggggctctgtgtctggggggtaaagcgaggcgaggccctgctttgcgagctcgccggaggaggcgagcggaaggggaaaaggaggcgcggcagcggtggaggtgtctcaagactgaggaggaggcgccgcccatggacacctcgcggggggtcgcgtgcctgctcgtggcggtcatctgcttgtcgtgcgccgccgccgccgccgcgaggtcgccggccgcgaggctgcaccgccacctcaagcggctcaacaaaccggccgtgaagagtatcgagagtccagacggggacatgatagactgcgtgcacatctcacatcagccagcgtttgatcacccctacctcaagaatcacacaatccagatgagggcgaactaccacccc

SEQ ID NO: 11387 - DNA, 1145 bp, Sorghum bicolor
  Clone ID: SORBI-28MAY03-CLUS33022_1
gagagaactagtctcgagtttcttgaaaggagatttaagacatcgaaacaggtcaagggagtcacttgtccgtgtcgaacttgataggatatcggaagagtcgccgatgcataatcctaacagccacctgaacagcaatacaaaagctaaggaactctcaatatgtagattaaaaatgagagcggtccaactgtcaactgaccatagcacgagtattgaggaggaagtcttgaggattaaagtagaacatcctgatgatccccaagctgtctttaatgatagagtgagcgcgcggctgaaggttactagagcatttggtgctggttttctaaagaagccaaaatttaacgaggcactacttgagatgttccgcattgactatgttggaacatcaccatatatcagctgcaaccctgctgtacttcaccatcgactctgcgcaaatgatcggtttcttgtactgtcgtcagatggattgtatcaatatttcagcaatgatgaggtagtttcgcatgtgttatggttcatggagaatgtaccagagggagacccagcgcaataccttgtagctgaacttctttgtcgtgcagccaagaagaatggaatgaattttcacgagttactggatatcccccagggtgatcgtcggaaataccatgatgatgtttctgttatggtaatctcacttgaaggaagaatttggcgatcttctggatgaatgttgaaacatgacccagtctgttccttgcagccttgcttagtgtagtaaatctcaatcaggaaaggcaccaatgtcttgctctgtctttatttttcaaccatgttcaaattctggcaatccatgtgccttttctgtcttctacattttggatttgcactgcattcttgggcagtccgagtccgacttgacatatacaggtttttctcttttgttattaggggaaaaaaaggttcttttgagggcagatatgttttccatgtgtccttttaaaatttaattttgtgttgtggggttattatttttcttttcgctacatttttctaattgctagaaaggaccctttttttctaagttggggcacaggtgattggtgtccaggatgttgcggattgatgctaagcaaatatgcattatacagttgctt

SEQ ID NO: 11388 - DNA, 661 bp, Sorghum bicolor
  Clone ID: SORBI-28MAY03-CLUS33173_1
gcacgaggcccacattcacctcgccgtcgacggggccaggcgaccggacacacccttgacgaccggcgccgccctactcgcagcttcccgggtttcgtcggatcctttgccggcgaggagcaccgactgcatcaggtcgtcccttgggcgccggtgcaatgcccggcgggtcttcaggcgcagatggtgaagtggatgcaggatttgcgaagctccagggggaggatttcgagtactacatgcagacatactccatcatgctgggacgcaacagcaagaaatcgacagtggatgtggatctctcgagcctcggtgggggtatgaacatctcccgccaccacgcccggatattctacgacttccagcgccgcaggttcgcgctcgatgtcattggcaagaacgggtgccttgttgagggtgtcctgcacctcccaggaaaccctcctgtgaagcttgattcgcaggatctgctgcagattggggacaagaagttctactttctactgccaacgcggtccatcttcgcctcagctgctgctgctcggcatgctcctgttattccaccgcagcttcctccaccatcatatgcacatgcacgggggccaggccgccctcgtttgtcagagtttcatgaccgctcctatgaagctgattatggtcg

SEQ ID NO: 11389 - DNA, 679 bp, Sorghum bicolor
  Clone ID: SORBI-28MAY03-CLUS33054_1
tactgggtgctgctcgccttcccacacaacacaacccacacttcgtctcgtcaccatgcgccgcccgtggaggcacccgggcccaggggcagccgtcgcggcgcgccacggcgccgccgacctctgcctccgcgaggtcggggacctcctgccgcgacgcttcgcccgccgcgcggccggttccgaggaccttgtgatgcggcttcagattcaccggaagcttgacagacacacgggttgcgtcaacacagtgagcttcagtgaggtcggtgacatcctcgtatcggggtctgatgaccagagggtgatgctgtgggactgggacactggcaccgtcaaattagagtttcattcaggacatggtggcaatgtgttccaggcacggttcatgccctgctcagacgaccagaccattgtcacttgtgctgccgatggcgaggtgaggcttgccaagatacaggatggtggagacgtctccacaacattgcttggtgaacatgggggaagggctcacaatttggctatagagcccggtagcccttatatcctctacagctgtggtgaggatggccttgttcaacaatttgatctcagaacaaatactgcctcaaaactatttctttgcagaagctccttcattaaatcagtatcctcaactcgtatccacctaaatgcaatt

SEQ ID NO: 11390 - DNA, 752 bp, Sorghum bicolor
  Clone ID: SORBI-28MAY03-CLUS33684_1
actgcccagcacaggcacagcagcagcagtgccaccgccaccaccaaccatggcctcctcagcgtccctgcagcgcttcctcccgccctcttcgcacgcggcgacggcgtcgtcgtcccggcgccgcaccggccgcgcccgagcggccgtctccatgccaccatcgtctccgccggcgacaggggaggtccctgcggagcggctggagcccagggtcgaggagcgggagggaggctactgggttctcaaggagaagtaccggacggggctgaacccgcaggagaaggtgaagctggagaaggagcccatggggctgttcatggaggacggcatcaaggatctcgccaagatccccatggaggagatcgacgccgccaagctcaccaaggacgacgtcgacgtccggctcaagtggctcggcctcttccaccgccgcaagcaccagtacgggcggttcatgatgcggctgaagctgcccaacggcgtgacgacgagcgagcagacgcggtacctggcgagcgtcatcgaggcgtacggcgcggacgggtgcgcggacgtgacgacccggcagaactggcagatccgcggggtgacgctcccggacgttccggccatcctggacggcctccgcgccgtcggcctcaccagcctgcagagcggcatggacaacgtgcgcaaccccgtcggcaacccgctcgccggcgtcgacccccacgagatcgtcgacacgcgcccctacaccaacctgctct

SEQ ID NO: 11391 - DNA, 695 bp, Sorghum bicolor
  Clone ID: SORBI-28MAY03-CLUS35913_1
gcacgaggctgatactccacctactactcctctgatcggggaggggaggagctcgccggagccggatccacgagggggaagttaacgccatcgagcgctgcgatgggcagcacgcgcctcggatgctccacctactactcctctgatcggggaggggaggagctcgccggagccggatccacgagggggaagttaacgccatcgagcgctgcgatgggcagcttgggaggtagcgccggtgctggggacggcggcaaggtcgggctgccggcgctggacgtggcgctcgcgttcccgcaggctacgccggcatcgctcttcccgcccgccgcctcggactactaccaatttgatgatttgctgactgaagaagagaaggcactcaggaagaaggtccggggtatcatggaaaaggaaatcccgcccattatgacggagtattgggagaaggctgaattcccattccatgccattcccagccttgccagtctcggcttagctggtggaacaataaaggggtatgggtgcccaggactctcgcttacagctagtgctatttcgatagcagaagttgcacgggtcgatgcgagctgctccacatttattctagtgcactcctcgttggctatgtccacgattgccctttgtggatctgaggctcaaaagcagaaatacttgccatctcttgccgagtt

SEQ ID NO: 11392 - DNA, 920 bp, Sorghum bicolor
  unsure (1)..(920): unsure at all n locations
  Clone ID: SORBI-28MAY03-CLUS362_1
cgcgtccgcccgnccaccccggcgcgctcgcgggcgccccgccgatcgacgccgcgcggtgcttcgtcgcgggggacagcgcgggcggcaacatcgcgcaccacgtggcccgccgctacgcgctcgacccgtcggcgttcgcgagcctccgcctcgcgggcctcatcgccatccagcctttcttcggcggcgaggagcgcacgcccgccgagctaaggctcgtgggcgcgcccatcgtctccgtgccgcgcaccgactggatgtggcgcgcgttcctgccccacggcgccgaccgcgaccacgaggcgtcgtcgcccgaggccgccaccgcgggcatcgacctcgacgccgccggttccttcccgcccgccacggtcgtcgtcggcgggtacgacccgctgcaggactggcagcggcgctactgcgacgcgctgcgcggcaaggggaaggaggtgcgggtgctcgagtaccccgacgccatccacgccttctacgtgttcccggagttcgccgagtccaaggacctcatgctacggatcaaggagatcgtcgccggcagcagcagcagcgagtgaccggcgacggacggcgcaggcgcagctgtcgccgagatgcttctgctagcagaggattactgtaggtgtcgagtgactggggtcggtgacgtggactgggacggtggtgtcgagtgtgacgtggttctcatcatgcaatgcaacccgtgtgggacgcgtcatagttgcactagtgtgaggtcatgatgacgatcgaaaatggtctttggcatgtcatggacgtggcagcaggcctatgaataaccatctttatgtcatgtgggcttttagtggatcgtccttgggctagaggatcaagacacacgaagacctcaaatccaggcccatgattagctcatcatttgt

SEQ ID NO: 11393 - DNA, 804 bp, Sorghum bicolor
  Clone ID: SORBI-28MAY03-CLUS36294_1
gcacgaggagccgccacgctctcacaagaccccgacacaccacgccgcactactcgtgagaagcagagcggacgaacacgcggcgcggacactgcgatatggatcctcgtgcgctcggcgctggcatgctgctcgccgtcctgctcatggccgccaccgcggcggcgtccgcgcgccccgacgacgacgacgtagcgggcagcggggccggagccggcggcatacggcaaccggcgagcgacgggtaccgcgggaggaaggtgggggccaggacggaggtgcgggacgtggagagcgacggcgaggtgcaggagctcggccgcttctccgtcgccgagtacaaccgccagcttagaggcgacggcggcggcaggctcgagttcggcagggtggtggcggcgcagcggcaggtggtgtcggggctcaagtactacctccgcgtcgcggcggtggaggaaggtgcgcagaacgccggcggcgagcgcgcgttcgacgccgtcgtcgttgtcaagccctggctcgagtcgcgcaccctgctcacgttcgcgccggcggccgccaagtaagcgcggcgtgcatcggtgcatgtctaggtagtatatgtcaggtctgccttctcggagaccatggagggtgaataaaagttttgcttgtgttttgcataaacgtactagtactagagagtgaagatgaactgtacatgtgctgcggcgcagatgtttttttgaggaaggctattgtacaaagagagtgagaataaatcgctgcgcttctataactaagcagcaggctgttttgttctca

SEQ ID NO: 11394 - DNA, 1392 bp, Sorghum bicolor
  unsure (1)..(1392): unsure at all n locations
  Clone ID: SORBI-28MAY03-CLUS36083_1
gcagcctccctccctccttccctgcctttttccccactcccagccatccatattcttccttccttccctcctcgtgaaggcgtcgagctttgtgttcttgctttcctctgctagacaggaagaatccctcgtgttcgcgtgttcgttcttgccttcgcttcatccaggagctgcttggagagagcttccctttgccggcgtcctcactcagtcactcaccgacggtcccagtggactgaggcgaaacttctcggagccggaacagggatggccgccgcgccgccgccaggggccgacgagctccagccgttcccgcccaaggagcagctgcccggcgtcgccttctgcatcaccagcccgccgccatggcccgaggccattttactaggattccagcatttcatcgtcatgctgggcaccactgtcattatacccagctcgctcgttcctcagatgggaggcggaaatgaagagaaagcccgggtggttcagacgatattgttcgtggctggcataaacaccctgttccaaacattcttcgggacacgccttccggttgtgatgggtggctcatacatcttcgtcggacccaccatctccatcatcttggctggacggtacagcaatgaagcagaccctcacgagaaattcttgcggacgatgaggggaacgcaaggtgctctcctaattgcgtcgacaattcagatcatacttgggttcagtgggctctggcgcaatgtagtcaaattattgagtccgctggcagctgttcctctagtatcacttgtcggatttgggctttatgagcttggctttccaggggtagcgaaatgtgttgaaattggccttccagaagttttcctgttggttgtattttctcagtatttgtctcaagttctggatttcgggaagtctgtctttagccggttcagtgttcttttcactgtctctattgtgtggctgtatgcttacattctcaccatcggtggtgcttacaagaattctccaccgaagacacaggtgcattgccgtgttgatcgttcaggccttatttcaggagcgccttggataagtgttccatacccctttcagtggggtgctccaacatttgacgctggagaagcttttgcaatgatgatgacttcattcattgctcttgtagagtcaactggcgccttcattggtgcttcaagatatgcaagtgcaactatgattcctccatcaattattagtcggggcgtgggatggcagggcattggcctcttgcttgattcattttttgggacagccaccgggacatcagtttcagtagagaatatcggattgcttgcattgacacgtattggcagccggagagtagtacaaatatctgcagggttcatgattntcttc

SEQ ID NO: 11395 - DNA, 750 bp, Sorghum bicolor
  Clone ID: SORBI-28MAY03-CLUS36308_1
cttgacgatgatccacagtgcgcagtttgcaaagacaaatttgagcttggggcagaggcacgggagatgccatgcaagcacttgtaccatactgactgcatcatcccctggctggttcaacacaattcttgccctgtttgccgccatccactgccatcacagcgatcaggcagtactagtaccccccgtgcgccttcagcttactacaatgaagccgctgatgctcctgaggtcaccagaacagatcttgatcctgctccaagaaacagtggcagcgaaagccaggaaaggcacagctccttctcgtttctctggccatttggcccgtcgggttccagttccagtccttaccaatacgaagaaagtgttgatgagcctgccgtatacgatccaaaccagatagcatattccgagtggcactatgaccactgactgtaacccagcatcgagtccaagctatctgcaattcgtgccttgatcttcagcttcagcttttgtgaggcattcatcagctgtaatggctgcttgccgtagataaaaggcaaggatggttcttgcctgttgtcttgtgttcagtgcatacctttgctcctcatgtccattgtggagcaatgaactctgctgtaatgcccgtatatattcctgttttggtatattaagtgtaaagctattatagtacataatcccctatgtgcagtaataagtgaactgaatgcatccagaatatcatgtcatggtaaacatgattat

SEQ ID NO: 11396 - DNA, 667 bp, Sorghum bicolor
  Clone ID: SORBI-28MAY03-CLUS36321_1
ggtggaaagcatgggattgggcgtatcgacatggtggaaaaccggctggtcggcatgaagtcacgtggtgtgtatgagacccccggtggcaccatcatggcagccgcggtgcgtgagttggggtcccggcctctggacagggagacaatgcagtggaaggacatcattgccctcaagtacgccgagctggtctacgcaggccgctggtttgacccgcttcgtcagtcctttgacgccttcatggagaagattaccgcgacgaccactggttcggtgaccctgaagctgtacaaggggtcggtgaacgtcgcgtcccggaagagcccctacagtctgtacagggaagatatctcctcgtttgagaatggggagatctacaaccaggctgacgccgagggcttcatcaggctgtatggtctaccgacacgggtccgggcaatgctggaaaagggtatctgagtgtctgtttgatttgttagaaataaaaatctctttcatgggagtttcctagtgattgcataccgatgggtatttgatgggattgtgttgtacactttgtttgagtttgtcccaatgtatttgggtgacaatagagtttaccatgccatgttaccatccgtttatgctatgcagtccaatgcaaaaaattaagataaattgatcagaa

SEQ ID NO: 11397 - DNA, 650 bp, Sorghum bicolor
  Clone ID: SORBI-28MAY03-CLUS34400_1
gcacgagggcccgcgccacctccgaccacctcgcgcgagacgagcaagcccaacacaggcatggccggagcagcagccgccgccgtggcgtccgggatctcggcccggccggccgcgccgaggagggcctcgacggggcgccgcgctcggctgtcggtggcgcgggccgcgatatccctcgagaagggcgagaaggcgtacacggtgcagaagtccgaggagatcttcaacgccgccaaggagctgatgcctggaggtgttaattcgccagtccgtgccttcaaatctgttggtgggcagcctatagtgttcgactctgtaaagggttcgcgtatgtgggatgttgatgggaatgagtacatcgattatgttggttcctggggtcctgcaatcatcggtcatgcagatgatgaggtgaatgctgcattgattgaaactctaaagaaaggaactagctttggtgctccatgtttgctggagaatgtattggctgagatggtcatctctgctgtaccaagtatcgaaatggtccgctttgtcaattcagggacagaagcctgcatgggagcactccgccttgtgcgtgcattcactgggcgggagaagattgtcaagtttgaaggctgctaccatggccatgctgattcctt

SEQ ID NO: 11398 - DNA, 826 bp, Sorghum bicolor
  Clone ID: SORBI-28MAY03-CLUS34421_1
gcagcacgacgcgttctctcatccgctcccctctcccactaggacaaggggggaaaagctcgaaagcgcaagccggcgaggcgagcgagatgggcgccgggagcagccgcgcggacgcgccgtcgcggcgccgggcgcgcctcagcctcggcgggtgcttcggggccggatcctcctcgtccgccgccgccgctgtcgccgccgagcaccgcggcgggagcttcaccgcggccgggccctcgtcctcgcgcgctatcgaggtacaatctcgacagtcagggcgaccagtgagtgccctgaattttcaggcttctctggctgctaaggatctccagatttccagtgagtcaaatccaaggctgcattcgtcttcaagcaccataagccatcatctcagattcaatcacctcaactgtcatgagaacaaggaagatggcctggggactgaaaatgctgaaacaagtggccttgaaagctcatctaggaaacctgtcatggttaggggaagtctcagtaatgaagctgttaatagtgatgtatcaggagaaggaataagttttataggatcagagttggaaaatgttcctagcacagtttccactaatgaaattggtgactcaacttctgaatctggtttgggcccctcgttgatgacatctgaaaggatcatgtctgacttagaaggagagatatctccgcaagggacctcatcaacaactgtcatgacaagtgaaagatcagatgtatctcaatctagcttaacatctatgtttcctaactcttcaactgcatcatctgcgactgtggaaccaatgccagatccgat

SEQ ID NO: 11399 - DNA, 1181 bp, Sorghum bicolor
  Clone ID: SORBI-28MAY03-CLUS3456_1
gaccaacttgaagctttgcaaaatttggtttgatatgggtgaatacggtcgcatgagcaagatattgaaggagctgcataaatcttgccaaagggaagatgggtctgatgatcaaaagaaaggcacacagcttttggaaggctatgctattggaattccaatggtcaccggaaccaaggattattaaaaggtttagggattggtttaaaacggacgcgtgggcaaatcagcgatacctcatccaagaatcatgggtataattcgtgagtgtggtgggaagatgcatatggctgagaggcagtgggctgaggctgcgactgatttctttgaagctttcaagaactacgatgaagcaggcaatcctcggagaatccaatgcctaaaatatcttgtccttgccgatatgttgatggaatctgaagtgaatccttttgatggacaagaggccaagccgtacaagaatgatcctgaaatccttgcaatgacaaacttgattgcagcgtaccagaagaatgacatcatggaatttgaaaagatcctgaagagtaatagaagaacaataatggatgatccttttatccgtaactatattgaggacttattgaagaacatcagaacccaagtgctgctcaagcttattaaaccatatactcgaatcaggataccattcatttcacaggaactcaatttcccagagaaggatgtcgagcagctggtggtatcgctcattctggacaaccgtatccaaggccacatagatcaggtcaacaagctactagagcgtggagaaaggtccaaggggatgaggaagtacagtgccatcgacaagtggaacacgcagctgaagtccatttaccaaacattgtccaacagagttggatgagacggatcgtggctgctgtatgctttgcacacctagaattgttgatagcctgttttggggatttgagggcaactgcaaagaactgtctggcaacgcttgcagtagaattctggatctgggtaaagtgaaatatccatgtaaacgcttgatctggtggattatattcgctttcttcagttatcgggcgttttgggagtgcaagacttgcccagtggtcgaaagcccagttgtagagtggggaaacatatgacgattttttgattgcaggttgcagttacggcgatgacggtctttcccc

SEQ ID NO: 11400 - DNA, 1090 bp, Sorghum bicolor
  Clone ID: SORBI-28MAY03-CLUS34590_1
gcacgaggctctatttgaaacacaagtctctcagaaggttgttgttttcttctcaacctgtgactctgtacatttccaccatacagtactcagccagctcaagtggagctctgacccacatcttgatattgataagaagcaaaattttcttagctgtaaagtgttccgtttgcatggcaacatggagcaagatgatcgcaagaagtcatttttgggttttggttctgagaaatcagcaattcttgtatctaccgatattgctgctaggggcttggactttccaaaagtcaagtacatcatacaatacgattctccaggagaagcttctgaatacgttcacagggttggaagaactgcaagaattggtgaaaagggtgaggctctcctctttctgcaacctattgaacttgactacttgaaagatctggagctacacggtgtatcactgacagaatacccctttcaaagggttttggatagtttccctgtaaatgggcagaaaccccacaaaaggaagctaatatccttagacatgcatccttggataatgtctctgcagagatcacttgaggcttttgttgcagctgaggatgcaacaaagaagcttgccagggatgccttctgctcctgggttcgtgcctacactgcccaccgaggtgaactgaagaaaattttcatggtgaagaagctccacctgggccatgtagcgaggagcttcgggctgaaggagcagccgtcgctggttggaaggtcacatcagatgcagcttaagaagaggaagaaagagcagaagcgtgagcggcctgccaagaggaggaagcttccctctaagaagtgaagttacacacccgaaatgctgcatcgcttgactttggatcatgatgcgcgccaattttggaactaacaaccgttgtgggctatgcctagggctgtaactctgtaactcttgacatgagctattttgttcgcgagattacatgtttggatatcggtctgaacgtaggaactagcaacaaatgtactgtaatgtgtgttgataatcatccattagaccattactattattttagtatccacctgggtttttttt

SEQ ID NO: 11401 - DNA, 954 bp, Sorghum bicolor
  Clone ID: SORBI-28MAY03-CLUS3676_1
tatcgcccgtacgccagaagcttcgcttcactctgccctccgccgccgccgcagctgccgcaggcgggaacttggcggtgatactacgcgcgactgctctcttctcgttccggcgcaggttttgttcacaatggcccgtgtgtatgttggcaacttggatgcacgtgtgacttctggggaactcgaagatgagttccgtgtgtttggagttctgcgaagtgtttgggtcgcacgtaaaccacctggctttgcatttattgattttgatgacaggagggatgcagaggatgctattcgtgatctagatggtaagaatggatggagagttgaactatctcgtaattccagtggccgtggtggtcgtgatcggtatggtggatctgagtcgaagtgctatgagtgtggtgagactgggcactttgcacgtgaatgtcgtctgcgcattggttctggaggtctaggcagtggaagacgtcgcagcaggagcaggagccgcagccgcagccctagataccgcaggagtccaagctatagtagaaggagctatagccctcgttatcgctctccaaggcgccgtagtccttctccagctcgtggccgcagctgtagcaggtcgccatagtacaactgcaacaaatatgtgtctcccttgccaatggaggtaatgatggcaggtactggtgtagcaggagctagcctgaagaccgtacctgattcttctgtgtgagaacttggtccttggtttggctgtcaggaacaaatttggaactgtcgtcaactgcttgacttcagttcaggtctaaaaccttatctagcttaattgtgattgtcttgattatgccattaaagaacttttaagatttggatgtattatgccactaagacatattaccttttttttcgtgtgttaaaaaggcatgttctgtttaaacgactcggccaactacggctctc

SEQ ID NO: 11402 - DNA, 919 bp, Sorghum bicolor
  Clone ID: SORBI-28MAY03-CLUS3678_1
gcacgagggccgtgcgcgcacatctaccacgccgactgtatcctgccatggctcgcgatacgcaactcctgccccgtctgccgccacgagatgcccaccgacgccaccccgcgcgccgctgccaacgctggggcagccggggaggaggaggaggcgacggtcgggctcaccatctggaggctccccggcggcgggttcgcggtggggaggttcgcgggcgggcggaggcctgaggagcgcgagctgccggtggtgtacacggagatggacggcgggttcaacagcggcggcgccggcgcgccccgccggatctcctgggggtccaggcagacggcttccacggacaggggcaccgtccgccgcttcctccgaaacgtcttcgcctgctttggtggacgcgggtcggcggcatcgcggtcgcacgccatgcctgagctcgacgacgacgacgcgtctgatcatagtgcagccttcagccgtggtgggtccaggagccgcagcaccagctggagactcgaggacggccatgccgccgacgccatggtgcagagatgatgatgatgatgattgctctctctctctctctgcctgtagtacagtagtacgctgcaaaaagcttgctgctttgtttcattcatggtgtatttatttaccatactactactcctgctacttagaagaagggaggaggaggatgagaagaaggaattggaggatttgagtttgtagaacagggtaaattaaattggtgttgttgtaagtatacatagtaaggaaatggaaggagagcagcatctctactctacctctctctttgttaattagagaccagaccatgcgtttgcaatttgcattgcaggtggggaattgttgttcttgaggtctctgtgagaaatggtgatggatcaactgttctttc

SEQ ID NO: 11403 - DNA, 745 bp, Sorghum bicolor
  Clone ID: SORBI-28MAY03-CLUS36853_1
catgggtatgggtcctggtgctggtgccggtgctggttatggtggtggaatgggaatgaaccggccaatgggcatggggatgggaatgggaatgggaatgaatcaacaacagatgcggatgcgcgtggacccgctgccgatggggatggggatggggatggggatgaaccagcaaccgatgggaatggggatggggatgaaccaacaacagatgggaggaatgaatatggggatggggatgaaccaggggatgccgatgcgtcctatggggatgggtcctggtggaatgcccggtgctggctacaatcagatgggtgcagcatacggtggtcagcagccatatggaggatacaggtgaggaggggctatgcagtctcccacaccacagattatgggggcgaggtgttgagaaacagtttaggaggcatctgtattttgctcacctggttttgctttgtgtatgatttcttgtttcttttgggggcgggtgagaagggtataattttcgtcactattcttttacagtccatgttggatactgtacctactaaatagcaaatagcaaacatgtgaacaagggcggtgctacaactactgtgttgtgttggatgcaaagccttgatatattacagagctcccatgtagttgtatactttgctataggctgcttctttttagtaaacatattatttgtttcaagcattcttgctggatggataataaatggctgtaccatttgtattgt

SEQ ID NO: 11404 - DNA, 810 bp, Sorghum bicolor
  Clone ID: SORBI-28MAY03-CLUS3667_1
ccccgggccacccacgggagcgcctccccgcccttcctcttgaacttgttctggggagttctgtactggaaaagacgagctgaacaagcactcatcgcaagcggcattccctacacgatcataaggcctggaggcatggagaggccgacggacgctttcaaggagacgcacaacctggtgttggcaccagaggacacctacgtgggtggccaggtatccaacctgcaggtggcggagctcatcggatgcatggccgccaacaggagggcggcctactgcaagatagtggaggcggtggccgagaccacggcgccattgctgcccacggagcagctcctctccaccattccatccaagagagaaccaccctgctccggccccgctgatgatgacgagcctggggatgatgcagatccaaagccgccccaacctccgccagcacctgccgcagcagaggggtcccagacaacgtaacgaccggaggaataacagcagagccatttaacgctctgacaccctacacggcagcagcagcgagggccccccaagccctagtgcatgcaacagcgcccactttcacctttcacacggtatagtgtacgttgcgtgcccatgcacgtacacaaggtttagcggcgtgcaaatcagaagcctacttatggttatggggagcaagactaccaagagacgacaggatcattgctacaatttggtgttatgtaatcattgatgcaatgtaaaaccaacaccgaaactaactggtgatctttgtaatctttttgtctatttaagagcccaaaatatcaatga

SEQ ID NO: 11405 - DNA, 299 bp, Sorghum bicolor
  Clone ID: LIB3481-027-P1-K1-B10
cgtccgagcagagccaattaacgctctgacaccctacacggcgtaagtagaggccatatatcacgagaaagttatttttgcccgcatgtgctgcaactctctctaccactggattcgcattgaaaaatgtgcaaacatacatctcaatacgaatctgctttgagatgtgtgtttgcacacttctcaatgcgaatccagtggtggagagagtaagagcatatgcccttaatgagaaaaaaaaaacctgcgttccatatattatatcacatcgtgcaccttcatcccctttcctcaaacag

SEQ ID NO: 11406 - DNA, 1181 bp, Sorghum bicolor
  Clone ID: SORBI-28MAY03-CLUS36860_1
gcacgagggcggctcttcgctctacgggaatctcagcgcagctcgcatgagggagtggctagcctaccacgcgcatttcttcggacccgcctcgcacttcgtgcttcacgacgccggcggcgtcagcccggaggtcagggcggtgctggatccgtgggtccgggccggccgggtcaccgtccaggacatccgggcgcaggcggagtacgacggctactactacaaccagttcttggtggtgaacgattgcctccaccgctaccggcacgccgccaattggaccttcttcttcgacgtcgacgagtacctctacctgcccggtcggccggacgctccaggaggtgctcggccagctcgcggcctactcgcagttcaccatcgagcagaaccccatgtccagcaagctctgcctgcaggatccaaccatggattactcaagggaatggggttttgagaaactcgtcttccgtaactcgatcaccggagtccggcgagatcgcaaatatgcaatccaagctcggaacgcatactccacaggtgtacacatgtcccaaaatgtcatcggtaggacaacccacaagacggaaagcttgatccgatactaccattatcacaactcgatcaacgtcatgggggaaccctgcagagaatttgtaccgacacccactaatggaagcaaggtaatgtttgaggggataccatatgtctatgatgacaacatgaagcgcatcacaggggagatcaaacgcttcgaggaggagacacttggaaccatccgtagataggattggtgcagaagcatagctggtacatatacagtatatttcggataccttgaacccatgcccatccattccccgtcactctcaacttgtgcacttcgtgccgccattccaacaagcagaaggaaagaatctatctcgggttgaattagtgtaaagtttcagtttcccttggcattctccagtctgtggagggccatgctttgatgcgcgttttcccttttgtctctttgatgttgtctgtatctcattatagatttgtctagactgactgttgggctttattagacttttctgaagtcttatagggcgcagtgtaaagtgtccgaatatttgacttaacctcactctggagtttggatctgaatgaaactttgttcctgcaaaaattgcagcgcc

SEQ ID NO: 11407 - DNA, 901 bp, Sorghum bicolor
  Clone ID: SORBI-28MAY03-CLUS36875_1
aaattttctttgctatacgcatacattacattacaagccagagtatactgccgcgtcgcagatttgcacgggcggcgcgcgacatgacgaggtggacttcgagttcctggggaacgcgagcggggagccatacctgctgcacaccaacatcttcagcgacgggcgtggggagcgggagcagcagttcgcgctgtggttcgaccccacgcggggcttccacacctacaccatcctgtggaacccgcacagcatcatcctctacgtcgacggcgtcccgatccgtgtcttcgccaacaacgccgcggcgggggtgccgttcccggcgcggcagccggtgcgggtgttcgctagcatctgggacgccgaggactgggccacgcagggcggccgcgtcaggaccgactggaaccgcgcgcctttcgtcgccacctaccgccggtacaacgtcaccaacgcctgcgtctgggaggatgaggaggatggaggtggtggtaatggtgggcgggtgcggtgcccgacgacggcggtggcgggcagtgggcggcggcggagggcggcggcgtggatggcgcagcggatggactggtggagctggatgacgctcagctgggtgcgcatgaactacatggtgtacgactactgcgctgaccggaggcggttcccgcacgagttcccgcccgagtgcgccatccccatcggcagatcgtgagctagctccagtcattctgctagctagctaaacaacctactactactagtgttttcgcacgtggtggcagtgtaataatcgtgtggtgatttctgttcctagactagattagaactcgcggaacggagcttccgtacatggatgaactggggcataatttgtgcatcatgttcttttccttttttggaaatt

SEQ ID NO: 11408 - DNA, 679 bp, Sorghum bicolor
  Clone ID: SORBI-28MAY03-CLUS35193_1
gcgccccgaagcatgttcccgcgatgccgctgggggtgatggtgttgaaggtcctccccaaacgcccatcgccaacttaaagctcgacctctgtgaaccaaactttgctcaatactcgcttcgttctcaggactccggatatctctgcaatgcaccatgacgatacgcctgacctgagaatcgtggctcagaaactggccgacaacctcaagatcatggacacatccttggatacaaggaagatggtcgtcgagatctgtgacatcgtcaccagcaggtctgcccggctggccgcggcagggatcgttgggatcctcaggaagatagggagagcagtgcccggcgacgagcgccggtccgtcgtcgccatcgacggcggcctgtttgagcactacgccgagttcaggaagtgcctggagagcacgctggtggagctgctcggggaggaggcgtcgaagtcgttggtggtgaagctcaccaaggacgggtctggcctcggagccgccctgatcgcagctgctcagtcccagtaatagtaccaccacagaatggccgtgtgtcgttgtgctggttcctggcagtcgtcatgtacctgttgtgaattcctcctgtatgtttccaaaaacaagtttgcttggaatttgccaagcacatgttctaatggaaagttgctatgcgg

SEQ ID NO: 11409 - DNA, 870 bp, Sorghum bicolor
  Clone ID: SORBI-28MAY03-CLUS35069_1
ccaccaggctcccgctcaaccaaaacaatcagtgaagtgagtggcaccggaagaaagcctctccagcggggaggctctgggtctgcgcggcctgggacgccccgcgccccccggctccgtgctggggccaccacgcttggcccttggccgcgacgccgtgcgttctggcggcggatggaggcgccgcggctggggcgctagagcgccctgcccgctcgaactgcagaggggaagctcttggtctttgaggacttggaggcccctggcccctccaccatgacccccgtgcaatgcctcgggccgctggctgctgcatcgttgggccggttggtggatggaggtgacattgataagaagctaaagctggctactcaaaaccttcactatgttaatgtacttccttccattggcctgaacgtttacagcatccttcagcatgacacccttgtaatgtctcgggctgctatcaacagaatcgtcgagcggatgcatacccccatcaaccgctagcaaggagggttctgggtcagaccactgtttcttacaatcagcaactgtgctttcgtcccctgttgaagctcgaggatttccagttatctcggtgctaacttggagagctgcaatatcaactgtttatttttcgtcagaccgaagcaaccgaggtaggagggaatggagcccttccgtggcttcttgcgcggactatagtgtcctagtttaagaagacacgtacaggttggtttgggaaatgagttagtccatcatctacttatttctctctttctcttttttggtttgttctgtggaatggaataggttgatgtattatcactttattactttcgagctaataattagtacgagtaattt

SEQ ID NO: 11410 - DNA, 1166 bp, Sorghum bicolor
  Clone ID: SORBI-28MAY03-CLUS353_1
ttccgccgcaacttctttggcgaatccaccgccgtcctacgcttccccggaggcgtgggcccggcagtcacgttcgactccgaggcgccgctgcgcgaacgaattctcccgttcagtgctgccgcgccccgggagctgaaggcgacggcgaaccactcgaaaagacaggtcatcaagacgccgaggctaacggcaagctcgcacatgacgactccaaactcctccatgggcgttgttccggtgaaatctcatcgttccaatcgctgtgcgcgcacatctggagggccgtgacgcgcgcgcggcggctgctggcggccgacaagacgacgacgttccgtatggccgtgaactgccggcaccgcctgcgcccggcgatctccccgctctacttcggcaacgcgatccagagcgtggcgacgacggcgaccgtggccgagctggcgtccaacgacctgggctgggcggcggcgcggctgcacgccaccgtgacgtcgcacgaggacggcgcgatccggcgcgccgcggcggagtgggaggccgcgccccgttgcttcccgctgggcaaccccgacggcgcggcgctcaccatggggagctcgcctcggttcccgatgtacgacgggaacgacttcgggtggggccgcgcgctcgccgtgcggagcggacgcgcgaacaagttcgacggcaagatgtccgcgttccccggccaggcgggggacgggagcgtcgacgtggaggtgtgcctcgcgccagacaccatggctcgtctcctcctcgacgaggagttcttgcagtacgtgtcctcccctgcaccgtgatacggtgacagagagaaagcgtctgatgtgtgccatgttgctgcgcagctcctggatttgtacccttccagaagacatcaagtgtttgtcagcttgaatgagagtttgagtgaccatgtagagatgctgttctgctgtttccttcgtgatgatgccgttgtaggctagcagcactagttatggcctccgagcagcggtgcaaaaacggttatgataggcggatatggtttttaggtccgtttagaacgtggattttttcttttttgagtcaagggtttgctcatgttaaactcctggtaaattaagttgtattcttgtgaaatagacaaggacagtgatagatacttg

SEQ ID NO: 11411 - DNA, 538 bp, Sorghum bicolor
  unsure (1)..(538): unsure at all n locations
  Clone ID: SORBI-28MAY03-CLUS35351_1
gcacgagggtcccgtccaaaatatcgcccccccgcgatcccctacctcgccgccgactggctccccctccacctcgccgccgggcagcggagacccctcagggccgggatcgggttcctccttccccgctccctgcatcaacgatcatcgacgaccgcttgcgcctgaaccttctgcaatctgccatgacgcttgtgcgcgtaccgaggcttgatctgtctgcctgctatttcctcgggggggacggccctcttctgatgaatccttattgttgtggacgtttcttggcaagcgctctttggtaaagttaataaccaggggaaggtacaaattgttacgcgagataggtgatgggacccgtgggaagggttttatggcttataatgtagaaactaatgggattgttgccggtagagaaatgaagggtaagattttccaatgggaagaatgcgttagtcttcgagaagtgaagganattgttgccgttaaaaaaatgaagagaaagtttttccaatgggaagaatgcgttagtcttcga

SEQ ID NO: 11412 - DNA, 816 bp, Sorghum bicolor
  Clone ID: SORBI-28MAY03-CLUS35522_1
tggcaccacctcttctctacaccaaacaagccaatggcttcctctccatctcgtgccactacgctgccctagaaccctcgccgccgcccctcttaacgattcccctctgtccccgatcgccccctgacacgcccgccgcccccggatcctgcaccggaattccgcctggaattccggtccggatcgaaatcgaaccgcctccctgcgtgcaccccccgatcaacgaactcctcgcgcgcgcgcgcgcgcccgaggcggttggatcctccggtgagggttccttggtctcgatttgccgcggatgggggcgccgaagcagcgctggacgccggaggaagaggccgcgctcaaggccggcgtcgccaagcacgggcccggcaagtggcgcaccatcctccgggactcggacttcagcgagctcctgcgcctccgctccaatgttgacctcaaggacaagtggcgcaacttgagcgtcaccgcaggaggttatgggtctagagagaaggcaaggatggcgttgaagaaaggcaagcgcgtggtgcctaagcttactgctgagccaatggacatagatggcaaggatatggacaacgctcatgacgcagccattgaagcggaaccattagcgatggctttggagcctttggcaattgaggaaagtccagataagtcagttgctaggctcgatgatctcatatttgaagctataaggaagcttaacgagccttctgggtccaataaggcagccattgctgcatatattgaggaacaatactggccacctgctgattttcaacgcctgctatctacgaaatt

SEQ ID NO: 11413 - DNA, 1473 bp, Sorghum bicolor
  Clone ID: SORBI-28MAY03-CLUS37359_1
gcacgagggtcctgaaggctcagttgctggaggcagcagagatagcgctctcacacgatacaaggagaagaagaagagaagaaagtttgacaagaagatcagatatgcctctagccacagatcagcctgctggatcagtttcagtgacacctaaggtaccttatgccagagatgacgataatttcaatgatggcatgtatgaagacttatgtgtggatgatgctgacatgacattcgagaactatgaagagctatttggtacctctcacattcgaacagaggaactctttgatgacgctggaattgacagttactttgaaatgaaggaaacacaaccttttgatttcaacgaggagcccaaaactatgcagctagaatgtagcaatgtggtatcagctgattgtgggatgttaaacccaggggcaagggctgattccagcctttcgccgccccctgcgcgacgcggtgccagtacctccccctccccctctcggctctcgcgggagggcggcgttttctctaccggagcggcaacagcgaaagcttctcgatctctctccctctccccccggcagcccccccgtccggtgggcgctgccgcgcctggcccccgcctgcgcgcgcccgctccgtgctcgccgtggaggagcgccgccgcgtttcgcatcacgttcggttccgccgctcgcagcgcctgggcaggcctcgggaagggggtcttgggacgggctctgaacgccggcggggctttcgcctatgctcccctgggccatgcccgctccttctgagccctgtgggcgactgggggctatcgtccactgccggcctggcgcgcctccactgctcatctgttgtaggttgcgctacaggcaagatcactggagagcacaacaattgcattgcatgcatcagagcctgcaattgaaatacagaaaaaaaaaaggttaagaagagataccaagtgttgggatgaatgaaaaagacaaaaagaaagatgcagacttgccggactccatgcggcgtggatggaatggaacataaatattcattcttcagttcctcagcagatgagtgatttggatggagctttgccgtctgtgcgttgaacagatgcaattggtgctcgtcctccagctctaccactgcgtgcaaggacctgcgtcggctacggtgttcggcagtgaccagtgagctgccaggttgtacagtcttggtaacagcctaacaggatacacttatacctcttctgttttcgttcctgtaatattatctgtgaagcacaatcttctcttgtcaggagattgttcttcggtcgtgtgtatgtttgtagatggatgcaacattggtaaaaagaagtagccgtcatgaatgtaaagtgtgttcttgttagatcacatatagcattggagatgagtaggaggatcacacatttctggacactgaacctctgtaactattttgtgccagaataac

SEQ ID NO: 11414 - DNA, 949 bp, Sorghum bicolor
  Clone ID: SORBI-28MAY03-CLUS3761_1
gcacgagggatcaaacttcttgggaacaaaatttactgtctatgatgcccatccaccttgtaccggggctgtggtttcaaagggtccgtctgcacacatgatcggttcagcccaagtttctcctggggtgcctgctgggaattatccaatttcgcacatttcttatgaagcgacttttggttctaggtatccaagaaagatgaactgtgtcatggattccatccctttatcagcaattaaagaaggagggactgctcccacgcagactgaatttccatcaattaactccaactcttttgcttcagttccattcttcaggaaatcaggtcgtctggatagttcaggtgttcagctagccactcagaatgaagctaagatggtgctgaagaacaagtcccccaactggcatgaaccactgcagtgttggtgcctgaatttccatgggcgggtcacggttgcatctgttaagaacttccagttggtggcttcaggagagagtgatctgaataaccagggtgatgacgacgtgatactccagtttggcaaggtcgggaaggacttgttcaccatggactaccgttatccaatatctgcattccaggcatttgccatctgcctgagcagctttgataccaaaattactcgcgaatgagtcaaggtgcgagggaggtgaaccagcaagatacagcaagaatacctgagctttaagccggagagtttggtgataaagtaatcatggtagagctgaatacttcttctgttgagtactatcgtgatgtaaatagcaatctagcattctagctggagtggtttgcattgagggttggcaagtgtgaacatcagaccagagtatcctgaagtttgaccttatagtattgaagttgagagatcatacttgtaaccatctgagtatatacaagtgctgaaggtctatttctccccaaaaaaa

SEQ ID NO: 11415 - DNA, 672 bp, Sorghum bicolor
  Clone ID: SORBI-28MAY03-CLUS3763_1
aacacccgatcgcccacgcaaacctctcccgaactcgatcaaaccgcggacgaaaaaaaccaccaaaattctcccaaatttcacaacccccctagcccccagccaatctcgaatcccgatgctcccagcctccaccgactccctagcggtcgtcaccagcgcatgagcttcctccgctcgctagccgactccttctcctcgctgctcttctcgtcgtggggcgaggcggcgcccatggacgcggcgggggcggcgccgtcgccggcggctgtggtgggggagcgcgtggcggtgaagctcaggggctacttcgacctcgccaaggaggagatcgacaaggccgtgcgcgccgaggagtggggcctccctgacgaggccaccgcgcactaccgcaacgcgatgcgcgtcatgctcgaggccaaggccgcgcgcgtccccgacgccgtctcctccagcgtgagggggcaggtcagggtgtaccaagagaagatcgccaagtggcaggcgcaggtcgaggagcggctcagagtgcttggtcggagaagtggtgaaggggctactactgcagtagtgcctaagaaggttgctgcaagcaatcctatcggtaggactgcaagaatagcgccaaatagcatccaaagatctcctttgcaaaatagtcctaccttcaac

SEQ ID NO: 11416 - DNA, 797 bp, Sorghum bicolor
  Clone ID: SORBI-28MAY03-CLUS3795_1
gcacgaggaccatccaatccaatccaatccaaggaaaaccgaagaagtctttgggagaaacagcagcggaggtcacaagaacaagaacacgcctcacttcctcgctcctcctccgccggatccatcacccaacccccctactacaaataaaatcatctatcgccacatgttggctaatcccacgcaacgcactgatattttccttccttgtttgtcttgctgctagccgctatcaaatcaatcggtctccagcttacagcgacgtgcagcaggtccaggtcagagctcgatcgaggcacagcgcacaggatcctttatttatccatccatccgcgcctgcctccaatagcagcaccgcgggcaagaacaacggcaccaacaacccgctggacgccatgggcgccttcttctcgaagcaggtggaccggcggaagctggtgaccaccgagaagcgtgcgctggcgacgcgtctgtcctcctccggcgagacgttcccggggtcggagcaccgccccgcggaccggaagcggtggatggcggagctgggcgccgacaagctgcgcgtgcaccaggtggtgtggcccggcacgcacgactcggccaccaacaagatcggcgtgccgttcgtgacccgccccttcgcgcagtgccagtccatgtccgtgtacgagcagctggccacgggcacgcgcgtcgtcgacgtgcgcgtccaggaggagcgccgcgtgtgccacggcatcctggcgacgtaccccgtggacgtggtgctggacgacgtgaaccggttcctgggcgag

SEQ ID NO: 11417 - DNA, 820 bp, Sorghum bicolor
  Clone ID: SORBI-28MAY03-CLUS378_1
tctgggctgctctttgggctttttgactctgcctgcttctcctctctctctcatggcggcggcggtggcggcgtcggcgtcgacgccgcagggggtggcggagcggcggggcatcccggcggcggcgttcgtcgaggacgtcgaggcctacctccgacaggccgggctcgacgtcaactccgccctcgccttcctccaggaaaggttgcagcagtacaaaatagtggagatgaagcttctagcacaacaaagggatcttcaggcaaagattcctgatatagagaagtgcttggatattgttgcaacattacaagctaaaaaggatttgggtgaggcactcatagctgatttcgaattatctgagggaatctactcccgtgcgaaaattgaggataccgactcggtgtgcctttggttaggtgcaaatgtgatgctggagtactcttgcgacgaggccaatgccctcttgaagaaaaacttggaaaatgccaaggccagcttagaagtccttgttgctgatcttcagttcttgcgagaccaacaaaccatcactcaggttacaattgctcgggtattcaactgggatgtacaccaacggagaagcaaacaagccataaaagaaacttgatcagttatatcacaaggccaaccaatgtgattgggacaaattttttttgtacgttttgctacctctggcagatgagtccatcatagcgagctctttgttgttgatggttcatttgctgtgtaacaatgtatcgatttattctgttttatggcgtcggaacattagtagaagatttcatttcactgctcaaaa

SEQ ID NO: 11418 - DNA, 701 bp, Sorghum bicolor
  Clone ID: SORBI-28MAY03-CLUS38114_1
tactggatgctgagtaacgccgcgtgagctgagcgggtgggggagtttgtcaactgggtgaggcgcgcgcgagggagcgagcgtccgactccggcgatggcggcggcgggggagaaggcgagggtggtgcttgttggcggcggccccgcgggctccctcttcgccaagaccatggagggccacgccgacgtcgtcctcctcgatccgaaagagtacctggagatcccctggtctgagctgcgttcgatggtggaaccatcttttgctgagagatcattaatctatcacaaagattacctcaacgacacaaccatcgtgacatcttctgcagtcaatatcaccgaagacgctgtcctgactgctgatggtcaatctcttccatatgattatcttgtcatagcgactggccatgctttgacttctcctgccagcagagctgagaggttaaaagaattccagagagataatgggaagatagagtcatcagaatctgtcctgataattggaggtggtccaactggtgttgaactagctgcagagattgcggtagactacccggggaagaaggtgacccttatccatagaggaccacgtctactcgaattcatgggagaaaaggcttcaaagaagtgccttgattggctgacttcaaagaaagtagacgtgcttcttcagcaatctgttgacttgggctcattatc

SEQ ID NO: 11419 - DNA, 983 bp, Sorghum bicolor
  Clone ID: SORBI-28MAY03-CLUS60834_1
gcacgaggcccatccccacccccccgccccgggccccaccccagctcccgctcgtctccgctcgcgcgcgtgtcggacttcggctcgcggctccggctcgctgagcgctcgcccctgtcctgccccggtcgggacctccgggtggtggtagagctggttcttcctccgtggatcctgccctcgtcgagccggctgcgggtccgcgggccgtggcccgcctgccgctccggctcgacccccttcccgcgcggcttcgccatcggttcgcggctcctcccgcatgaactagccaactgcgccgcgccagccctcctccatgcctcatccttgcagtttataacatgcatctgctcatactatttccgatggtcatttttccattctttatgctatagtgctaatctacaattagcgtataccaaaaataaagcatcctttctctagaatttttcgagatatgcatgtgcttgttgattaataataactagttattgagcttctttggtgggctgtttgtgtctgtcagtataatcagccttatttctagggaacaatattatggtccactgattattagtaagtcctgtttatttctagaattcgcttattgaccaagttgcctctatgtaacgtactttcatctttttggataacgatctattttatgtcttgttttttctaggaaaaacaaggcaattgcgccgcgccaaaccaactcgaaataacagctacaaggttggaggggacggaattgttgctaggatagaggagacaaaacagctacatggatggaggcgataaatatgtcgatattggttgtatgaatattattagttgtataaattagtattgttttaaatttcttctttgtgtaaatgggcgtactttttgtatatataaacatatgactaaatggtttgtaaatctgatttgatctatttgggaatgccgtactttttgtatatataaacatatttgactaa

SEQ ID NO: 11420 - DNA, 641 bp, Sorghum bicolor
  Clone ID: SORBI-28MAY03-CLUS6088_1
atctcaaagtggggtatttgactgctcctccagctaacaatgccattgcaccacacaaagattgggagagatcacagttcattttgaatcatgagggactacagcaggctgatgcttctgaccagcctccatcacaatcccctgggcatttggacaggggcagaaagcctgtcagaataaacattgcagatattgtttcagtgtcagcatgtgctgatttgactttaccaagtggtgctggcctctgtatagaaactattcatggtcctacattcttggttgccgatagttgggaggctcttgacggttggctagacgccatacgccttgtctacactatttttgcaagaggaaagagcgatgtacttgccggtattattactggttaaatggcttgctgcaaatgcaaaactgtcaccggagaggcgcaaagttttggagattctgcagcaaccttatcagttaaatgccccctttggtttattacgtctcccgtctgtgatgtcagttttcctagatgtagggtatatcatatttatttatttgtactcgtacttaccactgattggtgatagatccattttcctttgtaaaagtggccgtgttattactatattgtgcattcacagcagatgtatcgg

SEQ ID NO: 11421 - DNA, 781 bp, Sorghum bicolor
  Clone ID: SORBI-28MAY03-CLUS6129_1
ctcaaacggttggccccaggccaagtggagctctcctcacgggcggggccaatccctgctatcgctgaagatgacgatgaaccacatagctctggattgtggcctcttttgtctctgaatggatcagatggcagtctgcaggggtttgaggagctattggcctcagtacttggaaagaaagcaggcgagaagggtaccttcaagctactgaaggcacgggcctcggctcaaacctatgtcaagatggcattcacggtggagaagaagcttgttgaaggggaggtgaactggtcaaatattccggaatggaagacgaagcccaagaggctgagagcacactatgaagtccttgctcgagtggaggagggtcaggcgatccctgagaggatcgcgcaggtgcagcctttccaggccgacgaggccatgtccgagagtgtgctcaccggcaacgtcacaaggtcgaagatggaaatcgtccatccaccgcctgtttatttcactctctgatggaagagctggagcctggaggctgttttgatgttttctcttcagagctactacacgttgggtggtggttagtttacggtgcctcgtaggtaacaaagtcatacaagcggcaagagtttgttgcctatacactgactgcttcgacataaatattggcattttatgtgtactgacagactgccaagccttgtatattatcgactggaataatgagcaatacagaaaaaaatgttttcagtcacttttggatgggaaagaggcgagttcttagtaa

SEQ ID NO: 11422 - DNA, 757 bp, Sorghum bicolor
  Clone ID: SORBI-28MAY03-CLUS61410_1
gcacgagggatccttctgttcaattgcatgtctgtgagagatccaatgagactgcttcctcatctcctggatgcatcaactcaaaatggagtgcactttgacatggccctatttgtgccgaaccaatcacaatacaacaagcttggttctaatacttcagctcctgcggagcctgagcaaatcgatttatcatggcagttgtcactccaaacagtgtgggagaagttacttcaggataaaggtataaatactacaaaatctagtgatactagtcaagtttttgaatcgcttccactcgcaatcgactggctaaggagaaatgcccaagaaaaccaatccacttctttccaggtattggttactggctccctgcatctcattggtgatgtcttgagaataatcaagaagtgatacatacaccgcttgaatttcaaactggagccgacctatgatatatccctccacaaggctaacctgattagcaagggcagaaaatttcaacggtttgcttatgatgctaaccaagctgcgaggttcttgtgttttctggccactgtcgcctttcacccagaaaaccgctgtgctcattcttgtaaaggcatgaaataggatgatcacatgccatcattggacataactgggaattcgacatgaaattgggtcaatctgtacactcacaaaataagagtgcatgggttttcttcttcaaatacaaacactgcaaagaaacacaatcatattataccagagtaaaaaa

SEQ ID NO: 11423 - DNA, 1121 bp, Sorghum bicolor
  unsure (1)..(1121): unsure at all n locations
  Clone ID: SORBI-28MAY03-CLUS38478_1
gcacgaggccccgctttcctccctccgccgaatcacccccaaaacaaaccaaaacccaaacagcacttgtcctccgaggacaatcgccgacgtcgccggccggagcagccagacgccgccgacggttgctttgcgcctcatcgtccggcccggcggcccagggcgagcatggcttcggttgcgcccccgtcttcctccgtggctgccctcacccgccaaccggtgcagttcttgaaagggtgcagtgtatccaaggagacaaagggacctatcagcagtttcttccctgcaaattcaaacagcactaaggtgaaatcagtgggcttgagagtagcatcatccttcagaagtgatggcagttatccagctggcggtgtctctgggaatggcgacacgctattgccaaaaagcacatccgtccgtggccaggaccatccggttgctgaccctgtactcccattggattccatgattacgccagaaatcctctctactaatttggcacgtgctgtggagaagttctcagatgatgacacagatactgaacttgatttggatagcccgacagagggcgtcgcatcgattgcagatgccattgaggacatacgacaaggaaaacttgtgattgttgttgacgacgaatcaagggaaaatgaaggagatctgataatggctgccaacttggttaccccagaggctatggcttttatagtaaggcatgggacaggaattgtttgtgtcagcatgaaagaagatgatctggaaagactgaaccttcctttgatggttaccacaaaagaaaacgaggagaagctatgcactgctttcactgttacagtggatgcaaaagagggcacaactactggggtatctgccaaggacagggcaaaaacagtcatgactcttgcatctcctgactctaagcctgaggacttcaaccgccctggtcatattttccctttgaaatacagagaaggaggtgttctgaaacgagctggacacaccgaggcatctgttgatcttgccatgctggctggattacctcctgttgctgtcctttgtgagattgtggatgatgcaaatggttccatggctcgcctaccanagttgcgtgtctttgc

SEQ ID NO: 11424 - DNA, 648 bp, Sorghum bicolor
  Clone ID: SORBI-28MAY03-CLUS38510_1
tccgttgcaatgcattgtataaccacagcgctaccagattatctgtagtccctatccacgcatcaagatctcaggctctaaggtacttgtgtatacgttgggggatagaggtgccaaatgttgcagtccttgtgggtgaaagcggcgattcagattacgaggaactgctggggggtctccataggaccattatcctgaagggcgagttcaacatccccgcaaacaggatccacacggtgaggagataccctttgcaggatgttgtcgccctcgacagctcaaacatcatcggtgtcgagggctacaccacggatgacctgaagtctgccctgcagcagatgggtatactcacacaataacacccccggagcttctgtttccacacccaagccaacgggaaaacgaaaggaaaggtgacgaaccaagtgcaactgtttccatgctcgatggaaatgccgattttgcttgtaggctgtagaggttgtgtttgtgtgtgcgcgcgcggtggtggtggcttattcttgagctgtgaataactgccctcctttgtttgtaatatcccaaaattttgaagtgagtacactgcaaccaaacaagaaaccggttcacatattgataatggaaaaaaaacgaatgcataaagtgaaa

SEQ ID NO: 11425 - DNA, 669 bp, Sorghum bicolor
  Clone ID: SORBI-28MAY03-CLUS38718_1
tcaccagcagagaacacaaagagatgcttccatcgcgtccacttcacaagaattgtggggctcattaacgtcatacatgagatcaagccaacttggtccagtactagcagtggcactggtggctctcattatcctaatgcaggtaaccatcataattctactaacaagatccccccaggtccaaatggctcctcatgaggtctcgacgggcagtttaggttatagcaaagatagcatggagtgggtgcagaagcgcctcagcttactaagcgaggagatgcagctagcggaggcgcacatggagaagatgaggcacgagtttgcctggctcaggtcttacctggagagactggagaagctgaggggcagcacatgacgcagcgtgcgtacatgacagggacacaagttcttgctgcgaattcataggtgtatacaaaacaacttggagatgttgttcaggtttcttctgttgttacagatcatacagatgcaaacggagaggtggagtgttgttgcagagcagaggtattgccgtaaggcaaaactgcaagatcccggtatatagcatccgatgtaaatagttggaccttatccgttgcgttgaggtgatgtacaagtacaatgtgagggacgtttcattgcagtcacgctaaggtggtgtgatatccg

SEQ ID NO: 11426 - DNA, 959 bp, Sorghum bicolor
  Clone ID: SORBI-28MAY03-CLUS38719_1
gcacgagggcattacaacgcacccatcggcaccccaacgggctcgcaaaacgcggggacttgattgtactgacccaacaattccacaaactcggtagagggctgctcaggaacatacccaaatgcagtggtatgctgagcaaggtgctcagcttatgactgctgagaagtacctgcggttgcaactagcttctgatggagatagatttcagcactttcaggatgccctgtcaaaaagcaatgaagtctttgaaacttacaagcaggagatggaaaagatgatttcagtgataaagaatcttaagaaggagaatgaatttctgaagggaaaatgcgagaactcagattttgctcttgtgaagctcattgaagagcgcgagctaacgaagaagcaactagagaaactaaaaaatcaaaaggagaagcttgaatccctgtgtcgatcactacaggctgaaaggaaacaaggcccctccgccagtatcccagatgccccttctagccaagaagatgtgtcagcgacaagtcaagaatcttagcacttatgtgcttgtcaatacaccgttggtgccagctacagcttgccgagatttctgaagcctgagaaatgaatatgttacttgtatcctgttttgcttgtgtttgcggaagttctgggcacatttaacacacactcagctgtcaacctactgtccacctcaggccttttgatactgtagctagagcctagaggtgcattcctctacaagtaactcggtattgttaccaaagcatataagctgtcagctgttccttttcttgttttcgtttgagacaaaggctgttgctttgtgggtgtgttgattcctctaatcttttgttcctgttttgcccttaataaatggccattttgtcccatgctttctcgcaactattgtgttcaaaattaaaacagctttaattttggatagacaagaagct

SEQ ID NO: 11427 - DNA, 806 bp, Sorghum bicolor
  unsure (1)..(806): unsure at all n locations
  Clone ID: SORBI-28MAY03-CLUS38730_1
cagttgtcttgatcaagtgaatccatcatccttcattgtacctttcctcttgtctggcttaggtgatcattatgatgtaaaaatgccttgccatttgattctctcaaagctagcagacaagtgcccttcagccgttcttgctgttttggactccatagttgaaccgattgagaaaactataagtcacaaaccgaagggcgatgcagtgaagcaggaggttgatcggaatgaagacatgattcgtagcgctcttaggtccatttcttctttaagccgcataagtggcagcgactacagtatacggttcaagaatctgatgaacaagataacgaccactcctgcacttgcggagaagtacaactcggtgcgcagtgaataagatctggattttgtacatggtagaagataggttaaacccagagtggcacatgctcgtcaatcctggcttcttgcttctgtttcgccctgggatagtctgggtgtcctcagctgaggttctatacattctgttgccgcttccctgcttgattgctgagtgtgagccaatactctgatgggtggttggtttttgacttgtatctgtacaaaatcttgtggtaattcagtagaatttatgggatttagacgcttggttggttgttttatcttgccagagtttcagttctgctgaggagtgatgctaagcctgtatttagctgttctatctttattagtcggagacatctggttgcaggctttgctccgcaccgttactgttctcggctttgcttccgttgccttgtaaaaaatacataactgttntatct

SEQ ID NO: 11428 - DNA, 1606 bp, Sorghum bicolor
  Clone ID: SORBI-28MAY03-CLUS37_1
aaaactaccacagcagagtgataagcaagagcaaattaagcttctcactcatcatcagcacctggcctgccattaattacctagcagctagctagctaaggtagccatgaaggtagagcgcgacctccacatgagccgcggcgatggcgaggacagctacgcctccaactccaggctttaggagaagtccatactgaagacgaggccggtgctccacaaggccgtggcggcggcgcacgcgtcgtcgctctcctccggcggcggcgccatggtcgtcgcggacctcggctgctcgtcggggcccaacacgctgctcgtcgtctccgaggtgctcggagccgtcgccgacaggcgagaggatctggcaatggccgctggcgcccaaccgcagcacgtgcagttcttcctgaacgacctgcccgggaacgacttcaacctcgtgttccaatccctggagctgttcaagaagctggccgtcaaggacaagggggacgcgctgccgccgtactacgtcgccgggctgccgggctccttctacacgcggctgttcccggaccgctgcgtccacctcttccactcctcctactgcctcatgtggcgctccaaggtccccgacgagctcgccggaggcgccgtcgtcaacgagggcaacatgtacatctgggagaccacgccgccggcggtggtggcgctgtaccggaggcagttccaggaggacttctcgctgttcctcaggctgcgccacagggagctcgtgtccggtggccagatggtgctggcgttcctcggcaggaagaacaaggacgtgctccatggcgaggtcagctacatgtggggcctcctcgcgcaggctcttcagtcactcgtcaaacagggacgtgtggagaaggagaagctggactccttcaacctgccgttctacgcgccgtcggtggacgaggtgagggacgtgatcaggcagagccaggcgttcgacgtcacccacatccagctcttcgagtccaactgggatccgcacgacgacatggaggacgacgacggcggcctcgtgctcgacggcgtccagagcggcgtcaacgtcgccaagtgcatcagggccgtgatcgggccactcatcgcgcaccacttcggcgaccacgtactcgacggcctcttcgagctctatgccaagaacgtcgccgtgcacctccagaaagtgaagaccaagtaccctgtcatcgtcgtttcactcaaggcatcaattagtcgtgcgccaaagaaccaagctaatgacaagtattattcaggtttcacgcacggccagtttatgtagatcgaatctctggcgacatatctgttactggcgagtagttattaccgccggccggtagtacacgcgtactgtatgcatgcagaattaatctatgaaataaagtagctcaggtagacaggtacggttagtggcagaacgaaaatttaatttcctccttgctttggatgttgtagtagctagcatgcaggttcaatgtttccacaagcccatctagctagatgtatctggttgattatgtgctgtagtggtaatggtatatgaaaatcgaacggaagcagattgtttggataaagg

SEQ ID NO: 11429 - DNA, 1229 bp, Sorghum bicolor
  Clone ID: SORBI-28MAY03-CLUS3715_1
cgtccgcggacgcgtggggaaggatgcgaaggacttcctatttggatcctttgacgtgccattagccaacctggaagcaagcctaagaacttatgaaccttcagaagagccatttgacatatctttggtgtcgagagaagtcaggtcgctaccacttaaagagaaggcagcccctggcaagaagccacctgccgctgccgctgcccctgcacctgtttcaaccgttgatgcttatcagaaaatgctttcatccattcctgagttctctgggtttggaagactcttcaagtcctctgaacccatggagctgacagaggcagaaactgaatatgctgttagtgtggttaagcacatttatgacggctacattgtattgcagtacaattgtacaaacactatagaagaacaactgctagaagatgtaactgtttgcgttgatgcctctgatgctgaggagttttcagagatttgttcaaagcctcttacaagcttgccgtataattcacccgggcaagtttttgttgcttttgaaaagccagagggtgtacctgctgttgggaaattttcaaatttgttgaagttcacagttaaagaggttgacacaactacaggggaagctgatgaggatggtgtggaggatgaataccagttagaggactttgaaattgtttcatctgattatatgctgagggttgctgtctccaactttaggaacgcctgggaaaatatggacccagaaagtgagcgtgtcgatgagtatggacttggggttagagaaagtttggctgaggctgtcaatgctgtcattaatatccttgggatgcagccgtgtgagggcactgaggttgtaccaagaaatgcaagatcacacacctgcctgctatctggcgtgtttattggcaacgcgaaggtcctagttaggttgtcatttggactgagtgggcccaacgaagtggcaatgaaattggctgtgagatcagatgactctgaagtcagtgataagattcatgagattgttgccagcggataaagcgcaagacatacaaatcttctgccaaaacaatgtagagcgggtagatagcctttatactaagatgcttacaaggcttgttcttcgtggatattctcagatagcgtatgctgtaatcttttttttttttggctgtacaaataacatcagatactagttgatgtttattcaatactgatttcatggaatattcggaatg

SEQ ID NO: 11430 - DNA, 828 bp, Sorghum bicolor
  Clone ID: SORBI-28MAY03-CLUS37176_1
ccccaccatcgagccctcacgccctctgcggagcggcatcgcggcgtccggtgaggcggggggctgggcgacggcggtccgagagaaccaggtcctgaaggtcggcatggacaacatgcggatgcggctggccgagctggagaaggagtgctcgagcatgcggcaggagatcgagaagctgggcgggcgcgccggcaagggtggcggtggcggcgggtgggcctcccgcgtcgtgcctcggcggctcggcctgaaggtgaggtcgcagatgtgcagcgcccaggagggctccgtcagtgagcagcagaggagcatgagcgccaagctcgacaagctgcaggccaaggtgtcgaagcagaagaagcagctggccgtggatgcctgaagttgatgtcctggagactccggcttcatggcttgtcggcgtgaccttgtaatttgagcccggtgttaatcgctttttgttacctgtgtagctgttactctgttaggctaaacgtctgagtgcagtgtgtcggttcgttcttaaaccgtggatggtaccaggtagagtggctgaatgggagtgtcgtagctaagaacgagaacctgatgtgtgcagttgagagttgtgacttgtgaggataattgtcgactacttaattcctggctatcgcaagctgcttgggagcagctctgccgactgttggactgccagaagctctccctggaagcatgcactcacgccgcccagaacgagaggctgccgctgcgcgtggtggtgcaagtcctcttcttcgagcagctccagctaagaacctcgattgcagggtgcctcctggtctccga

SEQ ID NO: 11431 - DNA, 765 bp, Sorghum bicolor
  Clone ID: SORBI-28MAY03-CLUS37179_1
gcgtggccttgcagcagatgtgatgacatgtaggaaatatgctgagcgagcttacaaatatcgtccgcttaaggttgtagagtttgatagaccatatccgcagtgcatagcatacttggacctgaagcgtgaggagtgcagccgactttttccatccggacggatatactcacaagctttccatctagctggacagggtttcttcctctcagcacactgcaacatggaccagcaaagtgcattctattgttttggtctcttcctaggaatgcaagagaaagggtcgacaagtgttacggtggattatgagtttgctgcaaggacaaggccgtcaggtgagtttgtcagcaaatataagggctactataccttcactggtggcaaggcggttgggtaccggaatctctttgcgatcccgtggccatcattcatggccgatgacagtctcttcttcatcgacggggtattgcatctcagagctgagctgaccataaaacagccctaggcgtggctgtgtactaactgcgtttgtgccgcggtgtccaaatctatgcaatgatgatctgcagtgtagagaatgaaattttctgtgcgtgctgtttttaccttttactgatgcacttaaatagacaatttgaaaacgagaactgaattctctcttgtttagttgtttttgcacctgaggaagatcatgtctctgtactcactaaactgtgaaaagtgattcagctaatcaaattttacgttggaagggcaatcctggct

SEQ ID NO: 11432 - DNA, 1202 bp, Sorghum bicolor
  Clone ID: SORBI-28MAY03-CLUS37304_1
gcacgaggaccgatcgacgctaacgacgacgagcgcgacagcgatggcggcggacccggacacggaggtgcaggcggagttcccgccgctggtccgccagtacaagagcggccgcgtcgagcggttctttaacccgtccccgctcccggccggcaccgacccggccacgggcgtcgtgtccaaggacgtcgtcgtcgatccggccaccggcctctgggcgcgcctcttcctcccgcccagcagcagccacggcaagaagcagcagctccccatcgtcgtctactaccacggcggcgcctacgtgatcggctcggcggccgacccgtggacgcacacctacctcaacgggctcgtcgccaaggccggcgtcctcgccgtggcgctcgagtaccgcctcgcgccggagcacccgctcccggccgcctacgaggactcgtgggaggggctcaagtgggtggccacccacgccgccgccaccgccgccgcgggcgggggaccggagccgtggctgaccgagcacggcgacttctcccgcgtgttcctggccggagccagcgcgggcggcaccatcgcgcactacgtcgccgtccgtgccggcgagcagcagggccagggccagggcgacctcctcggggtgcgcgtcagggggctgctgatagtgcacccctacttcagcggcgcggcggacatcggcgacgaggggacgacggggaagcagcgcaaggcgcaggccgacgcgttctggcggttcctgtaccccggctcccccgggctcgacgacccgctttccaacccgttctcggaggccgccggcggcagcgcggcgcgcgtcgccgccgagcgagtgctcgtctgcgtcgccgagaaggatgacctcagggacaggggcgtctggtactacgagagcctcaaggccggcggctaccccggcgaggtggagctgctcgagtccaagggcgagggccacgtcttctactgcatgaacccgagctgcgacagggcgcgggagatggaggagcgcgtcctgagcttcctacgcaagtgagcgactctgagcgcgcgcccgtgcaaagcgctcaactgcgcaagtgagatggaataatttctcgtgtaatttgtttgcttaaaattcatttcaagtttcgaaatgtaccttaccgtcctccaaattgcaaatctgttggacttgttttgttttagct

SEQ ID NO: 11433 - DNA, 1103 bp, Sorghum bicolor
  Clone ID: SORBI-28MAY03-CLUS4000_1
cgcctcctcgtcctcctcatccgcagccaccgccgcgccgcgcctccagatctcgtcggagaacgagcgccgcctccgccgcctcctccttaactcctccgcagcatccaccccctccccggcacctgccgacggtccggaagcccgtggcgagtcgagggagcagaaggcgcggcggctgcgtggcgtgtacgataagctcgctctcgagggattatcccagcgaccgacttcgacgccctcatctgtggcagtggcagcgaggtgtactatcctggcacggtgaactgcatcgacgctgaaggaaagctgcgcccagaccaggactatctgatgcacatcagccaccgctggtcccatgacggcgcgaggcagaccatagcaaagctcatggccagtcaggacagttcagacgatgctgtcgagctggacgtggcgtccagcaatgcacactgcttcgcgttcctcatcaaagatcccaaaaaggtgaaaacggtcgatgagatgagagagaggctgaggatgcgtggtctccggtgccacatcatgtactgcaggaacgcgacaagacttcaggttgtccccctgctagcatcaaggtcacaggcactcaggtaccttttcgtgcgctggggcctatctgtggggaacatgtatctgatcactggggaacatggcgataccgatctagaggagatgctatctgggttacacaagactgtcatcgtccggggtgtcaccgagaagggttcggaagcgctgctgaggagctcgggaagttacaagagggacgacgtcgtcccgactgagacccccttggctgcgtacacgactggtgagctgaaggccgatgagatcatgcgggctctgaagcaggtctctaagacttccagcggcatgtgaatttgctgctgggtaaggctgatctctaatatatatccttgttgttcataactcaaaaggcagactcttttttgtttccttttcttcactactacacataaataatttgtgaacagtaccgcgggtgtatatattgcagtgacaaataactaggacactgctaattctactggtggctcacgactgtgaacagtattaat

SEQ ID NO: 11434 - DNA, 706 bp, Sorghum bicolor
  Clone ID: SORBI-28MAY03-CLUS40118_1
ctgcagggggtgtccgcaaccatctctgcctgtgacgcaaattcggcgatatatgtgacagatagtgctaaagaaataaagacaaaggtgaataaatatgccttctcaggtggccaggactcaatagagctgcatagaaaacttggagctaaccttgacggggggccaggactcaatagagctgcatagaaaacttggagctaaccttgatgtggatgtcccaatcaaatacctgaacttcttccttgaagatgatgacgagcttgcacacataaagaaggagtacaaggagggaaggatgttgacgggtgaagtgaagcaacgacttattgcagttctatctgagattgttgctagacatcaaagagctagagctcaagtgaccgaagagatggttgatgcattcatggcagtgaggccgcttccgaacatgtttggctgagcatcatggcgacaacttggaacatacatttttgttatcatggagaattaagggtctttagaattatggtatcaccataagtatctcctgtgttttacttctggatggctgtggtagattttgtagactcatacatgatatatggtatcaattcagatatttttgtcattgtaatagcgaatacctcattttctaggtataaaaacagatgttatttttgtttaagtcgaaaaccactgtgtttgaattgaagatgaaaacttg

SEQ ID NO: 11435 - DNA, 900 bp, Sorghum bicolor
  Clone ID: SORBI-28MAY03-CLUS4024_1
cctcctgggcccctcccctccaccgcacgacccctcctcccgaacggccgggcggcggcgagatcgagagcatcgagtcatcgacggccgacgagcatctttcagcacctgccatggctgccgcttccggggccgtccctctccgcgagctgccttggctgcatgggcatgtccgccttctacggtccgcccgcttccgagccgcctatgatcaagctcatccaccacgccgtcgccgccggggtcaccctcctcgacacctccgacatctacggcccgcacaccaacgagatcctgctgggcaaggcgcttcaaggcggggtaagggaaaaggtggagctggccaccaagtttggcctctccttcgccgacggtaagcgggagatccgcggtgacccagcatacgtgcgggcagcgtgcgagggcagcctcaagcggctcggcgtcgactgcattgacctctactaccagcaccgcatcgacaagaaggtgccgatcgaggtcacgattggtgaactcaagaagctagtggaagaaggaaagataaagtacattgggttatctgaagcatctgcgtcaacaatccggagagctcatgcagtccatcctatcactgcagtacagattgaatggtcattatggtctagagatgtggaagaagatataattcccacttgcagagaacttggaattggaattgtagcttacagtccactaggaagagggtttttgtgcagtggagcaaaactagttgactcactgtcggagcaggacttccgcaagcatatgcctagatttcaaccggagaatattgacaagaatgctaagatattcgagcatgtgaacgcaatggcagctaaaaaaggatgcacaccatcacaactagcattggcttgggtt

SEQ ID NO: 11436 - DNA, 789 bp, Sorghum bicolor
  Clone ID: SORBI-28MAY03-CLUS40639_1
tccacccaagcatggatagcattgaaggccaaacaatgggaatgaactcgccatttgtacaacaagcagatgtcactatggtcgatggtcatgacaccaaggagcagacccacccttccacctctggcatgactgattcttcgagcggcagtgcctcaagtcagcctactttcaaggggaacccaggacacaccctcctcaaagatagaagcagccccgcactgacagtgaaagctacctacaatggcgacactgtgcggttcaagtttctgccaacaatgggctggtaccacttactggaagagatagcaaagaggtttaagctgacgactggagcgttccagctcaaatacaaggatgacgaggacgagtgggtgatcctggcgaatgacgctgacctccaggagtgcatggacgtcctggactcgatcagctcgtgcaacatgaagctgcaggtgcgcgacctcccctgcctcatcagcagctcaggcagcagcagctgcttgcaggtggaagcgcatagctcatgacaggaccgaagcctaggttatcgcccatagcctgttgtagtaggtctagtgttctgttgttgccgtagaggatccatgtttatgttcacgcgatgtcgccttatggaatgtacaaatggcgagtgtaaaaagaaaaaacgggagtgtaatactcgctgcatggttgaaacaatgccgagaaggtcttgtcataatctgttgctggtttcgaaagcccatggtaatgatctgttgccattaagatgaaggtttaagatgc

SEQ ID NO: 11437 - DNA, 1169 bp, Sorghum bicolor
  Clone ID: SORBI-28MAY03-CLUS405_1
gcacgaggatggtgtcagctactgccatgataaaggtgtctaccacagagaccttaagccagagaatgtccttgttgataggaaaggcaacatcaagatctctgacttcggcctcagtgctctacctcaacatctcgggaatgatggacttctgcacacaacatgtggcagccccaattacatagctcctgaggttttgcaaaacagaggttacgatggctccttgtcagatatctggtcttgtggagtaattctttatgtgatgcttgttggttaccttccctttgatgataggaatcttgttgttctttatcagaagattttcaagggagactgtcagatcccaaagtggctctcacctgccgcacaggaccttcttaaaaggatccttgaaccaaatccaatgaagaggatcaacatcacagggatcagagagcatgagtggttcaagaaggactatgtacctgctgttccatacgatgatgatgaagatgtcctttccggttcagttctctcaataaaagagcaaattgaagaaccagcacaagaaaagtgtactcatatcaatgcttttcagttgatcggaatggcttcttcccttgatctttctggtttatttgaggaagaggatgcagctcaaagaaagattcggttcacttcaacgcatccacccaaggatttattcgacaagattgagagcgttgcgatggagatgggattcgaagttcataggggggcaagcaagctcaaagtcttgaagaatagcaaatgttccaagaagtccaggaatccgtcatcatttttggtgtgcactgaggtgtttgagcttgggccatcattatatgttgtagaacttaggaaatcccatggggactctacattgtatagacagctgtgcgagaggctctcggatgagctaggggcctgcaagacagagcagattatgaggactgaatcactgagtgacgatctttcgagcctcgatggcgaagcgttccctctatctgggttctgatcattgcttccctatgtggttttgggcagaggggatgaggaacatgctcgttcctgatgcaattctagattaggatcatgaatatagtgtacaaagcgagcggtgcaaattagccaccaagttgaatatatatatataataatataagaaatga

SEQ ID NO: 11438 - DNA, 902 bp, Sorghum bicolor
  Clone ID: SORBI-28MAY03-CLUS40830_1
aatacatgcagttatgactcgtttgatgctgctgttgcccttcatgcttctcgttatcaagcatctgagcagccagcccatgctccccattcaaccatatggggagcagaagaaacatgtgatgagttcagctttaatttgtcagcctccaggaagcaagaaggctcaaacactcctagcagctctcctgatacggacaatgaagtccatccctcaagttcagaaggatttcaaggtttttttcaggacttgactggagaggatgatgctgataatccttataatgatgatgccaaagacgaagaggagttgtgtgctaaatcaccacctcaaaatgatgaaactaatgagttgaaggatcaatctttagctgacatatattggcctgattcactcggaccactggacttggacataccgtctgtgagatatcaagctgatgacatactgataggggacagtcaaaatagttggaaccgcctgatggcaaatagcctcgatgcatttcgaaacctttcattcttctcagataagaatgactcgattccatcgatcatgtagaactggggatgttagggcttccacgatttgctgtgttggctaggaaggaacctccaatgctgcatacgtgagctgtttgttgctaatacgagtatccaagagatgcggatttgatgcatacgtgaggggctcgtgctgttgtaagatagcataacggatgtgctaacctgtactccatgtaattatggtgtccttgtacataaagcacatacaagcacttggttacaagtaaagcttctggggtcgtgtatttgtgccggcctgcctcatggccctcatactagcacttggttacaagtaagcttctggggccgtgtgcaggatcagtttgcctaatgccc

SEQ ID NO: 11439 - DNA, 1771 bp, Sorghum bicolor
  Clone ID: SORBI-28MAY03-CLUS3816_1
caacgcgctaccctaaccagatttcgccgcttgctccccgtcgacctcccccatctccctccagctaaccctagcccagcccccgagatctactccgcgcgagcagccatggccgagacgctcgacatgaccctcgacgacatcatcaagaacaacaagaagagtaactcctcctccggtgggggccgccgcagccgcggcggatccgcccctggcggcggcggcggcggcggcagcggcggggtcgggccgaccaggcgccccttcaagagggccgggaacaggcaggcgccctaccagccgccgaaggcccccgacgttgcgtggcagcacgacatgtaccctgcggtcgccgcaggaggaggcggcggcgggagggtctcggctctcgagactggtaccaagctctacatctccaacctggactttggggtttcgaacgaggatatcaaggagcttttctctgagctaggtgatctgaagcgctactccataaattatgatcgaagtggcaggtctaagggtacagcagaagttgtattcgcaaggcgttctgatgctgtagcggcagttaagaagtataacaatgtccaacttgatggtaagcccatgaagatagagatagttgggaccaatactccaactgcagctgctgctcttccagtctctaatggtggccatgctaggaatgctgcgaggagtgcacctaggggtgccgccccagcaggtatgccgcagcgtagaccccatcagaggggtgggaggcgtggtggtggatctggtggtggtcgtcgtggcaaagagcgcagcacgccgaagtcggctgaagaacttgatgctgacttggagaagtatcatgctgatgcgatgcagaccaactaaatactttcacaaatttgatatttggcatcaaatatgaagcgcattagtcctttcattccagctgtttgtgctactatgttcaggggacaacaaaccttatgtttgtggggggtattgctttactgaatttttgtgggttttatgtgtcagcacgaggctagagttgggtgatgctgaacacttctatggaaattacttggttgcctttagtttctgtacctaatgccgaggagacaagaatcatccaaagttgctcaacatgtgaaagttggtgatgtatgaaggtgcccacatttcctttgactccccactatattatatcttgaaggtaaaagagactgggcttcagatgtccctggttatctagttgtgcgctttcactctggtatttctcagatgtttatctgctgtaggccggttcaagctccagccatctaagtaggaggtggctgttgcatattgtgaaacatcgtgatatttattttgggcatcttaagctatcctctggcacattaaagattttattagcttcaaggtgcctttcttttataagttgattccatacttgcataatcttcactcaggtgtccacaaactcgtgagttaactgtggacttggctgtcactagtctgattgaagcatcatggtgcaaatcctgcttcaagatctgctattgatagcttagagatagctgtactgtcaacgcctcttcatcattttggacttctaggctctctgtgtatttatgctgtatatgagcatatggggcatcctctataatggtggatctcatatactgcgctttggagttcctttcaacttcacttgggagcctttgatatgacacaaatagagtcatgtgaggcccagaacatcagtttctcccgg

SEQ ID NO: 11440 - DNA, 727 bp, Sorghum bicolor
  Clone ID: SORBI-28MAY03-CLUS38220_1
cctgtcccagaacgcccccagcagcctccacacctcgaactccgcgccctcccctccgtaaccacccgccgcagcgggggacagagacaggtcgaggagacaaaacgccaaaggccggcggccgccatgggtgaggagaagaaggcaggcaaggacgccggcggcgacaagaagaaggacgccggcgcggcggccgcgccgcagcccatcgtgctgaaggtcgacttgcattgcgccggctgcgccagcaaggttcgcaaggccatcaagcgcgccccaggtgtggagtcggtgacggcggacatggcggcgggcaaggtcgtcgtgaccggtccggcggacgcggtggagctcaaggagcgcatcgaggccagggcaaagaagcccgtccagatcgtctccgccggcgccggcccgcccaagaaggacaaggaaaaggaaaaggacaaggagaaggagaagaaagcggacggcggcgacaagaaggcagacaaagggaagggcggcgacggcggagacaagaaggccgacaaggagaagggcggcggcggcggcggcgagaagaaggccgacaaggagatgggcggcggcggcggcgagaagaaggccgacaaggagaagggcgccgacaagcccaaggaggagaagaagcccaaggaggagacggtgacgctcaagatccggctgcactgcgacggctgcatcgaccgcatcaagcgccgcatct

SEQ ID NO: 11441 - DNA, 889 bp, Sorghum bicolor
  Clone ID: SORBI-28MAY03-CLUS38315_1
cttcccttcgtgtcccctgtcgctctctcttccccgctctctctctctctctcgtgtgggttcgtctaatctagattagatgcgatgatgatgattcgaggcgctagcttattttagctggaatcccaggctaaaccctggctccttggttcagcgggcctcccggtgagaagaatcgcatatccgatcaggatggagacggagaaagtgaagtctgtccctggtcataatcacgctgggagtggatgataagatcataaaaagaaaattctgacaaacatcagtcacaaactcacaactcatattgttgtgctttttccctgagccactgaggtcaggagtgattgattggtttaagttcagtgcacgctgcaagcggtggcatcatgggtagtgcctgttcgaggaagaggggccagttggtccaagaggatgatctctacagtgcgaggttctccaagagcggcagcttcaagtggctgctgcacacgctgccccgcagcaactctgccgatgtgcagcggagaacacagggcccagcgccaggccggtgcccgtcgcttgtggagctatgtgtggccaaagtctgcgaggacataaataggtattctgatttctccctcctgcccagagatcttagtcagcagatattcaatgagctggtggaatgcggatgcctcacggaggcatcgcttggggctttccgtgattgtgctttgcaggatgtttgtctaggagactaccctggagttactgatgcttggatggaagtagtggcttctcaagggcagtccttgctatctgttgacctctcttgctcagatgtgactgatagtggattcaatcttcttaaagattgctcaagcatgcaaagtttggcatgcgatta

SEQ ID NO: 11442 - DNA, 761 bp, Sorghum bicolor
  Clone ID: SORBI-28MAY03-CLUS38375_1
cagaaataaaagatgaactggtttaccggttcattttcccggaaaggcctggagccctcatgaaatttttggacgcgttcagccctcgttggaacatcagccttttccattaccgtgcacagggtgaagctggagcaaatgtattagttggtatacaagtgccgccagcagagttcgatgaattcaagagccatgctgagaatctcgggtacgagtacatgtcagagcacaacaatgagatataccggttgctgttgcgtgacccaaaggtctaatgtcatatggctttgctcccataagttggtgacacttttcaaggaagattctgctacaaggtagaaggtgcaagtttcttctaaagttgaaatgaagccatcagcaaatgtagcttcagtgtgccatctgtttattcagatcatgtagtgtatcagttgtgtatcattattgttgttgtgcttcgtgatctcaatttatcggtttgtggcacctagggtttgtcaaataatgataaccaacatgttatctaaatatctgataataattatgtaattgtgatttgggatgcatcactgttgtaaagtgtaaacccttgtctctttacaatatcgagttatcaacaatttgagtaagatctgaatgttctttcttttttgtgtataacaagagttgtaactgaaaatagatggaaggcatattaaacctcctttgtgccgtttgttgttgtctaaagttcaaactacgagaaagtctttcattttatt

SEQ ID NO: 11443 - DNA, 1160 bp, Sorghum bicolor
  Clone ID: SORBI-28MAY03-CLUS38351_1
ctacttcgcacgtggccaaagccaactaggatctctcaacagcacattagcagattagctgattatacttgttgtcctttcccccccgccggccggttcattagctagcaatggagtactccaaagccctagcgtcactgttcaccatgctggtgctggcaccgctcctcgtcgtcaaggccaccgacccagatcctctgcaggacttctgcgtcgctgacctcagcggcaagctctcagtgaacggcttcccctgccagccgacctcgtcggccggcgacgagttcctcttctcgaccaagatcgccacggggggcgaccccttggccaacccgaacggctccaacgtgacggagctggacgtctccgagtggcccggcgtcaacacgctgggcgtgtccatgaaccgcgtcgacttcgcccccggcggcaccaacccgccgcacgtccacccgcgcgccaccgaggtcgggctcgtcacccgcggcgagctcctcgtgggcatcatcggcagcctcgactccgggaaccggtactactccaaggtggtccgcgccggggagacgttcgtgatcccgcgcgggctcatgcacttccagttcaacgtcggcaaggaggacgccgccatggtcgtgtcgttcaacagccagaacccggggatcatcttcgtgccgctgacgctgttcgggtcctcgccgccgatcccgacgcccgtgctctccaaggccctccgggtggacgccagtgtcgtcgatctcctcaagtccaagttcgccggtgggtactgagatcgagccagcatctagctagcgcactgctgtgcaccgacaatggctatgcgttggcggattttggtttctcgttacgaaatgcatgggtgatgagggcgtgacaatcagcaacaatttgatacgccagggaaatcatatataatatgtcgatgtgtcagagcacgtattatatataataagctatggttaagattcagtcgtaaaaagatgtaatcagtaaagattattattgcctcgatgttcactgcctactcggggttaaaatgttttctcttttccatgtaataataaataagaaactatattgtgttatttttcagtgtgttccaataaaaattaagaaaatacatatattgggttaagttgctt

SEQ ID NO: 11444 - DNA, 1467 bp, Sorghum bicolor
  Clone ID: SORBI-28MAY03-CLUS42_1
cccatctcttcttctccacagtccacactgttcacctcctctcccctctcctcctctcttcgatccccaaatccggaattgaccagcccaaatcgtcgtcgccccggccgcatggagtggacggccccgaagcccgcctcctcgccctcctcgcctccccttctctgggactggggagaccacgccgccacgggctcgggctcctcctccggcgacgccccggcgcggcgcggtgctgggaaggagcgggaggcgaagcgtgccaggggcgaggacggcggcgggggagctgaggtgaggtgtcaggtcgaggggtgcggattggacctcaccagggtcaaggactaccaccggaagcaccgcgtctgcgaggcccacaccaagtccccccgcgtcatcgtcgccggccaggagcgccgcttctgccagcagtgcagccgattccatgccctgtcagagtttgatcagaagaagaggagctgcaggaggcgtctgtctgatcataatgcccgccgccggaagcctcagccagatgcattcacctttgcctctgcaaggctgccttcgtcattgtttgatgataggaggcaaataagttttgtctggaataaagctcctgttagtcatgtaaggcctttcacttctccatgggacagttcatctgacttaaagctccctcatgcaaaggaaacaagagaggtatcaacaaaagttgggacaattacgggacaagttcatttggataaatctcacatgtccaatgctattccaacacttagtcatggcaaagatgagccttggccaatgaaaggtccggacatgtctataactgcttcaaaatttgatggagcaccggatcttcagcgtgctctctctcttctgtcagttggcgcttgtggattgcctgatcctgtacatcaaacatcctgcgttatccaattcactggtgccagcgagaacagtggtgaccttcatttatcacatggggggaactctggtccagcttcatgcgctgatggacagcatatagctgctcagtctcagtctcagctggttcgttttaccatggataccagcaacaatgtctatgagcccagtttcttcggtgtaaaccagataaattaagcgtgaaagatacacgccagttgatcatttggataaatagccatgaagatggcctgggcttgtgcaggaagttcttcaaccaaccaccggacataaggatctctcagttaatgttatctgcatatttatcagcttatgtttaatatgcagttccaacctgtgattgacccattttttctgttgttttttttgccccctgtgatgtgacgactctggaactttctaagtgtgatactatgtagttttacacttttattttactgccctgatgatgatgatgatgatgatgtcaacggttggatatctttaaactgtccttgatgaatctggacatgttttttt

SEQ ID NO: 11445 - DNA, 692 bp, Sorghum bicolor
  unsure (1)..(692): unsure at all n locations
  Clone ID: SORBI-28MAY03-CLUS42119_1
cgcttcatcgtttatccacaaggctccccntaagatcccagaggtgatcattcctgaagatttagttgtcaacattgcgctatccactcgttatgagatcaacagggcctttgccaatctccgccagattgctcttggccgggacataaagaagttcctaatggttattgctgggttttggttcctttctgttcttggaagttgctgcaacttcttgaccttggtttacattgtctttgtggtgctgcacacagtacctgtgctgtatgagaagtatgaggatcacattgactcgtatggcgagaaggggtggattgagattaagaagcagtacgctgtgtttgatgagaaggttctgagcaaagtaccaaggggtcctgcgaaagacaagaagcactagaagcaagtgatgcaaggttgctcctagtagggaatgctagcaatcggttcgagtttctcaggaggcagcacttgtgggtgtgagcaccactatggcctatgcattatgttgtgtatggctgctttgttgtttggttttgatgggtgtagccgaattgctagctttgcccttcatgggtgtagccgaatttccggtagtgctgtttgattttgatctgtgttgtagacgtcgagcgcagactgtacctgtgacactgtttttgctacttatcaatgcagtttggaatttgacg

SEQ ID NO: 11446 - DNA, 1092 bp, Sorghum bicolor
  unsure (1)..(1092): unsure at all n locations
  Clone ID: SORBI-28MAY03-CLUS42345_1
gcacgaggcttcaaggctcaaaggttatgaaagccaaaaatgtgttaatgcttataattatatgccagtatgtgcctcggctaatccgaataaggccactgtacctccaaatcacaaggtctgctggtgtaattacagagacagcacgggctggtgctgctttcaaccttttgctttacatgcttgccagccatgtccttggagctctttggtacttgctttctattcaacgccaagattcctgctggagacagcattgtagaagcaataagacatgtaatctttcctatttgtactgtggagattatgataacgatgagggaaatgctttcttaactaaaagttgccaaccaagaaatcagccaaaccttccagatccgtactttgggatttatgcaccagctatacaaaatgtatcacagtcaaaaagtttctttgagaaattgttcttctgtgtttggtggggtcttcaaaatcttagttctcttggccaggccctccttccaacctctgctgcagcccaagacttattcgcagtgtttgtctcaatatcaggtttagttctgtttgcattgctgatcggtaatgtgcagacctattcgcatgcagccgctctgcgtattcgcggtgtgtgtctcaaaagccgtgacacagatcagtggatgtcatatcgacatcttcctgagaacctcaaggaaagaatacggcgttatgaacagtatagatggcaagaaacaagtggtgttgatgaagagcaacttcttatgaacctccccaaagatcttaggagggatataaaacgacatctctgtttatcgcttctcatgagggttccaatgtttgaaaatatggacgatcagcttttggatgccatgtgtgactgcctaaagcccatcctatacacagaaggtagctgtgttattcgtgaaggagatccagtaaatgaaatgctcttcgtcatgaggggaaacctaatgagcatgacgacaaatggtggaagaactggcttctttaactctgatgttctgaaagctggagatttctgtggcgaagagctcctcacctgngctcttgaccccacatcaacatcca

SEQ ID NO: 11447 - DNA, 577 bp, Sorghum bicolor
  Clone ID: SORBI-28MAY03-CLUS42426_1
gcgcacgagggcctggatcacaaatcacagggaagcagtggtagtggtaccttgcaatggcgacgaaccccggcctcttcaccgagtggccatggaagaagctcggcaacttcaagtacctgttggtggcgccgtgggtggcgcacggcgtctacctcgtggcgaccaaggggtggaaggcggccgacctggggtacatggccatcttcccgtcgctgctcctccggatgctgcagaaccaggtgtggatcaccgtgtcgcggctccagaacgcgcgcggccggcggcagatcgtggacaggggcatcgagttcgagcaggtggaccgggagcgcaactgggacgaccagatcctcctcagcggcatcctcatgtacctgggcttcatgtacatccccggcgggcagcacctgccgctgtggcgcacggacggcgccgtgctcatcgcgctgctgcacgccggccccgtcgagctcatctactactggttccaccgcgcgctgcaccaccacttcctctacacgcgcttccactcccaccaccacgcatccatcgtcaccgagccaatcagctccgt

SEQ ID NO: 11448 - DNA, 1082 bp, Sorghum bicolor
  Clone ID: SORBI-28MAY03-CLUS4251_1
cgtccggaaaagaaagagcctgagattgttcgttcgcctagagctccaacccattctttcaagaagccgattggtgctaaaaagcctggaaatgggactgggggacttggtgcgcggaagcttacatcaaagccaaatgaaagccttatggcagaagcccgaagaaccagctcccatcctgccatcggtgactgagagtactgcaactaggagcaaaccccatacttctcgatttgaatatgtacaaaatgcacctgccgctcctaagactggtagcagctcagaagacaaccacatgagtggacatgttgcacccccaaagtcgtcgaacttctttgctgaatttgggatggacagtggatatcacaaaaaatctacatccagctcatccaaagtgcagattgaggaaagcagtgaagcaagacagaaattctcgaatgcaaaatcaatttcatcctctcagttttttggtgatcaagccagttttgaaaaggacgctcaagtctctctccaaaagttttcaggttcttctgccatatcaagtgctgatctatttggccatccagcaaacaatcctagagtggatctcagtgcttcagatttgatcaacagaatttcattccaggccactcaggatctgtcttctctcaagaacatggcaggggaaacggggaaaaagttgacatcgatggcatccaacatcatcactgatcttcaggaccgcatcctctgagattaacttacagtaaagtaacctttacattgcttcagtggctggcttctcccggcaacccgggtgacaaactggcctggcctgcagatctttgtaggagttcgtaggcgtctgagaacttcctggcagatctgtctaggagttcggaagcatctgaaaacctgaagtgtaagttagagggatagagggggaaagaagaaaacttatggcgaatgctgtacttggctaagtcatgtatgcatctggagctgtaacgggaatgtctttttgaagttggttttatttcggttcgagatatatacttttgctttaaatgataattatatgagtagtacatacagttttccaa

SEQ ID NO: 11449 - DNA, 1756 bp, Sorghum bicolor
  Clone ID: SORBI-28MAY03-CLUS42648_1
attctacaccccggtgcttcatattctctacataccgaggcttagggttcgggtccctctagttgatctagtcctagttcatctagatctagttcatctagatgtagcaattaggagagactagttcttctagatctagtcttgtttagagattagagagattaagtagaggagtagagattctggaggagttctggcctgtcggtgcttcttcatggctgtattcgtctggattcagttccctcgcccggagctgcgttctgaggtacttttgtacttacccttctggtttaagtaagcaacttgttcttatttgttctttagttcacaactcatattgactgctttgatcttggtcgttacttggttgaagtagtatttcgtactgtaggtgtggtgcctaggctaggtttacttgtggatgtcccctgatcggccggacagtggtagttcgcgtaggtgacagcatacgtgcgttcatccctcggcaatctcctgcccattggtgggacacatgcccatattcgtgccgctcaggttgctacgggactggctcaagttaagcttgtgggaattgttgacggtcgataacgtcaatttttattataactttaaacctaaaggagaacatgaatacatactagtatagggtttaaactaataatttccacaagtattgtacattctgtatttttcacggcggtttcctggggagctggtattgagggcctctaatgcaaatcaaacacggaaacgtatccaccataggaaacagcgcgagaggatttaggaaactctagaagacgcccaacgtgagggggggaaccagcggccgccaagtggggccgcccggcgcccccctgctagggtttcgctccccccgtctggaagcttcctccaccgcctttgaggagtcatctcggcccttggttaagtcggtttgatccgacggcgcacatgcatcccatcggactataaatacaggggtagaccccctgaaaacaccaatcaactcattcatcaaggcctcaagccatcaagcatcaagcaccttcaagttcatcaatagccttctagttcatagttctagttagttagattagaagtagaggagatctagttcttcatcgggatctggagcccctagcgtttgtctggagcgcaagtgttcggtaattgatctagttctttctttatagtattcaattgtatattagggagactttattcttaatagattcatatgttcttaattgcaatagtcattgtctactttgattatatgtctaggatagttggttcgatcctattgaattcatgtaattgctcgtatagcatttacccaatcaattggtgggtagatggtagacaatatgtagacgtggtgtctagatatcttgtttatctgcgagggcaccctgcaccctgatgtgccaggtcgtgtggtagtccgcgtagatgatagctgttttggttcctttgtagtccacccccatacgtaggacagcttgggcacggtcgcgaaggaggtaatggttgcgtcttaatatcctcattagttgatgcctctttacatgtgattatgatatagggttgacttaacaatgatttctagatgtaattgcactaattagagttattcattgatgaagttatagaattaccttagtatttcttcctgagtttatccaatggctagcaattactatgactagaagagctctgatatttatctatttatgatgactgatcatta

SEQ ID NO: 11450 - DNA, 742 bp, Sorghum bicolor
  Clone ID: SORBI-28MAY03-CLUS39192_1
ttcccgcgcttccccaaacacaggcccgcggtttctcagaacagtgatcatgaccgtgctttgtttggggccaagtgcagtatgctggagtttcgtcctgctctgcttcgttgcttaaccgcttattgtttcttcatggtggaaggtacggatctatggcagagaggattctgaaagcaagacttgtctacgggagccccaacacgaacagagctgttagctttgagtacatgaatcggcagctggtctggaatgagttttcggaaatgttgcttttgcttctccccttgctaaactcatcctcagtaaagaagttccttctccccttctccaaagataagtcggcaggttcatctggcgatgaagcagattgtcctatatgtcggtccagtcctagcattccttttattgctcttccatgccaacacaggtattgctattactgcctacgcacacgttgttccgctacaagctcctatagatgcccacgctgtaacgaggtggtggttgcaattcaaagacaagggtctagttggtttactagttgggttaaaaaaaatcttgcccgtttacacagagtcacagacaaaggtctttcttctacacagtttagctgtttcaatgctcgattaaggattcgcatcatgatatgtccatgtaattgctttaagcgtggacaatcttgatgccattaatcacttgtatatgaatctctgccacgaaacaaacacgcattcattcg

SEQ ID NO: 11451 - DNA, 1346 bp, Sorghum bicolor
  Clone ID: SORBI-28MAY03-CLUS3954_1
cgtccgcccacgcgtccgtgtctgtgtctcaggaggaaattgttttcaacgttgggaagagtgtagttgagaacaaatctgatggtcttgcattcagacgggctggattacaaaaggaaggatcaaaggttgtctatggtgttccaaaacatggaaagaagaagaagtttatggaagtaagcaaacattatgacgcaggccagtctgacaagatttctgagggcaatgcatctaacagatttgtgaaacatctgatgccattgccaaggccacgtgaaaatactaccaaagttgatcctattagaggaaagagagtaggtgagacgaggtctagattacctaagcctaccaagtctcagagcgttggaggtagcagtgctcctgaaaaggattccatgcccatgcatgttcaaaattcttgtgtttctcaaaggagttttagttttgcgggaagttcgacaagcacttccaacaatgagaagcccaccttagttaaaaataatcctgcgcttggtgggggccttagaactgaagttccttctgtttctgaactgcaaactgcatctactgttcctagttccaagccaaatgtatccactactaatcgagctaaaaggaaatatgttcccactgtcagtaacgcaaacagaggtatactcaaaacctctgaaaagacgagttctgattctggtgaaccccgaatgactacttctgattctactgaacccagacgttctaacaggcgaattcaaccaacttcaagattactagagggcttgcaaagttccctcataatctcaaaagttcctggcgagaaggttcctaggagcaattacagaagtgcatcgtcaagagggagagctcaagctcatggttgagtgaaggcaccacatagctgcttttggtgggacagctcgttgtacatagctgcagccttccagtatggaagcaggaggataggattggagtaggaagtctttattggaacacaaggattcggatgtattataaactagcttaagtgaattgtgttaaccctttcttttacttgcttgaatcagacttgtccgtgttgtaggatagccattaatctcgtagaaacctcctcttaggccatcctcaatggcagtttcatagcccagttttcaacacatctgtattttggaaacagtgcattagagtttcatgggataaaactcttatcatctctctcttcattactatagcgccacatcagcatatttaatgtgcatgaaactctcatgaaactccattgagcctggccttagtatgtatggagacaccgggaaagaaattgggtgtggtttaaattcatccgacaattt

SEQ ID NO: 11452 - DNA, 916 bp, Sorghum bicolor
  Clone ID: SORBI-28MAY03-CLUS3879_1
cgcgccgtgcccctccccatcgcaccagctacctccctgcggctgctttgcatcgcctcgcctcgcctcgctggccgttagggcaaggcggcagggccgcgggcggtgaggcggggcgggggcctacggtgggggcggcgagcggcaggcggcaggcggcgaggccgccctagtaaaggatgatatacacggcgatcgacacgttctacctgacggacgagcagctgcgcgactcgccgtcgcggaaggatgggatcgacgaggccaccgagaccgcgctccgcgtctacggctgcgacctcatccaggagagcggcatcctcctcaagctaccacaagcggtgatggccacggcacaagtactgttccatcgcttttactgcaagaaatcatttgttcgattcagtgcaaagagagttgctgctagctgtgtttggctggcagggaagttggaggagagtcccaggagatcaaagcatattatatttgtcttccacagaatggaatgtaggagagaaaacttgcctatcgaattcttagatgttttttcaaagaaatattcagaactgaggcatgacctgatacggacagaacgacatctgttgaaggagatggggtttatttgccatgtcgagcacccccataagttcatatcaaactaccttgcaacacttgaagcccctcctgagcttactcaagaggcatggaaccttgccaatgatagctttgggtcgtctctctgcgtgcggacaactctgtgtgtgcgatttaagagtgaagtagtagcatgtggagttgtgtatgctgcagctaggagacaccgtgtaccccttcctgaagatcctccgtggtggactgtctttgatgctgatgaagcaggaattcaggaagtttgcaaggttcttgctcacctcta

SEQ ID NO: 11453 - DNA, 355 bp, Sorghum bicolor
  unsure (1)..(355): unsure at all n locations
  Clone ID: LIB3481-031-P1-K1-A2
cgtccgggagagaaaacttgcctatcgaattcttagatgttttttcaaagaaatattcagaactgaggcatgacctgatacggacagaacgacatctgttgaaggagatggggtttatttgccatgtcgagcacccccataagttcatatcaaactaccttgcaacacttgaagcccctcctgagcttactcaagaggcatggaaccttgccaatgatagcttaaggacaactctgtgtgtgcgatttaagagtgaagtagtagcatgtggagttgtgtatgctgcagctaggagacaccgtgtacccctttctgaagatcctncgtggtggactgtctttgatgctgatgaagc

SEQ ID NO: 11454 - DNA, 1323 bp, Sorghum bicolor
  Clone ID: SORBI-28MAY03-CLUS39604_1
gcacgaggcccagacttcctatatatccaatctttaggagaatctggtatcgtatccagcaagttgtcaaactccttgcgaaacactgacaagtggctctcattccaagggaaattccttgttcctacctgatagttacctctctcgtttcgatcttgtcaactggaaagtgcttgttgagcatccatttgcagaaatagaccaaaagatgctgagtcaaaatgtttgcattttggatctgcgtgcctgcccagatgtttctccgtccatgctcatagagctaatggctggtgaaaacagcatcatcagcagagtttttggaaatactagacgccttcaaccagactaacctgtaactaaagcgcaagcagctgctgcactaaccagtggtcgaatgaaggaagcaattcaggaagagttaaatagacgcgcggcggaaaaccaagcccatctttctgttatagctgaaatattggaagagttaattagtaggggagatatacaacaacaatgggaggaaatgatgaaaaaggagcaagaacgggctcttaaagttgacaataatcttcaacatgtgttgcatgagcttgcaaatgagaggacagacagagaagaggaactagcagacttgttgaaagaaagagcagatttagaacgccagaatcaggaacttataaatttaaggtcagaagttgatggaatgtatgatagattagcaactgagaatgaagaggtcatggctgatcagcaaactttggaaaaccagttgtccgacatgaccagcaagcatcaaactgtcaatgaagctaaatcatatcttgaagctgagaaggaagctcttacaatgctaaggacttgggtggaagatgaagcagcacgtgtccatgaacgagctgagacacttgagaaggctttgagaagatggcgaatcccagaagattgatccttccaaactaactgtgttttgcatcggtaaagtcttgctcaaagtttttgaagctctttggctccagagcatatgccatctgaataattctcaatggtatgggatggttgtgccttaatgttctattagtttattttcctttggtgcttcttgacatcttgctgccattctaagggcacactggcacctggaaaccttttccgcattcatgtagatatttttgatgccttgatgttgtagctgtgctcgtcaagtctaaactggatcttggtacatgggtgtacttgcgtgaaactgtgcaagcctggaagggtgttgctccttcaaatttcatgctatatgctatatagtcttgtagtggacgtaagagacttcag

SEQ ID NO: 11455 - DNA, 832 bp, Sorghum bicolor
  Clone ID: SORBI-28MAY03-CLUS39800_1
catctcctctcgctttcctgtgggctcccacggcagcgaacgcgagcacgcacggcgcggagctctcgtctaatcccctcgcgccgccggagagggagcaagggagagagatctgcgcgcggtcggccatggcagcagcggcggcggagcaaggggtggacggcgcgaggaaagagaagaaggaggaggaggaggagcaggttgtgaatccgtgggaggtgtcggcggggaagggcggcatcgactacgacaagctcgtggaccagtttgggtgccagcggatcgacgacgcgctcgtcgaccgcatcgcgcgcctcaccggccgaccgccgcactgcttcctccgccgaggcctcttcttcgcccaccgtgatttgaacgagctactggatttgtatgagaagggggagaagttctacctctacacggggaggggaccatcgtcggaggccctgcacctcggtcacctcatccccttcatgttcacaaaatacttgcaggaggcttttaaggtgcccctagttatacaactgactgacgatgagaagttcctgtggaaaaacttgactgttcaggaaagtaaaaggcttgcccgtgaaaatgctaaagacattatagcatgtggttttgacattgaaagaacattcattttctctgatttttcttatgttggaggtgctttttatgaaaacatgatgcaagttgccagatgtgtaactatgaataaggctataggaatatttgggttcaatcttgaggatcacataggaaaggttagctttcctccagtgcaggcagtcccatcattcccttcttcatttccccatctctt

SEQ ID NO: 11456 - DNA, 1242 bp, Sorghum bicolor
  Clone ID: SORBI-28MAY03-CLUS43635_1
tactgggtgcgcttcccagtttccactctgctcccttctctcttctctccgactccgccatggccgcatcgccctacccgacgccgacggcgccaccgcctctcatgggaatcctgggtttcctcctcctcctcctcctcctcatcctcgtctccctctcgccgtcgattccactagtggaggcgggcgcggaggcggcgggggttctgaggcaagtggttggtggggacgacgacgacgacggcgggaacttcttcgagccctccagcgtgacctacgaccaccgcgcgctcatccttggcgggaagcgcaggatgctcgtctccgcggggctccactacccgcgcgccacgcccgagatgtggccgagtttgattgcaaaggctaaggagggcggcgtggatgtaattgagacctatatcttttggaatgggcatgagcctgccaaaggccagtactactttgaaggaagatttgatattgtcaggtttgctaagctggttgctgcagaaggcctttttctgttccttcgtatcggcccatatgcttgtgctgaatggaatttcggtggtttcccagtttggctgcgtgacatccctgggatagaattccgtactgacaatgaaccctacaaggctgaaatgcagaattttgtgacaaaaatcgtagatatcatgaaagaggagaaactttattcttggcaaggtggtcccattatactacagcagattgaaaatgaatatggtaacattcaaggcaagtatggtcaagcagggaagagatacatgcaatgggcagctcagatggcacttgcacttgatactggtgttccttgggtcatgtgcaggcaaacagatgctccagaacaaattctcgatacgtgcaatgccttttattgcgatggtttcaaaccaaattcctacaacaagccaacaatatggactgaggattgggatggatggtatgccgactggggtgaagcgttgccacataggcctgctcaagatagtgcttttgctgttgctcgtttttatcaacgtggtggaagctttcaaaactattacatgtattttggtggaacaaattttgagcggacagctggtggtccacttcagataactagctatgattatgatgcaccaatcgatgaatacggtatcttaaggcaacctaagtgggggcatttgaaagacctacatgcagctattaaactgtgtgaaccagctcttactgcagtagatg

SEQ ID NO: 11457 - DNA, 906 bp, Sorghum bicolor
  Clone ID: SORBI-28MAY03-CLUS43703_1
gcacgagggtggatcagaaccttaaccaaactgcacctttcaccctccttttctctctcccgttcaccccgcgtgcacgctctcttcctcgtggcgacgaccgggcgaccgccgccgccgccgccgccgccgcccccaggtcttgatcgggccactcgccggcgacgagtagccaccaggaaatgttgtgaggactgatgctataactaagctccctggatggacggatgtgattgcatcgagccactatggcctactgatgatcttctcgtcaagtatcagtacatctcagacttcttcatagctctcgcgtacttctcaatcccattggagctcatctattttgtgaagaagtcgtccttcttcccgtacagatgggtcttgatccagtttggtgcgtttatagttctctgtggggcgacccatctgataaacctgtggactttcaccacacatacaaagaccgttgcgatggtcatgaccatagcaaaggtttctacagcagttgtgtcctgtgcaactgctttgatgcttgttcatatcatccccgacttgttgagtgtgaaaactagggagttgttcctcaagaataaagctgaacagcttgatagagagatgggactgataaggacgcacgaggagaccggtaggcatgttaggatgcttacacatgaaatcagaagtactcttgataggcatacaattttgaagactactcttgttgagctaggaaggaccttgggtctggaagaatgtgcattgtggatgccatctcgaagtggttcaagccttcagctttctcatactctgcgccaccagattactgtcggatcatcagtgccaattaatcttcctgtcgtcaatcaagtgttcagtagcaaccgagcaattataataccccacaca

SEQ ID NO: 11458 - DNA, 718 bp, Sorghum bicolor
  Clone ID: SORBI-28MAY03-CLUS43994_1
gcacgagggccgtctggaaccctcccggctctctttctgcaactgcaaccccccggcaaaggacctctcgaccctggctcgtcgccgtccgtccgacgaccagaccaaccaagaggttgattaggctactcctactctccgagtgaaggaggaaagcacatagacatggccctcaggaccctgcaccttccatccaggcccccgcgccctccctcccaccgcgccaggccatcctccccccccccccgcccgccgtccccgcctcctcgccagccaaagcttcctccaggacccggcccacaacaacaaacaagagttgccactgccacgaagcagcagcagccgccgctctgtaagaggagtacaccgttgctgaaggtgaaatgcagggccagtctgcacgactgcatggacgaggagactgttgagaccccgaaagaccagaccaccgagatccccatcgtcgcgtacccatcggtcgtcttcccgggcgccacgctccagctgcaggcgttcgagttcaggcaccgcatcatgatgcacaccctgctccagcagggcctcaggttcggggtcctctgctcggcgggcaagaccgggaccgggaggatggcggacgtggggtgcgtcgtccacgtcgtcgagtgcgagaggctcaccgacgaccgcttcttcctcacctgcgtcggcaaagaccgcttccgggtcatcgacatcg

SEQ ID NO: 11459 - DNA, 1583 bp, Sorghum bicolor
  Clone ID: SORBI-28MAY03-CLUS44093_1
actcatattaaaaataaagataattcatctgaaatactataccaattttagtactatgagtaacagagctatcatcccagctgaaaatttcttaagttatattgtataggtctaatttggtgccttcgtggtaccatttgggcacttgagcaataaccatgaaacacaacaccattttgcaggggcccttgtatgctatagcctatcacaaaggtaatatgtgcagcatacattcattttcatttcatattttatagtggaatagtattcctttaatcctctttatttggcattgtagcagttaaacgagacagctaggagtacatctctactaaagtagtgaagtgtgcctattccatttagtgcaagcaacacttttctttgtttattggttaataagcctaaacatgagcagtttgggagacaaacatatttagtacgcagcaagattcacaaagtcaataagggcatgaggtcatagctagcttttccttcagtgcatgcaattttgaaacatcatacacaaagggaacagagggagtaccaagtatgtcattgtcaagattcaaatatgcaggctatttcttaccttggtcttggactgcggcttctgaaacgaccccttggctttggattttcttctgtaattctacccctatggctgcaaacacaaacaagaaggcaatgcttaataagtgaaattgcttttagtgttttgccattctctgagttgtattgatgcacttaatagatagtaaaatgatagtatcaacatattttacatgatagcaagcggcattcttgattattgtaatgggtgttttcttagaaaagaaacaatatgagttaaacaggccatgtaatgtgacttttgtcctctgctagatgtgtaaacaagtaatttgggtttgtatgtctgaccgtgtcgctctcacctgcctcttcatatgttccatccaggacaatttcaatgccatacatagagcaacgatccttgtgattgtcttctgtacaagtgattattaatcatcatatgtgcattgttgtttttttcctaaaactgaatcgcatgccctctcctcttacagaaacactggaataggatcatcagatttttagcctgaagatagatcggggcatgagaattggccaaaatgccatcctgtatgtgtgatatggggaactgcttaccacctaaaaaatcaaatcatgtttgtgtaaaatcaaatcatccgcatagcgttggaaatttcagtaattaatcaagaacaagatcttttccccttcctgcttggcgctggtggctcggcgacggtggggcggccgacagggtgttgcgtgctggatgtctgcctcgagcacgtcatctccttcgtcctcctcggcatggaggcctgctctgtcctttttttcgatcggtctggctcctcatcacctcatgcataccgccgctgcttctggcttcaggtagcaccccgaccgcaccatggaagtagcgatcatggtcggggggcgccagggcatggcgtgcgcaagcagtagctgcgagtgctcttcgtcctcctccctgtggtggcctgcta

SEQ ID NO: 11460 - DNA, 549 bp, Sorghum bicolor
  Clone ID: SORBI-28MAY03-CLUS44054_1
gcacgaggcgctcccctgcgagctgtgcaagactccctcaagctactcgggaacaatcccatgccttatgctgattctaggaggaaacttgacaaaaggtgtgcgcaagacgaaggtacccctgatggtggttgtcgcagtcatctgcgtgcgctacttgatcctgccgctcatcggggtgctcgttgttagggctgcgcgtgacatgggcttccttccgcctcacccactctaccagtacacgctcatgatgcacttcgctgtcccgcctgcaatgagcatcggtaagtctcacatatgtatttgattttcatttctatccctcaccacaccatatacatcataagaaggatatatagacatctaacctatatcttggtgcatagtataatttactattatgcagcttggaaagccagaacatcttacgatttaaaatagagggagtactagttactacatttccatgcttccaagtgttactaagcatgtatttcctttttctcataaaagttacaacgtatcacaggaaaaaaaaaaaaaaaaaaa

SEQ ID NO: 11461 - DNA, 1498 bp, Sorghum bicolor
  Clone ID: SORBI-28MAY03-CLUS41266_1
accattaccactcgccgtcttcccgtctcctcctcctcctcgctcgtctgcttgcctagggtttcgcctactcccgccccgcgcctccagccgtcgcttcagatcccgctgctgccggcactcgatccttcttcgctgctcctcgctgatcccgctgagctccgatttgcgcccttcctccccgccggaacagcgtccggacgcgcggaggcagatctgggttttggtggcccgcttggtgtatgagaaggcctctagagctttggagtaatggaggtggagccggcgagggcgcgcgcggcagcgctggacccggagctgctgcagctggcggagctcgcgccgggcgcgcttcgtgagaactccataatagctgatgcgctctactcgcagtggcccgtgctacccgagacggccaaactggtaaagtctttgattgaggatgcaaagactggtgccgtgcttaatgttgttggaagctctgctagcacaaatgctgcttcaagcagttccctaccgtcgatgtttcctgctggtagtgctccaccactttctcctaggagcacttctgggtccccccgtgttatgagacgaggatctggagctggaccagcgcccgggggttctccattaaaattagttagtgaaccagtgagagaagttatacctcagttttacttcaagaatgggcgtcctcctacaaaagatttgaaggagcagtgcttatcaagaacagatcatctattttttggtggggagggacttcagattcaagaattcagatcggtcacaaaggacatatgtaaacttccttcattcttctctagtgttcttttcaagaaaattgatgttgcatgcactggaactgtctcaagggatgcatttgttgagtactggatcaatgacaataagattacaatggatatggctagtcaaatatttgaaatattaagaaagccgggttacacatatctcactcaggatgacttcaagcctgtcctgaaagaactactggcaactcaccctggcttagagtttttacaagggacccccgaatttcaggagagatatgcggagactgtgatatacagaatcttttactccataaatagatctgggaatggccatctgactctgagagagctcaaacgtggaaatttaattgctgcacttcagcagttagatgaggaagaagatatcaacaaagtgttgagatacttctcatatgagcacttctatgttatctactgtaaattctgggagctggatacagatcacgattttttgattgataaggaaaatctcatcagatatggaaatcattcgttgacctatagaatagttgatagaattttcacacagatcccaaggaaattcacaagcatgtcagaaggaaagatgggttatgaagactttgtttacttcatattatcagaggaagacaaatcatctgagcctagccttgaatactggtttaagtgcatcgatcttgatggta

SEQ ID NO: 11462 - DNA, 756 bp, Sorghum bicolor
  Clone ID: SORBI-28MAY03-CLUS41312_1
gatacattactgaagggcagatatacattgatagacagctccataatagacagatatatccacccatcaatgtccttccatctctctcgcggttgatgaagagtgctattggtgagggtatgacacgtcgagatcattcagatgtgtctaatcagctttatgcgaactatgccattgggaaggatgttcaagctatgaaagcagttgttggagaggaagcactttcatccgaggatctgctctatctagaattccttgacaagtttgagaggaagtttgtaacacaaggtgcatatgacacccggaacattttccagtcacttgacctggcatggacattgcttcgcatattccctcgtgaacttctccaccgtattcctgcaaagaccttggatcaatactacagcagggatgccacccattgatctgtttatccagcacaaaaagaaaactcatttcaccgaagcgcagcttgattgcttgaataaagaggagagtgtaaggacttgtgtctttttgtttgtttgtttgtttatatatatatatatagtcatcctattcattcagtctcaggcggcttttgtaatattatgcctgtatacttgaatccgatggtggatctcattgttggatgctactgtgtaggagcactgtaaagcggtattggctgaaatgctcgaatgtgttggttatatttgtttgtctctttgtaaattaatcaaacaaataaatgtctcacgtaatatttctctcctc

SEQ ID NO: 11463 - DNA, 990 bp, Sorghum bicolor
  Clone ID: SORBI-28MAY03-CLUS41766_1
gcacgagggtcgcgcaggtcacgttcgccaatcccggcgtgcaggaggacgccgcgtgcggcccgctgctggacgccgtcgccatcaaggagctgcccgctgcgtacccgaccaaagacaacctgatcaagaacgatgggttcgagatcggtccccaggtgctgaagaactcgacggtgggcgtgcttcttcccccgaagcagaaggacgcgacgtcgccgcttcccgggtggatcatcgagtcgctcaaggcggtgcggttcatcgacgcggcccacttctccgtcccggcggggcagtacgcggtggagctggtggccgggcgggagagcgccatcgcgcaggtgatccgcaccgtgccgaaccgcgcctacaacctgtcgttcgccgtcggcgacgccaagaacgggtgccacgggtccatgctggtggaggcgttcgcgggcaacgtgacgcagaaggtgccgttcgagtccgcggggaaaggtgggttcaaggcggcggcgttcaggttcgtggccgccggagcacggacccgcctcacgttctacagctcctactaccacaccaaggtcaccgacggcgtctcgctctgcggccccgtgctggaccaggtcaaggtcgtgcccgtgaaggcgtagtagtgaataatgaagaatcgtgagagctccgtcagagtgctcttgtcgtctgtagctgtgcttcgtcttcgtcgtgatttggcatggtgggttgggagactactgaacgaactcttggacccttctgaatcggatcatggtgtgcagaacttatgcatggtgtgatgtactaatcttgcgaaatttggttgcccttcttgcgaaattatggtttggtggtgtcctcaggctgaaccagacatgccacgattgcggtcagttccaattgtggaaacgcatgcgtgatgtccggttgccggaggcattgatgtagccgtgttcaatcaggcattgaagcaattgtcttgat

SEQ ID NO: 11464 - DNA, 591 bp, Sorghum bicolor
  unsure (1)..(591): unsure at all n locations
  Clone ID: SORBI-28MAY03-CLUS41798_1
gcacgaggcgtttgtctccgcggcccccgctcccctctcccaagcaaacacagccgagtcgtgcacgcacgcacgcctcccaccactcctcaaccgccctcgctcccgcctcgccggagcaggaggagcagtagcggaggatggagatcgacgaggcggtgcgcgggtgcagcgaccgccgcctgcgcaccaagtacggcaacgccgtctacgtcgtccagcgcgccttcgcgctctacccgtttgaggaaattgccttcagctttaatggtgggaaggattcaactgtgctcctgcatttgattcgagctggttactacctttacaagaaggactctggtgatatagcccaaatgaatgctgttaaaaactgtccactgcgtaccatctattttgaaagcccttgtgcttttcctgaaatcaactcattcacttatgagactgtctcaacttatgggttaccactggaaactatccattcggatttcaagtctggtctagaaggccttctgaaggagaagcccaccaaagcaattttcattggcacaagaattggtgatccaaatgcggtgattntcttttggcattgtt

SEQ ID NO: 11465 - DNA, 1047 bp, Sorghum bicolor
  Clone ID: SORBI-28MAY03-CLUS45199_1
gcacgaggcagggatcacgcccggtatataaacgcgcaggcgcaggcggcccacccaccggcggcgccgggccgagaacaatccgtcgtccgagttggcatctttggccaaaccagtatcattgcccaatcacagatctcctctccctctctctctcatttcccactacctgctcttgctgctgcttgtgcggtgggcgctgcgggcggtgaggaggagcggagcagagaggtgaaaggggatgaaggaagagatggtggtcggcctgtcggcgccggggccggtggggaggtggggcgccgcgccgccgcaggcgatgctcgagaggatgaaggactacggccaggagggcgccttcgcgctctgggacgatctctcgcccgaggaccgggagctcctcgtccgggacatcgagagtctagacctttcaaggatcgatcggatcatccggcggtcccttggatcacaaggcatcccattgcctgctgtcgagcccgtgccagaatctagcgtctccaaggtggaggacaggtctcctgaggacaaagaaagatggtggaagaaggggctgaaagccatctcggaggggaagctggctgttgtccttttggccggtggtcagggtactcgcactgggaagctcagatcctaagggatgtttcaatattggacttccatctggaaagtcacttttccaactccaagctgaacgtattttgtgtgttcaaaagctagctgctcaatctagtgaaagtccgagtaacactgtgccgatccactggtacataatgacaagcccctttacagatgctgtcactcgcaaattctttgagacccgtagatattttggcttggaccctgaccaagtgacatttttccaacaaggcacacttccatgtgtttctgctgatggtagatttattatggagacaccatatagggtagcaaaggctcctgatggcaatggtggagtttatgctgcgctgaagtccaaaaagttgttggaagatatggctgcacggggtgtaaaatatgtagattgctacg

SEQ ID NO: 11466 - DNA, 688 bp, Sorghum bicolor
  Clone ID: SORBI-28MAY03-CLUS45334_1
gccaaccagaagctggcattcaaatactatgggccattcaaggttattgctcgggtggggtctgtggcttatactttggagttgccatcatattcagcggtgcatccgacgttccatgtatctcagctcaaaaaggcggtccttcccaatacccaggtatcacctatccttccggctgatgttgaactccctcgtgttcctgctgctatcttacagcgccgtcagacttccaccggcgaacaagtactggtgcgttggtctgattggcctctcgagatggctacctaggagtcgctcgaagctctgcgccaagcttatccgcgggctcctgcttggggacaagcaggttctcaagccccggggattgttagcagctccccatctccaggcccagatgctacggagcgggccggcccaagaaggagtgccagaagccgaaggcccaataggaatgtctccggggaagagtgggcgtgagcgcctgcgtgcgcgagtccaggctgcggcttgtaagcgtctatatgaggggaaaccagagagagaggcatcgaatgattgatgtaaactcaactcatctcctaagcactcttggtcgctccctcccctgccgttcttcctctccgatccccaattctctaattccttccccaaattgctgtatccggtttctgatgctaacatatgccta

SEQ ID NO: 11467 - DNA, 805 bp, Sorghum bicolor
  Clone ID: SORBI-28MAY03-CLUS45338_1
ctccatctggctgcaccagttctactacatctttgggttcctcttccttgtgttcctgattctcatcgtgacatgtgctgagatctcgattgtgctatgttacttccagctctgcagcgaggattacctgtggtggtggaggtcatacctgacatctggttcctctgcactctacctcttcttgtatgcaaccttctatttcttcacaaagcttgagatcaccaagtttgtctcagcagttctgtactttggttacatgctcattgcctcatatgccttctttgccttgaccggcacaatcggattctatgcgtgcttcctgttcacaaggctgatttactcatcggtcaagatcgagtaaggtgaagtgcactcttgcctaattctttgttgccacgaagaaagaaatttctgtggataatgaattctacaggaccgctgagtttagctgcaagtggcctcgttttgagttttccaagctggtagttatgatgaagttgcgattcattaccgtatgattcaggtattatagctagtgcagtattttttttttgttttctcttttgttttgttttttttgggctgtgcctttggaccgtcaggatatatgcttatcaagcgctcgacgctgagcgaattgtatacggatgctgagtaatctatctcttgttcctgtcagaatttatgtacttgttgacgtgcactctgacttactccatgatacggagtatacaattgtagctacaaagtccggctcctgtttcttttgcatcggagtacagacataatggattatattttttct

SEQ ID NO: 11468 - DNA, 883 bp, Sorghum bicolor
  Clone ID: SORBI-28MAY03-CLUS45425_1
gcccgaggccgcaggctcattcttcttcctccgtttcgtctccactctccccccgcggccggggagcctcgagcgttcctgccacgagatctctcctgccactcccctcgcctgctcgcaacaccggcatggcgccgtcggcgtgggccgtagccctcgccgcactctgcatcgtcgcgctcgcgccaccggcagcagggttctacctacccggcgtcgcgcccaatgacttcgagaagaaagatccacttcctgtgaaagtcaacaagctgacctcaatcaagacacaacttccatactcttactattctctcccattctgcaagccggataccatagttgacagtgcggaaaatctcggtgaagttcttcgtggagatcgcattgaaaactctccctatacgtttgaaatgagggagcctcagatgtgtcaaatagtctgcaagatatctgttggggagaaagaagcaaagcttctcaaggagaagattgaagatgagtaccgtgttaacatgattcttgacaacctacctttagttgttcctattcaaagagtggatcaagaaggtgcttatttctatcaacatggattccatgttggggccaaaggaaaatattcagggagcaaggatgaaaaatacttcatccacaaccatctatcttttacggtgaaatatcacagggatgagcaaagagatatttccaggattgtggcctttgaagtgaaaccatacagcgttaagcatgaatatgaagggcaatggaatgataagaagacccgcctgacaacgtgtgatcctcatgctcaacgtattattacctcatctgagtctcctcaggaggttgaagttggcaaggatatcatatttacttatgatgtgga

SEQ ID NO: 11469 - DNA, 805 bp, Sorghum bicolor
  Clone ID: SORBI-28MAY03-CLUS4544_1
ctcacgtcctaataaagcttctttttgacgctgtaaaagacacactcacttgagattgcttcggatggcggaactggctgcatacccctggggtagatcatgctcttgggagcacagggattgcaagaatggttccagtaattcagcggctgaggaaatttggcgggtcattaggaactggtcgatacttgagaagtatcctcccggcgaagctattgaaagaaatctcttgctggagatgatactcaagagggaggtggctgagccagccagcgctgacacaactcggttagagatgtttgatctcaacgccacggtctgcgccatggtcttggaggacctggttgaagagacagctgtagatctgactaactgctagtgagtgtctgttgctgctgatgcagccatttgctggatttggagtggagtgcttggtcattgccatgggatccaatccaaagcctgaagaaggctgaaaggctatcagttattgtcatgaaatctgccttccccctgcagccgctgccgccaaattgctgtagttttttgcggtatgatatgaatgaatgccatgggctgcttgcatgctttgctattgaaaagtaggttgctgggtccctcctccacgttgggacgctctgccccgctcctgtgggccgccgttgtggggctcgtccgtgggttcttctcgtccagattgcatgcacgacagtgtgtgtacagtgactgactgacaggtgttgatcgagcagcattgatgaattgggggctgccatgccactgccaccacctccacgacggctca

SEQ ID NO: 11470 - DNA, 692 bp, Sorghum bicolor
  Clone ID: SORBI-28MAY03-CLUS45489_1
atctttacaaagacactttcatcactagtttagcagaaatcccaggtttatttttgtctgctgttcttgttgattggtttggtcgaaaagcttcgatgtggtctatgatgtttgcatgctgtgctttccttggaccacttgtacttcaacagaatgagctgttgacaactattcttctatttggtgcccgtgcgtgtgccatggggagctttacagttttgtgtctttatgctccagaggtatatccaacagttgtccgctcaaccggtgcaggaattgcaaccgccgttggtagaattggtggggttgtttgccctcttgttgctgtcgctatgctgcggagctgccaccagatggaagcactcattgtgtttgaggtgatattatgccttgctgcagttgcctgcatattcttccctgtagagaccaagggccgtggaatggattgattttgtagtatcagactttggcattcagatgagcttgtagttcatcactgttcaaaatttctaccatcattatgtgtacagagaatacacatgtaacatgatgtttgatgtgtataacgagctggatagttcttcaaaatatacgcatgactttccaaatttgttagatacttccctgtggattttgtactatcaaaacattgaaaggcaggtctacgaaccgagttatatttctgctatcaa

SEQ ID NO: 11471 - DNA, 728 bp, Sorghum bicolor
  Clone ID: SORBI-28MAY03-CLUS42703_1
atggaaattacactcatccagctggtttcacaatgggttctcctggtgttattggagctgcagttggtgttgatgatgtcaataggatgaagtacaaggacaacatttatgcctcaactccacaggtcgagacatctgacatctggattcagtcagctagagagatgccacctttgcaggttccttcatattataacataccaggtcaagcaacggctggtgcttttgtgccaaatccagcaaatgcatctttcaatgctacagctcaatcctctcatgcgcagttcccaggcttgtaccatcctcaacagcctccctctattgtaagtccgcaccccatggtgcatcaacaggtgccatcggccattggtcccaatgttggggtcggggtggcagctccaggcccgcaagttggggcttatcagcaaccacagcttggtcatatgaattggagacccagcttttgaagaaggtttcttaattatctgtaattaggggggccacaagagcctttatgtaacaacagtaggctccttttaacaggaagcacctttgtttttagtgcagctctttctgatctatttaagctataacaaggtttttgttagcttttccttcccccaggtgaattcggtatcccatctgaactggtatgatgtagatttgtgagttaaacattgggcaagatctagcgcgagcaccaaggttgagtgccttacatttttccc

SEQ ID NO: 11472 - DNA, 794 bp, Sorghum bicolor
  Clone ID: SORBI-28MAY03-CLUS42736_1
acttggtgcagatgaggtgttcacagaatctcagctagacatgaagaatgtcaagagcttgctgggtgccatgccggagcctgcattaggatttaactgtgttggaggaaatgctgcttctctaatactcaagcttttgaagcaaggaggcaccatggtgacttatggtggaatgtccaagagacctgtcactgtccctacttcatatttcatttttaaggatctttcgctacgagggttctggctccagaagtggctgaactcagataaaacagaagactgcagaagaatgatagactacctcttgggccttgtgcatgaaggcaaactcaaatacgagatggagtcgatttctttcggtgagttcagcttggctctggagaaggccctgggcaaacatggaagccatccaaagcaagttatcaggttctgagacgagggtaggctagaggatcagagagcatgcaattgccattgattctgtatgaatgatgaatccaacagttggtatggcaattgtaagagtgacctggagttgtatataaaataaaataaagtaaagtatgttgttcgcttgagcttatcagccaaatccaccagtcatttagtagtgtttttctcttataacaaatcagccaacaatacttttcgtcatggcttatgagccaaacgaacaagttagctaagtgagtgaaggatcacttgttggtggcgggcggttgtacacaagttgtgcgtgaagtattagtttctttgtggcggacggttaatacgaattcaacagagttgtttat

SEQ ID NO: 11473 - DNA, 612 bp, Sorghum bicolor
  Clone ID: SORBI-28MAY03-CLUS42759_1
ccgaggccgcccgcaccggcgcccgcaccggcgccgcaccgcccgcagctgcagctgctgcagcaagagggtgtcgcgatgaacgttgagcagcccgtggccgcggcggcgtcggagatgatccggcgcaacctcgcggagcagatggcgatgacgctgacaagggaccccagcttcaaggcggcgctcgtcaccgcgctgtccggccggatcctcgagctgtcgcctaccaaggattgacagacgcatcggatcggatcggttcgattggcatcacatacacgagattcttgctcagattgtcgtgcacccacgcagcaatcgtcaacaactgcgctggctgctttctctgttcatcgctgttagagcaaaacagcgataacagaacaagacatcaggatctgtagtgctgcacgaggaagaggaacaaccggagtccatggaagggagcagagatcattacgccgggtggtcgacgatgtaacatgcgaaatagtagcacaggacatgttagcatgaaattgtacaatccctagtactttgtagttgtaggcgaactgttcatccaattgatcaaatgaaatcattacaattttttctgagttggaattg

SEQ ID NO: 11474 - DNA, 737 bp, Sorghum bicolor
  Clone ID: SORBI-28MAY03-CLUS43132_1
gatgcttcgttggactctccgccggcgaccggcgagtccaccaccatccccactcccatccacccgcttcttccaactccaaggcgctgctgtgctggctgctgctgctaccgcaactgctccgcatcccggccattaatgcgcagctacgcccacgcacggaccgcggcggccttgattagcgaagtattcccttgccctacctctccccctccccctcccccgtcccgacgcggcggccggtgagaacctgccctgaagcttagcttcggccatggctcacgatggcggcgacaacggcggcgaactcccgccgcccgcgaagaagaagtcgcccgctgaggaggaggccgagaagaggaggaagaagcttacacctgggagcttgatgaagggcatcatacggtctgggagcggtgatgccacccctgcagagggcgatcaggttatacttcattgcactactcggacgatggatggtgttattatcaattctactagaagggagcacggaggtaaaggaatcccactcagatttgtcttagggaagagcaagatgatcctaggctttgctgaaggcttcccaacaatgctgaagggtgaaattgctatgttcaaaatgcagcctaaaattcactacgctgaggacgattgtccagttgcagctccagatggctttccgaaagatgatgaacttcaatttgagattgaaatgttggatttctttaaagccaagg

SEQ ID NO: 11475 - DNA, 1178 bp, Sorghum bicolor
  Clone ID: SORBI-28MAY03-CLUS43255_1
cacagagaagccaaaacacattctcccgatcctcatcctctgcgttcgtgcatctcgtcgtgcgaacagaagccaaagctatagagctctgccaatggcgggagcaggcaacgccgacgacccgaagttgctgggcgtgtggacgagcccgttcgtgatccgtgtccgcatcgtgctgaacctgaaaggcctggcgtacgagtacgtggaggaggacctgggcagcaagagcgcgctcctcgtgggctccaacccggtgcacaagaccgtccccgtcctcctccacggcggccgcgccatcaacgagtcccagatcatcctgcagtacatcgacgaggtgtactccgggaccggcccggccgtgctgccgtccgacccctacgagcgcgcgacggcgaggttctgggcggcgtacatcgacgacaaggtgaggtcggcgtggctggggatggtgttcacgtgcaaggacgaggaggagagggcggaggccgtggcgcgcgccggcgaggcgctcgacacgctggagggcgcgttcggggagtgcacggaggcggggaagaagcccttcttcggcggcgacggcatcgggttcgtggacgtcgtgctcggcgggtacctggggtggttcggcgccgtcgcgaagatcatcgggcgcagggtgatcgacccggccaggacgccgctgctggccgcgtgggaggaccggttccgcgccgccgatgtggcgaagggcgtcgtgccggacgacgtcgacaaggtgctcgcgttcctgcaggtcctgcttgctcgctaggtaggagcgagtaccgagtacgtactcctgcaagtgagatcacgttaattttcgtcgcgttactacgacgtgtgtacgaccgacctagtacgatgagctcgtctcgatcccttgtgtcactcagttttgctttgttcgtccgtcaataatcggtgtgcttaataaatgtacaacagctgttgttgtcttgtaacaatggctgatttttattataattttgcttcttcttcttctaccttttttttggatttgtactgcagagttcagtctcagtttgttgaagctggacacaaaatctcaggcacagatacgagaatgtgctcataaactggttggcaggcaagagaccacaaagaatcctttgcgggctttggaacctctagtg

SEQ ID NO: 11476 - DNA, 791 bp, Sorghum bicolor
  unsure (1)..(791): unsure at all n locations
  Clone ID: SORBI-28MAY03-CLUS45765_1
gcacgaggcaaatatccatccacactgcactcactactgcacgaggatcccattcattcccgtcggtacagactgcagaggagagggaggatgtccatgccggagacgttcaccgtgaaggtcggggaggcgacgccggccgccggcggcaggccgtcggccgggcccgtctaccggagcatctatgccaaggacggcctcatggtgctcccacaggacatccactccccttgggacttcttcagtggagcagtcaagaagtaccccattaacaggatgctcggccggcgccaagttattacagatggcaaggccggtgagtatgtgtggcaaacgtacgaggaagtgtaccagaaggtcatgaggattggatcagccatcagaagcttgggcgtagagccgggagctcactgtggcatatatggatccaactgcccggaatgggttatggccatgcaggcatgcaactgtcaaggaatatgttatgtgccactgtatgacaccctcggagcgaatgctgttgaattcatcatggaccatgctgagatatccattgcctttgtccaggagagcaagatcaaatcaatactagcagtagtccctaagtgcacagcccaccttagagccattgttagttttggagattttgcaagtgagatgaaaatggaagctgaaaaattgggtgtctcttgcttttcctgngaagagttttcttcaatgggaaaacaagactacaaacttcccaataaatgtaaggatgatatttgtacgatcatgtataccagcggaac

SEQ ID NO: 11477 - DNA, 795 bp, Sorghum bicolor
  Clone ID: SORBI-28MAY03-CLUS45882_1
gcacgaggcccgtccggctgcttcgtctccgacgcaaccccaggcccgcggccaccgccacggggccgtacgtccgcctgtggcacccggggccgcgcgggtgcggccgcggagcgggcgaaggaggcggcgcgggcggccgcgcacccggcgcaggagaccgcgcgcgcggtcaaggagcgcatggtccccgccgcgggcggccccgtggccgccatgatggcgcccggggggaaggtgctggagatgaccaaggagggccccgggagcgtcgccgagacggcccaggcgatcggcgacatggcgaagcaggccgcacggcgctcctgggacgcggccaaggagaccgcgcacagcgtcagggggagggtggtccccgacgaggacgacgtggacgccgccaggatggagcgggaccggatcgcgcgggagatggacagggtggagcgggagcgcaacaagagggaggccagggagaagggctcgggattgccgtagaccgaccggacaccaatttccatcgctgtctccagatgaattttactccagtagctggctgaataatgcaaaccatcgtgcgcggcgccagtttcgcttgtagtgttgaatcgtgtcgaatcgaatggaagctctgtaatttaaggcatacgatttgctgtgtccgccctccctgcgctgttcactgcaacggtgtctgcccaccttggcggcgtgtcagatttgttctctgatcagctggatggtccagtaacgtttcggacttcacacctctccaattttacattgggggtctct

SEQ ID NO: 11478 - DNA, 858 bp, Sorghum bicolor
  Clone ID: SORBI-28MAY03-CLUS4594_1
ccaaagcccaaagccgcgagaggcaagggcgcaacaaaaccctagccgccttcccccgtcctttcttaaaccccaagccgcgccgcattcgctcgcccccccgttccgccgcctctctctctctcctaccgcatatcccccctcaggtttagtgttaaaaaatggcggccttcaacaagcttggcagccttctaaggcacagtgctctggcgagcggtgtcgctgctagctcgtctcctgctgtgttcaatgctgctcggctcatgtccaccaagctattcgttggtggtctttcatggggtgttgatgacatgaaactgagagaggcgtttagtggctttggagatgttactgaagcgcgagtgatcacggacagggacactgggaagtcaagaggatttggctttgttaactacaccagcagtgatgctgccaatgcagctatatctggaatggatggcaaggaaattgatgggcggccggtacgtgtcaacattgctaacgacagacctgcagggaaccgcggtggaggtggctatggcggtggtggtttcggaggtggtggctatggtggtggcaaccaaagctatggtggtggctattaagctcattaacagtcaagatatttgaaataatgaactttaggacctggcatggggcttatgtgaagcctttcatattttgatatttgtgttatgttgaactgttggaactcctagattcatagactgtgccgcagagtattacctattggttttggttgcttcgttaagtgcaaatgcaagtcgcatgtatttctgttgagtggatacataatttgcacacattaccttagctgcctgtactttgcaatgtgta

SEQ ID NO: 11479 - DNA, 590 bp, Sorghum bicolor
  Clone ID: SORBI-28MAY03-CLUS46090_1
ttacatctgcaggctcctcggcgaggcggccctgaaaaccatagccggaaacaccagcttgacctgcactgaggtcgagcctatcaccggggcgcagctgaactacccggcgatactggtgccgctgcgagctgaggcgttcgccgtgaaccggacggtgacgaacgttgggccggcgaagtcgagctacaccgccaagatcgaagcgccgaaaggactgacggtcaaggtggagccggcggagctggagttcaccaaggaaaatgagaggaagacgttcacggtcacggtgagcgcagccgccggagccagcagcgagcagaagctcgccgaaggggccctgagctggttgtcccaagaccatcatcacgtcgtgaggagcccaatcgtggccgactccagccttaccctgagttgattgccacgactgcgttgtccattgcgtgcgcgcgcgcgcgcatgtaccctccgtaaaaaatgtaactcttacttttgagcattattcaaacataatgtcaacttcaaataaatatataaaaatactaatattgatgattctatcattagatgggcaactgaaatatactttt

SEQ ID NO: 11480 - DNA, 1276 bp, Sorghum bicolor
  Clone ID: SORBI-28MAY03-CLUS46493_1
gcacgaggaccacacggaagcacttcccccaatctatgctttcctcctcctcctctctctctcgtatctagatttgttgcaggatgacaaaatatgaatgaaatcagattcgattcgtgaggcagtaggccaaggatgctcctccaatccatcatcttaaattaaccaacgccaggcatccgcgcgcaatccgtccccttagcgaagcaccagcgatcctcaccgccccgccgacactttgggggcggcgcctgcgcctgcgccatggcgttcctattcggtgcattcctgggcctggtggtgggcgtggccgtcgtgatggcgtttgcgcgattcgagaacagccgcgccgagcagcgccgtgagctggctgctattgctgctgctttctcgaagttgactgtacaggatttgaggaagctcatcccacctgagttctatccatcatgggtttcattcacacaaaagcagaagcttaaatggctgcaccaggagttggtaaaaatctggccatttgtcaatgaggctgcatcagagttgattaaaacttctgtggagcctgtttttgagcagtacaagtcattcatcttggcttccctccatttctcaaagttgacacttggcactgttgcccctcagtttactggtgtttcaatcttggagagtgatgattctgccatcaccatggaactcgagttgcaatgggatggcaatcccaatatcgtacttgacatccaaacaacacttggaatttctcttcctgtacaggtgaaaaatattggattcacaggagtacttcggctcgtattcaaacctcttgtggctgaattaccctgttttggagccgtttgttgttctttaagggagaagagcaaggtggaatttaccctcaaggtcattggtggcgaaatgactgctattccaggaatttctgatgcaattgagggtacgatacgtgatacaatcgaggatacactgacatggccgaatcgcataattgttcccattgtacctggtgactatagtgacttggagttgaaacctaccggggtgttagaagtaaaactggtggaagctagggacctaacgaacaaggaccttgtgggaaagtcagacccttttgcagtgctatacatacgtccattgcgtgagaaaacaaagaaaagcaaaacaattaacaatgatttgaaccccatctggaacgagcactatgaatttgtggttgaggacatatctacacagcacttgactgtaaaatttatgatgacgaaggact

SEQ ID NO: 11481 - DNA, 668 bp, Sorghum bicolor
  Clone ID: SORBI-28MAY03-CLUS44170_1
cggcagccggcggcgcgctcggcatggagatggagccgcagttcgaccgcccgtacctggcgtcgtccctgcgcgacttctggggacggcggtggaacctcatggtgtcggccatcctccggccgtcagtctacgaccccgtgcgcgcgggcgccgggaaggcaccggccgtcctggccacgttcctcgtgtccgggctgatgcacgaggtcatgatgtactatctcgccctgcgaccacccaccggcgagatgacggccttcttcctgctccatggcgtgtgctgtgttgccgaggagtcgtgcgcgcggcggtcggcggagtcggggtggcggccgccgccgcgacccgtggctacgctgctcgtgatggtgttcgtggccggcacggcattctggctcttcttcccgccaatttgcagggaaggaacggaggagttgctgctggaggagtgggcagcggtgggggcgttcttcaacgacgccggccgaaagctgctcccgtatgtttagcccatcaagtctgttcgcttgacattattatggcttatcaggcaaaccaattaccttgaaactcggcacggcattcgtgctgcgccagcttaggccttgtttagatgcgaaaagattttggattttgttattgtagcactttcgtttgtttgtggt

SEQ ID NO: 11482 - DNA, 1395 bp, Sorghum bicolor
  Clone ID: SORBI-28MAY03-CLUS44226_1
gcacgagggcggctctctcctcctctccccgaccccgtccccgccgccgccgccgcaccaaaggagcacggacgggcatggggatcgtggaggaggcgcacaacctgcgcgtggtgggcgagggcaagcgcggggtcatcgtgctggcgcacggcttcggcaccgaccagtccgtctggaagcacctggtcccgcacctcgtcgccgactaccgcgtcgtgctcttcgacaccatgggcgcgcacgaggccaacccggactacttcgacttcgcccgctacgccacgctcgagggctacgcgctcgacctcctcgccatcctccaggagctcggcgtccagtcctgcatctacgtcggccactccgtctccgccgtcatcggcgcgctcgcctccatctcaaggcccgacctcttcacaaagctcgtcctactctccgcgtccccaaggtacctcaatgatgtggactactatggcgggtttgaacaagatgagcttgatgagctgtttgaggcgatgcgatcaaactacaaggcctggtgctcaggttttgcacccctgtgtgttggaggagatatggaatcagtggcagttcaggagtttagcaggacactcttcaatatacgcccagacattgcacttagtgttgcccagacgatcttccagagcgacgtgcgcagcctcctcccgcttgttagtgtcccatgccacataattcagagcaccaaggatcttgcggtgccagttgtggtgtctgagtacctgcacaagcacctcggtggcgactccattgtagaggtgatgccctctgaaggccatctcccccagctgagctctccagacattgtaatccctgtcttactccggcacattcagcatgatattgcagtctaggcaggttggccgatcattcctccaaggcaatgggcatccgaagctgtctacggtctctttgtatctcacttaattgttcaacgtaggattcacatctatttgatgttctaataaggtttgaaaggtgttatgtagtgttggcggtggaaattgtagcatatatgtctgtgtagtccattggccgtctaatgtaggctaccatgttggatgctctgacatcttaagtccttcagaaactcttcatgtcatgtcatttgtgtttttttttccatgaacctgaatgtacaaccttgttgtatatgttggtgtggtgatcataattttgggctgtaggatgtgcttatatgtagctctgggcttctttgtgaaggagatagattgggccaaattaggaaggaactccttccatatatcaaagagaaaaaaaacaacatatgtaattgcaaatttgtcaactcagctgtacccaacctgattgaaacatgttgttattggtcgctgg

SEQ ID NO: 11483 - DNA, 678 bp, Sorghum bicolor
  Clone ID: SORBI-28MAY03-CLUS44249_1
ggcgaggccaagcggcggttccagcggatccaggaggcgtacgcacgagggtcggacaaggggaagaaggccatgtacgacgccgggctcttcgatcccctcgacgacgacgaccaggatttctccgacttcatgcaggagatgctggtgatgatggataacgtgaaaaacgagaagccggacacgctggaggacctgcagaagatgctagaggacatcgtgaacggcgacggcgtgggcgggcgcgtgccgccgccggcggccgacggtgcccggcggacgcgcgtcgcgccgtacccgcagccgcagcaggcgcgcaggtgaccggcgcgccggtgtacgagatgtacacgcgccccgccgtagtagctgcggagtactcgtacgcttttggtgaaagggaccggagaaaggtcagcaagcaacgcgagggaggctctgcctctggaaaaagaagaataaagatttcaccctttttaggccaatctgatgatgatgatctgatgtagatttacgcctcctgtgtgtagcggtggtcgattgtgtaagctgggggttgggtggtgttggataccggcgccgccgccgcaacaactggcggacgcgtggccgggccggggactctgattttttattttaattaaatctcgtcgacatttcgatttcgtgccccaaaaa

SEQ ID NO: 11484 - DNA, 681 bp, Sorghum bicolor
  Clone ID: SORBI-28MAY03-CLUS44795_1
tctcgatgaagaggggaagagcatactaccaggaaacttcgagcggcactgggggatcttctccttcgatgggcaagccaaataccccctgaatcttggtctgggaaattcagtactgaagaatgcgaaagaggttccttaccttccatcacgttggtgtgtcgcaaaccctgctcggaatctcgacggtgtttcagatcacatgaagcttgcttgcagcatggctgattgtacgactctgtactacggaggttcatgctatggtatcggggagaagggcaatgtttcatatgctttcaacagctactatcagcagcagaagcaggacccaaagagttgcgattttggtgggcttgggatgataacttaccttgatccatctatgggcgagtgccgctttcttgttggtgttgatgatagcaagagctctgcagtcgcctcttgtggcggtggatgctgcggggtctgctgtggaatgtgggttttagctttctgggtgttcatgtaccttagaatgatgggttctgcttgattctaaaattgatgtgctggggcatgatgtttgtgcccatgttagatagactgtactcttgacttctatgtctaggaaaggactgcactgccgccatttgagattagaaaattatgcttgatatatataaaatattaatttaatttatt

SEQ ID NO: 11485 - DNA, 719 bp, Sorghum bicolor
  Clone ID: SORBI-28MAY03-CLUS44834_1
gatgcaaaatatgcacctaaaaagcaacagtgtgttctcgagctttcctgtggccctccgtcttcccgtccgcccccgattccgctggatgcctcggttctcaaagaaccagtgctgaagggacggcacgcaggctttcctgctatcagcttgcacgatgacgatgttgtttacatcatggacaaacacaaattcctggacaaaaaggcatcagtggtagctgttgatatgaaaaaccagactgtaaaaggtgcagcagattttgtctctggtgtattcttcggtctcactcaagcctacattccaagtggaatttccagatatatgggtctttggtcctctaccagaagcgaagagaatgatgctgaaacaagcaagaacggaattgcaaaagggaagcaagcggttcctgaagagggtgaggcttggagaagagggcgccgatggcgttgatcaactgcatttatgtaaggtgaggcttggagaagagggcgccgatggcgttgatcaactgcatttatgtaatgtatggttctgtgagatagggcagtggtgacggcatttatatatggtctacaggcatgttatggaaatgattcaaacagcagtcatggatgtactaaaacacttaacatcgagatgtgtgttgcaaaaaaaattgggtggcagttattttaaaaaatgggatgcccaggaaattgctcgtgtgggcaaggttt

SEQ ID NO: 11486 - DNA, 789 bp, Sorghum bicolor
  Clone ID: SORBI-28MAY03-CLUS47049_1
tcattgagaaggatgatgctggggacaatgatgaggaagaagatgatggggttcatacacctttgatattttctatctaatctttgcatgactcgactgtctcagatgataatgcagggcggggcgattctagggtcattctgcgttgttgctgtcccactgtaatattagattttgttgagctggatttacagcctaataaactagaagcctttgtttgtctatgacgagcatggggcaaaatcaggatgcaaatggatctaaaaaactcctttttctccttttcatttagtcactcatgttttgtggtcttaacacaaatggcagttgggttccttgcatagcacttcacttcatatggcaggttaacgtgatacttgatcacacaacggggactaagatggagattggagacctcccttggacctgtcaatgaccatgccagagtcaagatcatccaagagtgctaaagtttcaccttaaagacaagatttgggtgtgttgctaatagacaagacacgcaaaaggttaggtgcaggtcgaggttcatcctcaaaaagaaaatttataacacatccaagagatatgatttttgtgtgtaaacaatttactatagccttatattttgagtatgtaaccccatgtaaattatattagaaacgatacgatgtggaaattgactcggtttgcaccttacaagtgttaagccaagatgagacatcctcctcttgtagtttggtatttggtactataaagatcccattatgatgttaatggctcatttatctt

SEQ ID NO: 11487 - DNA, 725 bp, Sorghum bicolor
  Clone ID: SORBI-28MAY03-CLUS47439_1
ccgccccgtcaccagcgccggcgccggcgccgatgccgatgccgatgccgatggcgaggccggggccgtcgcagggttacatcgacgagcactacacgccgtcctactacaacagcaactacaaccggtcgccggcgtacgagcccgagccgtactactacagccgtccgcagccggcgccgtacagctaccagtaccagtaccagccgtcttcttcgtcggaggattactactacagcgcgccgccgcaaaggagcgccttctcgccgccgcgggacgcctacggcgagatgttcaacgacgagaacgccaattcttgcaccgtcatgtgaagggatccgaggagttgcaacatgaaaatgggttaatcgttagtagctagtttacttacagttccttattaatcaagcgagtctatatatatatgttagtagatattagaatccgtatgagtaaggagatgtattgaaagcactgctcaggcttgatggcgctgaataattggagagctgagctgagctgagcttgaatgctttgatgcatatgatagaggagaatgtgaggatctgagggaacagctctggtgatgctcatcagagcaattttgtaatgtatgacacggttaaactggagacttccaatcttttcaactttttcatttgagaactttgtatgtacttacagagaatatgagcgaagacacgagctgttctgtttccttgtgg

SEQ ID NO: 11488 - DNA, 1039 bp, Sorghum bicolor
  Clone ID: SORBI-28MAY03-CLUS4732_1
gcgttcgccccgcgtccgccccgcgtccggagcatgttggatctgttggacatcctttccgaactgccgaggaatgtcagcagctcaacgtagaggagaacatgactggggaagtactctagttgaagctgttttcttacccatcgaagcctatcatctagaggaccgcctagggccgcgcatccctcatgatcagaggttttctgtaccccgcattcccgctcttgtggaactttgcatccaagctggagttgaccttcctgagtatcccacaaagcgtcgaagaaagcctatcattaaaattggaagaaaagagtttgttgatgcaaatgaagatgacttaccagaaccagagcctgacagatttaagcagccacttcttgaggaattacattacgatgagattattgctccatctaaccctgaggagacagcggctcttgctgaggagacacttgaagcatgggaggctgttagggatggtgccttgaaacttatgaaaggctatgcagtgagggtttgcggatactgccctgaggtccatgttgggccaactggccacaaagcacggaactgtggagcttttaagcaccagcagaggaatggacaacatggatggcaagcagcggtgctcgatgacctagtacctcctagatacgtctggcacatgccagaatcgggggaggaactgcagagggagctaaagacgttctatggtcaggcaccagctgttgttgaaatatgcattcagggtggtgcaaaagttccggagaagtacaaagccactatgagactagatatagggattccctctagtttgaaggaggctgaaatggtcgtctgatcctccattgatttgagcaggtttaatctgtctattattgagtttttttggggggttgaaaagataatgtcattgtcaagctccatcgtggcttgacatatgttgaatctgttagtcgatgtgtatatatatcagaacttagacgagataattaattaggttttcttttttcgatccaaaaaaaaaaaaaaaaag

SEQ ID NO: 11489 - DNA, 904 bp, Sorghum bicolor
  Clone ID: SORBI-28MAY03-CLUS47485_1
tctggtcgcccagcgcgggctggggcagcagcttgcggaggccgccccccaggccaggggcccgagcattgttcagggacctgaagctgatagcatgggcactggttctagcctggagcaagggtctcaggtagtgtttgaaccactggagccggtggaatcacttgccaatggtgtgccatctgatctgggaagttcatctgtggaggcaaagggtttcgaggtccaacaaggtgtttcttcatgtggctctgagcgtcttaatggcaagccaactgcagagttaaatgatgatttctgggaggaccttctgcatgaggggggactcggtgcaggtaatgcagttggtcaggatgatatgaagatgtagtctcagaaggtagcctgcctcaactgaaagaacatggatccagacattagcggtacttgttttatcacaatggctccgagtatctttaccattatatgctcgtgtatcacagttttgtacccgattcgacccttcagtcaatgagatgctatatcaactgtggttgttaatacagtcttcagcatgcggatggaagttggattaagatgttcctatggtatctctggataccatagtttgttttcttttggcctactgcccgaccctgttaccgtggacaatgtttgtgcaaacaacatggttatgttgcctgcaggctatcagtgtatctgttctaactaatcgcagcgctggtacagtgcagtggcctgccaagctgcactatgagattgtagggaaagaccagatagcttgtatatatgtaaagtgatccttctatgtctgctgatctatagtaacttatcatgtgcacctttggtctgtacataacgtatttatcgccgtattttttccacatcatgtcttgatttaccc

SEQ ID NO: 11490 - DNA, 842 bp, Sorghum bicolor
  unsure (1)..(842): unsure at all n locations
  Clone ID: SORBI-28MAY03-CLUS47487_1
gcacgcggctcttcactgctcccagcagaagatacaaggtgcttgaagagtaccacaccacgttcgtcgagacagtgccattcaagacaatagccatgttcacattgttccagacaatgtaccttttggtctgctttggaatcacatggattccaatagctggagttcttttccccctcatgatcatgctcctggttccagtcaggcagtacatcctccccaagctcttcaaaggtgcacatctaactgacctagatgcagctgaatacgaggaatcaccggctataccattcagccttgctgcgcaagacattgatgtcgcattgggacgcacccagagtgcagaaatcctagacgacatggtcacgagaagccggggtgagatcaaacgcctcaacagcccgaagatcaccagctcaggtggcacacctgtggcagaactgaaaggcatccgcagcccatccatttttgagaaagcatacagccctcgtctcaccgagctccggcatgagcgcagccctctgggagggagaaacagccctaggacgccatccaagttgggtgaaggctcaacaccgaagtgaataaagcaatgattcatagtgcttaagcttgcaactactggccatcagttatatgagtgattttaaagtggtttcagtgctagtgtccttgtatgaagatgtcctctgatgagattactatttatgtgtatctctagcctctttttcttcttttttgtgttctcctgattaaaggagtgctatacatgtaatctctgaactagcagaatattagagtaactacttgaaaanaccctgtcactagccatattatcattc

SEQ ID NO: 11491 - DNA, 712 bp, Sorghum bicolor
  Clone ID: SORBI-28MAY03-CLUS47611_1
taaactcatacattgcatgggacttctccttgcaacaaggggccctcaacatggtattggacattgggtttcatgtggagcacattagcccttcaggggagaaaactttaattcttccaccccgacggtatgaagccgaccaaggtaatttttgcactgtttcatcgggatcatacaaacttgtatgggacaactcatattcttcattcttcaaaaagatcctacgttacaaggtggatgctgtgccaccagttgttgagccggccttgccagccatagtgctctgaagaggtctgtcttaatatgatgtaatgtaacgagggccgatgcatgcatgcagtagctgaacaaaatgtatctgaaggccccacacggtgttgttcccaattgattcatcgaatgctttgtggtgtcctgatcgcaggattccctgatacatacagctcgctgtcggggcgcaagatatgtatttcgtgtgcatgtttggctgtggccacttgccactgacgaatgcctaaatataacataagtgtattatatcgaccaataaaagcatgtctgattggaaggacgtgttccctggaaagagcatccagtttggctaccaattgtagaatttcatgatgaaattagctgcaactccaaatttagtgcttcattttggctcggatgtcgattccgtttggatgtcaagagttcagctttcttttcc

SEQ ID NO: 11492 - DNA, 729 bp, Sorghum bicolor
  Clone ID: SORBI-28MAY03-CLUS62282_1
tcctcggtcctggggctggccctgctctctggccttctgcaggcccgctcataaagggcttcatgtatcagagatctgcgactgctcctacccgtctccgttgtttcctcagttcgttgcatgtagcatgtcaaattgtgttccttgccatccaatccatttcgatccgttcctctctaagttgcatctagtggtggttttgccttcatttaggtatcttctgtacctacttgtccctgttcatgttcctggagcatgcccaggagtctagtcttcttcatgtattctcataaagggcttcatgtatcagagatctgcaaatgctcaaacctgaatatggtttgcttgtccaatgcacttcatgtcatccatacctggagttcggaattggccaagcatctttcacttagttatctgttttcatcatagtccagtattgtgccagactgttgtttctgtgcaatatttgatgggctagtctgtttgtggtactgttttagtttatgtgttactaatcatatatggtctcagtgttccatgctgatgctgtggcatcctgttgcttactagttaaatacttcaatgttatgtaccttcatgttaattttggtcatgtttctgtgacttgtttaaagtttcatgttatcgcacggtatttcctccaagatctagtatgatcttatgtttggtccatgtacaccacaacttctcttgtgatccttgttattt

SEQ ID NO: 11493 - DNA, 743 bp, Sorghum bicolor
  Clone ID: SORBI-28MAY03-CLUS45512_1
taaagcacacaaagatattgctcattttgaaacagcatatgttgtcaaactacaccgtatagcgacacttgcacctacacaacaggtttttactttcaaccatccaaatttctcaccaagtgctagcaaccaaaggtacaccaagttgcaatttgaaatgctaccagatatgggttcatgccttgtgcacggatttgctggctattttgactccgttctctataaggatgttcatcttggaatcgagccaaacaccgctacaccaaacatgtttagctggttccccatcttcttcccattgagaaagcccatctacgtgccccaagggtctcctatagaagtgcacttctggcgctgctgtgcccccacaaaggtgtggtacgagtgggctgtcactacgccgaccccgtcgccggtccacaacagcaatggccgctcgtactgggttggtctgtaataagtcatcaagatcatcgctttgtgttgtaacagagaagaaaaaagaatagagagatagtgtttagttctatttgagatgatgtcagggtgctactggttctggtttctgcccggaggagcagatcaaaggatctgtaacgtgttgttatcgaggtgattgacctccaacgatgcctagtcgattttgatagttgtgtgggagtaggatttcttgactagcaaatgttctggtttcgtcaaattttgaaacgtctgcagcaaatgttaaggtttcgtcaaatttg

SEQ ID NO: 11494 - DNA, 783 bp, Sorghum bicolor
  Clone ID: SORBI-28MAY03-CLUS45522_1
ttcggcacgaggacgggtttacccattggtagttgctgctcatcccatggagcctaaccagattgcacttggcatgagtgatggtaaggtccatgtggtggagccattagacggggacccaaagtggggaacagcgccacctcaggacaatggagtgcacccagcaatatcagcagcaccatcagccgctaccaaccaggcatccgatcagccaacgaggtgactcagtatgcagcactgagatttgttagggcaaaggatggtaggacctgtaggagatagggagaaaggataaacagttagattatgaagagaggctatatttatcaagtccactgtctctctcgtggcggcagcacaggtggtgaatggtgattgacaatgacattgctctaagttaggttttggttctttcctggccccagaaatcctgactgcacctggccccgccttatctgagggagatggcatcatcttcctcttgtaaagcttttcctgctgagtttagtggtaccttagattgttgttcatttctgctccgttctttgggcagctatttgtagtgtaaaaatatggtggcatgttggatggtgatattatgcgtgcatggcctgtgatgatggattccaccatgttgggggtctatttgatggatgtttactgatcatggcactagattgttttcgtgccatttgcaaatgtagaccgtggagaacatggtgtgtgagttcatgagattgctggaaagctatttctgggtgtgatagttgatcgacctctttt

SEQ ID NO: 11495 - DNA, 651 bp, Sorghum bicolor
  Clone ID: SORBI-28MAY03-CLUS45549_1
gtcgtcatgcttgagctactgactggccggaaagcatttgacagctgtcgggcaaggtcccagcaatcattggcccggtgggcttcgccgcagctgcacgacatcgactcgctagatcagatggttgatccaacactagaggggctgtaccatgcaaaatcactctctcggtttgcagacgcaatcgctctctgtgtccagcctgagccagaattcaggccaccgatgtcggaggtcgtccagtcactggtccgtcttgtgcagcgagcaagcatggggacaacactaagcagcgagtggaattcttgccggttcgatgaatccggtgatcacacgttctaggggaaaatgatgtgtatttcctagagagtctgatgaggagctatagaagactcacaagtcacagaaactttgcagcttggcttttttgtgacggtgtgatatgtgtgccagtgtcaggtgaaatatgacttttacctatgccattttactatgagtcattatgtgttttgagttttgtatataaaagcaatgaccggcttttctgcaatgctgctggaacctgaagcagggctgaaaagaaagttcctttttaaaaatttatgtatatgaatatctttcgaagacaatcaactttctgagttcgtctct

SEQ ID NO: 11496 - DNA, 1325 bp, Sorghum bicolor
  Clone ID: SORBI-28MAY03-CLUS4556_1
gccggccggggcacgagggaaagtgtcacaccttcatatgttccatacatgacatggagagcaatgaagcatttctttggtggagcaatgggtgtgtttacaacaagaaccttgctcaactctgttggagtctcgcaaagcagggctgcatctggtgctgtggctatcaactggatactcaaggatggggctgggcgtgttggaaagatgctttttgcccgccaagggaagaaatttgattatgacctgaagcagcttcgcttttctggtgatctcttgatggagttaggagctgggatagaattagctactgcagctttcccacaacttttcctaccaatggcatgcatagcaaatgttgttaagaatgttgctgctgtgacttccacctctactcgaacaccaatctacaaggcatatgcaaaaggagaaaatatcggtgatgtcactgctaaaggagaaagtgttggaaacattgctgatctgttgggaactggaatgagcattctaatctctaaaagcaatccatcactggtaacttcttttgccgtcttgtcgtgcggatatcttctcagttcatattatgaggtgagatctgttgtactgaataccctgaatagggcaaggttcactgtggctgtggattctttcatcaggactgggtatgtaccctcactgaaggatggaaactcacaagagacaatatttaatccaccttggcgacatgagccagtcgcaataggatcaagatttggggaggcgtttcaagaacctgcttcgtttattgctataaaacctttgttcgaggatgagaggtatattgttacatataatccgacaaaggacaaggtatatgctttgctcaaggaccaagcaaagccagatgacattctcaaagctgctttccatgcacatgtgttactgcattttatcaatgcttcacatgctaacctgaatgcacggaagcgcatgaatgccaatcggtcataccagtataacccactgaacatggactttgtaccacacatcgaagagtcatgcaagatcgttatgtcatcttatggagtcttcaagaagaaagcaagagaacagggatggataatgtctgaatcacttcttaacccgggaagagcaagattgtgtggagtagtaccacaatgatccaagtctttttcgtttttcatgatgaagaggatgagttctttttcatacaattggagtccagccctatgtgagtcagcaaaactaacttaaatcaacaatcagctcaagtacataaaatgcaccaaatccttatgagcccagaaggaacagttcttgaacct

SEQ ID NO: 11497 - DNA, 642 bp, Sorghum bicolor
  Clone ID: SORBI-28MAY03-CLUS45662_1
cctgtcacaaagttatgaagtgctaaagcggcaaaagaaaagtgctgaaaatgaacagagcatgaccaaagatgtggcagctagagatgaaaagtctccggaagatgtagatttgtcaaagccaactgacccagaagaagctgcaaaagaaccagagttaaatggcacaacgaaagaagccaacgaatcaccagccgaagaaccagaagtacctactcctgaacccatggagtctgacaacgttcaagtcgccactaccgtggctactggtgacgacttgctaggacagctagaagccctaaagcaacgcttcatggaactcactgcaggctacggcgtgccacagctcgagaggctgtattcccggataatgaaaggagcaatagagttgacaagtaaagaaagcaacgaggatcatagacggttagtagttaggtatttgttgacattcgttgagaacagcaacaatttttaactccggcgcgcaataagattcttgtttttccttgtacatcctctttggaacgaaagaatagtagtggttcatctggggagcttatcccccttgtaacaaatctgccaaatgctctagtgtcagtgacacagttttgccatgaatgatgtagcaagtgcacccttttt

SEQ ID NO: 11498 - DNA, 1712 bp, Sorghum bicolor
  Clone ID: SORBI-28MAY03-CLUS4829_1
cctactggaaattggcaagaaagctgccgctaccaatccaccattgcgatttgcgagaacctgtaaatactatcaaaatctttcgccattcgacgctggtgatccaaatgtggagctcctgatccgactttaatcagagccaggcctcccaaaatagggttcaaataggggcaaggagcaaggagccatcccctttttagccgttgccgcagctggtcgtcgtcgctgctcccaatctgcggccgtcggtgttgccttcgcttctaatccacaagagcgagcagcaccgaccgagccgatccgctcctcttcttggttcttggtcaataaatcagcagagcaggaaagatctgtgagggttcttgcagtcggcaggggtccaggattaagatggaagcccggggcgcaagaaacatctaagaagagggtaggaaagatttgggtgtagattggtagatatattacacaggttttcttttggagtagattattagcaaatagatcggtggagaagaagcctggcaaatagaggaggtgaaatttgtgcagaagaacatgtttgggatccaaaccagggacgtggctgatgatttcaactccaggaggaggacactatggaacacgcccaccgcatcgatgcccaccaacacccacaccatcaggtacaacacagccaagaagagtttgttcaatgtacacctcatgtctgtcaagtttgaggacctgtacgggttcatggtgaagggcaatgtggatgatgtcaatgtgctgaacgaggtgagggagaggatcagggagcaaggcagggggtggtgggcgctggaggcaagcaagggtgcaaattggtacctccaaccaaagatttcttcaaatgagggggtgatcagcgtcacatcactcaagttgtcagtgctcactaatacaattacattgaggaggttgatcaggaaaggtgtgccaccggtgctgaggccaaaggtttggttatctgtgtcaggagcagccaagaaacggtcaacagtaccagaaacatactatgatgagctaattcgtgctactgaggggaagaccacgccagccacaaggcaaattgatcatgatcttcctcgcactttcccttgtcatccttggttgaacagtgacaagggtcaggcatctctgcgacgggtacttgtggggtactcattccgtgattcagaagttggatactgccagggtctaaactacgtagctgcactcttgttgcttgtgatgaagacagaggaggatgcattttggatgcttgctgtactccttgagaatgtacttgtcagtgattgctatactgacactctttctggatgccatgtcgagcagagggtattcaaagatctcctggctaagaagtgtccaaggattgctgctcatcttgaagcaatggggtttgatgtttcacttgttgctacagaatggtttttgtgcctcttctcaaagagcctgccttcagagacaacacttcgggtatgggatgttttattcaatgaaggagccaaggttttgttccatgttgctcttgcaattttcaagatgcgagaagatgatctactacgcatccaacatatcggtgatgtgattgatattttgcaaacacccacacatcatctatatgcccctgatgaactcctgacatttgcatttgacaagattggttcaatgacaacaaacacaatcac

SEQ ID NO: 11499 - DNA, 421 bp, Sorghum bicolor
  Clone ID: LIB3480-050-P1-K1-F7
cccacgcgtccgggcaaattgatcatgatcttcctcgcactttcccttgtcatccttggttgaacagtgacaagggtcaggcatctctgcgacgggtacttgtggggtactcattccgtgattcagaagttggatactgccagctgcactcttgttgcttgtgatgaagacagaggaggatgcattttggatgcttgctgtactccttgagaatgtacttgtcagtgattgctatactgacactctttctggatgccatgtcgagcagagggtattcaaagatctcctggctaagaagtgtccaaggattgctgctcatcttgaagcaatggggtttgatgtttcacttgttgctacagaatggtttttgtgcctcttctcaaagagcctggctttagagacaacactttcggtatgggat

SEQ ID NO: 11500 - DNA, 741 bp, Sorghum bicolor
  Clone ID: SORBI-28MAY03-CLUS49301_1
ctgttggcctctggtctcttggatttggattgctttccccacccctcccccctccccgcctccgtctcttgccgacctccgcgactccacctgagaggagaggagaggagaggagagcaagcaaccgcccccgtcccctccctcctcgctgggaagatggagcctggccagagcggtactgagcagacctctccacgcgggactgattgggaagtcgtgcaactgactgcatcagcatacgcggccgcgcctgctccgaggagacctgaaccttccgaggaatccgaagctaagaaatatggcgcaaaaggggacgatttagccgctgggctactcatgtctggccacttctcggtgtctcagagtgaagttgaaagcctccttgtaggcgctgacagcaaagaacctcccaaggagcttagcagcccagatgcagtttccaatgagggggatggtgagaaataccaagaaacctgcaagcataagctggaggatgacgtccccagcattccatccttcgacaaagggaaggatgtttccttgggtgatatggcgtttgatgatggcaaggcattgaaaggcatgagtttggtcggggaagaaccggttgggttctcgtcgcctatttacagctcaattgaggctgaaaatgagttaagttggtcagctacagagagtaggaaatgataagaaaactgaggagcctactctgcataacttgagccccataaccggttcatc

SEQ ID NO: 11501 - DNA, 1339 bp, Sorghum bicolor
  Clone ID: SORBI-28MAY03-CLUS4931_1
gcgctcgggttccatttccatttgcttcgtctcggtcacctcagatcagatcaagggacgggacgccagcccacctgccaccctcctccttcgctccctccctcccatcccagatcccccaccccagccatggccaccgccttcgagtccccgacctcctcccccgccgccgcgcccttccacgacgaccctttcctccacttcgacggctcggcccccgccgccgacggcttcccggcctccccggacgcctatgcgccctcccccttcggcatgccccactccaacggcgacctccacgacgaccctttcgccgcacccgctgactccaacggtgggcccatcctcccgccgcccaccgagatggggcgcgaggagggattcctgctccgcgagtggcgccgacaaaatgctatccaccttgagaaaaaggagaagaatgagaaggagctgaggagccaaatcatcggtgatgctgaagagtttaagaaagcttttgttgagaagagaaagctcaatgttgagacaagcaagggccaaaaccgtgacagggagaagcttttcctagcaaaccaggaaaagttccatgctggtgcggataagcagtactggaaggcgatatcagaacttatcccacatgagattgctaacatcgagaagagaggggcaaggaaagataaggagaaggaaaagaagcctgggatcgtggtgatccagggcccaaagcctgggaagccaacagacatggcacggatgcggcagatattgctgaagctgaagcacactcccccaccacacatgaagccacccccgccacctgctgcagccactggaaaggatggagcaccagctgctgctggaaaggatggagctaagccagcagcccctgccaatggcagtgtccctgagatggaaaaggccgccgcggtggcaccagtgcctgcagcagcaccaccagcagcaactgagccgattgcagctgcctaatctaatcatttatggtaggaggatgtgaaaaatctcttatttagagttgttgcagaggcggtggtggtgaaactgaaaacgtgtgaatttcctggcatggtggagacatgcactgtgtatttgttaaggcacctcgattcatttacattactatatatttttattgcattttgtagagaggggcatgtgtatcctggttcatggtaataataaggttgtattaggaggatgtatgttttggtggctgtattatgtttcttcttccaagtgttggaaattttcctttgttataaaaactgattgtattgttctgctactatctgctgcatatatggagtatatttttgcgcat

SEQ ID NO: 11502 - DNA, 837 bp, Sorghum bicolor
  unsure (1)..(837): unsure at all n locations
  Clone ID: SORBI-28MAY03-CLUS48503_1
cctactggaccaccacgcattaaaaatctcccccctcatcctgccactgccagcgcccaatccaatccctacctgcccgggaaccaccacccgtcgggctcctcccgccctcccctcctcgccgcatccgcggcggggatctccgggctggttccgtcaccggagcgccaatcgccgccccgaaaccccccgcgcacgcagcacaacccattttttttgccgcgatcgcccacgggaacctccgctggttgggtccctgaccctgaaagctcgattctaggcgatttttgattcggataaccctcttcctccgattttggtgcgcgttgcgaggggccgggatggggttgcagcagtccaaggaggagctgctgtaccagcaggtcaactacggcaacgtcgacgggattcgcaccctccgggggcagggcgttggccttgagtggattgacaaggaagggaagacacccctgatggtggcctgtatgcggcccgatctgttcgacgtagccaaggtgctgatcgagttgggagctaatgtcaatgcctaccggcctgggtcacattgtgggacagcattgcaccatgctgccaagaaaggacttcagcagactgtccatttactactctcacatggagctaatccattcataccaaacgatgattgcaataccgcccttgaattggcaagggaaaaaggtcatgtgaatgttgtacgtgccatagagggacggctttctcttttttgtggatggatgagggagaactatgctcctgcttttttggatgcaattgctccacagttcatgacaagaaaaatttgngctgttattttac

SEQ ID NO: 11503 - DNA, 905 bp, Sorghum bicolor
  Clone ID: SORBI-28MAY03-CLUS49411_1
aaaaacaggcaggaggcgcggctccgccctcccgcagtccggcacgagcggacgagccccgcaggccgcagccacagcccacaacccaagcgcagcgcgggcgcttccctctgctccactcccgtccccgtgcctgcgtgcgctctgccgccgccgccgccgccgccgccttccattccaccgcgcggcgctgccgacgtccctcgccgcggccggagggagctggtctgggttggattggatctctcggagcgagatgggcggcggcaacggcgatggaaccaccccgctgggggagccgctgctggcgaagaaggggagggcgtaccggccgaggtgccccggatgccgggtggaccgcctgaacgcggagcgggagggggtgttccctctcaaggacctcttcctcatctggctcgtcaccatcacctgcaccttgccgatccagtctctgtttcccttcttgtattttatgataagggatctgcatattgctaaacaaacacaagacattggattttacgctggttttgttggcgcttcatatatgtttgggagagcactctcctcaacaatatggggaatcgtggctgataagtatggaaggaaaccagttatcgtactgacccttgttgcaatagttatcttcaatactctctttggactaagcttaaactattggatggcattaatcacacgatgcctgctgggggtcatgtgtggttatctcgggccaattaaggcttatgctacagaagttgtccgaaaagaatacaaccatctagctttagcagttgtttcttcctcacgaggcattggtctcattattggaccagctattggtggttaccttgcacagcctgcagataaatatccaagcatattctctcagacatccatatttg

SEQ ID NO: 11504 - DNA, 1321 bp, Sorghum bicolor
  Clone ID: SORBI-28MAY03-CLUS49472_1
cggcccttccccgccgccccctgctgccgcgcggtggcgctggccgtagtgttgggcgccgccgccgacctcggccgcccggcggggggcgagctcacctcgccctgcccttcccccgcgcgagctctccccgcccggcggccccctccccccgcgccgaactagcaaggtttcattacgctcaattgctatggctaccacacaagcctcagatgcagcggctgacaaaggattacctctggcagtggacgcgaccatggctgacgagtatgcctcacagtcaaagttgctgcaagaatttgttaaaatcccaactattggcaaggcttggatctttaattccaaggatgatgacatgtccaaagcagtggtttcgattggccaaacagatcttttggccaacaagaggagacaattccttctgaattctcacatttcaaagagtccaaaatctgttgatttcaagtggtcccctttcccgactgaaataagtggagcgtcagcagtaattccatcaccatctggagaaaaacttcttctagtacgcaattctgaggatgattcccctacaaaactggagatttggggcccatgtcaattagagaacgagatacatattgcaaaatctgttcatggatcactctatactgatgaatggtttggagggatatcatggaaccaggaggagactttcatagcttatgttgccgaggagcctcctcaaccaaaaccagtgtttaatgattatggattcaagaaggaaggctcatccgaaaaggactgcaagagctggaagggacaaggggattgggaggagacctggggagaaacgtattccaagaaaaggattcctgcgctgtttgtcgtcaacatatccagcggcgaagttcgacctgtcaagcaaataccgcacgaggtaagtgttggccaagtgatttgggctccatcttcttcatatagcttggtttttgttgcatggtcatctgacaatggtttccaagagacgccaaggaagcttggtattaaatactgctacaacagaccttgtgctttgtatgctgctcctgatcctttcagagaagaagctgagaaatcatcaactgagggcaataagagtgaaactacaactatgatcaaattaacaggagacctgatcagtgcttttttcccacggttcagtccggacgggaagtatcttgtgttcatctcagcgaagagtgctgtagatagtggggcacacaatgccacaaattcaatgcatagaatcgaatggcctgcagatggaaatttggatgggagccttggaattgctgatgtggtg

SEQ ID NO: 11505 - DNA, 833 bp, Sorghum bicolor
  Clone ID: SORBI-28MAY03-CLUS4948_1
cgcaacagaacagggatttgctgttggcatgcgtgcagctctccacatcaatccgtactatgggaagacctcaactgaaggaatgatttctcattttgaggctgttctcccaatgggcccgaccatcatctacaatgtgccatccaggagtgcccaggatatctcccctgaagttattgtagcaatttcaggctatacaaacatggcaggtgtcaaggaatgcgttgggcatgagaggattcagcagtatgctgacaaaggtataacaatttggagcggtaatgatgatgaatgccacgattctaggtggaaatatggtgctactggagtcatttctgttactagcaaccttgttcctgggctcatgcacagcctcatgtacaaaggcgagaatgctatgctgaacgagaaactattgcccctgatgaaatggttgttctgccaaccaaatccaattgctgtcaacactgctctggctcagctcggggtggcaaggcccgtcttcagactgccatatgttccgcttcctcttgaaaagaggatcgagtttgtccggattgttgaggctattggacgtgaaaattttgtgggagaaaaggaggctcaggttctcgatgatgatgatttcgtgttgatcagtaggtactagtaagtgagttagtgtgtattttgatgaataaaactgagagtttgtcccttgcgtttacagacttcgttctgttcatcagtggttggttttatatctgtttattaattagcgctcccttggctgcattgtataatctatgtgtcacgtttatagtttattacattgaattgccctactaggtaca

SEQ ID NO: 11506 - DNA, 817 bp, Sorghum bicolor
  Clone ID: SORBI-28MAY03-CLUS9427_1
agttggatcacccaatgtggggaagtcatcattagtccgcatattatcatctggaaaacctgaggtctgcagctacccattcacaacaagagggattctaatgggtcacattgtatccaatcacgaacgttttcaggttacggacactccaggactcctgacgaggcatgatgatgacagaaataacatagagagattgacacttgctgttctttcatatctacctattgctgtactgtatgtgcacgatctatctgaagactgtgggacctcagtggccgatcagtacatcacgtacaagcatattaaggacagattcggtgaccgcctatggcttgatgttatatccaaatgcgatcttttgggaaagaaagagcccataagctttagtgatgctgatgatgatgtagcacagtacagaagattggggccagaaggcgccctccgagtttctgtgcagagcgaaatcggcgtcaaagagctaaaggaaagagtgcatgagctactgacctctcagatggctcggatcaaagctagcaaggcggagcatgaaacacaggaaatagggactagtgtactgtagtttactgaagtttgacaatgagcattcgaacatccatgctggatgtttgtgttaacattccactaatgtcgatgatagtaacgcatttcagccgagccatttcgagcatccactaatttggatgtttgtgtacacattccactaattcgaacacccactattctgttgtcattttccccatttggaccaagggtgttcaattgttggtatgaatgtgttgcccatttttttccc

SEQ ID NO: 11507 - DNA, 902 bp, Sorghum bicolor
  Clone ID: SORBI-28MAY03-CLUS9309_1
cccacgcgtccggcagtgggaaccatgccgccgccgtggctttggctgcaaagctgcgtggcatacctgcacacattgtcataccaagaaatgcaccagcgtgtaaggttgaaaatgttaagcggtatggtggtcatattatccggagcgatgtcagcattgaatcgagagaatctgtttgtaaaagagtccaggaggagactggtgctgttcttatccatcccttcaatgataaatacactatcagtggtcagggtacagtatctcttgaaattttgcagcaaggcccggaaattgacacaatactagtttgtagtagtggcggtcgttagatttctggtgtgacccttgctgcaatggccataaacccttcgatacgcattctggcagcagaaccaaaaggtggctgatgattctgcccagtctaaggctgctggaaagatcatcacattgccttccacaaacaccattgctgatggtctacgagcttttcttggtgacttgacatggcctgtggtgcgtgacttggtgggcgatgttatcgttgtggatgccacggcgattgtggccgccatgagagtctgccacgagctcctggaggtggctgttgagcctcgtggcgcaattggcctggctgcagcactgtccgacgagtttaagcaaagctctgcttggcacgagagcagcaagataggaataattgtttccggaggcaatgttgacctcggcactctttgggagtctctgtacaaacaatgatttggagtagactgatgacattgtccttgaatttcaaatgtgctggttttaggcaagacgtttgtaaacttggaatagttcattgcaaacaggatactgtcttgtacacttcttatatgtttatcaatggatcattcagttgc

SEQ ID NO: 11508 - DNA, 380 bp, Sorghum bicolor
  Clone ID: LIB3478-042-P1-K1-F1
gtttgtaaaagagtccaggaggagactggtgctgttcttatccatcccttcaatgataaatacactatcaggtttcgcgttgtgcgtggctgagatgtactcttaatgcatggcaatttgtgatgattttccagtggtcagggtacagtatctcttgaacttttggagcaagtccctgaaattgacacaataattgttcctattagtggcggtggtttaatttctggtgtgacccttgctgcaaaggccataaacccttcgatacgcattctggcagcagaaccaaaaggtgctgatgattctgcccagtctaaggctgctggaaagatcatcacattgccttccacaaacaccattgctgatggtctacgagcttttct

SEQ ID NO: 11509 - DNA, 1242 bp, Sorghum bicolor
  Clone ID: SORBI-28MAY03-CLUS9460_1
gcacgaggggacaatccgcacgaggacgtgacgccatcggtgagctccgaaaccctaggtagcgcgacccgggcagcgctctgcgtgccgtttaggggagggggcagcgctaggacccgacgaggcgggcgaggccaactagcggcgggagaatctcctccgaagccttcctggagctgtgaatcgcgcgtgaatctcctggatttgcagactcgaggggaaagctgagataagagatgggttggggaatatccaggttgattggactgaaggctgctgtcctgctttctgtggcgtgttttttccaaggactaggagtgacccttatctcatttcctctcatatatgcatccgtgattgcaatactaatctcgatagcttcccacccatcgattgatcttcctttactccttggcaaagcatctgatggaagttttccgttgtggtcatggatcatgttctcaccatttcttcttttcattcacctgtttgtgctgctacgaagatttgtgaaaaatgagcctttatacactgaggttgcagatggagtgtttgttggaggatggccttcttcggttgaacacctgccaccaggtgaccctgcaatcatagattgcacgtgtgagctgccaaaaagctcgactatatctaacaatgcatatctgtgtgttgctacctgggatacgagggctcctcagccatcacaaattgagtctgccgtgcgatgggctgtgagaaagcggtcacagaacaagcctgtctatgtccactgtgcctatggtcatggcagaagtgtctgtgtgatgtgcgcgcttcttgttgcattaggattggctgaagattggaaagctgctgagcaaatgatccgtgagaagcgaccttatattagcatgaacactcttcaccgcaaaagcttggaggaatggtcaaaacatttgctctcctctaaaagaagtggggaatcggatgtgagttctgttatccattcggattataaccagaaataaaattgaaccagcaagagacacgcgtgttcagtaactgtgatatttaagatgcattgtacattcggtagtattgtttgctgctgtcctagtgaatgcctatggttcattctaagctatccttttgtggtaattgttttgtaaaaactatatgtttcaaattatgtcgatactgtagctttacactgctagttctttaaggaagatttagtgtccttgcctccttttttttttctcc

SEQ ID NO: 11510 - DNA, 731 bp, Sorghum bicolor
  Clone ID: SORBI-28MAY03-CLUS5023_1
gcacgaggttttcctcttcctcctcgcctccaccccttcccttccatctccttccacccggccactcctctccctctctctctcccgcgccgatcgattggcccacccatcgatcgagcacggggaagaagattccagtccggagagggtccaattcgatcgggttcgttgctggtgtgggtgggcgccatggcggcgacggaggccttggcagataagaacgccgtcttccgcaagctccgcgccaaatcggacaacaagatgtgcttcgattgcaacgccaagaacccgacgtgggcgtccgtcacctacggcgtcttcctctgcatcgactgctcagcggtgcaccgcagcctcggcgtccacgtctcctttgtcaggtcaacaaatttggattcgtggactccagaacagttgagaatgatggtctatggaggaaacaaccgtgcacaggctttctttaagcagcatggttggaccgatggtggaaagattgaagcaaagtatacttcaagagcagctgacttgtaccggcagttgcttgctaaagaggttgctaaaagctccacagaagatggcaacaatagttggccgtcttccccagttgcagtttcccagggtccaaatcaagctcctgcatttccagatctcaagctgacagaggtgtcaaaagaaaatgtaagtgaaaagaaagagcctgagattggtcgttcgcctagagctccaaccca

SEQ ID NO: 11511 - DNA, 1391 bp, Sorghum bicolor
  Clone ID: SORBI-28MAY03-CLUS5077_1
gttttgagtggcaaccattatatatattactcaagtgatgcaagaagtgtgggtgcaatattcaacaacatatatgagttcactggtttgattgctgatgatcaattcatttcagctgaaaatctcactgaaaaccagagggtgtttgctgacacattggttaagcaagcatatgatgattggatcaatgctgtagaatatgatggcaaggcgctgttgagtttcaagcagacaaagaaaactgttacaactagaagtgaaacagcgaaagcttcagcaagctaccctgcatcaaacgatttaatgaactcacagaaacaactggctggaggtcctgtaaatactgagcaatcttccctgaagaataccagagaaggtggaactggaatcccatccatggggaaccaggtagcaagagagtatgcaggcaatcctcagcacgtggcaccaagtatcaccatgcaatacgacatgagttcattggtccccggaggccagttcagtggttcctccgtgcagactcaaacttcacgaagctccaacatgcttgcactgcggccaatgcagcagcctcaaaacttcgagttctctgggcttggtcagtccacacaaccttcagggctcaaccctttcgatgactggtctcgatcgcaggagaaccgcggaggcggcgccgatgactacttgatggatgagataagggcaaggagccacgagatattggagaacgatgagatgcagcagatgctgcgcctcctgagcatgggcggggcaccgaccggcctgaataatgttgacggtttcccttcatacccgtctcctgccccagccttcagctttgaggacaaccgtgctcgctcgtccggcaaagctgttgtcgggtggctgaagatcaaggctgcgatgcggtggggcatctttgtcaggaggaaagcggccgagagacgagctcaacttgttgagctggaagactagcgggtgcttgggctcagtgttgcacatatttatgtggcgaggcaagtagaactgcaaaatgttgtatgtataatacgcttcccttttggctgcccttgcacaatatatagctccattgatattgtatattaatgggtaggggttttttcttttatgaattcaggaggggtttccccctactgtcttctattacgtggaagacttgaaggacgatcaggatcctgtcctgagctcatgagcttttacgaatgaactcacgttggttgtattactagtagatggtgcgcgcatgggttagcatagcataggtgttagcattatataaaaaaacataatacgtttaatttgtagattgaaaataattaagaatagtatacaaatatgtgtataggtatatatgttacatatgttattaa

SEQ ID NO: 11512 - DNA, 747 bp, Sorghum bicolor
  Clone ID: SORBI-28MAY03-CLUS50453_1
tttggactgtgcaatgatagcactgcatgacgttattccttttttcctcatttattgtgccatgtctgctgctcatgtttgttttaagaacaatttcaatcagaagcaatcgtcaatcctaacccaatcttctagtttatctatatttttggtaggtaccgcaatctgtcctatgcttcatccattttttttttccagtcatgcccatgctgcaatgtatgcctaactaacgaattaatattgttcctccattatgtcatttttctttcagatgttgatatgcttagaactccctgtttgtgtgacataccattcttttgccatgaggatataagactgccatgtttaagtggcttagagagcttcagctgtgaaggtgcctgatcgaagtccctcgaagaaaaaccgcactatgagaaaccagcacggttatcagattttggggtgtattaaacagattatttcaaccactgtgccaagaagaacccaagcattaccggttcccaggagaagaatttttcatttttttgtatatatgttcatagactaggtcattataacccggtttatatctatctattgtatgtaaaggatggagaaccatctgtttcaatgctatcgctagattttagatgataattattagacatgatttcatatttgaaatatcatttttgtaaagagggacctattcctgagttttttcacggttttgtggtttcaacgttaatctatggtagcttcctt

SEQ ID NO: 11513 - DNA, 822 bp, Sorghum bicolor
  Clone ID: SORBI-28MAY03-CLUS50945_1
cttctaaactctgcccaccaccacgcacgagggagagagcctgcctccactcttggtttggttggccccctggctggcggcaccacactagcctagtgagtagtgcagcagcggcagtcttgcttgctcggttgctcctactacctgtcctgcacactgcacaggagcagcagagcctagctaggaccgtcgtcgtcggcgaaaggggagcgggcggccatgaagtacgtgctggtgaccggaggggtggtgagcggcctcggcaagggcgtgacggccagcagcatcggcgtcgtgctcaaggcctgcggcctccgcgtcaccaccatcaagattgatccatacctcaacactgatgctggaaccatgtctccattcgagcatggggaggtgtttgttttggacgatggtggagaggtggacttggaccttggaaactacgagcgttttctggatatcaaattgacccgtgacaacaatataaccacaggaaagatctatcaggctgtcattaacaaagaaaggagaggtgactacctaggaaaaaccgtccaggttgtgccacatattacagatgaaatacaagattggattgaacgtgttgcaatggttccagtcgacggcaaagaaggacctcctgatgtttgtgtcattgaacttgggggcactataggggatattgagtccatgcctttcattgaagcattacgtcaattttcataccgtgttggacctggaaacttctgtctcgttcatgtcagtcttgttccagttctagatgtagtcggtgaacagaaaactaagcctacacagcatagtgtt

SEQ ID NO: 11514 - DNA, 1064 bp, Sorghum bicolor
  Clone ID: SORBI-28MAY03-CLUS5099_1
cccacgcgtccgaactacagaccttgtagcaggagcattgctgtccagactgagattggtggagtgactatcagaataggtggaatggctaaaggttctggaatgattcacccaaatatggcaacaatgctcggtgttttaaccacagatgctcaagtcagcaatgatgtctggagaggggggggccggacgtcagtggatggtgatactagtaccaatgactgtgttattgctatggcaagtgggttgtctggtttatctagaattcaaagtcttgatagcattgaggctcaacagttccaagcttgcctagatgcagtaatgcaaggtcttgcgaaatctatagcatgggatggggagggtgcaacatgcctaattgaggttactgtaagtggcgccaacaatgaggcagaagctgctaaaattgctcgttcagtagcatcttcttctctggttaaagccgctgtgtttggaagagacccaaattggggacgaattgcttgctcagttggctattcaggcattcaatttgatgcaaatcgacttgatatttctctgggagttattccactaatgaaaaatggccaaccactcccctttgacagatccgctgctagcaggtatctcaaagatgctggagatgcccatggtacagtgaacattgatatatcagttgggagtggaggaggaaatggaaaggcatggggctgtgatctgagctacaaatatgttgaaataaatgctgaatatacgacgtgaaaattatatttgccatgaagggaaaaaatgtcttcttggaatgaatgagtgcaactgccatcaggagaatgtagtttctattgcaatggcagccttgccttaacaagatgctgtggatgtattatttcctgtgagatcaatcagatcaatgttttctaagtgtaataatgtgatgaataacggtgggcacagtaacaacactgaccaccttgttcgcttctgaatttctgatgacgggaaagcattggtctgacaaacaattttttgaaatttggtatacaaatcttattgctggtcatgcggtc

SEQ ID NO: 11515 - DNA, 657 bp, Sorghum bicolor
  Clone ID: SORBI-28MAY03-CLUS51211_1
ttgactcccttcatacatcaaggtttcaccagacaaggttgaacactcctgataacaacaggtatggactgctgcagcgacagaagtctgggatttcagaagatggtagactctctcgcagaagcagctgtagttctttggactgcatgtctgaagggcccaaaagctctgatgacggtgctttcggtaaatatgtagtagacgataacagttctgctgtaaataacaatccaagtgttaaattccatgccgagcttgtaaataatactgggagccttaagtcagaggcccagctcggatttgtaaatagcaaagaggatggtgaagatggagagcaactcccagacttgtgatattgactctgtcaagatgatcgatggtgatggaggagccctctttaatcgctgaagtcttcattgtgcgtgtgtagctgaattctttcatttctccatccggagttctttacctctcttctatagttctattcataggcattcatgaaaattttaccgagagaaaagatagaaagggaggttgaattgtggccctatgggtgtggaagctttggtgatgtgagttgggtatcttagaagaatttgtacataacatgattgttcattgcatttgcaataataacacgtaattggtacataaaat

SEQ ID NO: 11516 - DNA, 767 bp, Sorghum bicolor
  Clone ID: SORBI-28MAY03-CLUS47886_1
gcacgaggctactactggtccgccggcattctgttccttccattggctctctgctccaagtcctaccccactctccctgcaacgctccaatcctcatcactctctgtgtccgtgagctctgctcctctgcatcaaccagagctgccctcggatccagggacctaccgcgagcgccaatggcggccgcggcggtcctggccgccatactagcgctgttctcccgcgcggcctccgcaacggccgcgacggcagcggcgaaggcggaccgcatcggcagcctgccgggccagccgccggtcaacttctccatgtactccggctacgtcaccgtggacgcggccgcggggcgggccctcttctactggctcatcgaggcggccggcgtgcccgcggagtccgcgccgctcgtgctctggctcaacggcgggcccgggtgctcctccgtcggctacggcgcgtcggaggagctcggcgccttccggatcaacgccgacggcaggacgctctacttgaacccctacccctggaataaagtggcgaacatgctgttcttggactcgccggcgggcgtcggttactcctactccaacaccacctccgatctgtacactgccggtgacaacaagacagcccatgattcgtacaatttcttggtgaattggctggaacggtttccacaatacaagtatcgcgatttctacatcacgggagagagctatgcaggccactatgtgcctcagttgtctcaactagtataccggaacaac

SEQ ID NO: 11517 - DNA, 735 bp, Sorghum bicolor
  Clone ID: SORBI-28MAY03-CLUS47734_1
acgactcgccggccaccctttcccctcctctcctcccccctgcaaagcaccttcctcacctccctctcctggcctcagagcctatgcagtgccgggttgtggtgcggggggtgtccattccctgcaagggaggcaagaggaaggtaaggaaagtgctccagaacagcaatggcgtgttccgatgcgaattccatgcccggcgcaacagggtcgtggcgaccgtctcggcgaggcccgtcccctccaggctgctctccaagctgcgcaggcccgccaaccgggcggagctgtggccggaccacccgccccccccccccccagccgcagcagcggagactgagagccaaccgcaggagcccaagaacaaccagcctgacaacccgagcaaccccaacgaaccgcccgacaagggcggccccgacccgcccgaggccgccgcgcaagacccgggcacccctccggagcccaggcagggccccggcgaggccccaaatccgcctcgggactgcaagcaccatgcaggcgccgatgaagccggcggcgacaccggggccggcacggccgcggccgcggcccggccgcggcccagcgacgcgaagggggaagcgaaggtgcggcagcagccgggggcgccgcatgccccccccggcggtgatgagctacaaccaggtgcggccgagcgtgagcgcgtcctactacgctcccgccccggcaccagcgccggcgccggcgccg

SEQ ID NO: 11518 - DNA, 659 bp, Sorghum bicolor
  Clone ID: SORBI-28MAY03-CLUS48103_1
cggaaaaaccgaagccacagccggaaaaaccgccaacgccgccgccacagtgcaattgccactgctgcaagccgccaccggaaaaaccgaagccaccgccaccgtgcaattgccactgctgcaagccgccaccgccaccggaaaaaccgaagccaccggcggagaaaccgccgccctgcaagtgcgagtgctcgcacgacaaggatgactgcaagcatcattgcccaccatgcccgccgtgcccgccgtgcccaccatgcccgccgccgaactactggccgccgcagccgtggcccgcatgccggtgcccggagcaggacagccagtgctccatcatgtgatccatggttcctttcttgcaaatctgctacctgccgtgcgatcagctatgctctgcgatcatcgtgtgatcagtcacaataatcccacgctcgtcgtgtacttggttctcgcgtcgttcgttgtgtcatttgggttgtgtagtctgtctgtgtgtcgtgtcttacatgtgcaatactaatgatgtgttttattaattccatgttacatctgtaataattcgttgggtaactactagtcattttctttttgtatgacgtgtgctgtaaagagatgcctactggtactagtcgatcatggtaatgatttctagcagagga

SEQ ID NO: 11519 - DNA, 796 bp, Sorghum bicolor
  unsure (1)..(796): unsure at all n locations
  Clone ID: SORBI-28MAY03-CLUS48397_1
ccttctggtctccctcccgccctctcccccccgcctttcccctctttctcggctcttgtcctctggcttcattagcctgggtgcgatgttggcaagctgcgccttcatcttcttcctcccacacctctcctacaaactgctctatctcttctcttgtccattgacaacattattcagggttagaagatggcaatactggtcatcaccatggtggacctgcagtgctgccgctgcagagccaagatcaccaaaatcctggaatgcctcaaagaggagttctgcattgagaagattgagttcgaggacaaggtcaacaaggtgattgtacgcgggaagtttgatggcgagaagctcaagacggtggtattatgcaaggcaggcaagatcgtcaaggagatagccgtcgtcgaaaagtggccacccccaccaccgcctccgcctcctcctccaccggaatgcaaggcggcaatactggtcataaccatggtcgatctgtgctgcgcctgcagaaccaagatcaccaaaatcctggaaggcctcaaagaggagttttgcatcgagaagtttgagttcgaggataagctcaacaaggtgattgtacgcgggaagttcgatgccgagaagctcaagaagacgatattgtgcaaggctggccacatcgtctaggagatagtgctcgtcgaaaagtggccgccgccgccaccaccacctccgtctccggctccgncgccgccgcccaaaccggaatgcaaggtggtgccgtatccgtaccctgtaccgtatccgtttccatccc

SEQ ID NO: 11520 - DNA, 744 bp, Sorghum bicolor
  unsure (1)..(744): unsure at all n locations
  Clone ID: SORBI-28MAY03-CLUS51927_1
gcacgaggggcttttctcctccctcccggtctactcgccgagtagtactcctctctactcgccttcttcggttcttcctccccgagcagccacttccgtctctaaccctactgcgacgacgagagcgaggccatgagggggaaaaagccgctcaaggacctcaggctctccgtgccggcgcaggagacccccgtcgacaagttcctgacggcaagtggtacgttcaaggatggtgagctgcggctcaatcaaagtggcttgcgacttatctccgaggaaaatgggggtgaagatgaatcaacaaagctgaaggtggaagatgtgcagttatcaatggatgatcttgagatgattcaagtcattggcaaaggaagtggtggcattgtccagctagtgaggcacaaatgggtggggacattgtatgccttaaagggtatacaaatgaacattcaggagtcagttcgtaaacaaatagtacaggagctcaaaataaaccaagcaacacagtgccctcatatagttatgtgccatcaatctttttaccacaatggtgtaatatatcttgttcttgagtacatggaccgtggatcacttgcagacattgttaagcaagtgaagactgttctggagccataccttgcggtactttgtaagcaggtcttggagggtttattgtatcttcatcatgaaaggcacgtgattcacagggacataaaaccatctnacttgttggtcaaccgtaaa

SEQ ID NO: 11521 - DNA, 860 bp, Sorghum bicolor
  Clone ID: SORBI-28MAY03-CLUS52300_1
gcaccacgagctcgagcacgaggcgatactggaactcagagcataggagggaaagtcgatttatggatggaatcaaatacgcagtatttacagaaaagagtcttcgtttattgggaaagaatcaatatacttttaatgtcgaatcgggattcactaagacagaaataaagcattgggtcgaactcttctttggtgttaaggtagtagctgtgaatagccatcgactacccggaaagggtagaagaatgggacctattctgggacatacaatgcattacagacgtatgatcattacccttcaaccgggttattctattccacttctagatagagaaacgaactaaaggagaatacttaataatatggcgaaacatttatacaaaacacctatcccgagcacacgcaagggaaccgtagacaggcaagtgaaatccaatccacgaaataaattgatccatggacggcaccgttgtggtaaaggtcgtaatgccagaggaatcattaccgcaaggcatagagggggaggtcataagcgcctataccgtaaaatcgattttcgacggaatcaaaaagacatatctggtagaatcgtaaccatagaatacgaccctaatcgaaatgcatacatttgtctcatacactatggggatggtgagaagagatatattttacatcccagaggggctataattggagatactattgtttctggtacaaaagttcctatatcaatggggaatgccctacctttgagtgcggtttgaactattgatttacgtaattggaagtaaccaattaggtttacgacgaaacctagaaatcgatcactgatccaatttgactacctctacgggatagac

SEQ ID NO: 11522 - DNA, 675 bp, Sorghum bicolor
  Clone ID: SORBI-28MAY03-CLUS52216_1
catgtccaaccgggaggttgtgcaggctgcccagctgcaggctgagggcgggatcccggagtgggtcactgccatagtcaaatcggaggtgggggatgacggcactggggatgtgcacttcgaggccttccagatgagcgagatttgtgtcaagctcttcaaggatggggtactggaaactgaggttcaggatgctgatgatccccgtctgtcaaagatgaggaaggaggtggtggctgggggaaaggatactatggaggtggataatgacttcttcctagtgcccgtcaagatctctgatcaccagggtccactctcagtaggctttcctatagagaaccgtggaagtcctctgggcatgagtgcgctgagaagtcacctggagcggatgaagcatttagcattcgtgaggcggatctcggacttccatttgcttcttaagcttgctactttcctagatgtaaaggcagacatgcccactatagctgcatgtgtaaaaactcagagcagggtgcccgaggggtaccagtttctgatcgagtcctttgctagtcagggataatcttgcctctgaaagcatggcacgacgatgcataattatttacttgtcacatcatgtataacttatgaaaagtctcaggtgtataagtattgttcaattcttatgcctttctt

SEQ ID NO: 11523 - DNA, 668 bp, Sorghum bicolor
  Clone ID: SORBI-28MAY03-CLUS52347_1
gcacgaggcgcccactgcacccatgagtcccccgcccccccctccggccgccgcctgcctggcctaggccgcccgccctcccaaccccccccgcccgccgcacctgcatcgagagcgcccggcccccgcaccccccgcccgcggccgccgccgtgccggcgccggcagtccccgccccgtcgctcaggcccgccccctgcccgcgatcgctgtacgtccgctccggcccaccccccgcccccccgccgctcccgcctgcgccagctgcgtccccgccgcctcccccgaggccttggcccccatctcccccgatccccacccgccgccccgcctcggcgcctccccctccacctccgccggccccgccccgccgccgcggctcgccgcgacgcctccggccccggagccctccaccgcccccccccggccgccttccacagccgaggccgccgcctcctcctccccccccgcctccaacgccaccggtgcccgcctccgggccgccacccgcgacccccggcagggctccccaccctgggtctgccgcccccggccccccggacgagccacctcaacagcgccgccgccccccccgccgcccccgaccctgcgctccttcgccgcggaatgcctcatctaccactacgctgcgtgccgtcgcggcgtag

SEQ ID NO: 11524 - DNA, 584 bp, Sorghum bicolor
  Clone ID: SORBI-28MAY03-CLUS52433_1
ctaccggattgctctgcctttcttcctcccctcctttccccccttactacaggaggaatcaatcaatcatcaatccccactgctcagcctcagccggccctcagcaagcaagggacagaggcgggaggcggccggcggccggggggcggcagcagcagcagtctcctcatcgagctctccgggaccggccgcgggaaagaaaaggcgcgcctttgctttgctttgcttcccttccgtggtgctcagttgagggggccggccggcggggatgggcagcggggtccgggcgctgatgcgccggaagcaggtggactcggagcggacgcgcgccgccggcagcgcccaccagctccgcaaggagctctccgtcacccagctcgtcgccatcggtgttgggtcaacgattggagccggggtgtatgtccttgttgggacagttgcccgggagcattctgggccggcattgacactttcatttctgatagccggaatagcagctgcactttcagcattctgctatgcagagcttgctagccgttgcccttcagcaggaagcgcctaccattattcatacatctgcgttg

SEQ ID NO: 11525 - DNA, 837 bp, Sorghum bicolor
  Clone ID: SORBI-28MAY03-CLUS52547_1
gtgaaagccgtccgtgctgacttccattatttttacagccaccgtcccaccccatcttctcttcttcccctcttcggctcttcccttccatttttttttccctcttctcttccaccaaaccaagcctcgcgagagaaatttctcccaaatttcagatcaaatcctcgaatcctccaacccctagcgacccctcggagaattcttctcagtagcgtcgcgatccggctcgatccggcatggagcgcgtcttctccgtggaggagatccccaacccctactgggccccgccgcaccctcaatcagctgccgccggcgctgttgctgcaccaggtggaggaggaggagctgtggacgcggcgggcgcgatgaaccggtgcccgtcggagtggtatttccagaagttcctggaggaggccgtgctcgacagcccggggcccgtccctggcgtcggtaggggcagcgttgtagctggagctgaggcgccggagagcaagccgctggggcccgcggctgcctcgagttcggttgttgaccctgtggagtacaacgcgatgctcaagcagaagctggagaaggacctcgctgctgtcgccatgtggagggcttctggtgcagcacctccagatcgttctgcagttgcttcttccttgccaagtgttgatgttccgcatgcagctcctcttaaacccatcggaggtactgaaagtctagttcaaaacaagctagctggtgctccaggtgtgggatcaggtccacatgtagtacaaactgccgatatccctattaagcaaaccactagctcttcctcacgagagcagtcagatgatgatgacatgg

SEQ ID NO: 11526 - DNA, 643 bp, Sorghum bicolor
  Clone ID: SORBI-28MAY03-CLUS52753_1
tatggtttgatttgtatggaagaggtggcacctcttgctgctcttcgcacgaggagcatgtgtttgttggtgagatcaaaggacgggggcaaggggagactgaggtatcaggcttccataactggattcagttttatttggaagaagccaagggaaatgtggattaccaaggttatatatttccaaggcgccgtggtgaatcgcctgattcagagacacagctgctgactgttcagtttgagtggcttggtgtgctgaaatcagtatccagcacgttgattggtgtcagtcctgagtttgaggttgcactttacacattgtgcttttttgttggaggggaagataaccgcgtcgatattggcccatacagtgtgaacatcaagtgctaccgattggggaacaacaaaattggatcagcctttcccattgcagagaactgattatttggtgctctgcttctgcaagtttgtagatcttcacttttttttggtttcatagtcacttatatgaagttattaatattgttgtactgttcaaggatagctggttacttgtgcatgaaaaggtaccatactgttcaatttgtattgctacttgtgctacagaaaaaagctgatagctgagactaaaattacttggtttt

SEQ ID NO: 11527 - DNA, 1150 bp, Sorghum bicolor
  Clone ID: SORBI-28MAY03-CLUS49506_1
gcacgaggcggaagcacattgttcaagtctttgacaaccattatcgatcaccctgctgggattgtgactatgcttgccaatagcctgcctggaagtgcaacgttcttcctcacatttgttgcgctgaaattctttgttggctgcgcgcgggagctctctcgcttggttcccctcatcattttccatctgaaaaggaagtacctatgcaagacggaggaggatgtgaaagcagcatgggctccaggagatctgggatataacaccagggtcccaaatgacatgctcattgcaacagttgttctgtgctactcagtcattgcacctttgattataccattcggtgttgcatactttgcccttgggtggcttatagcaaaaaatcagattctgagagtttatgttccgagctacgagagctacggacgaatgtggccacacatgcacacgaggatcatcacagctctgatggtttaccagactaccatgatcggcttcatccccctgaaaaagttttactatgtacctgttcttgtgcccctgcttccaataagcatcatcttcgcctatgtctgccatatgcgcttttacccagcatttgccaagactcctctggaggtggtggcacagcacgacctgaaggaaactccaaacatggaaaccatctatacctcatacatacctccgtgcttgaagcctgaaaaacttgaagatttggacgcatttgaggatgctcagtcacacaaaacctccagagccccatctgtttagctgtgcaatctagactgtcggaaaagaccgaagaaattctgcacacctgtcgtcaagtactcaagttcatgcaggatttctggtgaatttccatgcttccacgtgaaccctctgaacctgagtttcaggataggaatctgatgtgaaatgtacatatgctcgagctatttgtctgctgaacatgtgtggacttgtaggttctggtagctgctgtggatattagcgggttctaagtttgtcttcgtttctatccatgcgcgtgtgtttactgtagactatgctgtgttgttgtgtaggataactgtgaatcggtttgcctgatgctctgtgattccatttaacagaactgctcatatattattgtaagctgttgatgaagttc

SEQ ID NO: 11528 - DNA, 1473 bp, Sorghum bicolor
  Clone ID: SORBI-28MAY03-CLUS49534_1
tactgcatagaatacacccaagcaaaccccttcaagaggcgcatgcacagtcatcaggatcaaaaagctgtccaaggcaagaagaaaagaaaagcactcgccattgcaccagaccactcagagaagtgccaccccaaaccagtagagctgggacacgccaaaaccaacaagagcatgacccagcatcatcaatcatagccacatcatatataaaccaagcacagagcacccaagaacacaacatcaagagcagacaggcatcaagagcaggcagaaacagcgtcgaagatgtacccttaccgcatgagcaacgtgatgattggctacctcaacctggccactctccttgcctcgattccgatcatcggggcggggctctggctggcgaagggctccacgaccacatgctcgtcgattctgcagacaccactcctcgtcatcggcttcatcgtgctcctcatctctcttgctggcttcgtgggcgcctgcttccatgtcgcctgggcgctgtggctgtacctcgtcgccatcatactcctcatcgctttccttcttgggctcaccgcattcgggttcgcagtcacggcaggaggtggaggcacacaggtgtatggtaggccttacagggagtaccacatcactgattactcctcatggcttcagaagcacatgcaggacatcaagtactggcgcccagccctcgcctgtgtggtggggtccaaggcctgtcccaagattgaaaattggactcccatggattacctccagcatgatctcacgccaatacagtccggctgctgcaagccaccaacagcgtgccaatacagtggaggcatgcctgtcggggcacaggatgaggactgctaccggtggaacaatgccccagacatcctctgctatcagtgcaactcccgcaaggccggtgtgatggagcagatccgccaggactggcacaagatatccatcctcaatgtcattgtgctcgccgctctcatctgcatcgcctcctgttgctgctgcgccttcagaaacgctcgccgctctctgtccgagtacccatacggggtaaaccaaatgtccaagataaacccccgctgggactactactggtggcgatggttccgtggtagaagagaacagctctactaggctagctctagcttctcaatgcttgtatgatattttgctcctatattctatcgaaaagataataatacttgagagctgtgttagcccctgcggtactctatttgtttcaagttgtacagcttcttccaggtctgcataattaagcttctgtagatatttgggttaagaggagactaagccatgaagtaaaagagatgcctagtttttccaatatggtagccaacattgtatcatgtagaattctacatggcgaattcaggacagatagtgactcacatgtgtatgggggaaaccaaaccacacaagcagtctatgcatattctc

SEQ ID NO: 11529 - DNA, 700 bp, Sorghum bicolor
  Clone ID: SORBI-28MAY03-CLUS499_1
gaaccagcaagcaatcaaaatcaatctgataatacacggtcatgtgagccgtacccgctttagtgctcccacaattcttcgtgtgtcgaaggcaataaattctgaacaatctgtcatgtgtcactgggcatctctccgatgccactttgctcacatagtcacattacatgctgtatgtatacctgtactcgaattagcttcagtttcaaaacgtatgataccagtttaattttccctgatcttaaatatacaatatagcaccaagagccggggggagaaacaccctatttctgctacccaaaagaaccagatcatcatcgtcctctagccctcgttggaaccgagctctggatccacaacatagcctctcagcgaaggcgtcttgccgaaactgggactagggcctttcttctgcattctcttcctcgcgatgtggccacggatccacggcagcacatcctcgttgatcttgatcatgaggaagaagaggatgcggtagatgaagatcatgctgaaaatgactgacaagtcgatccacttgttccggtccacgttgatctggaagatgtacttcaggatgaagtccccggggatcttgggttgatctgggtactggttgtcgaatacgaggcctttcatgtcgttctggcactggccctgcagtgcccagtaatggaagctgatgtactgcatggggtat

SEQ ID NO: 11530 - DNA, 306 bp, Sorghum bicolor
  Clone ID: LIB3478-052-P1-K1-E8
actagttctagatcgcgagcgccgcccttttttttttttttttttctgaacaatctgtcatgtgtcactgggcatgtctccgatgccagtttgctcacatagtcacattacatgctgtatgtatacctgtactcgaattagcttcagtttcaaaacgtatgataccagtttaattttccctgatcttaaatatacaatatagcaccaagagccggggggagaaacaccctatttctgctacccaaaagaaccagatcatcatcgtcctctagccctcgttggaaccgagctctggatccacaacat

SEQ ID NO: 11531 - DNA, 756 bp, Sorghum bicolor
  Clone ID: SORBI-28MAY03-CLUS50107_1
cggggagcgttggggggtgcttcttagcttccttgtcactcttctatccatggtttgagtgccagaatgtaatattgttggagacttcctttacttcctgtgaaatagaagtgttaataggtgaggtgctggagatgttggatgcactacaggcaagttaaagggaaaaaaatggcaaaacctggtgccaaaggtggagcttgagcagttggcacatctcatggaaagggacgtaacaactgcgcacccacaagatgagatgtaatccaaaatatggatgcaatcgcagttcggggataatgagtaagtaatcttgatttccttttttgctggtgtaagcgcgagtcttttggttcatgtatcacaagatggtgtttaatttatcttgctcactgtttcacattttttattttttgtgtattaaatacagtactctagcatgaatgtatcctatatcgactttagatagtagcgggggtaaatgaaaagaggcttgcatatgtctgtatcgatcattttgacttgtagctacatagaaatgaggcagatctgaagtgtacttggatctttttgtttgattggacatcgaccataagttcccattccgaagtagcttagttactcctgtctactttattatatccttggttcctcccggtttgctatcattatcttcttcattcacacactgaatcaagtttgtgcctggattgtcactcatcaaaattctcaagtagagtctgaaattcattttct

SEQ ID NO: 11532 - DNA, 1219 bp, Sorghum bicolor
  Clone ID: SORBI-28MAY03-CLUS5418_1
gcacgaggcttcagtaatctgcgttctagaggttcaagtttgtgtgatattgccattttggttgttgacatcagcccggggcttgaacctcagacaattgaatccctgaatcttttgaagagtcgagatgcagtgttcattgttgctttgaataaggttgatcgtctttatggttggaagaaatgtccaaatgctcctcgtgggaaggctttaaaacaacaaaatgaagatgttaagagggagttcaatatgagacttacagatattgttacacaattcaagatgcaaggagtgaatactgctttgtactacaagaacaaggagatggaagatacctttaacatagtgcctacgagtgctgtaagtggtgaaggcattcctgatttgcttctattgttggttcaatgggcacagaagacaatggaagaaaaacttacttttgttgatgaagtccagtgtactgtactggaagtcaaggtcgttgaaggtcatggtactacaattgatgttgttttggtcaatggtatactgcatgaaggagatcaaatagttgtttgtggcatgcagggacccattgtgacaactgtcagggctttgttaactccacacccaatgagagagcttcgagttaagggtacctacctacatcataaggagatcagagctgcacaaggtgtcaaaatatctgctcagggtctcgaacatgcaattgcagggacagctctttacgtgttaggacctgatgatgatttagacaaactgaagaagctgttatggaagagatgactagggttaggagccggattgataggagtggtgagggtgtctatgtacaggcatctacccttgggtctttggaagctctcactgagttcttgaagagccctgcggtgaatattcccttctgtgatttcagtatagggccagtgcacaagaaggatgttatgaaggctagtgttatgcttgagagaaagaaagaatatgcaactatcttggcctttgatgtcaaagtgatgcctgatgcccgcgagcttgcagaagagtccggtgtgaggatctttgtggctgacataatataccacctgtttgaccaatttacagcatacattaagaacctcaaggaagagaagaagaaggaaagcgctgaaaaagccgtgttcccttgtgttcttaagattatgccaaactgtgtcttcaacaagaaggatccaatcgtttt

SEQ ID NO: 11533 - DNA, 909 bp, Sorghum bicolor
  Clone ID: SORBI-28MAY03-CLUS5443_1
aaaaaaaaaaaaacggacgagtgcgcggcagagcgctgtagaagaggaggagaggagagagaggaagaggacgaaccggagccactcagccgccacctcaccccgcatcggccgcctgaggtccgtccaaccgctcctgccgccgcccgttgctctcgccattgaagccgtcgccgcctcctccagcccgctcgcttgcctgccttcctgccggctgccttccggatgagaagcggcgcaacctgggcggtgcaagcgtggtcggcctgagccttcgtcggggttaacgccgagaagaggatcctggagtttaagcgcatgggttccttggaggcccggtatcggccggccggggcagctgaggacacagctaagagaaggacccagaaaagcaaaagtttcaaagaggttgaaaaatttgatgtttttgtgctggagaaaagttcaggttgcaaattccgatcgttgcaacttttgctcttcgctatcatgtctgctgcatttctaacactcctatacacaccatctgtgtatgaacatcagttgcagtcaagctctcggcttgtcaatgggtggatatgggataagagaagttctgatccccgatatgtatcttctgccagcattcaatgggaggatgtgtataaaagtatccaaaatctgaatgttggtgaacaaaagctcagtgttggactcctgaattttaatagaactgagtttggcgcttggacacatatgctcccagaaagtgatttttcaatcataaggctagagcatgccaatgaaagcattacctggcagactctgtatcctgaatggatagatgaggaggaagaaacagagataccatcttgcccttcgcttcagatccaagttttccaagagcgacacattttgatgttgttgctg

SEQ ID NO: 11534 - DNA, 1238 bp, Sorghum bicolor
  Clone ID: SORBI-28MAY03-CLUS54923_1
ccggcgggggcagcatgatggtagtgggaggcgatagagaagacaagtgctcataaccaaccaccactcactcctctctctctctcctctacacaacctttcccttccgtgtttctacttcctagagggaggaaagagagatcttaaggagcgcatgctccggttgctagcttcttcggttcgacaatatccgcgtataactgcggcggcccttcgttctcaatcacctttcagaattaattgattatcacccgatcgatcggtcgtgcagaaggagccggcggaggcaaacagagtcagctggtagactgctagcttccaacaagaagtacacgcgcccgcaggcacagtctcgctgctgccacacgctgcgtgactggactagtcggtgtgaccggccggtccgctggtggcttctttgcttgctgctggatccttctttccttctgtagctagctcgtggccgtcgacgtcgtcgtcgtcgtcggacgtacgtacgccagaagagggagagaagaagaacagcgacatatatacagtacactcgatcgaacgatcgatcagcttcgaattaatggcagctgcctcgtcgtctccccgcagctaggttcatggccggggagagctcctcgtcgaggagcacttctcaggccgagaacgagagccagttccgggacctgatgaacacgctcgcagcgtccgggagcggggctggcacagcgttcagcggtgggttcccgggcatggacggcagcaagctgagcacgagagacttcctcggcgtcggcggcggcggcgtcatgcggagcatgggtggcgcggcggggctgccgctgcggcacggtgccgcgggcattggcatgggctcattggacccagaaatgaagtaggcgatcgaaatccgaaacgatcgaccaccgcatgcagcattatgctccactcttggctcttgtgttgcatgcaaggtaagtagcagcagcctaaccaacgactagggttcatggatttggctgatgaagatgaggccatctatcgtgctaaaaaaaaagaagacgatgccatcaaccatgatatgtttatggtgctgcacggtgcatgaatggtgttggagattgatgatactagctagtgtagtactatagtgtagctcctgctggggatgtaagaatcgatcaaaagaaataatagcagagaaggctggacccggtgttaaattaaatgccggtatctatttaatt

SEQ ID NO: 11535 - DNA, 1788 bp, Sorghum bicolor
  Clone ID: SORBI-28MAY03-CLUS5511_1
agggcgcccctttctcggccatcctcgccgacttcctcggccgcgggatattcaacgtcgacggcgactcctggctcttccagcgcaagctcgccgccgccgagctcgcgtccccagcgctgcgctgcttcgcggccggcgtcgtggcctccgagctccggtgccgactcattcctctgctctactctgcagccggcgacggagacagcagcggcgagaggctgctggacctccaggacgtgttccgccgcttcgccttcgactgcatatgcaggatctcgttcggcctcgatcccggctgcctggagctctcgctgcccatgtcggcgttcgccgacgcgttcgacacggcgtcgatgctctccgcacgacgcgcgacggcgcccatgcacgtgctctggaagctgaagcggctactcaacgtcggggaggagcggagctccgcgacgccatccgcctcgtcgacacgctcgccgctgaggtcatccggcagcgccggaagctcggcaccgccgcctcgggcgacgacctcctgtcgcgcttcatgggctccatcaacgacgacaagtacctccgggacatcgtcgtgagcttcatgctggccggccgcgacaccgtcgcctcggctctcgcccccggcttcttgctgctctccgaccaccccgacgtggccaccgcgatccgggacgaagtctcgcgcgtcgccggagacgacgacagagacggccacgccgccgccagctcggagaagctcaaggacatgcactacgtgcacgcggcgctgcacgagtgcatgcggctgttcccgccggtgcagttcgactccaagttcgcggccggcgacgacatgctccctgacggcacgttcgtcgccaggggcacccgggtgacctaccacgcctacgccatgggccgcatggagtccgtgtggggccccgactgcgccgagttccggccggaccgctggctccacgacggccggttcgtgccggagagcccctaccggtacccagtgttccagggcggcgtgcgcgtctgcatcggcagggagctcgccatcatggagatgaagtccgtcatcgtctccgtcgtgcagagcttcgacatagaggcggtcggccggagctcccaccggccaaagttcgcgccaggccttaccgccacattcgccgggggcgtgcctgtcagagtccggcggcgagcgagagctcgtgtcagcgagctccgacgaccaccaagataacgtcaccacggcaccatgcacgcacgatttgttcgtcgtgttcttccccttcgtgacttgtattcgcgaatcgcgacgacgacacagtttggttcttggcctccactggagtctgaagattcctccgataagggtcatctggtcatggcacaggcggaggaagggattagtcgtctaatccgatgcccgacggacggcactagttctggcacatgcataaaaagggggcggcgtaaagtcgcctctgcatgtcagcatgtgtgctattctttccaactttcaaagcagaattgtcgaaaagaaaattttgcagattcaaagttgcagaatgcatgcacatctagatgttgtagcttccctgggaacttgaattattgcaaggtggtcgggcagcgaattagaaaaatgcatgcagttgatatattctttattccagctcagctcgttggatagatttttacggtggaaaccatatccacaccatgttccagtttttgactcagtgtagctacccgtccaatattatgggtttgttgtcctgtatt

SEQ ID NO: 11536 - DNA, 637 bp, Sorghum bicolor
  Clone ID: SORBI-28MAY03-CLUS55281_1
aattccctggatgacagatgaagaactgggacagtttgccgaaaagtttgagaagactggcttcacaggacccctcaactactaccgcatgcttgtaacaaactggagactcactgcaccttggagtggatcgaaaatcacagtgcctgcaaaattcatactcagcaagaacgacgttggtctgcagtcctttggaactgaggagtacgtcaagagtggcggtttaaaggagaatgttccagatcttgaggtttcaatcattgagggacaccatttcgtccagcaagaagaggccgagagtgtgaattcggaaatactgtccttccttaacaagtttgccaccgagggaggatcagcatgatctaattgtttccagtcagtcctgagatagtgagaggaagatggcctcagatctgagtgtgactgaaagcttttccaaactgaaaatgcaaggtcaagctgatatcttgatgtaaaacagtttgtgattgaataaagtgagagctgagtggaagccatatgttggcttgcatttagggataaaataaagagcatgcatgtaaaacagtttatgattaaataatcgtgtgctgtactctccttttcaaattataagaatgtttttgttcttttctgg

SEQ ID NO: 11537 - DNA, 1663 bp, Sorghum bicolor
  unsure (1)..(1663): unsure at all n locations
  Clone ID: SORBI-28MAY03-CLUS554_1
aaatgatcgaggctgaattggagatgctgaaggggaacatggaaaggattcaggcagagaaagatgatgctttagccatggtacatgctaaagatgctgaggtctcagtggctgttactaggagccatgaattggagttggaagtggagaagacagagacggagatggttacctccaaggagttggtggagaagcttcaagccttggtcgcccagatggaacagaagcagaatatcatggttgctgaagtgtctaggctccaaagtgagatggaccaattggtgaagacgaatgaagcggctgttgtggcacatgactctgagaagaaaatgatccaggctgaattggagatgctgaaagggagcatggacaagattaagtccgagaaagatgatgctttaggcatggtgcatgctaaagatgctgaggtctcagcggctgttactaggagccatgaattggagttggaagtgaagaagatggagacagagatggctgctaccaaggagtaggtggagaagcttcaatccacggttgctgatgtggaacagaagcaccgtctcatgtccgctgaagtggctaggttccaaagtgagatggaccaattggtgaaggtgaatgaagcggctgttgtggcacatgactctgagaagaaaatgatccaggctgaattggagatgctgaaggggaatgtggaaaggattcaggcagagaaagatgatgctttaggcatggtacatgctaaagatgctgaggtctcagcggctgttactaggagccatgaattggagttggaagtggagaagatggagacggagatggttgcctccaaggagttggtggagaagcttcaagccttggtcgccgagatggaacagaagcagaatatcatggttgctgaagtggctaggttccaaagtgagatggaccaattggtgaaggtgaatgaagctgctgttgtggcacatgactctcagaagaaaatgatccaggctgaattggagatgctgaaagggagcatggacaagattaagtccgagaaagatgatgctttaggcatggtgcatgctaaagatgatgaggctggaaagttgagggatgaactgaagaagctccacagtggcatggctgagctccgtgcttgctgcgatgatcttgatgggaagtcttcctcccttcatgatgagaaaattttggttctgaaaaaacttgagcaggagaaagacgaagcagagaagctgaagttcaaacttcaggagcttgagtcctataacagagacaatgatcgggagagtggagttctgaanggcangaagttgcaggcagggacaaacaaatcaatgacttgactgacgagcttgagcagctgcagctcgcagtcgctgcaggccagatcgcagggggaccaatgtggtctggacgtggctgggtccagctaccacaactgtgttagcagctgcttcctttgtctacgccgcacgtactcggtgaacagccagctctttcactcgctttttgctcacttgcttagagatatgtgatattgctcgaaataacctgggctagtactcatgagtcatgatacttggtatatggtaaactgcttcttatatactatgatgaaagaaagctgtgttccgacaaaaaaaaaaaaaaaaaaaaa

SEQ ID NO: 11538 - DNA, 700 bp, Sorghum bicolor
  Clone ID: SORBI-28MAY03-CLUS57199_1
gcacgacgccccgcccggtctcgaccacttctcttctctctcgacactcactcccgtgcgtctcgtgtctagcgctgacgacgacggtggtgccaccggagccgggcagcggccacaatgccaacgacgcacgcgctccgcctctgcccgctgctctccaccgtccgatccacaccgccgcgggccactgccgcagcccgccagggcgcctcgccagcgctcctcgtcgcccgctgctcctccgccgggacgccgtcagccgcccaggcgctcaagatcaactcgatcccgaccaagccagttgaggggcagaagacggggactagtggcctgaggaaaaaggtgaaagtgttccagcaggagaactaccttgctaattggattcaggctctattcaattccttgccccctgaagattatgtgggtgcaacccttgtacttgggggtgatggccggtactttaataaggaggctgctcagatcatcattaagattgcagctggaaatggagttcagaagatcattgtcggcagggatggtctactgtcaactcctgctgtatctgcagtaattcgtaaaagagaagccaatggtggcttcatcatgagtgcaagccataatccaggtggacctgacaatgactgggggtattaagtttaactacagcagtggacagccagcaccggagacgattactgat

SEQ ID NO: 11539 - DNA, 655 bp, Sorghum bicolor
  Clone ID: SORBI-28MAY03-CLUS51433_1
gcacgagggccctgcccccatttccacccacccacccctgccctgatgcctctctccccgcgattcgccgcccgccatcgttgagcttgattgagagcgtccgctgcctgcctctgccatctgccaccaccacagcttccgttgctctgttgctcgatctcccgccaaggcaaggcgaaggaagggaggggagaaggaagaggcgggtcggtcggtcggtcggtcgccatggggatctgcgcgtcgtcgaagcgcgtgcagcaggaggaggactcggacgagaacgtggtgtacgtgatggacgagcagggcggcggcggcggaccggacggggacggccatggccggaaggtggcctccctcttctcgcagaagggcaagaaagggcccaaccaggacgccgtcatcctctgccagggattcggcatggaggacggcgtgttctgcggcgtgttcgacgggcacgggcggtgcgggcagtacatcagcaagctggtgagggactacctgccgttcatgatcctgagccaccggaacgcgctcctcttgggctcctccgaggacgacgactacgcggcggtcttcagcgacgcgtcgcccgtggcctcgacggcggcgtcgtccacggacggcagcgggcggtcgtcgccggctc

SEQ ID NO: 11540 - DNA, 778 bp, Sorghum bicolor
  Clone ID: SORBI-28MAY03-CLUS51328_1
acatgttttaattcattgcaagaatcattcaaagcgaatgctagtatggctgctagcttctgtggtgctgacgatctctgctttgtttgtgctattattaggcatgcctttcagcaagcctttgtatacagtgagctacatgctactcactggaggagtatctgggttcttgttgctgctgttgtactacatagttgatgttattcatattaagaagcccttcgtactattccagtggatgggcatgaacgcacttatagtctatgttctagctgcttgcgagctgttccccacccttattcaagggttttattggcggtcacctgagaacaacctggtggatgttactgaatctctgctccaggccgtcttccagtcgaaacgatggggcaccttggcgttcgtcctcctggagatagtcttttggtgcttggccgctggcttcctgcacatgaaaggcatctacttgaaactgtagaaccaaatcgtcgacagttctctgatggacggaatcgatgacctgtaaatattggtgaaacgcctggtaaccctgttttatctgtaaatgcaacacgactctggaaccatgggtctagtggttgatttcagcacgttgtggtgtcaaggtcgatatcatccgcctccaagtagacaaggaaaatgtattgctggaagttgcaagtgtttcaccacgtaatcttgctgtttcacactcgtaatcttgtgaaaaactcaaaaatacttcattgttttctggttctagtggtttcgtagggtt

SEQ ID NO: 11541 - DNA, 678 bp, Sorghum bicolor
  Clone ID: SORBI-28MAY03-CLUS51660_1
gcacgaggctcactttctcgccctctataaacctgcctcccgccgcgccgcacttctccatccccagatcaaaacccccccggcccggcgcccttcgtccccgcctcttgatcggccatggcgcccgctgctgctgcgtcccgggtggctgtctcgtcgccggtcttcggctcggatggcggcgccaggagctccgagatcaagggtaacaacaatgttagcttcggcaacaaatcctgggtcggcggcacattggcctgggagagcagctcggtgcggcccaggcacgtgaacaaggtgctctgcatgtcggtccagcaggcgagcaagagtaaagtctctgttgcgccactcgatcttgagagcgccaaggagccacctctcaacacatacaagcccaaggagcccttcacggccaccattgtctcggtggagaggctagtcggccccaaagctccaggggagacttgccacatcgtcattgaccatggtggcaatgtgccgtactgggagggccagagttatggtgtcattcctcctggagaaaccccaaaaagcctggagccccacaaaatgtcaggctttattcaattgcatcaactaggtatggagattactttgatggaagaacccggagcttgtgtgtccgccgtgcagtttattatgatcctgaaactg

SEQ ID NO: 11542 - DNA, 956 bp, Sorghum bicolor
  Clone ID: SORBI-28MAY03-CLUS51803_1
gcgcgaggagccgatcaagagccccgctcccctcgccctccccccccgcgccccgcgacgggccgtgccgggggggtaaggaagctcccggctgctcgcttctccctctcccccggcgccccgagacggtccaatccgagggagtaaggaagctcccggcacgcgcgcaacgcaagcgagaggatatggcgaccagcaacggcaaggcggcgcagggggaggaggggaagacgccaccgccggcggggtcgatcggcgggtacgagtccctgcacaggctcctggaggccaacctctccccggagctattccaggaagcaagccggttgctgttgggactgaattgtgcacagccgcttgaggctatctcactgcctgacgccacaaccactcttgcagaaacacacaattttgatgtgcaggcattccgttttagtgcagacaaagagtttctaaggcaaccacgagttgttcgagttggtctagttcagaactcaatcgccgttcccactacttgtcactttgctgaccaaaagaaggcaatcatggacaaaataaaacctgtaattgatgcagctggtgcttctggtgtcaatattttgtgcctacaagaagcctggactatgccttttgctttctgcacacgcgagaaaagatggtgtgaatttgctgaaccagttgatggagaatctactcaattccttcaggaacttgcacagaaatataacatggtaatagtgagcccaatccttgaaagggatgtaaaccatggggagactatttggaatactgctgtcattattggaaacaatggcaacataattgggattcatcgaaagaatcacattccaagagttggtgatttcaatgagagcacatactacatggagggtaacactgggcatccagtgtttgaaacagcttatggcaaaataggagtgaacatttgctatgga

SEQ ID NO: 11543 - DNA, 723 bp, Sorghum bicolor
  Clone ID: SORBI-28MAY03-CLUS56371_1
tggaatcaagcaatgggacgagtttgtggagacttttgatgtttccaagagctcacagctgccaaagctacttgtgtgggatagaaacgaggagtacgagctagtggatggttcagagagattagaagaaggtgaccaagcatctcaaataagccaattccttgagggatacagagcaggaagaacaacaaagaagaaaatcagcggcccttcttttatgggtttcctgaactctctcgtcagcttgagctcgctgtacatccttatatttgtcattgcccttctggttgtcatggtttactttgctgggcaagatgatactcctcagccaagacgaattcatgaagagtgatggaagcatggggagcttcttgcactaaagatggctaatctaccaggagatgtagctcagaggttagatatcaaactttcaactgacgcaagtcgtgaagagtggttttggcgattgatgatgagattcttccatctctactggcaacatcaacttctacatcctacctgtttgtgtttatgtgttgtgcccttaaatttgtttttcaatttagagcttagaaattagtctctgcctcttcctgtgtattttagacactgccattccagagtccatttctgtgaaaatatatttgttatcatactctgctactgaacttttgtacaattattattacaggatatatattatatagagtgtgttctggtgct

SEQ ID NO: 11544 - DNA, 811 bp, Sorghum bicolor
  Clone ID: SORBI-28MAY03-CLUS56424_1
acatcggacgattccatccagatggctgccttgaaatcattgcccgtaagaaagatattgtgaagcttcaacatggcgaatatgtatcgctcgggaaggtggaggctgctttgattgtgagcccatatgtggagaacattatgatccatgctgatcctttccacaattactgtgttgcgcttgtggtagctgcacacattgagctggaaagctgggcttcacagcaaggaattaaatacagtgatttctcagatttgtgccagaagcaagaggctgttaaagaagtgcttggatctttagcgaaggctgcaaagcaagcacgacttgagaaatttgagataccagccaaaatcaagttgataccagagccatggacccccgagtcaggactcgtcactgctgccctcaagctcaagagggaggtgatcaggaagacgtatgagaatgatctggctcagctgtacgcatgatggttctactactatttttgatacgtttagtgtggagataatatagagtgccaatgtcactatgaaagctgtgataatttgataacgattatcgatctttagggattacgttttttttttggtaaagctagaggagataaaccttgaagttttgagttatggcttctcttgatgctgagacgctatcctgctctttctgtcaaaaacactctgcggtagcctcatgtgatggttcctatgtgtttaggataaaatgactttgaattcttgttgtcatctcttatcttgagataactattggtattgttgtctataaaataaaatggtacggtgtatttctc

SEQ ID NO: 11545 - DNA, 1081 bp, Sorghum bicolor
  Clone ID: SORBI-28MAY03-CLUS56715_1
gcacgaggctccccagagtttattggttccgtactttggccgtctcgtttcttccgtccgcaatggattcgtcacacctactgacctaccccacctctttcacgaccgccgcctggttctcatcgttctcgtcgacctcgccagttcttctttcctttgcctcatcccttcctccctgcgtgcatcccatggagctccactgcacctgggcaccgtgcgggggtgtagcggcaggctgttcccgggtcgtggggattctcgacggccggtgtccccggccacgacgcggtcgacccagccctgccggtcgtcaccggcgcggcttcatcccgcaggaccacgccttctcctgtgctccatggaaccctagatgtgtgtctcctccgcacttgctcccagatgggctgccacgaactgacctacagttgactattagttgctcttcatgcatggcaacttaaataaatttcttcaatatggattgggtataaaattgtcagtgcctacctataccaagaatacggatggagccagttcctgttgccttggcgtgtattggtctgttcttctaaagattggtcgctcgatggcaacaccaatataagtcaggctattgccattactgaacaacctgatgtacacacgcttcggccaatatctagattcattaaaaaaaagtacactgtaaggaacacactccctctattgtaagtgatggctcatggaggtgacacagtattgcttccgtgtccctcatccatcgtttctttcagaagtgcatcaattgccgaagtggctggatgtggatgaaacaaagatggcctttcgccaccgacatctaccaaccaaggaacagatcgaccagggaaaaaaaggacactcctagcctccgatacaacaagggccgtgaccaacatctgtagcatatcccgcagctatgaagtctatgcgtcctacaaatatgaaccggtcatcaaatctgtgctgtataaatcaccctcacctcctatactacaccgtagaccaacaataccattaccatattactgcaactctgtatcatgatgtaaatgtttaacag

SEQ ID NO: 11546 - DNA, 745 bp, Sorghum bicolor
  Clone ID: SORBI-28MAY03-CLUS568_1
gccgcgcgatgggtgtcggcggcggcccgtccggcgaggccggcggcgcggagcacgccgaggcggaggacgacgccggggaggaaggcgagtacgaggacgagtccatcgtccaccacacggcgagcatcggcgacgtcgagggcctgaagaaagcgctggaggatggcgcggacaaggacgaggaggactcggaagggcggcgtggcctccacttcgcttgcggctacggcgagctccagtgcgcgcaggcactcctggaggccggcgccgcggtggacgccgtcgacaagaacaagaacaccgcgctgcactacgccgccggatacggccgcaaggactgcgtcacgctcctgctcgagagcggcgccgccgtgacgctgcagaacctggacgggaagacgcccatcgacgtggccaagctcaacaaccaggacgacgtcctcaagctgctggagaagcacgccttcgtatagactagacgtacgccgccggccggccgggccgtcctgctccttgtcgtcgccgccgcctccacgtcgctctgttgatttctctccctccccatccaccccaccttcatcaccacttagttgcgctttgggtgtgtatgtatcgtcggtctcagattttgcttgcgtgatcacggtgcaattatatatttttatatttattattatcgagaggactcctcgttcatcaggaggttttcgtaatgaataaggaacaaatttccatttcaaaa

SEQ ID NO: 11547 - DNA, 946 bp, Sorghum bicolor
  Clone ID: SORBI-28MAY03-CLUS56869_1
gcacgagggtactatggagcccttgtagctccgatcaatttacctaattcccgtctcctcttttgctcaagatcatccatgtttcagtggcaggttggatcaaacttttggtctgagcaccctttgggtgtccaatgcattgttcaaattgtgtccttcaaaggtgagatatttgccattgacttccttgagaggctccacagagtacagttggaacctcagctgagcacgcaggaagtagcagttgtctgggatgcggacatttttctaggactgtggaatgcaccgtggttggtggtctgtggtgacatgcttctcttggttgacttctcagtaagcatcaatcaattttctggaatagctggaacctttaatgtatttcgccttgactttcaagttgaaccagctaagtgggtaaaagtggatgatctgggagacaatgccctctttattagttttgataggaggaatccaacattttcttgcccgggtcctgataaatggggtgggaaaaggaactgtatttacattgccagcccgtctgcagattctaaagaactttggagtgtggttgaagttggtcaggtggtgcttgatccaaagttgtgtactaatggtgcagaaaagtatctaccccgtgcccagttgatgcaactgcaaaacctttgggagcttcccagttttgtttatggtgttggccagtgaccaatccatgcttgccttggagttttggcaattcgtggacacccctttcctttgatgctctaatacgatgtattagctagtcctgtggatttgttatttcttagcttggcattcaatgccctgtacaaattacagtcagatgttgatgctgacctcatgatgtatccagtttccaaaccaaattttctcactgtacatctgaacagtaactgaaacatttttgtaggaaactgtttcctag

SEQ ID NO: 11548 - DNA, 902 bp, Sorghum bicolor
  Clone ID: SORBI-28MAY03-CLUS5688_1
aaacaaaacccaataaaatctcgcctggcctctcgcagtccagccagccccgtcgcccaccccaatctccacgcgtcgccgccgctcgccggcgcgtctattcccctccgccacgctgccgaagcttcccggtccctgcagcggttcggataaggcggccgcccgcccgccacccgccctcctttcgccccccactcctctcggtcccgggaccgcttcgggctggatctagggttgcgtggggagctctggaagcctccgccgcgatggacgaggcggacgatgaacttcgcaccttgaaggtcggcttcaccgccgccggagaggagcagttccggaagctcgtggcggagaagctgcgggggttcaagagggacgtggaccacaccctcgtggaatatgttactatcatgctcaagaatggaaagcgtaaggatctcgccagtaaagaactccgtgtatttctaggggatgatactgcagtattcatttcctggttgtgggaccatctttctctaaatatgtacttatatgtgcaagcacaagaacaaactcaggaggttaaggatgatgaagcccccaaagaagtatctggaagagaaaaatcatcagatgtgctcccgagaagcaaatgtcaaactcatagtgagcacacagttgaatcaagtgcagctagtactaggaaacggaataagcgggaatggaaaggaattggtcgggagggtaatgaaaaatttccacttcgaaatgtactaactgatattcttcacggggaggagaaaagatcgcaaaagtccaatgaaatacgacaccctccatcaaaacaaccagaacggcagaagcgtgacagggatgatgagccacagcaaacaaagagagcgtctcatcacgccccatgcttg

SEQ ID NO: 11549 - DNA, 1137 bp, Sorghum bicolor
  Clone ID: SORBI-28MAY03-CLUS569_1
agcagggcaccactcgcccgctccagcagtccagctcctccgacgcgcgaccagacgctcgccctcgccagtcccagtcgccatacccagaggcccagaccccgtccggcgcccgccgattcgacgcgagtacgcgacgcgccgcgccggccgccggcggcttccccagatccacgcgccgctcggcgacccggccgctcggagctcgctccggccgtccgcccgcagcccgccaaaaatcatcctcggatcggaatcagcggagcgacggcggagatgggcgcggattgccggtacgagctggcgcaggcggcgtacgtcaagctggcgctgcacgcactgaagcacccagcgaccgccgtcaacggcctcctcgtcggccgcctcgtcgagccttcgtcctcaccggccgtcgtctcggtcatcgatgccgtgccgctgtctcaccacccgcaccacctgccgctgctccccacgctcgagctcgcgctcaccctcgtcgaggaccacttcgcaacccagggcgaaggcctcgccgtcgtcggatactaccacgccaacccgcgctgcgacgacaccgacctcccgccagttgccaagcgcgtcggggaccatatcttcagatacttcccccgctccgccgtgttgttggtcgataacaagaagctggaggaggccgtcaaggggaagtctcgtgacccggtggctcagttatacaccagggattcatcaaaaagttggcgtcaggctggatcagatggaagcagtcagcttgttctgaaaggaccttctaccaatgttgtcctagctgatcatgttacaacaagggatggggggattttcggtgagtttgccggccgccgcgatgctattagctgggattggttgttccccggccggcccgccggtctgttcccgtttcctctctctccaccgtctcggctcttggctagacttggggtgctctccctcgtcctgctgtcctccggactgtgctctggcgctgtgctttgctggcacgtttttcagtttgctagcggttttgtttcagttactgttcctgatgctatatttgacgtggtggcggcattggtgtagtgttacccctgcggcttgttttgacgcctgtgcttaaca

SEQ ID NO: 11550 - DNA, 1102 bp, Sorghum bicolor
  Clone ID: SORBI-28MAY03-CLUS5257_1
gcacgagggggaagccccgcgcggccatgtacggcctcataccggacgactggggcgcctacgcccgcccctgggtcgccgagctcgccgcgccgctcgagtgcctcaaggcgctccacctccgacgcatggtcgtcacggacgacgacctcgccgagctcgtccgtgccaggggacacatgcgcccggggctcaagctcgacaagtgcaccggcttctccacggatggactccgcctcgttgcgcgctcctgcagatcactgagaactttgtttctggaagaatgtcaaattaatgataaaggcagtgaatggatccacgatcttgcagacggttgtcctgttctgacaacattgaatttccacatgactgagcttcaagtgatgccagctgacctagagtttcttgcaaggagctgcaagtcactgatttccttgaagattagcgactgtgatgtttcagatttgatagggttcttccaatttgccacagcactggaagaatttgctggagggacattcaatgagcaaggggaactcaccatgtatgggaatgtcagatttccatcaagactatgctccttgggacttactttcatgggaacaaatgaaatgcctattatatttcctttttctgcaatactgaagaagctggatttgcagtacactgtcctcaccactgaagaccattgccagcttattgcaaaatgtccgaacttactagttctcgcggtgaggaatgtgattggagatagaggattaggagttgttgcagatacatgcaagaagctccaaaggctcagaattgagcgaggagacgatgaaggagggctccaggaagagcagggaggggtctctcaagtgggcttgacggctatagccgtcggttgccgtgaactggaatacatagctgcctatgtgtctgatataaccaatggggccctggaatctatcgggacattctgcaaaaaactctatgacttccggcttgttctgcttgatagagaagagaggataacagaattgccactggacaatggtgtccgagctttgttgaggggctgcaccaaacttcggaggtttgctctgtacttgagaccagg

SEQ ID NO: 11551 - DNA, 640 bp, Sorghum bicolor
  unsure (1)..(640): unsure at all n locations
  Clone ID: SORBI-28MAY03-CLUS53075_1
gcntacggtgggagaagggatatcatggagatggttgccccagcaggaccaatgtaccaggcaggaactctcagtggaaaccctctagccatgactgctggaattcacacgctcaagcgtctaacagagcccggcacctatgagtacttggacaagatcactggtgaactcgttcgtgggatattggatgtgggtgcgaaaacggggcacgagatgtgtggaggacacatcagaggaatgtttggctttttcttcactggtggacctgtccacaactttggggacgctaagaagagcgacactgagaagtttggaaggttctaccgtggcatgctggaagaaggtgtatacctggctccctcgcagttcgaggcgggtttcaccagcttggcgcacacctcccaggacatcgagaagaccatcgaggctgctgagaaggttctgaagcggatataggggttctgctacggctatgcagagagcatttccttctctttaccttcttgtactcttagttctatatgtcactgaggttttgtattgtgcagcagcaggacagcttttgtagctcctctttctgaattagtgcgtcttgtttttttgcagtgctaataaatctctggtccacgattacggttgt

SEQ ID NO: 11552 - DNA, 1323 bp, Sorghum bicolor
  Clone ID: SORBI-28MAY03-CLUS5357_1
ctcgatataaaaaggagcttggaatcaaggcttttgtaaaaaaggaggtccaagaagttagaacagttgatgagaggaaagctagtgaaattactcagcttacaatgccaaagctgtgtgtacggctcaacagtctatattatggtatcagccagttgagtaagttggaggacagcattaatgagaggtgggcttggaagaaaagtgaaaaaactaacatcagacgtacaagtgaaaagtcaaagagtgccatccctcagaaaaatcaatttgatggcagtagaaaagaaatcaatactgctattgatcgtctgtgtgaatttactgggacaaaggttatattctgggacctgcagcagccatttattgagaatttatacagaaacggtgttgctcaagctcgattggacaccataactgaagtgcttgatttggtccttaatcaactttgtgatgtcattgtggaacaactgagggatcgtgtggttacagggctactgcaagcatccctggatggcttacttcgtgtgatactggatggaggttctacacgtgtcttctctccaaacgatgcaccttttttggaggaagatcttgaaaccctgaagggattttttatttctggtggagatggactgcctcggggaactgttgaaaacttggtctcgcgtgtacgtcctgtaatagatctgatcaagcaagagacccgtgtgcttattgatgacctacgagaagttactcaagggggcaaaagcaaatttggagtggactccaaaactctccttagggtcctgtgtcacagaaatgattcagaggcatcacattatgtaaagaagcaattcaagattcccagttcagctccgagcgcctgattgtttgcaaaccaaaacaaatttggaacagggcagtgcagccttgctcgtaaaccaggaaacagtgttcccccgcccccttgcaagtttgtgtaacagttgtgcagtagtaaccctaggatttagggtggacgctgtagtaaacatgtgccctaattcaaatacattggtcttgtattgatggtagttttggttcattggagcttccccatttagattttttttgtggactgaaggcattcctgatcccaatgtcaagattgaaattcatgtttccctattatttttagcatgtttttttgtagaaccctataatatgatgaattgtttgcattgcatcatttgatgcaaaattgatgctgctgaattgcttaatatagtactgggtactatattaggcgtcccagctttgatatgaattcccaatccaaggtacaagttttattttttg

SEQ ID NO: 11553 - DNA, 1424 bp, Sorghum bicolor
  Clone ID: SORBI-28MAY03-CLUS5385_1
gtggcccaatgccggtcataccagataaagatcatgagttcagctaacatagtcagggacgaggtactcttgggccaagctctagatgtaaatgatgaattacatactctgctcgagaaacatgattcgactgcatcaggttctactatacactaatcgtttttattgggatttgaacctttttatgtcctttctttgagatacatattgtaaatttgtcacttgtcctactaatgttaatgttaaacagggcaatcgtatatatttatcattgctttttaaaaaaatgatctaacaatgtatcctgcaaatccaaattttagaatgtaaagcttgctaaagtagctttaaggcctggtgctgggaatatggtgaatgcaattctgcgtaaacttgtattgctaaaggagacagactctcttcctcttccaaagatagaaggcgatgatcgtgcccaagctcgtgctctttctataatttatcaccatcctataccccggtaacacctgaaccaggcttaaatcaagccagctcaccgacaagtgggcatccgcaggcttatcatggaaaccaaagacatgtatctgcaacttatgtcgctccgtgggctcagcctcagtctaagaccacaggaagtcaacaactgacacccactcaagcacagttatcttacagctcatttgcttacccgccgccaccctgggcttcacaggacaacaccgaattgaacccttttgtagcatcatcatcatcatcatctcagcaccagtccacttcgagcactcctatcatgccaccgaacttgaggcctctgcagcaatcacattcttttggggtaccacttcgaaccgcgagtttggactcaccaataaatgggaacttgaagcaaccactgtctgctggggctcggaggccatcttatgttccttcaaacaagtttttcgatgacttgtttgagagaaattcggatggtagcctgaaagtaggcagtacaattggtggtggcactaccagcccatacaaggcatagtgatgtctatggaaaaggaagtgtaaagattgtcaatgtgcaagtttgtccgttcgcttgtcctggcgtttgatgttaccagctgcctgcatcttcttgaggtttcctcttttcagcctagactgatttagttgatgcttctgtggaacattctgaccatttcataaataattttgccaaaccaagctatgtgaaagcatcagcctatttgttagccagacatcttgaatggcaaaaggtgatcattcctaaatcgtgtaataaaacgggtttacttctatatgtacagtttttaaacggctttagagatagaaatagtttgttgtctccagttggagtaactcaataatgattcaacttgtaggtcaagttgacatgcaactgttatcgtcac

SEQ ID NO: 11554 - DNA, 716 bp, Sorghum bicolor
  Clone ID: SORBI-28MAY03-CLUS58544_1
aagaggggggaaaatagaaagacgagaggaggaaaaaccagaactgaagaggagagagagaaggaaatccccccacggggaaaaaaaaagaggagctcggaatttctagtctccaagccgtagccgtgcgacgacgagacgacccggccggaaccgccgccgccgaggagattggttctgggagtagaggcgataccgagggctgcagaggaggagggatttgggatggccggcgatgaccatgttgtggttgatgtggacggcttagcgaaatccaaggaggccgaggttactaagaaaccgtctgaggttgcaaacagtccagctgcggctgctgcatctccgtcagctgttgttgacttggtccatgacgaggaggagggcggtggggaggaggagccgctcatccaggctgcagagtgccgcatatgccaggaggaagatagtgtcaagaatctcgagaaaccctgtgcttgcagcggcagcctcaagtatgctcacagagcttgcgtgcaacgctggtgcaatgagaaaggagacactacttgtgaaatttgccatgaggctttctgccctcctgccgcaatacaagcctggttacactgcgccccctcgtcctcagccagatgagacaaccatagacatcgacggtgatttgattatggatttgcgtgacccaagaattctcgctgtagcagctgcccaacgtcgtcttc

SEQ ID NO: 11555 - DNA, 742 bp, Sorghum bicolor
  Clone ID: SORBI-28MAY03-CLUS5768_1
cgcggtgcccggggcccggaggggcccccattgtgaggcgctgccctctggctgtgtcgggggtcgtgctgaggcgggtgctcttgcggcgcgcgatctctcaccgccatcacactccccacgcgtccgcatcattgaattcttcaagcggttccctaatgttgatatgacctatgtggtccgtgcgggtgacgatataagcactggtgacaatgtaaccgtgcaggtaacgctggagcgcgacatgactaacttgccatctgaggttggttcagtccatgcgccaaggttccccaagcccactgaagaatgctgatggctcgtgatcggtgacactggcaatcaaaagagacgcactcccaaaaaaggcgcgcgtgaaacttgagttatctgctcctgcaagttctgggagaaaggattagcagggagaaaaaattacatgatttacctgatgtcaggatcaggagtatgagttgcaccggagtatgagagcatgctggatgggattgatgatgaaggctgtgacagatgatcgcatagacgcagtagaacttcgagtgtgtattgttacacgatattagtattttggaacattatgtgttgtaacctctgaacttgtagaatctgtagcttattttggatgttaactggtgcactttgggaagttgctgtcttatcctattctggtattattgtaaggataacgcttggttatacttgagccagagtatttggtctggat

SEQ ID NO: 11556 - DNA, 1379 bp, Sorghum bicolor
  Clone ID: SORBI-28MAY03-CLUS58545_1
tggctagctcaccgtcgtgctcgcgtccccgcgcctgctgctcccttcaggccttaaccgttcgccgccgccgcgctttcgagcccacgcggaagccatggcgaagaagcggaagcgcaccgacgccccggcagaggcggccggcgcagagaagcccgacgactccgcgccggcgcgcccggagcgcacgctcttcggcttcaaggacccggcccccgacgccgagcccgccgcctccgcgggcgacggggccgcggtggcgccgttccgcaacagggagaaggtgctcatcacctgctcccgccgcatcacgtacaggtatcggcatctgatgcaggacgtgctgtcgctgctcccgcacgcgaagaaggacagcaaggtcgagtcgaagcagagcaagggcagcgcgctgaacgagctgctcgagctcaggagctgctccagctgcctcttcttcgagtgcagaaaacagaaggatctttacctttggatggtcaagtctcctggaggaccatcagtgaaatttctagttaatgctgttcacaccatggaggagttgaagcttactggtaaccatctgaaagggtcaaggccacttcttacattttctacaaattttgatgagcaacctcattggaagcttgtgaaggaaatgataactcagatatttgctactcctaaagatcaccgtaaagcaaaacctttccatgatcatgtatttgccttctcaattgtggatggccatgtttggtttcgaaactatcagatttcggttccccacaatgagattgataaagttgataaaggtggtctggataaaatgacacttattgaggttggccccaggttctgtttgaatccaatcaaaatatttggtggtagttttggtggtcctacatggtatgagaacccatactacatttcccccaatcagatccgtgcactagagaagaggcagaaggcaggcaaatatgccaagaaggtgaaggccaaggtgaggaggaagatgcacgagatggagaacacgctggagcctgatgaatttgctgagctctggaaaggggagtaactgcgctttgatcgagaccctgtcaaagtcctgaacctgaagcaccaggaactcctttcagcaagcgcagattttgtttaccagtgtggcagtgtccatgtcgtggaagttttgtatgacaaggcatacatttatttacataacatcgaatttttgtgatgagataacttctgcccatatgacattcttccgtgtttgcttctactgaatgtggtgccaagtgttgtatcagttccgaattgttctccgagaatcatgaggaagcgcaatcatagttcaaagctcaagatatcaatgcgatttgccagtc

SEQ ID NO: 11557 - DNA, 937 bp, Sorghum bicolor
  Clone ID: SORBI-28MAY03-CLUS58640_1
gcacgaggctggcggggaggagcccctgctcgtgggggaggattccgctgcgttcgagctcaaggaccagagcatggcgtccggggctcccctcccccgctcccgtgccgcccggccccgcgcgcgctccccgcggtccacccccccccctcccggcgccgcctccacctcccgcccccccctcccctccgcctcccgcacccccgccgtccgctcctcccgccgccgctccgcccctccccaatcccggcccgtgcgccgctccccgcgcattcatgagcttgtttggttatcatcgttcatttcgttcttctttctgtatccatctacgttcaatcttttggaagtggcagctgtggacaagcctaaattacatatgtgggaaacaggaataatgcgtatcaccagacatccacagatggttggtcaggtaatttggtgccttgctcatacactatggattggcaactcagttgccgttgccgcctctgtcggacttatgggccaccatctctttggtgcttggaacggtgacaggaggctggtgtcacgctatggtgaagccttcgaagtcttgaagaacagaccatgtgttgtgccctttgctgcgatcgttgatggacggcagaaactgcccaaagattatcacaaggagttctttcggttaccatatgtagcaatcacaatattaaccttgggtgcatactttgctcatccattgatgcaggcatccagctaccaacttccctggtaatgctataaatctatgtacatatatgctcagtactgaaagtaccacaaacaaaaagaagagaaatatgtgctcctccggtatacctagatgaacgccatttcgtgtacaaatgtacagttatttattttaaggggaactttggtatatggcattgttcaaaacctttatctatgatctaccaca

SEQ ID NO: 11558 - DNA, 618 bp, Sorghum bicolor
  Clone ID: SORBI-28MAY03-CLUS59484_1
gcacgaggctcacttctcacggtcacggtgggggaggaagagacggtgccgcggcgcggtgagagcctgggagggggaggaagcctctcaacgctcggtccatccctcgccgacccgatccagttgctgctctatggcgggcgaagacgaggacgaggcggcggcgattgagcggcagctggagcagcagctgcaggagcagcggtcctcccttgccgccgtcgacgaggcactcgccgccgacccctccaacgccgacctcctcgaggttcatgaggagcttcttgctgcaattaaggatgcagaggagggtcttctccatctgaagcgctgtaggctactgaagcaagtagatgagatctttccagatgaggcatcaatatcccaatcgcctgaagttgctatcgagccattagatccagatgatggtgagccagaaccactggagccacacgatttttcagttggatcaaagtgtagattccggcacaacaatggccgctggtataatggatgcattataggctttgaaggttcaagcgatgcaaggatctcatttctgactcccacatctgaaaacatgtcgatgtgcaagttcttcctacagcagcgatgtcg

SEQ ID NO: 11559 - DNA, 1127 bp, Sorghum bicolor
  Clone ID: SORBI-28MAY03-CLUS59318_1
gcccggcgcgcggcccatcagaagagtgggagagggaccgagcgcttccctagcttcgcccttctccggcgccgttgcacacgtcgtctagctcggcgaggttgctgttgaggactgaggaagaggcgcttcgcattttgcgcccccctcgccgtatatggtgcgcctcgtactcctcgtcgccgcggctggcccccccgtcttcatcctgctgctgactgccggtggggcgtctttggcagccgctgttgctgccggcctacgcagcgaagcagcaagacattttttcaacattgtagtttttgttgtctgcccccccccccttgctgcctttttcgcggcaacaaccaccaccgtgggctgcgccgcactgcggtggttgccgccagttattcttcttcctgcttccttcggtggtctcttcggtgggtgggtggtggtagttgctacagcacctcccgccctgcgaggccgcctcttggggggttgttctgctgccgatttgggcaacatttttcttatcatcattccagctctttgccaagagaagggaagcccgtttggagcagctgatgtttgtcagaatattggactagcatattcttcactctcaatggctattggtgctgtttttgtgtggtcgtcggctgtgtatatcgtccgtctcgcctcatctttcgcggcaggagatgctgatgctcaaacaaatgaaacaaaagtgttaaattcaggaaatgctataggaagtgttgccgaagagaactgctccgcctcaaatgattgcgccgatgaatgtacactccctttgatattgacaagcatacgtccaactaaagataagcattcaatgttggagagagcacggaaggttttatcatcaatttctgaagctgttgacttgaagaagctctttgctccttcaactattgcagtggtacactggtttgatgagctataactctactttagtagcatatcatgtttattttttaactgaaactcgatggtaattgctgcgatcacaactatattggcaagatatctctgcaaccttaaaatctcaaaagaaagccattttgttagatcgcttgtctctactgatttgaacataatgatataatatattg

SEQ ID NO: 11560 - DNA, 837 bp, Sorghum bicolor
  Clone ID: SORBI-28MAY03-CLUS56029_1
gcacgagggtcgaagggacattaccagctcatgtctccactgttgttaagggcaccccgggctatcttgatccagaatacttcctaactcacaaattgacggataagagtgatgtttacagcctcggtgtcgtgttccttgaaatgttgactggtatgaaaccaattgagcatggtaaaaacatcgtgagagaggtaaactcagcttgccagtcaggctcagtttctgaaataatcgatggccggatgggcttgtaccccccagaatgcatcaggaggttcctatcactagcaaccaagtgttgccaggatgaaactgatgacaggccttccatgtgggagattgtgagagaacttgagctcatcttgaggatgatgcctgaagaggacgtgattctgctggaaacctcagagacagactcaaccgatgtcagtaaatcgttgtcaacttcagcgactgggaccctcttcatctcgtcacaggcctctgggagtcttgatgcgagcagcggcatgatctctggaagggtaactcctcggtaggcatgtgcaattcttgtgaatatgcagcaagtttgttctgtaacattatagttatagacttagcactcccaggtcctgtcttttctgaattattcagccgaatgtatagtagataatagcttatgatacacaggaacatagctggcattgccttctttaaccttctgatatgttaatctgctttctgtaaatgaacacagctttgaatgctgacacgtttagggtctattcggtgttagaacttagaagtaacaaagttttgccgcagaaagtcattgcaattagtctctttgct

SEQ ID NO: 11561 - DNA, 912 bp, Sorghum bicolor
  Clone ID: SORBI-28MAY03-CLUS56093_1
cgctgttttggcgtgcgcgccccgctgcctgccccccacgaatcgtctgaattgataggtggaggcgcaattccatccgtcacattgataatgggagcaaaccttctgaacggagtacaaggcggggcaagtgttccaccgtcagtgatagccggtgtcatagttgtcagatacattctgctcccgctgctcggcacggcgctggtgaaaggagcagtctggctgggcctcatccagccagacccccctataccagttcatcctccatctgcagtacgccgtgccacccgcaatgaacatcgggactataatgcagctgtttggcgttggggagagcgagtgctcggtgatctttgtgtgggtgtatgcgctcgcctccgtcgccgtgaccatctggtccgccttcttcatgtggatgctgtcgtgaactcgcgtcaggacacgcgaggctagaagcgttagagatttgggaaatggaattaaaacatctctcgtttggccactagagagaactggcagcgtctatctaatggatggaaacatttatattatttaaactagcgtgccagtccatatatagaactttggctctctttgtttatttcatataaaactctgtaatttgggcagtgtacatcctcggatgtagaggccggattttatatcctttatttaaaaaatctacaggaagcacgtgcacggccatccttcctgcccgccgctacgcggtcgtatattggaaagcgcaagtgtcgcgaccatatcgggtccccaaaaaaaattagggatccctagtttgtaattagttattaagtctaattagcttaagctcagttagcctaagtgataattgctttttaatttcatgacgcggctcacaagaatcattatgcaagagtttatcgatcccct

SEQ ID NO: 11562 - DNA, 714 bp, Sorghum bicolor
  Clone ID: SORBI-28MAY03-CLUS56167_1
gccgactttgggctcgcccgcatcctgctcaagtccggcgagcccgagtccgtgtccgccgtcgcccgctcctgcggatacatggctccagagtgtggacgcggcgcgaaggtgaaccagaaggtggacgtgtacagcttcggcgtggtgctgctggagctggcgacggggagggtggccaacgacagcagcaaggacgccgccgagtgctgcctggtggagtgggcgtggcggaggtacaaggccggtggccctctccacgacgtcgtggacgagagcatgcaggacaggtccgtgtacgccgaggacgccgtggccgtgttcgtgctcggagtcatgtgcaccggggacgacgcgccgtcgcggccgtcgatgaagcaggtgctgcagcagctcgcccggtacgaccgcaccgccagcgttgccggcgcgtgccgggacggcggcgacgtcgaagtgggacaggtgcccaaggggaagcatggtcgtcaccaagctgacaagagatcgtatgacgccggggcgttcttgggtggcgacgaggagagcggcgacttcgtggctcgtcctgtttaaatcttcactttaacttacttttttccagtatggcgttaaatcttcctagaatgtaaattatatatggcttcttgtaatatgtgctgcgtggacatgaagtccaaaaaataattgaaacttgcgattttcttctgacgc

SEQ ID NO: 11563 - DNA, 721 bp, Sorghum bicolor
  Clone ID: SORBI-28MAY03-CLUS5587_1
cacgcgcgacctcggctacacctacgacgccgagtacgacagggacctgccgtggctgcggcccaagatcacgaagctggtgccgcacggcaaggagagcggcgcggcggcgaggtcgtcggcggcggcgccggtgttcccagctcgcgctgaccaagggccaggtcgtggaggtgccggccgtggctgtgccggccagggaggccgggaaggagcagctgctggtgatcgacggcatcgagttcgacccgcaggcgaacaacaagttcgacgtcgccatcaacctgcccgcggacaaggcgtcgcaggtcgggccgcagtacaaggagtacgccgggagcttcgccgtcgtgccgggctccggcggcggcgagacgcggatcgggaaggtcaccctctgcatcaccgacgtgctgtacgacctcgacgctgaggacgacagctccgtcgacgtcgttatcgtgccgcgtacagatgccaaggtcaccatcaacgttcgccccatcatcaagaatcgaaactagcagcgtacgtacgtatgtgtactcgtgtgtgcatgtgtgtgtgtggtcattcgtcgaccatcgtttaatttcatgcagtcacgcatagcgcgcaccgccggtagggtggtgtgtactgtccgcaagaataaaagtactgtaccagctgattgtattgagacttgtttagttcgtaaaatttttcaagattccccgtc

SEQ ID NO: 11564 - DNA, 944 bp, Sorghum bicolor
  Clone ID: SORBI-28MAY03-CLUS60082_1
gctactggagcacgaggcctccctccagtctcctccgggtcggccggcttctgctcctccctcacgatccaaactcccaaccaaaccctagcgggcggcggcgtgtactccctccggcgtgcgcagagacaggcgaggacgctgggcagtgggcacgggcagctggggggcgccggctaggaggatcgcggtggggcggcggccgctcggctcgtggtggggcccgaagccggcagcgcgcctaggcggctgcgccgcggggtggccggcggcccggctgctcgggcgtttgagcgactggaagccagcgcctatgctggcagcagcagttctgcaacctgcataggcaccgagggcaggagaaggtctgaccgattggagtcttcagcaatcttcagcaagctatcaactgggaatccaatttgctaatgctgctaaatggctcaaccttctgtcattctagctactgcaagttatgatcacacaatcagattttgggaagccaagagtggtcgctgttaccgcactattcaatatccagactctcaagttaatcgccttgagataaccccagacaagcggttcttagctgctgctggcaatcctcatatccgcctttttgacgtgaactcaaatagccctcaaccggtgattagctatgattcacatactaccaatgtgatggctgtgggattccattgcgatggtaactggatgtactcaggttctgaagatggtactgttagaatttgggatttacggactggcacttgccaacgagaatatgaaagtcgtgccgctgtcaacactgtagttctgcacccaaatcagaaagagctaatatctggtgaccagaatggaaacatacgtgtgtgggatttggctgctaactcatgcagctgtgagttggtaccggaggttgatactgctgtaagatctctgac

SEQ ID NO: 11565 - DNA, 1084 bp, Sorghum bicolor
  Clone ID: SORBI-28MAY03-CLUS602_1
gcacgagcgcgcattccgctgcctcactccgtgcctccgccgccgctttcgttgctcacgagcgagatagccggagctagcaagggagggaggaggcgatgaaggggggcggggataaggttgactacgtcttcaaggtggtgctcatcggcgactccgccgtcggcaagtcgcagatcctggcgcgcttcgcccgcaacgagttcagcctcgactccaaggccaccatcggggtcgagttccagacccggacgcttgtcatcgaccacaagtccgtcaaggcgcagatctgggacaccgccgggcaggagaggtatagagctgtcacaagtgcctactacagaggtgctttgggagctctgctagtctatgatatcacgaaacgccagagctttgaccacatacctcgctggctggaagaacttcggggccatgctgacaagaacattgtcatcatgctggtcggcaacaagagtgaccttgaagaggagcgcgctgtaagcagcgaggatgccaaggagtttgctgagaaggagaacctcttcttcctcgagacatctgcgctgcaggcgactaatgtcgagaatgccttccagaccgtcttgacagagatctttaagatccacagcaagaagaacatggcagcagacccaaaggccaatggggctgcaccttcgctggcagggaagaaggtcatcgtcccaggcccagctcaggagatccctaagagcaagtgctgcagttccatgtgacatgttctgaatttatttgggtttgtttgtgtccaaaatattctcgatatctttgtggatgtacatctatactggaataggcttagatttgaaatactggttatctttgtgttcggaacgaagggaacgatatcatagtttagatttgtcacccgtctccaaggtgacacgaggaggatagggaccgaggagaaaagctctgtttgcatagacttgttggattaattacaaaaaatagaagtgtatgcagaattattatttttacgatgccttgaaacctttgtgtacagtgagacaccgatacaatacaactgtatcaacctgcttgtgtg

SEQ ID NO: 11566 - DNA, 1215 bp, Sorghum bicolor
  Clone ID: SORBI-28MAY03-CLUS6047_1
gcacgaggcactctcctgtctcctctcccctgctgtgtcgctccgctctgctccggtgagctgtccggcactcgcatctcgatccctcgatctgtcgttttcccggggggacgaagaaacgtgacaatggaggctccacccgtggcgctgttcgactccctcaaggctgccaaaccgttcttcttgctggccggtcccaacgtgattgagtcggaggagcatgtcctgaagatggccaaacacattaaaggaattacaacaaagcttggaattcctcttgtgttcaagtccagctttgataaagcaaaccgtacatcgtcaaaatcgttccgtggtcctggtcttgaagaaggcctaaagatccttgaaaaggtgaaagcaacatatgaccttccggtagtcactgatgttcatgaaagccaccagtgtgaagctgttggaagagttgctgacattatacagattccagcattcctctgtcgccagactgatcttctagtggccgctgctaagactggaaagattatcaacatcaagaaaggacaattctgtgcgccttctgttatgatgaactctgcagagaaagtaaggcttgctggaaacccaaatgtgatggtctgtgagcgtggtaccatgtttggctacaatgatctaattgttgacccaaggaactttgagtggctgagggaagccaactgcccagttgtagctgatgtcacacatgctctacaacaaccggctggaagaaagcttgcattttgtaagcttgatggtggaggtgttgcaagtggggggctacgagaactaataccatgcattgcaaggacttctgttgctgttggtgttgatggtattttcatggaggtacatgatgatcccttgaatgcaccatgcgacggcccaactcaatggccattgcgcaatttggaagagctattggaggaattgattgcaatcgctcgagttaccaagggaaagaagccattcaagatcgatctcactccgttccaggaataatctgccttggttcatagaaagcacaatgccagcatccatgggattcaacagggtggatttaatatgaatgctgtaaattttactgtttcgagcaaaactgcagtaaatgactgtaatcgccgaacgaactattgaattgaaacccgttgggttggtttatgttgttccatcagttgtaccaccatgttatcctcgtgc

SEQ ID NO: 11567 - DNA, 758 bp, Sorghum bicolor
  Clone ID: SORBI-28MAY03-CLUS6076_1
gctcttcgcctcctcacctttgctcaggccgccaacgaggacgagctatggcgagcaaggtggtctccatcctggtgctcgcattcctgctcctcgccgccgtcgccgtccccgtgtctgcaggtccgcggcagcgggggaagaacggcggtggcggcgccggcggcggtggtgggagcccaagtggtggcggcaacctgaagccctgggagtgctcgcccaagtgcgcgtcgcggtgctcgcagacgcagtacaagaaggcctgcctcaccttctgcaacaagtgctgcgccacgtgcctctgcgtgccgccgggcttctacggcaacaagggcgcctgcccctgctacaacaactggaagaccaaggaaggagggcccaagtgcccctagagctagatccacacactcccggccgccattgctgccctttaatttcttcggatctggaaatgcattgttcttctatccacccaaaatcgctgaatgtggaatgctaccagccagatctgcgtgctccatagcgagctaatcagggagagtgaggattcctaggtagggtggcatgccatgccatgtgaatcctgaatccccttccctaaagcagtatagtgctccactggtacgagtctcatcagtcaactaaacattacccccggattgacggacatcccacgcgattagcggggcctgtcactcagacctgatagccattgctagtattggcagtatttgtatgcggtaccagtcctaatgcac

SEQ ID NO: 11568 - DNA, 1268 bp, Sorghum bicolor
  Clone ID: SORBI-28MAY03-CLUS6050_1
gcacgaggaagaataccaaatccaaatgcacgatcgatcctacaagccgcagccggcggaggccggcagcggcgggactgccggcgacggcggcggcggaggcgggaacgtggatcgggtgctcttcaagaacctcgtcgagatggtgccgctcgtcgagtcgctcatggaccggagggtcaacccggcctactcgcgccgcgcttcgctggtctacacgccggcgccgcccaagaaggcgagtgatttgaaaagtgtcaaattgccacagagcgtatccgccaaaaagcggagagaccctggtgatgcagccaagaagagtgccccagattctaatggtgacagcggctcagttgtgccgttttctctgtccggagctgaaaataagcccaaggatgaggttgccatgctgcgcgagcagattgatgacctgcaaaagaaactgctcgagaaggaggaggcgctgaggtccgcggagagctccgtggctgagatgaatgcggcgtatgcaaccatcgatgaactcaggcgcctggtggctgacaaagaagctttgatcagatctaccaattctcagttgcatgatgcaaagattatgcttgcagacaagcaagctagtttagagaagctggaatgggaggtaaagatgtcaaataaaaaagttgaagaccttcaaggagatatgtcgaatatgggattcgagataagctcattgatggcatttttcgaaaaaatttcagagaatgtttcaagtgactcttatgatgatacaataccattgtcacatgaattagaggcactccaatcaacgagtgaaattgacaagattgaggtcgacaagatagagcaggaaaggatgatgtatgctgaagctctcgcggcagcgagagagaaccctgacgaggagcacctgaatatagctgcggaggcaaggtcaaggctgcaggtccttgtactatagtggccccttctgattgtagcatatgtatgataatgttgaactgctgatgtaattgtaagtgttggcttgagttgaggtgcttgtggaagaatcgttccggtggtaatggagtgagcactgtaaactgacagctatttcgtgttgtaatcatatttattcagtcctgaagcctgtattgtttgccaggaaacttgagctagtttagatttctgtgacagttatcatttcaagatttaaacccatggttgaagctgcttatgtaaattgttcttcagcctaaggtatagacaatagcttttgaggagtg

SEQ ID NO: 11569 - DNA, 948 bp, Sorghum bicolor
  Clone ID: SORBI-28MAY03-CLUS6078_1
cccacgcgtccgtatttttgcaaatccgcaggaaaaagaaggcgaaacgaggcctccaccagctcacaccaccgccgagcggaacgaactcggcgagagagcggaagcggcgccgagcacccagtccctctcctctcctcgtccgccgccgtctcccggatcatggccatggccgcctcctcccggctgctgtgggcgtcccgcgccgccgcctacctcaggatctccaccttccccagggccttctccaccgtgctgaaggatctgaagtatgctgacactcatgaatgggtgaaggttgagggtgattcggcaacagtggggattactgatcatgcccaggatcatttgggtgatgttgtctatgtggagttgccagaagttggcatcagtgtctcccagggaaagaactttggtgctgttgagagtgtgaaggcaaccagtgatatcaactcaccagtatctggagaggtcgttgaagtgaataacaaactaagcgaggaacctggattggtgaatgcaagcccatatgagaaggggtggattatcaaggtcaagctcagcgattcaggtgagctcaattcgctcatgaatgatgagaagtactcgaaattctgcgaagaagaagacaatcattgaagaaaccagagtgtcttctgaacacaaggacctgtgtttcaagctttatcactgcttctagtctgcagacctgctgtgacaaattcgcaaggttcatcgcctggaataaattagttttaggatttgccaagggcttgggaaatccgagcttgtgaatgacgtggtcaagtttgattatctctttgtagttgtaatctcgtgatttccttctttctaaagataactttttgattccttggtatgcaaatttgttggcccttttgcaaatggttcagaatgttaagcgttattattactgtgcatagtgat

SEQ ID NO: 11570 - DNA, 1542 bp, Sorghum bicolor
  Clone ID: SORBI-28MAY03-CLUS57322_1
aagtgcaattttgaccacagtcgacaccaagagaactccgacttcttcacttcaatccagaccgtctctctctctcactgacacacacacacacatggcgctgctgatgagccttggcgccgccgtgtactcctacttctccacggcaaccgcgccgccgcgtccccgaagatgcatcctgccgcctcgcccccccgccccccctccggcgctcgcccgcccgcgacgccgctgatgagccttggcgccgccgtgtactcctacttctccacggcaaccgcgccgccgcgtccccgaagatgcatcctgtcgtttcgcgccgccgcctcccctgcggcgctggaccgccggcgacggccgcagaacgtggcgggcgatttcttcgtcgaccagcgctgcatcgactgccagacctgccgatggatggcgccgcaagtgttcaagagggtggatggcaaggccgccgtagcggcgcagcccagctccgaggaggagaggaccaaggccctgcaggcgctgctctcctgtccaacatcctcaattcacactgagaaacctccaaaggacatccttcaagtgcaaaacatgtttcctcttccaatcgacgacaaactactcccaggcgtttatctctgtgggtacaattctgaagactcatatggggcaacatcctacctggtaattcatccacaaggaaacatactgattgacagcccaaggtatacttcaaagctggccaacaatattgaaaagcttggtggagcgcgctacatgtttttgacccacattgatgatgtggcggatcacaggaagtgggctgagcagctaaaatgtgaaagaataattcatatgggagatgtggaggaggctactgcagatgttgagtggaaacttgaaggaaatgggccatggaacataggaacagattttgaatttatccatacgccaggccataccccaggctcggtgtgcttgtattacaaaccgccaaaggtgctgttcactggagatcatgttgcaaagtcagaagaatcagacgacctgaatctctttctgatgtacagcaaacagtcagtgagccttcagctggaaagcataaggaaactattggaggtagagttcgaatggcttttacctgggcatggctatcgaattaggtacaaagatgtgcaggccaagaatgcagccatggagtccctcctagctaactacttaagctaggccgcctaggagcattagtgctcaaaataaggattgcaggaggctgaatgttgatgctatatttccagagaatagtgtgcatgaactcttgaatgtgcatttgttaccagagaatgcaatgcttttgtactcccgccgtataggatttagatatcgttttggacaaagtttaggtcaaacattagaaatataaatcatcaataactttaaaattattgagtttgtaaatgtgaaaattatatgaatagatctgtcttaaaaatgctttaaagttgtgttttggagaccgtgtcgctatcctaaacgacatttagtttggtt

SEQ ID NO: 11571 - DNA, 1454 bp, Sorghum bicolor
  Clone ID: SORBI-28MAY03-CLUS5739_1
gcacgaggattgaaaagcagagcgcccgaggctggctctccctcttctcctggacacaatcatcagctcccgaaatccaaattgatacaggggattctgagcttggggtttgttccgggggccgattctgggggcggcggacgggatgtcaggccccctcgaccgatttgctaggccatgttttgaagggtttgtgcataacgatgaaaggaaagagagcagatctgatgcagacaactcagaaggagataagaagactaaaatcggatctttcaagaaaaaagcaatcaatgcagggaacaaattcaggcattccctgagaaggagaagcaaaaagaaagaaaggggggagtccatcaaggacataagggacgttaaagagcttcaagatgttgagacatttcgacaatgcttaattgatgaggatttgctgccacaacagcatgatgattatcacatgatgttaaggttcctaaaagcaaggaaatttgaagttgagaaagctaagaatatgtggtcagacatgcttaaatggaggaaggaattcggggtcgacaaaatagaggaatttgactacaccgagttagatgaagttacgaagtattacccacaattttatcatggggtagataaagagggaagacctgtctacatagagttaataggaaaagttgatgcaagcaagctattacaagtgacaactctagatcggtatgtgaaataccatgtcaaggagtttgagaggtgtttccagatgagatttccagcttgctccattgctgcaaaaaagcacatagattcatcgactactattttggacgtgcaaggcgtgggtttcaagaacttctcgaaatctgccagggaattaatcacacgattacagaagattgacagtgataactacccagagacactgtgccggatgtatataattaatgctggccaaggcttcaagatgctatggagcacaataaaatcattccttgatccaaaaactgtttccaagattcatgttcttgggaataagtaccaacataagttgctcgaaataattgacgagtgtgaattgccagaatttttcggtggcaaatgcaactgtattgaaggttgccaaagatctgacaaaggtccttggaaggatcccaacataataaagagagtcctcaatggtgaggccaactatggcaggcaaattgtgaccatatccagcactgatggaaagataatcagttatgctaggccagggcacccaactagaaaaggcagtgatgcgtctgccgagtctgggtctgaagtggaagacgtagtatctcctactgcatcaaggaacctgattacacatcctattttgacccctgttcacgaggagtcaaaattgtcggcacatggatctgcatttgctgctcatgcttctattgaagaaagcattcctgttgtggacaaggtgttgtgat

SEQ ID NO: 11572 - DNA, 689 bp, Sorghum bicolor
  Clone ID: SORBI-28MAY03-CLUS57931_1
cctctgggttcgtccctcgtggacatctcactcacaccgccgcgtccgttcacctggcttcacccctctgccacgactgggtgtggcggtgggctaccgccgccgccgcccaacgccaagtgacgaggccttcgtcggtctattcgccggcgatgagcacccaccagggatggttgctacaatctgggcatagcgttgttgatatcagtggttcaaagatggttctccatataacccacagggcgttcagttttcgatgctttgctgccaatgggcgtggctttggtgcagattctactaataagagaaaaattaaaagcaagaagaggccaaaagatgttgcgctggagccgagtgaggtaatatctggaaatccaaagaacagggagcaatgggtgccagaattaagaagtggaagtgaaaacaaatctggtaaacaagtcatggataagaaatttttggaaaaagtggaagcagttcgaaggtctgctcttgagaaaaagaaagctgaagagaacaaagattatcaagctattgattatgatgctccaattgagtcagataaaagtacaattggctttggtactaaggttggaattggcgttgctgttgttgtctttggactagtcttcgcttttggggatttccttccttacggaagtgttagccctagcaaagaaagtgcagta

SEQ ID NO: 11573 - DNA, 746 bp, Sorghum bicolor
  Clone ID: SORBI-28MAY03-CLUS6119_1
agcagcctcgcatttgcgtcgcatccaagctcccttccctagggttgttcccttccccgaacccaaacccaaatccaaatccaaagcaagcacttcgtcggcggaccatggggcagggcactccgggagggatgggcaagcagggcggcgccggcgaccgcaagccgggggacggcggcgataagaaggacaagaagttcgagccgccggccgcgccttcccgcgtcggccgcaagcagcgcaagcagaagggcgccgaggcggccgcgcgtctccccaacgtcgccccgctctccaagtgccgactccgcctcctcaagctcgagcgggtcaaggactacctcctcatggaggaggagttcgtcgccgcgcaggagcgcctccgtccccaggaggacaaggccgaggaggaccgatccaaggtcgacgacctccgcggcacccccatgagcgtcggatccctcgaagagatcatcgacgagagccacgccatcgtctcctcctccgtcggacccgagtactacgttggcatcctatccttcgtcgacaaggaccagctcgagccgggatgctcaatcctcatgcacaacaaggttctctctgtggttggtatattgcaagatgaagttgatcctatggtatctgtgatgaaagttgagaaagctcctctggaatcttatgctgacattggtggactagatgctcagattcaagaaattaaagaggcagttgagcttcccttgact

SEQ ID NO: 11574 - DNA, 512 bp, Sorghum bicolor
  Clone ID: LIB3476-015-P1-K1-D1
cttcctatcttaggtggcaggaggctccatggagatcatcgacgagagccacgccatcgtctcctcctccgtcggacccgagtactacgttggcgtgctatccttcgtcgacaaggaccagctcgagccgggatgctcaatcctcatgcacaacaaggttctctctgtggttggtatattgcaagatgaagttgatcctatggtatctgtgatgaatcctgctttaccaatcctctacaaagggagcagaggtggcagggttttagggaggacaagggctatgtttcgcggaaggtgccaaatgcgaatgcctatcacacatctggtaaggcactggtgaaggagctgcaccatgtgacattacctgctggcagttcagttccagtggaaatcatggagaatgaagaatgtggtttggaaggcggcaggatagggaaagtagttttggagcatggaattgatgggaaggtggtagtggaggaaaaggagtgctataattgagcagatgacac

SEQ ID NO: 11575 - DNA, 680 bp, Sorghum bicolor
  Clone ID: SORBI-28MAY03-CLUS61577_1
cttgcttcaagggatagaaaatttgctgaacattataatgtcctggagcaaattcttgccgtgcttatacagtttgttaaagacaagaaattggagcatcagcaccaatttgatgatctgaagaagacctggcttatcaaaaggtgtcggacgatgaatgctaaactaagctatctagaacatcatctattgcgtgacacttacacaaaggacacagtaccagcactgcacaggatcaggaaatatcttgtagaggccacaaaagaagcatccaattcctacaatgaagcagtttcgcggttgcgtgagtatcagggtgttgatccacatttcgacgtgattgcaaggcagtaccatgaaattgtaaagaaactggagggcatgcagtggacaattcaccaggtggagatggacctgaaacctcaccatgatcacgcagctgtttaactccatacttattggagaccatgtttattttattacctgaatgcagtggatgtgagttaggggttgccgtcatgtgatttgacgtaggatcttgtttcgttgctccagacctgtcaggctggacagctcaatgtaaagtttcatctaaacatgaaatatatatggatgatgtttctgtatgtgcatgttttttagtcttccatattgaataatagcaccatcaatgcttgttt

SEQ ID NO: 11576 - DNA, 954 bp, Sorghum bicolor
  Clone ID: SORBI-28MAY03-CLUS614_1
accgtccgtcggacacattcgacatgagggcacgaggcgcagtctctccgcaaggaagcggagcgaaacgcaagcgactgaaacgagagcagcgtgcgtttctctttggactttgggtcgggtgagctgccagcgagagcgcggcggggtgaggctttgccgagcgacatgagctaccggctcggggaagcggcgggccgcgaggagggcgacgaggagccgttcgagacggcgtcgtccgtgtccagcggcgactccgactccgacgacgaggaggagggggaccagttccccggcggcggcggcggcagcgtggccgggggcgaggcctcgtgcgaccaccaggaccgccgcgcgttcgtgccgcagccgctgcggaggatgaactcggacagcatctacgacatgacgtccatgatgtcgcagctcccggccaagaaagggctgtcgcggtactacgagggcaagtcgcagtcgttcgcgtgcatgtcggaggtgcgctgcctggaggacctgcgcaagaaggacaacccctacaagcagaagatcaagtcgtgcaagagctacgtcgcgctgggagggatgatggccaagaagcagcccgcctccacctcctgcgtcaacctcgacctcgtcgccgccaacggcttcaggacgccgcccattcggaacgggtaccaccagtaggcggcgctggacgggtcgccgcttgcgagagagcgctgcaatgcgactgcaggaacgccgttattgttcctcgagggtcactgaactgtttttcttttctctgtttctttctacttgttctgcgggtgattttcttcacgggcgcatttagtctgtgagaattttacgaggtggcgtgaactgttacttgttctgctgttggtagagtactagaggaacttaccgttgaccgttctgcactgttgctgctcggcaaaaaagaaacgt

SEQ ID NO: 11577 - DNA, 631 bp, Sorghum bicolor
  Clone ID: SORBI-28MAY03-CLUS6182_1
gccggccgggtccggctctcgcgccgccgcggaacaccacccagtcgaatccccccacccgcacccggagcagaggagagatggcggacaggaagggaggagcggcaaggaaggaggaggtggtcaccagggagtacaccatcaacctccacaagcgcctccacggctgcacattcaagaagaaggcacccaatgccgtcaaggagatcaggaagtttgcacagaaggctatgggcaccaccgacgtcaggattgacgtgaagctcaacaagcacatctggagcagtggaatcaggagcgtgccacggagggttcgtgtgaggattgcccgcaagaggaacgacgaggaggatgccaaggaggaactctactcccttgtcacggtggctgagatccctgctgagggcttgaaagggctgggaaccaaggtcattgatgaagctgattaagctatcacatcttaagcatctttagagagtttttagtttgtatttgcaacagcaaaccttttgtatccaaagaagttttgtgctctggtactgtgatcgacatcacaaagttgtctatttcctcaatcgaattacatggctaaatcttttaaaaaaaaagcaaaaaaaaaaaaaaaaaactc

SEQ ID NO: 11578 - DNA, 667 bp, Sorghum bicolor
  Clone ID: SORBI-28MAY03-CLUS61630_1
agatatgattatgaggagtgtgaatcacaaagtgcaaacaagatgatggatcaccttaaagatgtcattgcaaatagcaagcctggagagaaatatggagattacaccctccaatttgctgatgatttcagctatactgatcctgtagacggtagtacggtatcaaaacaaggacttcgatttgttttcactgatggatctaggattatcttccggctttcgggaaccggatctgctggagctactatccgcctctacatagaacaatttgaatctgatatctcaaagcatagtctcgatgctcaaacagctctgaagcctttaatagacctggctttgtctgtttcaaagctcaaggacttcacaggaagagacaaacctactgtcataacataatctctagatgttcatgacatcagctccttcgctattttcttcatttctttttgttgtcctcggtggctcggtcataccaacagagtagcatgggtgtacggtaggtcggtaggccatgtttttgaattgaactgatggcaaatatgtatcattaggacaaactccgccagaataaattgtttcccggaagtgttgcaacatcttccaaatacttctcctccaataagatggtaatgggataacatgttgcagaactgtgcaaattatgcct

SEQ ID NO: 11579 - DNA, 706 bp, Sorghum bicolor
  Clone ID: SORBI-28MAY03-CLUS62480_1
gcacgagggctaggaggagttcagagaggagtgacgacgacttgctgctagttgagcaggtaacaagaaaccatgtgccttctgaagggtttctttctggattcatggcgagatacagaagcggccttcagggagacctttcatctctggacgacagcatggaggactcaaatggatacttgcgctttgatgtgggtggaatagaagagcttgagaactacttcatattcaatgatcggcatagaggaatgaggatggatatcgacggcatgtcctacgaagagctgcttgctttgggagagcgaattggtactgtaaacactggtctttcagacaatgcattgtccacgtgcctgaacaggagcctctacatgcccacagcttcaggttctcatgaagattgtgaaagaaaatgcagcatatgccaggaggagtatttagccggcgaggaggtgggaaagatggcatgtaagcactactaccacctttcctgcatacagcattggcttcggcagaagaactggtgtcctatctgcaaatctgttgccctgaaaatcaactagcaactcatttcatgtttgaaatgaagtgtatagattcttcatgtcctgtattccctccccacccctctccattttccttttgaaattcttttcccttctttgttttactcaaaacactcatttttattatcaatttaaatcgg

SEQ ID NO: 11580 - DNA, 1079 bp, Sorghum bicolor
  Clone ID: SORBI-28MAY03-CLUS59648_1
gcgccaggcgcgacgcctgctccccccgccgcggccccggcgggctcgccggcctcctgccgctccgcctccccatcttccccgtcttcccctcgcccgtgggcagcagcccgggcgtcgtgctcggattcgtgctgcccgctacgttccacctcaaggttttcggcgcagagatcgggtggactgggctcgtcgccgacgtggccgttatcgtaatcgggactgcgctcgcagtgtccgggacatggacgtcactcgtacaaatcttcagttcttccaacctgtaagagtcgacagttcgattagcaccatgtcttgctaatgcattggtaagcatcgacattctgatatggatcatgccttgctgatgcaatgggagcgctcaaatggttgtacattggttccagtggattgattccaacctgtaagagtcgacagtttgattagcaccatgtcttgctaatgcattggtaagcatcgacattctgatatggatcatgccttgctgatgcaatgggagcgctcaaatggttgcacattggttcttgtggattgagagcttgagacccaattcagctgccgtgttgatttgggcatgctttgcatctcttaaaagtatgggatctcctacactacctgctgggagctttctgaaatcttacatggttttggtcagatagagccatgtaggttccagctgtaccaggcagcagatccatgtgtaaagcccagaacgaggaattgaatccatgcgaatatgtacaatataagagtacctactttatgtaagattcttttgttcgaggagtttgtagcatgtttctgggtctatattgtctcatgtcctcgccataggtgtctttattgatctaaagtatgtgcacggtttaggtttgttggtcatactagttttgaatgattcgcataggttggcaaatggcaagtggcttaaccttcatggaaatgttgccgtgcacttcatagaggtggaaaatctctacttcattgacgaaggaaaaccaaatgctccattatttcctttgttccatcagctgtcaaactaaaaaaatggttcgttt

SEQ ID NO: 11581 - DNA, 814 bp, Sorghum bicolor
  Clone ID: SORBI-28MAY03-CLUS597_1
agctcacgccggtagagatgagggccgcgtcgtccccattgcccgccgccgtcctcgcggccccctccgccgccgccgccctagtcgtaaagcctctgcctcgtgccgcagcgaatggcggcggcagcacaggcaggcgcgacgtcgtgcttgccgggaccgggctgggcgcggcgctggtgctggcgctgggtcccgtgtgcggcgcggcgcgtgcggcggacgatgagtacgtgagcgagaccaaggaggtgatcgggaaggtgcggtcgaccatcagcctggacaagtcggacccgagcgtggcggacgcggtggcggagctccgggagctgtccaactcgtgggtggccaagtaccggcgggagaagtcgctgctggggcggccgtcgttccgggagatgtactcggcgctcaacgccgtgtcgggccactacatcagcttcggccccacggcgcccatcccggccaagcgccgcgcgcgcatcctcgaggagatggacaccgccgagaaggcgctcctccgcggcaggtaggcggccaaacccccagcgaagccacggcgcccatggccatcgccgtcgccgtcgccgtggctaaacttgtggcagggagcgcgcgtgcccagctcagcgacaacgctaccattttgtaactactgcgatgtactcagtatatatatgtgcatgcattcgtatacgtgatgcgaatgcgagctgtgttttcggccggctgggggagcgtgtcctgtcactgtgagtaaactaaaagttaccgagtttttgaggtctgagtttgcgactttcagtcaaaa

SEQ ID NO: 11582 - DNA, 1199 bp, Sorghum bicolor
  Clone ID: SORBI-28MAY03-CLUS5976_1
gggttctgctccaattaacctttctgatcgtctcaaccaagtgctacgctgggctcttggttcagttgaaattctacttagcagacactgtcctatctggtatggttacaatggaaggctaaagcttctggagagactggcatacatcaacaccattgtttatccaattacatctatcccactaatagcctactgtgtccttcctgctatctgtttactcaccaacaaatttattattcctgagattagcaattatgctggggcattcttcatcctgctttttgcttccatcttcgccactggtattttggagcttcgatggagtggtgttggcattgaggactggtggagaaatgaacagttttgggtcattggtggtacctctgcgcatctctttgctgtgttccaaggtctcttaaaagtgctggcagggatcgacacaaacttcacggtcacatcaaaggcaaccgatgatgatggtgattttgctgagctatatgtgttcaagtggacaagtcttctgattcccccgaccactgtgcttgtgataaacctggttggtatagtggctggagtatcatatgctatcaacagtggctaccaatcatggggtccactcttcggaaagctgttctttgcaatctgggtgatcctccacctctaccctttcctgaagggtctcatggggaaacagaaccgtacaccgaccatcgtcatcgtttggtccatcctccttgcttccatattctcgctgctgtgggtgaagatcgatcccttcatatcacctactcagaaagctatttcccgggggcagtgcggtgtaaactgctgatttgatctgaactgcctgctggataatattatggctctggccccatcaattctaccccttgtaaataccagaggaggttaggcaaggcatttgtcgtctaagttatgcttagctccttagttgactgtgctgcatttgggggtgggcagtacaaaacttgtcaacttatgtcgtgttacttattcgtagctaagtagcagtaattagtgtctgtttcttcatgaatgtcgtgactatatgctcaccgtgggctgtggactgttgtgatgttatctatatgtaggacttcaagtccctattttgctgtttggttaatgacattgtaatttagggattgttatctgttgaaatttatatatgtatttct

SEQ ID NO: 11583 - DNA, 687 bp, Sorghum bicolor
  unsure (1)..(687): unsure at all n locations
  Clone ID: SORBI-28MAY03-CLUS59921_1
cgcactagtggtaagcaaggtagctcgcggctgatcgtcgtcgagctcgctcgatctctcgaagtccgaatcagctaagcttagctaagagccatggcgacgaagcctgcgcaggtgctggtggcggtggtggtcctgctgctgctgtgcgccgccacgccgcggggcgccgacgcggcgacggcttgcgacgccacgcagctgaccccgtgcgcgggcgccatcatcggcagctcgccgcccaccgccgcgtgctgcagcaggctcaaggagcagcagccgtgcctgtgcacgtacgcgcgcgaccccaacctgcagcgctacgtcaactcgcccaacggcaagaaggccatggccgcgtgcaaggtgcccgtgccgtcgtgctaactgaacttctcttagcgccgccgccgccgctgcgtacgtgacgtgtgatgtacctgtgtcggtggcgtgggcccactggacagagacagagctagtgtgtggcgtcgctttctgtttccgtacgtacgtatacagttggatgttggatcgtgccgtgtatgcgtattccgttgtggtgttgctgtacgtatgcaccaaaaccgtgacgtaccaagctcttgggacgacagatacgtgtgtatgatgaataaatgatgtaataatatatataatgacgtatgcatccgctnatatatatgc

SEQ ID NO: 11584 - DNA, 1433 bp, Sorghum bicolor
  Clone ID: SORBI-28MAY03-CLUS59967_1
tgttggcctctggacgctacccggtggtgtcctcaccacagcggggccgccgcctgtgcggtggccagcatcgcccggccgggttcgtcgggaagcgaccgaaccctccttcgcgttggaaccaacactcgcccccaacctcgttctgaccgacggcgaccgccgcgccgcgccgcgccaccgctatatatatatacatctcccgctcccttcccgccgcggcgaccaacctacccagggaaatccaactccagtcctcctcctcctccctccgcctctcccgccgtcggggagatccgggttggcccgcccggtaatccatccctcgctctcgtgcctcccgtaatttcgcctcctaacccgaccgccgggagccacaggcggcgccggaggcggtggtggaggggggacgatggggatcggggcggtgtcggacgagctgctgggcacgttcgtgccgatcgccgtgtactggctctactcggggctctacgtcgcgctggacggggtggggcggctcgacggataccggctgcacactagggaggaggccgccacgaagaacatcgtctctaaggccgccgtcgtcaggggcgttctcctccagcaggtcttccaggtcgccgtctcgctcacccttttcgcggttattggtgatgagagtggtactggacagaagcaacctcctgctcttgtgatagcgttgcagtttatagctgcaatggttgttatggacacatggcagtacttcatgcacagatacatgcacattaacaagtttctatataaacacatccattccaagcaccacactcttgtagtcccttattcctttggagctctatacaaccaccctcttgagggccttattttggacactattggtggtgcactctcattccttgtctctggtatgactccacggacatccatattctttttctcctttgcaaccatcaaaactgtggatgatcattgtgggctgtggcttcctggtaacatcctccaggcgctgttcagcaataacagtgcttatcatgacattcaccatcagctctatggtaccaagtacaacttttcacaacccttctttgtgatgtgggacaagatactcggaacttacatgccctactctattgaacaacgaaaaggaggaggggtcgaatcaaaaccagctaaactcgactgagctgaggatacaagactgattagtacatgcatgcatagtttctgattcttgttttgacttgtccaatactggccttgtggtactgctgactgcacaaattatgtaaaactcgccctgtttcataacttcatatagtgaggctgtttttgttctctacatttttttgggtttgtatttttggggtgttctatcttgtaacaaaatacagtgagtaaagtattgtaatgtaccaaagaatactcaa

SEQ ID NO: 11585 - DNA, 726 bp, Sorghum bicolor
  Clone ID: SORBI-28MAY03-CLUS65084_1
cccaaatgggttcattcagtcgtttgattggcatgattccaggcatgaacaaggttacccctgcacaaatccgtgaagctgagaagaatctcaagtttatggagtcaatgatcaatgttatgactcctgaggaaagggaaagaccagagttactagctgaatcacgcgagagaaggaaacgagtggccaaggactctggaaagactgaacagcaggtgggccaattggttgcgcaactcttccaaatgcgtgcaaaaatgcagaaaatgatgggtgctatacaaggaaaagagtcgccagatatggacgagctcatggaatcaatgaaagctgaggagcaggctgctgctggtactggacgacgtagaaggaagtatggcaacctgaggcagcggcaattggatgcaatgcgtggtttccggagacggtgagatgttcattgccaactctgaccggcagcgtcaggtctgccgtattcctgcctgcgtgcatggacgggttatcccagggatttggctcggattcagaagtggaaaatgaggtgttttcgggacttcgggtgcgccgcaattagaatgtatcatctggatatcctactctgactagtcgtgtgcagcctttctattttgccatattagacgtatgccaaagtaagaattcacctaattgcaccatctgaatgactgaaccctgcccgctggtggtaggggtggaaaactggaaaca

SEQ ID NO: 11586 - DNA, 1195 bp, Sorghum bicolor
  Clone ID: SORBI-28MAY03-CLUS6490_1
acagctcatggcactcgtctccacctactagtcctccaccaccgccgtggaggcgctccccaggaatgggcagcagcgcgcctgttggacgtccttactcggcggcaagacgcttctgaagcacacaaactaagcagtacgaacgtggataaagtggcttgcctgatcatagctttatacattgaactcattcaatgtgttgcacgaggggctactctgcaggctaaaactgcattggagagactcgcatcagtgcaagaacaaattaacaaaattgcacaagaaagggaaagtgctataagggaagaatttgcctcacatttggaggaaaaggaagaggaaataaggaaattagttgcaaagattagagaagaggagagtgaagaaagtgtattgactgagcggttgctggttgcagaatcaaaaacacatggccataacaaggaaactgcaggcttgaaggatgaaatcaaagaactaacaagcaagttggagtttctgagagacagagcagtatcatatgaaaaacaagctagaatgcttgaacaagaaaaaaaccatcttcaagagaagttcttatctgaatgtaagaaatatgatgaggcagaacaaagatacaagtctgcagaaagggatgtgaaaaaggctactgagttggctgatgcagctcgaacagaggctattgcatcccagaaagggaaggatgaggcacagcggttatcgatggaaaaggtagcagttatagagagagttcaaaggcaggtagacagactggagcaggaaaaagttaatctattgggcgaagttcagagaatgcgtaattctgaatctgatgcctggtccaaggttaccttgcttgagagtagggttgctgagagggagaaagaaatggatgatttactgagctgtagcaacgaacaaaggtccagcacccttcatgtccttgagagtctgttggcaacggaacgtgcagctagagctgaagccaataagcgtgcagaggccttatctatacaactacaatccgcccaaggtaaacttgatatactccatcaggagctgacatcgattcgtcttgttgagactgcacttgatagcaagctccggaccattacctatggcaaaagatttagagataatgaagtacggctggattctatccaagatatggacattgatcctccagagaggagca

SEQ ID NO: 11587 - DNA, 755 bp, Sorghum bicolor
  Clone ID: SORBI-28MAY03-CLUS66170_1
ggcctgtctgcggtgggctccttgctcgtgccggactcgcgggcatccagggccggtcgcctccgcctctgcgacctcctgctcctgcggtcattctctctggcctccccccgggtctcggcaaacgagatgaggaagctccgagcaacgatgctgccaaatctgatcagcatgcggccagagtaactttccacttggtacctgctgtaaataatcatcaggctcgagcctcctctcgggtcacggcgaacgagtggaagaagctccgtgcaacgctggcacctaatcagatgtgaacgcgggctgtataactttccacgtggtccctgctgtatatcagcgaccgctttgggttcgggtgttgctagataagttacattggaactacccggtgcgtacgccggcctatgcgcgttggtatgtgtctatattgtaactatcgcgcttacgcgtcgtctgggttcttcttttttgtcgatcttgttattttggttaaattggagtcaagtgtgcgttatgttggtgtctgatgccccctttgcgcttattttctgtttgtctcacgtatgcttttgttcatgttttggctgttcactctgcaaccacaaagatgggcggtgacctatcgggtatataaagttatccttggccacaaggacttccggatattggccctgttaaatagatgtatattatgaaaatataattaatgaagaatttaatgatatttagttgataaaaaaaaaaaaaaaaaa

SEQ ID NO: 11588 - DNA, 673 bp, Sorghum bicolor
  Clone ID: SORBI-28MAY03-CLUS66596_1
cctactggaatcaaaaaaatatttccctgtactcttcacaacctttctagtaagttccccactgagtccttcaatccacggatcagtccttactagctcacagctcccccaaaacctctcattaggctccacggctaatgtcaggcaggttttcggctcatctcagcgcaaccgtgagatgaaaattgcttagtccagttcccctattgctgtgaaaagaccccagaaatgacagttcaagccccgggcggctgagatccagagctcctgtccaagcaggaaagaagatctgaagacaaagaccaataatggatctcaagtcaggttgtgctttagaggcaggttttgaagacacaagcccaagaaagacgggtgttatgagaccaggcgcttcaagacattgggaagataaaagctttttcgaccaaaacaaaaacaaaagaaattttcaagggaggttcaaaaacaattacaatatcctccaccaacaaaaactatttaattattataccagaaaagcacaataataattaccaataagcttcccagcctggaaatccccacgagtaccataagaatacaactacttctcataactcaagacccaaagccccaagactaattcacaaaaaccaaaagaaagctaaccagaaaaagcttctcaaaacgtatc

SEQ ID NO: 11589 - DNA, 750 bp, Sorghum bicolor
  Clone ID: SORBI-28MAY03-CLUS66722_1
cctacatccattgtgatacttcagacagacacttcttcttgcctactaagctctcttgtgttcttgccttctgcctgtgctgtgagtgatggccagcctcaccgatctcgttaacctcgacctgagtgattgcaccgacaagatcattgccgagtacatctggattggaggatccggcatagacctcaggagcaaagcaaggacggtgaaaggccccatcaccgatccgagccagctgccaaaatggaactacgacggctccagcaccgggcaggctcccggagaggacagcgaagtcatcctctaccctcaagccattttcaaggacccgttcaggaagggcgacaacatccttgtgatgtgtgactgctacacgccacaaggcgagccaatccctactaacaagaggtacaatgctgccaaggttttcagccaccccgacgttgcagctgaggtgccatggtacggtattgagcaggagtacactctccttcagaaggatgtgaactggccccttggctggcctgttggtggataccctggtccccagggaccatactactgcgctgccggtgccgataaggcctttgggcgcgatgtggtcgacgcccactacaaagcctgcctctacgccggcatcaacatcagcggcatcaacggcgaagtcatgcctggccagtgggagttccaagttggcccgtccgttgggatatctgccggtgacgaaatatgggttgcccgctacattct

SEQ ID NO: 11590 - DNA, 598 bp, Sorghum bicolor
  Clone ID: SORBI-28MAY03-CLUS67138_1
acgccgccaccaaagcgtacgttgaccaattctcaagatgcctctatgtcgagtacaagagcaagggtattgatgtgcaatgccaggtgcccctatatgtggcgacaaagatggcatccatcaggaagtcttccttcctggttccatctgctgacacctatgctcgtgccgctgttcgtcacattggatacgaacctaggtgcacaccatactggccacactctgtcctgtggttcttgatctccattcttcccgagtcccttatcgacagcgtgcgcctgggcatgtgcattaagatccgcaagaaggggctggccaaggatgccaagaagaagtcactgtgatcgacgtttcagaatgcatgttcagagtcgcacatttcctcatcacctgtagcagacatgtgccttgctatagtcactttattagctaccattgcctcctgaatctgttaagaatcgagaatgtcattgttccatccacggttatgatgttaaaaactatgattcctcaattcaaaatgtaacactaatacgataatgatgaatggaattaactggaagaagttgtgtaacaaagttggttttctgaaccattg

SEQ ID NO: 11591 - DNA, 693 bp, Sorghum bicolor
  Clone ID: SORBI-28MAY03-CLUS67448_1
gcacgaggggacgactccaccgcgccggccgccgcctccaacaaggatgggcagatgccgcccgtgggcgagtggccgtaccggtgtccccagcagtgcgactgctgcttcccgccgcacagcctcatcccctggccgaacgagcgcgacatggcggccgccgccgccgatgcctcctccgccgccggccaggcccaacagcagtagtgaaactgcacgtacggagggggatcgagggaccttcgctgcaattgtgtaatgtaagccgtagctagactactagactagcgtgttgtttgcatttggttgggtagtagctgcaagcgcgcgccgtgcaggtgtgcagggggcgccaacacttgcatgccccgcgctattctttaattggtagcttagctgagctcagttcatttccaagttgtgttcatctttggaagtacagtagcttggttgaggtcggtgggatgaacatggtggtcttgtaaatagctagctagaacactttgatctggatggcaaacctgcaaagaatctgcacgtacatagtacacatgttgctgcaaagtggcaagtttaagtgtcggcaggcaaagtatcatccggtgtactacttaaattagaactatactatttcttgaactgtaattccccctggatttgtgtagtaaatggaatgtaaatgactaattattt

SEQ ID NO: 11592 - DNA, 635 bp, Sorghum bicolor
  Clone ID: SORBI-28MAY03-CLUS18279_1
gccggccgggttccgatctgaatcgactccggccggccgccacaacgacaagatccaagaactcgctcgcgcgcacggacaaggcccggagccgggagatcgagactgatcgacagtccgagacgccatgaacgtggaggaggaggtcgggaaactcaaggaggagatccagaggctgggccagcagcagcccgatggctcctacaaggtcaagtttggtgtcctcttcaacgatgatcggtgtgcaaatatttttgaagcactagttggcaccttgagggccgccaagaagaggaaggttttgacctatgatggcgagctgcttctgcaaggcgttcatgacaatgtggagataaccctgttgcctcctcccgcagttgctgccgcttaaagtgcagagcgccacaaagttctcaattccatacacctcgtatgcttgtatttcaccctgcctagattctcatgaaccatttggtattcccagaagactgctattgtgtgatgtatgaaattgttatgcttaagaaatatccttgcttgcaaaaaaaaaaaaaaaaaaggaccctcaatgctggtataacattcatgtgatgagacatgaaggaaagcaaaaaaaaaaaaaaaaaaggccccta

SEQ ID NO: 11593 - DNA, 615 bp, Sorghum bicolor
  Clone ID: SORBI-28MAY03-CLUS18299_1
gccggccgggctgggatcgcctcccgccgccgccgccctcctctccgtcgctcgcctcactcctccgccatggccccgaagaaggataaggccccgccgccgtcgtccaagccggctaagtccggaggcgggaagcagaagaagaagaagtggagcaagggtaagcagaaggagaaggtcaacaacgcggtgctcttcgaccaggccacctacgacaagttgctctccgaggttcccaagtacaagcagatcaccccgtccgtgctctccgagcgtctcaggatcaatggatccttggcacggagggccattaaggatctgatggcaagggggctcataaggatgatcgctgttcattccagccagcagatatacaccagggcaaccaacacatgagggatgttttgcatcttgtcgatgttatctagtctagacgacttggtgttgctattatatatcaagtttatttcaatcatggctcagtcaatcttactgtcatgttgaatatgtttaaaattattgtgctattttaagctcatgttgccatccaaaatttatcttgatgaggaacataaatctatctctgctctcctgtttgacaaaaaaaaaaaaaaa

SEQ ID NO: 11594 - DNA, 868 bp, Sorghum bicolor
  Clone ID: SORBI-28MAY03-CLUS68529_1
agattccccctctgccattgccgtcccgggctcccggcgtcccccggcctcgttccgaccccgtccgctcgcgcctccccctccccccgcgccttctggccgggacccgtgcccctgaccgcgccgccgcacgcatcccccgagcctccttccgcttgtcgactctgcgctctgctgcgtcctggactgggttgcgcccgagctggtcggttctgcgctccgctgctggaccggggtgcgccgatccatttggacttcgggttgatccatccgttgtgttagtggaatcgaagtatttttgaggctgcagaaagagttccttatagagtaatctatgtacacatattgatgcctgtgccaatgcgataaggaattgtgttgatttgatattattgcaagatgggcgatggggtggcttttgaggctgcaaggaagattatcatgcacccgctttatgcgccaaggtcttcaccgtggcttgacttgaaggtgttctatattagggtaagcaactgtgtggtggatgagtctgcgccagaccatctcacactgaaccacatccctctgtcacctgatacagttattgaggtgaatggccagcggagcagcatgcatactgagttcatatcctcctcactgaggagggacagggttgacaaaaggacagaggaagccactgccctgatcagcaaatggtccccatgaatgtagatgtgtacttaccttggtcttgtaggaatctaactgtccacctttcctgtccatgctatagtcacagatgagtgtggttttctgtccttccctttccgcagtcactctgagtatctggtgctttcttctttgcaatgcaaatcatttttgacccctt

SEQ ID NO: 11595 - DNA, 905 bp, Sorghum bicolor
  Clone ID: SORBI-28MAY03-CLUS68865_1
caagaggttctcctactgcctcacgccctacttccacaacaacggcgcgtcgagccacctattcgtgggcgccgcggcgagcctgagcggcggcggcgggcccgtgatgtccatggcgttcgtggagagccccaaggactacccctacagcacgttctactacctcccgctggtggggatcaccgtgggcgagacgaagctggccatcccgagcacggcgttcgatctccaggaagtcgaggaggggttctgggagggcggcgtcatcatcgactccggcagccccttcacgtcgctggtcgaggacgcgtacgagccgctgatgggggagcttgcccggcagctgaacggaagcctcgtgccgccgccgggggaggacgacggtggcatggcgctgtgcgtggcacgcggcgacctggacagggtggtgccgacgctggtgctccacttcagcggcggcgcggacatggccctgccgcccgagaactactgggccccgctggagaagtcgacggcctgcatggcgatcgtcagagggtacctgcagagcatcatcggcaacttccagcagcagaacatgcacatcctctttgacgtcggcgggggacggctctccttccagaacgccgattgcagcactatctgattaccaacttttatggagatgataattgatatgcacatacataatttgtattagttacctagtactaattatgtctatacagtaaaagctattgtatctaaaaaacaaaacataaagtttgaaacggaaggagtacttaatatatgtgaatgaaccaagttgtcttttggccaatgtaaaacaacttagcaatggaagtagtacactagggccttcttataatttgtcaaaattatcgaaatgaggtatccaacagttt

SEQ ID NO: 11596 - DNA, 1281 bp, Sorghum bicolor
  Clone ID: SORBI-28MAY03-CLUS69583_1
acaagaaagggagctgagctcaggcttggagcagatccatatccatccggcaggagcagcgacagtgattagctgggtctgggtacctccgcctcgcgagccgagaccatgtggacggacagtccgctgctccgggatgccggcgccgccgtgctcaccggagtgaccgccggtgttgtgctccgcttctgggaagaggtcgccaaccgcgcgctgctggaccagaaactctgcaggaaactggtgcacataactgtcggattagtgtatttcctgatgtggcctttgttcagttcagatgatgcgtttgctccatttcttgctccacttatcctcgtcatcaacatcataaaggtgacagtgattggacttggtttggtgaaagatgaaggtatggttaattcgatgaccaggcatggagaccacagagaactactcaagggcccattgtattatgcttgtgctataactgtaacaacaatagttttctggaggacatctcccatctcaatcgccgtgatctgcaatttgtgtgccggagacggtgttgctgacatatttgggagacgatttgggcatgtgaagctccctcacaaccctgaaaaatcatatgcaggaagcattgccatgttcttggcaggtttcatcgcatcagtgctgttcatgtgctacttcaacatttttgggtttgttgagaagagctggaccatggtcgctgcctttggtgtcatatccctggttgcagcagttgtggagtcactcccgatcagcacatgccttgacgacaatctgactgttcctgtcgcatctgtgctatttagcgccctggttttctattccatcggagccagaaacctgtgctgcatgagcggcgaagactggagaagtatttcagctaccgttggaatgatgtttgcaggcagcagcagctgaaacaagtagacacagtccaggagcagagttgagcagaaaatacacagaggagtgatccttcagtcctgatgggtgtttcttgtcttgtaaccattttcctgtctaagcagacattcttgtaacttgagaattattaagaaagacaaagaaagaggaaaagcgggaaagtttacatattcatgaaaacagagcaggagctcataagtaaagtataagtgaaaactgcagctgagttggcagtgcgtttgtgatccgttcagaaacttgaatacttggtggtttgctgtgagaatttgtcagagtgctcgtaagaagaaaggtttgtgactggccaagttgccttttggg

SEQ ID NO: 11597 - DNA, 695 bp, Sorghum bicolor
  Clone ID: SORBI-28MAY03-CLUS69699_1
ggggctgaagctgggcagcgagtccgcgggcatcacctacaagccccaccgcaacctcggcatcgccatcttcagcctggccaccctgcaggtgttcgcgctgctgctcaggcccgacaagaagaacaagtacaggctctactggaacatctaccaccactccgtcggctactccgtcatcgtgctcagcgccatcaacatcttcaaggggctcgacatcctccagccggccagcgggtacaagaccgcctacattgtcatcctggccacgctcggcggcatcgcgctctgcctcgaggccatcacctggcccatcgccatccggaagcgcaggcggaacgccgccgacaaggcggccgtcggcaacggcaacggctggcagcagggtgcgtagggagtaccagatatcatcgccgggcgtgtgcatagcacagtgcgtgcgtgtgtgtgtgtgttttgatgcgagggaggaatgtgacatcgatgtgctgatggcgttgttcagagagatttgttgcagtgtgtgtgttctttattgttactactagtagtctagtaccgctgggctctgtagaaggtgtagctcctttttcttctggtttattttactagggttctataatggcatttgtacacatttcttcttcttattattattattgatgtacgattactttgattagtgtatggtttcg

SEQ ID NO: 11598 - DNA, 1144 bp, Sorghum bicolor
  Clone ID: SORBI-28MAY03-CLUS69044_1
gcacgaggcggacaactgtttgaactgggggacttgaatccatttacttcaaacttgaatccatttactttctttgttcccagcatgtagtgattgtcaacctcacagatttcttatgtttgctgttggatatgttcatgtctttctttattgacctcacagatttcttaccctagaaaaaacgatgtacatgtaggtgtggcaatgttgctgcaatcctggagctggatgagaacctaaataagcagttccgcgtatttgaagctgctccacatgtaagtgttctccacctttgtaatatgtcatgcttctgttaaacgcttctgttgaacatctggtccttcagcatataatttgtccatttatgcctttaggaatcaagaggcgttcctgctaaaaggccagcaccagattactttctatgatgctgcacattgagtagtagagcttgctacctaatctctgctttgggccggtggcggtcctaaataagcagttccgcgtatttgaagctgctccacatgaatcaagaggcgttccggctactgccccggcgcccgttcacgttccctgatgctgctctttgtcttctcctgcctgctccctgacctctgcgtgggtccatgggctctcccaggcttgctccgcgcagctcccccctgggcgctagaagtgcgcaggcctgacgggagttctgccgggcggcgctctctgcatgccgtaattgtgtgttgcgctcctcccttcccctcgatgaccccgatgcgagttgttggtgtcacccgcttttgctctgcccggctccctggcgcgcccctggaatgcgcaggtatgttgggagctcacggggtctgctttctgttcggggtgtattagttgcttgcggtcgggcctgccccgagaaaaccccgatactagaatttagagtgatttgctaatgttgtgcctgaatatgtggcgctgctctggaaagtgtaggaaattttgtagctgacaattttttcatactgttaggtgtaaattaaaagcatgtggtcagggctgacctgcctggagttctgcatgtaatggttgttatgtaactttgctctgctagcttcttctgattgaaacgtgctagctttaagccggcgggcggcccggt

SEQ ID NO: 11599 - DNA, 959 bp, Sorghum bicolor
  Clone ID: SORBI-28MAY03-CLUS69997_1
gcacgaggatgaagcagcagcagctttgccactacgacgacgatggcaaagacagaaggaagaagaagagcacagaagcagacgctggtagtggcaggggttgctcgtcgacgacgccgtcgtcagagcataggaaaaacaagaagaaggaggtgcagctccagcaggtgagccccgcgagctcgtccaggttcctgctcaactcctccaggctcatgatgcagtccgacgacgaaatcaccgtcgtcgactccttgccgccacttccgtccccgcggccctccttcattaaggacgccgacgacgacatcgaaatattcccaaccagccacggcgatgccgtgatgccggctggtccatcgaggcctcagctcctggcgccgccagtggaattattcgccgagccgtctgcatcaggtgcagggtcctcctcgtcatcgtcagaaataggaagaggccatgtcgttgccggtgacaacactgtcgtggtgagatcatgttccacgagaacaggccagaaccaggtggtggttttgagggtatctctacactgcaaggggtgtgctggcaaggtgaagaagcacatctccaagatggaaggggttacttcttttgacatcgacatcgcgacgaagaaggtgacggtggtgggagatgtaacaccgctaggcgtcctcaacagcatctccaaggtcaagagcgctcagttctggacggacactcgctcgtatttgtccacgccgccgcgagcctccgccaccttctgagctactccaataccttcaaaacccacttgatcgtctcggactgggacgccacggtctttcgagccttttctccatattattgtcggttggaaaatatatttgtaaaatccaatcagaaaattgttctattacaaaacgcgcattttacgacatgtaaaacttttactatataaatatgtagaagctgcatct

SEQ ID NO: 11600 - DNA, 763 bp, Sorghum bicolor
  Clone ID: SORBI-28MAY03-CLUS6311_1
ggcacttgcgcaggcgcgggcggcaagcgaggctgacggaggcattggcagtgggaaaaagcgcagtaggggtgggaaaaggaagcgtgagaagaagtttgcagaacaggccagggctgctaaagctgaagaagctgagagatctgtcttcaattttatcaacagccatctagtgagccaagatgtccctgaagtttcgaccaccaaagttagaaaagggtcatcagttgagacccatggacatgctaagaaggaggacagaagatccttggttgcatacgatgaggaagtaaaggagctgaggattcgagttgagaaactggaagagatgaagaaccgtaaccgcaaagacaaggcagtctttgaagcagcctcaaggaaactggaagagactcgaaaggcactcgcggatgctgaagctacccatgcttcagcgacgaatgccgttactagaaaggagaaagagaagaaatggttgaaattctgatatcaagttcatgtgccaacgcttctctgtttatgttctgacaagaatctggcgtgatgtgtgcaacttacaattgccctcctgtcagcccttagcatgctacacttgtatgtctatcaggtttttagggcatctgtggactgtggtggtggtagctggtagtagtagtgatactgtatttagatcggctttcgtctccttccttagactcgagttaatactgtttctgaaccgacgatcatttggtacaagtaaacattttatttgcattccggt

SEQ ID NO: 11601 - DNA, 1115 bp, Sorghum bicolor
  Clone ID: SORBI-28MAY03-CLUS6368_1
cttttgggcttggggattgtaaggctcctaaggttctcggagacatttttgagtctattgctggcgcaatattcctggatagtgggtgtgatacctctgtagtctggaaggtttttcagcctctacttgatccaatggtgacaccggacacccttccaatgcaccctgtaagggagctccaagagcgctgtcaacagcaagctgaaggattagaatacaaagcatcacgaacaggcaatgtagctacagttgaagtctttgttgatggtattcagattggtgtagctcagaacccacagaagaagatggcacaaaagttggcggctagaaatgcactggttgtcttgaaagagaaggaaactgcagcaaagaaagatactgagaaggacggcgagaagaaaaacggttcacagttcactaggcagaccctgaacgatatctgcttgagaaggcaatggccgatgccacagtacaggtgtataaacgagggtggccctgcccatgccaaaagatttgtttatgcggtaagggtaaatacatctgaccgtggatggactgacgagtgcattggagagccaatgccgagtgtgaaaaaggccaaggactctgccgccgttcttctgctcgagctgctgaatcgaaattactgtgacaagcctgatggcaaataatctttgatgtctttgcggtggtagtggtagatgtggaagcattcagtgcttttgagcaaggcaaattatctttgttgatgttcttggtggcggtagtggtgatatggaggcattcagcattcttataaccattcaatgcttttcagccctcgcaaataaaaacataagcagagctgaggagtgagattaattagaggattatttttgtctgatgaggtcactggttacaactaggtatttactggtgaggtattgaggtgtaacaaatagcagttgcaaattgcaatagaggaaggataggttgacataggatattggaggcctcttattcatcgattgtgtaaggtgtttaaagaacagtgcatggatccaataaatttatattgatatatattaacatctttcttctcatgtaaagagataaaaaaactcgagggggggccc

SEQ ID NO: 11602 - DNA, 1374 bp, Sorghum bicolor
  unsure (1)..(1374): unsure at all n locations
  Clone ID: SORBI-28MAY03-CLUS6377_1
ctcgtcgtgccccgcgcccgcgggagtgctcgtgttcctcactcctcccgcttccttccccgacactccctcagatccgcgcccgttttcccgatccacgcgacgcgagggggcattccagccctaaagcggccggtgagctggcctccttccgccgacgcggaccacctggagggaatttatcctggagccgtcttcctcctcgcctcctctcgcggcgcggcgcggaggcgggagacactcggaggtccagctgtgtttggattgatttcttcgtctgtggtggctagaggcacctggtttctttttgctgaagctggtggtacatgtgaacagcagggcctgtcttctgtctctgcttttgcttctaagcaatggcgaatgcaagcaagcacttgcaaccttcaagcaatgcaggcaatgacaggaagtaccagggcacgttggtcgcttctccagcaaaggccattgcgcctaagtgtgtgaaccgcatcatgccatcgaagcaactgatcttgggtggggattcaataggccatgtggcatcatttctgattaaagtcgttgctcttgaggcagtcagaagagtttctaaagcaagatgccctttcatttggaattctgttcaagcattgcagatccttgtgtatcctccatttagttggatccaaagatgggcaccactcagatttctcgtgcagggaattcagaaactatccatgccactgttgtttctgtcagtcacaacaacagtaagtgagctgtcttccaagcgcgacgatgaaccagataacaatacagaacattccgagacgccttctgaaacaaatgaagtggcatcaacttctggtacaagcgatgctgctgatggcacanaggaaatcgtgcaagagaactcgagggtgttacttttcagggagcttgagaagcaaggcatcactttgcccgagaggtttactgaagatgagttacgcagattttatgtcgctgcaaatggtgacttttcaagtttactctcatcggttaagaagacaattcgttggagggaaacatttcacatacttacattgcaagaacttgataaatggtctcacttagtcttttggcatggatttgacacgatgcttcggccttgtttagtaattcgtctcggacttgcatgctccagcataccacctcgtgacagaccccgtttcgggcaagcagtagtttctcaaattgaccatggtgttgtaaatttgaccaatgaagaagattcaagaattaccgttttgctggattgccatgggagttctccattcagatttccaatgcaaatgatgaggtcatttatcactgtagttcaagagaattacccgaatcgtcttggtgtat

SEQ ID NO: 11603 - DNA, 754 bp, Sorghum bicolor
  Clone ID: SORBI-28MAY03-CLUS64621_1
gcacgaggagattattctggaaccttaacagagccatggatttctcaaaattccactatgtcatatattccttctgggcctcaaggagggttatcctatgtggcaggacacgactctcacatgttgagttcaacacatcaaggagcttttccacctaggaatccatttgagtgagcgctagtaaagagtgttttgttggatagtggtgacagaagaggaaggcaatcggcactggtcgaaactcaaatggatattcaggtgtactatactagatgcgttgaaaacaaatgtgcatcggatctgaaaccctgaggtaaatatgtgtcttggatttcattgtccgcgttctcttgtatatcagaaaggactgcatagaagtctacatggcaggagtgctggaatttttgcccgaaggaaaagcttgtgtcctatactcccatggactgatgtatctctggcaggcagtgcgggtcaagcataaaaaatttatttcaccatttcaacatttgcccgtgggttgtgttcttgttaaaccctgttgtgaatgagggttggcatttttacatcaaatgactggttcattacccttttttattccttaaaaatatagtaaaaagatgttcatcaaaagataatttcatattggtgtcagatgttgtgttgttcagtaaatgggtgttccctttgtatgttaaaggggcatgtcgactttcggcaatattaatgctcatcatagtaaaagaataattttgtt

SEQ ID NO: 11604 - DNA, 1214 bp, Sorghum bicolor
  Clone ID: SORBI-28MAY03-CLUS7113_1
tggagatgctggtgagggacaccgtcgaggaggtcaccaagcccaacctctcggacctcttccccgtgctcgccaggctcgacctgcagggccgccgccgccgctccgctgagttcgtggcgaggttctacgacttcttcgatccgatcatcgcccgccgcatcgaagcgcgcggcggcggtggtgaaaagattgatgatgatttcttggacgtgttgcttcagcttcactcgatgggtcaactcagcctgcaaaccatcaagtcttttcttttggatctgtttgccgctggaacggacacgaacgcgatcacggtggagtggacgatggcggagctgctccggcacccggccgtgatggccaaggtccgggcggagctccgggaggcgctgggctcgaagcctcacccggacgagtcggacgtcggcaggctgccctatctccgcgccgtggtgatggagagcatgcggctccacccgccgagcccgatgctgatgccgcacctggccatggccggcggcgcggaggtgggcggattcgaggtgcccgccggcaccaaggtgatcataaacctgtgggcgatcatgcgcgaccgggcgacgtgggcggagcccgaggcgttcgtgccggagcggttcgtgggcgcgagcgacgcggagttccgtgggaaggaccggctcgagttcatgccgttcggggccggccggaggtcgtgccccggcacgccgatggccacgcgggtggtgacgctgctcctggcatccatgctccacgcgttcgagtggaggctgcccgaggggatgcagccgggcgacgtggacgtcagggaccggtttggaacgtcgctcaacatggtcacgccgctcaaggccgtgccggtgccgtcgcaacggtgatgcactgcaacggcttgtttaggccctctttaaatcctctaaaaattctgagaatatagtatccttaatagttatagatagattctttatccaactatccatttcgagtgtggtttgagccggatgtggtgtggcagctcagttttgttttttctttccttctcctcccttgtccttttgttctcctctctcgtccttttgttttttttttttcttcctaggcacttcacgtgcaggtctattttctttgtctgtatactatgcttttgagggtcgtctaccctcctcttaataaaatacgtgcatagcatgttctct

SEQ ID NO: 11605 - DNA, 1027 bp, Sorghum bicolor
  Clone ID: SORBI-28MAY03-CLUS7120_1
aagtcccccaaagccgctccccgttcaccaaaagctgctactcatcccacctttgccacttctgtaaagaagcccattggtgcaaagaaggttggagccaagactggagggcttggtgttcgaaagcttactacaaagccaaatgaaagcctgtatgagcagaaaccagaagagccaaaacctgctgtacctgccttggctgcttcaactacagcaaaaggtggtccatccttacattcacgttttgaatacgtggagaatgtgccatcagctgatttgagaactggcggatctggatctcgtgtgactggccatgtagccccaccaaaatcatcagacttctttcaagagtatgggatgggtaatgggttccaaaaaaaatctagcaatgcctcaaaaactcagattgaggaaactgatgaagcaaggaaaaagttctctaatgctaaggcaatttcgtcatctcagttttttggtactcaaaacagagaagagaaagaagctcaactatcccttcagaaatttgcgggttcttcatccatttcaagcgctgatctttttggtcgcaatgatgtggacaattctaacctcgacctaagtgctgccgatctcatcaacagaatatctttccaggcttcacaggatctgtcttcactcaaggatatagctggggagactggaaagaagctgacatctttggcctccaatttcatcagcgacctggacagaatcctttgagcaggcgaggccagcagcatttttcctaccggcaccagaatatatcccttctggtgcatcaccgacagttcaaatcaattcttgcacagctacagctagagggtagtagaggattcttattatgcttttgtattgaccattgttgtgagactccgtccacatgaagatatttttatttgttaaaacttcacgatggtgaagcatacaattatatacattaaggttgcttgtatcttggaagaaaaattcatactgtctgcgtggtaaatgaaaccgaagcttatgtgtt

SEQ ID NO: 11606 - DNA, 870 bp, Sorghum bicolor
  Clone ID: SORBI-28MAY03-CLUS71731_1
accatttcccccatccaaaccgtcccttacccttcttgttcctcttccgcctaccgcaatggggactcggcaacgggtcctccatttcccccatccaaaccgtcccttacccttcttgttcctcttcctcgaaacgcaatggggactcggcaacgggtcctcgcgccatgggcggtgctgctgctcaccgcgctgcagctcgccggtgcctcccatgttgtcgtccaccggagcctggaggccgaggcggcggcggcaccgccgtcggtgccggcctccattgtcagccccctgctcaggacagggtaccatttccagccaccaatgaactggatcaacgaccccaacgctccgatgtactacaagggatggtatcacctgttctaccagtacaaccccaagggcgcagtatggggcaacatcgtgtgggctcactccatatcacgcgacctcatcaactggatcgcgctggagcccgccatctacccgagcatcccctccgaccagtacggctgctggtcgggctcggcgacgatgctgcaagacggcacgccggcgatcctctacactgggatcaaccgcccggacatcaactaccaggtgcaggtgctcgccttccccaagaacgcgtcggacccgctgctccgggagtgggagaagccggcggcgtacaacccggtggcggcgccggtgggcggcatcaacgcgacgcagttccgcgacccgacgacggcgtggtacgccgacgggcactggcggatgctggtgggcagcgtgcgggacaccccgggtatggcgatcgtgtaccggagccgggacttccggcgctggacgaaagccaagcacccgctgcactcggcgctgacgggg

SEQ ID NO: 11607 - DNA, 1212 bp, Sorghum bicolor
  Clone ID: SORBI-28MAY03-CLUS71858_1
cgcacgagcccgcaaccaccgcaccgcacgttaggtaccgatcgagaggcaggcaggcaagaaccgagcaattcagggcagctagctgcctgccaaagtgccaagtcttggtcttcgtcttcgttctgtgtaaagactcggcgatggagggatcgacgacgacggaaggccatgtggttgggatcccggtgagcaccagggcgtatggcatcgaggagcccgacttcccggcggaggagacgcccgaccgtggagaattcccgagctccttccagtacagcagccatagccatgatgctaccagctcaacgacgacaacgaccaccgatcggccaacgagcaatcaacaacaacaagcagccagcaggaagggagacaggatcgctcagggcatcaaagaacacgtgaccctggggccaaagctttcggagacggtgaaggggaagctgtcgctggccaccaagatcctgcaggccggcggcgtggagaagatgttccggcagtggttctcggtggacaagaacgagaagctgctgcgggcgtcgcagtgctacctgtcgacgacggcgggtcccatcgccgggatgctgttcgtgtccacggcgcgggtggcgttccgcagcgaccggtcgctggcggtgcccaccccgtgcggcgacagcgccgggctgcgcgtgccctacaaggtgaccatcccgctgcggaaggtgaaggccgtgcggcccagcgagaacaagcaccggccagagcagaagtacgtgcacctcgccaccaacgacggcttcgagttctggttcatgggcttcgtcacctacaacaagtcgctgcaccacctggagcgcgccgtcgcctacgcgcagcaggcggcgcaatgacggcaggcccctcgccggccggcgatgggggtagtagtttcttcatgtcatcatgtgagcgccgtgcgcgactgctgcgtgtgcttgctggtttgtgtacgtgtagggtgggctagttggtttctgttctggctgtgtatgtgtaggctgcaacatgtcgttgtacatcttgggggatgggtttgccgactgactaatcggctgatgaagcaggttggttttagaggcgatcgatcggggcatgtggtctttttggtgggatggggaagaggaaaattcatggatttggaacagaaaatggctgtgtggaaatggcaaaaccgccatcaatatccat

SEQ ID NO: 11608 - DNA, 854 bp, Sorghum bicolor
  Clone ID: SORBI-28MAY03-CLUS733_1
gttgtactgagggtgcacaatgaaagatgggagggagttccatttattctcaaggctggtaaagcattaaattctaggaaagcagagatacgtgtgcaattcaaggatgctcctggtgacatttttagatgcaagaaacagggaagaaatgagtttgtcatacgcctgcagccatcagaagccatgtatatgaaattaacggtcaaaaaacccggactggaaatggcaactgaacaaagcgagctggatctatcctatgggttgcggtacaatgatgtaaaaatcccagaagcatatgagcgccttatcttggacacgataagaggagaccagcagcactttgttcgccgggatgaactgagggctgcatgggagatcttcactcctttgcttcacgacatcgatggtggcaagctgaagtccgttccatacaagccgggaacccgaggacctcaggaagccgacgagttgagcaagaggatggggtatgtgcagacccatggctacatatgggttgcgccaaccctttctaatatttagctgttttattatcggttgccgcgtaaaaccacagaatgacagaacgcgaggaagaaccctcgtacatgggtcgtgtaataagagaaacttctgcttgttgagagagtgaccgtttacgatatcgaaataagaaaaggatgtgatgttctatctcaatctctgtttttaacttctctcctttcttctgaatgtattgaattttctttttccttgagaagcttagatataattgcaatttttgtgataacaatcggcaagtcggtgcaatgacgaaactttcagctactgttctcgccaaaaagaaaaaatcagtt

SEQ ID NO: 11609 - DNA, 1032 bp, Sorghum bicolor
  Clone ID: SORBI-28MAY03-CLUS7331_1
gaacttaaagcccgaggcccatctcccccctcgtctccactcctctgctcctcctcgcgccgccgccgccgacgcagcgacgcgacgcgacgcgacgacaggtaatggcttccgccgcggtgctccggaacgccggctcccgccggctcttctcctacccagccctgcgggcgaccgcgatctcgggtcccgccgcgctacccgatgcgcccgcggcggcggcggcggcgccggcccagccgccgcctatggccgggaccctctgggcgaggtccatggccacctttacgcgcacgaagcctcacgtgaacgtcggcaccattgggcacgtcgatcacggcaaaaccacgctcactgctgccattaccaaggttcttgccgaggcagggaaagccaaagccgttgctttcgacgagatcgacaaggctccggaagagaaagccagaggaatcaccattgcaacggctcatgtcgagtatgagacggctaataggcattatgctcatgttgattgcccaggtcacgcagattatgtcgagaacatgatcactggagctgctcaaatggacggtggtattcttgttgtgtcagctcctgatggcccgatgccacaaacaaaggagcatattcttcttgcccctctggctggtgtaccttcgcttgtgtgcttcttgaacaaagttgatgctgttgatgacccagagctactggaacttgtagagatggagcttcgggagctcctcactttctacaagttccccggtgatgagattccgatcattcgtggatcggccttgtctgctttgcaagggaacaatgatgagattggaaagaatgccattttgaaactaatggatgcagttgatgagtacatccctgatcctgtgaggcagcttgataagcctttcttgatgccaattgaagatgtgttctctatccagggtcgtggaactgttgttactgggcgtgttgaacagggaacaattaaaactggtgaagatgttgagatcttgggtttgacacagagtggtc

SEQ ID NO: 11610 - DNA, 1071 bp, Sorghum bicolor
  Clone ID: SORBI-28MAY03-CLUS7338_1
atccggtgctcactcacgcgacggagtcctcgtgccagcgtccagccttccgggcgcctctgctgcctgcaacggtgcagcctgcgcgcgttgtgattgtgaagccgtgaacggcagctcgggctcggcgcagccgcgcagggcccctgccgcgccggcatcgcgccgcggccgcggtgcggggcatgctgcctgcgttgctggcttgctgccgcacgcggcacgccacgtcacatcgggttgtttttaagaggcgccctccggacctagacacgcggtcaccgctcaccacactctcgcacctactacccgcctgctctctctctgtctgacgcgccgccctcgcgatcggtgatggcagctgcggcgtggctgtgtggactcctgtggctcctggcccacgccgccgctgtggcgtcggcggcggatggggcggatggtgggtgggagccgctgatacggatgccgacggggaaggggggtgacgctgctgctcgggcggttgaggaggatgatgaagtggggacgaggtgggccgtgctcgtcgccggctcctccggatacgggaactaccggcaccaggccgatgtgtgccatgcgtaccagatactgcggaagggaggagtgaaggaggagaacattgtggtgttcatgtatgatgacattgcccataacattctgaacccgaggcctggggttatcattaaccatccaaaaggcgaaaatgtttataatggtgttccaaaggattacacaggtgatcaggtcactaccgaaaacttctttgctgtcctcttgggcaataaaagtgctatcacaggagggagtaagaaggtgatagacagcaaacctaatgaccacatcttcatctattactcagatcatgggggtcctggagttcttggtatgccgaacttgccatatctgtatgctggcgacttcatcaaggttttgaaaaagaagcatgcttgcaatagctactcaaaaatggttatatatgttgaagcatgtgagagtggcagtatcttcgagggattaatgcctgaagatctgaatatttatgtcacaaca

SEQ ID NO: 11611 - DNA, 1119 bp, Sorghum bicolor
  Clone ID: SORBI-28MAY03-CLUS6771_1
ccggcacgccgttcgctttcttcccccagtccaccccccacttcacaccaccaccctcccgaccgcgacgcccgacgccggcgacctccgcaccgcatcgccccccgccgatcgtcccgagatttgttgatcaaagaaccatggaaggatcgttccagttgaatccaaacgccagtcctttcatacctgggtcgctgggttcatttgcacacaaggccccagaaaaacaaggaggtcctatcatttttgcagggtcatcatcaaagggagagccttctggtagcagttttgatccttcgcagcatgaggaaaatgacatggatgaagttgctctagccaatatggtcttttcaatgttcccaaatgtctccgcagatttcattgatgagttactcaaggcaaatgattttgacataaatctgactgttgatatgcttcatgagctgaactcacaagatatgcttcctgatgatgctgaggctatcaatgaccttcctgatgatgctgaggctaccaatgaccttcataatggccagggcgtacctgatgctgataaggctgtggtgtctaagagtagcaggaagatgaatgaagatctgcagaatgagaagtcagcaacttctgatgtgaaatctgtgcacgaggagttctcagagatcaacttgcttcacaatgacctgggcctgcctgatgatgataagtcagtggggaattctgttgcaaagtgatcttacatatcaaggcgctctgttttatccgagttagtaggttatggtgtacatactagttgcacccagaattgtggcttggaggacaaagcagtgggagctactgttccattcccgttcgcaggactaattaattgtttctggtggttatccttagtttcaaattgctggtggttatccgtagtttcaaatcgcttgttcagctcctttgggctgagtagttaggtattcctagtggttatcatgagttttataccccttggtttgctcttcaagatcgagtagtacctggtggtcatcctgattttacatatcttggttagctgttttgggtttggtacccagttagttgaaacaatgcaggttatgctgcgactgcccgttatgtgtg

SEQ ID NO: 11612 - DNA, 729 bp, Sorghum bicolor
  Clone ID: SORBI-28MAY03-CLUS67803_1
gcacgaggctcgtttatacgccagcgacgccgcccccatctcgtcttcctctcctcctcaagcaaaaggcgagcgcgagagaaacctgaagccacttcccagcccgctccgccccctcgccgcgatttcctcacatggcagcgctgcttctccgcgagtcactcgagaggaacgacggcccctgcttctgcttctccgacccctgtccctgcgccgacacgcgccgcccctgtcccgatctcgccgcccccgccgccggtcccttctcctccctccgcgtccatcgcacctgctcctgatcccgctctctttcctcccttctcccgccgttatttgcgattgcggctctgattcttgcttccacggtctgtctcgcggttcctgggagcttctgagttctggttctgtccctgaccggtgttgccatggggaagagcaagaagagcaaggcccgcggcggcggggacgacctgctcgacagcagcgacgccgacagcgtcggctcctcgtccaccgcgctgtcggatctctccatctcgtacgccaccgagcacgtcaactcgcaggagttcgtcctcgacaagtacatcgacgcgctctacgagaagagggggtctacaagagaggcagcattggttaaactggttgatgcctttgaaagttttatgctccatggccttgtggagaataggtatgccacactgctgagtcaattcaataattccatca

SEQ ID NO: 11613 - DNA, 674 bp, Sorghum bicolor
  Clone ID: SORBI-28MAY03-CLUS67945_1
tactgcatcataataggagaagctgcaagaggcatcccatttctacagcaaatatttgcagcactaatctctttcttccatctcgatcgccatgtccttcaacgatgacgagccgattatccctccttcaaactcaggtccgaggccgacgccgatcgtgcccgggagggtgcagctggtgagcaagaacaacaacatggctccactggaggagaacacccagaaggtgctgctggagctcaccggcggcgactccaccagcgaccggtcggggctggacctggtggcggtgctggacgtgagcggcagcatgcagggcgagaagatcgacaagatgaagaccgccatgaagttcgtggtgaagaagctcagctccatcgaccgcctctccatcgtcaccttcatggacaccgccaccaggatctgcccgctccgccaggtcaccgacgcctcccagccggagctcctggggctcatcgacgcgctcaaccccggcggcaacaccaacatcaccgacggtctccagacggggctcaaggtcctcgccgaccggaacctcagctccggccgcgtcgtcggggtcatgctcatgtccgacggacagcagaacagaggtgggaacgccgccgacgtcaagatcggcaacgcgcccgtgtacaccttcgggttcggcg

SEQ ID NO: 11614 - DNA, 768 bp, Sorghum bicolor
  unsure (1)..(768): unsure at all n locations
  Clone ID: SORBI-28MAY03-CLUS6797_1
gcacgaggaggacgtggaggtttttcaggttcaaatgatgaacgcgagagtactttgaaccagctgcttgtagagatggatggatttggaacaactgctggtgttgttgttcttgctgggacaaatagacctgacatcctggataaggcattattaaggccaggaagatttgatcgccagataacaattgacaagccagatataaagggtcgtgatcaaatattccgcatatatcttcaaaagcttaagctagacaacgaaccatcattttattcgcaaaggctagctgccttgacacctgggtttgcaggagctgacattgccaatgtttgtaatgaagctgctttaattgctgcgagaagtgagaaaactcagattaccatgcagcattttgagtctgcgattgataggattattggtggtttggagaagaaaaatagggtcattagcaaactggagcgccgtaccgttgcttaccatgaatctggacatgctgttgctggatggttcttggagcatgcagagcctcttctgaaagttacaattgttcctcgtggaacagctgctttaggctttgcacaatatgtcccaaatgaaaatcttttgatgacaaaagagcagctttttgatatgacatgcatgacattaggtggccgagctgcagaggaggtttgattgcaaaatctcaactggtgctagaatgactnggaaaagtaccaaaatgcatatgcacgggcgtgtgtatgtttagtgaaaggtggctttatc

SEQ ID NO: 11615 - DNA, 1371 bp, Sorghum bicolor
  Clone ID: SORBI-28MAY03-CLUS75_1
ctcctcctcacatcccaccccccaccttctctttaaagctacctagctacctacctacctgccgcctcgccggcggccgctagctgccagtcgccaccgccgccgcatcgatcgatcggaacggaaggagctagctagcgcagcaagcgcccatcagcaagcagatcggagcaagatggggcgcggcaaggtgcagctcaagcggatagagaacaagataaaccggcaggtgaccttctccaagcgccgcaacgggctgctcaagaaggcgcacgagatctccgtcctctgcgacgccgaggtcgccgtcatcgtcttctcccccaagggcaagctctatgagtacgccaccgactcccgcatggacaaaattctcgaacgttatgagcgatattcctatgctgaaaaggctcttatttcagctgaatctgaaagtgagggaaactggtgccacgaatacaggaaactgaaggccaaaattgagaccattcaaaaatgccacaagcacctgatgggagaggatctagagtctttgaatcccaaagagctccaacaactagagcagcagctggagagctcactgaagcacatcagatcaagaaagagccaccttatggctgagtctatttctgaactacagaagaaggagaggtcactgcaggaggagaacaaggctctacagaaggaacttgcggagaggcagaaggcggccgcgagcaggcagcagcagcaaggtgcagtgggaccagcagacacagacccaggcccagacaagctcatcatcgtcctccttcatgatgaggcaggatcagcagggtctgccgcctccacaaaacatatgcttcccgccgctgataatcggagagagaggtgaagaggtggctgcggcggcgcagcagcagcagccaccaccagggcaggcgcagcagcaagcgcagtccgcatcgcaggtctgccgccatggatgctgagccacctcaatgcataagcagagggcgatagcaaatcgacctctctcgtcatgaaccatgacgtacgattaccatatggttgccgtgcctctcccatcgaatggcgagcaatggcacgctcctgcaagtgattgctcgatcaccgatgattaaaaccctagcgatggcagcagcaattaagctaaactattgttatgtttgcaagaaagggtaacccgctgtgtaatctttgtctccagctagcatgtacgtaccaactgagatgcatgcatgcgtatatcagcatatgctttattactgctcagttacccttgaatctagcagtgcttttggtgagagggtgcagtttactttaaacatatgggtttgtgactgtaaatagtatttttaactaggagtt

SEQ ID NO: 11616 - DNA, 1493 bp, Sorghum bicolor
  Clone ID: SORBI-28MAY03-CLUS7582_1
gcagcatatgcactagctgttacatcatctgaggcaactgatttagctgggttgcttcatctggttaagttctataaaagccgccgctttgatgcagatattggaatgcccaggccaaacgactttcatgatgtcccagtgtactaatgccttgaggcaatcccccatgcggtagctcttgttagatcatcggacaagaatagcccaaaaggagccattgagtttattcttcagctactgaagtacaatgataacaacgggaatatttactctgatgtgtactggctatctgcaatggtccaggcaataggcgaactggaatttggccagcagggcatgggcttcctatcctcccttctcaagcgaatgatcggctcttgcaatttgacaactttatgcctggttataacggggtcttgactgtcagctgcattcgtacccttgcacgaatagctaggagggtgtcatcttctgtctgtcttgatcgcatttgtgatttgattgcccctttccgtgacatggacaaaccatggaaagttcgaattgaagctagcagggttcttattgatcttgagttacaccataaaggacttgatgcagctcttttgttgttcttgaaatatgtagatgaagaaaagtctttgcgaggagcaacaaagttggctgttcatgtcttgcgtatatgtcaagcaagtattgttccttacgccaatgatcaaataaatttgacaactctaatcggtcttcttcatctgcttgctggcacaaaggcatacaataacgtatttcttcgtcatcatgtgttctgtatattgcaagttgccgctggaaggtccccaacattatttggtgttccaaagatcgtcacatcccctccggtggtcaaggacatatgtagtgatcagcacactaaagctgattcctcgattcctcagccatcaaagcctcaggaaccttccactagcactcctagtgtccgggaggtcttacctacgtctggacctactaaagatgctgataatatatctaactgcagcgaaagaaggaatgtggtcaaaattagggtgaagcttactgcgtcttccagtaaagcatctgatgctgaccacagaggccattctcatggtggaagaaatgaaaatgaaccaggtccatgtagctcaatgtcagtggatgcccccatggttggggcagcaaatgaaccattaaatgtaagcaatcataacattgaggaacagaactcatgtcatgaccgtgaatcaaggatgtccgcaagtgttagcaatgctaagctaatggacaggcatgacattaacaaggagctacagtgtactgctgattcaaggctggatgctcttcccaaggatcagttctctcctgccgttaatccgccagaagttttagacaagcctggcagtcagcttgaaggtgtctccaccagctatgatggaaaccaagctccagaatctgtgaacggaggggaaatgaaagag

SEQ ID NO: 11617 - DNA, 1487 bp, Sorghum bicolor
  Clone ID: SORBI-28MAY03-CLUS7650_1
gcacgaggccccgtcgatcggcgaaaaaaaggctttaagcgagccgctagggtttagcagcttccactcttgagcgagggtttatccgcgagggggcggcgcgagggggcggcggcttgagctagggtttccctctgaccccgttcccttcccggcgaggcgatggacgaggcggcggtcgacgacttgatccggcggctcctcgaggcccgcggcgggcgcaccccgcggaacgcgcaggtgaccgacgccgacatccggcgcctctgcgccgccgccaaggatgtgttcctccaacaacccaacctcctggagctcgaggcccccatcaagatatgcggggatgtccatggacaatattcagatcttcttcgattatttgagtatggtggctatccaccagacgcaaattatctgttcttgggtgactatgttgatagggggaaacagagcatagaaacaatatgccttctgttggcgtacaagttaaagtatccagaaaacttcttcctcctcaggggaaaccatgaatgcgcctcgatcaaccggatatatgggttctttgatgagtgcaagaggagattcaatgtccgtatctggaagatattcactgagtgctttaattgcctccctgtggctgcgcttattgatgataagatcttttgcatgcatgggggggttgtctcctgaacttaagaacatggatcagatacgtaacatttctcgtccggtggatgttcctgacgttggtctcctttgtgatttgctatggtcggaccccgagaaagagcttgatgggtggggtgagaatgacaggggtgtttcctacacatttggagctgatatagttgccgagttccttcagaaacatgatctagatttgatctgcagggcccaccaggttgtggaggatgggtatgaattttttgcaaaccgccagcttgtaacaatattctcagcaccaaactactgtggagagttcgacaatgctggtgcactgatgagcattgatgactccctagtatgttcgttccagattctcaagccttcagaaaagaaaggaaaagcaggaacttccaacatgtcaaaacctggaacacctcccaggaagataaaaataagtgttactcgaatttagccagattctcgatatcaaattggatttgagaagttgtgattaagtgctcccccaaacttgttatggtagggtttttggtggtcttaacatggtgttaaactgtggactgccgtgcctcatgtctctgatcaagtctgatgcgaatgtatcctggtgtggactgccgtgcctcatgtctctgatcaagtctgatgcgaatgtatcctggtgttttgccagccaaaaaagatcatgctaacagaaactttcggttcttttttattgtggtcgtaagttcttattgcccaacaaaaggaacacgtttattttgggtggcattgtttgcggagattgtgccttttgtacttaa

SEQ ID NO: 11618 - DNA, 515 bp, Sorghum bicolor
  Clone ID: SORBI-28MAY03-CLUS7533_2
ggcgaataacttcaataatcctttttagtaattatctagggataaatagaatattagaattacctttatctaacctcttgtgttcaagaggaatagcttaacccttgaactttgagctgtccactgttcaattcatctctgttactctgtatggcattcaagcagagtgttaaagctgaaggtcagagaatattttttcacttatcccatatttttgtttaaaaaattgtatgctgtattgctgtgtgcattagttgtgttgcttccgggtattggttgtggcatgttattttgttaatatagttttaatatgatatacagatcttgacttccatatcaacagttgatgatctgaattaccctgaaaagacagagacctattatgtagtcaatgttccgtacatattttctgcttgttggaaggttgtgaagcccttgttgcaggagaggacaaaaaagaaggttaaagttttgactggctgtgggagagatgaacttctgaagatatggactac

SEQ ID NO: 11619 - DNA, 905 bp, Sorghum bicolor
  Clone ID: SORBI-28MAY03-CLUS7533_1
gccggccgggccgggaattttgcctaggctgacacaacagtttaggcggcctgttacccagtgtataaaagttctggatatgactggtttgaagctatcagcactgagccaaataaagatcttgacttccatatcaacagttgatgatctgaattaccctgaaaagacagagacctattatgtagtcaatgttccgtacatattttctgcttgttggaaggttgtgaagcccttgttgcaggagaggacaaaaaagaaggttaaagttttgactggctgtgggagagatgaacttctgaagattatggactactcagcacttccccatttctgccgccacgagggctctggatcatcaaagcattcatctactgacgtcgacaactgcttctcccctgaccatccattccacaaagaactttatgatcatatcaaagagcaagcctcgcgcagggagctcatcaagatgggatcattgcacgtcagcattcccgagccagacccagatgacgcgaagatcgtcgaggtcatccaggctgagttccagaagatcggcgagcaggatgagtccccgaacggccacaaggactagcatgcccccaaggatggtcatctggcggagcgccttatcctatgccggcggtgatgaccgctgatgaagttgatcactgctgctcgtttctgtattttggttgacagtccccggttacctggggaatatagtggcaaagtcttgcatttgcatgacgcaggattgaatttatagttgcagaggctgagagataaaccagtcagtgtatgtatattagatgcacatgatacatgaagccataatcacctttttgttagtatataaccaacacatatatttagctgtttaaaggaggaaattcagggaagcgtct

SEQ ID NO: 11620 - DNA, 1208 bp, Sorghum bicolor
  Clone ID: SORBI-28MAY03-CLUS7676_1
aaagaaaaaaaataaagaactagaaatacctctttactggcccaaaattataagtacacatacattattgattgatgagaaataagtaacataggacaacccccaatttgtgggaagttgaggaaatcaaatacaacacaggagcttatttgaccttcctctgtttgctgatttcttcaaaaccagcatccacaaccgattgatgactgtatatgaatacaatacaagcttgaattgttgtcatgctttcttggtcttgggcttaggtgccggtggtaggaacaccgccctaaaaatccatccagcaagcaaggccccaataaaggggcatatccagtacacataaagctgctcccatgtgttgtgccaattgttaacatatgcccagccaaatgcattagctgggttcatggacggtccggtgtccggtgcgcctgcgacgatgagggagacaatggagactgagatcaacaagatcctgaggatggcgttgcgggggcccttgacgatgacccagagcacggccagggtgacgacgaaagtgagcaccccttccgcaagggcgcctgtgtggggatccaccttgagcgaggggcccgcgagcgtgtgcttgtactgcgccggcatcagctccgatatcgccagggcgccgcccacagcgccggcggcctgcgccgggaagcggagcgcgacggagaagagggaggggctgtcgagtccggcggcataggaagcggcgaagtcggtggggttgaagctggcgccgccgagcgcgccgcagaggcggtcgaaggcgaagaggagcaccgcgaggagggacgcggtgacgaggagcgcgtagtggccgccggcgccctcctgcacccccaggcacgacgtgacggccgccgtggaagcgccgagcgcggaggcgcacagcacccacaggaacgtcaccacggcgtccgcggccgccgcgcgaaccgccgctcccatcgccatcagtccgcgccggcgccggccttcctcctgctgccgcgtttgcggctcgatcggaagtacaagattggattggggtttaggaatggaaacggcagctcgatcgatcacgcgctccggttgacggagaggggtacccacgacgagcacgctctcgccgtgcttctccctctgactgactctgttccccctcccccaagtccaacaagataacgacgacccatccagta

SEQ ID NO: 11621 - DNA, 703 bp, Sorghum bicolor
  Clone ID: SORBI-28MAY03-CLUS7677_1
atgccatccgccgatctccacccaaatctctatcggattcggaatctcctgatctccagttgcccaatccccttccaatctccatcgtcgccgactagtaatcaacacgcgaaatgcatccaatcctcgccgggatcccgcagtctctccggcccgcggtgctgatcgcctcgacgtgcgccttgctcctcctcgccaccgcgctgctcctcccgcgcgcccctcctcccccgccgccgctgctgaccactgacgcctccgcctccgcctccgcctccgcctccgccgacgccgacgccgtccgcctcgacgcgcgcgtcgcgcgaaggaacggcaacgaggtgctgtggcagctgccgcggccgtcgtcgccgctgcgggccgcgctgttcgcggcgcccgggtgcaccatccgcgccaccgacttcttcgacgcctccccgggctgcccgcgctgcacggggctccccgaggagcgccgcttcactcgcgaagcgctcagccgcgggtacgccgtcctcgccgtctccagccgcgccaagtgctggtccctcgacgacgacgacgccgccgccggcggcggcggcggggccggggaggatggcagcgagctcgccgccgtccagtccatcatcgagtggtggaccacagagaagtaccctcagctcgcgggcctccctctcgtcggcatcggcgcgtcctc

SEQ ID NO: 11622 - DNA, 947 bp, Sorghum bicolor
  Clone ID: SORBI-28MAY03-CLUS7024_1
cccgtctggagcgagctagccaggctgccatggctgcggcgaacgcaggggacgtggatgtggtcgatttcgactccgacgacgacgacctcatggacgacgacgccctcgaggcctacccggcctccgcccctcgcctccgctccaccatcgcggccagcggagattcctccgctgccgcgcgcaagaccaaaggccgcggattccgcgaggagccttcctcctcgcggcccttagccggccgctccgacttcgactccctcggctccgactatggccctggacccctcagatctattgaggggtggattattttggtaactggcatccatgaagaagcacaggaggatgatctccataatgctttccgggaatttgggcaggtcaagaaccttcatttgaatttagatcgtcgtactgggtttgtcaaaggatatgctttggttgaatatgagagcttgatgaagcacaggctgcaattaaagcaatggatggaactgagcttgttacacagataataaatgttgactgggcatttagtagtggcccagttaagcgaagaaatgttcgctggagatcaaggagccctgtcaggagaagatactgaacttgctttcttcacctaatcacagggagtgcttatgtgatgaatattgttcgttttctaggctttgcttctcaactacgtgagtaaagttggatgcacgatggtctggcttccgttttcaactttatgcagtatgagtgttgtatgtcatttcctactattttggtgtatgtgggtgtgtgttcaaatataccatattgccatgagcactattagtctctggttgtaattgtgatactggagtggatgcctcgccttttttgttatctgtgttaccgcacgcccattgtgccacgtgtaggaagacaatgtaatgtcaattcatggttacctttttttt

SEQ ID NO: 11623 - DNA, 584 bp, Sorghum bicolor
  Clone ID: SORBI-28MAY03-CLUS70322_1
gcacgaggccccaaacaagaactcacaatcaacttcagtcccgtagaaggaatttggaaagcaaaagtgcacctctgagagttcaactactgcagcttgaatggcaacgcccaagctgtccccggtctcaccggtgcggcgggacgacaagccgtgcgcgccatcctcctcctcgtcgactgttctgagggtgcaggacgcgtccgcggccgaggcgtacgagcagtacctacgcctgccggagctgtcgagcctgtggaaggccgggtgcttccctgagtgggcgggcgagggcctggtcaagccggcgctgcaggcgctcgaggtcaccttccgcttcgcgtccctcgcgctctccgacccgcgcggctacgccagccgccgcgagctcgcgcgccggctcgagtccctcgcggcgcgggaggtggagctggtgtccgcgctctgcgagggcgacgaccgcagcgcgccgctcgccgagctgagcgcctccgggggcgtgctcccgcgggagcgcagcgcgtccgaggtgtggcagctgcccgggagcgccgccgccgtcgtgtgccatgtcagcgaggcca

SEQ ID NO: 11624 - DNA, 794 bp, Sorghum bicolor
  Clone ID: SORBI-28MAY03-CLUS71004_1
gagtccgtcgtcgtgtagctcccccatcgtcctcgttcctccgacctctcacaccactaaccccaaccaccgccacctatcacccagacaccaatcactgcaagcgcggccttccggtcagatccgcgcggccgtgcccgccgaccggtccttctgcctagtttctccgcccagcgggtggcgagctcctcggagattcggctggtcgcgggaatccatttgtgcccgttcgcgttgcctgtggatctggtttgagacggaggagagaaagcgcggaggtgatcgtgtggggtgggacgccatcagtgctctgtctggggttcggcctgctcttcggctgtagatctggaagggtttcgtgggatcggtcgctacaagctgttccagtcagagcacctgcatcatctcgggccatggcgactctggtcatctcggagcagcgcagccaccagctacaccactcctcgggtcgccggaagaaggcgtcatcagcgtcgccccatttctcatcgcctcagtccacacgcggctaccatgctggcaactgccgggccttccattcgggcatcaccatcggcatcctgccgtccccgcccacgcagggggttgcacggacccgctcctcccctgagcccaagacaccaaaacagcaggctcaccatgggaaaaagcgcagccgagcaatctctataagcccttcgacttcccctccctctcgccctgagctctgggctggccccgggttctgcaattcgccgcctcctagctccctcccaatacccaagttctccctc

SEQ ID NO: 11625 - DNA, 681 bp, Sorghum bicolor
  Clone ID: SORBI-28MAY03-CLUS71032_1
caacatccctccggccgtcaaccaggtggaggtaaacccatgctgccggcagaacaaactgagggtgttttgcagggagaaaggaatccagctctgcgcctactctccattgggtggcaagggagcaccatgggccaacaattctgtcatgaacagccctctcctcaggcagattgcccttacaaagggtaaaaccgtcgcccaggtgtgcattaggtgggtgtacgagcagggcgattgcgtgatagctaaaagcttcaacgagaagaggatgcgagagaacctcgacatctttgagtggcaactcacggaagacgagtgtcgcaggattagcgccctcccagaatcgaggggaacctacgatttcttcgtccatgaatctggcccgtacaaaactgcccaagagttttgggatggtgagattgtggctggccaggctaacaatgatgctttgagtttggatcctaccaattgagaccagcatgctaggttactactagtcaagaaaactctatgctttcattccgtttacaaggcatcctgcactatgtttttttatattttgcgtatccttttaatcttggatatatgcaaacttttagttacagaaaagctactatttgaagatgtttttctataaagaaataatattgttaattcgcaattattatatcaagttca

SEQ ID NO: 11626 - DNA, 1629 bp, Sorghum bicolor
  Clone ID: SORBI-28MAY03-CLUS7874_1
gcacgaggcgacgagaagccgccggcgccggcgccgacgggggcagtggatgtgaagttgcggttcccgcgccggcccggagagcctgactgcagctactacctcaagttcggcacctgccgcttcgggatcaagtgcaagttcaaccaccctgcgaggaagaagaagagtagtagggtgagaggcagtgggagcaacagcagcagcagcacggcgtcgtctcctgatgatgatcaggctcctagagaagaatacgaaggccttgttccagacatttcggattccatgggctttgatgacaaggggagcttatctagctcagaaatctataggaagatgtcatatgaagttattgatatggaaagagggaaactagagccaaaggagaaggtttgtgaagaacctgaaaagggtatttattttatgaagttagatgagacaaatatcacaacccaaaagggtgctaaagataaaagaaaggaaacctttgcagaaggcaacgctcaggaggaatgcaagtattattcaacatctggaggatgcaaatttggtaaagcttgcaaatacctccaccgtgagggaaaagaagcgaaaacagaggttgaaaaagctgagctgaactttctaggtcttccactgcgaccaggtgaaaaggagtgtccatactatatgcgcactgggagctgcaaatttgcgactaactgcctgtttctgcgcccagatcctactaacgcgtcttcaaaagaaccagggttggaacatgagaatgcggatacaccactgcaaaatgtccaaggatcctgtcagcctagccttcagatatggcctgatcacagaacattgaatgaacagcatgttccttttctagctccagcacagtcatacggtggaggcatggttccacctcaaggaatgtatccatctcctgattggagtggatatcatcaggtacctttgaatccatattaccctcctggtgtcccttttccgcattttccagctgcccatatgaatcacccgatgtacaaggctgcagatgtaccaggaaatcaaccaccaccttctgatgagtatcctgagagacctggccaacctgaatgccagcattttattaagagcggtttctgtaaatacaggatgaaatgcagatttcaccatccaaggtcgggccagtctgcacctctaacaggtcttagccccatcggcttgcctatcaaacctgatcaacctgtgtgcacgtattatggccgctatggtttttgcaagtatgggccagcttgcatgttcaaccaccccttcaacttcggtcctcctgtgccggcagcaggaccacccctccccgggcaatacccaacacctggaaacttcactgtctagcaggcatgggatgagcgatttttctgaggtcaccatgaatgctcgtaataacttccacttgtaaaatagcgtagacaagctgtacgtggttggcggtagacatccagcatgtaggcgcaacaaagttgcatggagctgggtacattacagttggtattcatggaaacggatcgaacctgtgatagtattgcaaactttatgctgtacagcaagttacagttcgtacataatctgccattgcatttagaatcc

SEQ ID NO: 11627 - DNA, 728 bp, Sorghum bicolor
  Clone ID: SORBI-28MAY03-CLUS797_1
ctttgatcgaagagtagaaagcttgattgatccaataataatcaacgttggagtatacattgtttgcacgaggattagcagcagcatgatgacgagaaaagtggccggcggggaggcggaggagatgaagcggaggaacgccgagctggagagggcggtcgcggaggcggcggcgagggaggagcggctgcggcgggagctggaggcggccctggcgcggctggcggtggccgaggaggccgaggagcgcctgtgcgtgcagctcggcgagctggaggccgaggccgtggagcaggccatcgagtaccaggagcgtgtcagggcgctgtccgagcgcctcgccttcgccgacggcgtgctcaggtcgtccgggatccggggcttcgccgccgccggcgcatccacctcgaggatggattgatttgatcgatgtgtgtgtacgtacgtcatcaccggcaaaactggctgcgtgctccgatcctcaacgatcgacgggtattagtagtggcctaaattaaagggacgtgtacattttgttaattatttttattatcgtccaccacgttgattcatgtgtggcgtaatacgtgtgtatattgtctggagtttatattattagcttgagagatgtagacaaggttgtaaagaaatcagtggctactgatctgctttctacttttcgctggtttcattttaatttatatataatataagaccggacggatcgg

SEQ ID NO: 11628 - DNA, 1173 bp, Sorghum bicolor
  Clone ID: SORBI-28MAY03-CLUS8116_1
ggctcctccggttgccggtcatcccgtttacccagcggccagctcgcgctctcttcgctctacctctcgtggcctttctttcctagcggcgacagctgggctagcggcgccgccaccgtacgtcaggtctccgttgggtgtttgatggcgattagcacctgtaaggtactctaggccactttctcattaaggtagtactgagttccttgcttgaccatgacttctgaagatggagacattttggctcttctgtctgagccaagcctaaaagaagagcaacttgaggcttctgaatctgatgatatatttcctgctattatggaagccattaaatcaaataagaatgtagttgaactttcacctgaggaagctgcctgggcagattcatgcttcgtgcagacttctgaactgtcagatgatgactggggagcgatgaggaatgcgttgcttgatgcccttgaaaggccaacagaaagtcccgatgatatttcaggaagtgcacataatgcaatctcagaggcaaaacttcactccctccctgctgaaaacatttgtgagcatggtgacatccacatggagcaaataaacaattccgatgatgaccaggatggaattgaagcatgtgaaattgctgatgtaatcagaggtgcagaagaacatggtaagcaaatggatagttatgtagcagaggcaggtgatgagttggcttcatctgaagttcttgagcagacccagtcaacaggttctatatttagggtttgggacctggaggtacctttttctgatgatgatgatggcgagcttgaactcattaaagatctgaagaagctcctcaaggagaaggacagccttccagaggatgtatatccaactcttcctccagatgatgcagccaaacccttgagccagataagcatcgatgaacttgtggcaggcttgagcgacttgtcaatacagcgagccaatgagtgactattgtttctcaaatagctgtgtagcacaccttggccgtccaggtgatattgtgtttttctctcaagagtgtgcgaatcacttgggattttaaaaacttcaggtttaggctaactgttgtgtgctgtctgttcgttctgtatgcgctgtgtctatttctgcttaacttgaaatcagcccacaaaatgaagatgttttggt

SEQ ID NO: 11629 - DNA, 695 bp, Sorghum bicolor
  Clone ID: SORBI-28MAY03-CLUS8118_1
cgccccactctgtcagtctcactccccgcgcgcgcgcgcgctctccctccctccctcctcgcctcgccgccggcgacgagctcgagctcgagctggttcctcgtatagaagacggccaccgcggtatggagcccatgaacgtagacaacggcggctgcggcggcctggacgcgcagatcgagcagctgatgcagtgtcgcccgctcgccgagcaggaggttaaggcactgtgcgagaaggccaaggagatattgatggaggaaagcaacgttcagcctgtcaagagtccagtgacaatatgtggtgatatacatgggcaattccatgatcttgtagagcttttccgaattggcgggaagtgtccagacaccaattacttatttatgggggattatgtagatcgtggctactattctgttgagactgtcactctgctagtagcactaaaagtgaggtacccacatcgaattacgatccttcgtggaaaccacgagagtcggcagatcacacaggtctttggattttacggtgaatgcctactaaggtatggcaatgcaaatgtttggaagacttttacggtgctttttgtttttgttcctcggacagctctcgtggaatctgagattttctgccttcatggtggtctatctccatcacttgtcattctgctcagtctgcgccgcttagatcgagtc

SEQ ID NO: 11630 - DNA, 660 bp, Sorghum bicolor
  Clone ID: SORBI-28MAY03-CLUS81565_1
cgtgcatcggcgatggaagcttccaggtgacggcgcaagacgtgtcgacgatgctccggtgcgggcagaagagcatcatcttcctcatcaacaacggcgggtacaccatcgaggtggagatccacgacggcccgtacaacgtgatcaagaactgggactacacggggctcatcaacgccatccacaacggcgacggcaactgctggaccatgaaggttcggacggaggcggagctcaaggaggcgatcgccacggcgacgggcgccaagaaagactgcctctgcttcatcgaggtgatcgtgcacaaggacgacaccagcaaggagctcctcgagtggggctccagggtctccgccgccaacagcaggccgcccaacccccagtgagctatctagctggctcatgctcatccatcggcctcttcactccagcgtttcctgcgctgcaacggcgcctccttcgtctgcctgccgtgaaaacgtccggttcattttcagtcagttattagttcgtacttccctgctgatggaagctgctgccaatctttatcctatttattatttcctatttgtaattcagttgtttggaattgagttctgttgtaaattttgcaagttgcatttcctgcattaataaaattcatggtcggaaaagatttcg

SEQ ID NO: 11631 - DNA, 844 bp, Sorghum bicolor
  Clone ID: SORBI-28MAY03-CLUS8206_1
gccggccggccgggagaagccgctcccagcaactcatttctttcttcgagagagggcaaatcggcaaggggagcgcagcggagagcaagggagcgggtgacgtcatcgtcctccagggtttctcgatcggcggcgatggcgaccagggcggcggcgaggttcctgcagcgcaggctcctgtcttccggcggcaaggtcctcagcgaggaggagaaggccgccgagaacgtgtacatcaagaaaatggaacaagagaagctggagaagctcgcacgcaagggacccagttcaggacagcaagcttcatcaaccacaggctctgcagcaaatgatgtgaaggttggcgctgggccaacagagtcagcgtctgcaagtgtgtcatccgacaagaacaggaactacgctgtcctggcaggcacagttgctgccctgagtggtctgggttggtatctattgtcaaagcctaagaagtcggaggaggttgtggactgaagaggggcttgtgaatgcaaactgcggatggtccttattcaccttggtttactttctgcgcatagactgcaccttctggaaataattgttgaaatgtactctgcactacttctgttttgaggccagtttcatcaccaaaccttgaaatacactcgagacgttcagtagtagccctcgcttgacagattgcaatgttgagtgatgcttgtaatgctgcctacattgtttgctggagaggtttttgggtactgatgttttgaatgtaaacttgttgccactggcctggcgtagtgcatcctatgataatgaggctctgtttagttcccaaaaaaaaaaaaaaaaaaggccccta

SEQ ID NO: 11632 - DNA, 1050 bp, Sorghum bicolor
  Clone ID: SORBI-28MAY03-CLUS8222_1
gcacgaggcggcacgaggataagtttcttcactgacctccttgttgttggtgagaaccgccaaacgtttgatctagaaggtgatagtggaagccttattatcctgactggccaggacagcgagaagccgcgtcctatcgggataatatggggtggaacagcaaaccgtgggaggctaaagcttaggtgtgaccatggccctgaaaattggaccagtggtgttgaccttggccgccttctggatcgtcttgaacttgatcttatcataaccagtgaatcactcaaagatgctgtgcagcagcaaaggcttgcgatggtggccgcagcgaactctgctgttggggagtcgtcaactgcagctgttcctgtcccggaagaaaaggtggaggagctctacgagcctttggggattaaaattgagcagctgcctcggcacgacgtttcagcctctgggactgaaggggaggaggcagctgtggtcaacgtggaagagcgccagttcatctcaaactttgtgggcatgtcccccgtgcgcggtgaccaagatgctccaaggcaaattgccaacctgaacaatccatcagaggaagagctcgccatgtcgctgcacctaggcgaccgggagcccaagcggcttcgcacagacacagaatccgacctcgacctggagaagtgaagctctcagttcagcgtctctacattgagaagtcataagtagttcgaaggaggtcacctgtggttcagcaaactgaacctgcaggctgcagccgtagcttaaaccagcagcttcctggcgcaagcgttatcatgtactatggtgcaacttgattcagcacttgtaggatgttaggcggtatcccctgcagttttgctgtgctcatgagacttgatatgcacaatgctgaatacccctatcatcataaaacaatgcagggattgatgaagtggtcttgatgactttttctttcgtagtaccattatcggtggaaattttcaagatcagtagaccagcttcttgaaaccttgtgttttcagtttatgaagtattctt

SEQ ID NO: 11633 - DNA, 707 bp, Sorghum bicolor
  Clone ID: SORBI-28MAY03-CLUS73606_1
gactttccttgactcgatcgttcttcctactcgactgtcacactcgacgcaaccccttcgatggctcaggcacgcgtgcgccttactccggccgcctacacgccggccgccgcgttcctctcgggctccaaccccagacccgcccacctcaccttcttcccgaagctcaccccgacctccatctccgcaaccgcggctgccaatgcgccgccgccccacatcgtcgtcgtgggctctgccaacgccgacatctacgtcgaggtcgaccgcctcccgctaatcggcgagaccgtggcggcccgcgcggggcgcagcctcgcgggcggcaagggcgccaaccaggccgcctgcggcggacgcctcgcgctgggtcctacctacctcgtggctcgcgtcggcgatgacgcaaacggccgactcctcgaaggtgccctagccgacgccggcggtgtccgcaccgaccgcgtcgcgcgcgcggccgatgcgccatcgggacacgccgtcgtcatgctcatgcccgacggccagaactccatcatcatcgtgggcggggcgaacatggagggctgggcggcggggatcggcccggaggatctggaattgatccgaaaggccggcgtactgctgctgcagagggagatacccgattgggtcaacgcgcaggctgcccaggctgcaaaaagtgccggagtgcctgttatcatgga

SEQ ID NO: 11634 - DNA, 721 bp, Sorghum bicolor
  Clone ID: SORBI-28MAY03-CLUS7378_1
tcgccggggcgcggcccgtgccctgctgggcgggctggtgcacatcggcctgggcgacccggtggtgaacaagtgctgcccggtgctggaggggctggtggagctggaggcggccgtgtgcctgtgcaccaccatcaagctcaagctcctcaacatcaacctctacctgcccctggcgctccagctcctcctcacctgcggcaagacgccgccgccgggctacacctgtaccatctgatctcgatttggctagcaacccccatgcatgtgcatccatgaacatgggttctggagtgagctagcattctttgttcggtagagattgaagagagatcgacatgagaggatgtcgtctgcttcgttcctagctagctgaagggctccgatccggcagaggaaagaggacctgcaggtcgatcagctaattaacgatggatcgaccatttcccatgtttattgtttgtctctgttgtggtttctactttctagatgtgttttcagtttggtctctcggtcgattcgcagcttgatgttttggttaagcttgatttgatgcaagaggggttgatggttgattgttaataattcccgttattttccatgaaaagggcatgaactcggtcatgattgagagctgggagctggaagaaacatattgttgttgcatgcattcttcggttctgggcttcacttgttttttatctgctgtggtttaatttat

SEQ ID NO: 11635 - DNA, 1059 bp, Sorghum bicolor
  Clone ID: SORBI-28MAY03-CLUS7310_1
caaaatgctcaaacagtgatgggattggtaggaattgtgtgtactctcctgtattggaggacttaaaatacgaaggcatcattcactttcgtaagcattggataaacgcggagcctgttattatcaggaaagcatttgagccttctctatcatcaagctgggatcccttgagtatttggagaggtatccaggagatcatggatgaagaaatggatgaagatgtcgtgttccgcaacatcacgggcacgtcgtccacgccacaggccatcagcctgctctgctcgcagtcacagccatgcagcggcgtgtcgctcatcgatgtaaacgtggagtacgccggcaagaacaacaagaccatggccgtgtgcagcaacgccaagggcaccgccaagggcagcgtcgaggccctggcatgcctggcctgagcgatgagcatgcatctgcatgcatgttatgtgtttcctcaaacgatgtgatcatcatctggtagttttctagttctcgcttttgcaaatttgattgcgtttaattcacaaatggtccggccaggcatcgaccttttctgatcttccctgcatgtgcagtaaatgtatatctgcaggcacttcaatggtgtggacgacgcatatatatatgtccgggcggggtccgcctcccctggctgggtcttccgtagctttatggacatctggccgttctgcgggatgttttcgcccctcgatgtcgtggcgtgtcttctggtccggacccgttttctgctctatctgtgtaccttaacgattatcataagaagatgttgaaggatcaatatggaattgaacccatcacatgtagatatcaagctcaaacagtttatcaaaggctactcagatggcagcaaaggaggagatggtcacttgttgatgctgaaattgaaagagtgtccccgacccagtgtcttgtaggcgtttttgttgtgccaaagaccagaatttattgttaactttccttttgttgattttattcattctagatggggtctactaaaccttgttgcctagttacccctacatgccttac

SEQ ID NO: 11636 - DNA, 323 bp, Sorghum bicolor
  Clone ID: LIB3476-032-P1-K1-B7
cttgagtatttggagaggtatccaggagatcatggatgaagaaatggatgaagatgtcgtagtcaaggctgtggactgctcgaaccaatcagaggtagatatcaagctcaaacagtttatcaaaggctactcagatggcagcaaaggaggagatggtcacttgttgatgctgaaattgaaagagtggccccgacccagtgtcttggaggcgtttctgttgtgccaaagaccagaatttattgtcaactttcctcttggtgattttattcatcctagatggggtctcctaaaccttgctgccaagttacccccaaatgccttac

SEQ ID NO: 11637 - DNA, 800 bp, Sorghum bicolor
  Clone ID: SORBI-28MAY03-CLUS7402_1
gcacgaggcatcggccggttgcggcggcatcctgcatccataggactctcagattcccatctcgtctccggatctccacttctccctccacacatcccctcctccgtcgtcctctgtttataaaactcgccaggcgtccatcgcttccgcttcggcatcagcgacggccgccaccaccgctcccctccctctcctcctcctcccaccgcggccattaccacagcctcgccagcaagccgggatggctgcactcaaggcgtcgttccggggggagctcagcgccgtctccttcctcgactcaagcaggggacctttcgtccagcacaaagtggattttacgtttcaaaggaagggcaaacgagctatttcactgagaaggacatgctgttctatgcaacaggctccaccgccagcatggcctgggagagctgttgctgagcctgaccggaggtcatgggatggcccaaagcctatctcgattgttggatcaactggttccataggaacacagacattggacattgttgctgagaatcctgataagttcagagttgttgctcttgctgctggatccaatgtcacgcttctagctgatcaggtcaaaacattcaaacctaagttggttgctgtaagaaacgaagcattagttgatgaactaaaagaagccttagctgattgcgaagagaagccagaaattattcctggggagcaaggagtcatagaagtcgctcgacacccagatgcagttacagttgtcacagggatagtagggtgtgcagggctgaagcctacagttgctg

SEQ ID NO: 11638 - DNA, 688 bp, Sorghum bicolor
  Clone ID: SORBI-28MAY03-CLUS86063_1
gcacgagggcactagcagtggcggcccccccgctcggcccccgcccgcgtgcgatggtcgccccctctctgccagccgcccgcgacagccccctggcccgtcccggctcccgcagcgcagctgtgaccggaggaggaagaagaagagtcagcggcagcgatcgacacaggagggggagcgaaaaaggtggccttttttgcagccgccggcgacaggactctagcgcttctcagctcaagcatctgcaggggatcggaggatggggggacgacgcagtagaggaggaggcgcgtcgggcctgctagtgtgggcggtggcgattgcggcggcggcggcggtgtcgcaggcgcagctgcaggtggggttctacgacacgctgtgcccggcggcggagatcatagtgcaggaagaggtcagcaaggcggcgtccggcaaccccggcgtcgccgcgggcctcctccgcctccacttccacgactgcttcgtcagggggtgcgacgggtcggtgctgctggactcgacggcgggcaaccaggcggagaaggacgcggcgccgaacgcgagcctgcgcgggttcgaggtgatcgacagcgccaagacgcggctggagcaggcctgcttcggcgtcgtctcctgcgccgacatcctcgccttcgccgcccgcgacgccctcgcgctggtcgggggc

SEQ ID NO: 11639 - DNA, 1000 bp, Sorghum bicolor
  Clone ID: SORBI-28MAY03-CLUS8138_2
gccggccgggccgcggacctcgattcgcgattccgcagtcgcccgaccggtgaagcgcagccgcgacgctgctcgacgcccgcccgacgcccgccggccgctggcgccgttcctgctcgccggcgacgagcacggcccctgctcacccgcgaagccacctgtggagcctgcgcgggcgcgcctgctcttccgcgacggctgaagccgcgaggctacgacgcccggccgcccgcgcgacgcctgcccgacgcctgccggccgctggcactgtccctgctcgccggcgacgagcacggcccctgctcagtcgcggagccgccctgctctggatccaactgtatcagctcaagatcaatattatttagatgagtaataagcttggaaacatgttctcggctctgtgtctggatgctgaagatgaccgagttgaagtaccacaggcgcctcccagcacagacgaaactgctccaagcaaacctgataaaaatgagcagaatgacacaactgcagtaaagtatgaggaggcagcacttgtatcatcatctggtgattacagaatgcctttggtatggatagacttggaaatgaccggtttggatattacaaaagatcggattttggagattgcttgtatcataacggatggtaaacttacaaaacaaattgagggtcctgacttggttataggccagagcaaagattgtttagataatatgggtgaatggtgcaaaactcatcatgcagctagtggtttgacagaaagagtgctgcagagtgaactttctgaacatgatgcagaggcaaaagttttagactttgttaggaagcacataaattcaggcactccattattagctgggaattctgtttatgtggatttactatttctgaagaagtacatgccacagcttgcagctgtcttctctcatgtaattgttgatgtgagcagtataatggctttatgcgtacgatggtaccccaaagaaaggaaacaaactcc

SEQ ID NO: 11640 - DNA, 771 bp, Sorghum bicolor
  unsure (1)..(771): unsure at all n locations
  Clone ID: SORBI-28MAY03-CLUS8138_1
accgggnccccccctcggattttttttttttttactaataggatacggttggctgatacgtatcaagcaacggatacacgtatcagatatggcccagcccattacggtcgccctaacgcacagacgcgcgacgccccgacctcgattcgcgattccgcagtcgcccgaccggggaagcgcagccgcgacgctgctcgacgcccgcccgacgcccgccggccgctggcgccgttcctgctcgccggcgacgagcacggcccctgctcacccgcgaagccacctgtggagcctgcgcgggcgcgcctgctcttccgcgacggctgaagccgcgaggctacgacgcccggccgcccgcgcgacgcctgcccgacgcctgccggccgctggcactgtccctgctcgccggcgacgagcacggcccctgctcagtcgcggagccgccctgctctggtcagccgcggagccgccctgctcagcctgctcctcttcttcagatttaaatatagacttccataattttatttttttattttatttttaatattaaacgtatccgcgtatctggttttttgggaaatcggcgtatccgcgtatccgtatccttccgataccgatacgcgtatccgtatccgtgcaacttaggatccaactgtatcagctcaagatcaatattatttagatgagtaataagcttggaaacatgttctcggctctgtgtctggatgctgaagatgaccgagttgaagtaccacaggcgcctcccagcacaga

SEQ ID NO: 11641 - DNA, 878 bp, Sorghum bicolor
  Clone ID: SORBI-28MAY03-CLUS862_1
tgtgggggagtgtgaatcctgaatttgtgttgcctttccacgatgccgcgcccgtctgttgtgtggaccctgttcgtttccagtggctgtcagggccggcgcgcgtggttgtggccaccagtccaccacagtttcctccgaacaaacataatcctagcactgcacattcataaaatcaaaactgaaattttaaattttaaatgtgcacatccttctaaaacttattccttaataatatgacacgccagcacattcagaagatcttgcatttctctatagctattttcatattccaatcacattctttgcggcccttctcatgaataatagtgcaagagcctttcttttggtacgaatagtctaaattttagtagatgtacataaaggtagttggtttgagctttggatcaacttcttcattgtgctaatctgcaagtacattgggaatcagacattgtgctctgtagctggacggtgcacaacaggcttgtaaacttggggcgccacggcgaaggacgctaacacatcctagcatagttgccaacacatcatagtatagttgctaatatatctgttgtatcctaccctttgttgtgcaaagcacacttttttttttttattttgcccacttctcaactttagcagctttcatcttttgtaccgtgcacgcctccccttctgcaggtttcaatctgtgttgcgcgtgcctcaatgaccttcaaccttttcgaattacatccctctcccctcttaaagctaatggtcccattaaaatccaagttatgtttcatacatcgtttagtaagaatgggcccgatccttagttgttggagaagaaacgatagtgatgaacaactatcaatttacctaaacatatt

SEQ ID NO: 11642 - DNA, 1333 bp, Sorghum bicolor
  unsure (1)..(1333): unsure at all n locations
  Clone ID: SORBI-28MAY03-CLUS8863_1
ccaagtgctgaagaggctcttgctgatccttatttcaagaacatagccaatgtagatagagagccttctgcacaggctgtcacaaagcttgaatttgaattcgagaggcggagagttacaaaggaagacataagggaactcatatatagggaaattcttgagtatcatccaaagatgctgagggagtttcttgagggaactgagtcaagtggtttcatgtacccaagtgcagtagaccattttaaaaagcagtttgcgtaccttgaagaacattatgccaagggatctacaggaactccacctgagaggcaacataattcattgccacggccttctgttgtctattcggacaaccgatcacaaaccacagccaacatcaccgaggatctttccaagtgtataatcagagaaaatacacaaaagccacatcaacattctgcttatgttgcaagtaaatttccaccccatgttcctcaaggtgttgttgcaaggcctggtaaagcggttggttcggtgatgcagtacaacccctatccagcatctgctgccgagcaatatgagcaacgaagaattgctaggcacccagcagttgccccaaacaatatcccttctggaagctcatacccgagaagaagtcagacctgcaagagtgagacaggtgatgctgaaaggatggatgtgaaccaagctgggcagccaaagccatatgcagcgaacaaattaccagctacggttgatggtcgtggtggccactggtagaatttcntgcagtgcaccagcaaaccatttcaatccatttcttaacatgttatcagtatcgactacttatgctaagcgctacattattctgacaaaattcagaaatgtagttctgtacagatttatattctttgtcaggatacctgaatacccaaagactgtagaactgtactctttattgctgatttctactccttgttgctattcaatcacaaaaagatacgtgcctggtggagaggatttgccagactgaagtatagtgggaactcactggcagcagtgggatctcagtgcagagttcttgcctgacgttgtcatggacttgttcttcaatctggtagccctgaagagtaactaaatagctagtatttcctgttaatcatctacagtcaggcgcggaatgttttgggagttaggagctgctaggtctgaatatgaagtaattgctgtaatctgcacgtttctgagctcctaacttctgagcatgctactactgtattatgtaatttaatcaactgtactattcaataccatgtttacatttataacatgttgcgaagaaactattatgtgg

SEQ ID NO: 11643 - DNA, 634 bp, Sorghum bicolor
  Clone ID: SORBI-28MAY03-CLUS8873_1
gcacgaggccccgctgtgtctgcgagtgcgcatccttcgtccccttccagccgccgtctccctcgcccggtcgacggcgaaactggggtccacggagctggcgcgtccaactccgacccacgaagacctccgtcgacggcggcgaaaatagggccgactcctagaggtttcacttcacaggttcatcaaacaccagttgtggagacagcgccgccgcttccaatcgccggtgctctgtgccctgcggagcccccaccgcggaaaccggttggtgcgcgtgcgtggagcggaggccatggcggcggcgaaggtcaaatcggtcgccctctccgtcacccacaagtgccggaacatcttggctgccggttgggaagcccacctcaacactgtcaaggccgatgccaagggaagcaatagtgagatttactcgtcgagggtgcactacatgatccagaagggcacgccctacctgattgtccctgagaacgacatgcacaacattaacattataatcgacgagcgggggtctcttgcagtatgcagtccgatccggggccgagttgcaggcttattgaagtcactgaagaagacgcctcctcgtgttgctatgactggtgatgttctgcgactgaaa

SEQ ID NO: 11644 - DNA, 1293 bp, Sorghum bicolor
  Clone ID: SORBI-28MAY03-CLUS8816_1
cctcgaagtctgcgctgcgcgcgagccacaccgcccgcacaggcacaggagatcccatccccgcacacggcacaccccaccggccacacacgcaggcaccgacggcgactcgaggatgacggccggccagccgctgcgcaccgagccagcagcccagcccccgcgggtgtaccacagcaccccgcccccgcccccgccgccggcgctccaagcggacatcgtgccgtcgtacccgccccccgagtctgacggcgacgagtcctgggtctggtcccagatcaaggccgaggcgcggcgcgacgcggacgcggagccggcgctggcgtcgttcctctacgccacggtgctgtcgcacccgtccctggaccgctccctcgccttccacctcgccaacaagctctgctcctccacgctgctctccacgctgctctacgacctcttcgtcgccacgctcgcggcgcacccgtccctccgcgccgccgccgccgccgacctactcgcggcccggtcgcgcgaccccgcctgcgccggcttctcccactgcctcctcaactacaagggcttcctcgccatccaggcccaccgcgtcgcgcacgtgctgtgggcgcagcaccgccggccccttgcgctcgcgctccagtcccgcgtcgctgacgtcttcgctgtcgacatccaccccgccgccatcgtcgggaagggaatcctcctcgaccacgccacgggcgtcgtcatcggtgagacggccgtcgtcggcgacaacgtctccatcctccaccacgtcacgctgggcgggacgggcaaggcggtgggcgaccggcaccccaagatcggcgacggcgtgctcatcggcgccggcgcgaccatcctcggcaacgtcaggatcggcgccggcgccaaggtcggagctgggtccgtggtgctcatcgacgtgccgcccaggagcaccgccgtggggaaccccgccaggctgatcggcgggaagaagggggaggatgtcatgccaggggagtccatggaccacacctccttcatacagcagtggtcggactacatcatttgagcttcagccccgcaaccgcaaagctgcaaaagagcgagctcgtcttgctactgctattgcgtatcgtgtgtatgtgccgtttttagctgtaatttctttttgcagtgaggtgatcaggtgaaccgtgttggacatggtgtctagctcatctctggaacctgacatggagaaagatgtgctgaaagttcgctctgtaattttcgaagcagatgaacaatattctttttactctt

SEQ ID NO: 11645 - DNA, 586 bp, Sorghum bicolor
  Clone ID: SORBI-28MAY03-CLUS88948_1
agagatgggaatcgcctcctcctcatcatccaacccggaatcgagagctatggcgctcgccaaggccaaggagatcgtcgcctccgctcccctcgtcgtcttcagcaagacttcctgccctttctgcgtccgtgtgaagcagttgtttgagaagctgggagcaagctacaaggccattgagttggatgtggaaagtgatgggcctgagctccagaatgccctcaaggagtggactggacagaggactgtcccaaatgtcttcatcaatgggaagcatattggcggctgtgatgatactatggcactgaacaatgatgggaagctggtgcctctgctgactgaggctggagccatcgccggttctacctcaaagacaaccgtcactgcttgacatttgtgttaccgttcctgtgcttaaaataaagatgctttgcaagtgctgaacttgcagctgtcagatgctatctgggatgttggatccctgtgtacaaactgcctagacatcagtcgagtcgtatcccagtgcttgttgtgcactctactgccgttgctctgtttgtctttaaaaaaaaaaaaaaaaaaaaag

SEQ ID NO: 11646 - DNA, 714 bp, Sorghum bicolor
  Clone ID: SORBI-28MAY03-CLUS77224_1
gggtgcaggctgtcggtggccccgcgatggcgttcgacttcactaccaagggcctgctgcaggccggcgtgcagggggagctgtggcggctgcgcgacagctccggcaaggcggctggcatgatcgggtggatgccggaaaaggctgtcaccttcgtcgacaaccatgacaccgggtcgacgcagaagctgtggccgttcccgtccgacaaggtcatgcagggctacgcctacatcctcacccacccaggagtcccctgcatcttctacgaccacatgttcgactggaatctgaagcaggagatatcgacgctgtccgccatcagggcgcggaacggcatccacgccgggagcaagctgcggatcctcgtcgcggacgccgacgcgtacgtggccgtcgtcgacgagaaggtcatggtgaagatcgggacaaggtacgacgtgagcaacgtgatcccgtcggatttccacccggcggcacacggcaaggactactgcgtctgggagaaagggagcctccgcgtcccggctgggcggcacctttagcagttcagtcttgcgctgcaaacacagcagcgcgacactgaatagtccgtcccccaacgtcttttcctataacgaggatttcctgaattttaccctttttttttctagttcagtttcacatatattccacatgtacacactgtcacaatcagatataaataaacaaggt

SEQ ID NO: 11647 - DNA, 840 bp, Sorghum bicolor
  Clone ID: SORBI-28MAY03-CLUS7807_1
gccggccgggccggggaaaaaaaaaatactgcagattagactatccgatccatcgacgccgcgggacaaagccgtttgatcgatcgatccatctcgcgccgtgtttcccgtctctctccacgcccgctcgcggattcgcgactcgcaagcttctagcgtcttggttttcgattgctgcaggaagggaagaggcggcggcaatggcggggagagccaacatcccgaccaacaactctgcgctaatcgccatcatcgccgacgaggacacggttactggctttttgttggctggagttggcaatgtggatctgagaaagaaaacaaattatcttattgttgataacaaaacaacagttaaacaaattgaagatgcatttaaggagttcaccgccagagaggacattgcgattgtactcatcagccaatatgttgcaaacatgataaggttcttggtagatggctacaacaaacctgttcctgctatactggagatcccgtccaaggaccatccatatgatccagcgcatgattcggttctttctcgcgtgaagtatctattttctgctgaatcagtggcctcagataggcgataaaagtcttatgacttcatgtatcttgtctatgatgtgcctgggccattttattgaaaatgaagaggtattaacatgttctgtatctgaatgagattcagtcaccgatgattttttatttatttgtcacaatttgtattttcgtaatcacaatttgtatttggaggatatattctttccagctcagtactgtacttcgaactgtacttcgtgcgctgcacacatatcatattgaaattgaaatagtttt

SEQ ID NO: 11648 - DNA, 812 bp, Sorghum bicolor
  Clone ID: SORBI-28MAY03-CLUS7830_1
gcacgagggaggagagagattcagtgtctgccagtgaatcatcagggtcggaatcagatgaagatttgatctttggggattcttcagttgacaatgaggttgttgctgattacatggagggggtcggtgggagcgatgagctgttgagcagtaagtggatcactggtatgaatttgggtgatgcagatactgtagagcagatgtatacagatgacgatgatgataatgatcggtttgtgaagaaagggaaggaaaagcttgagggttatgcactaatgactgcatccgagcagtatggcatgaagaggcccagctcagttgagaaggggaacggaaaaagaatggtttgtaagcgcgatttgccaagcatgcaagcgatgggcctggaggatatgttcatggtgaagaatgtctggatgccaaacaggtcaatgaaggggtcgaagacaggatcatcatcctctcagctctcacggtcctggcctaataacgagggtagaaagagcaaaaagtatcagagcaggccaggtgaaaagaagcagcataggaaggaactcattgcaaagaagcgtcaacaacgaatgctaagcagaggagttgacttagggcaaattaatactaaattgaggcaaatggttgtggatcaggttgatatgttatgttttcatccaatgcactctcgagactgttcgcagagatgaagctccagacttgttggtctactacacaaccaaaaaagaggtgatggacagactcctaacaatagaagacacaagtacaacgccttgcatctatttatcaattgaagagcg

SEQ ID NO: 11649 - DNA, 898 bp, Sorghum bicolor
  Clone ID: SORBI-28MAY03-CLUS7870_1
gcacgagggctgttcagtgctgctcgtgtttggtggatgttccgtgtatttggacatgataaaatttgggtgttagatggaggtttgccacaatggcgtgcttctggatacgatgttgaatcaagtgcctccagtgatgccatcctaaaggctagtgcggctggtgaagcaattgagaaagtgtacctgggtcaatcggttggtcgaaccacatttgaagcaaagctgcagcctcatcttctttggagtcttgatcaggtgaaagagaacatcaagacccagacacatcaacttatagatgctcgatcaaaacctagatttgatggcgcagttcccgagccacgaaagggcattagaagtgggcatgtgcctgggagcaaatgtgttccgtttcctcaggttcttgacagctcacaaaagctattgcctccagatgagctccgtaaacggtttgagcaagaaggaatatcacttgatcaacctcttgtgacctcttgcggcactggtgtgacagcatgtgtgttagccttgggccttcatcgtcttggcaaaaccgaggtcgcaatttatgacggatcatggactgaatggggcgcccatcctgacactccagttgcaactgctgtttagtctcttcatcgagaacgtctcaggctcttcatagaggactcttgattgtatttttcccttgctgtgatcctatggagagaggcggtgtgaagttgtgaactgaggaggttggttgggtacctgggtgtaaggttgggggacgcgaagccatttggtcttcactgtaaatgctgaaacagaagaattgtcacatacactgaattataagacagcttcccttggtctcttctcttggtggaataataatagtaataatggagtttagagg

SEQ ID NO: 11650 - DNA, 859 bp, Sorghum bicolor
  Clone ID: SORBI-28MAY03-CLUS90947_1
gcacgaggggaacagagagctttacattaatcttcttattaagaatatctttgtggactctatttcatctcagctaacccatttcacggaaggatttgctgacatactagttaatccaaaacgccgggaagagttttttgagtgtttagatctagaagacttggaccgactgttagggggaaacaacaatgcaataaatctgcaagattggaaatcacatactcaatataatggctacaaagaaaaggatcgtcagattaccttgttctggaaggctgttgagcgcatgtcacttgagagacagaggcaactcctcttcttctggacttcagtgaagtatttaccatcagacggattttgtgggctgagctccaaactttacatatacaagacgtccgattcacctgaccggctcccatcatctcagacctgcttctaccggctctgcctccctccttatacatccttgaaaatgatggaaaaccagctgcagaagatcacacaagagcatgtgagctgcagcttcggtacatggtagttgctgctgctgttctggatcctgaaccggtatattctgtacatatggtaggctagtgacaccctactgtctcattgaatctgttcctagagcttgaggaggtaataggctgtctttctttttcatgtatcgtgagttagtctccgagacttttatttaatctatctaatgcagaaggaattgatagaaagcaggttccttttgttttctaaagagcagtgacgctgtgtagtccagccggtggcagtaatgtaacatgtgcatgtagccgcattgttctcagtattgaccctccgattaccaatgaacggctggtgggct

SEQ ID NO: 11651 - DNA, 806 bp, Sorghum bicolor
  unsure (1)..(806): unsure at all n locations
  Clone ID: SORBI-28MAY03-CLUS9119_1
acccgtgccaccgcccccgcccctcatactgcacccagaagctaggtttagccgccgccttctcccttttctccgcggcggccgcaagcaccgaccttctcctcgaagaagccccaagcaagcgaccctcgcttcctctccgcgccagatcgttgtttatgagctcgaaggagaagcccactcttggaggcacgcggattaagacccgcaagcggaacattgcagctcctttggaccctgcatcattctctgatgcaattgttcagatttatctggacaatggtggagatctggaacttgtcgccaaaagtatcgagtcctcagacctcaacttctcacgttacggtgacacgttttttgaggtggtttttgttggagggcgcactcagcctggcactataaaacctgaagaaggagaccgccacccttattctgtgttagattgtgcagcacagcgtgaaacaattttgcctttcgtactctatatccagaaaacattgcgcaggaggcctttcttaataaagaatcttgaaaatgttatgcgcaaattcctccaatctttggagttctttgaagaaaatgagagaaagaaactcgccatattcactgcccttgcattttctcagaagctatcagggcttcctcctgagacagtgttccagccactgctcaaggataatcttgttgccaaagggatagtactttcattcatcactgagtttttcaaggagtaccttaaggaaaacagcttggatganttgattgcacttttgaagaagggcaaaatggaggacaatctgttggac

SEQ ID NO: 11652 - DNA, 1061 bp, Sorghum bicolor
  Clone ID: SORBI-28MAY03-CLUS9125_1
cagtctttgaagcttctttaagagctacacttgccaggattggaacaaacttttctgtttctggctttggctcaagcctggataaatcacctgcagcagctattgatgagaatgcagacttgcctcttgctggaagggctgcactagatattgcagctattcgcctaagtgatctgccagacaagtctaagaagctcttgactgtactagaacagtcaaaagatccacggttccatgctcttcctctcacatcacaaagagttgcagccttctcagacacagtaaatgaacttgtctatgatgtactcatatctaaggttcggcagcgtctcagtgaggttgcacgccttccaatctggtcatccgtggaggaacagggtggtcttcctcttccaagtttcagtgcctacccgcaagcatatgtgaccagtgttggggagtatctcctcactttaccacagcagctggagccactcgcggaaggtatctcaggcaatgaagctggcaacgacgaggcccagttctttgccactgagtggatttttaaggtcgccgagggtgccactgctttgttcatggagcagctccgaggaatccactacatcaccgaccgaggttcacagcagctcgctgccgacattgagtacctaaacaatgtcctatctgcgctctcgatgccaatccctccgttcctgtctaccttccacgcctgcgtctccaccccgagggaccaggtccgtgatctgatcaaatcagatggtggaagccagctcgacctccctactgcccatctggtctgcaagatccggcggatcacattagattagtgaaatcgtcttaacctctctccctttccgtaaggtttataccactgtaaaagcacgcattccagtgtcctttgcttctgtgaccctatgtttgaaatgcgggcttgtaagctgcttcactcttctttcttttcattttctttgacagtaagttttgccatgtaagttgtaaacgtactgctggctaatagtggagataatcatatatatagaataattcgttacttagagcgt

SEQ ID NO: 11653 - DNA, 1289 bp, Sorghum bicolor
  Clone ID: SORBI-28MAY03-CLUS920_1
ggaaaacgaagggataagctgggcaacggccactcccatccccgcacttcaccggcctccgcctcctccctcccctccatcgccgtcgccggggcgctctacagctcaaaatggcggccaccgccaccgccaccgccatggccatagcaactatctccccctcggctccgatcccttccgcgcccttcccatccctccccctccgcctccgttctcaacccctcctcgctgcctcccgccgcctcctcctccctgtccccaaggcctcctcctgggacgaatccgtcgccgaggagggaggagacacggaggaatccgccgccgctggggacgaggaggacgaggacgagaagccgcggccggagccggtgtcgtcctccgagttccagttcgcggcgccccccgagggctacgtggagcccgcggcgttcgacgagctgcctccggagtccccagaagacgtggcggcggcgtacgagtcgctctacgggccggccttcagcggcgagtcgctgctggggaacaacgtctacgaggtcaaggtggtcgaccccatcgacatggaccgggagcagcgccccaacgacgatttcaccgagcgcgtcgtccaggtcaaccgcgtcaccaaggtcgtcaagggaggcaggcagctctcctaccgcgcaattgtcgtcgttggcgacatgaagggccacgttggtgtcggcgtgggaaaggccaaggaggtcacggaggccatcaccaaggccgccatgaacggccgacgcaaccttgtcacagtgccgctcactaagtactccacattcccgcacagagctgatgcggactatggagcagccagggtgatgctgaggcctgcttgccctggatctggtgttattgccggtggagctgtgcgggttgtgttggagatggctggtgtggaaaatgctctgggtaagcaactgcgcagcaagaaccccttgaacaacgcacgagccaccatcaaggcgacgcagatgatgaagcagttcaaggatgtcgccgaggagcgtggtgttccaatggaggagctatggaaatgataaaaacaaatcgaaaccgacccccctgcccccaccccctcccttttgtagcattctttctccttgcgctgtatttttctcaagttcttttttctgctgtgtctatctatgggatgggataaccccgcctcacgatttctttttgcatatctcttctgagatcgccagtagtgccaacatttacacgcaagtttacggggaaaattgaatcagtgaaatctgacc

SEQ ID NO: 11654 - DNA, 1116 bp, Sorghum bicolor
  Clone ID: SORBI-28MAY03-CLUS9344_1
ccggtggtggccatctcgtttacctggaaattagggattctaaacttgttgaagtgaagcatgcacagctagaacatgagatttcttgccttgatttgaacccaatcggggagaatccacagtatagttccctagctgctgttgggatgtggacagatataagcgttagaatattttcacttccagaccttgaattaataaggaaggaaaatttgggtggagaaattgttcctcggtctgttctgctgtgcaccttggaggaggtttcatatttgctttgtgctcttggggatggtaatcttttcagttttctgctgaatgcaagtacaggtgaactgactgatagaaagaaagttacccttgggacccaacccatcagccttcgtaccttctcatcaaagggtaccacccatgtgtttgcttcatcagataggccaactgtcatctatagcagcaataagaagcttctctatagcaatgtcaatttgaaagaggttaatcatatgtgccctttcaatacagctgcttttccagacagtcttgcaattgctaaagagggtgagctttcaattggaactattgatgatatccagaagcttcatatccgcacaatcccccttaatgaacaagcacgtcgcatttgtcaccaggagcaatcaaagacactagcattttgcagtttcaagtacaaccagagtgtggaggaaagtgagactcatttaatacgtctgctagatcatcagacttttgagtccctgtgtgtatatcctctagatcaatatgaatttggattcaaaatcattagactgcaccttgcagatgattttagtgtaaaggtaaatgatgttggtagatatgttatccttttagaaattatgtacttaaatcttatcattaacagtcatgctgttgaagatggaagtttgcaattaattgtggagaaagaaaccaaaggagcagtttattcactgaatgcattcaatgggaaattgttggctgctatcaaccagaagattcaattatataagtggatgtcacgcgaggatggttcacatgagctgcaatctgagtgtggccaccatgggcacatacttgccttgtatactcaaacgcgtg

SEQ ID NO: 11655 - DNA, 1026 bp, Sorghum bicolor
  Clone ID: SORBI-28MAY03-CLUS9251_1
aagttttgatgaggccccatggcccactctcacagctgaagctaaagattttgtaaaaaggcttcttaataaggattatcgcaagagaatgatgtgatcgaagaacttgcatcggtatgggaccatctatgctgacaatttgaaagggatgttggatatgataatctataaagtgatgagagcttacattcaatcttttgttcgccaggaactcggactgagccccctagtcacgacgctgactgtcaaccaacacttttatgtaagggagcagtttgaattgctgggcccaaacaagaatggttatatctcattgcaaaatctgaaatcggctctagtgaagaactccacagatgcaatgaaggactctagggtggttgactttgttaacacggccggcgcccttccctacagaaaattggatttcgaagagtttgctgcttctgccatcagtgtttaccagatggaagccttggagacctgggaacagcatgcgaggcgcgcatatgatctgtttgataaggaaggaaaccggcctattgtgatcgaagaacttgcatcggaactcggacttggcccatcagtgcctgttcacgttgtcctccaagactggatcagacacgccgatgggaagctgagcttcctgggattcatcaagcttctgcacggggtttcgtcgcgctttattccaaaggcctagcatacaccatccatccccgcatatccatatccatcaaccaaggagatgaccgatggctaagccaatctctggctggtgcgtgtgtgcgtgtgtgtgttgtgttcaagggtggctggagggtagacggcctgaaaccaatgcaaagacgaagagaaatgcctgatagtccttgtagtaagagtaaggcaacaaaaggcctgatgcttgtgccttatatacccttgccacgtggattgatgatcgttgttgttgtactgaagtaagctgttgtgtagacgagtgtacagatgaggataggaaaaaaaaatgaatatatggaaggtccg

SEQ ID NO: 11656 - DNA, 707 bp, Sorghum bicolor
  Clone ID: SORBI-28MAY03-CLUS9356_1
actagttctagatcgcgaacggccgccctttttttttttttttttgatcaattcgagatagccaatagacctagggcaaataaagagccattataggctgagtgcaaagataattacacaaccatataatatcatccgattgcacaatgctaaaaccccaagacactagcagacaagttgcaaaccaatattccatccaccaacgcagcacaacgtgccccagacaacaccctcaccacctaatagaaaccaaactcgagatatcaacatcaacatctggcctgtgcggcacaaccaccgacataacctctaggcagctcaatggaaaatactgcatcaaccaaacaccaacatcagcaggccagaaatggccaccagccagttttactgctgcttgcactccgctggttgttcagcatttccttgcgacaccttctgcggccccttatgtttgcgaccagatcccgacttccgtgctggcttgctttcttcctcatcatcctcctcgtcgtcttcatcctcgtcctcatcctcttcatcctcctcatcgtcgtcatcttcatcatcatcctcatcatcgtcgcccaagtcagcaaaatcatcaccttgtacagcctcaccagtaaaccatgaaactgcatgtgggataattttatcccttatggtggtcccaatgtcataatcatgctccatttctccctgcagct

SEQ ID NO: 11657 - DNA, 1123 bp, Sorghum bicolor
  Clone ID: SORBI-28MAY03-CLUS82379_1
agcaccccacaatttcccactcaaaaaccggaacgtgcaatcccaccagtgtccagtgctcacatcaggtaatcgacacagctctccagccaagctagcacaacaagcccaatcaacagaacaacaacaacaacaggcggcatggcgctcgcggaggggaacaacggcgcggtcgtcttcagcgaggagcaggaggcgctggtgctcaagtcgtgggccgtcatgaagaaggactccgccaacctgggcctccgcttcttcctcaaggtcttcgagatcgcgccgtcggcgaagcagatgttctcgttcctgcgcgactccgacgtgccgctagagaagaaccctaagctcaagacgcatgccatgtccgtctttgtcatgacttgcgaggcggcggcgcagcttcgcaaggccgggaaggtcacagtgagggagaccacgctcaagaggctgggcgccacgcacttgaagtacggcgtcgcagatgcccacggccgggtggcgcgctgcgcgcggctccacgcgctcgaggcggcgcgccccgctctcgtggggcgccgccgcaggtggccaccctggggcgaggcttcctgccaccgggccgcggccctcaagcaagagatgaaacctgatgcctagtgcgaccactctgcacgaaagcgttattattcttgtcttctagattgagcgatggtggtgtcgcagcattgaaattgagcacgcttgaaataataatataatcgtaagtaacgtcgcgcgtgctgatcacgaacacgaatgcaggtgacggggttcgcgctgcttgagacgatcaaggaggcgctccccgctgacatgtggagcctcgagatgaagaaagcctggagcgaggcttgcaaccagctggtggcggccatcaagcaagagatgaaacctgatgcctagtgcgaccacttcttagcttcaaattgacccatgacgcagcaccgtctcaaatgtaccgtcgcttgatttgccgattaactcgtgtgatcttgcactttaccagtttctctctggagaagcgtctgttattatttttgtgagagcttgtatacttcttttcttgaatgtgattagtaataaataaagatgtagcttctcc

SEQ ID NO: 11658 - DNA, 696 bp, Sorghum bicolor
  Clone ID: SORBI-28MAY03-CLUS8268_1
aaaaacaagcagaaggttgatggagctagtgttggtgctggcacaagtgcaccttctagcagtgctgacattccaaagtctgatccaagctcttccataggtgctaagttggtagcagcccagcctgtcagtattcgtgcaacggacctgatggaagctactgttccgtgctgggatgatgtagacgtgccaaatacaaaggttgctgcgggccaacactccaaacgcaagagcattggttacatcttagatgagtgggacgaggagtacgacaaagggaagacaaagaaagtacggaaatcaaagcaagactttggcgggccgaaccccttccaggaggaggcagactacatatcagagcggaggatgaaacagaaatcctaccagggcaagtcttggaacaagcctaacactatagaggagttgagaatatgagagagaatccccgggacgcacatgctgtttgtttgttgttacttgtagcacccattggtgaaagagattatgttaaaaccattcgtcgtcgatagtccatagttgtcgctattctgttttagcagtttttggtagacatttgaacattgtgtttggttgtaacggactgtttagcggagcagacaaagtgagattattattttatcgcaactgctgttgttgagttactgaataataaaatgatggtgatgatcaattggt

SEQ ID NO: 11659 - DNA, 1820 bp, Sorghum bicolor
  Clone ID: SORBI-28MAY03-CLUS82794_1
ggaggatttggtaagaaggactggactggaaaaaagaaccaaggatccgagctctatggatggcttgcacgagctgaagattacaattctccaggaataatagcagactacttgagaaaaaatggcgacttgaagtctgttaatgatcttgcaaaggaaggagcacgtaaaactgacaggcttgttgctaatttagctaaccaaattgaggtaaaaaataggtacttacaggaacttgaaagcaaatacagtgaggcaactgcatcacttgagaagatgatggggcaaagggaacaacttctccagtcatacaatgaagaaattagcaagatgcagcagctagctcgcaggcattctcagaaggtcagcgcggggaatcaagagctgcgttctgaacttgaggcaaaaatgaatgatcttgatgtgagatccaagcaacttgatgagcttgcagcgaaaagtgattatgacagaaggaaccttgagcaggagaagcagaagaatgctatcaaatcgagtcatcttaaattggcaacattggagcagcagaaagctgatgagaatgtgttgaagcttgtggaagaacaaaaaagagagaaacatgctgcgttgaagaagattctgatgttggaacaacaattggatgcaaaacaaaagcttgaattagaaatacagcagttgaagggcaaactaaaagtgatggagcatatgccaggtaatgaagattcagcgtcaaagaataaaattaatgagttgagtgaggcattgcaagaaaagatagatgaactggatgggctcgaggcacttaaccaaactctggtcatcaaagaaagcaaaagcaacattgaactgcaagaagctcgcaaagagctagaaaatggcttgcttgatctttcaggtgggcaggcacatataggaatcaagagaatgggagagcttgatctgaaagcattttcaaaggcatgccaaaaggagcgcacagaagatgcagaagttactgctgcctttctttgttcaaagtgggaggctgaaataaaaaatcctgactggcacccttttagggttgtcacagttgatggaaaggagatggagataatcgaggacgacgcaaagcttcgagcactcaaagaagaacatggagaagaaatctatgcactggtgacaaaggcgctgcttgaaatcaacgagtacaagtctaaaggcagttatcctgtgggtgagctatggaacttcaaagaaaaccggaaggtgactctgaaggaagctgtccagtttgtgctgagacagtggcgaacaaacaggaggaagcgataagctctcaatggccactcaatgggccttggctttctttccacccgatccgaacgccaggagctcgagaactagccacctgaacaaacactagtattgattcgtgataaaaatcgatagggcgatacagccctgtcgatctgttccttgttgggggtattataagctggtgctcctattgcagtatcagcgtcactggactaggacgccgttacggcggtatccttgtgccacctttgtagcaagtactagtttcgagtttcgttgttgaacagggttttatgcttgggcccttggccgcgttctgttctgtacgcggtgcctacacagctgcggtggaacatgcagacgcataataataaagcatgcttgggcccttcttgtgctagctccgcacttagatcttgtttggatgtagtcgaatttacatcaattcacatgtgttgatgtggattgaagtgaaatttgaactaaattttattctattttatatcaacacacatggattg

SEQ ID NO: 11660 - DNA, 642 bp, Sorghum bicolor
  Clone ID: SORBI-28MAY03-CLUS8322_1
tctgctaactccactcatcacacagccaatacccacagctgctagccactcccactccaaggaacaagtagcagtttgcagttagctccgccggtagaaccgaagatgatcggaaagataatcggagacatcacgggcagcaacaagcatgcgcagctcaagggcaacgtggtgctcgtgcgcaagaccgtgctcggcttggacgtcaccagcatcgccggctccctcctcgacggcgttggcgagttcctcggacgcggcgtcacctgccagcttatcagctccaccgtcgtcgaccccaacaatggcaaccgcgggaaggtgggcgcggaggcgagcctggagaagtggctgctgaacccgccgccgcttctgtccggcgagaacaagttccacgtcaccttcgactgggaggtggagaagcagggcattccaggcgccatcatcgtcaagaacaaccacgcctccgagttcttcctcaagaccatcaccctcgacgacgtccccggccacggcaccgtcgtcttcgtcgccaactcatggatctacccgcagtccaagtaccgctacaaccgcgtcttcttctccaacgacacgtacctgcccagccagatgccggcggcgctcaagccttaccgcgac

SEQ ID NO: 11661 - DNA, 1019 bp, Sorghum bicolor
  Clone ID: SORBI-28MAY03-CLUS96108_1
gcacgaggactacaacgccgggtgcaagacggccatgtccaacgtggtcatgtccgtggcggtgatggtcacgctgctgttcctgaccccgctcttccactacaccccgttggtggtgctgtcggcgatcatcatctccgcgatgctggggctcatcgactaccaggccgcgatccacctgtggcaggtggacaaggtggacttctgcgtctgcgtcggcgcctacctgggcgtcgtcttcggcagcgtcgaggtcggcctggtcgtcgccgtctccatctccctcctccgcgtcctgctgttcatcgcgcggccacggaccacggtgctcggcaacatccccaactccatggtctaccggaggatggaccagtacgccgccgcgcagacggtgcccggcgtgctcgtgctgcgcgtcgacgcgcccatctacttcgctaacgccagctacctgcgcgagaggatctcgcggtggatcgacgacgaggaggagcgcaccaagggcaagggcgagatgggcgtgcagtacgttgtcctcgacatgggtgccgtcggtagcattgacacgagcgggacgagcatgctggacgaactcaagaagtccctggacagaaggggagtgcagatcgtgttggcgaacccgggcagcgagatcatgaagaagctggacagctccaaggtgctggagcagatcggccacgactggatcttcccgacggtgggcgaggcggtggcgtcgtgcggctacgcactgcactcgcacaagccggccggcgtcctcaaggacagcgccgcggcccgtgagagcatggtctgagttctgactgatcgatacgaggaccgtcaaccgtgtgtgtagtaagtgtggtcgagtctgacgtaacttgtcgtcacgcgaaccgagatgaattatatcgcgtctcgcgtattgtacaacacctgtaccgtcgaggaaaaaaattcagagagagaatcccacccgttttgggtaagaaaagccttctcgacagggtttggcg

SEQ ID NO: 11662 - DNA, 801 bp, Sorghum bicolor
  Clone ID: SORBI-28MAY03-CLUS9463_1
gcccagagcaccagattccgttcccctgaacccgatcgagatggagtcggaagctgacagggcggcggcgccggcgccggcgccagcagtcgccgcggagaccagcgacgacgccatccaggaggagtctccagcgacggccccttcctcagacgggaagcccggatcaggggcggcgccggagctggaggtgcagctgttccggcgcgggcgtccggtggccgtcttccggtcgcagctgggcgggtatacgcaggaccagctggaggtgggcgacatcctggagcagcacggcctcaagtccgtcttcgccttcgaccccgccgcccgcaaacgcggcgtcgccatccgcttcaacccccgcaacggccgctccctcctcacctacgcccctggctccacgatcttcctagacggcgagcccaaggattctttgctgaagcccatcacgaagatggtgattggggtggctgctatgactgtggtagcagcagtgctactgaaggaggccaagatgccagagtggcttcagtcatctaagctgggcaccgtgagcttcccaccatgggtgctggcttgcatggtcatcgtgttcctgaggcttcggaagagaaccaaggatgtcatgaagaagtttggctgggtctcatgaggtagcaacagttttacctttattttgaagaaatctgagtatacttaaaggcaaagacagaggcaaaagtagttgccgtcagaactctatgtcactctcaaaattcaagttaattgaattgtaataattgcagtctaattctaaaggag

SEQ ID NO: 11663 - DNA, 1659 bp, Sorghum bicolor
  Clone ID: SORBI-28MAY03-CLUS9629_1
gcacgagggctggagccgtcttaccaggactcagcgacgacgactgtgtcgccgggctcggtccagcagggctcaccagacaccattcccgatggttctcccaagttccctgaggacatgtggtctcgcagcccttcgccggacgtcgagtacaaagaggacgaggagaaggtaacaagagaagctgaagcacagtatgacgaggacatcgaacggagaagcacggcggaagaggaggcgggcatcgacatgagcgacgatgacgagcactcatcgggcggcgagaaggtagaatctggaccagcctatgatctggctcctgttgctgacgactgtatggaccattcggaggcgcgaggcatcactgtacatgatcactcaggaggtgaagctgcttctgatgctcaaagaagtccaaaggcagtctctgagagagaattagctgtcgtgccatcagatcaagatgctggcccagtcaagagaagtccggagccatcggagcaggaatttattggtatggttgatcattcacttgagcacagttctgacgaccggaaggaaactgccagcgaaagcgatcagtcatatgaaatagtatttgatgacaaaaggaggccgcacccgccagagactggattcgttggtacgagagatcactcacatgagcttatttctgatgtttggaaagagattgtcagtagaaacgatcagccacgcctagcggctcatgctgatgaggaaggcctggatacaactgatcgttcaaacggtcttgtttcttatcagaagaaagtgactttcagtactacaaatgatcaggcatatgctgcattttctgatgagaagagcgtcccagagactccagagcaagaattcagtctaaccgaccgtcgaaatggagtagttcctgacgccaagaacatttcagagaccaaagaagatgaggaacaagacagtgcaaatgatgatttggacaatgcagctcgacaggcctacatttcagtcacggggaaggcaaaggtatatgacgaagatggggaggatccggaagcgaagtggaaggatttgacagacgaggaggaagacgagctggagtcactgtgggagcaccaagacctgatagagcagctgaagcttgagctgaaaaaggtccggtcgatcgggctgccgacgatccttgaggagtcggagacaccgaaggctccaatggaggacctcaagccttggaggatcgatgctaagttcctccgtgaagacccgatggacgagctgaacaagttctacaagagttacagggagaggatgaggaagtttgacattttgtgctaccagaagatgtatgcaatagatttcctacagctcagaggcccccagcagtccagcaactctctaaagtccctgtcgccaacggtggcgtccatcctgtcacacaatttccggtcatctcgtcggagatctcccgaggacccatcggagcggttcctcaaggagctccgctatgatctggagacggtgtacgtcgggcagatgtgcctgtcatgggagttcctccggtggcagtacgagcaggcccgtgacctcccggagtcggactcttaccacagccaccagtacaacgtggtggccggagagttccagcagttccaggtcgtggtgcag

SEQ ID NO: 11664 - DNA, 801 bp, Sorghum bicolor
  Clone ID: SORBI-28MAY03-CLUS96783_1
ctactggatcgcaaagcacgaggccactccttccccttcacgcctcgcaacgcatctgcacttcgtcttcctcctcctgccaaatcgcagttcctccacttcccaaatcgcgccgcagcaacaccgcgagcactgcccctagggggaagcaaagcaaagcaaatcatcgtcgagagagaagaacaggaacagagacccggcccttcgttcgtttcagtccggaactggcgagatcattaatggacgccgccgcgctacaggcctcgtcgtccccttcgtccccttcgtccccgtcgaagctgcgcgacaagctgcggaccacggtgtgctgctgcttcggcgcgggcggcggcggagcggagaggacgaggtggcggcggcggggcgcggcggcgggcgagttccggtacgacgcgctcagctacgcgctcaacttcgacgagggcgaggacgacgacgcgtacgcggaccccgccgcggcgttccggtacaggaacttcaacgcgcgcctcccgccctcgccggccgccgccgccgcggtggggacacagcggccgcgggccacggccatcgccatcgcctagagttaagatcgcgctccgtgatggcacttttttttttcctactgatggagcgagcgacactcagttcttctattcagcgagttactactagtgaattatcctgatataaatatagtgttactcttgtaatcctagcagcattccaatgtgtttagtaccaattggaagtggcggtaatgaaccctagaaattgggagggagctttgattccacaaag

SEQ ID NO: 11665 - DNA, 969 bp, Sorghum bicolor
  Clone ID: SORBI-28MAY03-CLUS97180_1
aaatctcgcatcaacgcacgcgcatttccccccccgccaccccaactttcccttacctcggcgcgatccaaatccggtccggcgatggacggcggggggcagcccccggacacggagatgacggacgccggcgcgggcggcggggggcagcagccgccgccggcgcagcagcagccgcagcaggcggcaggcgggggcgggatgatggagaacatccaggcgacgctcagccacggcggccgcttcatccagtacaacatcttcggcaacgtgttcgaggtcaccgccaagtacaagccccccatcctccccatcggcaagggcgcctacggcatcgtctgctcggcgctcaactccgagacggcggagcaggtggccatcaagaagatcgccaacgccttcgacaacaagatcgatgccaagcgcaccctccgcgagatcaagctgctccgccacatggaccacgagaatattgttgcaataagggatatcatacctcctccgcagagggaggcattcaatgatgtgtatattgcttatgaattgatggatactgatctgcatcaaattattcgttcaaatcaagctttgtcagaggagcactgtcagtattttctttatcaaattcttcgtggcttgaagtatatacattcagcaaatgttcttcaccgtgacttgaagcctagcaatcttcttttgaatgcaaactgtgacctcaagatatgtgattttgggcttgctcgaaccacctcagaaactgattttatgactgaatatgttgtcacaagatggtacagagcaccagagcttttgttgaactcctctgaatatactgctgccattgatgtgtggtctgtgggttgtatatttatggaactgatggaccgaaaacccctgtttcctggaagagaccatgtccatcagctacgtctactaatggagctcattgggacaccgaatgaggctgat

SEQ ID NO: 11666 - DNA, 655 bp, Sorghum bicolor
  Clone ID: SORBI-28MAY03-CLUS9727_1
ccctaccgagaaaataaagacactagcgagccttcacttgcgttcccctggcccccgtcctctgttccagcgtttccgccgctctccagaagccctgcctacccgatgtccgtcgcgtccgtggccgccctccggacggccgcctccggctccggccggtgccacggcgcgggttccccacaggtcggcctgaacgggggcaggttcttgatgatgcagaggagggagctggtgaccaaggccgggatcgcgctcgccgtctcctgctccatggcaacttctccagccccggccaacggctctgctcaagggctggaggttttgccgttcaaagcggacgggtacaacttctggacgtggcggggtcgccggatacactacgtcgagcaaggcgccgggcagcccattgtgctcatccacggcttcggcgcttccgccttccactggaggtacaacatccctgagctggccaagaagtacaaggtgtacgccatagacctgctggggttcgggtggagcgagaaggcgctggtggactacgaggccaccatctggatggagcaggtctccgacttcctccgggagatcgtcaaggagcctgccgtcctcgtaggcaacagcttgggaggtttcacgacgctgttcacggcaaccg

SEQ ID NO: 11667 - DNA, 1068 bp, Sorghum bicolor
  Clone ID: SORBI-28MAY03-CLUS9646_1
gcacgaggcatctcaacttcaacgccaacgacagttgatgctaccatggttggaaatcggacatggtttgggggccttttcaacggctcaggcaaaaggcgacaagtcagtgcagagaagatagtgcttgatctaacccctctacaggaacagagactgcaaaacttgaaggaaaggctaaatataccttatgacgaaaatcggcatgaacatcaagaatcgcttagggctctttggaaaatctcctttcctgatacagagctcactagctttgtttcagcacagtggaaagaaatggggtggcagggcatgaacccagcgactgatttcaggggctgtggatacgtttcccttgagaaccttctattctttgcaagaacatatccgcaggcttctttcaagaggttaatgctgaagcagcaaggaacgcgagctacatgggagtacccctttgcggtcgcaggtgtaaacatctcatacatgctgattcaactgctggagctcaactcagtgcgtccgaaatctttgccagggattaacttcatcaaggtgttgacagaacatgaggatgcattcgacgtgctctactgcatagctttcgagatgatggatgcacagtggctagcaatgcgagcctcgtatatgcagttcaaagaggtgctggaggccacaaagcagcagcttgagagggagctctccctggaggatctcaatggcatccatgacctcccagcctgcaacctcttgtacaaatagtactggtagttagactattatgatgcagtcagagcaaaaaaaaattgaacaaaaaaaaaacatgatgaacagattgcttcataatcagcagcagcagcatcagcctgtaatgagaagggatacacatctgtggttgacagaaacacgacacagttaattttgccgaggatcaaagcctacacataccatgtatatatattaccgctgcgcgtgtatataacaccggcatttctacatcaattattatgtaagaacaaatataaagtagttagcccttttattaattttttttatgaaaaattaaattaaact

SEQ ID NO: 11668 - DNA, 400 bp, Sorghum bicolor
  Clone ID: LIB3480-011-P1-K1-G8
gcttgatctaacccctctacaggaacagagactgcaaaacttgaaggaaaggctaaatgtgaccttatgacgaaaatcggcatgaacatcaagtgacaaactctcgacttaattaattaccttattgactttcagccaatcttgacttgtttacactgtgtgctttggatttaggaatcgcttagggctctttggaaaatctcctttcctgatacagagctcactagctttgtttcagcgcagtggaaagaaatggggtggcagggcatgaacccagcgactgatttcaggggctgtggatatgtttcccttgagaaccttctattctttgcaagaacatatccggcttctttcaagaggttgatgctgaagcagcaaggaacgcgagctacatgggagt

SEQ ID NO: 11669 - DNA, 1803 bp, Sorghum bicolor
  Clone ID: SORBI-28MAY03-CLUS8730_1
atgctcctgctcattcccggccgcgccgcggttcttgcatgcttttcgtcggcgccaggggatctgcggacggaaaagggaaactgtctcggccgtcaatttaaaccccgcggcaagaccggatttatatattttgctggaaaggcagatcttgatcttgatcggttcctgctgccgctgctgctagcttctgtctgctctgctgggggggcttgtacgaacgtacgtgttgatgaagacgacggtggaagggagcggcggcggcggcggcgccccggccgcggtcaagaggcggcggagggatgcacctggtggcaggcgacggagcgtcggcgtgagcgtgcggcggcgcgtgcaggtggacgcgacgacgaccgcgccggcgccgctccagagtctgcttgccgcgtgccgccgcgcgttcggaggccccgggaccgtgccggcgcccgacgacgtcgccctcatcagagacatcctcgacaagatgggaccagaagatgtgcacctgagagccgtcaccaaggccgcggcggcggcttccttccctcgaacacatcctaatcctatcatcacacgaaccaccatttacaaatgcaaaaacttctcgatcgtcatcttcttgcgcccctccaccccgggatgacggtgttcagcaagcttctcctgggctcgctgcacgtcacgtcgtacgactggctcgtcgacgccggcggcggccctcccgccgtcgttggcggcggaggcaatgatcgcctactgaggctggcgaagcgggtggtggacgccgacctgagcgcgccgtgcgacgccctggtgctgttcccggagtccggcgggaacatgcaccggttcgccgccgccacggcgtgcgcggtcctcgacgtcctcggcccgccctactccggcgaccgggactgcacctactaccaggacttgccataccgccatcatcatcacgacaacgacgatgcagatgaggccgccggggacggcgacgtccctgccactgccacggatggtgagcgtctggggtggctgctggagacgcgcaagcccaaggaattgcagatgtacgaggtgccgtacaggggccctccgatcctatagaagaagagaagcgacctgcaattcagtgttggcagcagcagggagccagctgcagctatcacagatgcatgcatgcatgggaacataaaatgtgtagcacgtgcagaatgctgttggcaaagatgtgtactgggcgtgtgaaatgtctccggagaaatcggttggtatttgttagtacaaagtagaccgacagcggatgaactaatggatacgcgagtgtacgcttcagaattcagagtgcgcgtgtccacccgcactcgttttctttttatcgttcatccgcttcatggcgcaatcatccgtggtggctcgatcggtcctctatctccagtgaatacctcttctaagcttagtagatgcagggtgcaaagctcaccgggccggcggatttgttggcaagaccgcaagagaatcggaggcgtagtttatttgtgcgttgaaaaaaaaatctcttttatgtcccacatctcagttttataggagctatggtaccatagtgtataagtgaggcaaagattcggatgtttttctcgacctatgtgagaagattttctttttagacataatgtctaatgttgtctcacctccgagggagttttccttttaagcttagtagatgcgtggtcagcgtttagagtgtagtttgcgatgtattggacttgtttgttttttattataatcggtttctagacc

SEQ ID NO: 11670 - DNA, 538 bp, Sorghum bicolor
  Clone ID: LIB3476-053-P1-K1-C10
ccagccacgcccacgccacgccacacccctcatcatatccatcgtcgcccgcggtttttcacccacaccacccacgagctgcctttatactaacgtgccggctctgctccccacgcatgctcctgctcattcccggccgcgccgcggttcttgcatgcttttcgtcggcgccaggggatctgcggacggaaaagggaaactgtctcggccgtcaatttaaaccccacggcaagaccggatttatatattttgctggaaaaggcagatcttgatcttgatcttgatcggttcctgctgctagcttctgtctgctctgctggggggggcttgtacgaacgtacgtgttgatgaagacgacggtggaagggagcggcggcggcggcgcccaggccgcggtcaagaggcggcggagggatgcacctggtggcaggcgacggagcgtcggcgtgagcgtgcggcggcgcgtgcaggtggacgcgacgacgaccgcgccggcgccgctccagagtctgcttgccgcgtgccgccgcgcgttcgg

SEQ ID NO: 11671 - DNA, 660 bp, Sorghum bicolor
  Clone ID: SORBI-28MAY03-CLUS8993_1
cctacccgcgcctcccgccgccgaaggattgccgagaggatccggggagaaatcggaactcgttttagatcggatcggggggactcgtggaattgcagggaaaggatttgaggatggatttcgagctgcggcaggcgcgggagaagctggagcgcgagcagagggagcggatgcagcgcgccaaggccaaggccgagcgcgagcgccgggccaaggccgaggcggcgcgccgccgggaagcgctcgaggcgtcccatcgcgagcgacgactcgacgccgcacgcgcccaggaagaggctgaccagaaaatggaagaggtgatgcagctggggaagggagtttcattctcgcacatgtttgaggcacttcgttatgatggccctggggataagatcaagctgccaccatcttcgtttaaggagttgtctgatgaaggagctctcgataaaggtcccatgtacttcaggttgtccaaagttagggacacagtcccaggtacctctatggaacaagatgccgacgcgacctgttgtggtgttcttgaattcactgcaggggaaggctctgctgaactcccgctgcatgtttggaacaacctgtttcgggagtgacaccccagaggtccctctgattgaagtcaaatatttcagtttgcccaaa

SEQ ID NO: 11672 - DNA, 1037 bp, Sorghum bicolor
  Clone ID: SORBI-28MAY03-CLUS89_1
gcgtctcgaaggttcttgccttgttgggaaagggatggcgtcggaggtggaggacgcgcggcggccgccgggaacgtcgcgtctcgaaggttcttgccttgttgggaaagggatggcgtcggaggtggaggacgacgcggcggccgcgggggcgccgctggtcgccaacggtgcagccgacgtccgccggaggagggatcaggcgaaggcgattctgtccaagcaggccgtcaagatcgccaccaaggccgagcagcacgacagcttcatctttaaggtcacacacttgctgggtgttcttggatttgggggattttgctatctcttgggtgccagaccacaggatgtgccatatgtgtactgcctattctatatcatattcgttccgctccgctggatttactaccgctacaagaaatggcattactatctcctggacttctgctactatgccaacacctttctccttgtaatgattctcttctatccaaaggatgaaaaacttttcatggtttgcttctcgtttgcagagggtccgcttgcttgggcattaattgtgtggcgttgcagcttggtttttagttcatttgacaaacttgttagtgtcctgatacatctcttacctgggattgttctattcactatccgaaggaaggagatcgagcagcataacccaacggagctcgacaccacaaagtgcgccaggatgaagaaggtacattgggtaccaccaccatcaacacttccgaaggagcgcaatccaggagtgaggaaattgaagccggatgtaagattagattttgccggttactggtgccaacctttgtttttactgagtgttctttgtgttgtttttctttactctgcccaagttgtgatatccataagtttaggtgtaatgataatggggctggggaatagatgcgtgcccatgcttgtcaggcttgggccaagataaccttttcctctcgctgtggcagttgtgaattgcgtgaagctgttgcattgttcgtttgaaaaaaaaaaaaaaaaaaaaa

SEQ ID NO: 11673 - DNA, 1523 bp, Sorghum bicolor
  unsure (1)..(1523): unsure at all n locations
  Clone ID: SORBI-28MAY03-CLUS9092_1
gcacgaggcactcttctgctcccttccgtcctcacctccgctttccacgcctgttgtccacccgcatcgagacaggcgacaacaccggccaccagcgggccgcagcggcggccgccgcacacctcttcctcctcctctccctccacctctctctctgttcccaaggcggcaaaagggacgacgtggttgcgggcggcggcgcggttgcgacccttgcgggtggcacgttggcgcagctagggtcccgtggcccctttcctctcctccatccttcgacatgggctgctcaatgcctcctcccaccggagaacgtctgctcctcgggttgctgaaaccctagctacctatatgcgtgctgcaaatgggttacctcttctgatctggtttcttttttgtttttctggattgatttcagatttgttgcttctctttcctagggttcatctatgatttcacgggtataaagaaagggagttccattttgatgctgttatagtgttttaactctacaaaccttgcgggctcctaaaagagaaccaatgcccacgtctcctgcaattactttagccatttgatcccctccattaacggcccacatcagcaacgtcaagatttttaagagctgattcgattcacctgactggatttaggggattccttgttggattccttcgattttgtcttcttggcataatatatacgcatatgcccaggctgctgattaatttattttataccgagcatatgtcattgccgatgatgtagttattccagtttcagtatacgacaatgcctatagagttgaccatattttcatgccattgctattttgtattttcctattcaccatatttcaataccattgatgctagaacaaagtaccttttttggtaatatgcagttatgattatcgcccttttatgatcatatcttatgatgagcacttaggcctttatgataattcgattcaacttctgctgaattgaggcatttagcatatgctagaacaaagtatctttttttagaatatgcagttatgagtatcactctttttatgatgatgactacttagtcctttatgataattcgattcgacttctactgaattgaggcattgggcgtatggaatgatgagaacattacatatacatggtcctctttttaattgttaataatgagctgaggcattttggcacatgcaatgatgacctactttttcctagcaacaatcaaatcttttttatgctcttcattgctatgtgccgaaaaagtccattttgtttgaagataagcttgtgttgtcatgaataatgatttctttcacaagtatatgtctgctctttgtgttcttagcgaaaaagaatgttgtgtgtgatgtttatgcctctcaattttaccttccatatgtgagccttgtttattttccattgttttcccattgcttcagccataactatatcttgttcaaaaatgactttgcattngtttatatctgttcagcttcacttatcagccttacatga

SEQ ID NO: 11674 - DNA, 937 bp, Sorghum bicolor
  unsure (1)..(937): unsure at all n locations
  Clone ID: SORBI-28MAY03-CLUS10306_1
gccggccgggttcgagctgtggctgacagccaaaccaagaaatcgccatgctttcccctgctcatctcgccttcgccgccgctttcctcctcgtcttccggtcatcggcgcctgccgctgccgcccgaccgatcttcgacggcaagccctccccctccgaggccaccgccaccgcgaggtggctcgccgcccagaacacgtggggtgtcctcagcacaatatcaagtgacttaagcggagctccatttggcaatgtagtttcgtatagtgatggagttccaggggagggccgtggaatcccttacttttatctgacaactctggatcctactgcaagagatgcactggaggatgaaaggacctcctttacccttagtgagttccctctggggacatgtgggaaaatagatcctgaaaaccccacttgtgcaaaacttactcttaatggaaagttgaagatggttgaccttcagtcatctgaagcagatttggccaagttagcacttttcaccaaacatgctgaaatgaaggattggccaaagaatcatcatttcaaaatcttcaaattggaaatcgaaaacatattcttgattgattggtttggaggtcctaaaccgatatccccctcccaataccttgaattcggaaggaatcagtcagtgatgtcctcataagggaagaatgcttcatggatctatatccgtctgtgtatgctcttcttacaaatgaaatacatattgcacatattgtaacagaataaacttttagtgttatagttgtttggtattgttgtccatcacatcttcgtgagcaattacttgacaaaaaaaaaaggtctgtgtattttatgcgctatgcattatggtctggccttgtttagatccaagaactttttaaaccctaaacactgtagcacttcgtttttatttgnacaaat

SEQ ID NO: 11675 - DNA, 1929 bp, Sorghum bicolor
  Clone ID: SORBI-28MAY03-CLUS10468_1
gcacgaggctctctctctctctctcgattctctgccggctctccctcgagctcatcgactcctacatggagaactccgaggggccgtccccggactccggtgatcgcacggcaccggttcaggatgtcgatgcccaaactacacctgggtataattcgcgaaggccaaacctttctttgcaaataccagctaggaccttggataccagtgtacagacttcgacaagggttactatatcccccagccctagttcaacgagagtgggtttgccaccaagacctaattcaacgagaacaaaatcatctatcaagaacatcaatcctcagaacagtttcagagcaaggagttcagcccaggaaggtgatcgagtggtccttctaaatcctgggacgtcatctgaagggcagcaggataacccaaccacagcaagatcgttttcttttagaaaggtcattagctcattatcggcaaaaaggacccattctcttccagtcacgcctgtaggaactactgacaagactgcatctcctgcaaatcaattagataccctgccaactacatctactgaaggagttgaagcaaaaattaggcgttcactttcagtaccaggaaatcgcaaaaacagaagtttgaggagggcagattcaataggcgtcattcgtgtgattccaacaaccccacgacctgtgccagtcgatgcaaccacatcgaatgatgtaattgaagaaacaatcgatgttcctgaaaatggaggtgaagatattcctgaagaagaggcagtctgcagaatttgttttattgagctcaacgaaggaggggaaacacttaaaatggagtgcagctgcaaaggagaacttgcccttgcacaccaagattgtgctgtcaaatggtttagcatcaagggaaacaagatatgtgatgtctgcaaacaagaagttcagaatctgccagtgacgttactgagaataccaactcaaactgcaaacaggcgggtagcaaatgctgctcagcagagagcagctcaacaatacagattttggcaggacattccaattctggtgatggttagcatgcttgcgtacttctgtttcttggaacaacttctggttactaatttgcagtcacgtgcactggcaatttcattgcctttctcatgcgtgctaggcctcctttcttcaatgatagcatcaactatggtgtcgaagagctatctatgggcctatgcttcattccagtttgctattgtcatcctgtttgctcatatcttctacaatgtgttgagagtgaatccagtccttgcagtcttactctcctcattcactgggttcggtattgctattagtacaaactctctgctagtagagtatttgaggtggagagctagaaggaatcaccgtttggctcagcaggctgccaatgccgcacagcatcaagaatctgggaatgatggtgcaaatgacaacgatggtgctaggcagcaagggcgcgatgcaaattctgggaacaatgctgtatgattcagattatgaaatgttatgggtgtgaacagctgtttttttaaatctgtacagtaagtatagctcattcaactcggcaccagtcacaaggagctgaaacctggaaaaacgtatcttcatatgccacgtggagggtgctcacggatataattatacatcacgtagagatgaaccaaaacatgatatgtttgtgtattattagtccaagtagtttgacatcaaatgtatgggttattcattctaaggttaatagatctgatatatcacagaagtatatcactaagtgtgtgcagcatatagttgtgatttgtgagtatagccatatagatatacgtaaatgaaatgtacctttccagtattgaggattgctagtcagcacggaagaaatattcagattgaattgtgatacaat

SEQ ID NO: 11676 - DNA, 1104 bp, Sorghum bicolor
  Clone ID: SORBI-28MAY03-CLUS10125_1
atggttcggccaggcacaatcagcgatgaactcatggctggcgagaagccccgtaagcttgatccgcgacgtcactgcgtcggcaccctctccaatccaatccatccaccggtcaaaggagcatgatcccgtctgcgcctttccaacttcttccccatttataatttgctcactcgccggcggccgctacctgcaacccagcgacacccgaccgacagcctgcttgccacgcatgtatcgtggggtcattggccgccggccgctacgtcccaccccgccgcacccggccgacgccttccctcccacgctcgcagttgcgagcctccgtgcacctccgagcgttgaagccatccgccaggagttcagttcaaatggctgctgaatcagagaacggcaactgcaatgcttgggcagcgagagatccttctggagttctctcaccatacaagtttaaccgcagagcagtgcaaagcagcgatgttgcgctgaagatcatatactgtggagtctgttatgctgacgttggatggacacggaacatgcaccatgattcaaaatatcctgtggttcctgggcatgagatagctggagtcgtaactcaagttggtgcagatgtcaaagccgtttaaagtgggtgacctatgtaggtgttgggaacatatgtgaagctcatgccgaggtggcgagaactgcaatctctctctagaaaaccactgtccaaaaggagtttatactttcaatggcattgacacagatggaactgtcacaaaggggggttactccactcacattgtagtccatgaaaggtattgcttccaaatacccgatggctaccctttggcaaaggcagcacctcttctgtgtgctggaataactgtgtatactccaatgatgcgacacaacatgtaccaacctgggaagtcacttggggtcattggacttggtggtctgggtcacatggctgtgaaatttggtaaagcatttggtcttaaggtcacagttttgagtacaagtgaatcaaagagagatgaagccatcaccctccttggagcagataattttgttatatcatcagacacacaacagatggagtccctgaaaaac

SEQ ID NO: 11677 - DNA, 1137 bp, Sorghum bicolor
  Clone ID: SORBI-28MAY03-CLUS10623_1
gtctgttaacacctggcgtagaaaggccaggattcttacagcttctgtttttatttgaacatttgtcatatattttaaatatcatttgttaaggcatcatattggtagaagtttactcctgggttcgtatctttcacagtcattgagatgtacaaaattctgattattttacaggcgtgttctactaatatggatttttatgtgcagatcaaaataaaagagcattactggattggcccaaacttctcgcaataattgagggaatagcacatgggcttaattacctacatatgcactccaggctgcgtgtcatacatcgagatcttaaaccaagtaacattctcttggaccacgaaatgaacccaaaaatttcagattttgggctagcaaaaatattcagctcatataacgttgaaggaaacactacaagaagagtggttggtacatatggctacatggcacctgagtatgcttcggagggcatcttctctatcaagtccgacgtattcagctttggtgtacttgttcttgagatcattagtggaaaacggaattctggtagccatcagtgtggcgatttcatcaatctcattggatatgcatggcaattatgggacgatggaaggtggattgatctagttgatgcatctttggctcccaagaatcactcggcagagatgacgaagtgcattaagattgcactgttatgtgtacaagaaaatgcgactgatcgaccgaccatggcagaggttgttgcaatgctaagcctaagcagtgagacggctatgatcgtggctgagcctaagcagccagcatatttcaatgtgagggtcggaaatgaagtgacgtccacagctactgagtcatgcagtatcaatgatgtgaccatatcggtcacaactccaagatagtttttttttctccttccaagtggcagacatatgggttctacacttctaccatcatcccagtcactgactcatcactgcagtatctatatactgttgtaggattgtactctctgtgtttaaataagggtcgctatggtatttgtatccgtcaaactttcttagatttgattagatttatacaaaatattaacaacattggtgtctccaaataagtttaatataaaaa

SEQ ID NO: 11678 - DNA, 964 bp, Sorghum bicolor
  Clone ID: SORBI-28MAY03-CLUS109197_1
gcccgagccccgtccccgtccccttcggggcacgcggcaacttcggcttgcgcatcgatcttgaaattttggcgagtgtcgacgaccttaatcgggtggagtttcttgctcaccgatcgtcgaggtctgttcgattgaagttcgaagtgcgcacgcactgaagccgtcggggtccgtgacgatgtcgaggagaaccgcagcgttggcgctcgcgtgcctcgccgtgacgacggcggcgctggcggacggcgctctgcttccgtggttcggcgacggcaggcgcggcgggcgcgacgaggcggcggcggtgtcgccgctgtccgacgtgggactcctggcggacccgttccggatcctggagcacgtccccttcgggttcgaccgggacgacgtggccatggtgtccatggcgcgcgtggactggcgcgagacccccgacgcgcacgagatcgtggtggacgtgcccgggatgcgcagggaggacctcgaggtcggggtgcggggctaccgggggctgcgcgtgagccgcgcgcggcggcgcggcgggggccccgagggcgaccactggcaccgcgaggagcggtcctacggcaggttctggcgccagttccgcctccccgagaacgccgacctcgactccgtcgccgccagcctcgacaacggcgtcctccccgtgcggttccggaagctggcgcccgagcagatcaagggcccgcgcgtcgtcgggatccccgggggagacggagacggcggcgacgccaagaagagcatcggcgctggcgctggcgccggccccggggacgatcatcagaccaagaaggtggagctctgaacagtgaaaatgaggagatggctgtgcctagtatgttcttttgtgtggtctgtatgttttgagtactccacgacgtgtatccacttgtagaggcaagtgtgcgatggttactgaggaataaataaaaacatc

SEQ ID NO: 11679 - DNA, 998 bp, Sorghum bicolor
  Clone ID: SORBI-28MAY03-CLUS109236_1
gcacgagggccattcgtccactgacacagcaacacactgctacttgcaaagctccaagcctgtatactgcgacgttgaattgactagaatggcgaacgcagcaagatcttcttcgtggcctggtcccctgaggcggcggccgtgcggagcaagatggtgtacgctagctcctgcgacggcttcaggaaggagctggacggcgtgccggtggacctccaggccaccgagcccagcgagctgacgctcgacgtcctcaaccaccacgcatccggatcaaggatgatgagtgcctgcttcggcgtccagacattacgtcaccgttgccgaccgccgcgtccgccgtcgcggtcgcggcgggctgcgtggcgcggctccaggagctgcgcggcggccgcgcgcaccgcttcgtggtgttctaggtcgtcgtcgcgctgccccgggcgcgggcgggcatggtggccgttccggccgccggcgtcgccgacccctccgccagcctccccgccgacgactgccgctacgccgtgtacgaccacgacttcaccgtcgaggacgccaccgccaccggggaggcgcaggcggcgccgcgcagcaagatcttcttcgtggcctggtcccctgaggcggcggccgtgcggagcaagatggtgtacgctagctcctgcgacggcttcaggaaggagctggacggcgtgcaggtggacctccaggccaccgagcccagcgagctgacgctcgacgtcctcaacgaccacgcatcctgatgaatgatgatgagtgcttgcatcggcgtccatacattacgtcaccgttgcgtacgtacacgtatgcgttcgtatacatggcgtgcaaggtggtactaccgtgtacgggactacgggggtgctttgcaggcagcattggtgtgtaattaatggtgatatataccgagtcgcgtgcttggattgtttcctttccttccctgtaacgttgctgatacgtatactacacgaataaaa

SEQ ID NO: 11680 - DNA, 963 bp, Sorghum bicolor
  Clone ID: SORBI-28MAY03-CLUS10948_1
cgaaacatgtcaatctggtgagcgagctgagcagaattgtggaggaaaggaaacttatgctagtttcacagacagaacaagagctagcatgtactagtggacaagcagcagcctttgaggctgccacttccttgctaaacaatgaaagggtatctgatattgatcgcttgcgatcagtaatgctctatgctttgcggtatgaaaaagagagtccagttcaattgatgcaacttttcaacaaattggcttctcattctgccaaatacaagtcagggcttgttcaattcctccttaagcaagctggcattgataagagaacaggcgacttgtatgggaaccgtgatctgttaaatattgctcgcaatatggctcgtgggcttaagggagttgagaatgtctacacccaacaccagcctcttatcttccaaacgatggaaggaattgtgaaagggagattgcgagatgttgactatccacttgttggcaatcatttccagcagggcaggcctcaagatgttgtcatattcgttgttggagggacaacttacgaggaagcaagatcggtagccctttataatgcagcaaatccgggagttcgtttcttccttggaggttcagtggttctaaattcaaagagatttcttgaagatttgggagaggcacaaaggatatcaaaatcaagcactataatatgagctgaatggttttatctcttgtttgaagagtaccatagtatgataattgacagtgttgactccacttttgcacagaatcaaatttgtgataaatctgtaacatagttctaggtgcgtagaatcaaatttcgtgaagatctgtagctgctccagcttcaaccttctatatgttttcatggtcattgtttttcccttatttagttgaagcaatgatctagattttattgaaacatgttctttgtcttgttacgattgttgatagagattg

SEQ ID NO: 11681 - DNA, 514 bp, Sorghum bicolor
  Clone ID: SORBI-28MAY03-CLUS29975_1
gcacgaggcatagacaagcactcacacacactatcgcggcaatggccgacacggccgacgccccgctcctgacgagccaccacaagcaggccaagctggccaacaaggcgccgtccatcgacgacaccatcgagacgtacatcggcgcgaccggttccatgcagctgctgaaggccgtcctgctggcattcgcgtgggccttcgacgcgcagcaggtgttcatctccgtgttcacggacgcggagccggagtggcactgcacgggcgcctcggcgtcctgctcgccggccgcacccccggcctcgccgtgcgcgctcccttctggcgcgtgggcgtgggaccggccggccgagacgacggtggtctccgagtgggcgctcaagtgcggcggcccggccctcgtgtcgctcccggcgtcgtcgttcttcgccggctgcctggcgggagggttcctgctcaccacgctcgcggactcgctactcgggcgcaagaagatgctgctcacgtccctggt

SEQ ID NO: 11682 - DNA, 1028 bp, Sorghum bicolor
  unsure (1)..(1028): unsure at all n locations
  Clone ID: SORBI-28MAY03-CLUS30728_1
gcacgaggcaaacgtctccgcctcctctccttcccctcgccgccgcgctcgccacccctattaattctccgcacgaggcacttccacgtccaccactccgcacgcctcgacgcacaacctcctcctccttcgacgtcgtgcgcttcgcttcgccagttcgcctacttcctgccgttcctgtctgtgccgagacacgcagggcagaggcagagccaagtcaggggagagcactagagcacagggcagccagcggtcaagaaaggaaggagagaagagccggcgccatgtccgtgcgagtggcgtccgcgccggcggcggcgaggtccgcgggcggcgtggctgcgtggccgtacctggagcacatggcgcggtgggagcgtcaggtggagcggcggcagctgttcctccggagctaccacttctcccgcgacgccgagtccccacggtccccgcgcgcgcgcgccaggcgcgtcgtctgggtggggctccgccgcctgcgccgcgccgcggccacgggcctccgccgcctccgcgcgcgcctccgcctctgcttcggctgggccacccgccgccgcggctcctcctccttgccacgccgctccaaaaccggtggcctacgctacggccgcctctccggcgccggcaagccccgcgccgccgccgagtccgtcttcttctggtaactgcgctggcgccgccggcgcagagcactgcactgcagaggcgtgtgcgtgtgcgacctcgaagcattctttgcttcgtctgcttggttggttggcgtgtgtgaaacggagaggagcttacttagacatggattagctggtggtgcatgttaacttctactgctgtttctgtggagtgcttgcttaaactagcagtattattatttcctaattagagaggacaaagagtgttaattaattattagtagggganttatgaatggcgtttttttttccatttttcattcgcaactcgctgcttgtcttgtctgaatatattctcctgcctttctatcaatgaatgaa

SEQ ID NO: 11683 - DNA, 1898 bp, Sorghum bicolor
  Clone ID: SORBI-28MAY03-CLUS44539_1
gcacgagggtcctctgttcctcttcttgcccccaccctctcctctcctccgatggcgacgctgcagctcaaccacatcgcgcgggagacctccgacgtggtccgcctcgccgccttctacgaggccgtgctggggttcgagcgcatcccttcgcccacctactcgggcacgagggtcgcttggctccgcctcccgagctcccccgacgtcgcgctccacctcatcgagcgggaccccgccgcggcacccgccgccgtggggcctggcgccgagggcgcgccgccgtcgcagctgccccggcgccaccacctcgccttctccgtcgccgactacgacgggttcgtgaccgggctgaaagcgcggggcaccgaggtgttcgagaagacgcagccagacgggcgcacgcgccaggtcttcttcttcgaccccgacggcaatggcctagaggttactagcgctggtgcaggcagtgctaagtgaacagagaccatgttttgcagtacacttctgttttatcgtgtaatacctcggcaaacactgcctgcaaaatgcgatggaaactggatatgttcttgggtcaagcttcgttccgtaaaataaataaatccgaagctctgctcacactgttgtttggttgagacaagggcctgcgttcttgctgcatctcatccaaaatgattgtaatcctaacaatgtctagttaataaagttctcgtgttgcactcaaaatgttgtaagatgtaacatcgctccgtacgtgattggatttcctgcatgacaattggcaaatgaagtctgaatacttgccaaaaaaaaaaaaaaaaaactcgagactagttctccaaccccgggctcagatcggcagcttcggcggcggcgacggcggcggagatggcgatccggtactggccgatggccgcggcagccgttgggttccgcctcgtcctggttctcttcggcggagacctccaccttgcctctcgccctgaggtctccacccccctcacctcccttcgccgcctggcggaaggctactggctgaagcaagcgtccgtgtcgccgtactccggttctatgtatcacggttctccgttgctcctgtctgttcttggtccattaactaatagcagggcagatggacatcatgctcatatttactgcagattttctagcagccatgctcatccgagcaactgggcataaactccaaatggcacggagcagaagtttgaagttgcttgatctcacaaaggcagtaaacgatacagttaatgtaagcgctggagatgttgcttctctcatatatttgtggaacccttgcgcgagggtcacttgtgtgggttcatgtacatcaccaatcgagaatctaatggttgtaataatgatctatggagcctgttcacgtctggctcctcttgctgcttttggatatgttatggccacgcatctctctctttatcctgcaattctcgttgtaccggtcattcttttgctgggttatggtccagatgctcctccaccaaaagtatttcttataaaagacaatgataaaacaaccagacagagagttgttcagcagttttcatggaaaccggtacttcactttatattttggctgtttatctggtcgtgccatgtgttgttattgagcagcgtgattctgaagaaagttggtggcctccacgagatgtttgaaaagtaagatgctataagctccttttctggccttcagtgggacgtgtttcctgggatgtcaccaaattcatcccaaaatgtgcactagttttgccctaagccttcttcgcatataatataagacagtttttcttaaagtaatgaggtataactttgattaggagttccgttcagatatttgcaaatcatgtcgtccttgtaaa

SEQ ID NO: 11684 - DNA, 311 bp, Sorghum bicolor
  Clone ID: SORBI-28MAY03-CLUS10995_2
cccacgcccagtgcatcaccactcacgagctcttctccatccagattaacaggccatcatcggctttgtttctgatcccaaatcatttacggcgcaagtgccttctgttccaaaccccagtcccacagcaatggcgtgcgagaacggccgcgttgctgctaccaacggcgacggtctgtgcatggcgacgccccgcgccgacccgcttaactgggggaaggccgcggaggagctgatgggcagccacctcgacgaggtgaagcggatggtggccgagtaccgtcagcccttggtgaagatcgagggcgcca

SEQ ID NO: 11685 - DNA, 581 bp, Sorghum bicolor
  Clone ID: SORBI-28MAY03-CLUS10995_1
gcacgaggcacaaagctcaagctcttcttcgatctacaccactgtcagtcacgcaattcttagctagctgtactaataatccgccattagtagcagcagtgtagcgctactactgctgctcttgtttgtgtagctttaatttcccccagctagcaagtttctactttcgtcgctcatctcatctcgcacgtgtcgcaatggagtgcgagacgggtcttgtccgctccctgaacggcgacgggctgtgcatgtcggcgcaggcggcgccgcgcggcgctgacccgctgaactggggcaaggccgcggaggacctgtccgggagccacctggaggaggtgaagcggatggtggcggagttccgggacccggtggtgaagatccagggcgcgagcctgagcatcgcgcaggtggccgccgtggccgccggcgctggcgaggcccgcgtggagctcgacgagtccgcgcgcgagcgcgtcaaggccagcagcgactgggtcatgagcagcatgatgaacggcaccgacagctacggcgtcaccacgggattccggcgcattcggcaccggcaccgacggccacgt

SEQ ID NO: 11686 - DNA, 683 bp, Sorghum bicolor
  Clone ID: SORBI-28MAY03-CLUS11154_1
gccggccgggctgcggagccaccgtggagcgagcctcaggccctagtctcctctcctcaatccgacgcggcgccgcggccccctattttttagcctttcctctccgtcggcgacgcatacatccggcgagcggtccaatccggacgaggagatgccgcggatccctctgatcaagttccccaagcggaatctgaaagccccatcggcgccagcgccgtcgcaacccgcagatcagcacgcgaccctcatgtcccggttgggggctaaagcagaggcaccatcttctggagggattaaaaattaccgctttaggtcagatgtaccttccccaccttctcatactgccgtaggaggtccagcttcactccttcctaagcgtaaacccctgactgaagaagaaattgaggctattatgttgggaggctccatctgatatcacctcatatggattggaaattctaggaacatcaataagatcgtatacctgaacttatttcctttgacctctgaaagagtgttactgaagccatgttgatatggaattgggtgttttttttaattgtctggaagtcagctgttgagacattcgtttccagtattctgcacatgtaactggccaaatcgtgaacacattcagttccttgcagaagaagtgttgatcatggaatggttttgcatatctg

SEQ ID NO: 11687 - DNA, 1287 bp, Sorghum bicolor
  Clone ID: SORBI-28MAY03-CLUS11267_1
gcacgaggtggtcctcttgctctagcaagggacaagcttgcggatgggtcgggcgagccattctttgtcctcaacagtgatgtcataagcgaatacccatttgctgaactcatcaaatttcacaaatgtcatggtggtgaggcaacaattatggtcactaaggtggatgaaccatcaaaatatggtgttgtggttatggaggaggcaactggcagggtggaaagatttgttgagaagccaaaagtatttgtgggcaacaagatcaatgctgggatttacttactgaacccatctgtccttgaccgcattgaactgaggccaacttcaattgagaaagaggtcttccctcaaattgcagctgatcagaagctctatgcaatggtccttccaggtttttggatggatgttggtcagccaagggactacattactggcttgcgtctttatctagactcacttaggaagaaatcagctgccaggctagctactggaacacatgttgttggcaatgtgctggtgcatgagagcgccaagattggagaaggttgtctgattggtcctgatgtcgccattggacctggatgtgttgtggaggatggcgtgaggctttcccgctgcactgtcatgcgtggtgtgcgcatcaagaagcatgcttgcatctcaaacagcattatcgggtggcactcaactgttggaaaatgggcacggatagagaatatgactatcctgggggaggatgttcatgtgtgtgatgaggtatacagcaatggcggtgttgttctcccacataaagagatcaagtcaagcattctgaagcctgagatcgtcatgtgagctctccagttttagccacagtacattcttaagttctttgacaaagggaggatttgatatccccttttgtaaacgatattgcctggtatcttcgacctaatgcaaacagcttcatacatgttctcttgactcttgttaaactattgacaatgtatccttgttctttgttgaaaagtttagtactttagtgtcaaccatattccacaagtgattgtgatatactgagcttggaggttttggacccttgatctgcagaagttcaatgcaatagcaagagtaagttaaaaaaatgtggtccaaggtaactttcagtagtaatgtttgtgtgccaaatgctcttccggagaaatgtacacacataagaccatgtgtaatgtaaccctaatatggttcgtatttaatcttgtaccaataaatatactgtcggtctcttaccaatgaattactgtcggt

SEQ ID NO: 11688 - DNA, 662 bp, Sorghum bicolor
  Clone ID: SORBI-28MAY03-CLUS11194_1
gaggttgtagaaggaagggatcggagagcccaccccggctgggagagctaggaagaacacacagttactagctagctaggatccaatccaaggatccaacgatcgatcgatcgacatggacaggccagaccaccaccagcaccagttcttcatgccggcgccgacgccggtgcaggtgccgcagccacagcagcagcagcagatttgcgtgccgatgatggacgagccgtcgtcgttcttggcggggatgggcggcggaggtggcgggccgtcgtcgtcgtcggcgaggggtgagaggaagcggcggttcacggaggagcagatacggtcgctggagtccatgttccacgcgcaccacgccaagctggagccccgggagaaggcggagctggcgcgggagctgggcctgcagccccggcaggtggccatctggttccagaacaagcgcgcccgctggcgctccaagcagctggagcacgactacgccgtgctccgcgccaagttcgacgacctccacgcccgcgtcgagtccctcaagcaggacaagctcgccctcaccacacagttgaacgagctaagcgagaggctgagggagcgagaggaccgggccgccggcggcgcgacgacggctagcagcagcagctgcaacgtcggcggtgctg

SEQ ID NO: 11689 - DNA, 861 bp, Sorghum bicolor
  Clone ID: SORBI-28MAY03-CLUS11237_1
acttttggcatctcaactccaccggccacacgtttctcctccatctccatctccgcctggagtcctggacggacaccacgcgcccgacggcccgagcgacgcttccgcccccgcgccccgcttcgcttctgccttctggattgtccagctaaagacgctgcattttacaatccaagcttctttgggaagcccctgacgaaaaaccaagttggacttgcaaaggtggatagctggtccagtagggctggctctagaagatcaaccacggctccaaggataggatcccgtattacacttcgaaggggaagacaatgctcccagtgttttcctaagtttctacttgcatccccttcttttcacggtggtcgtggtgccctcccatctgcaggggggcatccttccgatttgacctaccttgctggtggtggtgctgctgaagtctgaagtaggattgttagtattgtagatattcagatagtattacataaattaagcatcataactatggtgtcggccaccaaggtagaaggtgaatattcgtttctgagcaagaactctcacctggatcaatctgaaggtgtgaagatacatctatatcaatttggtgcagaacacagaaatgagaaacttaaaagctttgcatgctctgtacaggatggcccaagtttacttgatatgttgcttctttcccagtgggataattttgcctggaagggccatttggactatgatgttactgcttgccaaattaaagtcattgaaggtggagtaattttggtggtctgattaaaataaatgagatccattttacagaatgaatattaaagtttttattatcatgatatttttatactattattt

SEQ ID NO: 11690 - DNA, 461 bp, Sorghum bicolor
  Clone ID: LIB3480-059-Q6-K1-C6
cagaaatgagaaacttaaaagctttgcatgctctgtacaggatggcccaagtttacttgatatgttgcttctttcccagtgggataattttgcctggaagggccatttggactatgatgttactgcttgccaacttaaggtcattggaggtggaagaaattttgtgggtcagctgaacaataaatggaatccattttcactgaaggaatatgacaagttctttgagtcctttgaatgcttgaagccaaatagtatgaagagttacgatggattgctcctgggcattgcacaaggagaaaatgatagacctgaggttgctccttcagcatcaccaccgaaggatggactacttgtgattgcaaatacatatcctgttgaatatggtcatatcttcttggtcccaagtgcaatccaataactatcttgctactgggacaaaaggatgattggactggctacaa

SEQ ID NO: 11691 - DNA, 1271 bp, Sorghum bicolor
  Clone ID: SORBI-28MAY03-CLUS112824_1
ccgggcccccctcgagatagttctctccagactagtgcctatctgccagagccaacatcgatctgagcacttttaggatttagggctctcctgcaacaaacacgcacgttcatggaggacgccattcctcccattccggcgaccacaagggttgctgtggtgaccggtggcaacaaagggatcgggctagaggtgtgccggcagctggccagcaataagggccttatcgttgtcttaacagcccggaatgaccagaggggcgcatccgccgtccagaagctcaaagaagcaggacattctaatgtcattttccatcagctggacaccaccgatgctctgagcatctctcgattggctgatttcttgaagagccgtttcggcaggatagacatcctggtgaacaacgccgcacttggtggtgttgagtacgtccaggatcctgcgtatagttcaacatccagcgagctagagctgcgtggcatgaacaagcagcagatggcagaatggatgttctcaaaggtcaaggagactttggacgccgctaaggaaggtctgcggaccaactactacggcaacaaagctgtaacccaagccttgcttcccctgctcaaagcttcctccgatggcagaatcgttttcgtctcctctgactacgggctgatagggcaactcaaagacgaggagctgaagaaggagctagacgacattgagaggctcacggaggagaggctggatgagatgctcgccacgtacctcaaagacttcgaggcgggggcgttggcggcgcgcggctggccgacgaatttctcagcgtacaaggtgggcgccgttgccatgaacgcctacgcgaggatcaccgcgaggatgcaccccgagctgcgcgtcaactgcgccaaccctggctacgtgaggaccgacatgtccgtgtactccgggtcgctgacgccggcggaaggcgcaagcaatctgctaaaggtggcgctgctgccggaaggcgggccgaccggctcctacttcagcgacggtcaggttgcgtcgtttgtgtgatgcagctcatcgccgttggttgccattgatatgggaataaagcgtgttggtgcgctgctgtggtatgctgctttcagaattctaacaaggattcatgttgctgctgggtcttaatttcttgtctgcagcatgcttctgcgcgctcatacaaacaaactaaaatatctttccctgttatgaaatattgttaaagtggatatcctaacccctatatacttgttatg

SEQ ID NO: 11692 - DNA, 633 bp, Sorghum bicolor
  Clone ID: SORBI-28MAY03-CLUS1128_2
ccgggtcggacccgcgtccgcccacgcgtccgctcatctggtgtgtcgtcgactccgctcccgctgtgctccaccactccccgcttcaaaaacagccaaaccggaaaaaagattctccgtccaatcctcgccccaaccctagccccggcgatctcgcatggccaccggcccgcgatctctccacgccctcctcggcggcggcgcagtcgccgacttgctgctgtggcggcggaggaacgcctcggcggcggccgtggtgggcgccaccgcggtctggttcgtcttcgagcgcgcgggctacagcttcccctccgtcctgtccaacgccttgctcctcctcgtcgccatcctcttcttctgggccaagtccgcgtcgctgctcaacaggcctcttccacctcttcctaatcttgaggtttcagatgcaattgttgaaaaagctgcagatcatgctcttgtatggatcaataggctgctggctgttggtcaagacatcgccatcaagagagataggaaagtttttataaaggtgatattgattttgtgggtggtttcattcgttggaatgctcttcaactttcttacgctcatttacatcggggtaatgctttgtctgttggctccaccactcta

SEQ ID NO: 11693 - DNA, 1029 bp, Sorghum bicolor
  unsure (1)..(1029): unsure at all n locations
  Clone ID: SORBI-28MAY03-CLUS1128_1
gaacgatntcggaacaaagcatccacagacccgaattagacgctacacaagcttagcctcaggttctatcacaaatcacccatcaaagttgatagaggctggctgctaaccaacatcagcagtatgcactacctaccacggaggactcaagactcgactaaccaagtttcagcagctacaaacctaaaaggctacaccggcccgcgttctgcagagcgagagaggatttctatttctttctttcttggcactctccagaagatgacaaatccgggcacaactatcgctttgatggtggcctcccatcgtcatcatcgtcgccatcatcatccccgtcgtcgtcttcatcatcgtcacctgacctcttcctcttcgtagaggactgtgccttcgcaccatcatcagcatcttcttcttcttcttcgtcaatctcctcctcctcagcaccatcaccgttttcatcaggttcaaagtcgcttgagtgctcttcgtcttcagcccgaccaaggggctgaacaagataatcagttcccagctcctcctcctgctcgtcttcgccgtcgacctcttcgtcgtcgtcatcgtcgtcgtcgtcgtcatcgtcgtcgtcgtcgtccccgtcgtcgtcgtccgcctccccgtcgtcgtcgtcatcttcgtcggagatctctacaacccctgccgcctccttttcctccccctccacctcctcctcgtcgtcctcctctccgccttccccatcgtcttcctcgttaccgtcatcgtccccatcgaccgcctcgtccccatcttcctcctccccgtccagcacctcctccacctcaacctcctcagcggctttcttggccgccgctgccttcttaatttccgccgctcgctcgtcagcctccacctccactgccggcttcatctcgacgaaatcggatctgattggatttgtgctcggtggatgccgcataccgccggcgaaagatgttgagacaatgtaatgcgtacatacaagtatgtggcctgcttgcgctgttagtc

SEQ ID NO: 11694 - DNA, 999 bp, Sorghum bicolor
  Clone ID: SORBI-28MAY03-CLUS9755_1
tctagatcctcttggccaattttcggatcaacaaatatgggaggttcttgacaaatgtcagcttcttgaagctgtccaggagaaggaacagggattggactcacttgttgtggaggatggttcgaactggagcatgggtcaaaggcagctcttctgtttgggacgtgcacttctaagaagatgtcgtatcttagttctcgatgaggccacggcatctatagacaatgctactgatgctatccttcagaaaacaatcagggcagaattcagagattgcactgttatcactgttgcacaccgtatacccactgttatggactgcaatatggtacttgcaatgagtgacgggaaactagtggagtatgacaaacctacaaagctcatggaaacggaaggatctctcttccgtgacctcgtcaaagagtactggtcatacacatcgaatggaaatatttagaactcacctcgtcaaagagtactggtcatactcatcaattggaaatacatgttcagtctcttaaaaggagatacaaaaatcttggctcgcacaactgaagaagtcttctatctgaaatcttaagaaaaggaatcaggcattgtcaggaaatgctcgttatcaagttttcaccacccattctgagcaactttttgatcacttctgttttgggtcattgattcccttcaggcactgaatagaaggaaacctgtccctcaaaaaaaaaaaaaacagaggaaatcttcagcatttctttgctccaatagtgaggtaaataaaagaataaatgggaggtattaacatcaagtctgcaacggtgatacttcatgttcatagaaatgcttaggctattccattgaaattttgtggtgtatacttacattcctacaaaactaagtcgagtatatgatgtctgggggggaaataatggcttttcagcaccctcttgttcatgtttaaggtatattcatcgagagagccgatttggtggtaaaaaaaaacac

SEQ ID NO: 11695 - DNA, 734 bp, Sorghum bicolor
  Clone ID: SORBI-28MAY03-CLUS9770_1
atacccgtgggagagcagggcgatcgcccggccagttcgcctcggcggagtgtagcactagcacaccatggagagctcgtcgccgtcggtgccgttcccgctgctgcaggcgccggtcgagagcacctaccgcgcctgcaccatcccctaccgcttcccctccgacaacccgcggaaggccactcctgttgagatccagtggattgacctcttcctcaactctgtcccgtccttcaagcagcgcgctgagaacgaccccaccgtacctgatgcgccggcgaaagcggagaagttcgcgcagaggtacacaacaatgcttgaagagttgaagaagaatccagaaagccatggaggaccaccagactgcatacttctttgtaggcttcgtgagctagtacttagagagctgggattcagggatatcttcaagaaggttaaggatgaggagaatgccaaggctatgtcactttttgagggagttgtgaagcggaatgatgaaattgaggatgatgggaaaagagttgagaacttgatccgtggaatcttagctggaaacatttttgatctaggatctgcacagcttgcagaagtttttgctaaagatggcatgtcgttcttggcaagttgccagaatcttgtatctcgaccttgggttattgatgaccttgatgcttttaagagtaaatggaccaagaaatcatgggaaaaggcagttatttttgttgataactctg

SEQ ID NO: 11696 - DNA, 731 bp, Sorghum bicolor
  Clone ID: SORBI-28MAY03-CLUS9991_1
tgtttgattgccctggccagattgaactcttcacgcatgttccagttttgcggaactttgttgagcacctgaaacgaaaaaatttcaatgtttgcgctgtttaccttcttgattcacagtttgtcagtgatgtaacgaaatacatcagtggttgcatggcttctctatcagctatgattcagcttgaacttcctcatatcaacatcctttcaaagatggatctagtctccaacaaaaaagaagtagaagagtacctggacccgaacgcacaggttcttctttcacagctgaatcgacagatggcacctcgatttggcaagttgaacaagtgtttagctgaactggttgatgattacagcatggttaatttcataccacttgatttgagaaaggaaagcagcatacaatatgtgctgtcgtatatcgacacctgtatccagtacggggaagatgctgatgtgaaggtcagggactttgagcccatcgaagacgaagactaaaattgcctcattggatgccgaaggagctgcaaactagttggtagtagtcttgtagtgaggtgtggcgtttgggaatattatatatgtatggcacagactgcaggcatgcaaaaaaaaaaaaaaaacgggcccataggatgctgatgacatctacctggtttatgtaagtttgaaactaaagcagagcactcatatctacaagttccagtaaaaatgattgtgccttgatgg

SEQ ID NO: 11697 - DNA, 1097 bp, Sorghum bicolor
  Clone ID: SORBI-28MAY03-CLUS9850_1
gccggccgggccgggacccgtcctactcctacctccagccacagagacgagctctaccattccacccacaccgaatcttccccggacgattccacccaagaaccgcgcgcaacaacaattcacaccgcgcttctcttctccagcgatgcaggcggcggcggcggccgtggcgtgggcgccgggcccgtcggcgtccacctcctcatcgtcctcgccctccgccttcagggtgggggttccgtcgacggccgtgccggcttcttccgcgcctaggcttgttgccgcctccgcgcccctgggtcgtcgacggcggcggcaagtggttcaagctgttgccaatccagaccctgcaatcaagctgccattgactgctgaaaatgttgagatggtgttggatgaagtaaggccgtatcttatggcagacggaggcaatgttgcgttgcatgagattgatgggaacatggtaaggttaaagctgcaaggagcatgtgggtcgtgcccagcttcagtaacaacgatgaagatgggtattgagcggcgcttgatggagaaaataccggagattgttgcggttgagcccatcgcggatgaggagactggccttgagttgaaccaagagaacattgaaaaggtacttgacgagattaggccataccttgctggcacaggaggtggcgagcttgagtttgtcacaatcgaggagcctattgtcaaggttaggcttacaggcccagctgctggtgtgatgactgtccgagtagcgttgactcagaagctccgtgagaagatccctaaaattgcagctgtccagctattgccataagattagaatcttttagaagtcaggcaccagtcacagttgacaatgtagatgtactactgcaataagtcttaaggagttgtaatgtgtagcctactgggcatttagctcctctacagcgatattatgaatattatgataatcgatacacaatgttcaagtgactaaaggtgtttgttggatttgtaaccggagttttggtttctgtttgtatgatctgtactcttgctataaacacgagggaagaaactaaatcatacacatatgttcagctttc

SEQ ID NO: 11698 - DNA, 901 bp, Sorghum bicolor
  Clone ID: SORBI-28MAY03-CLUS115_1
gttgcaactgaaaatgccagaagtgactgcagtatcaattgatccaaatttttcttcatatctttttagcgagtatttgtgtagtacgtccgacaagaaattatctgaaggcgtctaccttggaaggaataagcggaaatactcaaataatgatgaaccttcagattctttgaaggcaatggatagtatcaaagttgtgaatggtcttgaatgcaagatatcctgcaagacctctaaggtctcatatgtccttgatactgaagatttcttgttccgacttcggaagagacggaaaattttgcggggtgggaatgtgcccgacagtttgcagatttcaaaaatatatgctgcaaaagtgcagcgcttcaataggttcctatccaaaccatagggtcatttggcatacaaatgtatcgaaacctggtgttgctggggtcccagctgcttcgcttgaacaatgattccatcgacaattcgtcgcagagtgccctttcggaataacagatgggaagacatatagggtaaatacagcaaagcgaagcgagcatgtaggccacagcagtcaagctctgttgtgccgaaagatgtgtatatatgtattagcagcatgttgtttgttctgattacccttttactggttttcgatggtaggtctattccatcaagtatttaactaatcatcatttgttgctgttggtataggtcttctgttctttttgccgtcgttttgcattgaagatatgtagccaaaattaaaccctgtgtcaaacagctatgtagtcttggcttggttaagcaaacagagaccgtaatttcttaggagcaagtttcacctatagcttagagctgtgcgcaaaaaaaaaaaaaaaaaaaaaaaaaaaaaaaaaaaaaaaaaaaaaaa

SEQ ID NO: 11699 - DNA, 1186 bp, Sorghum bicolor
  Clone ID: SORBI-28MAY03-CLUS117115_1
gcacgaggcgcacgtcgacacgtacgtgcttactgtgcatgcaatcacgcgccaacacgatgctccaccaccgagtcccaggtgacaccgctccttgaccccgacctctctctgcagctggacctgcgcgcgcgaacgccaatcaaccctctacctcatatatgggcccgctgatcccgctaccttaacttgctatattttcacaggcaccacacactagagagagaacgagagcgcgccatttatgggtcaggacgccgtggcagcgaacggcaccgccggcggcggccggcgccgcgcaaggccgcacgccgtggtgatgccgtacccgcacgagggccacgtcatcccggcggtgcacctggcgctgcggctggcggagcgcgggttcgcggtcaccttcgtcaacacggagtccgtgcaccaccagatcggcgccggcggcgacatcttcgccgccgtgcgggcgggaggaggaggagctacgacgacgacgacggagctggacgtgcggtacgagctggtgagcgacggcttcccgctgggcttcgaccgctcgctgaaccacgaccagttcatggagggcatcctgcacgtgctcccggcccacgtcgaggagctcctccgccgcgtcgtcgtcgacccgcccaccacgtgcctcgtcatcgacaccttcttcgtgtggccggccacgctggcacggaagctgggcgtcccctacgtgtccttctggacggagcccgcgctcatcttcaacctctactaccacatggacctgctcaccaagcacggccacttcaaatgcaaagagcctcgcaaggacacgatcacctacatccctggcgtggcgtccatcgagccgagcgagctcatgtcgtacctgcaggagacggacaccacctccgtggtgcaccgcatcatcttcaaggcgttcgacgaggcccgcgacgccgattacgtcctctgcaacaccgtggaggagctggagccgtccaccatcgccgcgctccgcgccgacaggcccttctacgccgtgggccccatcttcccggcggggttcgcgcgcagcgccgtggctacgtccatgtgggccgagtccgactgctcccggtggctggacgcgcagccgcccggctccgtgctctacatctccttcggcagctacgcgcacgtcaccaagcaggag

SEQ ID NO: 11700 - DNA, 641 bp, Sorghum bicolor
  Clone ID: SORBI-28MAY03-CLUS1179_1
gccggccgggccgggacgcacgtgacgtggctggcagcaactccctccaccatctccttcccctgcagcacctgtcgcgtctccctccccgaccgagcgatccagcgagagggagcgagaagcagcagcagccgccggaggagctcgccgaggccgccgccgaagacgaccatggggttctgggttaccacgctcatcttcctcctcgccggcgtcgccgcatccctcttcacgctcctctgctgcaaccgcgggccctccacaaacctattccatttgaccttggtgactacagctgtaatttgttgttggatgatgtatgcaatcgtttaccttgctcagatgaagccattgatcaaccccatcctgagcggagagtgagctctgtctcttcattaaacagaatgaaagctagacctgctgtaccattattcagtctgtgaactttctattcattttggcgcacctgatgaaataaataaactgccatgagtttttttgctactctgcactccagacattgaggaggctcgctgtgattagtgtatgcaattgtatgatatacgcaataataaatatctatgtgtcgctcctgtgcttttattggaaaaaaaaaaaaaaaaaaggcccctaaggccgcg

SEQ ID NO: 11701 - DNA, 938 bp, Sorghum bicolor
  Clone ID: SORBI-28MAY03-CLUS12313_1
gcacgaggctcttccgtaagcacttcccgaggaaacgaagacagagggcacgaggctgcagtgaagtcgccggcgccgccgcgacaggaggaaggagaaggagcggcagcggcagaggcaggcccggcgatctcggctgctgcggcgcggtaagggagggagcggagccgcgacaggatgcactcctttgggcaccgcgccaacgcggtggcaacgttcggggtcaccatactggccgcgatgtgcttcgccgcctccttctccgacaacttcaacaccccgacacccaccgcctccgtcaagatcttgaatataaactggttccagaaggaggccaacggcaacgacgaggttagcatgacgctgaacatttcggcagacctttcatctcttttcacgtggaacacaaaacaggtgtttgtttttgtggcagcagagtatgagactccacagaatgctttgaatcaagtttctctttgggatggtattatacctgcaaaggagcatgccaagtttttgatccataccacaaacaagtacagatttattgaccagggaagcaatctaaagggcaaggaattcaacttaacaatgcactggcacattatgccaaagactggcaagatgtttgcagataagatagtcatgacaggctatcggctccctgagcagtacagatagtcagggagatcatgaacaggagtggaggcctgcaagaagtgttagtggcagtggcatagctgatcctgagctttttgttctaatctaagtggaacatgtaatcttataagcatctacttaagctgaaccaggcgaaacaaagttgttatttgaggagatatatgtattgttcaactttgctttgcctataaaatgttgattctgaacttgaaattgtttgttggtctgaaactgtattgcaatcgcggagcactata

SEQ ID NO: 11702 - DNA, 1130 bp, Sorghum bicolor
  Clone ID: SORBI-28MAY03-CLUS125221_1
gggagaaaatctgttttgccctgttttactatggatttctgcaagaaccgaaaaggctaaaactttgtacatacaggacgggttccgcaaggttgatccggaccggtgggagttcgcgcacgcgtcgttcctgcgcggccagacccacctcctgcgcaacatcgtccgccgcggcagcagcggcagcgccggaggcggaggcggaggcggcggcggcaagaggaaggacgcaccagcgtcggtcaaccccgtcgagccttccgcggaggacatcgccatggtggccacggaggtggtgcgcctcaagcagcaccagcgcaccatcgacgaccgcgtcgccgccatgtggcgccgcgtgcaggagacggagcgcaggcccaagcagatgctggctttcctcctcaaggtcgtcggcgaccgcgacaggctgcaccgcctcgtcggcgacggcggcaccgccgccgcgccggggccagataataacgggttcgcctccgggggcgccgccgccgccgaggagggcggcgagaagcgggccaggctgctgctcgacggtgacaacatggtggcgctcggccccgaggccgtcgacttcgccgggttctacagcggcggcggcgtgttcgggttcggcgacgtcgccgtggacgctgccgcggggtccggcggcggcgggtgctcgtttgcgttcggcggcgggtactgagtcacgaccatgccgtgcggcgcccatgccgcccagtgtcagcagcttggcccgcttttgctgctgtttctgccgacttcttcttgccaatgccataccggcgtggcggcccgcggccgcttggaacgcccaagaggcaagagcagcggcggcagccgtgacatggaagcatggcaggggcctgcctagagtcagccagtgatgtccatgctccatggtcgtgtctatttgatgcttttggtggatctgatttcatgggcgggagtgactaccgcgtcgggatcatccaagctaaataaggaactactgtctgtgatggagtgtgaccttggaaggaacttcctgaaatgtgtaggtttgattgatgttgtacatgcatggttattattgtagtggccaagtccatgcatatttcaatctcctg

SEQ ID NO: 11703 - DNA, 761 bp, Sorghum bicolor
  Clone ID: SORBI-28MAY03-CLUS12571_1
tacttgcatcagtgaaggagagaggaaagcaggctgatttcgtattgtgcatcggcgatgataggtccgatgaggacatgtttgaaaatattgctgatatcattaataggaatgtggttgatccaagaacatcgctgtttgcgtgcactgtgggacaaaaaccaagcaaagccaaattctacctggacgatacattcgaagtggtcactatgctgagcgcacttgcagatgccacaggacctgaactggagactgattcggctgatgaattggccgcatctatctcttcacttgatattggtgacgaacaatcagaatccagtgatagaccaattggagggtcttagccagttttctcttgcattttcagaatatgatgattgtttcaatagtcaattctacacgattttctgatggatatgaagttcgactactaacaactggttctacggatgctccagagggaagcttcttaatctgctgtactccaagtttctccagttgggcaagatagtacagtctgttgctgcaaggcgtagatccatatgttcatagctgactcgccgactttcttggcacattctttcactttctcatttctggttgaagtaaaatgaaagcctcgcagaaggcaagggaactgtgtggctgaagtgattgtggggaggtataggagtggcaaatgtgaaaggagcacgtgcggagcttgtgatatgatcccgtattaacacgacgttacaaagtggtgtcacttttgaact

SEQ ID NO: 11704 - DNA, 1253 bp, Sorghum bicolor
  Clone ID: SORBI-28MAY03-CLUS10500_1
aggaaactcaaaaagggcggagaaactgcttgaactggaagcgaccctagtccaaaaccaccgcaccgagcccccgccgcgccgcgccacctccgctcctctcgtctcccccggccggcgtcgaggccgaagcgaaggcgagcatgcatcacgaccccaaccccttcgacgagggcggcgccgaggacaaccccttctccaatggaggaggtggaggcggcaagcagcagtacgggttccggccgactgagcccgtcgggttcggcggcgccggcagggggggcgacgccgtcgtcgacgtcccgctcgagaccatgggggactctaagagcaagtcgagggagctctcgtcgtgggaatcagatctgaagcggcgagaagcggatatcaagaggagggaggaggcgctgaagaatgctggtgtgccgatggaggagaagaactggccaccattcttccccatcatccaccatgacattgccaatgagataccagccaatgtgcagaagttgcagtatcttgcattcgcaagctggcttggaattgtgctttgcctgtcctggaacttcattgctgtcatagtctgctggatcaaggagggagattcaaagttgtttttccttgcaacaatctatgctttgcttggaattcctctgtcatatctgatatggtataggccactctaccgtgcaatgaggactaacagtgctttcagttttggatggtttttcctgtgttacctgatccacattggtttttgcataattgctgccattgctccaccaattgtatttcatgggaaatcattaactggtattctggctgcgattgacaccttctctgagcatgtgataattgggatcctttactttgttgggtttgcactgttttgtctggagacattgctgagcattggggtccttcagaaagtgtacatgtacttcagagggaacaagtgaagccagtcatgatggagaattacatttcttgacaaaatggggagtactttagcacatgttcactcgatggttttgtgcatatctgtcagtacaccttgagtctgtcttttcttatgtcagtggcactgagaattgctttttaagatggtatggaagtaggatagcacagagaaccgccttgcactcgcggcgctatgtgttcaaacagactatgggggtgattatgctgccggtacaagaagtataaatttctagtccatttgaaccagctatagttgaagctgaaagacaaat

SEQ ID NO: 11705 - DNA, 784 bp, Sorghum bicolor
  Clone ID: LIB5049-008-R1-XP1-D5
ccggccgggccggggaggcaggaaaactcaaaaagggcggagaaactgcttgaactggaagcgaccctagtccaaaaccaccgcaccgagcccccgccgcgccgcgccacctccgctcctctcgtctcccccggccggcgtcgaggccgaaacgaaggcgagcatgcatcacgaccccaaccccttcgacgagggcggcgccgaggacaaccccttctccgtgagcgcaaaaccctttccccccctcgttcggaaatttcgctgcctacctaggtggtttggtagatctggagattttggtcgagtatgtctgatcaaccgtcgctgttgcgtcgtagaatggaggaggtggaggcggcaagcagcagtacgggttccggccgactgaacccgtcgggttcggcggcgccggcagggggggcgacgccgtcgtcgacgtcccgctcgagaccatgggggactctaagagcaagtcgagggagctctcgtcgtgggaatcagatctgaagcggcgagaagcggatatcaagaggagggaggaggcgctgaagaatgctggtgtgccgatggaggagaagaactggccaccattcttccccatcatccaccatgacattgccaatgagataccagccaatgtgcagaagttgcagtatcttgcattcgcaagctggcttggaattgtgctttgcctgtcctggaaactcattgctgtcatagtctgctggatcaaggagggagattcaaagttgtttttccttgcaccatctatgctttgcttgga

SEQ ID NO: 11706 - DNA, 1288 bp, Sorghum bicolor
  Clone ID: SORBI-28MAY03-CLUS10987_1
agtcgtccccgtccctccactcctcccgtcgagcacttggcactgccaatggcggctcccgcccacaccccttcgatgcgcgcaagccacctcctttcctcgtgagatcgacgcacctcctcctctcgtgctccattcccgctcctcgttcgtttcttcggccccgagccagccatcgcgcggccgccccccgcatctcgtcgtgctcccacccaggtccttggcctccgccgttcttggacaggggcgcgccgccggtgcccactccgcggaatccgactccctcgtgccgctccgtacggtgggagagatccatcaggccgtgagcgggaggggcggcgtccacacaaccgggggggacgggcaatggcggccgtggcaggcccactctgcacgtggctcgtcgccgcgtgcttatctgcggcatgcgacgccgaagagtacaagcagaagcattgctgccccggcggaagcggcgctgggggcggcgtcatgctcggccagcgccgccgcctcggcgcgcggcgccgcggcttggcgcgctctggaatggctatggctgttgccttacaagctgaaagaagtgtcatcgaaaagaagaaacccgatatcaaacaaaggagggtggttgtcactggcatgggtgtagtgacaccattgggccatgatcctgacgtgttttacaacaatcttcttgatggtgttagcggaataagtgagattgagaggtttgactgttccaacttccccacgagaattgcaggagagataaaatcattttcaactgatggttgggttgcacctaaacttgcaaagcggatggacaagtttatgctatatctgataactgctggaaagaaggcattagaaaatggtggactcaccgaggaactgaggaatgagttggacaaaaccaggtgtggggttctcattggttctgcaatgggcggcatgaaggtttttaatgatgcaattgaagcactgagggtctcttacaagaaaatgaacccattttgtgttccttttgcaactacgaatatgggctctgcaatccttgcaatggatctgggatggatgggaccaaactattctatttccacagcttgtgctaccagtaacttctgtattcttaatgcagcaaaccacatcagaagaggtgaagctgacgttatgctctgtggtggttctgatgcacctcttatcccaatcggattgggaggttttgtggcctgcacagcactttcacagaggaacagtgacccaacgaaagcttatcgcccttgggaca

SEQ ID NO: 11707 - DNA, 945 bp, Sorghum bicolor
  Clone ID: SORBI-28MAY03-CLUS111402_1
gcacgaggaagattctagatcaaacaatttctctactgaagtaacctttctcgacctctttaaatcttcccgacctcaaccacatgaacatgttcacaccaaagacagtcgctttcttcggcgctagcacaggtgtatgcctctcaccgctgaaacattcactggctgcagggcataactgcatcgctctgtgtcgaatcccttcaaaacttgaggcgcacgtctcaccaaaaactcattccaatctacggattgtccaaggcaacgcccacgatatcaaggtagtggcttcttgcctgaaaaaggatgacggctcaatcgtggatgcggttgtctctacgattggcggcaagcccatcattcacaaaatgacgattgatgatcccaactgttgtcgaatcggcatgtctgtcattctcgatgctctcacccaaacacgtgcagagggtgcagtaggaagacctcacatcaccgtctttagcaccactggcatgtctgactttggtcgcgattatccccttctgctctatcctatttatgcgattgctctcaaggttccgcacgaagacaaaaagatcatggagaccaagttggccgacagtggtgaagtcttcaccatcgtgcgaggcagtctgttggtagatggtgagagcgaaacgccagtgcgcgtaggcattgaggaccccaagaatgggatagagtcgttggagattggatacactatatcaagggaggacgctgggaaatggttggcagataatctgcttgtaaagacacgttccgagtacgtgatcaagattgcatctatcacctactgaggggattcaacggaataaggtgcatttagaaggtgttggggattaattgggaacttagcgtgaacttatagataagtgagctcgtacgatccagtttttacatgatacaaataataatcgtctaaac

SEQ ID NO: 11708 - DNA, 1306 bp, Sorghum bicolor
  Clone ID: SORBI-28MAY03-CLUS13558_1
caataccgggcgcgttagtgtctggtaattggaatgagtacaatctaaatcccttaacgaggatccattggagggcaagtctggtgccagcagccgcggtaattccagctccaatagcgtatatttaagttgttgcagttaaaaagctcgtagttggaccttgggccgggtcggccggtccgcctcacggcgagaaccgacctactcgacccttctgccggcgatgcgctcctggccttaattggccgggtcgtgcctccggcgccgttactttgaagaaattagagatggttctagtgcccaggcttgtggtacaaatgttcagagtaacctgctttcatcatcatttgctatccatgatggcttgtcaaccgtcaggagtggtggtgttggcagtggaactgatgcgataaccatagcttcgttgagatatggtgatatgaatttgctacctgaaaactccatagcaacgtccagttgtttgggtgaatcaggaaccttcaattctcttgacgatgtttgtggtgtaaacccatcacaaggtggaacctttgtgaaggtttacaaatcagggtccctcgggagatcgctcgatatcaccagattcagcagctactacgagttacgtagcgagctcgagcggttatttggtcttgaaggccaattggaggaccctgtaagatcaggctggcagcttgtattcgtcgaccgggaaaatgatattcttctcgtcggcgacgacccgtggcaggagtttgtgaatagcgtatggtgcataaagatcctctcgccacaagatgtgcagcagatggtccgcggcggaggcgaccttctgtctgcacctggagcgaggatgctgcagagcagtgtctgcgatgactattctgcaggccacgacatgcagaacctcaccggcatcattgcacctgtggtgcctctggactactgagactgagatgaagaccggaatctgaagttctgaaccaaaaccagcaattcagcaccggaggattgccatccacaagtcgtttcagttcctatgatcttctctcatgtcctgttggtcagaaataacctagtcattaatatagctagatgagatgatcccttgtatcattatggtaatggacatgttgtacgatagctactgtagctatgtgatagccatagcctaagctctaaatggcagggaagaattgttctatgaaagtatgaatgcaggcactcactgtagaggtgatctagccctgtagttctctatattatcttatatcgaaaactgatggttccttgtggcgcctaaact

SEQ ID NO: 11709 - DNA, 684 bp, Sorghum bicolor
  Clone ID: SORBI-28MAY03-CLUS13347_2
ccgggaggcataaatcccaatcaccccttggagctcccggtcacggctgctcaagctcaattgtactgtgtcagcgggaagaaagaggagacacctccagcctccggggctccagagatcgagcgagcaagatgaaggagggcacggcgaactgcgtcgacatcctcatcgccatcatcctcccctctctcggcgtcttcctcaagttcggctgcaaggtcgagttctggctctgcctcttgctcaccttcctcgcctatcttccggggatcatctacgcgatctacgccatcaccaaggactagcatggtaccagttgtggacaatcaacatcccgtcagtttctgtcagtttctttctcctcagcaacagtcgagtgagcgcttgatcaacaagcggagtaatggaaatgaactagctagtacctcgctgccatcgtaataatcgctgcttgccctgctgctcgatgtttgtggatgcaggaactgcgccgcaggatgtaaaattcattactacgtacaattgtcctttggagatcggttgaatctcagctgctgtgaagccactactagtctactactgattgagcctgaatttgtcgcttctcgttcgtgtattccgtcgatcgctctggttgttggtcgtggatcttagtaccagtttgtttaacatcacagagtaact

SEQ ID NO: 11710 - DNA, 688 bp, Sorghum bicolor
  unsure (1)..(688): unsure at all n locations
  Clone ID: SORBI-28MAY03-CLUS13347_1
gccggccggngtacgaggataagtccactcaccccttggagctcccggtcacggctgctcaagctcaattgtactgtgtcagcgggaagaaagaggagacacctccagcctccggggctccagagatcgagcgagcaagatgaaggagggcacggcgaactgcgtcgacatcctcatcgccatcatcctcccccctctcggcgtcttcctcaagttcggctgcaaggtcgagttctggctctgcctcttgctcaccttcctcgcctatcttccggggatcatctacgcgatctacgccatcaccaaggactagcatggtaccagttgtggacaatcaacatcccgtcagtttctgaactgcgccgcaggatgtaaaattcattactacgtacaattgtcctttggagatcggttgaatctcagctgctgtgaagccactactagtctactactgattgagcctgaatttgtcgcttctcgttcgtgtattccgtcgatcgctctggttgttggtcgtggatcttagtaccagtttgtttaacatcacagagtaacttgtaatgttctgcttctgtattcgattcagtggtctgcgtaaaatttgtctccaacttgtgactgtgatatactagtgtgatgcatatatattgcttggtgaaaataaaaaaaaaaaaaaaaaaggccccta

SEQ ID NO: 11711 - DNA, 768 bp, Sorghum bicolor
  Clone ID: SORBI-28MAY03-CLUS13570_1
gagtagctgccaagggtctatcacaataaataatacacaccattattatattatcacctggccaagcggccagtgtacacaacacgaaatcatctccatgcatgcatgtcctctctcatgcgcaacacagtagtaagagtagtaactagtgaaagcagaagcttgagaaagcatgcagagtaccggtagctaggacacacagatgtgtctcattctccagacgtacacatgatcgacgcatgcacagccatccgatccagagtcacggacggtgcggcatgcatggtctatggacggatgctacgcatggcagccagctggagctggtgacggcgagaggcaggcagagagggtccgtgcctccggagggaggcatctaagggcacttgggcctggtgcggttgccgtggccggtggtcatgtcgcggtagcaggggcactcgtccttgtggcccgcggtgccggacggcacgcagttgcagctggcgcagcagatcccgcagtacttgaggcagtcgtcgtgccggctcgccttggagcacctcaccccgcacttgccgtcgcagaacgctgatccagccatggagacacggagcgaaggcggcgccaggaggaggacgaggaggagagcaacggtggcggccgtctcaagcttcattctgcccacctacactactactgccactgctgctgctggtcgctgcttggtgtgaggtttgggaaagcaggggcggtggcgataaaggagagggtgcaagcccggccggc

SEQ ID NO: 11712 - DNA, 1859 bp, Sorghum bicolor
  Clone ID: SORBI-28MAY03-CLUS11939_1
gcacgaggggccgctgcctcgaatcggttcctcctctggagagggagctatgtcttctcggtcgccgtcgcggccttctggcgacgtcaacgtcgacgtcgacgtcgacgaacggagcatgggcagattgcggtccctccgtacccaaatccgctcccgccgccacctctcaggcccgacggatgcttcgatgcctaccccgtcgccccactcagtccgctcccgccacctccccccaggcccgacggctgcttcgatgcctaccgcgtcgacccctgttgacccgacggctgcttcgatttctaccacggcgacccctgttgacttgttccaattttccacaggggggccgtcctatgccaccgtcgttcgctttggccttcgtaccgtgcccaaaccccaaccccagcaggaatcaggatcggaatccgatttagaactggacagtcctcctcgtctcaccgcactagaggatgaagatgataaattggacattcccacatctccgggtggttcttcagaggatgagatggatcgttgtggtagtacaccaccaccatcgattgacatagggcctgcagtgttgccaacatttggctctgatactgaggaatggcatttctcagatgaccaggaggatctatacttcaaatctttggtggacaacttcgtcagtgcagttggagatgtatacaaatctatgttaccagaggacactatatgtaaggaggcagacaatcagctacagtctaatagatatgccatgagtgccttaaaacattacaacaacagcgaggataacaaggttaaatatgagttaattgatgctatcacaagcggtggaatgatagatatgaatggcggctacggtcatgtgaattttacagcaaaagcaaatcaggaaaattcaaaagaggagcttttctttgctgagttacgattccaccacaatacctatatagcaacctgtgtgctttctctggagggggagaaatcagttggtggactttgtgggagtaaatatgataatcataagaacggtttttttatcgatgctaagcattgctgtgcgccggccgggccgggtcttgtgggcgtggattgaaacatcccaagaacggtgcattatatgagggtggtcatgttgcttgcagcgattactatcatggatgctaggttgtcacatgatgaattccttgccattacaataagcacccaaaggacaagcataaagtatatgtaaaatatatatgattttggttacatggtctggggagtgaagcacctagacaatcactcgtttgtctatcagagctacctctagctaatttacgagtaatgtcgcatgattcttgatagtgttctttgtactgctgtgtttatggatatattgatgctaaaaaaaaaaaaaaagcatcgatctttctaacaattcacacgggacaaaccatggcggctgccttcacgaagctctccctcaccttcgtcctcctcctctccgcgttcgtcgtgtccggcgagatcgggggagccatggcggcgaccgactgctcgacggtccggtgcatccagggcgggtacatcacctgcgacaactacccgtaccagaagctggacggctgcgcctgcgtctgcgcgcccaagaacggccggaactgcgtgctccacctccagtccggctccacttacaactgcggcgacaagaagaaggaatagctagcccaagccgaccgatcagtacgtcttcgagtagagtcgaaccaataatgcttcaagctgtgtaccctgtcggatgataatagttctactgaaacgagctgaataatgcttgccaaaaaaaaaaaaaaaaaaggccccta

SEQ ID NO: 11713 - DNA, 396 bp, Sorghum bicolor
  Clone ID: LIB3478-036-P1-K1-D7
attgaggaatggcattcaccatatgaccaagaggatccatacttcgaatctttgatggacaacttcctcagtgcatccggagatgtttgcaaatctatgttaccagcaaagaacactatatataaagagagaagtcatcaacaacaatctattgattatgcagtgagtgccctaaaacattacaacaacaatgagaataacaaggttaaatatgagttaattgatgctatcacaagcggtggaatgatagatatgaatgacggctatggtcatgtgaattttacagcaaaagcaaatcaggaaaattcaaaagaggagcttttctttgctgagttacgattccacgacaataatacctatatagcaacctgtgtgctttctctggagggggagaaa

SEQ ID NO: 11714 - DNA, 1028 bp, Sorghum bicolor
  unsure (1)..(1028): unsure at all n locations
  Clone ID: SORBI-28MAY03-CLUS13670_1
ngagatacacaaccctattttggggggttttcttcctccccggtcaccttgatattgggggagcttcgcctcccctgccttctcttgtcgacgtctccctctccctctccttcctccagcaccagcggcagctgtcggagcacgacagctgcggtgaagagtcatccttcagagggaggaggaaaggggacgacggcaggagtttaagccaacaatctctcatcatatcgtaatatagagcacaacgacagaagccatgggcagtaatggcagagagcataggtgcggagtcccacgcccgccacctttatcactttacagggactgggaggaggaagaggtcgtcaaggtcggcagacgccagcagtcgccgctggaacagtcaacatcgatttcagccacagccggcattgccaacaagaagaggttgtcaaagcaggtgtccatgaaggagaccacccgggaggtcaagtgggagaagcggaggcgacagatacagcgacagaggagcagcatgcgcctcaacgaagctgacgacagggctggtagcaggactgtctgtcatgttgacagcgaggcgagctcgagcgcggagcgggtgtcgtccaagcgtataaccgacgaggacctcgatgagctgaggggatccatggatctcggcttcaggttcgatgagcacaagggcgggcaggacctgtgcgacacgctcccggccctcgacatctacttcgctgtcaaccggcagctgtccgagcccaaaatgcggttttctacgagctcagcaccgtctctcttggccaccaagtcgtcgcccaacctctgcggcacgcccagccccggaagtcctagtacgcactctaataaccccttggagtcatggaaaatttgcagtccaggagataacccacagcttgtgaagacaaggcttaggcactgggctcaagtagtggcttgttcagtgaagcactccagctgatccttgccagtgttctatccacgcccttnctccatatatatactcgtacaag

SEQ ID NO: 11715 - DNA, 1705 bp, Sorghum bicolor
  Clone ID: SORBI-28MAY03-CLUS13763_1
cgagggtgtccggcgtggtgaccaacgcgcccatcatgctgaacgtggactgcgacatgttcgccaacaacccgcaggtggcactccacgccatgtgcctcctcctgggcttcgacgacgagctccacagcggcttcgttcaggcgccgcagaagttctacggcggcctcaaggacgatcctttcggcaaccagatgcaggtcatatacgagaaagttggatttggagttgccggacttcaaggcatattttacggcgggacaggttgctttcaccgtaggaaagtcatctacggcgtgccaccagactccaccaccaccatcggcatcaaagattcaccatcttacaaggagctgcataagaagtttggcagctcgaaagaactgatcgagtcggcgaggagcatcatttcaggggacatgttcagaacaccaactgaggttgtggcagacctaacgagtctcatcgaagcagccaaacaagtctccgcctgcagctacgagaccggcacgagctggggtcaggaggtcggctgggtctacgggtccatgaccgaggacgtcctgacggggcaacgcatccacgccgccggctggaggacggcgttgttgaaccccgacccgccggcgttcctcggcggcgcgcccaccggcggacccggcagcctcacccagtacaagaggtgggcgacgggcctgctggagatactcctcagccgccataacccgttccttctcgccgcgttcaagcgcctcgatctccggcagtgcgtcgcctacctagtcatcgacgtgtgggccattagggcaccctttgagctgtgctacgcgttgctcggaccttactgcgtcatcgcaaaccactccttcctgccaaaggcgtcagaaccgggtttcgtcatcctgctggccctgttcctaggttacaacgtgtacaacctgggcgagtacaaggactgccggctctcggtgcgcgcctggtggaacaaccaccggatgcagcggatcgtgtcgtcctccgcctggctgctcgcgtttctcaccgtcgtcctcaagacgctcggcctctcggagacggtgttcgaggtgacgcgcaaggagcagcagagcacgtctgatggtggtgcggacgccgtcgccgacccggggcggttcacctttgactcgtcgccggtgttcatcccgccgacagcgctcacgatgctgagcatcgtcgccgtcgtctttggggcgtggaggctggtcgccggtgagggggaaggcgtgcccagtcccagtggcccgggcgtcggggagttcgtgtgctgcggttggctggtgctctgcttctggccgttcgtgagggggctcgtcagcaagggaagctacggcatcccctggaacgtcaggctcaaggctgccctgcttgtagccgcgttcgtgcacttgtccacatggaagtaactttcgctggtgtcagaatatgcaatggttgatgtgacgacgggaatcaatcatctgggaaacatgtccatacttaataatctcattagatccttaattatattgtcatcaacgcatcaacacccacttaggggcttagatgatgaactttcaagacgactagcatctggctggccttattcctgcactgaactttcgttaccagtctgagtctgtaaaacctgatattttgcgagacaattcttttaaacctaattagtgta

SEQ ID NO: 11716 - DNA, 1678 bp, Sorghum bicolor
  Clone ID: SORBI-28MAY03-CLUS14243_1
gggaacgaacggatgatctcgtcttccgggaggaacgaatcctttccttgcttgtcaaaattgtacccttttttctttaaaaagaaaacgaaccaaaggcaaaaacaaaaaaaaacgaatctgtgcacggttaccggcgacggatttgttgagctggttcgatcgatcgcttatccttgctactaggcgaggagcatctggaagagcatgtcgttccagatgtcgatgggtccggggaggcaccagtggatgcagtcgttgtacagctgcaccttctcgttggcccagtgcccgtaccggctgggatgcccgtcgggccgcatcagcatcgccgccgtggcgtccatgagcatcagccgccgccccttgtcgctcgcgaccttctccgccgcgcggaactcctccatctgcgcggtgtagaagtgcaggtcgcggccttccatggtggtctggtccccccgcagcggctgcgtgcgcttgcagtcgccgccgtggtcccacgtcccgttctcgaagtgcgacatgggggagagcatgcgcacgatgacacgcccgcggaggtgctccaggtcgttgatggcgcgcagcgccacgcgccacgcgcggcgctgcgagtagtagagcgtcaggtcggggacgccgtactggcggctgcagaagctgcacccgatcaggcgacgcttctcgtagaagagggacgggcgggagaaccagttggccgccgacaccagcacgtagtcgaagcgggagatctgcgagacccacttgtcgtcggcctcgtctaggtacaggctccagtggcccgtgtgcgcggggccgtcgtggtcgggctcccgcgcgcgcaccaggaacggcgaccagaacatgctgatggtgaagttgtacgcccggtagtggtacaccttgttctggtccgacgggttcgccgacaggtccttgggatacgccacctgggagaggaggcagagcagcgactgcatgtggttcctggccagggagtcgccgacgagggccagcgacttgccgcggacgaactgcaggaactgcagcgggtcgaagcgcggcaggtcgcagccggagggccgccaccgccacttgaggaatccgaggtcggggcgcccgtacttgaggcagtcctggtgctcctggatcatgtggcacgtcttgtggttgtagtagggcgcctcggcgtcgggcacccactcgccgcggaagatgtcgcagtacttcatgacgctgaccacgggcgtggtggaggccagcttcgcggcgcgcggcgccacgccgacgcccaccagcccgaagtactgcgcgttggtgagcacgatgaggatggccagcgccgagaagtagaccggcaccggcccgaacaggaaccgcaccaaccagtggagcttcttcatcctcttatccgccgccttccgccgccgccaccagacctccgattcaattccccacctatctggctacctagcaatctctctccggccggctagctactctccgctagcagcaattcatgggcaagacaagcatcggcacgccggctagcaagacgacgacggcctccgctccgccggtgatggccggggctcggtagctgtgtgagtgatatctagctagcgctatccatccatggcgaaagcccgaaagcccttttgggtgctcttgaataagc

SEQ ID NO: 11717 - DNA, 723 bp, Sorghum bicolor
  Clone ID: SORBI-28MAY03-CLUS114400_1
gcaccacgcaagaccagtatagccaccaatccacgagagggagatctcgaaggagagggcagcaagctagccaagcatggcgagtggtggcggcaagaggaagccggcggcaccggtggtggccaagacaatgctgctgctgctgctgcaggtgatggcggctccgacggcagtcatggccgcccgcacactgcagggggaggatgtgctgctctacaccacccccgtcctgggtttaaacacgattgcgagggagtttggtaatccggtggcctgtggggaatcttgtgtttttataccgtgcatctcgtctgtcgttggttgcaaatgcgttaataaggcttgctatttcatgccatcaataagctcgtgatcgatgatggcaacttattgaatccatccccacgacgtcaggtatataaatacactgcattcgtcccccggaatgtgttcaaacatgcatggatgtgctgttgctgaatttccttctcatctcgtcgtttatttgcgtacgtgttaattacaataaatttcagttatgtttatttccaggggccgtgtgtagtcatctgtgaactttgtgtgtaaactgtgtactttgtgttgtgttgggaggaacagaagggtggtgtgtttcaacttattatattattatgtatatgttcggtgattcaatgtataaataaataaatgaagggaaatcgacattggatgtgaaaccat

SEQ ID NO: 11718 - DNA, 439 bp, Sorghum bicolor
  Clone ID: SORBI-28MAY03-CLUS11421_2
cccacgcgtccggcaaaaagattgtaacagagacccaaggagttccagggatgagaactgaggatgttcttgccaaggctgcagatgaagcacggtgccctggttcttccactgttttagttgctcactttgatggccaggtccttcatgcatcaaatattggagattccggattccttgtgataaggaacggagaggtccataaaaaatcaaaaccgatgacctatggtttcaatttcccgttgcaaattgaaaagggcgatgacccttttaaaatcgtacagaactacgccatcgatctacaagaaggtgatgtcattgtaacagcatcagatggtctttttgacaacgtcctcaatgtagaagtagcaggcatcgtatgtgtatcattagaagctgatctcaggcccacggaaaaggctgatttattggttgcaag

SEQ ID NO: 11719 - DNA, 870 bp, Sorghum bicolor
  Clone ID: SORBI-28MAY03-CLUS11421_1
aggctgcagatgaagcacggtgcctgggttcttccactgttttagttgctcactttgatggccaggtatgttcgttggttatggcttggcctccttttttttcacatgtacgtactgatagttgattctatatagattatcctcccacctggttcttccactgttttagttgctcactttgatggccaggtccttcatgcatcaaatattggagattccggattccttgtgataaggaacggagaggtccataaaaaatcaaaaccgatgacctatggtttcaatttcccgttgcaaattgaaaagggcgatgacccttttaaaatcgtacagaactacgccatcgatctacaagaaggtgatgtcattgtaacagcatcagatggtctttttgacaacgtctatgaagaagaagtagcaggcattgtctccaaatcattagaagctgatctcaggcccacggaaattgctgatttattggttgcaagagcaaaggaagtggggcggtgtgggtttggaagaagcccgttttcagactctgctctggcggctgggtacctgggttactccgggggcaagctggatgatgtaactgttgttgtatctattgttcggaaatctgaggtttaaactataaacaaactcacaaagttgagcgcagctcaagtttttgctacagctgcactcgctggcaaatgcctatgaacatattgtgcgtcatgagcacacagcacaatcctgggctacgctcagccaaacgtgtgtacactaatacatatacatactataaggttgcatgagtatctctttgagcacggccgcagtaagttgcaacttgcgagcctttcgggcggccgtcgcgatctagtc

SEQ ID NO: 11720 - DNA, 664 bp, Sorghum bicolor
  Clone ID: SORBI-28MAY03-CLUS11504_1
ccgggagcacgctcccggaacgaacgacgcaaccacattctcgacccaaaaaccagcggcaccacccatggcttcggcggcggcgagatccggcctccggtcgctggcggcgcgcgctgccccgttgaggcgccgcatgtcctcctccgtccacgacgacgcctatgagacggccaagtgggagaagatcacctacgccgggatcgtgacctgcaccctcctggcggcctacaacctctccaagggccacccccacttcgatgagccgccggcgtacccctatctgcacatccgcaacaaggagttcccctggggtcctgatggcttgtttgagaagaaggaccaccattgagccctgattaccacaccttcaggagttggtgcatgctttaaagagtttctggttgtttcagtgatttttcttttctcttgagacctatttgctgcaacaagaaataagaattgaccaaactcttgtattcacagccaggttttaactgtgttgttagttgttaccggcttgttttcttttcttccctgtccacatcaaagatcacatgtaagttgatcttgcccggtttcagtaaatggtgtcacagttatcaaaaactgttattaacttattatattctgaatggcttcaagattgccccatgtgctcggg

SEQ ID NO: 11721 - DNA, 1119 bp, Sorghum bicolor
  unsure (1)..(1119): unsure at all n locations
  Clone ID: SORBI-28MAY03-CLUS1151_1
ttcccggcgaccacgcgtncggagaagcacaggaggtactggatacctctgataccacgagcaaggacaatgaggaacaaacagtcactgctgatgaaccaaaagaaaagaagcaacgtgtggaagaccctccagtttctgagcaaactgtgcaaaaagagactactgatgaaccaaagaggtccattgataaaccaaaagaacccagtgaaaaaaatattgatgatttaattgatgaggacctgaaagaaataggggacaggaaaaagaggctcttttcaagccttgagtctggctgcaatggatgcatattcattcaaatgcataaaagagcaggagaccctggtccagttgagattgtacaaaacatgatgtcatctgctgtttcgactcgtaaacatatgtcaagatttattctgcgagttttgcctgctgaggtgacatgctatgcatccgaagaggaaataacaaaggcaattagtccccttgttgaaaaatacttcccaaaagaatgcccttcaggccataagtttgcggtgttatatgaagcaaggtcaaacacaggaattgatagaatgaaaatcataaatgcagtagcgaaatctgtaccacaacctcataaagttgacctgagcaacccagacaagactattgttgtccagattgcaaagaccatatgcatgattggagttgtggagaggtacagagagctctcaaagttcaacctaaggcagctgacctcaccagagtcggagaagaagtagccacctttgggtgacaaaatcttccaggcagcacgtggaccaacttaaatcagctgtagcgacgtcaggtggttaggcactagcgaattaagttatgactagctgaacctcactgtctgaaagactcagatgtactgattttcaatgcttcattcatataggtcaagatgtagagtcatacgatgatgcttttgctaccactagtggttagtggttggttgctagtcgattcatcttcatgcttccctggttagagttatgaaatttttaaggttatatagaaagatcagacgatcttaatgtgtgtgtgtttttcctgatgatgctatattgctatggtccatactggctcacc

SEQ ID NO: 11722 - DNA, 642 bp, Sorghum bicolor
  Clone ID: SORBI-28MAY03-CLUS1444_1
aaaaaaaaaaaaaaaaaaaaattttttgcttctccatcaatcatttccgtcatcctgttaccattagcgtgtagaccaaccgcgggctaggccgaccagtcccgatcatccatggcgtcctcctccaagcggtcgctgccatgcgtggtggtcctcctcctcgctgtagtcttccaccatggctgctcgtcggcgacggcccacagaccgtacgccggcgacatggggagcagcaccgacgacaacagcccgatgatcgagcggttccagcggtggaaggcggcgtacaacaagtcctacgccacggtcgccgaggaccggcggcggttcctggtgtacgcgcgcaacatggcgtacatcgaggccaccaacgccgaggccgaggccgcggggctcacttacgagctcggcgagacggcctacaccgacctcaccaaccaggagttcatggccatgtacacggcggccccctcgccggcgcagctgcctgccgacgaagacgaggacgacgccgcggaggcggtgatcaccacccgcgcggggcctgttgacgccgtcggccagctgccggtgtacgtgaacctgtccaccgccgcgccggcgagcgtggactggcgggccagcggcgccgtgacgccggtg

SEQ ID NO: 11723 - DNA, 982 bp, Sorghum bicolor
  Clone ID: SORBI-28MAY03-CLUS14453_1
cctcggggctacgtgtgcatcggctcccttggcgcgccggcctgtgccccgcagcctcctaatgttggcccggtgtccgctgactgtcaatgtagtggcacttctagttaacttttcctcagcctgctttacaggaaatgcaccgctgacagctgttcagcttctttgggttaacatgatcatggacacccttggcgcgcttgcgttagccacggagccacctaatgatgacttgatgaacagagagccagtaggaaggacagggaaattcattacgaatgtgatgtggaggaacatcctgggtcagtctttctaccagttctttgtgatgtggtatctccaaacgcaagggaaaaacttctttgggcttgaagactctggtactgatattgtgctaaatacaatcattttcaactcattcgtcttctgtcaggtgttcaatgagataagctctcgggagatggagaagatcaacgttctcaagggcatgactaggaactacgtgttcatggctgtccttaccagcacggtcatcttccagttcatcatggtgcagtttctaggcgagtttgccaacacgacgcccctgaccatacaccagtggctggccagcgtgctcctcggtctggctgggatgcccattgccgctgccgtcaagctgattccagttggctcgtcatgatatcattgaagatcgctgtctgcgaagcacggcataatacaggctgactgaccaagttgcatgatattcggtgcagctgagctctctgcgtaaacttttgtaatgcatggagagcaagcaggcttgggaacagctgctgcacctgcacttcgaaaagttttgtagcctgcaaatgtgtctagatcgcatcgtactgtaagaagctccgtgtttggcactggggttcaggccagctctggtggtgcagcagaattgtaagattggtgcttagaccttgaaatggaatttagaccactgcat

SEQ ID NO: 11724 - DNA, 882 bp, Sorghum bicolor
  Clone ID: SORBI-28MAY03-CLUS14640_1
caaacagagttgttttcttcattgatctgatctctatgcccaaacaacaagtatactccgtatcacactgcacggcagcagcaagccagcagcagcagcagcaacgacaccaaaacggcaaaaccgctcgctcgattggagcagagggcaagggcaggcacacaggtgcggcatgacgagaacacaagaaaaccctaaccgatttttcaaatttgtactccgatcatccgttcggatccccaatatacatgaagacgaagatgaagaaatggaattcacgttatacaactaatatgagtgagtgagtgagtcagtcgaccatgtcctcgatgacgacggtggcgagcggcgggtgcgcgtaggggcccttgacccaggtgttggcgatgaagcggtagggcgcctcggtgaggtggatgccgtcccagctgacgtgcgcgtcggggtcctcgcaggtggtggcgccggggagcccgcacgacgcgctcatgttgtagttgtacggcccgccgccgccgcagcacgcacgcagagcgccgcgcttgtacccgtagaggtgcggggtgcgcgcgaactggatgtaaggcgtgtagtagtcaccgtagacgatgcgtgactccggccgccgtcgctggagacgatccagcgcgatacggagcatggcgttatggtagagcgccacggcgttgtacttcttcagacacccggtccgcgggtcgtactcggacctgtcctcggacgggtacatggtgagcgtgatggggatgcagccggcggggaggttcccggggaccacgacgtggcgggcgccctcgtcgagcagccgctccacgccgctcaccagggaggccaccacggcgggcaccagcgtcgtcttcactt

SEQ ID NO: 11725 - DNA, 592 bp, Sorghum bicolor
  Clone ID: SORBI-28MAY03-CLUS14685_1
caatcacaagcaagttgatatggcgacaaaaggacaaaaggtcgctattaagattatcgcaaacaattctgacgagcagcagaggagcttcggcagacactttgatatggaagatgaactggtcagccggatatcaagacggtctattgatattttgaaacaaaactacagggaggatttgtctattgaagactggaaacttgttgtaaagttgaaagcaatattgaagatacaatgagaagccctcagcccctcaccccaccccaccccacccccacctgtccatgaatcggcaaccgcgtagaaacaagtctcctgataatttgggaaggctgactgtcttaatatcagcagtaaaatttgggagttgcgaggctgaggtcctgtggcaccacatccatctttacactggagttccccagggagggttacaaattttgatacggtttgattttgtaatttgctcggaaggcgtttcattttacaaccacattctgtgccgtaccttaacgtttgcttttcctggcttgaactgtacttttcatgaactctcaggccttacagcaacgaattgtgcaatatactacatgct

SEQ ID NO: 11726 - DNA, 944 bp, Sorghum bicolor
  Clone ID: SORBI-28MAY03-CLUS15219_1
gcacgaggtctaagtgttgttctgggtatctcatctggcaagaaggctgtcaaggatttttctcctgatatagtcagctggatgaactttgctgtgtttatcaatgcttggaacttgtgttctaatgtgtcagtgatccctggaactgaccaaagcagccaaaattcctggtggattgtggataaccttctcaaaacttgcatagatgagcagttgactgataccaatcaaatgctgacttctccaggaagcaatattccacttctagcgtggatggtgacagagcccattacctggcaccttcttgtaattcaatcctgtatgagatctatgaccccacaagggaagaagaagaagaaaggcggtccatctgagcgaccaaacacacctcacctgcaggcaattcggagctcagttcagtgcatggctgacattctccagggagtccagaaatgtctgtcagaccaggtgaagccagaagaccaagctctggacatactggtgtcacatttgcaaggaaccagcgctgaaggccctggacagatcacccgtctcttggatgagagtgcagcagctgccagctccgaagtcggtggtcggatcgcccattctctagaaccgtggagctgcgcctgtgtgatgagaagattagtccaggctgagaatgagacgatagctgagttgaggaaaatatgcacctcgaagctgaagctccttgcgtccgcatcagcttccctgaacttagtgttgcactaggcgtggaaattttggtcgttgagattttttctcctcatcccgactgttgtgccttcctctgctcccttgatgttgtaaactaatgtgcgtttgtgtttgttgtttctatgcaattttgatttgagtgacatccctgtttccgcgttatttgcatgcgttctatattcagtcgtggtggaactgttgct

SEQ ID NO: 11727 - DNA, 1604 bp, Sorghum bicolor
  Clone ID: SORBI-28MAY03-CLUS1564_1
gcacgagggaaaatcgcacatatgcctacatactttgttccagattcaatgtctgtttggaacctattaagagagttccggatcaggcaggttcatatggcagtggtccttaatgaatatggtggaactattggtattgtaacactagaagatgtagtggaagaaatagttggtgaaatatttgacgagaatgattccaaggaggaaatccagaagaaaacagccgctcgagggaggcggggagatggaacatttgatgttgatgcaaatacatcaatagatcacctctctgaagagcttggtatcaaaataccagaggggcatcagtatgagacggtgtctggttttgtctgtgcatcttttggctatattccagaagaaggtgggaaaatgcttgtgattcttgaaaaggattacagagaagaaaacggtgaatatcaggaggaccgtccggagcgccttgctcttcctgtattacctcgcgcctccggccctcagatagtggaagctaatgcaaggaaggtgggcaaagtcctatttaagccaataagcagtgaatgtgttggtgttgacaacaagggtgtgaaccgcctggtctccaagaagatcatcaaacggaagaagcagggctatgatgattcctccggtgacgagtatccagatacaacagagaatggctgccctgctgaggcactctcctactcggatggtaacagtgccttgttggaagatgcaagccgttcttgtgccaagaggtgacaataaaggaactccaagaccatcgtactactggtaataattacagcacaccgtcaccggtcctaataccccttgttacaacagaagaagatgagaagaacatagtagtaggctacccaaaaaaaaaactgcgagagcaacaccaagaggttaacagcagtttaaggcattgcaacatttttcagtagcaggagtagcagtagtagcagtctagaggtgcagcgaggtgtcgacgtcgacttcaccagagacatgtttgtagttgtaggtcttactgggccacagctccaccgcaatggggtcgctatcgccgtggagctggaagcttttgcattcacagacagtggttggcacggccgggaataaggaggctgcggcggcaacagcggcagtggtttcccgcagcggcctgcacgggtagagcagctccgggtggaagaaccacttgacgggcatctccctcggggaggcggtggccgcggggcggggggcgagcacgtggagaagcctctcctcccgcttctccctgatcctctccagctccctgaacctctgctgcagcagggcgatggaggagaacatcacctggccttcgctgctctgcacccccatgatgactgggcgagagggggagctctcactccagctccgagtttcagttacgtgttcgtgtcgtgtgtatctcactcaagcgtctgtctacttcgctcggtgtgtgtggggggttttgcttgctgcttgaaggggtggtggtcttgggcatgtgcgtatttataagccgcaaagttttgtcacggcgcagggcgtcgtcttgtggtcgtcttgcaagttgcgccaattctttc

SEQ ID NO: 11728 - DNA, 1209 bp, Sorghum bicolor
  Clone ID: SORBI-28MAY03-CLUS11948_1
gcacgaggatggtgacgtagcaatagaaggaccagaattccgcaacaagagcccagaagagatgagggacataatacctaagattcgggtcctcgcgcgttctttaccattggacaagcatacccttgtgacaaacttgcgaggtatgtttcgtgaggtggttgctgtgacaggtgacggcacaaatgatgctccagcattacatgaagcagatattggccttgctatgggcatagcaggaacagaggttgccaaggagagtgcagatgtgatagttcttgatgacaattttacaactataataaatgttgcaaggtggggtcgtgcggcttacataaacatccaaaagtttgtgcagtttcagttgactgtcaatattgttgctttggtcatcaactttgtttcagcatgtattacagggagtgctcctctcacagcggtgcaactgttgtgggtcaatatgattatggatacattgggagctttagctctagcaacagagcctccaaatgatgacatgatgaagaggccacctgttgggcgaggagagagtttcattaccaaagtcatgtggcgaaatatcattgggcaaagtttatatcagttggctgtacttggagttctcatgtttgcaggggaacagtttctgagtatcaagggtgcagattccaaatctgttatcaatacactcatattcaactcctttgtgttctgccaggtgttcaacgaaataaacagcagggaaatggagaagattaatgtttttcgtggtatggtcaccaactggatctttattgcaatcatagctgtgacagtcgtatttcaagtggtgatcatagaattcctcggcacttttgcaagtactgttccacttaactggcagcattggctgctaagcattggccttggatcggtcagcttgattatcggtgccatcttgaagtgcataccagttaccaaatcaaatgaagttcctgcaagtccaaatggctatgcgccgcttcccagcggtcctgatgacatatagctgaagaagagtgatggaaaaggaattgcatttggtagcaagaaacccttgtcccgcaattacacgtttttcccccctgtttgctgttgctgctatgtaaaaaagatggtgatgagcacaatgcagagcaatattttcatgggtcatggccctcatggaaacgaagttttcttgactgatcc

SEQ ID NO: 11729 - DNA, 527 bp, Sorghum bicolor
  Clone ID: LIB3480-025-P1-K1-B2
cggacgcgtggggtgacagcagctttccaagtggtgatcatcgaattcctcggcacctttgccagcaccgttccacttagctggcagctgtggctggtaagcgtcggtctcggatccatcagcttgatcgtcggtgtcatcctaaagtgcataccagttaaatcagatggaactcgcgcgagtccaaatgggtacgcaccgcttcccagcggtcctgataacatatagctggagaagagaagagaagagcgactacggagaaggtactactgacgaactgtgttcgctagcattagcgaattcatgagaacctcaggagcactgcggctaccttatattttgggacctgttcggaataagtctgacttgtctgggttcagtgattttcgcatgaaggaacctcggaaccaaccactgtcgcctaggttcagttttaacagattattctgtgccttgtcatgcaactgctcttgtttgcagttggtggtactgtgtaaaaggacatggggtgagtgagcacaaggcac

SEQ ID NO: 11730 - DNA, 1227 bp, Sorghum bicolor
  Clone ID: SORBI-28MAY03-CLUS12613_1
gcacgagggatcagcaggagcacgagggttttgtccagcttgatcgtgtaaagttgagtggcagcaacaaaaaactatcgatactgcaacttggcatcaaacaaaataacaacaaggttcagcaaaaactgcatggagttacccactttagtcgtattcagatgcctatatcttcagatcctcttaccggcttatatgtgaccgcctcaggacttgactcagaaattcttagtttgcaacgaaaatttggtcaatggcgggaggatggttcatctgaggagcatagtgacctattgttctatgagtatgttgaagctgtaaaattaacaggggacaaccttgtgccagctggtcaggttgtcttccgtgcaaaagttggtgaacgttatcagctccctcataagggaattatccctagagaacttggagtgattgctaggtacaaggggcaaaggaaaattgcagatcctggtttccaaaaccctcgatgggttgacggggagcttttgatactagatggaaagttcatcagagatggtcctgtgatagctttcttttactggacatctaattttcatcttttcgaattctttagacggttgaggctttctgactagttcccttctaaaagtagttaaagcaggccatgcttatttcagcatagttgcatttggagccaaccggagttgcctggcattatattttccggggacagttctgatgtggagaacagggctggcatgaatcaagtggcatctccatccactctgaaagcctgccataagggtggaaatagctcgcagctgcaggaagaggaataatcctaccaacatggatgagccgcgggcgcaacatactcgttccgcttctgcgccgcttgcctgccaggtccaaaaccgccagttcctgtgtttctcagagcacatagtaaagcacctcaaatatgtaaagttatgcagtcgcagataatttaggattttgagagcatcttggcagctttcatgcatgcagagtcagtatgtgaaatagtacgagcaatggttttgtgtagcgtgatcaaacagtggccgtcatatttgtacatatgtcgcaatcagcagcagaggcgtgcagcccaacacggttacactttcatagatttgttaatatgttgaagtttgtttgagcgtgccttttctcacgcaagcacttttaaaaaaattaagcttctctgcaacaagcaagggt

SEQ ID NO: 11731 - DNA, 1152 bp, Sorghum bicolor
  Clone ID: SORBI-28MAY03-CLUS13328_1
cttgggtcctatgatattgggcaaattgcaccaggaagatgttctgatccgtttggatttggaacaaaaaaatgtacagtggggaactcaagtgtggaaccatatatagcagctcataacatgctactggcacatgcgtcagctaccagactgtacagagaaaaataccaagctgtacaaaaaggagttgttggcataaatatatatacaatgtgggcatacccactaacaaactccactgccgatttagaagcatctcaaagatttctggacttctattgcggctggatactagaaccattggtgtttggagattatccaagtgtagtgaagaagaatgttggttctcgccttccgtcattcagaaaagttcaatctgaagccattcgtggcactatagatttcattggaataaaccactatctttctgtctatgtgaatgaccaccctttagaaaaaggcatccgtgacttcgtactggacgtcgctgctgactatagagtttcgagaacggatccgccagtaggtcagcatgccccaacatctattccggctgatcccagaggattgcaacttatggtagagtacctgagtgaagcttatgggaaccttcccatttatatccaagagacaggttatgcaaccagaaacggtagcctccatgatactgacagggttgattacatgaagaaccacataaacagcacattgactgctctaaggaatggggccaatgtgaaaggctacttcgcgtggtgcttcctggacgtcttcgagtacctgacagggttcagttcgcaatacggcctgtaccgtgttgattttgaggacgaggcgctaccaaggcaagcaaggctatctgctcgctggtactctaaattcctcaagaaggggatccgtgtagaggatgagctcgacgatgcgggatcacatgttgagcaataagttttctacagcgatccattgatttgtacatcctttagcaagactattgagtattgtgcattgcaatggaagaacacttggccatgtttagatgcagtcagattgatatcaatccacatgtattagagtggatggtggaacttatgttttacttaaccaacaaggagttgtgggtaaattttcatacagagaccttcatcttattgc

SEQ ID NO: 11732 - DNA, 919 bp, Sorghum bicolor
  Clone ID: SORBI-28MAY03-CLUS12899_1
ggcaggtggtcggcctctcgctatccaccaccgccgctccaattttctcctcgatcatcttctgctccacccgcaaaaggggcagagaaatttaacccattttttgtggttcgtgaccgaagatctaggagatccgagcgacatgggtcccaccggcaccagctctgccgccatcctcttctgctgcatctgtgtcgtcgtctcattatcgtcatcgatggtggtcgtcaggtccgccgtcccagaagaaacccccaagtttaacgtcgtctcggaggaaaaccctaaggctatcgccgccgcaaaggaaatcccaaagtctaccgttgtcccagaggaaaccccgaagtctaccaccaccctggaggaaaacccgaagtctaccgccatcccggaggaaaccccgaactctacagacgctccaaaggaaaccccgaagtttatctcaatgggcgcccttgagtgctccgctaacataacgatgacaaagccagcgcgcaagctgggcgctgttgttgaaggggtgtgcccggtgcggttcgaccacacgcgcgggatcagcgcggtggccggcagctgcagggaccggccgcgcccgtcgccggagcggtgctgcggggcactcaagaccttcgcgtgcccctacagcgacctcatcaacgacaacgaccacaacgggtgcgccagcgacatgttctaccagatcatcgtccgcggcaggctgcggccgggcctcttctcgcagatgtgcgtcgaaggcccgctgggcctctcgtgctgatcaactgcgtgcgtgagtgcgtgcccgacccaccggccggtatatatcgccgggtgattattacacctaagataagacgatgatgcctgtcacgtccagtgcgcgccattgattttgtgatgcatgtatgcggtttta

SEQ ID NO: 11733 - DNA, 608 bp, Sorghum bicolor
  Clone ID: LIB3480-053-P1-K1-A6
ctcggaggaaaaccctaagggctatcgccgccgcaaaggaaatcccaaagtctaccgttgtcccagaggaaaccccgaagtctaccaccaccctggaggaaaacccgaagtctaccgccatcccggaggaaaccccgaactctacagacgctccaaaggaaaccccgaagtttatctcaagtactgttgcttgctcaccatagaaattaactttcacccatactatcttacttttgaaaaaaaaatcatacggtaactttttttagcctcgtgcatgatgagctgacttgtccctcccttgtttcttctctgatgatgattcgtcttcagtgggcgcccttgagtgctccgctaacataacgatgacaaagccagcgcgcaagctgggcgctgttgttgaaggtatgggtctctaaacctaatgactaacagctaataattaattagcgagacgccacagcttgattcttccgcgtcacttgtgatgaataatatcgatggagccaaattgaaaaaccacgcacacacgtacgtgtacgtgcggcgatgttgcaatgcatgcaggggtgtgcccggtgcggttcgaccacacgcgcgggatcagcgcg

SEQ ID NO: 11734 - DNA, 725 bp, Sorghum bicolor
  Clone ID: SORBI-28MAY03-CLUS16099_1
ctcccctccgtcccctccgcacctttgccggtttcttcatcctacttgccagacgaaggacgtcgtccgggtccgcttccatcccacgaagccaacactcaatctgcgctttctaacccacaaaacgtggtatttggctatccgttccaaagcccagactcttcgtctgtctcccgacgcgggtaaaagcgtttccgaccggaagtccctctcatgacctgcggcaagcgtggccagaagactgtgatcgtgtataagctgtcgaaacagggactgatctacgttcgtatgttctacaagtcaccggattgggattccgtttgcaggcatcagcacggagctactccatccagaacaagttgtttgctttctttttgtgctgtcttcgctgatgcaataagcaaatcatcgcacggcagcaggatggcactgcttacttgtccagttgtctctgtttttctggctccatgttttgcaggtcagaatgagcttcgatgtacactggtgcagcaagaggatcaaagtgctcatggtggctatttttgaaagattttgttatgctagaaaatcatatgagttgtattgtgtaagctaccctcttagttttgtagctacttgtgtgtagcttgcttattgcctttgtatttcctatgaaaattgtacaagtacaaatgttgatggtttcaatgaaaagatgacaaatatttggcaattggactttttcc

SEQ ID NO: 11735 - DNA, 527 bp, Sorghum bicolor
  unsure (1)..(527): unsure at all n locations
  Clone ID: LIB3480-053-P1-K1-G8
cggacgcgtgggcaaagcctttatcaccggtttgtaacacaaacccggtttttgccctgaaccggtgctggaggtccggtttataggctgtctcccgcctcccctctgcccatttgaaaccgagagcaccattgttgttcttgaagcttcttcttgcttgttcttcatttgttcttcatctccgacgcccattgttgatcttcttcgactccgtcatcgtctcatcgtgcttggaggtgactaacttcagcctttcttgtctttttcatgttgtttttggcttgtgatgttcccatcatttttaactcaaatccactttgttattttgaatcattcgcatgaattagtatccatatatatatatatcatatttcatggttgacctagtattaatgtactttgcaagaatgaantatttatgatcttagaaagtaggatagttcaaattaattggttttgtaatatcactngatttatttttattactacataatgttcattatataatttaagaagatttggtaaag

SEQ ID NO: 11736 - DNA, 1146 bp, Sorghum bicolor
  Clone ID: SORBI-28MAY03-CLUS16406_1
gctctttgtaaatgtcgttcagctcatccacctttatttttctaacctacatttagttttgtgttaatgtttggattaacttattatatatccatgttttcatcaataaattatccatatttataatctagcttctcccacgcagcactttcttctttctcatttagtacctgtaagcagggatgataataagaataaataaatgttgcaactcagagcaggattaggtgaagaccgaagactgtgtggtcataatgggatgttctggactctagatagtctcaaacttaatttggttctagctagactggaaggttcactgtttcagtttaatgtttctttgttaattatcattaacttttgttttaggtaatgcaagtgtattaggcatgcaggtttatgtcagtctgcaggttgtttgttcactgggctgttcatcttctgaagttctctgactcaccttttcagtatgtgtgacctcatttttcgagttaatgctaggttcgttggtcacttgacacaacttttgacttgcggaacctgaacaagcggatgagcccgaagaagaacgggaatctatgcagcattggcgcccacaacaggagggttcgctcaagtgcaacaaacaaggacaagagtgtctggggtggttctctgaaacgacctaggtctctttgttggagcacgggtgagaggtggtacccccatggctttgatgcattgacctgaaagcttttggcttgcggggatggtgctgctctagcgtgagacaagggggtgctgcaacttatcctggagagcgatagccaagagtttgtgtaagttatggaaggaggacgccaaccaacaatcatggattgcgacagtcatcagggaaactcagagaggttagctcatgttttgtaggtttttctatgatgtatacaagtcgcttttgtaactgagttgctcatgtgtaatgtgttagctaagcaagtcttgtaactgagttgctcatgtgttagctaagcaagtttcaaggcacgcagtattgcccatatgacatgcattaatatttacatatatacttgaacctatgtatagtattacacatatgactgttaattttacaaactttgttttttattaaatgtcactttaatgttg

SEQ ID NO: 11737 - DNA, 1740 bp, Sorghum bicolor
  Clone ID: SORBI-28MAY03-CLUS16621_1
agaagaaaagggcacccccaaaagaaaaaaaaaaaagggagggagagagagggaaggggattggagcgagacggatcaggggcggggaagcttccagccctagcgcgcgcagcaatggcgagctggtgcgaggaggcggtggcgctgctgcagcgccccgcggtggcggagatggccgtcgacgtgctgctctgcgcggtgccgatctgggccgccgtcatgatcggcctcgtcgtcggctggtcctggcgcccgcgctggacggggctgctcttcctaggcctccgcacccgcctccgcatcctctgggtctgggtgccgcccggactcggcgcccggaggctctggctcgcctgcaccgcgctctccgcctgctccgtcgcgcccaggctcctttcctccgcattccgacgctgcagaggcaagcaccaggacagggcctcccccgaggatgatgccgccgcggaccgggacggtggaggttgcgccgacggcagcaggacaaattttgagggcgagcatgatactgtcactgagaaggacctagaacatctcctgcaacttttagataacaaggaaagtggggatacagcttggcagaatttgatggagcgcagaacctccaacatgacctacaaggcctggcggcgtgagcccgaggagggacctataatgtactgcagtcgcactatttttgaggatgctaccccggggctggttagagatttcttctgggatggtgattttcgtctaaagtgggatcccatgcttgcatactccaaatctttggatgagttccctcagagtggagcaacaattgtccactggataaaaaagttcccattcttctgcagtgaccgtgaatacatctttggagggcgcatatgggaatcggggaagacttactattgtgttacaaagggtgttccatatccatcattgcccaagaaagaaaaaccaaggcgtgtggagctgtacttctcaagttggcgtatcagagctgttcaatcgcctaaacatgtgggtcagcaatctgcgtgtgaagtaactttggttcactatgaggacatgggcataccaaaagatgtagccagagttgctgttcgtcacggcatgtggggtgctgtgaagaaacttcagtctgggttcagagcgtaccagcaaatgagagacacagaaaataccctgtcgcacagcgccatcatggctcgaatgaccaccaagatatccatcacggcttcaaatggtcccttggaccatgacctgtccattgccgataaaatcggtgatgagaatgacaactcccatgcagttcaacatggttttgactggaagtgggtggtggttggtggtgcggtggctgcggtttgtgtgctcaacaccggactggtaggcaaggtcctcttgcttggagcagcgagaaggcaggcaaagaagtgatgtaaggagcaaccttccagcctctacagaaggcattcatcagactagctgcaaccgtacaggcaaaaaatgttgagaaaataggtggggttcgacagagataagtacaatgcataattttggattggtgcacttatgcagtagatgtagcgtgcttgttaccataacagattccgctgtatcaggaatcgctggctaatatatctgaagataagaggttactggcttcttccagctttcatgttccaatttattcataagaaagcccatcctctgacactgaacaaattttcaattctt

SEQ ID NO: 11738 - DNA, 785 bp, Sorghum bicolor
  Clone ID: SORBI-28MAY03-CLUS16688_1
tgtgaggctgcctctgctgcagcaggagtggggggggggggggggtgagaagcggcagaaaaacagtagatgaacctattggaggcaggaaagaacagtggatgaaccggcagaatcatctttggacagttctgtctctgtagctttgccagctcctgttaatggtagtgagcctgccaactcggaagcttcttccgaacaagttgcccatgacactgatgtgcagcaaccagtcaaggaagcccctgccgaggatgttgatgcaaagaaaactgatggagccaaagcaagcgagtgaattagcaacatgttggacttagctgatcagagcaattacttgtgaactgaaactctgtagagtgtagcctgggcattgatcttgcttcatgtgtgctcagctgccacaggatagtctgaagcaaactgctgtacaataagcaagtgattgttctgccatcaaccgtggcatatcactgtacaaatgaccaccattgactaacgcacgtaagtcgccttgtctgaaactggtcattttctttgaaattcaccctccagttcatgtgctttggtggcggtcttaatggcatggtatatgatacctgaaagaacattctttggttggcactggttttggctacttagtcttctgttgctttaggttaactttggaactgtaatatgagatgtgatgttatttctagtctagctattgttgtaattttttcggactctacatgtgtcagttcgacttgaacatgttatttttttataaagattcgttactg

SEQ ID NO: 11739 - DNA, 917 bp, Sorghum bicolor
  Clone ID: SORBI-28MAY03-CLUS16655_1
ccctttttttttttttttttttttttttttttttttttttactggaaacacgaggggtttccccctgggctgtctgccactgccaccacaccaggctgctgagtaatctcccgtcacgccatggaagccctcgccacgacgccccgaccgctcttcgcgcgcgcgtccccggcggcattattgttggtcgcgacggctgcggcggcccggcgccgctctgccgctcacatctgcagggcctccgcggcggccggggaggagacgccgccggccgctcccaaggcggcagaggccgcggcggcgcccaagaagatcctcaagaagaagccggtctactcgatgaagaaagggcagattgtgcgggtcgacaaagagaaatacctcaacagcatcaattatctgtcagtgggacacccgcccttctacaaggggctggactacatatacgaagaccgcggcgaggtcttggacatcaggaactttgaaaccggagaatacgccctgatcgcttgggtagggattccgacgccaccggcatggctaccaacatacatgctcatcaagtcggacaagctcgactacgagaggatatgatagtcggcgcccggcggcctctcgcagtcgcaggagaccgtagcatgcacgcgccaccgccaagccatgcatgtttcctgtcctttccttggggtcaggacacggtgttgtacacagatgacaatgccaacacacagtgatcaggcaattctgccacctcggctgaaataaggaagacatcgaaagccacgatgacaagatttcataattgctgttgtacagcacttcttatattatataatatagtaaactcatatttcgtactacctgttcatgccacgtaacttgtcacgaccctaatttcataaccagagatttaattc

SEQ ID NO: 11740 - DNA, 700 bp, Sorghum bicolor
  Clone ID: SORBI-28MAY03-CLUS16913_1
gccggccgggccgggaaaacccgtctcatcatccaatagctgaatagggacaacaataatggcctaggtgagaaacattgttggagctctattcatagtgaccctcatcctaggagccccatgtgtgctagcaggagaaattgctgaaaaggtcagcacggtagttgccaaggcagatgactgcaacaagcaatgtgagggtaaggggacgcctgccgacatcgaccattgcaaggagaagtgtagcctcaccgagcacttcagttatgcgaccatcggtgtaggtgcctgccgtcagaactgcgacaagctaaagaatgaccaatcctccttcaactcgtgtgaagagaaatgtcgtgagaagtatgagggtaggttgtcacagatcaaacagggtcagaatctttagggaggcatgcccaaagtattatccaacgacaaccgatagaccacactcacatgggtgatgtgtcaacccaacatcaacaaccatatttttgcccaaggtgaaccgctcgacagcgaagccccacgcaatccttgtaatgtcatgtctttttataaatctttgtagctggactatcaagttggttgataacaattggtagttctttccattgtcaatgaaattattgttgtaataaattctattaattaaaaaaatgtgctagccctttaacaaaaaacaaaaaggccccta

SEQ ID NO: 11741 - DNA, 1789 bp, Sorghum bicolor
  Clone ID: SORBI-28MAY03-CLUS14403_1
gcacgaggctgaggcttggtcttcagatggatggtggggaagcaattcaatatctgcaagcaccaaatggagcactccattctttaggtgtcgttgatgaggcttcaacatctgctactgtaaggaacatgggtggttacatgccatccctactctttgctccccgtgccaattctactgtcaatgagacacaagtagaaaccccagattctctagacctcacgcacagcaccagcaatagtcagcatgttcaacatcacctccagctcagccctgaaccctctgcaatgaccgagtcttcatttggtgtgagttctgatgttgtcactgcaacaactacatcagaacgtagccattcccggcatcctaagaaatgcaggtttaagggatgttccaaaggtgcaagaggcgcatcagggttgtgtattgctcacggaggtgggcagagatgtcataaatctggatgccataaaggtgccgagagcagctctgcgtactgcaaagctcacggtggcggtcgtcggtgtgaggagcttggttgtaccaaaagtgcagaaggaaaaacagattattgcattgctcatggtggaggccgccgatgtgaacatcctggctgtcctaaagctgcccggggtaagtctgggcggtgcatcaagcatggtggtgggaagaggtgctcggttaaaggttgcattcggagtgccgaggggaaggctggactgtgcatttctcatggcggtggccgacggtgccagtatccagattgtggcaagggggcacagggcagcacattgtactgcaagggacatggtggtggcaagaggtgcatcttcgatggttgcagcaaaggcgcagagggtagcacacctctgtgcaaagcacacggtggtgggaagcgatgcatgtttgaaggaggtggtgtctgtgcaaagagtgtgcacggggctactgaatactgtgtggcacatggaggtgggaagcgctgttccgtgcccggctgcaccaaaagtgctcgtggccgcactgactgctgtgtgaagcatggtggtggtaagcggtgcaaggttgacaactgcggcaagagcgcccaggggagcacggaattctgcaaagcccatggtggaggaaaacggtgcacttggagcacagggtgtgaaaagttctcccgtggcaagagtggcttctgtgcggcacatggtaccttgatggccaggcagcgagaacaagaggtggtgaagaatgtaggaagcatgattggaccaggtctcttcagcggcattgtggtgtcatctgccactgcagcaagcagcatgacgaacgagcactcgtcctctggtgtcagtaccgcttcggattgtgacggcaccatgaggagccaatcaatgattcctccgcaggtgctggttcctcgctctatgatgccttggtcttctgagcctgtagatgggggcagagagggaggtcatgttgttcccgaggggagggtccatggaggtggcctcctgtcactactcggtggcagcttcaggaacgctgatgttgaaaagctttgaagctagtgcttttccatcggcagatttggtcagtttgtacataaacagggcgtgtttccgcctattgaattcctattgtgccttttcttgtctagataaacatttcaaaccttcatgtactggttaagtccattgtaaagtggtgactggcaattgatgcgaacgcttttggcttgttggttaagttgtagtcagtactgcaataaattcgtgtacttattatgctgctcttaaaa

SEQ ID NO: 11742 - DNA, 786 bp, Sorghum bicolor
  Clone ID: SORBI-28MAY03-CLUS13862_2
gcacgaggccgtgcccttctacacgggattcctccctcttctcttctggagtggacacggcagactggctaggcagatgaccctcctcatggctttctgcgattacctcggcaactctctcaaggatatggtgtcagcccctcggccatgctctcctcctgttagaagagtgacagctacagaagatgagaaggaaaatgccatggaatatggcctgccatcatcgcatgctctcaacactgtttgtttgatgggatatctattacattatgtcctcacatatggagaacatggcagtgttatagttgctgcgggtttatctctagctttcttacttgttatgctagttggcattgcgaggatatatttgggtatgcacagcttgaccgatgttgttgctggaattggttttggaattgtcatccttgcattctggttggctgtcgatgaccatgttgatgccttcattgtctctgggaaaaatgttgcaaccttctgggcaggcctttctctattgatgtgctttgcgtatccaaagccagaattccctactcctagctttgattaccacacagcattcaatggagtcgctttcggaattgtgtacgggatccaacaaacctacttccactttcacacccctgacgcccccctcatctttagcgctcagctgcccctttccacattcgccgggcgcatcctcatcgggatcccaaccatcctgatcgtgaaattctgcagcaaagcgctctccaagtggctgcttgccgtgatgtgcagcaccct

SEQ ID NO: 11743 - DNA, 769 bp, Sorghum bicolor
  Clone ID: SORBI-28MAY03-CLUS13862_1
actcctagctttgattaccacacagcatgctctccacccaacctgattcaggtgtacggcatccaacaaacctacttccactttcacacccctgacgcccccctcatctttagcgctcagctgccccttcccacattcgccgggcgcatcctcatcgggatcccaaccatcctgatcgtgaaattctgcagcaaagcgctctccaagtggctgctgcccgtgatgtgcagcaccctgggcatccccattgtgtcatcttgctacgtccctgccctgaaagtcgacagcagcggcaagaacaagcaggccgccgggtacctccagcggctgttctctcactttccccagaaggcctacgacgtggacacgggcatcaggttcgtccagtacgccggcctcgcatggtccgtggttgacttggtgccggccatattcagccatttgaatctgtagccagcagctactcaaaatttcatcaaaaaaaatggagctcctaatgcggcgttcctactcgtaagacatggatcatcttatgaggctgtaaatccaatgatctggcctttcttttttttgtattgtatgtatatggtcgcctagctgtcttcaccaggggcgttgtttccgtagaggtgtccagtaagtactagcaattagtagcattgatttgtggctatgagactatcattattgttcggttccatgacagaagtggacactacgacgccacgcctaacttgcagtggactgaattctctgattcttgacatta

SEQ ID NO: 11744 - DNA, 1348 bp, Sorghum bicolor
  Clone ID: SORBI-28MAY03-CLUS14436_1
gcacgaggattctaatccccttaagaaaatgactggcttcaatgccttttggtttacgcaccacttatttgttattgtgtatgcactgctcgttgtccatgggatctgcttatatctaagcaggaaatggtacaagaaaacgacttggatgtaccttgctgtccctgtgctcctgtatgtaagtgagcgcattattcggctatttaggagccatgatgctgttaggattcagaaggttgcagtatatccagggaatgttttggctctctatatgtccaagccacctggattcaggtaccggagtgggcagtatatcttcataaactgccgtgctgtctctccatacgaatggcacccattttccattacatcagcaccaggagatgattatcttagtgtccacattcgcacaaggggtgattggacttcacgtcttaggactgtcttctctgaggcatgccgtcctccaactgatggagaaagtggactcctcagagctgacctttccaaggggatcactgagagcaacgccaggttcccaaaactcttaattgatggaccatatggtgctccggcacaagactatcgggaatatgatgtgctcctgctcattggactaggcattggagccactccattgattagcattgtgaaggatgtacttaaccacattcagcatggaggatctgttgcaggcaccgagcctgacggcagtggcaaggccaagaagaggccattcatgacaaagagagcctacttctactgggtgaccagagaagagggatcttttgaatggttccgaggggtcatgaatgaggtggctgagaaggacaaggatggagtcattgaactccacaaccactgctcgagtgtgtacgaggaaggggatgcacgttctgccctcattgtcatgctccaagagctccagcacgcaaaaaagggagtcgacatcttgtctggaactagtgtcaagacgcactttgcgcgtcccaattggcgaagcgtcttcaaacatgttgcagtgaaccatgagaaccaacgcgtcggagttttctactgcggtgagcccgtccttgtgccacagctacggcagttttcagcagacttcacccacaagacaaatacaaagtttgagttccacaaggagaacttctaagggcgtaactggagaagcgctggacgtggtcctctaatgatttcagaatgtgaatgacaagggttgtaatatatatacaagtagatgaataagacgatgggagttattttgttgtagatgtcaaagtagatgaagtgtctttgggaacatgacatttcattttaaagctggttttgacaggtcggttgtgct

SEQ ID NO: 11745 - DNA, 1229 bp, Sorghum bicolor
  Clone ID: SORBI-28MAY03-CLUS14290_1
gcacgagggcggcatcggcggcggggcgggcgacgacgagccgtcgcccaacgtgaagcgaggccgagtcccgagagccgagaggaggcacctgcgctacctgcagctgcgaaccgtgcgcacccgtcttccccagatccggcgccgccgcctaatccgcgcctgctcgcgccagagagatcgttccggggacagccgagcagagcacagcagagctgactctgcttgcttgcctgttcttggttgctgtggctgctggcgtgcgtgcacgaggagcggttgatttgatgctcgcggtccctccctctctgcgctcgcccccagcggacgcggcgtgcgtgcacctaccaccagagcagcaggcgccccaggcccagacgtgctcgccccgacgcgagcggggcgggctccccccctccggatccggctgcggcggcggcggtgaaagaggacgcgtgggaggtgcgtccgggcgggatgctggtgcagaagcggagccccgacccggaccggccccctgccggcgcgctcgtgcccaccatccgcgtcaaggtcaagttcaacggcgtctaccacgagatctacatcaactcccaggcctccttcggcgagctcaagaagctgctgtcggcgcagacgggcctgcaccccgacgaccagaagctcgtgtacaaggacaaggagagggactccaaggcgttcctggacatggccggcgtcaaggaccgctccaagatggtcatgctcgaggaccccgccgctaaggccaagcgcctcctcgaggagcgccggaccagcaaggccgagcgcgccgccaaggccatcgcacgcgtcgcgctcgacgtcgacaagctcgccaccaaggtgtcggcgctggagacgatcgtgagcaagggcggcaaggtggtggacgcggacgtggtgacgctgaccgaggcgctgatgaccgagctggtgaagctggacgccgtcgccgctgttgacgaggaggtgaaggtggcgcggcgggcgcaggagaagcgggtgcagaagtacgtggagacgctggacgccgtccgcgccaagaacaaggcggcgccggtgtccaaggccaccaacaacaacaccaacaacaaggcacggtcgccgcacctgccgccgcgcccgcccccggcggcggcgcatcagaaccaccagcggcggcagttccagccgccggcgcccaccacggcgacggcgctagtgccgca

SEQ ID NO: 11746 - DNA, 232 bp, Sorghum bicolor
  Clone ID: LIB3480-016-P1-K1-B5
ggcggcatcggcggcggggcgggcgacgacgagccgtcgcccaacgtgaagccggtgcccaccatccgggtcaaggtgaagcacgccggcgtcacgcacgagatctacatcagctccgaggcctacttcggggagctgaagaagctggtggccgccaagacggggctgcacccggacgaccagaaggtgctgtacaaggacaaggagcgcgacttcaaagcgttcctggaca

SEQ ID NO: 11747 - DNA, 800 bp, Sorghum bicolor
  unsure (1)..(800): unsure at all n locations
  Clone ID: SORBI-28MAY03-CLUS17383_1
gccgggccggccgggccgggctagccagcgccggcgccgcagactcctccccttcgctccgttcccttgcgccgccgtcgccgtccacgcgccgccgcccctgccgagatggccccgaagaaggacaaggccccgccgccgtcgtcgaagcccgccaagtccggcggtggcaagcagaagaagaagaagtggagcaagggtaagcaaaaggagaaggtgaacaacgctgtgctgttcgaccaggccacctacgacaagctgctctctgaggtgcccaagtacaagcagatcaccccctccgtcctctccgagcgcttgaggatcaatggctcccttgctcggagggccatcaaggacctgatggcgcgtggcctcatccggatggtcgctgtccactcaagccagcagatctacaccagggcaaccaatacctaaggatggggaagagcctgtatctgccctctctgtagtaggagctcgtcatctttagagcagttgtcatctttgtcaagagtttgctaatattatgttacctgtgacctgtggctgaaacatttcagagattttgagtactagttgtgtactatggtttgccttataaattacctggcctcaatatctttttgttcgaaggatcaaaaatattttaccatgaaatcattttgttggcagcttctgtctaaatgtgnggccgtaatgtctgatctgtgattactcgatgcctctgtccaaactactgtttgctgctatgctttcagcttgtcaaatgagtaatgaggtcttagcctgtgttgctgtgg

SEQ ID NO: 11748 - DNA, 1065 bp, Sorghum bicolor
  Clone ID: SORBI-28MAY03-CLUS17416_1
gcgcgggccagataaataaaaagagcagcgggccgggcgcggagcagagcatgctcttcctgcagtgccagcagcagcctcgcgtgccgtccccgcccgcgtcggcgccgccttttcgtccccgcgtcgcggcggctccgctgagcgtgcgcgtcaccggcgggaggcgagggaggcaggcggtggtggcgatggcgtccgcagacgcgcgcttggccgggatcgcctcctccatccgcgtcatccccgacttccccaagccagggatcatgttccaggacatcacgacgttgctgctcgaccccaaggcgttccgtgacaccatcgacctctttgtcgagcgctacaaggaccaagggatcaccgtagttgctggtgttgaagctagagggttcattttcggtcctcctatcgctttagccatcggtgcaaaatttgtgcctttgagaaagccaaagaagttgccaggcgaggtgatctccgaagagtattctttgggatacggaactgacaagatcgaaatgcatgttggagctgtacaggccaacgatcgggctcttgtggtcgatgatcttattgccactggtggaacactctgtgcagctgtcaaacttcttgaacgtgttggagcaaaggttgttgagtgtgcttgtgtcattgaattgccagaactgaagggccgagacaagcttggggacaggccagtttttgtccttgtggaagcagacgcttgagcggaacttgggacttctcagagagttagagttggcgctgttgatgctccctctctggaaacaacaaagttcccatgttaccatgttggctattttctggctgacgcgtaataaagttttattccaaattgtgatcccctgaatgatttgtcaatgtagacatgattgctggtccttgtaaactgtggcttatgttttgtcaaaacagtgctaattattcacatcaattgaggataatcctgattggagatgcttgtttgttctagtaatgttcctttcttgttttgtcggcgcaactattgatgaaataaagttgccatctcaataattg

SEQ ID NO: 11749 - DNA, 614 bp, Sorghum bicolor
  Clone ID: SORBI-28MAY03-CLUS1765_1
ctactggacgcgccgaccctccgcttcccaccaaaaaccctagccatcccaggttcctcaggccgcatcgccgccgaccaccgaccgccgacgatgcctcccaaggccaagaaggacgccgcgccggctgagcgccccatcctcggccgcttctcctcccacctcaagatcgggatcgttgggttgccaaatgttggcaaatcaacttttttcaacatagtaacaaagttggcaatcccagctgagaatttccctttctgtaccatcgaaccaaatgaggcgcgtgtgaatgttccagatgaacggtttgattggctttgcaaactttacaagccaaagagtgaggtgcctgcatatctggaagtaactgacatagctgggcttattaggggtgctcacgctggggatggtctgggcaatgcattcctctcacatatacgtgctgttgatggaatctttcatgtcctaagagcatttgaagacccagaaattacacatgttgatgacacagtagatcctgttagagacatggaaactattagtgaagaactcagactaaaggatatagagttcatgaaaaagaaacttgaggaccttgataagtcaatgaagag

SEQ ID NO: 11750 - DNA, 632 bp, Sorghum bicolor
  Clone ID: SORBI-28MAY03-CLUS17359_1
cgctcgaggccggccgggccgggaagtcacacctaaaccacacatcttttgctttgtcgaaattcaatcaggagctgaaggagaggccgggcttgctattaaatcaaaccataaaacacaagctataaccatggcaaaactactcttgggtttgctccttgtccttgtcattatagggacaacgtcggccgataactgtgctaaagatgcggaagccatgaagcaagagtgcaagaagttcgaggtgttccccgcgaacccaaagttgcaaccgtcgccggcatgttgcgctgtgtggcagagggcagacatcccatgcctatgcaaaagggtcaccccggaagtagagaaggtgtggtgcatggagaaggtcgtgtatgtcgccaattactgcaagaagccctttacacccggctacaagtgcgggagttatacggttcctaaaagcctctaaatagctagagcggtttggacatgcatggtactctatcctgaagcttgcatttgagatttgtaacatgtgagagactatgttgagaataatgtgtatcgagtgctttgtatgaaaagcgttggagatttgataatgttcggcttttaaaaaaaaaaaaaaaaaaaggcctatatcacat

SEQ ID NO: 11751 - DNA, 858 bp, Sorghum bicolor
  Clone ID: SORBI-28MAY03-CLUS1787_1
cgtccgaattgcggtcgccacgcgtaatcgactcattatccccactagccatccacacaagagatttgttggcagacccaagatgcacccttgttgtacaggtacctggatggagtggactatcaatgcacgagtaactatctttggtgatgtcattccgttgcccgttgaacaacaggaatgggctcatcagcagtatgtttcaaagcaccagcagtgggcatcccaacagtggggtaacttttattactacagaatgcacacaataagtgacatatatttcattggaggttttggtactgttgcttggatagatgtgaacgaatatgaggctctgcagcctgacaagattgcaatggatggaggggaacacaatctaaaggaactcaactcaatgttctcaaagcctctgagagaacttttatcaactgatgaaggagaggtagatgatgtagctgttatttcaatggatagcaaaggcattgatatccgtgttcgacatggtgcacagttcaacatccagaggatagcttttgaggtggatcacagcgtcgagacactggatgaagccacggaagcgcttaggaggatcatcagcaagtctaggtggcacacaagggctcaattatgagacgctcttgaagcggaagcaggttctgtaaaacggtttgtacagtgcggcagtctttatggtacgccaataaaggaactacgtttcagagttttgtctaccgtgaagggcctcgtgtgggttgaataaacacgcaatttgagatgtgttcttttgaccgtgaatttagattggaagcacaaggcaataatttatgtgaagttgtcgattgaccgattgagcggcgc

SEQ ID NO: 11752 - DNA, 1238 bp, Sorghum bicolor
  unsure (1)..(1238): unsure at all n locations
  Clone ID: SORBI-28MAY03-CLUS1790_1
gcacgaggcagaatcacttgttgagagcaggaacatagtgcaagcacctcttggtttatttcctcagccttggccacctagtgctgctgcatcagaaggtagcaagttcttcaaagttgtcgagtacttccgcttagttggtcgaacgatggcaaaagcattgcaagatcgtccgcttcttgatcggcctttcgtccgagcattttacaaacttttgcttggacaagaacttgatttgtatgatatattatcttttgatactgagttcggaaagacattgcaagaactgcaaattcttgttgcacgtaaacaatttcttgagtcctgctctagtgagaaccaaaaaatagaagaattatgtttccgtggtgctcccattgaagatttatgtttggacttcactcttccgggctatcctgattatgttctcaaggaaggtggagagaatgcagtggtcaacatttataacttagaagagtatatttctttggttgtggatgctactgttaagactggaataatgcggcaagtagaggcattgaaggcaggattcaatcaggtgtntgacatatcgacactccaaatattttctcctcaagaacttgattatctgttctgtggtcgccgtgaactttgggagccggaaacactgcctgaacatataaaattcgaccatggttatacctctaagagtcctgcaattgtcaattttcttgagatcatggcagagtttactcctgagcagcaacatgctttctgccagtttgtgactggtgctcctcggcttccacctgggggtttggctgctctaaatcctaagttgactattgttaggaagcactcatctgcggcaaataatacttcaaatccaactggagcgacagagtctgcagatgatgatttgcctagtgtcatgacttgtgccaactatcttaaactaccaccatactccaccaaggctatcatgttaaagaaactgctttatgcgatcaacgaaggccaagggtcatttgatctttcgtgaagctcaaaactaacatagagaaatttgtcattgttgcccagagttagtagtttctacctcatgtatgacataggttaaagtcagctctccagagtcccaccgaaggtttggatcccgtacctttggatgtggatgtctatattttctttttcttttggttgtatattcttgcggatctttatagtgaataataataaattgttttgctctcctt

SEQ ID NO: 11753 - DNA, 622 bp, Sorghum bicolor
  Clone ID: SORBI-28MAY03-CLUS18032_1
gccggccgggcctggatatcagacataccatataccatagaatagaaagaccttccatccagagtcgtcggcataaagaaattccacagccaagaagcctttaattgctcccctcgcctccttcatccccatcctaccaaaagctcatcgctccgccctttgtaacagctaacatgggcaagctatgctgcagccaggaagatgatgagccggcgttcaaccttctggggctgcttgtcaccatcgtcctcgccttgctgctgctgatgctgtgcactcctcctcggcgcaggcgctgcgtcgcctactacccttgctgctaggatcgggtgacgactccttcaagcttcaaggtaggaggatcatcttctgagatgtgctgggttgaataggagatgagcaccgagctaggcatcatatgttgagttcagttaagtccaaattatgaaataaattatgctgagttgtaaagcgttctattattatcaatgtgcctactgcagaagtttgatctgtaacctgatccgaaagtttatgataaattgactactgaaaaaaaaaaaaaaaaaaggcccctaaaaaaaaaaaacaaaaaaagagccccccaaggcggccccccccc

SEQ ID NO: 11754 - DNA, 944 bp, Sorghum bicolor
  Clone ID: SORBI-28MAY03-CLUS18073_1
tactgggcaacacgctgcccagttgaaacgggagtccgtccccttttccccgtcgggtcttccgcttataaaacacgccaccgggggcttagctcctgcttccggccggttcccggcaagcatccaatccaagaaaaccaaggcagacttgcagcccaatcaggcgagcaaaagcaagaagcaagaaaccaccactctgctcccccccctcgcggagatgtcgtcgcagctgatcgaggaccaccggtcgggcgcggaggtgcacgccgggcacgagctgtgcgagcgcaagtcccgcgagttcatggtggagctgggcctccccgacggtctcctcccgctgcccaccctcgacgaggtcgggtacaaccgctccacgggcttcgtgtggctccgccaggccgccggcgtcacccacaccttcgactccatcggcaagcaggtgtggtacgacaaggaggtgacggccttcgtggagcccggccggatgcacagcctcaccggcgtcaagagcaaggagctcctcatctgggtcaccatctccgagatcgtcctcagcccctccggcaccaagatcgtgttccgcacccccgccgggctcggccgcgccttccccatcaccgccttccagctcaagcccgccgcggccgaagaggaggccgccgccgccgccgccaactgatctgtttagcttccggcgccggcggccgcgtgtgtgggctgctcgatctggccgcggcgccgcgagatccggcggtgactctgtgagttgattaaggtttcctccgccgtgtatgtgtaatgtaatggtagtggatgatgcaggaataatcggcgtccctggatccagaactcatgattgtgtgcgctagtgctgccacagtttgattttggattgattgacaactcagtctctgatccatccagtttttatttatgctcac

SEQ ID NO: 11755 - DNA, 824 bp, Sorghum bicolor
  Clone ID: SORBI-28MAY03-CLUS14614_1
gtggcggccgctttcgagggccggccgggccggggcaactcaagcatcccaagcttctcggccagttcagccacctacagtcttgtctgtagacgctgagagcaagatgagcagcagcagggttcttcttgtcagtgctgtcctggtggggctcgtcaccctgagctcatgcaggagcctgggagagttgtctgagcagaagacctactcttctgctcccagctatggtggctccccaactcctacgtacgggtcaggaggaggctacaagccaacgccaacaccaacaccatcttatggcacaacaccaacaccatcttatggcacaacaccaacaccatcttacggcacgacaccaagcaccccaagtacacctgcctatggagtccctgaaattccgaagcatggatttgttggatcctgcgactactggaagagccacccagacatgatcattgcagttgctggatcccttggcaacattggcaagacttttggtgctgcctgcagtttgatcgtcggcaagaagcttgagaatctgcatgatgcactctctaacaccagaactgatggtgttggttccctgctacgtgagggagcagctgcttacctcaactccattgtcaacaagaagtttccttttaccacacagcaggtgaaggattgcattgttgtggccgtgacctctgacggtgctgcttctgcccaggctgggatcttcaagaaggcaaatgaataccactactaggacatggatatctcctgcctagactatttctcttaattgatactacccttcatttcttcctcctgatgaatttcct

SEQ ID NO: 11756 - DNA, 884 bp, Sorghum bicolor
  Clone ID: SORBI-28MAY03-CLUS15873_1
gcacgagggcaaactcgaaccagagcaacatgctgatcctccaggagagctgcaccgacgcatctggctcgtatgtggtgtacgcaccagtggacgtggtggcaatgaacgtggtgctcaacggcggggacccagactacgtggccctgctgccatcgggcttcgctatcctccccgatggaccaccgggcatggctccccatggagagggtgccgccttggagactggcggtggttccctcttgacggtggcgttccagatcctggtggactccgtgcctactgcaaagctctccctgggctctgtagcaactgtgaacagcctcatcgcctgcaccgtggagcgcatcaaggctgccgtctgcgtggaaggcaacccacagtagccttccatccatatgatctcgaggaggggggcagcaaggttttggggaaatattagtggggagtcaagaacgcacctcagactctccttgccatgtggtgctcatactgcaagcgaaaattcagttcgttaggaaaaagaaggcgtcaccactatgcaaggggggatggttcgggtattgacttccccgttgatcaagtctactacagaaaggatgctgcggagaagatgctgtttctggatctctttcaatatttttagggtttccatttgctgctgtgtacttcgtcatgttcgtggtgtcgccgttgttcaggctaaggtgcctgtgcctgctcgtagctagagaacagagatttgttgcgtctttttttttttggatttgcaaagatttgtagaatctaggatcaatcatttcataaccaatgcttggctaaaacgtgcccgttgttgtttgtagctttttgctatttaaaacgatgcaattccatgttctgag

SEQ ID NO: 11757 - DNA, 858 bp, Sorghum bicolor
  Clone ID: SORBI-28MAY03-CLUS16034_1
tccagttcatattctgtgccactttacattttcacaatgtctcttgtgttgattggtcacctatatcctgctgatttcgcgcacatcaggagttccaagtaggtatttacatcgttcttcctactagtaagttttctataatctgacaaatttcgtggtgctatgctaatggcttgagggttatcaggacagccctggacagctggcaaatatgtatgtatttaatttcaattgaagcattaattttattcattgccaattcactgcatgcaaatatgggtttgtagcaaaaataggtggctgaggttagcgcatgacggtagcatttattgaaggtaaagtttggtcgagaatgtggcaagagttttgctccaggtcagctttcatttggccagtgagcctgagaagctctgcttgaatctttgttccagaggcaccaaccatatctaacaccaagtttgttgtttcacaattcctatgaacagatgaactctgttgacgcagcaattgatcgaagaatatcagagagtcggctggcaggacgcatggccctatgaagatgggggctttgcttggtagattacccaccccccttgcagttcacccaaggactcgcctgtgcttttatcgctgtgcagcagtcggacctgttcatttagttagcgcatggagttgttgcagttaaaaggaatgttttgtttctgacttgttggagtgtggagcctttgttcttctatgtttccagcagcgagaagaaaatgaattgtagcccttaggagttaatttggtccaattgtcacctctgcacgattgtaacctggtgatgtgttattgccaattgaagcctaatgatgtaca

SEQ ID NO: 11758 - DNA, 1581 bp, Sorghum bicolor
  Clone ID: SORBI-28MAY03-CLUS16293_1
gcagctgcaccattcttttcgacgaaggaaacggcaacgcgaccccagggccgcgggcgctgacgcgctgtgctgcgttttttttccccatcgagacaacaagacgaggccagccacgcgcaaaccgaatccacccacgccgaacgaccgcatcaagtcaccaaccaatccacttcgccggcgagcggcgatccgtctcatctcgtcgcgtctccggcgccgacagccacgggcaactcggctccgagatcggcgggcaggatgatgatgctgatcgactgctcggggtgccgtaccccgctgcagctgccgcacggggctccctgcatccggtgcgccatctgtggggccgtcacgcacgtcgcccccgcccctcccgccgaccccaaccgcggcgccgtacagcaggcgccgggatggggcccgccgccgccgccggtgcacgggcggaagcgcgccgtggtgtgcgggatctcgtatcggtactcgcggcatgagctcaagggctgcatcaacgacgccaagtgcatgcggcacctgctcatgacgcgcttcaacttccccgacgactccatcatcatgctcaacgaagaacaaaccgacccctacaaaatcccaacaaagcataacataaggatggccatgtattggcttgtccaaggttgtcaacctggagactcattggtgttccattattctgggcatggagcacaacaaagaaactacagtggagatgaggttgatgggttcgatgaaaccctctgcccattggattttgagacacagggaatgattgtggatgatgagataaatacagcactagttagaccacttcctcatggagttaaacttcatgcactcattgatgcttgtcatagtgggactgcacttgatttgccttacctctgcagaatgagcaggagtggtcaatatgtatgggaagatcaccgaccacgatctggtgtctggaaaggcactagtggtggggaggctatttcatttagtggttgtgatgatgatcagacctctgcagatacctctgctttgtcaaagatcacttcgactggtgcaatgacattctgcttcatccaagctattgaacgtggacagggcaccacctacggtagtatcttgaactccatgcgttcgacaatacgcaacacaggtgactcagcgggtgtcggtggtggtgctgttacatcactaattacaatgcttcttactggagggagcctttctgctggtggtctgagacaggagccacaactgacggcgtgcgagacatttgatgtctatgcgaagcccttctccctatgacgcgttcatggtattgcccaatgtattatatagcacctcccgtttcacgttatcatcgtacatttcactgttagatgtcctccatccatcgcgattgttaacaacgcgtgggattgccctttattcccatgccctcgcaatgttcagtgcacagttgtaaaaggagaatgcactttgacggctcagttcacttgtcttataaaccgtaaaccatgttttctctgtcagcctgcagtttttttctctcataataatcagcgaaca

SEQ ID NO: 11759 - DNA, 829 bp, Sorghum bicolor
  Clone ID: SORBI-28MAY03-CLUS186_1
cgttcggccagggcgctcttctgccgcgacgggccccccctctgacacgtccccggcacgattgagcctacctccaaatcctggggtttgtccgtcagcttcatcagcatcatcctgctaccaatcgtcggcaacgccgcagcgcatgccggggccatcatttttgctctcaagaacaagctggacatcaccctcggagtagctttgggttcggcaacccagatctccatgtttgtggtgccactgagtgtcattgtagcttggatcgcgggtattcaaatggatctcgacttcaagctgctagagaccggctgtctcttcgtctcagtaatagtgacagcattcactctgcaggatggatcgtcacactacctgaaggggatccttctgctgctatgctacattgtgatcggtgcatgcttttttgttacgcggcaacctgcaagtcatgcaaacaacaatggtgctgggctgttgctgccaactgatactttgggtgcacaagttgcataacggttcaagagtcatgcctgaacaaatgagcatccaagacagcaacgcagtgttcgagtctgaaacagtgcggtgcaaagattgatgctttcagaagagacgaaatcggtcagtggctcagtgctttcggagaaatgtattcatcactgcacaaaaatcggcatatgaaaagtattatttgtgcttgtattactattggtttagttagcctagctgctgttgcaataagggtaccgaatatgcatccggtctatgtatatgatggtgtcttgtttcatttattatacagcttaataagatatgcagagcctcgtgc

SEQ ID NO: 11760 - DNA, 713 bp, Sorghum bicolor
  unsure (1)..(713): unsure at all n locations
  Clone ID: SORBI-28MAY03-CLUS18601_1
ttccgcgcgccacccacctggccggcgccggccgccgcccccttgacgagttgtgtgtcgctcactcgcgcttccaccatcccatgccaccccgctcctggtccttcgtgctcgcacgtgctcgcaagttccagatcgagagccgcactccctcctcttgcagtctttctcacgcatgcagcatgcgttccagattaagagccgcactccctccctcttgcagcgtgcatccttgaacgcttgtccatgattggctaaaggaagaggaaagaagcatagaaatactggtccttcaactctcatccgagattggataaagattgaatctttggagcacagcactgttgtccgccttgtattttttttttatttggatttttcgagataggaactacgattgtttgttggcaatctggacatgggaactactttctcgattgaaaactttactgcccttgtcgccacttgcaatcaagcaattggcctcgccgtttccacccttctctagatatgccgggcacacggtcatgcccgcgggcaaggcgcaccctcgggtagcgtttgtgttcaatttttcattttacctacatggntgttggcttctgatttgctatgtatttagtgtccatctagagcatacttgtgatgatcttgatttggattgtactctgtttggcttgatcttaatcaggatagtattgatttggtattgc

SEQ ID NO: 11761 - DNA, 1236 bp, Sorghum bicolor
  Clone ID: SORBI-28MAY03-CLUS19114_1
gccggccgggctccgcgaggtcggcacgcacccgcaattcgcacgcccgcaccacctccctaaccctcccgcgagatctctcaccttcccctcagatccgcctcacctcgccggcgcgctcgcgcgctttccgcacgcccgccgccatgtcgcacaaccacagcgacacgatcccgctccacccctcgtcggcgcagtccgacatggatgagatcgagagcctcatccacgccgcgccatccccggccaccgtgctccccgcgcggccgccgtctccgacgcgggcctccatccccgtatcctcctcgccggcgccggcccccgtccccacgaagccgcctctccccgccgcctccatcccgatctccgtctccgtttcccccgttcccgcctccgtctccgtccccatcggcgctgacgggtttgggcctccgcccaacacgctcacagagccggtatgggataccgtcaagcgagacttagcacgcatcgtcagcaatctcaagctcgtcgtcttccccaatccctaccgcgaggaccccggcaaggcgctcagggactgggacctttggggtcccttcttcttcatcgtcttccttggcctcacgctctcctggtcggcttccgttaagaagtctgaagtattcgctgttgcattcgctgtcctggcagctggggctataattctgaccttgaatgttctgcttctgggtggacacatcatcttcttccaaagcctgagtcttcttggctattgcctgtttccactggatgttggtgctctagtttgcatgctgaaggacaatgtcatacttaagattgtcgtggtgacaatcacattggcatggagctcctgggctgcatatccattcatgagtgctgctgttaacccaaggagaaaagctctggccctatatcctgtcttcctcatgtatatctcagttggtttcctcataattgccattgattaatgaaggtggccaagctttgtagtaacatctgaagagttgagtggatgattgaaccaccagaatacatacaagtttgagtagacaatgcttctaccctcatggagtctttgtgaattgcctcgtggggattttggtctttacatgggcaggaggcttaaggttgtaaaattagtcgaaaatttatatctgttgtaaagggcatgaacattggaccactgaattggctgtcaagctttcttatactaccatatgctgttcaaaattc

SEQ ID NO: 11762 - DNA, 875 bp, Sorghum bicolor
  Clone ID: SORBI-28MAY03-CLUS19045_1
gccggccgggtccggggtctttccttgtcaccaaaccaaaccgaagccgcgctccactccactccactgctcccctcccccggccaatcagctatgctcgcccaccgccgcctcctcctcctcctcctcgccgccgcggctgcggcgacgggcggcaccgccttcgctaagaaaacggcgtacgaagtcctcgccgactacgacttcccgccggggatcctccccaagggcgtggtctcctatacgctcgacaacgccacgggcgccttcacggccacgctcgatggatcctcctcctgcgagttctccatcgagggctcctacactctccgctacaagaccgatatcaccggcaccatcgccaccgaccacctcaccgacctcgagggcgtctccgtcaaggtcctcctcttctggctcgacatcgtcgaggtcacccgcagcggcgacagcctcgagttctccatcggcatcgtctccgccgacttcgggatcgacaacttcctcgagagccccacctgcggctgcggcttcgactgcgacgaccggctcgtgctccagaagcagccggggggcgccacagccaagctgcgcctgcgaggtgccttctagaattccatttcggtgtgactgctgctgcaagctgccactactagctagtagtgctatatgtcttagtaaatgtaggttaataaagagggcaaacttcaaaatcccagcttttagaaaaaaaaaaaaaaaaagatgaagaataggttagtaagttaatcaactgattacatgtttcttaaactatttcagacagttctttaagaagtcacactgtctttgatgcaattgagttctttcaaatattttgttctttaaatctctgt

SEQ ID NO: 11763 - DNA, 875 bp, Sorghum bicolor
  Clone ID: SORBI-28MAY03-CLUS19143_1
gcacgaggctccggcgacttccgcatccggaagaagcacgtcgtcgttacgaagaagaagaagcaggcccagcaccagcaccagcacaggggcgcggcggcggcgtcggagtcggaggacgactcgtccaccagcaccagcggcggcagcgacaagagcagcgtggtgcagagcttcaccccgtcgaccccgccggcgactgccaacagcttccgcaccgggaagcggcgcaagggcgtgccgcaccggtcgccgttcggcaacctcatggtggagttctagaccaccaataccaaaggcgcggctccgattccaccagaaacagcggtacaccactgtagcatacgcacttctacataccatctataggtgtttgccggatcgaccggtctacatacatagccagccaaaaggagctagtagtagcaagcaataaccaagggtcccactgcacgcccgcgcttctggacgagacgaggaggccggtgcaatgcggcacgtacgggtacggttacttccatagcagttacataatgcaagttcacactgtgctagtaacaacggtttgggtttggtgcctctgaaaggaaacgaggtagttgtagcagttactcttgtcgtcatcagccagtcactactaagttttgcaagttttacctatataggtgttttcctagttttactttttaccggcggtgcttgatataagtagtagaaatgtacatatacatataatactgtcacagatgggggggaatggtgtaggagtgtagcttcccagtgttcatattcgtgtttgcctttgttgcctgtaataaaaaggataagaaaagaatgctgctcctggatggccttcaatgtcaagggtttgtgta

SEQ ID NO: 11764 - DNA, 1130 bp, Sorghum bicolor
  Clone ID: SORBI-28MAY03-CLUS18963_1
ctactgggactgcttctacgcacgaggccataatcatcacagactccaccgcctgctcctcctcctcctcctccaaccttgtgatccttcaaaacctctcagttcttgatgccaagatcctactttgcccaacttgtgattagtcgagagaggtgataggagaaaccaattctagacagttgattgagattggggaaagtggggagaggaaggggagaagagatgtctcggggcggtagccacggggagctgggccagaggatcgattacgtcttcaaggtggttctcatcggcgactccgctgtgggcaagtcgcagctgctcgcccgcttcgcccgcaacgagttcaacctcgactccaaggccaccatcggagtcgagttccagacgcgcaccctcaacatcgacgcccgcaccgtcaaggcacagatctgggacaccgcaggccaggaaaggtaccgagcagtaacaagtgcctactacaggggtgcagttggagctatgttagtatatgacataaccaagcgccagtcctttgatcatgtggctaggtggcttgaggaactacgtggccatgctgataagaacattgttatcatgcttattggtaacaaatctgatctgggaacacttcgttctgtcgcaactgaagatgcaaaagagtttgctgagcgtgagaacctcttctttatggagacctctgcacttgaggctgtcaatgttgaaaatgctttcatgactgtactgacggagatttaccgggttgtcagcaagaaaaaccttgttgccaatgaggagtctgattctagtggaaactcgagtttactgaaaggaacaaagattgttgtccctggtcaagagccaccccctacatccaaggcaacatgttgtatgtcctcctaagcatgataatgtaccatgtcctctctggtagtcagttcctgattacttctgccatatctgcatgatgaatggctgggattcttggaagtaaagatgagaaagtctataggaacagttaactcatatacactgtaactatctggacgtcctttttgtatctgattatgtgatatagtgcattcattaagaatccttcgctctaaaaaaaaaaaaaaaaaaggccccta

SEQ ID NO: 11765 - DNA, 537 bp, Sorghum bicolor
  Clone ID: LIB5050-001-R1-XP1-E12
tgcggcgctcgagccggccgggccggggcgacccccgaaggaaagccggagcagagagcgccaccactagccagctgaggaggcatggcgggggccggagacaaggtggactacgtcttcaaggtggtgctgatcggcgactcggcggtgggcaagtcgcagatcctcgcccgcttcgcccgcaacgagttcagcctcgactccaaggccaccatcggcgtcgagttccagacccgcaccctcgtcatcgaccacaggagcgtcaaggcccagatctgggacaccgccggccaggagaggtacagagctgtgacaagtgcttattacagaggtgcactgggagctttgctggtctatgacatcaccagacgccagagcttcgatcatataccccgctggctagatgaactccgagcccatgctgacaagaacattgtgataatgctggttggcaacaagagtgatctccaggagcagcgagccgtgagcacctgaaaatgccaaggagcttgccgagaaggacaatcccttcttcct

SEQ ID NO: 11766 - DNA, 1057 bp, Sorghum bicolor
  Clone ID: SORBI-28MAY03-CLUS18_2
gccggccgggccgggctctctccctcacccactgcccccgccagcgccgcggccgcgtcctgcgcgcctcgctcactctgcttcctccgccgcaggagcagccgtttcgcagcggagcggaaccggaggcctaccatggccgccgcaatctcgctggaggccggcgggggcctggcccacgacctagggtccgcagccgtcaccgctggtgtcgccctcgcgctcctcaaattcttcgaggagatcgcgaagcgcggcgtcttcgagcagaaactcagcaggaaacttgttcatataagcgtgggcctggtgttcttgcttttttggcctctttttagctctggatggtatgctcctttccttgctgcgctagcaccaggggtcaacgttataaggatgcttctactggggctgggacttatgaaaaatgaggctatggttaaatcaataagccgctctggagattacagggaacttctcaagggcccactgtattatgctactactataacttttgccacgtcctgtattatggagaacctcaccagttgctatagcacttatatgcaacttatgtgctggggatggtatagctgatgttgttgggagacgcctaggtaaagaaaagcttccatacaatcccaacaaatcatatgctggaagcatagcaatggcggtggctggttttctggcctcagttgggtaatgtctgacctttactgaattctcagttgcatcaacttatttttaatcattcggtctcatttattcaggtatatgcattacttccacacttttggttttattgaggaaacatggtacatggctttaggcttccttgtggtatctgtagctgcaacactcgttgaatcacaccccatcagcacagaactggatgacaatttgactgttcctttaacatcattcctagttggtagcctcatcttttgatgtttaggctcaaaggacatcttagatgtttctccatcatgttgtaattatgtaaaacgttactaaaataatactataattgtgagaatctctacctagagtttgg

SEQ ID NO: 11767 - DNA, 1086 bp, Sorghum bicolor
  Clone ID: SORBI-28MAY03-CLUS18_1
gcacgagggcgacgacgagcacgagggcgggatgttcagtctcgggcctctcggcgcccacacctcgccgctgtcctgctccacataccacgctcccctactccaatccagacgcctctctccctcacccactgcccccgccagcgccgcggccgcgtcctgcgcgcctcgctcactctgcttcctccgccgcaggagcagccgtttcgcagcggagcggaaccggaggcctaccatggccgccgcaatctcgctggaggccggcgggggcctggcccacgacctagcgtccgatcctgtgaactgcaatgagatttgcagtatactattgtgacacaggagaggagctatacggtgccaaatgctaaaaactcagcaggaaacttgttcatataagcgtgggcctggtgttcttgctttttttggcctctttttagctctggatggtatgctcctttccttgctgcgctagcaccaggggtcaacgttataaggatgcttctactggggctgggacttatgaaaaatgaggctatggttaaatcaataagccgctctggagattacagggaacttctcaagggcccactgtattatgctactactataacttttgccacgtctgtattatggagaacctcaccagttgctatagcacttatatgcaacttatgtgctggggatggtatagctgatgttgttgggagacgcctaggtaaagaaaagcttccatacaatcccaacaaatcatatgctggaagcatagcaatggcggtggctggttttctggcctcagttgggtatatgcattacttccacacttttggttttattgaggaaacatggtacatggctttaggcttccttgtggtatctgtagctgcaacactcgttgaatcacaccccatcagcacagaactggatgacaatttgactgttcctttaacatcattcctagttggtagcctcatcttttgatgtttaggctcaaaggacatcttagatgtttctccatcatgttgtaattatgtaaaacgttactaaaataatactataattgtgagaatctctacctagagtttggag

SEQ ID NO: 11768 - DNA, 880 bp, Sorghum bicolor
  Clone ID: SORBI-28MAY03-CLUS16930_1
gcgcacgaggctgatacacaagcaaggcggctagctacagctagctggtgcgtgcagtgcatgcaaatggcggcttccctgggactgaaccctgaagctctcttcgcttcatactcgtctgcctactcctcctcctcgccgttcgtgtccgactacgcggcgagcttcccggcggccgtcgactccgccacggccttctccgcggagctcgatgaccttcaccacttcgactactcaccggcgccgatcttcacagctgtcggagccggggctggcggcgatcgcaacgagaagatgatgatgtggtgtgagggcggtggtgatgaaaagagactcagaagcagtggaaggatcgggttcagaacgagatcagaggtggagatcttggacgatggattcaaatggaggaagtatgggaagaaggctgtcaagaacagcccaaatccaaggaactactaccgctgctcgtcggagggctgcggcgtgaagaagcgggtggagagggaccgcgacgacccccgctacgtcatcaccacctacgacggcgtccacaaccacgccagtcccggagccgccgccatcatccagtacggcggcggcggcggcaatagcggcttctacagcccgccgcacagtggctcgccgtcggctgcctcatactcgggctccttcgtcttctgacttttccgggccttgaccttgacccagagtgatttacctttaccccagtcgtaggatgagaagagtgttcagagagatcagttcagcggccggctaaattccgacctgcttgtacatttttacacacttgtgcagtacaagtaataatatttaagctagaagcagtgtactctactttatttacctcaaaaaaaaaaaa

SEQ ID NO: 11769 - DNA, 1051 bp, Sorghum bicolor
  Clone ID: SORBI-28MAY03-CLUS17_1
cttattgcaggtggtccttttgtgcttccccttgcacacaaacacaatgtgaaaattcttcctgctgattctgagcactctgcaatatttcagtgtatacaaggcttgtccaaaggagcacttcgtcgcattattctaactgcatcaggtggtgctttcagggactggccagttgacaggctgaaagatgtaaaagttgctgacgctttaaagcatccaaactggaatatgggaaagaagatcacagtagattctgctactttattcaacaagggtttagaagttattgaagcgcattatttatttggtgctgaatatgatgacattgagattgtgatccacccacagtctatcatacactctatggttgaaacccaggattcatctgtcctagctcaattgggttggccggatatgcggataccaatcttatacaccttatcgtggccagatagaatctattgctctgaggtcacatggccccgccttgatctttgcaagttgggttcactgacgttcaaagctcctgacaatgtaaaatacccatcaatggacctagcgtatgcagctgggcgggctgggggcaccatgacaggagttctgagtgctgctaatgagaaggccgtggagttgttcattgatgaaaagattagctacctggacatattcaaggtggtggaacttacatgtgacgcgcatcggaacgagctggtaagaagtccttcactcgaggagatcatccattatgatctgtgggcgaggagatatgcagctagcctacaaccatcttctggcctgagccctgtccctgcataataatatgtagatatactcctacatattgtcatgacctcgtgtacaggagttctaagatatcaagtgtgtggctcctgtttccatgttcgatttccaggagctagatgaagcattaggggacatctaggtcgccctcctgaatgtaaatcatgcctccacagtccacacgaataaaatgcatctgttccatgtgatttttttttatgggtgaagtgttcgaattcgggtgggaatc

SEQ ID NO: 11770 - DNA, 706 bp, Sorghum bicolor
  unsure (1)..(706): unsure at all n locations
  Clone ID: SORBI-28MAY03-CLUS17245_1
gccggccgggccgggaaaaaaaaaaaaataggtctcgagtctcccctgtcccctccctccctacgctcgctgtagaggaaaggcgaagatggcgatgaccgtcgaagtgcttgctggactcgcgttcatgttctccacgagtattctgctgcagatactggcatgtgctttgtacaacaactggtggcccatgttagcagctctcatgtatgtccttgtaccaatgccatgcctgttttttggtggtggatccacacacttcttgactagcagagaaggtggagggtggatgaatgctgcaaaattcctgactggtgcgtccgccatgggaagccttgctattccagcaattctgaggcatgctggcctaatcgaaacgggggcaatgttcatcgagttcacgtccttcttcatccttgtatgcacggtgctgtgcttccatagggctaccctggatgaagactggtaaatgcgcatgcacggaaccccctaaacctgaagattagccattctgtggccacttttctccatgctaagaaaactcctgacatggatctgtatgtacaaagaagcaaatttcgagcttacgtagctgatgttttatgtatacacttgttaagattctgtagtcatgtggcaatgcagattgcgttacgatcatccttaaaaaaaaaaaaaaaaannnnnnnnnnnnnnnnnnnnnnnn

SEQ ID NO: 11771 - DNA, 688 bp, Sorghum bicolor
  Clone ID: SORBI-28MAY03-CLUS17266_1
atgtactggaaccagctgcgctaggagtattttcctttccctatatatagtagtggctgattctcaggtccacaaatcgacaacaccgatcaacaggccggcgtccatcctgcagtattgccgccgataactgttttgacacacaatcaggccggatagatggcgtcggagaagagcaagatcctggtggtcggcggcacggggtacctgggccggcacgtcgtggcggcgagcgcgcggctgggccaccccaccgtcgcgctcgtcagggacacggcgccctccgacccggccaaggcggcgctgctccagagcttccaggacgccggcgtgacgctcgtcaagggcgacctctacgaccaggctagccttgtcagcgccgtgaagggcgccgacgtggtcatctccacgctcgggtcgctgcagatcgccgaccagacccggctcatcgacgccatcaaggaggccggcaacgtcaagaggttcttcccgtcggagttcggcctggacgtggaccgcacggggatcgtggagccgggcaagtcgatcctcgccggcaaggtgggcatccggcgcgccaccgaggccgcgggcatcccctacacgtacgccctggcgggctacttcgcggggtacgcgctccccaacatcgggcagctcctggcgcccggcccgcccacggacaaag

SEQ ID NO: 11772 - DNA, 842 bp, Sorghum bicolor
  Clone ID: SORBI-28MAY03-CLUS20098_1
gccggccgggcgcggcttctcccctcgtgccgccgctgccgcaggagcatctcaactccgcctcgagccccaccagctcgccggtctcagccatggtgaagtactcgagggagccgaccaaccccaccaagtccgccaaggccatgggtcgtgacctccgtgttcacttcaagaacacccgcgagacagcttttgccctcaggaagctgtcactcaccaaggccaaaaggtaccttgaggatgtgattgcccacaagcaggccatcccgttccgcaggtattgtggtggtgtagggcgaactgctcaggctaagtctcgccactcaaatgggcagggacgctggcctgtcaagtctgctaaattcattctggaccttctcaagaatgcagagagcaatgctgaggtaaaaggtcttgatgtggataccctctatgtgtcgcacattcaagtgaaccaggctcagaagcagaggcgcaggacctaccgcgctcatggacgcatcaacccttacatgtcctccccgtgccacatcgagctcatcttgtcagagaaggaagagcctgtgaagaaagaggctgagtctcagattgcaaccaggaaggcttagagaagggatcatcttctgtgattggctgagtgaaaattttggctgattatttgtcatcttatattgtatctgagtattgttcgctagtgctttgttactttgatcactacctgaactgcacatacaattcaccagtcttgagaattgtctcgagtttccatattttgtgctgatggtgatgtcactgatcgtgttaatttgcaattttgctggtaaaaaaaaaaaacctcgtgc

SEQ ID NO: 11773 - DNA, 771 bp, Sorghum bicolor
  Clone ID: SORBI-28MAY03-CLUS2014_1
cgtccggtccaatactgcagctgcacctcctgtgaaggagattaggaggacaatgagaattcaagcactgcgctgccatgttttgtacagccatgatggtagcaagctgaacgtaattcctgttttggcttctcgctcacaggctttaaggtatttgtatatcagatggggggtagagctgtcaaacatcactgtggttgtcggtgaatgtggtgacacagattatgaaggactacttggaggcgtgcacaaaactatcatactcaaaggctcgttcaatactgctccaaaccaagtccatgctaacagaagctattcattccaagatgttgtatcccttgagaaacaaggaattgcttcaattgagggatatggtccagacaatctaaaatcagctctaaggcaatttggtatatcgaaagactaaatctttgatcttgctggtcagcagaggaatcaaactaggatcgaggagagtggcaggacttcccctatgccgtcgtactgcacctcgccgaaaaatagtgggattgctatgcatggtccttattgtacactagaaaattggggacacaaacttgtgtcagattctccgttgcaaaattcagtgatggtgtttttgtaactatacaaaagttgtgccagtttctccgttgttgcaagactcagtgatggcgtttttgtaattacacatcccaataagactgatgactatgcaacctgagggaaaatgacaattttcctagatcaaatattttctattgcagtgcg

SEQ ID NO: 11774 - DNA, 955 bp, Sorghum bicolor
  Clone ID: SORBI-28MAY03-CLUS20201_1
gattaacaggcatcaattcatttcaggatataaacaaggtcctcgctatgtctcgaattatggtggcatggcaaccaataggcatatcaatgggagtttttgacatctgccatcggtatttgaaagaaaggaagcaatttggagctccactggcagcttttcagctgaatcaagaaaagcttgtccgaatgcttggcaacattcaggctatgcttctcgttggctggcgtctgtgcaagttctatgagtcaggcaaaatgacaccaggccgatctagtttaggcaaggcgtggacatcccagaaggctagggaggtagtttctcttggacgagagctactgggtggcaatggcattttggctgattttcttgttgccaaggcgttttgtgacctggagcccattttctcttacgagggcacctatgacattaacagcctggtaactggcagagagatcaccgggatcgcgagcttcaagcctgctatgtcagcaaaatcacgcctgtgaagttgtttttttatttccccgaggaagatgatagacaccaatcttgtatatattccgatgattgggaataactgaataagaacgatggggaaactgtatttgttacattttcacttttgtcagtctgtgataaacgactctccactggccgtgttcaaatgctgcaaaaaaaaaaaattttacaaaggacatggcccttttttttattacgcaggagaggtgcgtttcattgtattattgtagagatgaaaatagggggtcaccagcaggatcctcactggctcttgaaagcacgcttctcggcatccgtagatatactattagcttctggattcatggatcatggatgtatacctacgagtttttcatcgtaatcatattcttgtaacagtactatgatactacggcatgtttagttgacgaagtgaaaaattttatgacactgt

SEQ ID NO: 11775 - DNA, 873 bp, Sorghum bicolor
  Clone ID: SORBI-28MAY03-CLUS20885_1
tagccggcctagtcatataagttgaagaacatgctaaataatgcgccagagtatttgcagaatgttgttgagctatgccaaaacagagttgtcgtcttcgataacatgaccaatgaccgaaggctccaagcgcagcaacttgacaaattgcttgatgtagtggactcagtttgtgcaaacaatggaggaaaaccattttcagatcaaatgttcactcgcatcaaggaggtgcatgatagagaaaaagaggtgcataccttggggtattcagaagagcagatatctgagttgaaaaaggagattcatagaactagggatgaacagcttgcacacataaccagcatggtcgaggaaaagttaaactgcactgtggagaagctgcaacagcaactcatggaagaacagaacgcaaggctggaagctgagaaggtggcgtatgaagctaggctgaaatcagaagcggagatccagaagctcaaggagagcctcaagaaggctcaaagggaaaacgaggagttccggaggatggcgcagagccagggcagcaaatgtgctatcctgtagggtacttgctagaagtttcggtggggctaatcgtgctgccgcgtctcttatctgtagtagtaccttttagcagtttatgcgacaactgttaattagtcactggtattcgaatcttctcttccctacattatcgttgtgcttctttgcttgtgaggctgagtaagtaatcaaatctctttgcagccctgtcaacttgctcgaaggattgtaacttgttgttggcatcttggagatagtttttgggtagtaactttttgaacaactcccttcgcttcttctcttatgttctaatgcaatgcgatttcccct

SEQ ID NO: 11776 - DNA, 1007 bp, Sorghum bicolor
  Clone ID: SORBI-28MAY03-CLUS20368_1
gcacgaggcacccggccgggtccccgctttcccagtccccaccccccccgactcctttaacccccgtcaccgcgccgcaccggcgacttgcctctccactgctccaactccattcccccacacccgctcgcgcggttgctcaatggcgggaggcggggcgtcgtcggcgtggggcccgagcccggctctggtgaccgcgctggtggctctgctcggcctcggcctcgccgcctacatcgtcggcccgcagctctactggcacgccgcggaggcgctcacggcggcggccgcgtgccccgcctgcgactgcaactgcgacgcgcgcccgctcctcgacctcccggaagattgtgctaaacacttcaagggggtcaagagtcgagcatctggtgaagagacagaaaaaagtttcacagagctgcttgtggaagaactaaagcagagagaagaggaggcaacacaagctcagcaagaggctgatgttaagttgctcgaggccaaaaaattagcttcacagtatcagaaggaggctgacaaatgcagctcaggcatggatacctgtgaagaagctagggagaagtcagctgtagcattggtccaacagaagaaactgacttctttgtgggagcaaagggctcgggaactaggatggaaacccgagaataccaaggcacacctatagtaaatcaaatacccttgtggatggggttgtatactatgtgtaccatagatcacattgcaaatacaacccactaagagctcgagatgatgtggaaacaaatgggtttctgtttgagcggactctagcacttgactctctttacaagccaagggcctccttgtccatagtaaatttgtattcagtttgtagtttactttcgttgctgtttgtgaacactgatgtgtgttgggatggtcataggatgacactgttcattattgtctagatgtctaaaaggagaaaagttattgtctgggggtggggccaaaaaaaaaaaaattgtttt

SEQ ID NO: 11777 - DNA, 700 bp, Sorghum bicolor
  Clone ID: SORBI-28MAY03-CLUS20896_1
tgccgtcggccatcctgtcgttgatcttcatcggcaggatcaaccggcggagctcggtcgtcgcgctcaccgtggcggccggtgccttgagcctcgcgtgcgtcgtcatcccggagggctcggcggcgcgaatggcggccgagttgctctccttcttctcaaccatcaccgcgttcaacctcatcctgatctactccatcgagctgttcccgacgtccgtgcgcaactcggcggtggggctggtgcggcaggcgctggtgctgggcggcgtggtggcacccatgctcgtcgcgctcggccgcgagcggagcttctggtccttcggtgtgttcgggctctgcatcggatgcctggggctcttcgccgcctgcctcccggagaccagggggcggagcatgtcggacaccatggaggaggaggagcacaaggaggctgccgccgcggcttgcaccggcgcaaccgacatcatcgccaccaaggatgatagcgacctcgtgtagcaaacgtccgtgtggtcaatcacgaagctgtcaggctgcctctatccagtcttgtaccgctgccgccaagttgatgcatataattcagtttcaaaaaaaaaaaaaaaaaaaggcccctaagctaaaatcaggggccacattcacaaaagcagaactcgatccatatcgatcggtgaagatgaagcacatgttcaaaccaa

SEQ ID NO: 11778 - DNA, 989 bp, Sorghum bicolor
  Clone ID: SORBI-28MAY03-CLUS2015_1
gccccacccccagagtcgaaaccacagggccgacccgaccgcacccccaggcagtcgaaaccacaggagcgaccgagagaggcctacgcgcaccggcagatcccaagctcaccggggaggaggaggggagagggcgaccggcggcggcggcgatgggtttcatcatggagttcgcggagaacctgatcctccgtctgatggaggacccggacaagcgcgaccaggttcggcgggagcatgtctacaagatgaaggagcggtgcgagcgcaccaaggcggcgtggaacctcccgctgcgcccctacggcttctggaccttcgagcgcttcaactcgcagctctcctgggacccgcagatcagccaggccgccggccgccgggacccctacgacgacctcatcacccgccactccggctccccgccgtcttcctaaacacccgcgccgcaggtctacctcggcaccaataagaaactcgcccctctcaaactgattgtgattccattctcttctgttcgaaaaatagtgtcaccaaactactctactttctgtttcagtttggcatggaagcagaagttgtgtacttttattctcaagattcagtctttgtattatgaaatgttccaataatcattcggagcactcatttgcctttaccataaaggaaattctcctagtgattacaggcgccagatcttatatattttggatggtttgtcaggggcagataattttctatattgattctacaagcctgcatttcattgattgaggcaagcctagagagtagagaccagattcaatcagaccgtggtccaggtttttctgcgctgaattcaccacttgttagtggtcagtcatcagttacaagcatctcgcaccacaatggtcatttggttacgggcatcgggggcatgcaggccaaagagctgtatcatggtatggtatcacttggtactcgtagtttctaatctaactggctgcattggt

SEQ ID NO: 11779 - DNA, 686 bp, Sorghum bicolor
  Clone ID: SORBI-28MAY03-CLUS44176_1
gcacgagggccagttgcagcaagtaatttctcaaggccaggcaattcagccagcaaacgtgggatatggtagtgattggcccagaaaccgtgacaatcagtatgctgatgacttcaccgaagacattcacgtgaatagtcaccagatgcttgagagcgaggacatgcagcagcttctgagggtcttcagtatgggtggagcttctggcagtttgccagacgacactttcaacttccagtcttacatgccctctcccttaccgaaccaaactgagcgcagccattcatctggcaaagctgttgttggctggctcaagatcaaggctgcaataaggtgggggattttcgtcaggaagaaagctgccgagagaagggcgcagctggtcgagctggaggattaacattgtggctttacaatggtcaagcaaggttgcgttgtaaattactagtagttctctgcctcctataccgtcctgttacagttgagacaagtttctaaaatgtacaatgactagttctgctatcttgtacagaattcaccctgtttgcttgtgttagttgtgtaacatagctctgctaagtttgacacatgattggatcatatgcttatgtatctttcccccctagctcttctgcggagaatacagtaacagtgcggattaatccaaagattatgtttgtatgttg

SEQ ID NO: 11780 - DNA, 1401 bp, Sorghum bicolor
  Clone ID: SORBI-28MAY03-CLUS44165_1
ttgacccataactcccactttactcacctccacaaaccagcaccctcctctgctctgctctctcctccctcaccttgttccttcttcccttccccttcctcctcctcccctgtcccctctccattccattccactcctccatccaacaagactcacgcacagagaccccagacgctcccaacccaaactcgatcccaaatcccaagaatcacacatcagccatgagcaaggactgcggcaaccacggcgacgacgacctccgccggtcctgccgccgcctcctggccatcctcctcgtcctggccctcctcgtcgccctcatcgcgctcatcatctacctagtcctccgcccaacccacccgcgcttcttcctccaagacgcctcgctccggcagctcgacctctccaacaccaccaccaccacctccgcggcgggcgccctctccaccacgctccaggtcaccgtcgcctcccgcaacccaaacgacaaggtcggggtctactacgaccgtctcgacgtgtacgcctcctacaagtaccagcagatcacggtggccgcgtcgctccccgccgtgtaccagggccacggcgacgtcgacgtctggtccccggtcctctccggccccgacgtccccttcgcgccgtacctcgccgacgcgctccgccaggactgtcaggcggggtacctgattctgcaggtcaagatcgacggccgtgtgcggtggaaagtcggcagctggatctccggccactaccatctcttcgtcacgtgcccggcgttccttgtcaccaccggtgggaacggcgcgcccggggccagtgggttcaagttccagaccaccacttactgccacgtcgaggtctagcgcccgccggacttcaggtcaggtgtctggtctggtggttcgtcgccgtccgtacgtcccttgtcgtctgtgttgttcataccgtggagcgagaaacagagctcgtcgtcgcctgtcaaggaaggaggcagagatcttggctggctggctggttggcggtcgacatggccggccggccatgcgccatggctggctttgctggtgcctgctggtaataactctctctgtccgctgctgcctgctggtgttactgctgtctgtagtgatgcggatgtaaaggagggtaatttcgttttttttttccttttgctttttcttcttcttcttcttcttctttcttcggtagggttgattaatactgctatagtaaacagtaattataattactattactacggtcatatatgctgtcttcatcgtctcattagctggtttgctgctgtttgactgttgttaaaaggaagcttaattgttaataaacctattttccgggggaccacaattacaatttacaattgaagaggggaaactaagt

SEQ ID NO: 11781 - DNA, 736 bp, Sorghum bicolor
  Clone ID: SORBI-28MAY03-CLUS44196_1
attttcggaagattcccaatggtgtaaatggtcttgaggaacggatgcatataatttgggacaggcacgaggagactggcaaaatttctgtaaccgactatgtcagagtgacaagcacagaatgtgccaagatcttcaacatattccctcggaaaggagcaatcctggaaggatctgacgcagatatcataatcctgaatcctgaaaggagctttgtgatgggtgctcacactcaccattcgaggtccaacactaatgtgtacgagggcaggaaaggaaagggaatggtggaaatcacaatctcaaggggccgagtggtatgggaggatggtgttctgaacattacacctggttcaggaagatacgtcatgatgccacctttcggctacgtctttgatgggattcagaggtccgacgccgcctacagagcttccctccgagcccctgtacagcgtggtaaagctagtgcatagcttatagctatgacagctgttgatgccattgacctggcagtagcccccatctgattcaagaacgagttgctccaaggtgaacaccgtttgttccatgtgtattgtctatacagaacactttatttaagatcagattcaggataggtaaaggccttagcttgcctatgtacatcaaacacatctgtgacttagaaaaattcctagttttggtccatttgtgcaactagcaatttgctatttcaataaatcatattttcacattt

SEQ ID NO: 11782 - DNA, 744 bp, Sorghum bicolor
  Clone ID: SORBI-28MAY03-CLUS22874_1
tcaggggaggtatgcagatctttgtcaagactctgactggcaagaccatcacacttgaagtcgagtcttctgacacgatcgacaacgtgaaggcaaagattcaagacaaggagggcatcccaccagaccagcagcgcctcatctttgctggaaagcaactagaagatggccgcactctggccgactacaatatccagaaggagtccaccctccacttggtgctccgcctccgtggtggcatgcaaatctttgtgaaaaccctgactgggaagaccatcacgctggaggtcgagtcgtctgacaccattgacaatgtgaaggcgaagatccaggacaaggagggcatcccaccagaccagcagcgcctgatctttgctggtaagcagctggaggatggccgcacgcttgcagactacaatatccagaaggagtccacgctccacctggtgctgcgcctccgtggtggtcagtgaagtgaagttgttcgccctggtggttcactgggtggtgtgctctttttagttgtcctgggtgtgtttccataccgtgtgtttctactgtgatgtcgagtcctgcaaacttgagctgtggtgcagcagcaggttaacttggtttgccttagctatttctctttgattgcctgctatgaaatttaccttgtgttatctgtgcatctattggatacgtaacactcaaaactattgggtggccatctggccggatatatgtgatttaacatatggg

SEQ ID NO: 11783 - DNA, 1665 bp, Sorghum bicolor
  unsure (1)..(1665): unsure at all n locations
  Clone ID: SORBI-28MAY03-CLUS2305_1
gcacgaggttgacatccaatatgttaagcagcacattgccatctaatattggcgctccacgcccaaatctccgaacactatggctgtccaaaaatatgttcgaaggtaccataccagcttccctgggaaatgcttcagatctagaagacattgatctatcggaaaatcatttcacaggccaaatcccaagctctttaggaaacctttctggactgtatgatctaatccttgaggacaacatgcttgaagcaaaagagaacgaaggctgggaattcttccatgccctagcaaattgtagaattctaaaggtcctctcattatctctgaatcaacttcagggagtcatacctaattcgattgctaacctgtctaccagtcttacaaatctaataatgggtgggaactacctatcaggaacagtcccgtcaagtattggaaaatttaataaattaataaaactctcactggatggcaacaatcttacaggtacaattgacgaatgggtcaggaacctgacgagtcttcaacatttaaatcttgaagtgaacaacttaattgggacatttccaccttccattagcagtcttactaacttgacatatctgtctttggcaaacaacaaattcactggttttttgccaccttcgctgggaaaccttcaaagaatgaccaactttaaccttagccataataaattccagggtggcatacctgttgcatttggtaacctccaacaactagtcataatagatctttcatggaacaatattagtggggaaattcctgctacactgggccaatgcccgcggcttaccatcattgaaatggggcaaaatttgcttgtaggaatcatcccaaccaccttcgataaactatacagcttaagcatgctcaatctttcccataacaaattatcaggccccttgccagattatctaaatgatctaaagcttcttagtaaacttgacctatcttacaacaatttccaaggagaaataccaagaactggcatattcgataatgctacagtcgttttacttgatggcaatccgggattgtgtggaggatccatggatttgcataaaccttcatgccataatgtttctagaagaacaagaatagtaaactatttggtgaaaatattgataccgatatttgggttcatgtccctcctattgttggtttactttttactccttcacaagaaaacttcaagtcgagaacaactatcacagcttccttttgttgagcattttgagaaagttacttacaatgacctagcccaagcaacaagggatttctcagaatctaacctgattggaagaggaagctatggttcggtgtacagtgggaaattgaaggaaaacaagatggaagtggctgtaaaggttttcgaccttgacatgcgaggtgcagagagaagcttcttggcagagtgtgaagcactgagaagtattcagcatcgaaatcttcttccgatattaactgcctgctcaactgtagatagcgcaggcaatgttttcaaggctttagtttatgagctcatgcctaatggcaatttggatacatggattcatcatagaggggacgagggagctccaagcaactgancttgattnaaaggtaggcatagctgtcaacataaattgtgcattggattattta

SEQ ID NO: 11784 - DNA, 1257 bp, Sorghum bicolor
  Clone ID: SORBI-28MAY03-CLUS2317_1
gccggccgggccgggaagagagatcccgcgctcaccaccgcttctcggccgcggccctccctcggcccctcccttcctccttccctccggtggccgccggggacggggagcgaagaagactcccttcctccttccctccgttggccgacggggacggggagcgaagaagactcccttcctccttctctccggtgatagccggggacggggagcgaagaagactcccttcctccttccctccggtggtagccggggacggggagcgaagaagcctcccttcctccttccctccggtggtcgccggggacggggagcgaagatgttctatggggccatggtgtgggacccgtggctgatcgtgtcgcagatcgtgtgcctgcagtgcctctactacctgtcgctgggcgtcgccatggcgctcctcgtcggcacccgcgtcccgcgactcaccctcctctacctcttcgacttcgccacgctcaccccgcgcacccccacgggttggtgcgccatcgcatcattcctcctcgccgccgtcgcaggagctgggttcatgctttatgtgattgagagagccaagaagtgcctggactttgcagcaacactctacataatccatctcttcatttgcattgtgtatggtggatggccagcttcaattacatggtgggttgttaacatcactggtttggcaatcatggctctcttgggtgaatacctatgcattcggcgggagttgaaagaaattccaatatcacgtcttcgtgcaagtgtttaatctcacatgctaaaagagtataggtgatttcaaatggtgttatcccaggaggtgcttgttaatatgtttcttaaggaatacaatgactcgcaatgaaggctttgttctgttatttccaatggatacttctcaaactttgcatagagcgttcatctgatgcccaatctcccagtagaccatgataaactgattgatctcagagttccgaccaacggaaatggcagctcagtctcaaaatcatacattcaagtcctcccttgccccttatgaaaaagagttccaggccttcctcttatgaaaaaaaaaagttccccttgcctatgttctagctacagtttgctgcttgacaatgtatgtctagatatcaacatgtgcattctttagtagtatgttcttcttaatacatgcaagcacccatggactcttgtctagatgtatcttgcaaataatatatctagtgctatatgctaattcatgct

SEQ ID NO: 11785 - DNA, 862 bp, Sorghum bicolor
  Clone ID: SORBI-28MAY03-CLUS23186_1
cggcggccagcggctgcatggtgaccttcgacgcgaacgagctcggcagcctggtttacctgcacgccgcgctgagcgagtgcttgaggctgtacccgtccgtgcctttcgagcacaaggtcgcggcggccgccgacgttctgccgagcgggcaggagttgaaggcaggagacaaggtactggtgttcaactactccatgggcaggatgaagggcgtatggggcaaggactgcatggagttccggccggagagatggctcaacgaggaagggaccaagcttcggtacgagccgtcctacaagttcatctccttcaacgccgggccacggacgtgcctcggcaaggagatggcgttcgtgcagatgaagaccgtggcggcggccgtgctgtggaacttcgccgtcgaggtggtgcccggccacgtcgtggagccgaagctgtccatcatacttcacatgaagaatgggcttgccgtcaaggttaggagaagggatgggacggcggctccgtcgtcgtgcgtcacggcttgcatctgagttctgactgacatcagtgcgtctcgctcgcctacgttacgtggtttcttagtcgatttgttatatccggctggaatctaccaacacgttgtgtgacacgtctcaatatgcatgtgcccgtacgtggcatatatggtgtcttcttgcacactagctagcggaacaattaatgggtcttccatgcatgtgcaccagcatagtgcatactagtatactataggtatagtttttcattcatatgtggcgtgtgattgtacgtacgttttctacttctccggcagttcccattaaagctagcatgctactttctcgtccgtttgttccct

SEQ ID NO: 11786 - DNA, 897 bp, Sorghum bicolor
  Clone ID: SORBI-28MAY03-CLUS23315_1
cagcactaaagcaccggatcccatcagaactccgaagttaagcgtcccgttgtccgctgcctactaggactactgaactgcccccctccacccccctcttctcctcctcccactacactgtcctcagctcctgccgccccactccaccttcggaacatcttgggagtatcccactcccaccgcgcatggtcaccccatagccccctcaaagctccccccaagaaaccaccccaccgacgcgccggcagcaatggcggtgggcagcggcctggccctgtaccacgtcctcggcgtggccacctgcgtggcgctgctctacttcaccttcggcgaggtggacctccgccacacttccctcccttccatgcccgcctccgcctccgtccccggctcgtggtcctcctcctcccgcgcggcggccgccgtggcggcgcccttcgtggagcggcgcggcgcgcagctgttcctggacgggcggccgttctacgccaacgggtggaactcctactggctcatggaccaggccgtggagccgaggtcccgagtttgcgtctcccgcatgttccgcaccggcggagggataagcacaggaatatttctccgatgaactgtgaacgaccggattttactccctctccacctccccttttcacttgtaacttcacgcggcaaaattattcgagagcaatctctgttctggtctgcgtgtcacgatggtcacgtgctttgttggaaacgaaggaatgtaacagcagtgaaataagaatttagagagagagagtttaaggaagactcttagagacaggcagagagcatctccaacagtttggtaaaacatatgacaagtgagattttcttctgtctccaacaatttgccaattgggcttgataaattta

SEQ ID NO: 11787 - DNA, 1176 bp, Sorghum bicolor
  Clone ID: SORBI-28MAY03-CLUS241_1
ctccgaggccggcccgtcgcgcttgcccgtcccgactccacccctccaccaaccccccctgtccgctttcaccggcgcgcccccctcccagcccgcgacttcgccacgctcgcacccccccacgaccccgcgcgccctgcgcctacggcgcgcggcgacctccctccccctccccccccggcagcccccgccccggccgcgcgccccccccccggcgggggcacgcgccccgccccgcgcatgagcgctgattcgaggaccccacgcgtcactgcccgctggcttgcagtcgctagcagcgcaaggttaagcacgaaagctgctgctggaaatttgagttttgacatgcagtgcaaacattgcgaaaaggagtcaataaatagctctctgttgaacttgttaacatacccatggatagagaagagggtgaatgaaggtactttgaatcttcatggaggctactacaactttattgattgcacatttgagaaatggacattattgtaccgtgaaggtttggaaggtggaagcaagtatgctataaagaataggtccacctggtcttgaccaatgaaggccttgtttacttgggtaaatttcactctgtcccctgcagttcagcatggttttgctttgccactgcgatgttcatttccattgcaccttgctccattgtggtattgatgttctgcagaagcgagtccctgtatcaaataactgttgcaaggttgttggcatcgtccattgccacacatgatactatgccactagcagtcgtcagcttcaactgtgtgttgtcgtattgcatacacgggtagtaggtgcatcagcattatagcagttatttgatacaggaactctccactgtagaagtacaaacccacaatggagtgaggtgcaacgcaatgaacaatatggtagcagagtgaaagtctgtggaattgccgggggcaaagtgaaatttatccgactatttatttgtgtgttgttttccggttgaaaccgttgagaaaatacgaataagctgcaggatcagtcatagtgcatgtaattgtcgccacatttggcgttaccttgttattgtaacatgtgtaccatttgttgtatcattataactgtgaaatacaaatattatacggcctcgtcaaatttgcttgatgacagtgttgttcgttc

SEQ ID NO: 11788 - DNA, 622 bp, Sorghum bicolor
  Clone ID: SORBI-28MAY03-CLUS19235_1
gccggccggcgccgacgagcaaggagaggaaagaatgctgaagcagacagcagtagtagcaagtcaaaggaggccgaagaggcgaacgaaagagaagaggaagatggtggcgccgatggatccgatgctgtggcacaaggtggctgccgtctccgggatcgctgctttggggctcggcacctacggcgcgcacatgttccgccccaagaaccccgcgtacaaagaggtttggcacaccgcgtccctgtaccatctcgtccacaccgccgcgctgctcggggcgcccatcaccaagcgccccaacgtcttcggagggctcctaactgctggaatcgtgctcttttctggaacgtgctacaccgtggcttatcttgaagacaggaagctttcttcaccggcaccattgggtggctttgccttcatagctgcttgggccagcctcctcttctgattaaattgtgcttttccaagaaaacaaataaaaatcataaacctctgtatttggtgctttatttggttatatgaaaattgtacttgtacactgtacagaatgcacctgtggttaataattcaatctgtgatcttgtgtttctaccaaaaaaaaaaaaaaaaaaggccccta

SEQ ID NO: 11789 - DNA, 694 bp, Sorghum bicolor
  Clone ID: SORBI-28MAY03-CLUS19489_1
gcgcacgaggccacgacttgtcgctcccgggagccgagggaaggaagcagcggcgcatgcggacgagccgagcgaggcggaggagaggagatggcgcgcggcgtggcggctggggcgaagggcggcgccgccggcggcgacaagaagaagggctccgtcaccttcacgatcgactgcaccaagcccgtggaggacgagatcatggagatcgccacgctcgagaagttcctgcaggagcgcatcaaggtcgccggcggcaaggctggcaaccttggcgagggcgtcaccgtcacccgcgacaagaccaaggtcaccgtcacctccgatgggcctttctccaagaggtacctgaagtacttgacaaagaagtacctgaagaagcacaatgtgcgtgactggctccgggttatcgcgtcaaacaaggaccgcagcgtctatgagctccggtacttcaatattgctgagaacgagggtgaggaggaggattagacgcaccaccttatctgtgtcttgtgaactttggatgtgttggaacactcatgcttgtagcctttgaagggatgagttttgatgtttaaaattagaaatatgaaatttttctaagcgtgctggaacttctcatgtgatgcttagataatcgagtcgaagaattgttgttcttgctgttgggtggttgggcagcttcatgatttta

SEQ ID NO: 11790 - DNA, 843 bp, Sorghum bicolor
  Clone ID: SORBI-28MAY03-CLUS19590_1
acccaaagttgagttgaaaaagattcccccaacacgtgctaggtcaccaaagctcggccggcacaagccagccagttctgctactgctgcttctgcagatggttcatgtgaggccccacggagcactgcaaattcgggcaaggtaaatgaagttatggagaacaataaacctcgtgtccctgctagaaaacctgttcagaggccagtcacaaaagctccatcacaagtgtctgccaccacaaaggctgaagcaagacctgcagttacaaaggcgaaaatctcgaactcgaaacctaaggtttcaagggcaaaggttgcgcaagcgcaagataccccagtcgaagtcccgccttcagtaccttctgccccagaagagctcgtagttgaacatggcgttggagaagctacaggtcttgatctggctccacaattggttgcttcgaatgaagtcccagtccatggttgataaattgcgcattttgcctattttatttcctttttgcagtcctgtgaatagtgagggtgtgtgcttcattgaaagttgaatcgttcaaagtgtcatggtttatcgtttccggagtagacatccattttttcagcttgtcattgagcatgccatgtatattgcttcatattgtcttcatgtttaaaattcccagactttgtgtatattggatttgtatgtcgctggacatcctaggattgttgcaatacattaaggcaacttgtggattaaaaaaaaaaaaaaaaaaaaaaaaaaaaaaaaaaaaaaaaaaaaaaaaaaaaaaaaaaaaaaaaaaaaaaaaaaaaaaaaaccaaaaaaaaaaaaaaaaagggccccta

SEQ ID NO: 11791 - DNA, 902 bp, Sorghum bicolor
  Clone ID: SORBI-28MAY03-CLUS19883_1
aacgcccgcgcgtctccgtaattgttccgcaactaccccgatcccccatccccaaaccctccgtcgacccggctcctcctctctctgcaccggtgatcggcggtgagcgatggggtgggcgacgcggttcgtggcggcggtgtgcttctttgccgcgggcgtccttttcgtccccgaggctctcctcggctccccctccggcgcaggcgccgtcaccgccgccaagctggcccacgtcctcgccttcgccacctcctggggcgccgccctctgggccaccttcatcggcggcatcatcatgttcaagaacctgccgaggcacatgttcggcaacttgcagagcaagatgttcccggcctacttcacgcttatctctgcctgcgcagccatctccgtcgccgccttcgcgtacctccacccgtggaagacagcgtccaccgtggagcgctaccagcttggattcctcctctcggcgctcggctgcaatctctccaacctgctagtcttcacccccatgaccatcgagatgatgaagaagaggcacaagattgagcgggacctgagcatcggcgaggaagtcggatggtcaaagaatcagcaggtggctaaatccaaccccacccttgctgcaatgaacaagaagtttgggatgatccacgggctgtcatcactggccaacatcatgtcgtttggcagcttggccatgcactcatggtacctggccagcaagctagaactgtgaaggggagccaagacgacacctttctccgccttcttgttgtgaatcttatcacgatggtggtattggtgcacgtcatgttatgagatctctagactaaattgtacgattgcgctattggcttcaaaggataataaattgtagttaaaaaaaaaaaaaaaaa

SEQ ID NO: 11792 - DNA, 1588 bp, Sorghum bicolor
  Clone ID: SORBI-28MAY03-CLUS24739_1
agcaagtggactctccactcttcttctgcggtgcacgaggccgggctccggcgagccgctgacgagggtttgtgcagcgagcgagctcgtggcgggaggagatggacgaagccagcacctccgcgtccggcgccgcgacgaggcgcgccttcccgccggcaagatcgggagttttctataggttcacccagcagaatctcccagcttggaagccagcaatgacacctggatgtttaatagccatgttcttgattattggaatcattttcgtaccttttgggcttctttgtctccaaagttcaaatcatgttgcagaaatcattcaccgctatgatgttgactgtgtacctaatgcttacagaggaaataggcaagcttatattaaggacagctcgattttaaagaactgtactctgcaagcgaaggttctggaacacatgagagcaccaatttatgtttattatgaactcgagaatttctatcagaatcatcgcaggtatatcaaaagtagaagtgataaacagctgcggtttggggcgaaatacacggctgagtcgtgcagtcctgttcagtgggataataatggttccccaattgtcccctgcggcttgattgcctggagcttattcaatgatacctatgattttactcgtgggtccaaggaaataaaggtcaacaggaaaaaacatttcatggaagagtgatcgggagcataagtttggcacagatgtgtttccttccaactttcagaatggaaccttgattggagggggaaaactcgaccctactgtcccactgagtgagcaggaagatcttattgtgtggatgcggacttctgctcttcccaagtttcgaaagctgtatggtgtaattgaagacgatctacatgccgatgagaccataaccattctcataggaaataattacaacacctacacttttggtggaaagaaaagcatagttctttcgactgcatcctggctaggtggcaagaataacttccttggacatgcttatattgtcactggttcattgagcatcttcatatcaatcctctttgctctgattcatgtgaagtacccaaggccccaaggtgaccctaattgcctatcctggaacaggaaaaacagcaatagctaaggagcctgtatctgttattaccagcccagctaacatgcattagatcccttgtaagacatctctatctgaaacaagtcagacgccatgccgccgggttaatcccagatgaaaagaaaactgtgtactacatcatgcccttgagaaatagtttgaattccgacacatctgctgtgcatcaaggttaacacctggaggtttttaccatgcttcgtttataagagtgagcacagtaatttgaaaatgcaattctggtgggtacccggtgcggatctgtccggtgaaattctggtggccgccgaggaccatgcccctcccaaggcgaaagcaaagttgtaaaaaagcttcagctgtgaaaaatgagaagtggttattctggcttggctgctgcttttgtgacttgtgagagatgcaatgcttgtcagccctgaactcaaaagttcgttttcta

SEQ ID NO: 11793 - DNA, 880 bp, Sorghum bicolor
  Clone ID: SORBI-28MAY03-CLUS24743_1
ccccgtcggtcgtccccgtctcgctcccccccccccccgcccacctcccccccccccccctgaagtcccgaagctcgcggaagcgccgagatgtaccaccccacgacaggcggcgtccgcggcggcagagatcaattcaaatgggacgatgtgaagggtgacaagcatcgagagaattaccttggtcgctctgcgtgggctccgcgtggcgggtgcctggaaccttgggccccctgctgggatacccgggataagaaatctgacacggaagatgctctgaaggaagaaataaggagagtgaaggaagaggaggaacaggctatgcgtgaggctcttggcttagctcctaagcgcagcaatcgacctaagggcaatcgcttggataagcacgaatatgcagagctgattaagagaggatcaactgcagaggacttgggagcagggcatgctgaagcagcacaagtgcagggtctaggattgtacaaggctcatcgtgatgagggcgaatcgagttctttgaaccttgatcctcctgaaatggagcctgagcaggctgaccccccaccagcacccaagcaggaggattcggaggatgataaaaaggggaaaaggcggcgtgaacgtgatgagaggagaggggagaaggagcgaaaacgagataagcatggtgatggaaaggagaggaggcgagacaagcacgagaggaggcacgacttggaggacaggtcaaagcggcaccgcaaagacaagcagaagaggaggcatgattctgattctgattgataatggccctgcgcctgtatgactatcgtgtactgggatatttcacacccatggatctgtttttgtttgatgtagtgtaaactgtaaagccaatgga

SEQ ID NO: 11794 - DNA, 1041 bp, Sorghum bicolor
  Clone ID: SORBI-28MAY03-CLUS25039_1
gtcggcgccacgaggcctgggggcgttcgtggtaatcaagctgagagtatgtggttacatacacatttgattcaggatatgctttcaatttgtcgtgaaactttcaagggttctgtacgctatgcatggactagtgtcccaacttacccgagtggggtgattgggtttttactatgtgccaaagaaggtccatcggtcaactttctgactcctataaatccaattgaaaaggtggaaggagctacaaaagctggaagggagatcagattttataattcggagatgcatagggctgtttttgagaccatcgctagagctttgaggcctggtggtgttctttgtaatcaagctgagagtatgtggttgcatacacatttgattcaggacatgctttcaatttgccgtgagactttcaagggttctgtccgctatgcatggactagtgtcccaacatacccaagtggggtgattgggtttctgctatgtgccaaagaaggaccaccggtcaactttctgactcctataaatccaattgaaaaagtggaaggagctactaaagcaggaagggagatcagattttataactcagagatgcatagggcagcgtttgttcttccgacctttgcgaagagagagctagaagcatattgtgcttctacgtaaacagagcaggcagaggaggaaatagcgacaccaccaccaaagctaactgtggctccagagagtggaattctcagtgcatcctagcttagaccggcgtgactcagaaccgagacacgtctagaaaccgtcccttcacggcattccctagtatcgccaattggatacgctcttgctctatcacgtattgtaagcatggacatatggagtgtgtgtggggtgcattggaatttgacgcgtaatgaggcgctcatgtgttaataataatctatgctcctgtgttatggcaccaacaatgagatgacaaatggcatggtaaggaaaagacgaacagtgtgatgagtctgacgtgatgagcaaattccacattgcactttaccc

SEQ ID NO: 11795 - DNA, 663 bp, Sorghum bicolor
  Clone ID: SORBI-28MAY03-CLUS25107_1
gtcttcgtctccccttccccctcagcccaagctccgttccccaacctcagacggaatcgttccaacgctaacctagggttccggtctgttctgttccgtccggatccgggctcatcgatggggagggagggcgtggtggcggggccggcggcggagggtagcaaatcgcggccggagtgcatcaactcgtccaacccgtaccacgagtgctccgactactgcctccgcaaaatcgccgaggccaggcagcgcctcgacgacgagctccccgactcgtggaaccgcccgccagagcaacgcaccgtccacccggactgcatcaacgcctccaacccctaccacgagtgctccgactactgcttcaggcgcatcgccgacgccaaatccgggctcgagcgtggggagggacagccaccagctgatgtggccaccgctgctggcacgtccgatgctgcggagcagcagcgacctgaagataatgacgccgacaaacaggagggcgcaggcgcggatgatggttatctgcagatgaccgaaaagcagaagaagctgttcgagctgcggcttaagatgaacgaagcgcggaaagcgaatcagcaggcaatggttgccgagaagaaaaggatggagcctcgcggtgagagccgaggtgtttctaagcag

SEQ ID NO: 11796 - DNA, 711 bp, Sorghum bicolor
  Clone ID: SORBI-28MAY03-CLUS25270_1
aaggcgtggtcgtggagggtgagacgtcgccggtgaagagcgacgtggtgatcttcggcaccggcttcaagggcgacgacaaaatcaagaacatgttcacttcagagtattttcgaaacattgcagttgggtcagaatccactactgtgcctctctacagggagtgcatacatcctaagatccctcagctggccgtgatcggatattccgagagcattgcgaacatgtacacctcggacattcgcgccaagtggttggcgcgcttcttggacggcggcttcagactaccaaacgtcgcggcgatgcagaaggatgtcttggaatgggagaagtacatgaagagatactctggaagatactttcgccggtccagcattctaatcctgcacacttggtacaacgaccagctctgccgtgacatggggtgcaacccgaggaggaagaaagggttcttttctgaactgtttgaggtctatggccctggcgattatgccaacctactctccaactcaaagtccaaggagcagtagagaccttgtgcttagattcctttggcgtgtataaagatcagttcatgctctcagatattcttgttattcaacgagaatatataatgtgtgtacgtactgtcgtgatgaccatctttgcacttatctaaatgatgtaaagctttcatgatatataataaagtttcgtgtatgttactccctc

SEQ ID NO: 11797 - DNA, 762 bp, Sorghum bicolor
  Clone ID: SORBI-28MAY03-CLUS25262_1
aagcgcgccaagggcgaggtgaacgtggagtacatgcggtcggtggccgacctgatggtgctgcgcggccggccgcacttcacggcggtgcgcgcgtacctggcgtccgacgtgaccaaggccgggttcggcgacctcgacttcggctggggaaagccggtgtacggaggccccgccaagggcggcgtgggcgccatccccggggtggccagcttcttcatcccgttcaagaacgccaagggagaggacggcatcgtcgtgcctatgtgcctgcccggcctcgccatggagacgttcgtgcaggagatgggcaagctgctgagcccacccgcaggcgcaggcgcaggcgcagagcagaagcagcaggacacgttccccgtcatcaggtccgcgctctgaggtgaggaggagtgcgagtgagctgatagctcaggcagcaggcacggcatcgatcaaaccacctcgttttcgcttcgtgctatggcaaatacacgtaatcggcggatccagagctttcgtgatgcgtatgcgtagtgggtgaaccaagttgatgtgtgcgtggagttacgttgttaatgtatatgtactgtacccctacgctccccgccggctgaaatgcgcgcgtttgtgcagggcgctactgaggccggcggctatgggttgttgtgtatgtagcctgtagatttgtatacgtatattttggtaccttttcatccagtaattcatatccttcttcctttcttttattaaaaaaaaaaaaaa

SEQ ID NO: 11798 - DNA, 738 bp, Sorghum bicolor
  Clone ID: SORBI-28MAY03-CLUS25326_1
tatggagctactagtcattctctgcctggaactgttggtattgtccagccaatgtcacctctggcacctgggttggcttcactacctggtggtatttctgctgccccaggtgtggatcctgctctggggcaggcattgacagctttgcttgccacccagcagggggctgggctgaatttgactagcattctgggggtcggtgctaatggatcagggttgcctccgcagggggcaactggagcattgggtggtagcggtgtgccggggatgcaaggtggttatatgggtggctatggtggttccggtggatatgggggtgctgcttcaggaggcccaggaagaaattacatgggtcattaggatggttataactattttactgtggccagatgattctacatgttcctgattggcacttataaacttgctgttttaagctgtttctggctactcaattatgcctgtggtcaaagttttcataggaactttagttccctccacctatcatttcaaaacgaaacagtgctttgtacaactatttcgattttcaaaaggacatcttatggctgcaagactattgtaaaagacttcatgtggatttaaagcactgcagtatttaagatattactctctttgtaaggttttcaaaaaggccaaattaaggcttgcaaaactattgtaaaagacttcctgtcggtttaaagcactgagtatttaatgacaatggtttcttgattt

SEQ ID NO: 11799 - DNA, 811 bp, Sorghum bicolor
  unsure (1)..(811): unsure at all n locations
  Clone ID: SORBI-28MAY03-CLUS2093_1
cgtccgcacaccaggctcatcacccccatctgcccacactatgctgagcacgtgtggcagaagatcgtgaagaaaggaggcatagtaataaaatctggctgtccggacgcagacaccccccagatccgactctgaaaattgcaaatgaatacttgcagaattccattgagtttcaatgaggaagctgcttcaggagcgagagtctggttccaagaagcctaagaaaggagctgcaccagacctccatccgaggaaaagaagatgagcattggccttatatatgtggacagagcaccactctggctggaaagagcagtccttgagggtgctgcagtccaagtttgacagccaaagttgctatttcgcacctgataagaaaatagcacaagctctgaaggggtgtcctatcgggcaggaaatgaactagaagcaagttcagcagctgtgcatgcccttcatcaagatgaagaaggataaggctagggatgttggtactcaggcactatacttgaagcttccattcagtgagatggaagttttccgggagaacttggagccgatcaagaggcagctggagcatgagcacctttacttgttcacagcaccgcacatttaagagtccaatgttaaagattgagcttttacagtagcattttgttttggtgaaaccagcttcgtgtctgtcaacagagtatgctgtccttcggttttgtgaaaccagcttcgtttttctgtcaacagcgaatgttatcttcttggtttggggaacgcacatntaagagttgtaggttaaatattgagaacagagtat

SEQ ID NO: 11800 - DNA, 894 bp, Sorghum bicolor
  Clone ID: SORBI-28MAY03-CLUS2170_1
cgtccgcggacgcacgagtggaactgcaaaatttagggttttgtttgcctcacccacgccgtcggctcctccccctccccacctccacctctccccgcgaaggatcggcggcggcggcgagcgccttcccttgtcgaagtccacccggcggcagagcagagcctcgttgctgaggagggggagatggcgggcatgggagatatgccgatgaggccggcgcgtccgggcccgccgatgcagcaccgcgggccgccgccgatggcgcgcctccgccccgaaccaatcgaccgtgagaagacctgtcctctgctgctcagggttttcacaagggttgctggtcaccatcaaaatgaagagtttgctgtgagagggaaggaaccaaaggatgaagttcagatttacacatggaaggatgccactctccgcgagctcactgatcttgtgaaagaggttgctcttccagcaaggaaaaggaatgcgaggctttcttttgcatttgtatacccagacaagaatggtcgttttgttgtcagacaggtgggttcgaccttcgcatatggtcatggaagaggtgatgatgccaaaactcttgcagagctcgggttccagattggtgattacttgagcgttgcaatcatgtagacggtgcccacaatgaattcagcgactgtaccagatgtaactgctgtgatgtcaaaaggctttagttgcaacaatcaagggttgaatttctgttagcactaggaagtggaaccaaaattgtctgtaatactggtagtatcaaattaattacctagacacttcgaacgagcaactgagcaaggcttctggtatggttgcttttgcttgtataatatggcacttttctgtgcctctgtggtgcctgaagtttcc

SEQ ID NO: 11801 - DNA, 1912 bp, Sorghum bicolor
  unsure (1)..(1912): unsure at all n locations
  Clone ID: SORBI-28MAY03-CLUS2246_1
aaagatattataaggaatgtacacacaaggaggggccttcttatgctagttcctgaggctgttgagattcttggtggtgtagttgacgaattggaagaagcacgtgaaagacttgtttctgaagtaaacaaaccacctcgtggcaaaagtaaacagggcggattacctttatcttcaagagccacgcgagctgcctggccatctagtaccaatattacaaatggtggtgagcaagggatctcaatgcaaagatcagttaattcctcttatccaacaggatcaggtaatgctttccaggttggtggagctacagaaacagtggttgaagagcttgttagccctcctgtaggaaacactgtccgagaaatcaacatgcagggcctatatgcttctcttaccagggaaactactgaaacttctatgcatactacccatagccctcctgtagtaaacactgtccaaggaatcaacatgcagggcctacatgcttctcttaccaggaaaactactgaaacttctatgcatactacccgcaccccgcctgtagtaaccactgtccaaggaatcaacatgcagggcctacatgcttctcttaccagggaaactactgaaacttctatgcatactacccataactatgaccccactcatatcattgaaagaagtacagggaccatcatggaagaatgtgtcgatcctcctattatagcaaacaatgtccatgaacaaatgcagcgagtccaatcagctaacgttgtggagggtgtacagtctccaaatgttggcaagatcaatgagatggaacagtctttcattctaagtggtgaaaatgaagaaccatttacgtacatatacagcatgcttattaactggggtagacaacaggacacaaaagcctacataaaaggaaaaatcaagggtctgatcacttctgtcaaaagttttcaatataaacaatgcaccaaatatgagctttatgtatatatagatgatgggagtttcatttcagaggccttcattgacagtgatattgtgaataacatgcttggtctttctcctggagaggttactgctgctctttctggtcaatttgagtttgcatcacccagtgaagtgaaagaaactttgaaacggtttcagaggtttttggtgaaattcgagggaatgatgattattgagttaaacaaaaactcttctattcctgtcgtacgtgagctgaacgaaggttgctcaagttctactgcatggcttctgctccgaaggctgaaaacagtttcttctcaaaagcgcgtgcaaactctggatattatggacaccactccatgattatttccatcctctattctcaacggatacacagatcgcaatggttttgttgagccaggtcattggccagtatgcatttgagctgggtgtgtgttcagtatcgaggtctggttcaggttgctgtcgccgtgcgggcggtgttcttggtgccgaatgatgaaaacacattggtcgattagtggttgtcgtccagagggcaactgcactctgatgtgaggaaatgaatgcatgttctggtgatgcatgtggcttggacattgtggaacgaacgcaatcaacgtgtcttccagcgccgccgcccagcgggctctcaagctggcctctggtgtgggacaccacgccatttccgaaggggcttcctggatggaagcaggctacagcctacagtccgttgccgttttgcttgctgcggtttgaatactgacccttattgtcgcaaactagatttctgtaaaggaaccaaaacgcctgtctctgcgtgttagtaaagctcaatgttgcgtgtcctcatgcctttactatagacattattatttgaaagactctgtcctataatgctatatatggcgtntcttacaatagaaaa

SEQ ID NO: 11802 - DNA, 1150 bp, Sorghum bicolor
  Clone ID: SORBI-28MAY03-CLUS2277_1
gcacgaggccaggcgttgtgcccgcgtgcgcacccctcccctcatggcggcttcggcggcgcggcccctcgcgctcctcgcgtccgcctcggcatcgctcggcgtcgggcggcgggcgtgggctcgcttgcctgtctcttcctcttcgttgaggtcggcgccctccagcctccgcgggcgccgctcgttcgccgcctccgcagggggcgccgtgatggggaagccaggccccggcgccgttgacgccgacgccgggatggacgccgtccagcggcggctcatgtttgaggacgagtgcattttggtggatgaacaagacaatgtcatcggccacgagtccaagtataactgccatctcatggagaagatagaggctggaaatgccctgcacagagctttcagtgttttccttttcaactccaaatatgagttgctactacagcaaaggtcggcaacaaaagtgacatttccactcgtctggacaaacacctgctgtagccatcctctctaccgcgagtctgagttgattgaggaaaattatgcaggggtgagaaatgcagcccagcgcaaactatttgatgaactgggaatagtggctgatgaattacctgttgaccagttcattccgctcgggaggattctttacaaggctccttcagatggaaaatggggcgaacatgagttggattacctcttgttcatggttcgtgacgtgaagctcaacccgaatcctgaagaggtggccgacgtcaagtacatgaaccgtgatcagctgaaggagctgctaaggaaagctgatgccggggaagatggcgttaagctgtccccttggttcaggctggtggtggacaacttcctcatgggctggtgggatcatgtcgagcaagggactctgcagggggcagcggacatgaaaaccatccataaattgtaagcctgtagtcttgtagatcgcataaattgtaagcctgtagtcttgtagatcgctaagatcgtgttgtgctccgttgagaaataagcgtttctgctgctgtttgcgctggctttgttatagccatcattttgatggaaatagtcgataaagttataatagagtgttcttaaatctggaacataactattatatgtaattaattatcttggattctgt

SEQ ID NO: 11803 - DNA, 1250 bp, Sorghum bicolor
  Clone ID: SORBI-28MAY03-CLUS25905_1
gctcgactaaacagaattgggggagaagttttatgttatatatggtaatggccgcacctatagtacccaaattctatctcgaacttcctattttgaaaataaaaatagaaaaataggagaaaaatatatgacagaaaaaaaaaataggagagaaaaaaaaaacccgagagaagcaaaagtaactttcgaaggtttagttacggaagccctacccaacggaatgttccgcgttcgcctagagaatgacacgatcatcctgggctatatttcaggaaagatccggtctagctctatacgaatactgatgggggatagggtcaaaattgaagtaagtcgttatgattccagcaaaggtcgtataatttatagacttccccataaggattcgaagcgtaccgaagactcgaaggatactgaagatttgaaggataccaaagattcaaaggattaggtttttctggggtaataacttccaagtttcagaatttaagtgaagagacttattttttccaaaagaatagattcatagtttaagaaaggaatacctatatatgaaaataagagcttccgttcgtaaaatttgtacaaaatgtcgactgattcgcaggcgtgggcgaattagagtcatttgttccaatccgaagcataaacaaagacaggggtaatctttcgaaaaagaagcttttctttctaataaagtaaaaaaaaagtacccacggaaatgtccaaattgcaaataaaaaaaatgaaagtaaaggatatattttaacccgaaacggatatctttgtatcttttttctttttgttatttctaactcatatttatgagataataaaatatgacaaaagctataccaaaaataggttcacgtaagaaagtgcgtattggtttgcgtaggaatgcccgttttagtttacggaagagtgcacgtagaataacaaaaggggttattcatgttcaagccagtttcaacaataccattataaccgttacagacccacaaggtcgggtcgttttctggtcctccgcaggtacttgtggattcaaaagctcaagaaaagcatcaccctatgctggtcaaagaacagcagtagatgctattcgtacagtgggtttgcaacgagcagaagttatggtaaaaggtgctggtagcggaagagatgccgcattacgagctattgctaaaagtggtgtacggttaagttgtatacgcgatgtaacacctatgccgcataatggatgtcgacct

SEQ ID NO: 11804 - DNA, 1486 bp, Sorghum bicolor
  Clone ID: SORBI-28MAY03-CLUS2597_1
agatccaacaagatgattattgatgcatataaaccagcatacagatctgatagctccatcggtacacttccaaggaataaagacaaacaaacatgaacagatattttgttatctccgacaacaaaacagattcacaaaaatacttattacagcaccatgaatggactggagaaataggatcacatcgcccctggctcctaatataccatgccatgcaatataccggcaatgcttgggtactatgtacaagagcaccaaggagagctttttcctgacttgcttttttcttcaaatctgaacagaggcttattgcatgaattgcgctccgttatagggtagcagcctctgtattatgagatgaggctgctctggatgcgcttcagactgggacaaaccaaacggagtctgccaaaatccagagcattgatctttggacaagaatgcacattaaggatctccaatgcactacagcgggatattgcagattctaattcctcctcttgcaacatggtgcatgccagaagttggagattggtcaatcttgggcaatcaagcttcagcacctccagtgagctacagttgctcaagtttaacatgaaaaggttggagcatgttaaatccacttccttcaagttggtcgaaagattaagactaattttggacagatgtagaaagtttgctatcgaaggaataacaactttcttaatattagggcacccagtacaactgagaacttcaagcaggcgaccagatcgctcactgatctcttcactcttgattggtgaagaactaggtggacaaaagtcaactggcatatccacagaactgctatcatctgacccacacaccaattcttgaaagtttgtacatccgttcaagttcacattaaccaaattagtacaacaagcaagaagatcttctatcgcattctgtccaatggatgagtaggacagatctagctcaacaagtaatggaagagcaccctctctgtagagggcatctaatgatgagtcactgaggtacttgcaagctgaaagttttaacaccctcagctgtgggcaactgtcgaatacaggcttcaagttgatcaaaaatgtataagacaggtcaagcaaggtcagcttatgaaggcaatgcaatgaagacaatccatcaatgccaatggataggcatgatgacaggataagatgttcaatcagaggacatgcctctgccatacgagtcagtgaatcatccacaagctgcctgcagaaagaggcatctaacgatgtcaagcgagggcaattgatggaagcctcagaaagcacaccacaacccttcagctccaatatagacatattcggggcctcaatgcgcagaacacttaattttggacaaattcccagatttagggattcaaggcccactgggcagaatgctgcactttgaaggtgatcacagccatcaagattcacatgttgcagatttgggcacgacagcctaagga

SEQ ID NO: 11805 - DNA, 744 bp, Sorghum bicolor
  Clone ID: SORBI-28MAY03-CLUS2602_1
acatgcacgtccgattataagttgtgagcgagcttggagaagttccatttgctcaggaaagtagccttcacttcaggttgtgacgtaagtttaggtttcagagtaatcgaatagaccagtgaaatctgccttatgtgggtcatttaatatagcacccacctgatgatattataatagactatgcatgtacgtacctatactgttgtaactctgtgcagtgttgaaactggtggtcatggggcattttagtttttaacatttatctgctccagcgaagaagaccattgtgggcgtagtttttagcctgagaagaagacctctggtgagcgggcaggcacatttgcattcctaccagtctagcagtgattgtacaggttgggttatcgcttatcagggactttctgcttgttatttttcacgagtggaaggtgcccagtatcaggtgtcaaagtatgtggggggtggtttactggtttagcgtcttgtttacttcacttaggtcaaaatgtgttcgaataatggagtactctttttaggctttggtaaagatacattcttctagttcttaagtctaaggtttcagatccagatacccactgatattgttatagtggaatcctggaacaggaaatgtacccttttacatttctacagttgatgttcttcgtaggtcactggactggtttgcacattttgggttttatttatatactgacatactgttatttattaagctactcgtag

SEQ ID NO: 11806 - DNA, 648 bp, Sorghum bicolor
  Clone ID: SORBI-28MAY03-CLUS26319_1
aaaaaaaaaaaaaccaactcagccagagcagaatccagacctcggcagagcccattcccctgtgcatctcggcctctcttctctcccttcttcctccccgcccagtcatctgaacctcttctccagccgagatggtctccctgcgatgcaccaccgcgcaccactccctgctcggctcgccgacctgcctcgtgcgcccgaggcggcgggcgtgccccgtggtgcgcgctgccgtggcagtggaggccggcgcggaggccaaggtctccctcatccggattgggacgcgtggaagtcctcttgctcttgcacaagcccatgaaactcgagaaaaactgaaagccgcacactctgagttagctgaggagggggctattgagatcgtcatcataaagaccacaggagacatgatcttggacaaacctcttgcagatattggaggcaagggtttattcaccaaggaaatagatgatgcgctcttgcagggaaggattgatatcgctgttcactctatgaaagatgttccaacatatctacctgaaggcacaatattgccctgtaacctcccacgagaagatgtcagagatgcattcatatgcttgactgcaaattcgcttgcggagcttcctgctggcagtgttgttggaa

SEQ ID NO: 11807 - DNA, 1240 bp, Sorghum bicolor
  Clone ID: SORBI-28MAY03-CLUS26358_1
ccttgctacaaggctcatacttcgccttccagcaagctcggggactacatcggtacgatgcatctggcgatgcatctcagtttcagaatttctttgaggacttttcttttgaccctggcaccacgtgcctacgtcacctactaccaggctcggggactaagtgggcacacttcaccttgcggtgattgtgcttgcttttttgatgactatacttttcagaaaagtaaagtgggcacacttcaccaggaaagaaatcttttttaattaagagcaccatgcattcttcgaacaacctgcttcttcgatgtcaatgttgatcaactgtcttttgagttggtcaaactaccgttgcaactcatggggctacggtcctgcttattgaggacgtcgggcctcgctgatcgaagaagttccagacggcgtgtcgcatcacaatacatcgtgctcggggactagctgtgggggtataaacccctatacccttacggctagacttcggccaggaggcttggcccattacgagacgagttcaaggcttgatccgacaacctggagttccacgcaaggaaacaagatgtggagatcaagcaggatcctggtcggttagaataggaattgatatcgaactatctatggcaattgtaaccgactaggattagtttccagatctgtaaccctgccctccggactatataaggaggggcaagggaccccctcagggaaactcatactcaacacaatctcatatccaatacaatcagacgctgggcgtaggtattacgccttctcggcggccgaatctggataaaatccttgtctgtgtcttgcgtcaccatcaagttcgtagcttgcgcacctgtctgccgacaatctactaccatgggtataccctaaggtagattgccgaccagctttcgtcgacagatggcttctgaatttggttcacatatgtggttttgttctagactctatagcatcgtggacactgaccaactgtaagtatttgtttttgtattctgtttagacagatgatttgttctctgaatatgctatatccttatgccactacatgtcagtgttgcattcatccaatgagaggttacaagtttctgcagtcgacttttgggaatctcatttttaaataaaatattgtgtagtaacttgtatatctactttgctccacacgaagcttaggccgagaatgctggcaggagatgcagcatgggctctggcctcgtgc

SEQ ID NO: 11808 - DNA, 679 bp, Sorghum bicolor
  Clone ID: SORBI-28MAY03-CLUS26559_1
atgaaccaatctcaaacgacaactttgggctcaactgccgtaacattgttgcttgggcccgatcgcacatcgagagcgggaacatccacgccatcgttgatgaatcattggacagaggctatgacctgcagtcggtgtggaagatcgcggaggtggccataatgtgtgtgaagcccaagggcgcgcagaggcctcccatttcagaggtgctcaaggagatccaggacgccattgccatcgagcggggaccccaggagatgcagcgctgtaccatccagcagcagctgcttgtgtccaacagcaacaggtccatgggtggtgcctcgtcatccgccaacaacaattcaggtagtgtggcagtagacttggagcagaacggagcatccttcgacgagctgctcatgcggccaggtctcagatgagatgagaaattgagaatattgcagcagcccgcagccttatttgtatgtatatgtacctacgtatatatgggactgggttaccagtcttgagtccgtttcattcatgtagcgtgagaaccaccgagtccccaagttgtatgtaggggaaactaactgccttgagaaccacccagtccctgagctgtatgtaatgcgtaagaatttattatgtttagctaactggagactaagcatacaaagttttggcagacaaatcg

SEQ ID NO: 11809 - DNA, 915 bp, Sorghum bicolor
  Clone ID: SORBI-28MAY03-CLUS24219_1
tgggttcgataggaggtagtctcggtcttctccctcttcttcctccccgtccatcacacatttgcaactgctggatctgacggcgctttcaacttctgggataaggctagccacccgacgcccaccccgtccagcacacgcccccttcccctgcctcgcacggccctctccactgctgggataaggatagcaagcagaggctaaaggctttcagtagatgcccccttcccattccttgcagtaccttcaacagtgatggttccatatttgcttatgcggtttgctatgactggagccgtggggctgaaaatcacaaccctgcagctgcaaagacatctatctatctccacagtccacaggaaaccgaggtgaaaggaaagccacgcctcacgacaggcaggaagtgattacattgcagaagatgttactaaatggctgcacaagaaatcatgatgtcactcactagttatgttgtgcccccctcctatcttgggaagtctggtagattgtaaatttcagcttacttgtaggcgccaattatagggtttctgttggaagtcttaacatgctgtagtacgtggtgtttgtggtgtcttccaaatagattgtctgtggaggctccgtgatcatctccctactgcttattttggcagtaaaatcagtgtaccaaagaatgttctaatgtaaattttcgtgcatatggtcgtatggatagatactaatggagttgtagttcacagataaatccggttctggattatgatgggcatggagcaatacatggatacccaccgagccaatcggttcaatttaataaggtagtgtttcagtttgagtgatgaaaagtttgccagtttagggaatgtttgggactgtttccctccatgtatttttaagctccgctccacgttttcc

SEQ ID NO: 11810 - DNA, 1367 bp, Sorghum bicolor
  Clone ID: SORBI-28MAY03-CLUS24257_1
atcccccccccctcctggaccatggatcatcaccattgcagcttgcagctatagcatagtaggtcgatctccaaaccgaagggagagagagagagaagagcagagtagatcgagcgaggttgatcggtcaggccaccagggaccaagggaggcaaaggggtcccggatcagtaggcggccggcgcggatcggagaaccaggcgagacgcaaagagaggaggaggaggaggaggaggacatccggttggagtactcgggagaggtagcaggacgacgatgcttggaggccgtcccctcttcgtgctcttcggctcctccatcgtgcagtacagcttcagcaacggcggatggggcgccgcgcttgccgacatctacgcccgcaaggctgacatcctgctaagaggatatatcggctggaacacaaggcgggctgttcaagtgatggacaaagtgttccctaaggattcagcagtgcagccatctttggtaatagtttactttggtggaaacgactccattgctgctcattcttccggtctcgggcctcatgtgccactagatgagtacataggaaacatgagaaagattgcagaacacctaaagagcctctctgagaagacacgagtcattttcctgagctgcccacctctgaacgaggagatgcttcgaaactcaaccagtagtactatactgagtgagatcgtccggaccaacgaaacctgccgtctgtactctgatgcttgcgtagctctgtgcaaggagatgaacctgaaggtggttgatctctggcatgccatgcagaagagggaggactggatgactgcatgcttcacggatgggctgcatctgtctgaagaagggagcaatattgtggtggaagagatcctgaaggtgttgaaagaggcagagtgggaaccatgcctgcactggaaggcgatgccgacggagtttgctgaggactcccccttcgatcttgtctcctccagcggtgacgccaccgtgaacccgtcggagtggacaatccacaggaaaataccgtgggactgacttgtttgtggccttgattggctccatggctggatgcatacatgcatgcatttgttctgccttgatggatttggaatgaatcatgatgctcaagaataacaatggaggactagagttaagggagctggtcatggccgggacagtatgatacagtcatcttatctatttgatcagacctcgctctctcgaagactgattgattattatatattgtgttttcccccattagtatgggtgtgttcggattgatggcaaggttggctaggatgcatccatgtgtttcagggatatagccattcaagttgtgtgttacgaatgaa

SEQ ID NO: 11811 - DNA, 1118 bp, Sorghum bicolor
  Clone ID: SORBI-28MAY03-CLUS24346_1
ctctcgcagcgtccgcctccccttccctcgagggtttctagggtttgagaggagggttctcgtgggtgtccggccggcggcgtgaggagatatggcggaggagagggtgaccgggaccgtgaagtggttcaacgtcgacaaggggttcggcttcatcacccccgacgacgccagcgaggacctcttcgtccaccagtcctccatcaagtgcgacggctaccgcagcctcaaggagggcgaggccgtcgagtacaccgtcggcagcggccaggacggccgcaccaaggccatggacgtcaccgcgcccggcggtggcaacctcgctggcggggaacgtcccgacggaggccacggcggcggtggtcgctacggcggcggcgggggcgaccgcggctacggtggaggcggtgaccgcggctacggcggcggcggcggctatggtggaggcggtgaccgcggctatggcggcggcggcgaccgtgtctacggtggtggaggtgaccgcggctacggccgcggcggcggaggcggctacggtggtggtggcggcggcggtcgcggctgcttcaagtgcggcgaggagggccacatggcaagggactgctcccagggcggcggcggcggcggctacggaggtggcggcggcggtggttacggaggtggcggcggtggccgcgagtgctacaactgccaccaggagggccacatctcccgcgactgccccgagaagatgcgctaggcgcggcgccaccgtcgcgtcggatccggcggagtcccatgtcgtctctcgcccgcttccctacccgctcaaggtatcgctcggctgactctgcctgaagtcgtcggagccagttatctatcagtagtagcagtgtcgtgtttcgttctcgtcgatgctatcgtatcgtaggtggtggtagcaagaaaagcaagccgtatggggctatctttagtagtttggatctgtgttggagcagtatcagtttctttctgttggaatcgtcagttgtatggcagccattttcatggatggctctgcctaatctatcagtcatgaactttctataatataccaatgcaatcgtgtcggttggccatttaaaaaaaaaaaaaaaaaa

SEQ ID NO: 11812 - DNA, 1024 bp, Sorghum bicolor
  Clone ID: SORBI-28MAY03-CLUS24730_1
gcacgcggcacggttcacaaaggttaccccccacctcgcccgcgcgcggtggttcgtgttagtccagtcacagtcacacagcagccgtttctctcttctcttctctcccccggaggggatggccggtcgccggagcagcctctccatggtcgcgtcgcaccggctgttcgcgcccgcggtgcaccctgtgggcggcgcagccgcagaccatggcgtggagctcgacgaggccgacgtcatctggggcggcggcggccagacgtcgtcctctccgtcgtcgtcgtcgtcgttcctgtcctccgcggccgacccgtacgcgcggtcgccgccggtggccgcgccgtcgtccaagcagaagccgcgtggcgcgggtggcgctccggctccggggccggcgtcggtgcccgtcaacatcccggactggtccaagatcctgggcgccgagtacgccgggagctgcgccgcggcgcgcgcggccgggtgggcggcgcacgacgaccgcgcggactttttcaccgacgactgcggcaccgggggccggcgctgggtgccaccccacgaggtggtgcagggccgggatcgcgcggcggcgtctttctccgtgcgcgagggcgtgggacgcacgctcaagggccgcgacctccgccgcgtccgcaacgccatctgggagaagaccggcttccaggactgaccgaccggtgtcagcctcagcaccgtcgccggtcgccgcccacctttgacggcaatgcctgccgcggcggcctcgttgatcccgttctcgccttgaggaggaagagaggaggagctttcgcttgattagtgtggccttaatccttctggattaattcttcgacgagttcttttttctttgttgtattttggttcttgtcgttctagtcgtgatcgctgaggaagagagtagagattagaagcctctgtttttggcatttttttcccggagaggctccgtcgatgtactaccactattattaaaattaattcctcttgattactactagtattg

SEQ ID NO: 11813 - DNA, 690 bp, Sorghum bicolor
  Clone ID: SORBI-28MAY03-CLUS26883_1
gcaatggaaataatcatgctgctcttgcaagtacttctggggtgctgacatgggaaaagcccatctattcagatttccagattttgtctagtgaaagtgaatatgctgcatggactcttgttaatggctatgcactaaatcatgccacaattgccacccatcgcctagaatcagatatcagaaatattaataagttcaacaaatttgtggaggacaatggcttcaagttaaattcagaaggagggattctgaaagtgagtcctgatggtctccttcagcaaagttcaacagtagctgattcatcattgtttacatttgctgatggaataactgaatctattcctcgatcttacattgaatttgctgaacgtctcctgctaccacagttcaaagatttgcaagatgaagaggtgaaagaataccacaggcgtgatggttttgaggtgggcaatgcggacaagatattcgaaagtacatcgagggatcagctgacaaggacatctgcataaacagtgaactctagatctattgtgcaaatgacccaatgtgcctcttggaagtgtgttggaggcatgtattgtgaaatgattgtacctacttgagtgaaataaaacatgagaatcaataaaaagtaactgttttttattctacatctgttgaatccaaagagagaatcagttacttttctgt

SEQ ID NO: 11814 - DNA, 789 bp, Sorghum bicolor
  Clone ID: SORBI-28MAY03-CLUS27155_1
actggcaacacttagaatgccatggagtgggatgaatccaatgcaagttgtgggggcagttggtttccaggatagacggcttgatattcccaaggaagttgatcctctggtagcaaggatcatatttgaatgctggcagaaggatccaaatttgcgtccgtcatttgcacagttaacgagtgccctgaagactgttcaaagactagtgaccccttctcaccaggagacccagagcccccatgttcaccaagaaatctcagtgaacttgactccttaggggggctttcacacttcccgttgtgcatagtttatattcttttgctgtttgtgtttgtccaaaagtcggcaaatgcgggcgcaccttgtagattgagcgccccaggtggtagacactctgccgccgcgacaaggaccccgcagtagggtatgtatagagtcgcccatcaaacagcaatcggaagaagtgattcaatgtgtggcaactgattgttatgccctcgtcaatcccgcttttgtacacccaactggccaacgcgagccctctggaaagcagtgagagctctttgtgttcattgtgaagtgcctggctatgtgaaagtgtttttttttttcatgctgctaaaagaagacagcatatttggaagctggaagtgttgtaacactatacaatcaggacacgtgaatttaggatacattgtacttttgtaagatgtgtttatgctcgcagagtagcatgagcatgactggcttaggtgttgtttagttacacctaaaatctaaaaacttttt

SEQ ID NO: 11815 - DNA, 772 bp, Sorghum bicolor
  Clone ID: SORBI-28MAY03-CLUS27236_1
atgagcagccacacgattggagacgcggcattgggagacaatgacgagtgcaaggacaggccattgattctccgaaacaaggccccaaggtggcatgagcagctgcagtgctggtgcctcaattttaagggcagagtgacagtcgcatctgtcaagaacttccagcttgttgccgctacgcagccctctgctggagcaccaaccctatcatcacaggctaccccagtgccaccgcctgagcatgaaaaggtgatcctgcaatttgggaaggtggccaaggatatgttcacaatggactaccgttacccactgtcagccttccaggcctttgcaatctgcttgagcagctttgacaccaagctggcctgtgaataaagccatcatggctgaaggatgatctgtttcatgaaatacggcggccccaaattttgctgggccgccattctgttgtatgttgttgatgccttcttaacttacctagaaagctgtgtctagccatttccacctgatctacagctgctgctgctgtgctctgtcctgatcgcattgttttcaatagctttgttctgtggagtagcatcttggcctgcccttaactagccggcagatttaaattgtttttccataccatggttgtattaactgataagagaatttgacattttcgcttgtgcctaagctgtttgcctgtgggatatgcaaatgtgcatcttgtaaaattctgaattgctttgttgtaagtcatagcaataaaagaattagcttccatttg

SEQ ID NO: 11816 - DNA, 654 bp, Sorghum bicolor
  Clone ID: SORBI-28MAY03-CLUS27273_1
ctgttggcctacggaaaactcccttttttcttctttattttctccatcctcttcgtctcgactccgcccacagcgtcccctcgaatccctttcgatccaatccccaaaccctagcagtccgccatcagagtgttgggtgtacccccttcgttaacccgcggccatggcccacggcggcggcggcgggagggcgaaggtgacgccgaacctggcggtggacggcgagggcacgcggacgctcaacctcaccgtgctgcagcgcctcgaccccgccgtcgaggacatcctcatcaccgcggctcacgtcacgctgtacgacttcgacaccgacgtcaaccagtggagccggaaggacgtggaggggtcgctattcgtcgtcaagaggaatgctcaacccagattccagttcattgtcatgaatcgcaggaatacagataatctagttgaagatctcttgggagattttgagtaccaactccaagctccttatataatgtaccgcaatgctgctcaagaagttataggaatttggttttacaactctcaggagtgtcaagaagttgcaaaccttttcaacaggattttgaatgctttctcgaaggtgccaccaaagccgaagattccctctgttcaaagtgaatttgaagagtcgga

SEQ ID NO: 11817 - DNA, 622 bp, Sorghum bicolor
  Clone ID: SORBI-28MAY03-CLUS27387_1
gcaccacgcgcgtccgtcctcctctccactctctcttctccctccaataattctctcctctctctctgcactctgcttgctccacctccaagcaccaccgaatcagggccagtgggagcagcagcagcagcgagtgggagcagaggagggcagagaatcccatgtctccgcccctcgctagagcagatcctcggcgagccgggcgtggagctgcttcggtagaaaagcgagccaactgagcctgcgagcgcctgatccgcccgcggcccgatcgggatcgatgggcggtgaggcgccggagccccggcggctgacccgcgcgctgagcatcggcggcggcgacggcggctgggtccccgaggagatgctgcacctggtgatggggttcgtcgaggacccgcgcgaccgggaggccgcgtcgctggtgtgccgccggtggcaccgcgtcgacgcgctgtcgcggaagcacgtcacggtgcccttctgctacgccgtgtccccggcgcgcctgctcgcgcggttcccgcggctcgagtcgctggccatcaaggggaagccccgcgcggccatgtacggcctcataccggacgactggggcgcctacgcccgcccctgggtcgcc

SEQ ID NO: 11818 - DNA, 764 bp, Sorghum bicolor
  Clone ID: SORBI-28MAY03-CLUS25332_1
gcccggctggctgccgtcccctctgttcccgatctacgtccacaacatccacaagagcaagcatggcagtgactctgggacctatgacgacgagggcaggttcatgccggtgaacttcgagaacatgttcagcaagtacgcccgcacgtccccggacaggctcacctacagggagctgtggtccatgaccgagggcttccgcgacgccttcgatctcttcggctgggtcgcggcgaagctggagtggacgatcctgtacgtgctggcgcgggacgacgaggggtacgtgtcgcgggaggccatgcggcgcgtgtacgacggcagcctcttcgagtacgtcgagaggcagcgcgcgcagcacgccaagatgtcctagacgaagaggatggctggtggtacggtgctgcgcgaatgaatggaatggaaggcgaagtgatcctgtgtccagctagtatagctcaagtctcggtctttatgtgtggcgtctctgctctggatgtatatatgtgttgataatgagatcgagggccgggcgtgtcagaaaacaagcagccgtgtactcaataagcagagttcgccgggacctggacctcgctctctttgcactttgccgcttcaacctttgttttgtgcgcggtttatgttcaccttccggttcccgagatgcaaattgtgttcgaatgagaacggtgaatgtctatgtgtatactggtgtcggcatggcaggggtctgtggagaatttatatattaaataatcaaaact

SEQ ID NO: 11819 - DNA, 716 bp, Sorghum bicolor
  Clone ID: SORBI-28MAY03-CLUS25388_1
tggaagaggtagaccagattttgatagcttgaaccgcctgaagattgtaaccatgattctatatgaggtgcttaggttgtacccaccagtgatcttactaaccagaagaacttacaaggaaatggagctaggtggcatcacatatccttcaggtgtgagccttctactgcctatcattttcattcaccatgatcctaacatctggggaaaagacgctagcgagttcaatccacagaggtttgaggatggcatttccaatgcgaccaagcatcaggctgctttctttccatttggatggggtcccaggatctgcataggccagaactttgcgttgctagaagcaaagatggcactgtgcaccatccttcaacgcttctcctttgagctctcgccatcctacactcatgcgccatacaccgtgataactttgcaccctcagcatggtgctcaaatcaggttgaagaagctttgaccatgatggtcatactgaatggcaaaacatatactgctagtaacatatagtgattgtgcatgcatgtagttttaaattccccttgcatatgaacaataagaagaaagtgtgtatgaatggagacatgggttgatggatggtttgaaaaataatgatctgctttgtctggtaatgcgtccatggtttgaaaaaaaaatgatgttgcacccatagtttattggcaaaatttgctgttggccatgct

SEQ ID NO: 11820 - DNA, 903 bp, Sorghum bicolor
  Clone ID: SORBI-28MAY03-CLUS25470_1
gcacgagggatccattctctgattcctctcagtgccggcggcggcggtggctggtgttgctcctgccaggatgcgaccggcggcagcttgtgcgtggctgcgaggggcggcggctgttgttgctggtagcgaattttacgttggctgcgaggggcggcgcccgctatttgacttgacacctacgagtatatacatattgcaaccaaacaccttccaaattccaaacgctcgtcgctcccccacaccaaccgcgcgccgccgcttcgcaacaagagacacgacacgatgcggcggtccctctccctcctcgcgcggcagcaggtggcgcagcagcggcggctgctgagcaacgtgccggagtccaccgtctacgggggcccacgcccgcaggagtcggcggcggcgcggcgcgtgacggtgaccaccctccgcggcaagcaccgccgaggggagcccatcaccgtcgtcaccgcctacgactacccctccgcggtccacgtcgactccgcgggcatcgacgtctgcctcgtcggggactccgccgccatggtcgtccacggccacgacaccacgctccccatcacgctcgacctcatgctcgagcactgccgcgccgtggccaggggcgcgccaaggccgctcctcgtcggggatctcccgttcggctgctacgagtcctccgcagcgcaggctgttgattcagctgtgagggtactgaaggaaggtggaatggatgcaatcaagctggaagggggtgcaccgtccaggatcactgcagccaaggctatcgtggaggctggaattgctgtcatggggcatgttggcctcacaccgcaagctattagtgtgctcggtggatttaggcctcaagggaagacggttgacagtgctgtaaaggttgtg

SEQ ID NO: 11821 - DNA, 838 bp, Sorghum bicolor
  Clone ID: SORBI-28MAY03-CLUS25866_1
gcacgaggcacttgcacgaggcccactcttccttctgcggttccacgcccatccctgcacacgaagcctggaatagccctccccctgctctgccacctcctcggatcccgatcgcccccccgcagacaacaacagatcgatggaggccaagatggaacgcttcttcgagtccgtgggcaatttcttcaccggaggcgacaacatcccctggtgcgaccgcgacctcatcgccggcattgaaagagagcttgccgacgctgcaaatgatgaacagaggaatgctagccttatgaggttatcatgggcccttgtgcactccaagcagacagacgatgtaaaccgtggaatcagcatgcttcaagcttctttggataattctggcagtcctctggagactaaggaaaagatgtacctgttggcagttgggctcttcaggattggcgactactcaaaaagtaggcaacttgcagatcgctgtttggagattcaacctgactggaggcaggccatgtctctgaagaaagcaatagaagataaaattgccaaagatggtgtgattggcataggaatcgcagcaactgccgtgggacttctggttggtggaatagctgctcttgccaggaagaagtgaggcgaatatattggaccagctcattgaactaggagaggtcccgtctataattacatatcttctgttgttgccttggtgatattacagtcgaatcgcaacagtctttatgtgtacaaacacaaaaaaaaaagcttggatgataatagtactcttgagacaccatgccttttgttaattaattggttttcccatcgatctggcgtttta

SEQ ID NO: 11822 - DNA, 952 bp, Sorghum bicolor
  Clone ID: SORBI-28MAY03-CLUS28063_1
cggagcgttggttgacaagattctagacaagactgggatgaaggggactgggaaatggacggtgcagcaggccgcagagcttgcagtggcagcacccacaattgcggcatcactggatgggaggtacttgtcagggttgaaggacgaacgggttgcagctgctggggtgctggaggaagaggggatgccagccgggctgttggagacgattaatgttgataagaaggtgctggtggatagggtaaggcaagcactttatgcctcgaagatttgcagctatgcacagggtatgaatctgctgcgagccaagagtgtggagaagggatggaaccttaaccttgcagagcttgccaggatttggaagggcgggtgcattatccgtgcgaggtttcttgataggatcaagagggcgtatgacaggaatcctgaactggccaatttgattgttgacagagactttgcaagggagatggtgcagcggcagaatgcgtggaggtgggttgtggcacgggcagtggaggctggcattagcacaccaggaatgactgctagcctttcatacttcgatacctacagatcaagtcggttgcctgcaaacctgatccaagcacagagggacctgtttggtgcacacacctatgagcgcattgactgtccaggttcattccacacggaatggaccaagctggcgaggaggagcaacggtgcagccatttgaggaattggttctgctgtttgctgctctgggtgatttctctttgtgggttctctttcattttactattgttgtctttttgcttctagatccaagttgtgtactttgaataatgctgtactgtatggttggcaagtgaagaacattgtgtagcttcagatttactgtgttctaggtacacccagtttgatcctcttaattttggcatgcaatcgctatcatgcctctcaaatccca

SEQ ID NO: 11823 - DNA, 713 bp, Sorghum bicolor
  Clone ID: SORBI-28MAY03-CLUS28110_1
gcacgagggaggaggaatgccagggtttttttgtgcaaaaagattacaaaatgtttccaccaaccgtggactgggacaatattaattggtcaactagaaggccacagatggatttccctgtgcagtctgctatctgtacactggaagatgtagatgttatcaaggaaggaaaggctaggattgctggatatgcactttcaggtggtggccgtggcattgagagagtggatatatctgttgatgggggtaaaacatggattgaggctcgtcgatatcagaaagacaatgtggcgtacgtatcagatggacctcaaagtgataagtgggcttgggttctctttgaggctacattagacataccagcaaatgctgagatcgtagctaaggcggtggactcggctgcaaatgttcaaccggaaaaggtagaagacatatggaatctgagaggaatcctcaacacgtcttggcatcggatcaaaatacagaactcttcaggaagatctaagctgtgaaattaagtacgctgctgacaacttggagcaagcatggtgctgacccttgcgagtcttaccattgtactaaaataataagtcatttcaactttctgtatttctcgtttcttgtcaaaaaaaaaaaaactttctgtgtttctcgagtcaggctgtaccacgaatgttggagtggtgttctatgggatttgagctcacttgatt

SEQ ID NO: 11824 - DNA, 1344 bp, Sorghum bicolor
  Clone ID: SORBI-28MAY03-CLUS28237_1
cctgaggcggcagggggattgtgagccacaatccgtctgacaggccctgcaagttctttctatccggtaccgaatgcagctatggcgataggtgccgctatccgcacagctactgcagtaagcgatagtgttacgatgcttaccccgctcaagggccatgacaagggtgttacgggcattgcattacccgcggggtcagacaagctgtattccgggagtaaggatggaactgttcttatgtgggattgccaaactggccagtgtgccggtatcatccctgttggtcgtgaggttgggtgcatgatcattgaaggtccatggttatttgttggaatgcctgatgcagtgaaggtttggaatatgcaaacagcagcggaaatgagccttaccggaccaactgggcaagtctatgcactcgccgttgccagtgagttactctttgctgcaacacaagacgggaggattttagcatggagatttagtgctgcaactaactgttttgaaccagctgcttctcttgatggccataagcttgctgttgtttcattgatagtaggaggcatgaggctttattctgcttcgatggataaaactatcagagtatgggatttggcaacactgcagtgcatacagactctttctgatcataccgatgttgttatgtctgtgctgtgctgggatcaatttctattatcttgctctttggatcaaacaataaaagtttgggcagctacagagagtggaaacttagaagtaacatatacgcacaaagaagatcagggtgcacttgccctcagtggtatgcctgatgcacagtcaaaacctgtgctattgtgttcattaaatgacaacactgtccgcctatatgatttgccatcgttcaatgatcgaggcagactattctccaaacaagaaattagggcaatacaaatgggtcctggtggtttattttttaccggggatggaactggtgagctaaaggtttggcagtgggtagatggagcccaaacctaatgaacatagtgttctagattagtttctctcatgtattttatgagggagttcttacaaatacgcataatgagttgaggttgtggttggtggcccgttctttttgtaatatgccccacatttgtcgcaaaggatatgagattcagtcgatctgtctggcagtgaagtgaggagcagagtctgtgttatggactgtagttttgtcctggaatgaatttcaagacaggggaataatcggttgtaaaatgtaaggcactggaaccagcaagtctgacgactgcttggaggtgctgacagtttcgaaaggatgtgctaatataaagaggtttgttc

SEQ ID NO: 11825 - DNA, 683 bp, Sorghum bicolor
  Clone ID: SORBI-28MAY03-CLUS28292_1
ccataaaagatcctgtgaaagaggaacagctcaagggaaggcctggctatgaacacttgggtgatccaacacatatcttaattgaggctgaattacctgctgatgttattgatgctagactgacacaagcacaggagatactagaggagttgctgaaaccagtggatgagtcacaagacaacatcaagagacaacaacttcgagaacttgccatgttgaactccgtataccgagaggatagcccgcatcagaacggcagtgcctctccgttcagcaatggtggcacaaaacagtgacagggaggcgtttcatctctgatccttcccagaaactctctcatcggtcctcctctcatgacagacatagcttctctgatgctcaagctcccgtgatggtattggaattcatgccattgctagctggtgaattttgatatcccttgtgacattgacctgccgatgagatgacaagtagtgaggatgaaaaaaaaactcccatggctgtgtacttagaatatttcgtttattgcttccttgtcgtcgactactagtgctgatagtgcagagacgtctaagttccggtactttgagctctttgattgactaaggttatgactctgcaacatatttgattatgatagtatttgtcgacataaatatatctcgagacgcattttgtgtgtc

SEQ ID NO: 11826 - DNA, 916 bp, Sorghum bicolor
  Clone ID: SORBI-28MAY03-CLUS28633_1
gcacgaggcaagaataatcctgatgaccgccgaataattatgtctgcgtggaatccttcagatctcaagaagatggctcttcctccttgccacatgtttgcacaattttatgttgaaaatggggagctatcctgccagatgtatcaacgctctgcagacatggggcttggtgttccattcaacatcgcatcatattctcttctgacatacatgatcgctcaagtttgtgatctttctcctggagattttgtccatgttataggggatgctcatgtctatagaactcatgttcgagctctggaggagcaaattcagaagatgcctaaaccatttccaattttgaagataaatccttcaaaaaaggatatagattctttcatggcatcagacttcaagctggttggctatgatcctcaccagaagatagagatgaaaatggcagtgtaatggtgacttagctggagccccagcctttggactcggtgggtgaaatcagtcagactgggtactacataaaaattaaccggacatcgcactagcttgtttttggtgatggtgctggatgttccgtgggagacgtttctccccttattagttgcgattgcatactatggtcgcttaaatgaactctacaaaaccggctcccttttatctggagcgagttgatgactcaattgcgagcaagagatgatctgggcatcataccctgttgcaagggcctactggtgtgtgtgcccccgtgaggctgtgacgtttgtgctactgccccttgagaaccatgtaaccgaaattgctgttgtgtacctggtagagctccgtactgtttggtatctggttgccttaatgcgtgccctgattatttcagtttccagtttggacgcaagataacgacttgattgtaggtttttaagaaaca

SEQ ID NO: 11827 - DNA, 744 bp, Sorghum bicolor
  Clone ID: SORBI-28MAY03-CLUS28838_1
cccgtccctacccggcagcgggctccccgcccgccgcaacggcgaaaccgtcggaaccctagatctctctcgcccgtgccccgatcccccaccgccgccacggtccagcccgcagcacgctagatctctctcgcccgtgctgcaaaaccccagatccgccatgcaccagcccagagcccgctacccgcccggctatggctccggcggcggaggcggagccgggcgtggcggcggaggcggcaatggaggcggcggcggaggcggtggcggaaaccacaactactacggccggaacccgcagccacagcagcaacaccaccaccaacagcagcagcagcagcagcagcacgtgcataggaactcctcgcaccagcagcagtggctgcggcgagaccaggcccccgccgttgcgggggcagcgtccggaaacgctgcggctaaaacggcgcctcagcttgacgccataggctcgagttctcatgagcggcaggcgccactgaatataccagctccagatacacgctacaggacagaggatgtcactgcaacaaaaggcaatgagtttgaggattatttcttgaaacgtgaactgcttatgggaatctatgaaaagggatttgaaaggccatctcctatgccactggaaagcctgccgcttgcgccgtctggaagtgatattcttgcaagggcgaaaaatggcactggaaaaactgctgcattttgcattccagcacttgaaaaaat

SEQ ID NO: 11828 - DNA, 1278 bp, Sorghum bicolor
  Clone ID: SORBI-28MAY03-CLUS2659_1
tggtgcccgggagttcctttgcgctcgcccagcagtccgtcaggagggaactttctgctcctccgtccttcggtctagctctagcccgagtggacgtaggaagagggggcttgacgccggcgagccatggcgggggctctcctctcctctccccacactctcccgagccccatttctcagtcctcgcttcgccccaggagcagggcaccgctcggcgctggggcagcgcgtgttctgccaccgaggaggaaggcctgtgtgctcgcttcgtgctctcgcgagcctcccgataggaaccgcggcttggaggtggagaggaggcgccttctcatgtccgggctcgtgtcttctttcgcaatcgtgctcccgatttcagaagcatatgctgtcatggagactgatgaagacgtgaagatgaacacacaagttgatgagatcaatgcatactcttttctttacccggtcgaactgccaggaaagaaattttccttcaaatgggtagagtccagaaaaccagagcgatattcctctgcagcgccactatcacctgatgcgcggcaacctttcgtatcggagcgagttgtcatgttactttatgctgtcatatcaacctcgtttgggcccccgagttcacgttttttgccttcaaaagacaagagctcgtgggatccgaaagatgttgctgattgcattttgtctgatagatctaccctgaaggtgacgactggccagcgcatgacagagagttccgtccttgatgcacacgctacagaggttgacggagaaccatattggtattatgagtatcttgttcggaaatcaccaacaaaatctgcaccagaaccaaatttgtttcgacacaatgtagcctgcactgctgagcgtgatgggttcctgtactcactgaatgcttccacccttagcaaacagtgggaatctatggggccctttctacaacagactgtggcatcctttcgccttctcccccctacagaaaactatgttcctccctacaaggatccttggagattttggtgaatggagattctttttgtagttcccattttttctcttcagatgacattatagcttcaggttttagaccattttttcacaccagatccttagtgagtgcctgtcctttcagcttgacagatgaaattcagagatccagtttggtttcaccaatcctgcctgttttgattaatcaacagtcaaatgcaccataacaattactgtactccttttgtctcaaaataaatcaacttctagaatcac

SEQ ID NO: 11829 - DNA, 1292 bp, Sorghum bicolor
  Clone ID: SORBI-28MAY03-CLUS26668_1
ttggatcttcatcaagtggatttcggacatgaaactctgaagcacctcaatcattgcatggatcacctccgtcacaccgatctatgggcaaatcacataacgtcaggacacgcacgagggcagactattctagaaactccaagatgggcacaagattcgattctgcacaagacttgtctaaaaagttttacagtataaatgaaatgacgaaggagttagatgtcctactagcatatatagaaaaggatggtggtttcagagatgcctgcataaccttccagcagcgtcctttttctatgtttgaggatggcttgcaaaaccttttggagttgttgcaggtcttcaagggtaaagtagaggaacaatgttcaaaaattgaagatatgaggaacaagatgtttcaagtttctactaggcaaacttacatgaagggaattgttagccagtcttcagataatcagtactgggatatatggaaccgccagaaattgagtccagaattcgaagtgaagagacaaattatcctcaaagctaaccaagtatcagtatctaacattctgactaacttatttgtttgtatgatatcagagagaataataagtcctttgtcatacagaatttgacaaatcagctggtcgagttggagaggcacttcaataatctggagatgaacagatccagtgaaacaggaagagtggcttctaatcgaagagttgtttattctaataagacaaggttgaggcggcggcggcgagcggccgcgagcacgggccgaggtccgaaggtggggtcgcgaacgccgggggcgttccggccgagatcagaattcagtgactttgcttcatgaagtcacggtgtaactttcgatccatctcacacctccgttcaagatccaatgactccaaagcaattttttacggaatgctggctgcgggaggcgggagtttccctcgcgcgctggccgtcccacgcgccgcttcactttcttggccgcgcggtgcgccgccggtcccgcggggcgcgccgcccgcactgcctcagctgcctgagcctgactgcgctatgcggcggctgtcacgcgcgccgcctcgtaaggcttttgattcaaacctaaattgggggcggttgccgaacggctctaatagtgtactgtttttcaattttggtcctctctctcttcaattggattagtgatgatgtaaaaaaaagtttaaaacaacaatgcctctctatcacatgttttcttaaaaaacacagggcttattagtcaacaaaaataaatgtggtgaggc

SEQ ID NO: 11830 - DNA, 701 bp, Sorghum bicolor
  Clone ID: SORBI-28MAY03-CLUS26720_1
ctttcatgcccggcgcccagctcatccccgttgctggcagggggttcctgtacatcggcatgtacgcggagaagctggagatgctctccgtagcattcgcaggggatactgacgacggcatggtctacgtgctcaacggctgcaagaacctcaagaagctggaaatcagggacagcccctttggggatgcggctctccttgcgggcgcgcacaggtacgagtcgatgcgctctctctggatgtcgtcctgcgagatcaccctgggggcctgcaagacccttgcggcggccatgccaaacatcaatgtcgaggtcatcagtgaggcgggggcgagcgttggtgcgacggatgatggcatcagcaatgcgaggaaggtggataagctatacctctaccggactatcgccggacccaggagcgatacgccaggattcgtttcgatattgtgagctgtacctactaactactgtagtggctaaaggatttatacccggctttttagaacaactcgacgttcttaaccatatgcctgctatggctgtgctactctgtctcgtagtgttggaaacacaatgtgtgtatatatcgttctgtggaactgaaaccttggtgctatgtgaaccttgtttatgccggacacgtaatagatcttaaataggagtaacataacgtttggtacaagtgtttcatgctggctctcg

SEQ ID NO: 11831 - DNA, 825 bp, Sorghum bicolor
  Clone ID: SORBI-28MAY03-CLUS26733_1
ctttatgctgcattggcatctgtgctatataacaagcatgatagtctgaatggacacagaattgtgatgttctcttacggcagtggcttgacatccactatgttttcattgaggctgaacaatggtcagcatccattcagtctatcaaacattgcttcagttcttgatgtcaccgagaagcttcagtcaagacatgagcccttgcctgaaaaattcgttgagacactgaagctgatggaacacagatacggcgcaaaggacttcgagacgagcagagacaccagcctgctgcagccaggcacattctacctcaccaaggtcgactccatgtacaggaggttctattcccagaagctggccgaggaaacaggcggcggcaaaaccaagtgctgcaacggcttcgcaaatggccactagtggtgttcatgccgtgaattgctaggtcgccctgcactgttgttcatcattctccgtattttgataatgctcgtggttagcgtttagtctacgtgtttctgaaataatataattgttctttgaagctgttccccctagatcagctagtttttgtatcttatttatctgaccaatgagatttatcagtctcgacattgtttctctttgattcttcttccactagcaagagttcttagaaattagtaccccctcccattccaaatttcaaactataatacattttggcttttctatatacatagcgtttgctttgtatttagatactagcaaacttatccgttgcaaacttgtttgtgcattgcaacagaagataaaaaaagctatgaaatgttacttgttcacttagtc

SEQ ID NO: 11832 - DNA, 758 bp, Sorghum bicolor
  Clone ID: SORBI-28MAY03-CLUS26805_1
gcacgaggcttactgctgctcttccccattgtcccaacttcccgttccacaaggaagaaaacttctggctgcttctagctgatgtggcatctaatgatgtctggttgtcacagaaagtcagcttcatggatgaggccactgccataactgcagcatcaaaagctatacaagagacccaggaagcactaggtgcaagtgcaaaggaaataggaaatgcagttaaggaggcagttgacagggtgaagaaaggcagtaggctggtaatgggcaagttccaagccccagcagagggtactcacaacctcacctctttttgtttgtgcgactgttggataggctgtgacaccaagaccagcttcaagctcaaggtgctgaagcgcagccgtgctggaacaagaggccatgtgcctgaagaagggccagcggcagccacagaggatggtattgaggaggaagaggaggaagaggaagaggagtatgatgactatgagagcgagtacagtgatgacgaggaggacgacaagaacaaggggaaagggaaggggaaggtcgtgaacggatcggcccatcaaggggctgaatctgatatagattcaggcagcgatgagtgattctatactgtgttatgttgagaaaaaaaacatagagcttaacaccatctgttttttttttaatttgaacatatcccctctatttatagatggtataatagttactcagttttgttaactaataaattgagatgagactgattggtt

SEQ ID NO: 11833 - DNA, 727 bp, Sorghum bicolor
  Clone ID: SORBI-28MAY03-CLUS29169_1
gttggtgaggcagcccctgttctgcccaggggtttggagtgggctggttttgtgctgaactcgagaatgctgtggaaggaggctgatggcaagcctgactgggtgaaggatcttgatgctgtgggcgagaatggagaggagattgagaacccacttgctctattgaatgatccatcctctgttgagccactagggaactgtgggaagaaggtccttctgtggtggctccgtgttgaagcacgggctgatagcaagtttcctcaggggtgggtgattgagccgcctttggaagtcgtcgtccctgcaaagcgcactccatggcctgaaaccaccaccgagcttccatccgagttgttggatgacaagcaagagcaggaggatagacggctgtctagagccaacaaatcatctcggccccgaggcaccacgaaacggaaggctgaccctcaagggcaagaaaactgatggagaacttactggcattgtaatgtatatctcttacaccctgcaaaaaacacagtaggaagcgtatccagttaatctggcggtggctgtgtttatttttttttttctgatgtttttgctcttgtggcgatggtccacgcttgggtatgttatctgtagagtgcacatttttaatgtagctgtatctgttgtgttgtaatgtacgctgcattgggaactgaaaatggtggctgaattctggaaatctgtcgccttgtgttcc

SEQ ID NO: 11834 - DNA, 1494 bp, Sorghum bicolor
  unsure (1)..(1494): unsure at all n locations
  Clone ID: SORBI-28MAY03-CLUS29237_1
gcacgagggatttcttattttctgatgggaagaaccactccccaatacatcgcaagacaaaggatggcaagagcaaggtgcctgatgtttttgtcaggatagtgcagcactctaataacctgcacctttctacctattctgaaacatcaaccaaggatggcctgacagttacatgttcgaagaggggaggagaagcatacctacccaaccactccaagtggctgcaaacagtggcaaagaaacctgatgcccgtgggttcaaatttgtccccatcacctctcttctaactggtattcctggtagtggttacctcagccatgccatcaatctatatcttcgctataaacctgatcttcaagacttgcaatatttcttggagtttcaagttcctctacaatgggcacctatgttcaacgagcttgtccttgggccccaaaagagaaaaggctcctacccttcaatgcagttcagatgtctcggccccaaactccatgtcagcacttctcaggtatctagttctcagaaaccggtggttggcctacggctatacctggagggcaggaagtgcaaccggatggccatccatgtccagcacctctccagtgttccaagcatgattggagactccgtggcatcttcaatgtcagaatggcgcgagtccaaagacagcgacccagggtacatcgaggccatccagtggaagaactactcgtgcgtctgcacctccgctgtcaagtacaacccggagtggcacaagagagcccccggcggagtcttcgtcgtcactggtgcccagctcgtcaccaaggggacctggtccaagaaggtcctccatntgcgcctcctctacacccacatccccaactgcaccatccagaggaccgagtggacgaacgctccggcgtcgtctcagaaggggagcttcctgacgacgatcagcacgacactgagctcccctttcacgcagcgtgacacccatcagcaggcgaagcatgagccggtgcagctgaactcaggtgtctacccggatggaccgcccgtcccgctccggtccaggaagctcctcaagttcgtcgacatttcggaggtggtaaaagggccacacgacgtcccgggccactggctggtgatcgcggcgaagcttgtgaaggagggagggaagatcgggatccatgtgaagtttgcactgctaggctacgaagggcaatcgcagggtgacagtttcatgagctgagtctctgtacataacaacagctggctcatctttgtagatttcaggattttggaagaagcataggacgaggatttgttattgcttttttttttttggggaggtcgacaggaagtgtatagagggcagtcacaataaaccaatcatcgctctgttgaggatgctccgtgaattcccgtgcagtataattagagcccgtagttgtaaattactccttttttacaaggtatatatttatttcagtatagcaaagacttcggtt

SEQ ID NO: 11835 - DNA, 1398 bp, Sorghum bicolor
  Clone ID: SORBI-28MAY03-CLUS29418_1
ccacgaggactctcccttgtgccccctgtggcatcaacgaggtcggtacctggtggcggctcggacgctggtaggtctaccttcaggcacttggctcggcattgtgggcccggccggggtgctgctggcacccgaccggtttgtgatgagcataggtaccagcatgtagaacttggacggtgtctgtcactggactatactcatagtcatagggggattcttctcaatgaagatgatgtgggttgagaggaaatgcaaagtttctgtaatttctgtagatttttcgtagctgttaggcttttttgttctaatttactcgacgcggcatcccgtccccggaggatttgcgcgcctgcccccggcagcggccgttttgggaccggcccctccgggcctccgggtttatctgcgtcccctgcgctgctttttcacccgcctgcttagctgtgccctggtttttagctgggggaagcgttacgtcagctgcccatataaacgcttggtgcaacggatagtccagttgctactcctgcatctgcgggtcctcgggtccgaccgctcgcttccgctctccttggcccagcaggatcattacctgcccagcattcaaggcagtatgctataaatcttgctgagggtagcagcagtggacgtgacagtagtcgtaaatgggaaagtcagggccttgatcttaactcaggccctggaagtatagatttagaaggaaaggatgaacggatgcctttaccagtcagacaaaatttgatcccacccccacatggctttgcagaggatcaaggaagaatttaccaaatgccagttgtaggaacaaagagaaaggagcctgatggcagttgggactcagaaaggtctacatacaagcaattatcatggcaatgagggctctgaaggagatcattttgcaccgactggtctgcgatgagcataggtacctgcatgtagaacttgggcggtgtgttcttcagtcactggactatactcgggattcagccccgtgacgatgatgtgggattgaggaaacgaaaagttgctgtaattgttgtagatttttcttagctgttaggcttttggttctaatttactcaggagggtatggctgcggaggaggaatctttgtgatcctgagctctggggctactgtaattagaccgtccgctctgtttgttggtgataaactgttgagcacatgctgcagctttacataagaatttagatgtgaccttgttccttgttgggaaagcgttacgtcagctgaccatatacacactggtgcaacgaacagctcgagttgctacgccatgtatcttgggttgcagtgcagctgtatgtataagaattctagcagatcagcaaactataattttttgctgttctttg

SEQ ID NO: 11836 - DNA, 934 bp, Sorghum bicolor
  Clone ID: SORBI-28MAY03-CLUS2942_1
ttttgtcgagataaaagcatcgactcaatactttcaacgcactttattctttatactaatactttcaacgcactttattctttatatactgcaaaagatctggtacaggcagagctgaggtgtaaatagcatacaaatctcacgtggctatgaaacattttaattctctacattgctcatggggatataaaacacccgttacatgaacatctcagcccatggtgtaggatggtgacggcaggtttatgacagtgctcttcaccttggtcatcatgttaatgctgtttgttatcccctgggatccaatgccactgtctttcagaccctggaaggggaaatggtcaggtccgcgggctggtgcagagttgatctgcacagttccagtctccattgcgtcactgatcaggattgccttgttgatgtctcttgtgaaaatgcatccctgtaggccgaaattgctagcgttgcaatggtggatgccctcctcaactgagttgatcctgatcacaggcaagacgggcccaaaaggttcctcccatgcgatcctcatgtcagggcggacatgatccagcagcaatggccatataaggttgccttctctcctgtattcctggcagaaggttgctcctttctcctttgcatccatcaccagaccctcgatgaagttggctgaggattctgttacaaccggggtgatatcagagtcgtcctcaggtgggccaactttcagtttcgccaacttggcgttaaccttctgtactacggcatctgcgatggattccatgattagcactactttgacagcagtgcacctctggccactgtaagagaaaccaccctttactatatttcctgcaaccaagtctagatctgcatcctccaacacaatgcaagcatctttgcccccaagctccatctgaagagggaccggacg

SEQ ID NO: 11837 - DNA, 750 bp, Sorghum bicolor
  Clone ID: SORBI-28MAY03-CLUS29449_1
gaactgggcaacgggggcatgtaccaaccgcgagtacgtcctgcgccgcggccccggggcgcgccccagggcgcccctcatcatcggctgcgacctgaggcacatgtcgctggcggcggacgacatccgcgcgaacaagggggtgatcgccgtcaaccaagacccgctgggcgtgccggggaagaaggttcggatggagggcagcagcgagatctgggcggcgccgctctcccgagtaccggacggcggtggtgctcctgaaccggcacgccaaggaccaggccaccatcaccgcgcactgggacgacatcggcctccccgccggcacgcccgtcgaggccacggacctctggctgcacgagacggtggacgccacgttcacggacacgatgagcttcgaccgtcgcggcccccctcgtgcaggatgtgcgcgggctcgcctcccacccccggccggtgacctgcctacaccgcgccggccggtgcccgcgcgcacggacggcgcggcctggcgacgacatcaccaccggtgataccatccctgcaggcgattcacttgcactgcaggctgattgcatacacatgggtggaatcaaaatcaatcaccaagagtgttttactgttccgcccgtcgtcgtccccctccgcgcatggggcgtctcgctcccggcggagtggggcgcgcccgacgccaactgcgggacggccccctacgtcgtcgccggcccgcgggacagcatgatcgccacg

SEQ ID NO: 11838 - DNA, 727 bp, Sorghum bicolor
  Clone ID: SORBI-28MAY03-CLUS29519_1
acggcccaaaaattgatattggtgtgtttgatgcccttaagaggaaatttcagtgtgcaaccttacagctggattttcaactgcccattcggttcaagctggcttattctgctgaggatgaagccaaaattgaaaggcctgtgatgatacacagggcaatcctaggttctgttgaaaggatgtttgccattcttttggagcattacaatggtaaatggcccttatggctaagccctcgccaggccattgtttgctcggtttcttctggttcagtggagtatgcgaaacaggttcttgccactctacatgaagctggttttcatgctgatattgacgcgagtgacaggacaatacaaaagaaggtacgggaagcccaactagcccaattcaactacattcttgtcgtaggtgcacaagaggccgagactggaaatatctgcgttagggtaagagacaatgctgacctggccacaatgagcgtagatggcttcgtcacacgtttgaaggaggaaatcgcagccttcagatgattttgatgctgcataatttcatactttcagtcgttgactctcgtttgtgcttttgacgagtttttagtaatcagcattgagttcctcgtgttactattcttgtttgtatggtgggaagctactcaaaggttgtttttttttgttaattacagatgtgaagttaaatactgccactagtaaaaaaaaacttgacttcc

SEQ ID NO: 11839 - DNA, 1002 bp, Sorghum bicolor
  Clone ID: SORBI-28MAY03-CLUS29511_1
gcacgaggccagtacgtagctagctaaacagcgacacctaaagagcagttcctcacacgtacgtctagcgaccatccacaccgagctcgtgagctttcgttcgttcgttagtttctgagggcggcggcgataatggcgtccggtcaggacagcagggaggagctggatcgcatggccgaggagggccagaccgtcgtccccggcggcaccggcggcaagtccctcgaggcacaggagcacctcgccgaagggcgcagccacggcgggagcaagggcgggcagacccgcaaggagcagctgggccacgagggctacgtcgagatggggaagaagggcgggcagacccggagtgagcagctgggccacgagggctaccaggagatgggcagcaagggcgggcagactcgcagggagcagctgggccacgagggctaccaggagatggggaagaagggcgggctgagcaccaaggaggagtccggcggcgagcgcgccgcccgggagggcatcgagatcgacgagtccaagttcaggaccaagtcctagatctctgatgcctgtgcggcgtaccgcgtacgtgtcccgtgccccgtagcatctagtagctgcaggcaggtagtgtaggctagtcgtagcacatgtgccactccaggttttggcacgtgtgtgcactgaataataatgtagggcgtcagtcgccgcagcacgcatgtaggcggtcatatggtgtgcgtatgatcatgcgtgctttgctagcttgtagcttcagtttggtgctgatgatagtcaattgtcagcggtcgtcgtgactttgtggtgttgaggcatatgcagctttgtcgtcgtcgggagtttcagcagcctgtgttctggctctaccccaaactgtagtcccttagtgtgtggtgtggtggggtctagcacctgatgcctcaaggtcgtcgagtttgcttgtatccatgctttgtttcggtaacgtagtacgagtaatagttggttcgt

SEQ ID NO: 11840 - DNA, 1555 bp, Sorghum bicolor
  Clone ID: SORBI-28MAY03-CLUS2743_1
cgggcgctgcgccgcagctggcgccctcccgccgcgccgccgctgtccgtgttgccggcccgcccgccgccgccaccgccgccatgcacccggcgagctcgaaaccgatggaagtcgcggccgtggcgtgccgcgccgggctgctcgcgcgggcccgtccaggcagcaggccgcgcacgcggcggtttgccgtcggtcccgccccgtcggcggctcgaagaaggctgctcgtcgcgtcgctcggggtcggggagccactcccggcgcaatccctactatgcgaagaggccgtggcgctggaggttggggtcggggagccactcccggcgcgatccctgggcgaggacgccgtggcgctggaggtgggtgaggatgatgatctggactcccttgtttctgccgagaatctcttgcctcccgctgctgctgctgacgttcctgaggataggacagtgcgtgtcaagttcgtgctgaggaagcagtgcgcctttggacagcacttcctcgtcgtcggcgacgaagcggcgctcggactttgggatccggctaaggcgaccgccttagaatggtcagaaggccacgtctggacggcgacgacggatttgccggcgaacaggtcgatcgagttcaagtttctgctgcgagatgcctcggggcatgtccgttggcagcatggcactaacagaactctgcaaattactgaaaccccaaacaccatggttgtccacgaagactgggatcacggcaacaaacagaaagtatcagaggaggaagagctctccatcggggcagaagatgtggaattttcagaggatcttgaaggaacaaatggcgcaatgccggtagataacaatccccaaaagcatgagaatctggagaccgacaggtcggctgtggtggttgcagatgctcctctgcagtgggaaatggtagcagcaaatggcacggaccaaccacagctgatgctggacaaacaccagacgattcttgaagaggtccccggagaacaaaacggcccaccttctgccggtgattatgctggcaatggcgacgacgacgacgacgacactaccttgtatcagggaggtgacctgctgcagaacaggccgacaagtatatttgagaacgacttggcctgggccgggaaagccatgcagcagctgcttcggatcctcggtttccagatcggcacaacaagaacatgatattcagcttcagctaccgtcgtgtatatgttgcaaacctgctgttttgaaggatcacctatgccttcaactcacttttcaacgctgaaagaagcctcagagctgaggattgtaactgaaactccagtgacagcagcaaacatcagccgtcttcccctgcactgtgttgcatatagcaatactaggagataagtaactagtactgcaagtatgttcagtttagaaatagtgactaataacgtgagaatcatcgacttcttatctgcttcttgtgaaggcagactccatctgtacaatatggcaaatctcagtgccatgtgaaatcaaatctgtggaggtaactctaaaag

SEQ ID NO: 11841 - DNA, 1518 bp, Sorghum bicolor
  Clone ID: SORBI-28MAY03-CLUS27705_1
gcgcgggggcaccgcggcgccgaagccccgcccccccgtctccctcgccgcccggctcgcgcccccgtctgcgcccgtccgcgtcctcggcgggggggggtgtgtgggcggcgccgtctcccccgccgccccgccggcggcccgtcttcgggccggtcctcgtcggggacccccgccacgccgcccgccacccgctcctcgaccgcctcggctgccgcgaccgcatcgtcgtgcgctccggcttcgcgtctggctcctccgtggctgaacgtcatcgcctggatgcccttccggcccctgaccgggccccctttgcccccgcctgacgccggctgtccgttgtgccctcacgcgctctgcgacctccgcgccggcatggttaccggcctggtgcttcttctatccccaccggcacgccgttcctcgccacctccgagccgttccacccacgggtcagcgtccttggtgggcacttcgctcctttgggggacttctcttgtgggcggagcaggttcaacgtcgccggcctccagttcgtacctcgggtataagttgttcaacatcatgcttacctctcaatctctcatcatgaatggaatctaccactctagttctcttcatatcatcagaactctgcacgcttcgcttttgtctactttgaggatgaacgtgatggcaatgatgccatacgggctcttgatggttatccatttggccctggcagacgcaggctttcagtagagtggtcacggggtgatcgagctgctagacgtgatggtaacaaaccagaagcaaatactaagccaactaggacattgtttgtcatcaactttgatccaatcaacacaagggtcagtgacattgaaaggcacttcgcaccatttgggaacttatcaagtgtaaggataaggaagaactttgctttcgtccagtttgaaacactggaagaagccagaaaggctcttgatgctactcatgctaccacgcttttggacagggtgatttctgttgagtacgcctttagggatgatagtgaacggagtgataggtacgacagcccaagaagaggtggtggctatggtaggcgtggtgatagcccagtgtacaggtcacggcctagtccagactatggtcgcccagcaagtcctgtatatggttcatatgacagaagtcctgttcgtgatcgctatcggagatctcctgcttatcgatcaagatccccacgtgtgaaccgaagagcatatgactaattgagaactatctctgttatggtgctacaggctagcggctgctaatatccgccttttgcagggctgcacccagtagcaagaacttactgtgcctgtaccggagcgtgtcaccttaattgccttaaactcttgtgtttaaagtggcctgtacttagttatgctatgcgactgtcagactttactacatgcaatgttatcatacagccctatcatttgtcttgcgttgagatgctctggagctcttttacaaaaaaaaaaaaaaaaaaaa

SEQ ID NO: 11842 - DNA, 954 bp, Sorghum bicolor
  Clone ID: SORBI-28MAY03-CLUS27833_1
ctaatccaaaaatcgcgtgctctgctcgctcgagggggatggagaccatggccgcgctcgcgaggacggcgccgccccttgcagggtccactcgccggccctcctgcgcgctgcggccgacggcatccctctccttcgccgccgcttccacgacgccccgtggccggctcgggctggcgctgagcacggcgtcggcggggagcgggagggcggccagggctcgcgccgtcccgcgccgcatcgtcgcctcctcggaggttgagcaaagctacattatgatcaaaccagatggtgttcagcgtggtctggttggagagattatttctcgctttgagaagaaaggttttttgttgaaaggcttaaaacttttccagtgccccaaggacttggctcaggagcattacaaggatttgaaggataaacctttctttcctaaactgatcgattacataacttctggtcctgttgtctgcatggcctgggagggtgatggtgttgtcgcatcagctcgcaaattaataggagctactaatccccttcaagctgaaccagggaccataaggggtgatcttgcggttcaaactggaaggaatgttgtccacggaagtgatagtcctgataacggcaagcgtgaaattgctctgtggttcaaagaaggcgagctctgccagtgggaatcagttcaaacaccttggcttatagagtaacccttgctaatcatcactttgagagttgtattcaatgttttttttgtccgttcaatttgattcaaggagccatgtatgagtgtatgagtttagttcggctaagaaaattagctcatgagggctctaattatcggtaccctttacctggaggttccttttgcaatgtatgagtttcagtatgatttgtgcaactgaaacctttgatcagttctcgttgagaagctatttcttctcacatttacagtaa

SEQ ID NO: 11843 - DNA, 1498 bp, Sorghum bicolor
  Clone ID: SORBI-28MAY03-CLUS2796_1
gcacgaggggcttttgtcagaggagccactagatgtagaaactgagcttgcacttggtttcctggatcatctattgctggggactccagcttcaccgcttagaaggattcttcttgagagtggtttaggagaagctattgtcggaggtggtgtcgaggatgagctccttcaaccacaatttagcataggcctgaaaggtgtatcagaggataatattcaaaaagttgaagagttggttatgcaaactttgaataatttggcagaggaaggatttgcaacagaagcggtggaggcttccatgaacacgatcgaattttctcttcgggagaacaacacagggtcatttcctcgaggcttgtcactgatgcttcgttcgattgggaaatggatatatgatatggacccttttgagcctctgaaatatgaacagccactacagcaattgaaagcacgaattgcagaggaggggtcaaaagctgtgttctcaccgctcattgagaaatttattttgaagaatttgcatcgtgtcactgttgaaatgcagcctgatccagagaaatcatcacgtgatgaagcgcgcgagaaagagatcctaaaacaagtgaaagctagcatgactcaggaggatcttgcagagttggcacgtgctacaaaggagctaaaggaaaaacaagaaacaccagatcctccagaagctctcaaggctgtccctagtctgtcattgcaagatatcccaaaagagcctattcatgtaccaattgaggttggagagataaacggtgtcaaggttttgcaacatgatcttttcaccaatgatgtcgtctactctgaggttgtatttgatatgggttcgatgaagaaagaacatctgcaattgttgccattgttctgccaatccttactggagatgggcacaaaagacatggactttgtgcaacttaatcaattaattggtagaaaaactggaggcatatcagtttacccattcacgtcatcggttaggggaaaagaagatcctcttactcgcatcatcgttcggggaaaggcaatggcaccacgagtagaagatttgtttaatctgatgtacaccattcttcaagatgttcaattcacagaacagcagaggttcaagcagtttgtttctcaaagtaaagcaagaatggagaatcgattgaggggcagtggccatggcatagcagctgctagaatggatgctaagttaaatgcagctggatggatttcggaacaaatgggtggtgttagttatcttgagtatctgcgggacctggaaactaagattgatcaagactgggacagcatatcatcttcactcgaggaaatgagaaaatcactcttttccaagaatggttgcttgatcaacctaacaagtgactggaaaaatcttgaaaaatcaagccaacatattgccaaatttcttgattcactcccaagtaacccatcccttggaagtgatccatggctttctcggctaccttct

SEQ ID NO: 11844 - DNA, 884 bp, Sorghum bicolor
  Clone ID: SORBI-28MAY03-CLUS278_1
cgcgtccggtggcaccggccggcattccccggctcgatccgcctcgcctctcctctcctcgactcacctctcctcacgactcacagccgacttctcctccgtcgccgcccctccgccgtcgcctcgcgccttctcttgccatctttgtctccgtcccggccaccgtcccggccgaactgtcttatccccacctccacatcggcttcgtcccctcgctggatagacttgaccgccgtagctgctgaaaggtaccggctccaaaatccactctagttcttctcggatttgtcttccctccgaacaaaggaaggcagtctcaatctggaatgtccgccccacgcctggctccacttcctgctccagtgaggaaccgaccatagccatttggctcggtggaagcaatgctttaatttagatgaataaagtctgaacacttttgtagcgtttgttggacttttcggcttttatgttgccacacaatgctcgcaaatggactctactaggtatttctagcatctttagttgtgcatgacatttatggcatattctaaactgcctatatatttgaattggactctactgattattcgcagcatctttggtggtggatagacgtgatttcatattttgaaatgggtatgtatttgtatggagaaagacttattccttgtggtggaagcaacatgatttcagacaagtgaagtgtggtcacttctagcagtgaagagaatcatattttgttatttttttacttgtctagattttgtggatggagatgaatttgcgatgcatgtattaggttgtttagatattgttattacttattagatggcacttgggtcgcacgtccgcttcccttcctttgtttgataaataatagtcat

SEQ ID NO: 11845 - DNA, 372 bp, Sorghum bicolor
  Clone ID: LIB3480-034-P1-K1-D5
tggacatttctggcttttatgttgccacacagagaactcaaatggactctattgagcatttctagcatctatagttgtgcgtagacttgatttcatattataaaatggctatgtatttgtatggagaaagacttattccttgcaaagggtttggtggaagcaacatgatttcagacaagtgaagtgtggtcacttctagtagtgaagagactcatattttgttcttttttttacctgtctagaatctgtggatggagacaaatttgtgatgcatgtattaggttgtttagatattgttattacttattagatggcacctgaatcaaacttctgcatgaatatgactcttatttctgatgcagatcttctcac

SEQ ID NO: 11846 - DNA, 656 bp, Sorghum bicolor
  Clone ID: SORBI-28MAY03-CLUS30544_1
tcggtccggctgcccatagcttccgcgctatgccaccctcgtaacttcatcacaaagatagctcgttatgacaaggtggtgaacattccccactgcgtggccgtttcgggtctgctgcggcctatcgcccttcacctgccctggcggggccgcccgcgctgagggtcctgcgccgttcctggcgttgtcagccacaatgagattctagagatgtacaagaaatacatcaatcctgatttcaagtggaccaacttcacactcgaagagcaggccaaggtcatagtcgcacgtagaagcaacaacgagatggacgcgtcaaaactgaaggctgagttccctcagctgctgtccatcaaggattctttgatcaagtatgtctttgagcctaacaggaaggttccggctatttgaggatttaggatacaaagggacattgaggtattgggttactattagacattaaattagctatataatgttgggtgtgttacgtagttgtggtcgatactcctggaacattgacaggcatacctcttgtttttcaattttgttatgcatcgaattttaacagaacacgtagatccttaatgttctatatagtggatgatatgctgagatgtggttatcgatgaacacgataagtcattctgtcgtgc

SEQ ID NO: 11847 - DNA, 1022 bp, Sorghum bicolor
  Clone ID: SORBI-28MAY03-CLUS30175_1
ggttaaatcctcgtgctcgaagcctcctcggtttttccctccacacaacgcacgcgaggtccatcgctccttcactcccttaccgcgcacatggcggtctcctccccggccatggcctcgcctcctctcaccgcgcccggtacccaccgtggccccggcttctcgaccctctgcctctcaccgtcgccttcctggtacccgcctctttcggcttcctcctcaccggctatctccaccgtcctcaaacccaagcccagaggtctcggattaaggtgccaggccgcggaggagtcgtcaccgccagcgcggggtaagcctccgctcaaggtgatgatctcgggagcgcccgcgtcgggaaaaggaacccaatgccgcatgattgtcgagaagtatggtttagttcacgtatcaactggtgatcttctgcgagctgaagtatcttctggcacaaaaattggcaagaaagcaaaagaatacatggacaatggaaagcttgttccggatcaagttgtgacggatatggtggtatcacgactgtcacaaccagatgtacaagaaagagggtggcttcttgatggttacccaaggagctttggtcaagcacaaagccttgaaaatctgaaaataagacctgatattttcattgtgctagaagttcctgatgacgttctaattgatagatgtgttggaagacggctggatcctgtgactggcaagatttaccatttaacaaacttccccccggagaatgaggagatttctgtccgacttattacacgttctgacgacacatttgagaaggttaaatcacgccttgatacgtacaagagaaattctgaagctattcttcctacgtactctgatttgcttaatcagattgatggaaactgcctagccgaagttgtttttcaggagatagattccctattacagaagatctgtgtgaacacttcagcgaacaagttgaccaaaacaaatggaaaacgaccagattctgtggatacagtttcaaaaaatgaatg

SEQ ID NO: 11848 - DNA, 1427 bp, Sorghum bicolor
  Clone ID: SORBI-28MAY03-CLUS2997_1
gtcgtgcggcgactcgcccgccccccggttcctcctcctcgagcccgccgccctcccctccgcacggggcagatcccgacgccccttcccttgcgcgcgacgcgacgactccactctccacagtccacacgccaagcgagggccgcatctagatccgcgccgccgagctgactattgcaacccacgccttcttctccccgcgattttcctggcccgggcgccgttgctgctgctgctgctgcgactactactaccacgcggccgcgaggaccgccgcttcgtcctctgctcgcagtcgtagcggaggcaggggcgcgaggagcggacggattgcgatggccgccgcggggaggaatgcgggcgtcctcgcgctcttcgatgtcgacggcactctcacagcgccgcgcaaggtggtgacgccagagatgctagagttcatgaagcagctgcgccagcatgtgactgtgggcgcagtcggcggatccgatcttgtgaagattactgagcagctcggcaatacagttattactgattatgattacgtcttctccgaaaacggcctggttgcacacaaaaatggccaactaattggaactcaaagtttgaaatcgtttgcccgcgtgaacctgccattggctttcggtggcctcactcgtctcgacgttgctcccctgggctgccccattacttgcggttcgtgctttctgttccggtgtcgggtgatccatgtctctcctgttgggacttactggggccgcgaagaacgtgatgaatttgagacggacggtacggtgcggcacactcgtcccagcccggtggccgcgcttcgtcaatgctgtgctctcttcatcccgacgtgttctcctgctgggcgggccacttttgtggttgccccccagggttgcctctgaccttactgcttgtgttgccttgtggcagcgcttgtatgccacctctttgggcttgaggttcaagcaaaaaattgtgcttactccacattgccaaattttgtgctctgagtacaattggcgactataagtgaagaattcatcccccttgcctgtgcccgcttcatgtcgcagggttctcgtgcgtatggcctccggataggtattaagttcccagtgtttcggcagccgcgtccgcctccgctgtggcctggctgcggctctggctcctcctgccgttctgccttccgagcccttccagctgcttctgctccgctcgcctctcacccagttgctgacttcgtggctactcgggcgaactttgtggtgctctgccgggtccgcttgtagtcatgcaatgctcaacccgaaaaagacaagttgtaaaataccccaaaaaagtctgaacagatgtttctcacactgacactcaaaggcaccattgagaagcgatgtcattgtccattcatcttttggagc

SEQ ID NO: 11849 - DNA, 596 bp, Sorghum bicolor
  unsure (1)..(596): unsure at all n locations
  Clone ID: LIB3481-016-P1-K1-G8
cgtctcgaaattccaggtatttcctcaaggttgggacataacttactgcttgagatatcttgaggaatttcaagaaatccatttctggtgggataagacatacaaggtgatatgcctttcttactggtgttcaaatcctataaaactcttgatatgtatcttcttcttaggaccaaaaataatctgtgtgtatatttttacattttttttggttagtaactagcagcttaattctaacatggcctttattttggtaatttatctgactaatttttgttttccattgaacagggtggcaatgactatgagatatttgaatctgaaagaacagttggccatacaggtatgctggctgtatgggaaaggctgatattcttatgcctacgaatttgtaatgtcacctaacaagaatatggacatagcttaaagagagatatttttagttctccttagaaaataaaaataaataggaaacgagagcatcagtgcaaaatcaatgtggtttgcctgaaatttttccgcagaatttaatttaatgttaaatgatacctctntcatcatcatagtagttgcataatacaattgctactcactca

SEQ ID NO: 11850 - DNA, 1135 bp, Sorghum bicolor
  unsure (1)..(1135): unsure at all n locations
  Clone ID: SORBI-28MAY03-CLUS30908_1
gcacgagggacctgggnacaggnaaactacagagttcagcagttggatatggggtggttccttgccttgttaagttgctttcggaaggatcagtggacgccaagtctaaagcagcaacatccttggcccaactatcacagagcacaatggcactgcttaagtcaaaattgccaaggtggctttgtgttccttcatcagctgaatcctactgtatagtccacagctgccagtgcaccgtcaagagcaccttctgcttagtaaaagctggcgccgtcaatcctctggtccagatactagaaggcgaagaacgcggagcagatggagcggtgctggaagcactgggtactcttatgcaggacgagatctgggaaaacgggagcagggtgatagagaaggcgtcaggcatccatgctctgctgaggatcgccgaagctggagagctgagttcccaggacagggcgatatggatgctggagcggatgttccggctcgaagcccacagagagcggtacggcgaaatcacgcaggctttgctcatcgaccttgcccagaaaggagaccctgccctgaaacccatgattggcaagatactggctcaccttgagctgctgcaaacacaatctagctacttttaagcgtggaggtgttgctgcagagatactggccatttgcagttatgcagggcgatgccatttgaccgggcaatgatctgaattctgaacgaaatggtgcaccggattgtgcgccgtgacgtgcgaatcactgtaacttccggctgtcttgtttatagcagattgtatgaatattttgcacttcctccctctgttctttaacatttaacgtttggtcggttcgaaatataaccaatcaacgtcaacgtcaaatgttaaagaacagagtgagtgttggttattttcccccttgtaggtccaacgagttctgcttcaaaaaagcaagagtatgtaggatgtgtagttagccatatgctcctgtaaagttgtaaattggtgacaatggcaaaagctagatggaggatatgttgtcatttgtacagcaaaacagaaagttcagccgttttcattcgcgtgtgaggcgttaatgacaggcgtgactcgtgaacgtgtcatgtctgttc

SEQ ID NO: 11851 - DNA, 1310 bp, Sorghum bicolor
  Clone ID: SORBI-28MAY03-CLUS31106_1
gcacgaggcgaccagtcaacctgaaatcattgcattttatatttaacaagggccgcagctcatggagatgttcggccgttctttggggggctcggagtgcttctcgttgttgctttttctggccatcggccgaccggggtgcatcaaggggccggctttggcctccaggctcctgccgtccagccagtccgggccctctggcgcctgcacaatcagtacactttacctggagcgatgggccctattcaagttagatatgctgatggtgaaagggaacggcatgtttctgtcacgtcgttccttcgggccatcgagcacaaattatttgttgcatccctcaataagcaagcaactccaaaggagattgaagagatatttgccccatatggtcatgttgaagatgtttacattatgagagatggcatgaggcagagcagaggctgtggatttgtcaaattctcatcaaaagagacagcagtggaagcaatgaatgcccttaatgggacttacataatgagggggtgcgagcaaccattagtcattagatttgctgatcctaagaggcctagacctggagaatcgaggggtggccctgcatttggaggtcctggtttcagtcctcgatcggatgcagcacttgttatcaggccaacagccaatcttgatgaatcaaggggccggcatatgcctccagaatcttggcgtccatcaagtccaaggtcaatggcacctaaccaatataataattttggatctgacaatcccttggcactaagttgtggcactgtaacatcagcagataataatgctgcttttcggcctccaatgttccctggaaatggttccttgtcaaatcagacggctgtgcctacttcgtcacacatgggcatgaacacttccattgtacaaggacaccatataggaggccaacagatcccacccttgcaaaagccacctggtccaccacagaatttccctgtacaactgcagaatgctcagccaggacagcctctgcaggggcctattccacagattgggcaacttcaggtcccacaatccgcgggacctgtttcatttggccagaatatttcatctatgcaattacctggccaacctcctgcgtcacagccattgatgcaacagaatgcttctctaggtgctttacaggcccctccatctgtacagtccaattcaatgcaagctgttcctggccagcagcaacttcccaccagtgtcgctccccaagtgctccagcagtcgatgcagcagatgccttcacaagcaccacaggtgctgcttcaacagcaagc

SEQ ID NO: 11852 - DNA, 1611 bp, Sorghum bicolor
  Clone ID: SORBI-28MAY03-CLUS31133_1
gcacgaggagcacgcggttccatttccatacagcggcctggctggctgctttggctgaaagggccgtgcgggaagccgccaaccaccgcgaaagcgccggggagtcgggcgaacgaagcaatccaagcgaacgaaacgaggaagaaaacagccggaaaagagagagagagggccggagaccgccggacacaggtcctcgtcggttcgtcccctccgtgggaccgtttcgccgtctcgtctcgtcccgacctcgccgcccgcccgcccgtccatggaggcgctgtggaagcaggcctccaggctcaaggaccaggtcgctcggcagggtgtgttcaagcagtttggctatgggaattctgataatgcgtttacagacgagtcagaggttaaactgcatcagagattggaaaagctttacttatccactcgtgctgctaaacattttcaaagggacattgttcggggtgtggagggctatatagtcacaggatccaaacaagttgaaatagggaataaattgtctgatgacagccagaaatatggtgttgaaaacacatgtacaagtggtgatactttatccaaagctgctacatacttcggaaaggcacgctcacagatggaaaaggagcgtggcaacatgttgaaagcgtttggcacacaggtggcagagccactgcgggcaatggtaatgggtgcacctttagaggatgccagacatctggcccagagatatgacagaatgaggcaagaagctgaagcacaggttgttgaagtatcaagacggcagaacagggtgagggaatcagctgggaatggagatatgatatctaagttggaagctgctgagtacaagcttgaagaattgaagtcaaacatggtgggattagggagggaagctatcgcagcaatgtcggctgttgagactcagcagcaacggttgaccttacagcgtctcattgcactggttgaggctgagagagcttaccataagagagttctggagatacttgaccagttggaacaagaaatggtgtctgagcgccaaaaaattgaagcacccccgactccagcagctgaaaattatatgccaccaccaccaccaccatcttatgatgaagttaatggagcatttgcatccacttctgttaatgagtcagtccaatctgtcgatttcttcctaggagaggcccttgattccttcaaagctgaaagtgagtttgagcttaccttgtcagctggtgacattgtaattgtccgaaagatctcaagcaatggttgggcagaaggtgaatgcaagggcaaagcaggatggtttcctcatgcttatatcgaaaggcaagagcgtgttctagcaagcaaagttccacatatcttttaggagttttgggctgtcacataacacggttttcatttctattattgggagctggaatagaatcatgttttcatttcctcttagtttccgtgatctatttaccggctgtcatgtacatagattagattttacttcctttttttagtctggagaggattttggatgtaacatatttttgagagaccaattggacactggttgccttaatattgtgaaatagttaaagtacctgtttt

SEQ ID NO: 11853 - DNA, 690 bp, Sorghum bicolor
  Clone ID: SORBI-28MAY03-CLUS31181_1
gcacgcacgaggcataggcgtagcagcaaagcaagcagcggagagacgccggagaggagagcggcgaagaaacatggacaaggagcagctcggcacgctgctccgcgacctcgacgcgctccagcagcgtcccgacgacctcgcctccaccatccatcggatgcgggagcggttactggcgatgatgaatccggccgccggcgccgcttctcgatccaagatcaaggacatgagcgcagaagtggtggacaacaacccctacagcagacttatggcgttgcaacggatgggcgtggtggagaattatgagcgcatcagggactactctgtcgccatcgttggcataggtggtgttggtagtgttgctgctgagatgctcactagatgtggaatcggacgcctgttgctgtatgactatgacacagtcgagttggccaacatgaataggttgttctttcgtccagaacaggttggaatgaccaaaacagatgctgctgtacagacactttctggaataaatcctgatgttgtgttggagagctactcattgaatattactacagtcaaaggtttcgatacatttttagcaagtttaaaagcacagagctctcatgggcgtagcactggagttgatcttgtcttgagttgtgtcgataactatgaagctcgtatggttgtaaaccaggcatg

SEQ ID NO: 11854 - DNA, 1184 bp, Sorghum bicolor
  Clone ID: SORBI-28MAY03-CLUS3109_1
gcggcggccggcccgggagcgctcacacagaaaccacccaccggcgcctcggttttacggccgttccctcaccgccccgcgcgagccaagccatgaagctggaggtcatgcccatgcccaagcagagggtgctggaggcggagcagagggaggaggccatggagatgagcggcctggacctgtggaagcacgagaagcccccaaggatctgccccttgcccccgccgctcccgccggcggcggcggcgtgcgacgagacgacgctcgtgccgccgctcaacttcgccatggtcgacgacggcatcttccgctccggcttcccggatacctccaacttccggttcctcaagaccctcaacctccgctccatcgtgtacctgtgcccggagccgtacccggagacgaacatggaattccttgagaagaacgggatcaggctccaccagttcggaatcgaggggcgcaaggaaccatttgtcaacatacctgatgacaaaataagggaggcgctcaaagttgtcttagacccaagaaaccaacctctgcttattcattgcaagagaggcaagcaccgaactggttgtgtggtcggttgcttgaggaagcttcagaaatggtgcttgtcttcagtcttcgatgagtaccaccgctttgccgctgcaaaagcaaggatcactgaccagagattcatggagctattcgacgtatcaagcttgaagcacctgacaccctcacattgttaaccaaggcgtgtgatcgctttgatcccccttgatccctcaactctagtacatctccaaggctatcttcctgcagctactgaaccgattcagccgtgaataattttggaaccccctagagtccatgaggtagtgatgaaaccattgtaaaacattcgtgcttgagaggtttagtttccccctgcttagcgcactggagagcctgagagccagactgctgtggtcgatttgcgaggggttctgttttttggtagctctcgcgaggaattcgccattgttttcgggtactgaagtatgtactcgagcagcttcgctgaggaggaatgaactactctctaagtgcaaaaggcttgtctcttgttgcatgagtgtggttagagatcctccatattaacaagaggtaggcttaagttagcccaaaacattgaaaaacattaatcttgc

SEQ ID NO: 11855 - DNA, 341 bp, Sorghum bicolor
  unsure (1)..(341): unsure at all n locations
  Clone ID: LIB3478-022-P1-K1-F7
aaatatggtttgctttcggtaacatccatgatacacggcttgtttgccccgagccgacgttgctgatcatatgtcgtcttgtgtatcctcatttagtactagctttccagtggtgattttgggatagccctggtgctttagtaaatgagatttatttgttattgtaaccgacttgcctgaaagggtccataaatcctcttcagtcttcacgtaggcacgcagtgttatctggagaantttcaaaattcacggcgaatcagtagtggtccctttcaacattgctttgattaaacaagccagctgtgctgctgatntaaaacaattcttttctcaatattctc

SEQ ID NO: 11856 - DNA, 952 bp, Sorghum bicolor
  Clone ID: SORBI-28MAY03-CLUS28676_1
gcacgaggccccgcgcggccctacgcgtgctcccgtctgggttttgcggccccgctctgtgctccgccgcccctcgcctcgcccccggtaagttgtttgaatgcatcgaggcggcgcgcgggggatggggtccgtggaggaggacgtggaggagtacagctggcgggaggtggtgctgccgcacctcgtccccgtggtctccgacggcgcgccgccggagctcgagcgggagaccggggagcgccgccgcggcagggacctcctcgtcgccgtcgacttcggcccaaactccaagcacgccttcgactgggcgctcgcgcacatcgcccgcatggccgacacggtccacctcgtccacgccgtgtccagtgtgcataatgagattgtgtatgataaaagtcgggagctgatggaggatttagccgttgaggcattcaagacgttactggtccgaaccaaggccagacttgttgaaggagatgctggaaaagttatttgccgagaagcagatcgactgaagcccgctgctgtcattcttggtacacgtggtagaggccttattcaaagtgtgttgcagggaagtgtcagtgagtattgcttccgcaactgtaaagcagcaccaattatcattgtgcctggcaaagaagctggtgaacagtctgtgctttgaaggaagatgagtaggagagttgttcctgtttcttgtactatcagtttaggtgataaagtgttgtatattggtgttggttagttgtggcctgtgggaacatgtttttaagtgctttgcttgtaatctgaagttctgaaccctctgtgtagcttgactctcaaggaatgtttagaaattgggagagtagcagacaaacatataacacaagaaatgtacttgtattgccattgctgacagaattacttcattagtacagttgctaggaataaagaatcttcagcc

SEQ ID NO: 11857 - DNA, 1097 bp, Sorghum bicolor
  Clone ID: SORBI-28MAY03-CLUS28853_1
gcacgaggcaagtttgataccgaagtctgctagaagctgctctacgcctctaccaggaactcttcagcatggggatctgcctcaagtttgataccgaagtctgctagaacttgtagacctgattgtatccagacatccagttatgtacataacgttaccctatgaggatagaggatatcgtactggcagctatgtgaaaattcctgccgatgtgtgctgctggcatagcaaggatgggcgagtgtgatgtagtgaaacggcactggcaggtgggtatctccaagcaggtgtggggatctacctctgctttgagaataagctctgtggatgctagccttcctgttccggggtccctccttttaccagaggctgattcatatgtccgaagataaggtgaaattccgtaacactgggccggtgcaccccctcacgaggcagcctgttgctgacaggaaaaggtttggcggagttaagtttggagaaatggagcgtgattgcctcctcgcccacgggtcagctgccaacctgcatgagcgcctcttcatgcttagtgacttctcccagatgcacatctgccagacatgcgagcgtgtggccaatgttgtcatgaggtctgttcctggaggcaaaaagatccgtggcccctactgcggcttctgcaagtcttcggagaacatagtgaggatcaatgtgccctatggcgcgaagctgctctaccaggaactcttcagcatggggatctgcctcaagtttgacaccgaagtctgctaggaacttgtagacctgcttgtatccagacatccagttatgtacataaagttagcctatgaggatatcgtactgggctactggcagctatgtgaaaactcgtgccgatgtgtgatgctggcatagcaaaggatgggcgagtctgatggagtgcaacggcactggcaggtgggtttctccaacccgatgtggggatctaccactgctctgctttgaggataaactctgttgaaactagaaaccttgtagcgtttatgtgctgtttcgccctgctcgtctgataaactatgctcaagtgaatgaacacttgtttccctgttcctgccgtg

SEQ ID NO: 11858 - DNA, 972 bp, Sorghum bicolor
  Clone ID: SORBI-28MAY03-CLUS28866_1
gcacgagggccaggctcagggggaagccgcggcggcggacaacgacgacgacgacgggagcaacgaggccgaggcggcgtcgtggctgctcgccgagcccgacaacagccacgaggacagcgccgccgccaccgccgccgacacgttgttcgcggaatcggacgcgtacctcggcgtcgacctggacttcgcccggtgcatggacggcgtcaaggccatcggcgtgccggtcgcgccgcccgagctggacatcgctgccggcagctttttctaccccgaacactccatgaaccacagtttgtcgtcgtcggaggtggcggtggtgccggacgcgcaggcggccggcgtgccggcggtggtgagcagggggaaggagcgggaggcgcggctgatgcggtaccgtgagaagcgcaagaaccgccggttcgacaagaccatccgctacgcgtcccgcaaggcgtacgccgagacgcggccgcgcatcaagggccgcttcgccaagcgctgctccgcggaggccgacgacgacgcgctggagcacgacgaaggcgcgtgcttctcgcccgcggggtcggcgcacgcggcgtcggacggcgtcgtcccgtccttctgttgaggaggaaagaagacggcgaaccccggcagacggcggccttccccgcctgcctgcccggcggcgacgacggctccttagttttgccaactctgtcgactctgaacctttttttttttggtctctcctccctctctcttttgatcgaggggttgctagctctggatctgaaactccgaatgcatgggacgcgagctccgtgtagcatgaataactgtgtagttgttcgatggacgaatcaatggcgttcgcatggaattctcctcttgtaatcctctcggtcctcaccgtcactgtaatccacccttgtatatgaccatctagagttgtttcttttccatggatgcatctgctacctg

SEQ ID NO: 11859 - DNA, 639 bp, Sorghum bicolor
  Clone ID: SORBI-28MAY03-CLUS28883_1
atctggcactgaaggacttctgtttgtcaccacatcagcaaggatagctgctgggaggatttatattaaggaacaggacagtgaagagagtagggtcacatcttctagatcttctaggagatatcttcatggtaaatggggaaaagtttcacaaatgaaggagctgccatctagtctcccaactgtaagcattgctgctatggatgaaatcgacgtatcgatgagctgcgactcgagtttgaatgtcaattctgcacaaaacgtactgcaagagatccgtacacagaccccaccggaaatgttcgatttgacaaagattgtttgtgggacatacattgatgcgagactgatgattcttcgtggtgttaacgggtcggctctgctcttcactagagcaaatccaacgagtgacccctgaggagactccgttccccatgtaacgcgtattcttcctctgtacatgtgtatttctagcagtacattcatctgtaacaagtgtaggtaacgaggtgtgtatgccataggttagaacgttacatattcctttttaaaatgatttgttgcttcaagtaggaagccttggcagggcttgagctgataaatgatggttactccccccattgcttcggtactcctttt

SEQ ID NO: 11860 - DNA, 1413 bp, Sorghum bicolor
  Clone ID: SORBI-28MAY03-CLUS323_1
gcacgagggggcgaaccccaccggatccacaccgccttctctttcctcctccatctctctctcgccggagccagatcaatcaatacacgctgccgtctcatccgatggctcctctcctttccccaccgctgctcgcggacaccggcaccaagttccatgcggcctcagcgccagtctcgtgctccggtagcccacagcgatatgccatcgcagggttggctggggccggaagaagagaccgggactgccgccggaggacgcggggaagaacgagcttgagggtgaaagcggtggcggcggagtcccgcagctcggaggggggaatcgctgaagattactacgctgttcttggcgttatgccagatgcaacgccgaagcagatcaagaaagcatactacaattgcatgaaatcatgtcatcctgatctcagtgggaatgaccctgatatgacaaatttctgcatgttcatcaatgaagtttacacggttcttacagatcccatccagcgagcagtgtatgatgagatacatgggtatgccgcgactgcaaccaatcctttcttggatgacagtgcaccccgggatcacgtgtttgttgatgagtttagctgcataggatgcaagaactgtgctaacgtgtgttctaaggtctttcaaattgaggaagatttcggacgggcaagagtttatgaccaatcaggcagcacagaactgattcaagaagctattgacagttgcccagttgactgcattcattggacttcagctgcgcaactttcgctccttgaggacgaaatgcgcagagtagagagagtaaatgttggattaatgcttgctgggatgggaggctcagttgacgtgtttcggatggcaagctcacgctgggagaaaagacaagccaaagtcctggagaaggtcagaaggcggatgagccaagatgattccagtaagggtggctcatggagtgatatctggggagcaccaacaagatacgagaagaacgaagaggaggcaaaggagagagcaaagcgagcagcggctgcagcgaggaggtggcgagagtactcaaggaaaggcgccgacaagcctcctacattcaaacttccagaggcagtgcccaacaaggagtgagctgaacacaacaatcagagatcttaggaaacattacagggatacttaaccccaatttacttcatgtatgtatagcctaatcatcgtttacagagagctgtagcctgtatagcatttgctctctgtttccacaaggtacacctgtaaatcctctgttagtgatagctcgggtcgattacccatagacttccctcagattccagacgcaaaaacaagtgtacacagaaagtaacaccttgctactcttacaatcataatctatgtcaaatgaatcggttatgtt

SEQ ID NO: 11861 - DNA, 1423 bp, Sorghum bicolor
  Clone ID: SORBI-28MAY03-CLUS32323_1
ctcgcggctcgtggctccattggcgccactggaggacgttcaggtggagaacgatctttctcaaccctttgcttcaccttatctcttcatggaatgacagaagcaccatttagggccatggatgagtttgatgtattcatggatgcggtgagccgcaaaataagcttagacaccctagtagattttgctgtcacacaagggtctcaatggatatttataacccctcatgatatcagcatggtgaaggctggggataggatcaagaagcagcctttggccgccccccgcggctgactgggctcggctcccccggcctcgcccgggggattgtggcctggctgcctcggtctgggccgtgagtgaagtggatgctcttgggggtgttgatggatccatagaacaattaagtgctcgtattagtaaattaaacaagaaatttcagcaagaaagcagaagatatactgagaccattgatgatctgagagcactgcatgacaaaaaaggacagaagatcttgagaaaacaacaaatgtatgcaggttttacggacaaattaaatgcatgtcaaaaggcattggacttgcgatggaagaagttccagagaaatgcgggtcttttgaagcgtcagcttacgtggctgttcaatgagcacctgggaaagaaaggtattagtgggcacatcaatgtagactataagaacgaagttctgtctgttgagctgacaatgcctcaagatgcgtctcgtgataccattagagacactagaggactttcaggtggagaacgatctttctcaaccctttgcttcaccttatctcttcatggaatgacagaagcaccatttagggccatggatgagtttgatgtattcatggatgcagtgagccgcaaaataagcttaaacaccctagtagaatttgctgttgaacaagggtctcaatggatatttataacccctcatgatatcagcatggtaaaggctggggataggatcaagaagcagcaaatggcggcaccccgtggttgacagtgttgagcacccctggtccttgttccttggacatggggttcaatctgctacttttatattttgtttgtagtttgtatatagctcattttgagatgtacctaagcatggcctggtcgtccctgggcagcatcggcagttctgtagttgcattgctgtttggacaaggtccgagtgtgcatgtcttgaaatcgttgggcctttaaatgagcaaactgtggctgtaaatgaacaaattgcggctgcagatgttgattaagttagcccggagcgaactgggattcctgtggagatagagcctttgttgtccgtctcgccaaaaaaaaaatgttgtccagtctaccagattagttccaaacgtatggtgactaatctctttttcaagggtacattaat

SEQ ID NO: 11862 - DNA, 1286 bp, Sorghum bicolor
  Clone ID: SORBI-28MAY03-CLUS3235_1
gcaccggccccagccggggccccgggtccccgccgcggccccgggccccgccgtcgggtcccgcaggcccccgcacctccagctgccgctgctgcgggggcctcgccctcgcccccagccaacgaccgatcggagttggagttggagccctgtgcttctcctgcgggcgccgctgcgcgctgcccccgccgctgccgctgccacgggtgtctccagcacccccaacctcaagctgcagctcctgctggtgcctcgccctcgcaccggaacaacggccacgccgccaaggccggtgcgcctgcgctgcgccctcagcatctgagccgcctgtgcagcctcccatgaccgtcttccatcactaggagccacaggtttcattggccgcagattggttcacaagcttctatcggatgatcacaaggtttgcgtcctgacatgcaccacccacgccgccacagccggttctccgccctccccctgtccgggacccacagcaaccgcgcaggacgcgtccggcgaaatccatagctttgatgaatcaagtccctcgggcaatgactacctagcagaggtgtgccgagaatgggagactacggcatgccaagtaaaccaggaggatgttaggcttgcgcttctccggattggggttgttcttggcagggacggcggtgctctagcaaagatgatcccccgtgcgacggcctttgccggtggtcctcccggcgcgggccgccgctgggttgcctcgagccccccgggtgacctggtcaacctcatctacgaatctctaacgaaccctacatacaaaggtgtaatcaatggaactgcacctaatcctgtgcgtttgtcggagctatgcgaacggctggggcgaatcgtcgggcggccctcctggttgcccgtgccggaattcgcgctcaaagcggtgcttggagaaggcgcttctgtggtgttggaaggacaaaaggttcttccggcgaaggcaaagcatctgggcttctcctacagatacccctatgttgaagacgctctcaaggccattgctcgagacttgtaggttggcgacagtgagcaatttaatttaatttctctctacaaagattaaataggccctttaatttgtgacgacacgcatgcatgcatgtgtatagagtttacactccgatcctccggcctcgtttgcatgcgcgtgttatgtaacacttgctctcttttcccttcttttgacatcatcaaatgttgtactcctagtagtgctcctttttacaagtaagagttcacctttc

SEQ ID NO: 11863 - DNA, 1242 bp, Sorghum bicolor
  Clone ID: SORBI-28MAY03-CLUS32748_1
gaaattattcttctgaactatgcaggtacaatggtttttgcagagaagatggtcttggcagtgtttgggggtctaattgtgctatggatgaccaggaaccttacagatgacatgccagggtggggagctctcttccacaacaaagttggagacggaacagtcaccatcatgatggccacgctactcttcataattccaagccggaagaacaagggcgagaagctgatggactggaacaagtgtaggaagctccagtgggacattatcctcctcctgggggcaggattcgccattgccgcacgaggcagggcgagcgcccgccccgagaccctctctgacgggctcaggttcctgaagggtgcagagacggcggtcattgtacctgtggcctgcatcgtcagtggtgtcatcacggagttcacctctgacgatgcgaccacgacgctggtgctccccctgttcgctgaattggcgaaggcgatcaatgtgcacccagcgttccttatggtttctggagctgttggggctcagctttcctacttgttacctactggatcgccgtcaaacgtaattgggttcagtagtggccacattaccatcaaggatcttgtgatcacaggactgcccctgaaagttgtcgggatcgcagctctgacaatcttgatgccaactctaggatcacaggtttttagcacagacagcaagttctaggagtggaatgcaaattttggactgtttatccctccaagtccagttgtatatatgtacagtactttccttatctcgtatctgtgtcctagtcaaaactatgggggctatacactttgatctgtacaaggttaaactttgagatttgtatatgcaatctctttgtgaaaaatagctatagaaatgcaccttgagagctaaatgaagtcaaagggagagcaatttaaaattcaagaggaacttatcagcccatcctaacatgggaagctcaatcctattccaaaacttcagcatacaaaggatgatggatttgaaacggaggaaatttcagaacaaatgttggaatggtcagtatcctatcaagtacttatatgggtaaataaatactttgtaaagcttgtgggtttcgcactttttgtagcgagccccaaggatatgccatactatcatttctgtactctgaaatgtcactggtgttagactgttgactgttgacctctcaaatccagtaggtcagcctaccgagattgcgtg

SEQ ID NO: 11864 - DNA, 688 bp, Sorghum bicolor
  Clone ID: SORBI-28MAY03-CLUS32760_1
gggaggataagaagtgtaaaggtgaatctagattcccagctcaggtgaggatccgcattaggaagctttgcaagccgttggaagaggattccttcaggccagttttgcaccattatgatggcccaaagtttcgccttgagctctctatcgcggagaccttgtcgctgctagacctatgtgagaaggaaggtatctgagctgttggggaggtggttgccttgtgagcttctagtaaatatcaatcatccttgtatgttttgtggatggtggttggttggcaatgttgtttattttagcgaaagctgctgctggttttgttttccctaccctggatgaaagcaaggacctggtacttggaaggccccctcaaacaagctgtgagcctgtcagtgtactgcgttgtgtctgtcgtcgtcaagaaccaaaccaatcttggaccgactgagagttggagtgtgtatgttttgctgtctatctacatgtgttagtagagtgggtatacctgggcagaatgggtcctcaaaagatggggggcctatctgtatactatgtgtaatggttaagatgcatgcggccctaagtaagggctggtgatgtcgatgctggtgctcctggtgtgtattttgtactctgttgtaccttgaacctcctttgcatttgccttaatgctgctgctttttgcactgcc

SEQ ID NO: 11865 - DNA, 797 bp, Sorghum bicolor
  Clone ID: SORBI-28MAY03-CLUS32886_1
ggatatctatggtgggcatagaatcaatgtggaaccaataggaacactaggtgaagacagtagatcagacataagatcaaggggtgaaagggatattgacaaccaacaagcccttcaagcagaagagaaggatgttgtgtcatctgttgccacagtgttatcggacctctgcggccctggagaatggatgcccatggcaaaactccatacagagcttcttgatcagtttggcaatgtgtggcaccccagcagggtccgaaagtacttaacacaagacgactggtcaccaacagagacgaagggcaggccttggtttggccttctggcgctgctcagaaagtaccctgagcattttgtcatcaacacaagatcgaaaggtagaatgacctctgagttcgtttcgctggtctccttgctctcctagagggaactaggggaccgggaggggcatgctgaggaaataataggcacactggctccccccatttccagtccgtgttcagaaggggccgaggtttcggcagctgttttggaccctgttgtactgtgtcttgtgtgtttgagcagctgtactggtccgtgaccatctctgtaatgtcggcagcagtatatggaagcatgagttttaaagtcttaacctatgctagcaacttaacaacagctcgattaccgtatccagtatgtatatccagtgtcatgattgaaatacttgtaaactaactgttgtctggtgtcctcttctcagcagttttctgacttttggaaactaactatcctagcgtcccccggttgacact

SEQ ID NO: 11866 - DNA, 1322 bp, Sorghum bicolor
  Clone ID: SORBI-28MAY03-CLUS6996_1
gaacccctaataaatctaaagaaaaacctcctttgccggaccttaaaccatctccgggaggaccttaaccatctcaggcgaaatggcggcctccggtgagggcgcgtcgctgccgtctccggcgggcggggaggatgcgcaccgccgccgcgtgagctatttctacgagccgtcgatcggcgactactactacgggcaaggtcacccgatgaagccccaccgcatccgcatggcgcactcgctggtggtccactacggcctccaccgcctcctcgagctctcccgcccctacccggcctctgaggccgacatccgccgcttccactccgacgactacgtcgccttcctcgcgtccgccaccggaaaccccagtgtcctcgacccgcgcgccgttaagcgcttcaacgtcggtgaggactgccccgtgttcgacggtctcttccccttctgccaggcctccgcggggggaagcatcggcgccgccgtcaagctcaaccgcggggatgctgacatcaccgtcaactgggctggcggcctccaccacgccaagaagagcgaggcctccggtttctgctatgtcaacgacatcgtcctcgccatcctcgagctcctcaagttccacaggcgtgtgctatatgtagacattgatgtccatcatggagatggcgtggaggaggccttcttcactacaaaccgagtcatgacagtttcttttcacaagtatggggattttttccctggtactggacatatcactgatgttggggctgccgaggggaagcattatgctctgaatgttcccctgagtgatggtatcgatgatgccacctttcgtgatctgttccaatgcatcattaagaaagttatggaggtttatcagccagacgtggttgtcctccaatgcggagctgactctttggctggagacaggttaggttgcttcaacctgtctgtgaagggtcatgctgactgcctccggtttcttaggtcgtacaatgttcctatgatggttttaggtggtggaggttacaccatcagaaacgttgcacgctgctggtgctatgagaccgcagttgctgttggagttgaacctgataacaagctgccttacaatgattactatgaatactttggccctgattatattcttcatatccaaccaaaaagtgttgaaaaccagaatactacaaaggacttggagaacataaagaacatgatattggagagcctgtcaaagatagaacatgttcccagcactcaattccatgacaggccgtcagaccctgaagctccagaggagaaagaggaggacatggataaga

SEQ ID NO: 11867 - DNA, 1121 bp, Sorghum bicolor
  Clone ID: SORBI-28MAY03-CLUS70154_1
gccagggcgccgcgtcccgggggctgcccgcccgccgaaccggtaaggctcctgagcccgcccccaagttcatcaagtctggtgactctgccatggtcaagatggttccctccaagcccatgtgcgttgaggctttcactgactacccccctctgggccgtttcgccgtccgtgacatgcgacagaccgtcgctgtcggtgtcatcaaggccgtcgagaagccccccgctgcctcccggcaaggtcaccaagtccgctgccaaggccgctaagaagtaagcgacttccttctgaactgacaaccctcggcgggatcttacgactccgatctcgcgcccaagggctgatgttctcacctctgcggccaagtccgctgagatgcaccgcatgcgccctcgccgtgggtctccccgctgacaacgtcggcttcaacgtcaagaacgtctccgtcaaggagatccgtcgtggcaacgttgccggtgactccaagaatgacccccccaagggtgccgagtccttcaacgcccaggtcatcgtcctcaaccaccctggtcaggttggtgctggttacgctcctgtcctcgactgccacaccgcccacattgcttgcaagttctccgagctcctcgagaagattgaccgccgtaccggaaagtctgtcgaggcctctcccaagttcatcaagtctggtgacgccgccatcgtcaagatggttccctccaagcccatgtgcgttgaggccttcactgactaccctcctcttggtcgtttcgccgtccgtgacatgcgtcagaccgtcgccgtcggtgtcatcaagtccgtcgccaaggttgacaaggctggcaaggtcaccaaggccgccgccaaggctaccaagaaataagcgctctctttgggttgcttgtttcccttctttcgtctctaggtatctggttctggggatgtggttgcttcggaaaagttgtgatgacttttgaaatgtgtcaaggataacggtctgggtcatggcgtccttccctagtttccagaatgataaatgaagacatggtgggccctttccgcgaatgcaaaacaaaagggaacgaaaaaaaattagatagaagttaattgatgacttcgac

SEQ ID NO: 11868 - DNA, 846 bp, Sorghum bicolor
  Clone ID: SORBI-28MAY03-CLUS70911_1
cgatcacgcgctgaacgcttcctgatcctatccgtttcacgcttattataactcgtttccccgcctcctccgcgcccccgaaaggcagaaccctcgctccctatcccggtcccctcctcgcggcgtcggtcaaaccctagcacacggtacgcgcagacccgtccgcccgctcccattccccatccccacacatggcggcgctctccgtgcccctacgcgccgcggccgtcgccgccggatcccgcgccgccggggccgaccccgtcaaggtcttgtgcgtgaggagcactggctcggctcactttggctgcgccttcccttccatcacggcctcctcttcggttgcgaggaacatcgagccgctgagggcgatagctacacaggcgccccctgccgtgccacaatattcgagcggggagaagacaaagattggcatcaatgggtttggacggattggcaggttggtcctgcgaattgcaaccagcagagacgatattgaagttgtggctgtgaatgaccctttcgttgatgctaagtacatggcctatatgttcaagtatgactccactcatggcccgttcaaaggttctatccgtgtcgtggatgattcaaccctggagatcaatgggaagaaggtcacaattacaagcaaaagagatcctacagagattccatggggtaactttggggctgaatatgttgttgaatcttctggtgtctttacaacgattgataaagcatcagcacacttaaagggtggcgctaagaaagtggtgatatctgcaccatcagcagatgctcccatgtttgtagttggagttaatgagaaaagctatgatccaaaga

SEQ ID NO: 11869 - DNA, 726 bp, Sorghum bicolor
  unsure (1)..(726): unsure at all n locations
  Clone ID: SORBI-28MAY03-CLUS71332_1
catcaaggataatctttcacatgactctgacttgtataacatcttaagtatggtgtccttggttggtgtcgtggcctatgtcattgccttctccttcggtatgggtgccattccttggatcataatgtccgagatcctcccagttagcatcaagagtcttgcaggaagctttgcgacccttgccaactggttgacatcctttggaataacaatgacagccaacttgctgatcagctggagtgctggaggtacgtttgcctcctacatgattgtgagtgccttcactctcgtgtttgtaatcatttgggtgccagagacgaagggaagaaccctcgaggagatacaatggtcattccgctgagctccagcgtcttcaagatacgaaatggttcttcacgttttgttgctttagatagttttaatatggttattcatctgcaatggttcttcaagttttttgtcgctttagatggagaacattgattcacgtaatcagtgttcttggctattctttcgcagctcaaatcactcgatgaaggccacacattctttctgttcgtaaaaggtcttgtacatgaaattgtatacattgttgttttaactttaccccaataggcctgtaaatgcttgtgcagtaacttatattacttctcttcccttcaacattgtaagataaacgacagttgccaaaataaaatctaaaccttgattccagtattcaattgn

SEQ ID NO: 11870 - DNA, 817 bp, Sorghum bicolor
  Clone ID: SORBI-28MAY03-CLUS3344_1
ccggcccggccccccgcatccacccacacagactcaccccgccgctgccgcatcagccacgccgggacggccgaccgagcccgcgcgccgcctcctcccctcccctgctagtcactccggccggccgcatccactcggcaaaactacgtattccagtagcgcctggactgagttgcgcgccacaagcagatgagcgcgcagagtccctggagcaactagctagcggcaaaggaggaagaaggccatgtgatagtgaatgtgcatgtgctcagaagccagctgaactcgctgcgcctagctagctatcgacgggctgcttagctgcggcggtgagccggtgactcggaggaggcggcgccaacccatggccggaggtacaacggtgtgcgtgaccggcgccggcgggttcatcgcctcgtggctcgtgaagctcctgctctcccgcggctacaccgtgcacggcaccgtccgcgacctcagtgacgagaagacgaaccatctgaagcgcctggagaatgctgccggaaacctcaggattttcaaggctgatctgctggactacgacgccatggcagctgcggtcgtcgggtgccagggagttctccatgtggccactccagtgccttcagagaacctgactgacccagagctacaaatgttgggtcctgctgtcactggtacaactaatgtgctcaaggctgcctctgccgcgaatgtccagcgagtggtggttgtgtcatccatggttgccgttgagatcagccccaaagattggcctgaaggtaagatccgagatgagagctgctggtcagacaaa

SEQ ID NO: 11871 - DNA, 2158 bp, Sorghum bicolor
  Clone ID: SORBI-28MAY03-CLUS33537_1
gcacgaggcacaaatggagggaggctgcccagtagattataatacaataactgaccttttccttcagagaaatatgatacgggaggcaacagcttttctgttggatgttctgaaacccacctggccagagcatgcttttcttcaaaccaaggttttggagataaacttagtgacttacccgaatgttgctgatgccattcttgctaatggtatgttcagtcattatgaccgccctcgtattgctcagctgtgtgaaaaggctggtttgtacttgcgagccctccagcattactcagagttgcctgatatcaagcgtgtcattgtaaatacccatgccattgagccacaggcacttgttgagttctttggcaccttgtcaagagagtgggctttggagtgcatgaaagacctcctactggttaacctgaggggaaatcttcagattgttgtgcaggctgcaaaagaatactctgaacagctaggggttgacgcttgcattaaattatttgagcaattcaaatcttatgagggcctttactttttcttgggatcctatctgagctccagcgaggacccagatatccatttcaagtacatagaagcagctgcaaggactggacagatcaaagaagttgaacgtgtaaccagagagtcaaacttctatgatgctgagaagacaaagaactttttgatggaagcaaaactacctgatgcccgtccactgattaatgtttgtgaccgctttggttttgtgccagatctcactcactatctgtataccaacaacatgcttcgatatatcgaaggctatgttcagaaggtgaatcctgggaatgctccattggtagtggggcaactacttgatgatgagtgccctgaagattttatcaagggtttgattctctctgttcgttctcgcccgccggttgagcctctggttgatgaatgtgagaagaggaaccgcctacgtttgctcactcaattcttggagcacttagtgagtgaaggtagccaagatgtgcatgtccataatgctcttgggaaaatcatcattgacagcaacaacaatcctgagcatttccttactaccaacccattttacgattctcgtgttgtgggcaaatattgtgacaagcgggatcctacacttgccgttgttgcttacagacgtgggcagtgtgatgatgaacttattaatgtcactaacaaaaactcattattcaagctgcaagctaggtatgtggttgagagaatggatggtgatctgtgggataaagttcttcagcctgagaatgaatatagaaggcaactcattgaccaagtggtttcgactgcattacctgagagcaagagccctgagcaagtgtctgctgctgttaaggctttcatgactgctgacctgccacctcgacggattgagcttcttgaaaagattgttcttcagaattctgctttcagtggaaatttcaatctgcagaacctgctcatcttgactgctatcaaggcagatccatccagagtcatggactatgtcaacagactcgataactttgatgggcctgctgttggagaagttgctgttgaagcacaactgtatgaggaggcttttgctatattcaaggcgcgcggcttaaatgtgcaggctgtcaatgttctcttggacaacatccggagcatagaaagagccgaggaatttgcttttcgtgttgaagaagatgctgtttggagccaggttgccaaagcccagttacgtgaaggtctggtcagtgaagcaattgagtccttcattcgcgcagatgatgctgcacacttccttgatgtcatccgtgctgctgaagaagctaatgtgtacgatgatttagtgaagtaccttctgatggtaaggcaaaaagcacgggaacccaaagtcgatggagaactcatctttgcatatgctaagattgacaggctcagtgacattgaggagttcattcttatgccaaatgttgccaaccttcaaaatgtcggtgaccgtctgtatgatgaagaactatatgaagctgcaaagatcatctatgctttcatctcgaactgggctaagctggctgttaccctggttaagctgaagcagttccaaggtgctgtggatgctgctcgcaaggctaacagtgccaaaaca

SEQ ID NO: 11872 - DNA, 973 bp, Sorghum bicolor
  Clone ID: SORBI-28MAY03-CLUS33592_1
ccccctcccggctcccccgccgcctcgccgcccgcccggcctctcccctgctagcccacacacccgcagaaatcacagcgggaggagccgcaaaaatctccatgcgcgccgcgctggccctggctcgcttgcttctccctccaataattcccttccgcctctcctccctcccgtcctctcacaagctagcccacacacccgcagaaatcacagcgggaggagcagcaaaaatctccatgctcaccacgctgggcctagatctccggcgagccggcctcgcgcggtagcccgatccgctccccgatccgctcccccgcccctggcgccgcgtcctcccgctcccgcgccggctcggccccgcccgctgctgcggcgccggcgcccccccccggctgcccccccgcttccccagcctcgagtcgctcgcgctcaaggggaggccccgcgccgccatgtacggcctcatccccgaggacttcggcgcctacgccgcgccctgggtcgcccagctcgccgcgccgctcgactgcctcaaggcgctccacctgcgccgcatgaccgtcaccgacgaggacatcgccgtgctcgtccgcgcgcgcggctacatgctacaggtgctcaagctcgacaagtgctccggcttctcaaccgacgccctccgcctcgtcgcccgctcctgcagatctctgagaactttgttcctggaagaatgtacaattgccgatgaagggagtgaatggctccatgaactcgctgtcaacaattctgttctggtgacactgaacttctacatgacagatctcagagtggagcctgctgatctggaacttcttgcaaagaactgtaaatcattgatttctttgaagatgagtgagtgtgatctttcagatctgattggttttctccaaacctccaaaggattgcaagaattcgctggaggtgcattttctgaagttggagagtacaccaaata

SEQ ID NO: 11873 - DNA, 1270 bp, Sorghum bicolor
  Clone ID: SORBI-28MAY03-CLUS33632_1
aacattcgtgcctgcctgcctcctcggccccggcctcccccccccccccgccccgccccccccccccccctcgcgccccccccgcccccccgcgagcccggccgccttccccgcgccccgtccccgccgccggtcgccgatgagctcgaagggctgggacgctgacccgtgttttatggggagaggatgccagagctgcgaagcagtactcgtcaagcacgcctgaggtctaagaagctcgacgatctgcagacagcagagccgcctgcgaaaccggcgccacctgctccgcagagggcagcaaagcgtgctcctacacgtgctgctaggggcagaaagggtgctgctgggaaaggagtgcctcccgcaccaaagcctagaagaaagggggttcagattgccgacttagaagctgatccagcttgtgaagaaccccctaaagctgtcaagaaactggaagttgcccctaaagctgtcaagggactgcaagctgctgcacccaagaaccttcctttgaagaaggtacccgaggttggtgttctgaaaatggatggtgaaagtgcggagaagattgttggggctgaagatgaatcaacaactacacctgtgccagagagggttcaagtaggtaattctccagagtacataactgacaggaagttaggtaaaggtggttttggtcaggtctatgttggccgaagggtttctggtgggaatgcgcgcgcgggtcctgatgcatatgaggttgcattgaaattcgagcatcggaacagtaaaggatgcaattatggccccccatacgagtggcaggtttataacactctcaatggttgctatggcataccatcggtccactacaagggtcgtcagggcgactactatatacttgtaatggatatgcttggtcccagcctttgggacgtgtggaattcaatggggcagacgatgtctgcaaatatggctgcttgcattgctgtagaggccatatcgattcttgagaagctccattctaaagggtttgtgcatggtgatgtgaaaccagagaattttctgcttggtcagcctggatctcctgatgataagaaactttaccttatagatcttggtttagcatccaagtggagagagagtcatggtcatcatgttgattatgatcaacgtcccgatatctttaggggaacaattagatatgcgagtgtccatgctcatttggggcgcaccggaagtaggagggatgatttagagtcactggcgtacacccttattttcc

SEQ ID NO: 11874 - DNA, 680 bp, Sorghum bicolor
  Clone ID: SORBI-28MAY03-CLUS33777_1
gggggcaccagtcttggaagagaagaagatgggcgtgaaaggcgtcgggaggaagacgaccgacgagtcggagcacatctcctggagggacggtgtgatagtcccctgcggcaagctggtgccgtcggcgaacaaggacggcccgctcgagtacaacgagtatgccgtgtacgaccccaagcaggtgagcatctgcttcctggttggggtgaagtacgaggagcagaacatggaggtggtgccggacgaggagtgaagtcgtattcgtggcgtgcctaggagacgatggtcgtgcgacccattttgcaaccctgtagtgttagtgtgatctggcttttgtgctgtagtactagtagttgttagtggggagaggtagcggcgatgcgttgggtggaaatgtgaggtgcctgtgtctcattttgggctgcctcctggtttagccatcgccgtggctgtgtgtgtggtgtactttgtagtgtagttggttagtgctagtgaccctagctaaaaagccccttggatggctggacgtgctgccgtgtggctgcggctgcagactgcagtagtatgtaaatatttgtgcgtgtcggatgttattagcagttagcacgaatctggtttgccgctggctcgacatggttctgctgggtgctctcgagcaggattatgttccataggct

SEQ ID NO: 11875 - DNA, 685 bp, Sorghum bicolor
  Clone ID: SORBI-28MAY03-CLUS33790_1
aagtcatcaggaaattgtcagaggaggtgttctcaattgttggacgggatccacttattgaggtggccattgctctagaaaaggcagcactgtcagatgaatattttgtcaagaggaagctatatccaaacgtggacttctactctgggttaatttatagggcgatgggattccctacagaatttttccctgtgctgtttgccattcctcgcatggctggctggctagcacattggaaagagtcactcgatgatcccgacactaagattatgaggccccaacaggtatacaccggcgcctggctgaggcattataccccagtcagagaacgagtgctgccaagccagagtgaggaactcggccagattgccacctcaaacgcaactaggcgccgccgtgctggttctgccctgtagaatagctgctgcatataaacacaccggcatatactcaataaacagcgaccacttttgtgcttggaaaggccacaggtgcttagctttttggagttgtaggccttctgttgtcaagtatataggcaataatgccgtgagaacaccacaccgttacaatgtaaaactgttatgggtcatgactctgctggtgtacaccccttgcgttctctatgacttttcccttaagatgaatgaaaaggtacgatcaagttcctgggtcttcttgcctt

SEQ ID NO: 11876 - DNA, 1021 bp, Sorghum bicolor
  Clone ID: SORBI-28MAY03-CLUS31593_1
ctctcgctcgcgcgcgggggcgctcgctgccgcccgcctcccgcccgcgcgccccccacgctctcccccccccccccccccctcccgcccgctcggcctcccccccccccccccccccgcccggccgcccgccgaccgcccgcgcccgcccccccccccccccccccccccccccccccccccccccccccccctccccccccccccccccctccctccgtcctgcccgcccgccttcccccccctcccccgccgcccgcgcgcggggggagggggggccgccccccgcccgtcgagcggcggccgccgccgtcccgcccgcgtggggagggggagccggccggggctccctggcgtcggacttccatttcggggggcctgtgcggcgcgctgtgcaagtcttggtgctccagggcttcccaccaaggaggattgaagcaagattagggagttattcaaaacttgaaagtaaagggtttccagtcttccagttaaatgaccaaatgacctgtataatgtcagcaagcaagcaaaataaacgacagacaaattgtaccaactcagaacagtgcaggccggggaagaaaacaaaatttgactcatctcattgtctagtaagtttgaagcctcatatcggtcttaaatgggaccaatatctgaggaaagttgtgccagagaaggagcaagttggaattttgtggtcagatatggcccctttcatggaaagccaaaaacactgttcaggccttgctgatgttacatatgttcctccagagactttctctcttaagagccttagaggtgtgctatcctatgaggtatggtctacatttcttacagaagccgagagaaaatttctcatacaatttcttccaagtgagactgatgcagaagaaaatgtatattcgttgcttacgggaaaaaatcatcactttggggatcctttcctcagctggtcatcttctctttgctatggtgatattcatcctgatgcactacttaacaaggagaagcacataaa

SEQ ID NO: 11877 - DNA, 775 bp, Sorghum bicolor
  Clone ID: SORBI-28MAY03-CLUS3141_1
ttccccacatccatcgtcaaaaggagaagagagagagagagagaggagcaaaccctagctccagcttgcctcctactccgccatcatccagatccggccggtgcgtgcgatggcgctgcgcgttctggcccgtaagctgaggttccctgccacgtccgttctccagcgggcgtcgacccccgtggtgtcgccgccggcgagctcccgacttctcacctcccactcctctcagagtggaggagccaagagagcagtgaatgagaccaggaatgctcgaccaaggtggaggaattacaagaaactggagaagcgttttttgcgcgatatggagaaggacatgaagaatttcaaggagctttcattagctatggacaacttgccaaggaatgttgtactcacttcctctgttggtcttgcggttttgacaaccggctgggcgtatgccattggtgttttcgattggaacagaatgggggacagtgaaccttcggatcaacaaggtgttgtgtagacgcaccccatgaataatctatgagacttttatatttatgtaagagaaatgaaatggtgcggacaaggagaagactgtatgcttgttaagtaaggccttgtttagatccaaaattttttctgtttttgacactagcaatttcgtttttatttgacaaaccttgtccaatcatggagtaactagactcaaaaatttaattggatgtttgactgtttggtttgtggaatgaactatctatctcaaaaaaaaaaaaaaaaagcccct

SEQ ID NO: 11878 - DNA, 404 bp, Sorghum bicolor
  unsure (1)..(404): unsure at all n locations
  Clone ID: LIB3481-018-P1-K1-F11
cgtccggcgatatggagaaggacatgaagaatttcaaggagctttcattagctatggacaacttgccaaggaatgttgtactcacttcctctgttggtcttgcggttttgacaaccggctgggcgtatgccattggtgttttcgattggaacagaatgggggacaatgaaccttcggcttaacaaggtgttgcgtagatgcacctcatgaataatctatgagacttttatgtttatgtaagaggaatggaatggtgcggacaaggagaagactgtatgcttgttaagtaatttattagnttgatgtttgactgtttggtttgtggtatgaagcgatccatcacaatctcactacttagtttttttgtgtttggtttgtggaatagaataagttgatctgttgcc

SEQ ID NO: 11879 - DNA, 1221 bp, Sorghum bicolor
  Clone ID: SORBI-28MAY03-CLUS32105_1
gcacgagggttacaaacgcttctacagcacgtcgctcttggaagcatctgatttcttaaagaatgattgcctagtgatgaactgcacagtaggtgttgtcaagaaccgtatggaaacaccaaaggacatccagattcatgttccacgatcagacatgggccactgcttcaaggagctcctcagccgcggcattggatgtgacataaccttcgaagtgcgcgacgagaaagtcagggcacacaagtggattcttgctgctcgctccccagtatttaaagcccagttctttggtcctattggaaagcctgacctgcacacggttgtcgtggaggatgtggaacctgtcgtcttcaaggcaatggtgaacttcatgtacactgatgaactccccagcatttctgagctagctggatctgcctcaacatggacatcaacagtagtagtacagcatttgttggcagcagctgatagatatggactggaccgtcttcgtatcctgtgtgaatcaaagctatgtgatgaactgactcctgaaactgtcgcaacaaccttagcccttgctgaacaacaccattgcgctgagctgaagtctgcctgtctaaggtttgctgctgtgcgagaaaatttgggagctgttatggggacggaaggctttgattacttggaagagacatgcccgtccctactatccgacttgttagctactgtggcagaagtggacgatgatcctgcatcccttgaccgaaaaaggggagtttgcggtaaccaagtcttggctccagtggaaagtgtcgaggctactgaaaggcgcacccggaggaggctttagctgggctggttagattcaggccgtcaactaatgtagctttaagagtcgtgtgaagtgccctagttgacaacgatttgatttggactatagtagctgtgaataatttcgtatctcgacgattttgttttgcagcagtagaagttgtaaattttttattagcatggaaaatttatgtttctggttgtcagtcgtgtgcggctatgaaatgtgtcgggcaaaatgaatgctaacatcagttagcttaggggcactagctgcaccgcgatgcagccagaatgacaattgaaaccattgaatgtggtagattgtttctactaaatcaatgtatattggcattcaaaactctacatatatttggatgtaaaaaaaaaatgctctgctcatcctgcatg

SEQ ID NO: 11880 - DNA, 1865 bp, Sorghum bicolor
  Clone ID: SORBI-28MAY03-CLUS32121_1
gcacgaggccgacgcgtcgtcgaccgaggtggcggggtgccgtgtagcagagcaggactgcccgccgggcgtcttgggcagaagataatctgagaagccgtcggcccgtcgccctccctctcaactccgctcctcgctcggggcccaacttcccatcgccgcattcttcgcctcccaccacagcagcttgagctcctcaccaccgcccctccctccacttccaccgctgtccttgccctcctcgttaccgtcagggtggacgcatcctggatctggcgagcgcgtcttccttgcgcacttgatgaccggcgtcggcgccctccaagcagctccgatttgacgagaccgtcgacgccggtcgaaccaagacggagacaggccatcaatacccagtagaatagcaaggctgggcggctggcggcgtccaggtttccagagttccagctgagggggagatagaccggcgcggcagcccacgcgggcggggcccgccgcgccccggccccgcacccgcggcggggctcccctgggtccgcctgccgcggtccctcatcccagtgatcaggcttaatctgggtggggaaagtttggaaagatcaattcggtggagaagcacgattcaacagggaggagcttcaatccggtgggcagaatttcgaaatcagttacgtttcctcagatggcatgactctcgtgtccccagttccgcgctgatctgtagctgtcttgccggcgatttcgaaggagggtatggatctgggaccgtcgctgccggacgacgtgctcgcgggcgtcctccgtcgcctcgcgccacgcggcctcgccgcgtcccgctgcgtctgcaaggcgtggcgacgtgtcgtcgacgaccgctgcctgctgcgcgcggacctcctgccgctctcgctgggcggcatcttcctcaacttgcatgacctacgtttcacgcagttcctctctcgccccacgacgggcgccgtagtctccggccggcttgactacacggtgcccgaggctcgctttcaaacaatacgtaccaagcaattaggatgcccacagaagatgaattttatctgggaaaatcaatcaatgggatatactgtgcatccttatttcagggatcacaacttcaggtttggttccttaacgaccaatgtgttcatggtcagacagagtgggtgttgaagcatggcagagacatcttccccttcctgccaaatctgaactatgacgaacagtgtgatggtccttggatcttacaagatttttactattgccgacaagaagaacataatgcttgtggtgaagcttatgatgtggtgtacaacaacgaagcaatacttgaagagaaatttgtgtgggactctgacaatgataatgttctggaaccaggaagtaggtgcaaggattcttatatcaattttcttggatttcatccgtacaaagaggttgtcttcttgagtgataaattcgaccgggtgttagcctataattggagtagctcaagggttcaagatttgggcaaggttttcccaaaattctatatagactggaatctccatttccaccatacactggtagtagcgtctttcccatacactccctgctggttgggagagctccctgagaaactgaatttagaagctcagctggaagattagaatatgttcccttgcaagctatttgaagatcctgtttgttcgtttgatatttgtgtacacacattgctccctgcaaaactaaatttatatatctcattatctccagtttaaattatcttattttccttgcctctgagtacaactgatcttagtttgtctttctgcatggatcactgctgaatgaacttggtttctttttggttc

SEQ ID NO: 11881 - DNA, 1876 bp, Sorghum bicolor
  Clone ID: SORBI-28MAY03-CLUS34069_1
aagcgacgcccgccgaacgaatttcccctccaaaaacgagctccagagccacaacgcccgaattcgccctcgcgcgctgtctcgcagcgcgcgcgccccgtccctcctgcccgtttggagtccgctcggcggcgggacggaccggatcctgctccatggcggagggcttcgggcggtgggagtcggatccgctcttccccgccgccgagtgcgtgcaggactccgccgacagaatggagggtgtctaccgcctgcttttgcatgaaaggaaagttatgcaggatggtacttccgatgcaaagtttcatgctccaatacaatacgagagagatgtgattactgctcttggaactaccaaatggcagctggagcaatttgagagggaggtgaatgcagctgcattctctgacaagtcaaagtcaagagaaaatgcgatcttaaagtttaggcaattcattagagctatagcggaccagatttctcaggtggaagaaagcttgaagagtcttaggctaggttctagtagaactccaaaacactcgagcgaatatgatggagatgggctggcatcctttctttctggttccaccaaggatgaccatgcatatcaatatcattccactggtacagatgaaattgtggagcttaagctcgataatgttcctttagtaaatggctatcattctacccaagaacatacaacatacgaacacaggaattcagataaagatgtggaaggagcagggagtgcatgtgaaggggatcatagcaatagcaatatgtatgttttggatgctgatgattctataagttggaggcttttttgcaaaaacaaactgagcagacaataccgtagttttataagaaacatatggtttacaaaacgaggtcgtgaaagctttacgaagaggaggaaagatggagaagatatggatagcttgagaaatggaaagctaccttctttcaatctacctcaatctgaaagggttatgtatttctggcctgaggtcattaagaggagaatatgtagatctgggtattttacagatcataatcgtcctcaaatccgtttagtgacagcagtactgattgcacttgctgttctctgcttgctggtatcccatgtgaaatgacgatcctgtgaatctagttttggttcacgttgtgttatatattgccatagtccacggtgtactcatactgatcatgcttgtgctgtgtcatggattctggaggaccatcattgtttggaagcatttcaatgttgcactccaaattgtcatgccctgcagatggaggtttggaaacggccttttgcggttgacagctttggttgctgtcattggcatgacctgtcaccagcacctctcaaagaaaattcactaatccctgtatttgttcagagcctccacatgttgtaacagtttttgctcacacatctgatataactcagaattgccagatcagtgagactggattcggagtgtagaattcctggggtgcggttaccttgtgttaatatattgttatgaaagtgaaagccgaattgaatagaaatgaatcagtgtttgtaactatagtttgtaactgctcctatgtcatgtacgggcgcgcatactcgcgccgccgcagggcgcgcgacgtccgtcgcgcagcagagcgcgctgagcgcctgggtcagcaaggaaacaggctaggtggctaggattatagggaataaaagatttagttggttgtttccctttcttagttggttgctttcctttcttagtcctaaagtttaggaaggtttgttgggactaaaggctatataagcctgtgtaatcagaccttgaggattatcaaagaattatcaatcttccctacctcttctcct

SEQ ID NO: 11882 - DNA, 1207 bp, Sorghum bicolor
  unsure (1)..(1207): unsure at all n locations
  Clone ID: SORBI-28MAY03-CLUS34081_1
gcacgaggagcgatcaggcagccatggctaccaaagccaaatcaagctcctcgtcatgcctctccttcctcaaggacgccctgctccttccatccaagaaccccaagctcttcgtccctgtcttcttcctggtaaccgcttccctcctccttctccaaatcaccaatgtcttctgcatccagccgcgcacagccgacatactgcaccagctcgacgagatcaagaacatggatccctcaagctccgattacgccaaactcatggcggagatcataaaggaaaccagggagcttgtcgtcatctccatcacgctcctaatcatcagctttgcagaaagcttcgccagacagatcattgccttcttcgccacctccaccacctacgccggcgaccgctactcgctccctgagctcttcaccgaggtgatcatgaaggggcgtcgcgtgaggggccctctaataaccgtggccatggtgggcgtcctcaacgtcgcgtgcatgctcctcctcgtcgcgctgctgcagctcgcgatgcgccacatggggggtgctctacatggcggtcctcttcgtgctcccgttcctcgcgttcctctacctcaacgtcgtcttcttcgtcgccgtcgccgcgtcggtggccgacgcggaccaccgcggcgtgagcgcgctcaggctggcgtggcggttgatgacgaaggtgtggaggaaagaaggctgcgtgctggtcgtcgtggtccacttggtggcgacggttccgtccccgctctacgcggtggcgctcgcgtgcttgaagaagagcatgcccatgggactggctctgctctccgtgtacacgctgctgggcggcttggtgcagctcttctactacgccgcagcgatggtgtactactaccaagccatggagagcaaggagaaggaggtgatggcccatgatgactacgtcaagatcccgaccggtgaagcaacaactgtgtgattgattgttgaatggtaggagtaataaattttctgccaggtaatgaataatatttgttcaatagaaatggataatactatacatgtatggtttgtgctgagacttgtatgcaaagactactcattttgcaaatttttttaaaaaaatccaaagactataatgtacaccttgggtgaaaagggttagtggcaagtgagctatgtatatataataatttttgtgcgttttncta

SEQ ID NO: 11883 - DNA, 685 bp, Sorghum bicolor
  unsure (1)..(685): unsure at all n locations
  Clone ID: SORBI-28MAY03-CLUS3409_1
aaagggaaagaagtatatgtgggttcgccttgattccttgagaagggtgaaagaagctgtaaaggaggttggtgctgggctagagtgtggtattggggtagatgacttcgatgaatggcaggaaggtgacatcgtagaggcattcaatactgtgaagaaggcaagaacactcgaggaggcctctgcaaccgtgactgccgcgctcaaggatgcaggtgtccagctgtagaattggcaacgctgataagaaagaagtggtttaacagttgcagcagcagcctgtggccaacaatttttttggcaacgaatctggagggcactggtcgaagttctgaagaataacaagcatgttgctgtacagacttaacatatatgaagatcaattctacagcaccggtgtctgagctcgacgaccatctcgcgcctgccagagctgcatctgctgctgaaagttgatgtacatagagaagatgggatcagctgttttaccctttttagtttgcctctaatagtgacaggtagataacgggtgtctagttttgcaactattgattttattttacacaagatgtaactgcaacggcgacaccgccgccattgttgaaccgtcattcatactcttcatgatagatatatagagttaatagaaatgggaacgaggttgccctactnaatttgttactcc

SEQ ID NO: 11884 - DNA, 876 bp, Sorghum bicolor
  Clone ID: SORBI-28MAY03-CLUS34251_1
gcacgaggcacgcacgcgccaacaacaacctgatgctagtttgcgctttgcccggccccggtgaggggcccgggtatgcctgcacctgccagtgtgcaacgaacacattatcctttgttttgctggcagatggtagcaggcataaaagaaccgagaggcgtaaggcagagtcagccatctgtttgatattgtcagcctgtgcgcactctcggtgtagttgctccctgcatactgagtgcaggaggggcactttatactctgttctccttcaagcagaagccactcgaggtcaacccctctagtccaatccacaagaagctgagaggtgaagcatgggctgtggggccacctgcatgcccctttcagcttcattctcagcgctgttgtttgctcctcatagattgagatgctggaggacatcttgccctcattgaatgggctctgttgtcaaaggacttgtgatgatgatgaaagattgggattgtggagtgagcgaacgatcagtgagtaaaagattgggacggtccagtatgtgaacaggcgacagggatgtggcttttagccccattgcccatgggatggttcccggttgagctgaggtggcatgaagacgatgttgggtcttgctttacctagtgcaggcgtggcaccattcttggtcaggtttagaagaggaggcatctgtcgcagctgctactcacgtcgctggtgttctaaagttatttctagtcagtgctgtgttgtaaatcaatccgtgttagtttgagtgaccaaaccagtttcttgtaccatgtgcatgacaagcaacgagtctagttaagatgatgacgaatcatgtatacctcagtgacaggtttactacagtacagtgttcgg

SEQ ID NO: 11885 - DNA, 928 bp, Sorghum bicolor
  Clone ID: SORBI-28MAY03-CLUS34410_1
gcacgaggcgttctcgtcggcgccgtccctcccacgctgccctctgccacctcctccttgcgcggccggcgctcctctgcgacgcagttcgcctccggagctcgatcctgtcgccctctcctccgccgcctcctcccccgccgccagatgttacatgcttttctagtacctcggagtaattaacatcgattacacagtcatggaagagcagcaagtcaagccattggatctgccacccactagtttggacaaccaggattcagctgcaactcctgttaccagtgcagaccctgttcgtccggctgcaactgattctcccagtaaggttgctggtgccgctcctgctgctgtttcttcacctaccgctgctcctgcagaagatgctgcagggcgtgaggcaccagcatccgtgttttctgcatctggtttatcctcctgggctaagaacctcaaaattccccagccttcatcaggtcaagaatcacctactggaaagaatacctttgcccgtttaacaagtggccttggactgcgtatgtctccaaaagcgccacagcaagatgagggtgctgaaggaagcacatccccaacaacaggacagcctggggtttttggttctttgacaaaaggcattgtggattcctctaagaatgctgtaaaggcagtgcaagtcaaggctcgccacatggtctcacagaataaaagacgataccaggaaggaggatttgatttagacatgacatatattactgagaacataattgctatgggttttcctgctggtgatttgagttcacggctttttgggatattttgagggtttctaccgcaaccacatggaggaagtcatcaggttctttgaaatgcaccataaggggaagtataaggtgtacaatctttgttctgaaaggctatatgatgcatctct

SEQ ID NO: 11886 - DNA, 1198 bp, Sorghum bicolor
  Clone ID: SORBI-28MAY03-CLUS34342_1
tactcggcaattgcagcagcctcctctcctcccctctcctctcctccctgcctggttcttgcttgcagttcttgaaccaaatccacaccgccggcgcgcttagcattggggctagctagggggccgatcgatatggcggccttaggggcgaagatggagcggctgtcgtcgatcgacgcgcagctgcggatgctggtgccggggaaggtctcggaggacgacaagctcatcgagtacgacgcgctcctcctcgaccgcttcctcgacatcctccaggacctccacggcgacgacctcaaggagatggttcaagaatgctatgaggtagctgctgagtatgaaacaaaacatgacttgcaaaagcttgatgaactcgggaagatgataacaagcttggatcctggggactctattgtgatcgccaagtctttctcgcacatgcttaacttggccaacttggctgaggaagtccagatagcatacaggaggagaatcaagctcaagaagggagactttgctgatgagaactcggcaatcacagaatctgacattgaggaaacacttaagaggcttgttgttgacctgaagaagtcacccgcgggggtatttgatgccctcaagagccagactgttgatctggttttgactgcacatccaacacagtctgtgaggaggtcactgctccagaaacactcgaggatacgaaactgtttggttcaactctactcaaaagatatcactccagatgataagcaggaacttgatgaggctctgcagagagagatccaagctgcctttagaactgatgagatccgaagaacgcagcccactccccaagatgaaatgcgtgctggtatgagctacttccatgaaacaatttggaagggtgttccaaagttcttgcgccgagttgatactgcattgaagaacattgggattaacgagcgtgttccttacaatgcacctcttattcagttctcttcttggatgggaggagatcgtgatggaaatccaagagtgacaccagaggttaccagggatgtctgcttgcttgccaggatgatggcatcgaacttgtactgctctcagattgaggatctcatgtttgagttgtctatgtggcgatgcagtgatgagctgcgcatgcgagctgatgagctgcatcgctccactaagaaagatgccaagcattacatag

SEQ ID NO: 11887 - DNA, 966 bp, Sorghum bicolor
  Clone ID: SORBI-28MAY03-CLUS33057_1
ctcctcttccctcttccgcctcctctctctctctctctctctctcggctctcgctctcagacgactgctgggcagccgccgccctaggccaggtgctgaggctttccctggtctcttcgccgtcgacgagcacccaccagtaggtacttgattggacgagccatggacagcctgtggcatctgggggacgagctccgtgggcaaccgaaggtggtggaggaccgccagtggtcgctcatgacgtccaagctggcggagatcaccaggtccaagggcgagaggatgaacgacctcgactacgccaggatgaacaccgtccctgacgccaagcagtgggacaagacgtccttccagcatcatgaccagagcaggatggaccacatcaatctcggcctcatgaacctggatctcaagatgaacgatctcaagatgaacgaggcccccaccgccatgaagctccccttccacaacatgccctataacatgaacccaatgtaccccaaggggagcaatgccaatgtcaatgtcaatgcgttcaagatgaatgttggggtgaacaagtactccaatagtcctaacgggaaagacgccaatgggaaaaacaatggcggcagcaacaacaatggaggaaacagcaatgggagcgcaaacggcaattctgcagttgacaagcgcttcaagacattgccaacaagtgagatgctaccgaggaatgaagtccttggtggatacatctttgtctgcaacaacgataccatgcaggaggatctcaagaggcagctttttggattgccagcaagatatcgtgattcagtccgagcaattactcctggcctgcctcttttcctctataactacacaacccaccagcttcatggggtatttgaggctgccagctttggtgggtctaatatcgatcccactgcatgggaggataagaagtgtaaaggtgaatctagattccca

SEQ ID NO: 11888 - DNA, 653 bp, Sorghum bicolor
  Clone ID: SORBI-28MAY03-CLUS33142_1
gcacgaggccgccgttgggcctacggccttcggcgtccccaataaggcatagctccggcctccgggaatccccatcaacctccacttcctcctccactccccggccccggccacggccactgatcgcggcggtgagcagaacatgctctttctacgtcttgctgaagttttaagttatattgatattcctgttgtcaagtctgaactcaaacctcagctaactggttagtggtggcatgtctgccaaggtgccaaggtgcttaggagttacttccagtggcatggcggattgggcctctattcaaactgatattcttggcataataataaagaagcttccaatccctgattacattagatttcgtgctgtgtgcacatcttggaacaatgtctgcaaggatgtgtcataccgtccaagggtggacccatggctgatgctccccccagatcagaatcctcttggtgctcagttcttttgcattcctgaaagaaagaatcaaagtatccgtctccctagcactgcctcactgtttgaatctgtctgggctccagttggttcttccaatggatggcttatctacttcagtcgaacttatggaaccatgcagctggttaaccctatcagtggcaaacacattcagctgcccccgtta

SEQ ID NO: 11889 - DNA, 687 bp, Sorghum bicolor
  Clone ID: SORBI-28MAY03-CLUS33233_1
gcacgaggctctccccacccctcctctgcctttccccatcgtctacacctcatcacaatcacagagagcgagaaggggagagagtgtgagaggggaagagagagagagggagggagacggggggctagggtttcgtgctcacccacgcgacacgcatcgaatccgagccggatccggggggtgcgccgagtcgccggcggcccggcggtgcctgggctgtgattcccttgcaatggcatctgaaactgatgacaaagctaagatggagagtttgacatctgctgcagcctttgtggagggtggcattcaggacgcatgtgatgatgcatgcagcatttgccttgaggctttctgtgagagtgacccttctgcattgactggctgcaaacatgagttccatctccaatgcattcttgaatggtgtcagagaagttcacaatgcccaatgtgttggcagtctattagcatgaaggatcctaccagtcaggagcttcttgaggcagtagagcgtgagaggaatataagaaccaatcaaactcgaaacacgactatatttcatcatcctgctcttggggattttgagctgcagcatctgcctgttggtaatgatgctgagcttgaagagcgtatattacagcatctagctgctgctgctgcaatgggaagggcacaccatcttggaaggag

SEQ ID NO: 11890 - DNA, 1210 bp, Sorghum bicolor
  Clone ID: SORBI-28MAY03-CLUS33390_1
cgcgaattctattgcttcctaatggcacagacatttatggaagtaaatacaaaggcatatggatctctctgactgttctttcaagggctttgtgtgggaactatgtcaattttggtgtatttgagctgtatggtgacagagcgcttgctgatgcccttgatatatctctgaagatgaccctctcagttccattgtctgatatattggcattcagaaagctgtcgaaggcgtactttgggtatatggaagttctgttcaacaaccatatcaagtttgttctcaatttggacacacacacattcatacatattgtcagttcactcgaatctggcttgaaaggtctagatacagggatatcaacacagtgcgcttctgccatcgacagcctggcggccttttactttaacaacattacatctggtgactcacctccgtcaccagcttcagtaaatctggcacggcatattggagagtgccccaatttgtttcctcagatactgaagacactttttgagatcatgctctttgaggatgctggtaatcaatggagtctgagtcgaccaatattgagcctgataatgaccagtgaacagatgttcactgaactcagagcacacatattagcatcacagactgtggaccagcaacaacgcctttcacagtgcttcgataagctgatgacggatgtcaacaggaacttggaacctaagaatcgcgacagattcactcaaaacctgacagcatttagacgtgatttccgactgaagtaatagctccttggaactagctatcagtttgaaggagatcctgcatgatgtaaatactccagttaccttctttttaggaactaccattctgcgggttgagaatggtttgccttggattggctgaagatgatggatgggtcttgttgatgcatgtggtggtaaaagcagctgtaaattgcatagcatgtcattttaatcagaatggtgaatggtggagattgtttcttttgttttttcttttatttatattgcatcccttttgcgtgtacagcgaaattgatgctagaacagggaaagctgtttgcccaagttgtttggtgggaagcagtcatcccttagatctaattcatttgttaacaagtcaacgaggtaaaggatgtaaatgattccgttggctttgctgaatatgaaagttgaaacagtaaaaagggtggcccaattgc

SEQ ID NO: 11891 - DNA, 1342 bp, Sorghum bicolor
  Clone ID: SORBI-28MAY03-CLUS35094_1
gcacgagggtgtgattgagactatacagctagcatagcaggcctaagtactggcaatggcgggagagaggatgagcactagcagcggcggctttgccggcctggtggcgtgcgtcgccaccgtgtgcctgctgctgccgacggggagccgcgcccagctcaaggtggggttctacaacaccacctgccccaacgccgaggcgctcgtgcgtcaggtcgtcacggctgctttcgccaacaactccggcgtcgcacccggcctcatccgcctccatttccatgactgctttgtcaggggctgcgacgcctccgtcctcctatccgtgaaccccgccggcggcaacacggagcgtcagtcccgggcgaacaacccgagcctgcgcggcttcgacgtgatcgacgccgccaaggccgccgtggagcggagctgcccgcgcaccgtctcgtgcgccgacatcgtcgccttcgccgcccgcgacagcgtcaacctgacgggcaagctcttctaccaggtgcccgcggggcggcgggacggccgcgtgtccaacgagacggaggccgacaccaacctgcttggccctgacagcacggcgcaggtcctcatcgacggcttcaggaggaagaacctcaccgtcgaggacatggtggtgctgtcgggctcccacactatcggccgctcccactgcgcctccttcctggccaccaaccgccgccggctggccgacgggaccatcagcgcggcgtaccaggcgctgctggaggcgctgtgcccgcccagccccggccagttcgacccaaacacgacggagatcgacgtcagcacgccggctgtgctggacaacaactactacaagctgctgccgctcaacctcggcctccacttctccgacgaccagctcatccgcaacgccacgctcgcgccgctcgccaacgccttcgccgccgacgagacgctctggaagcagaagttcgccgccgccatggtcaagatgggcaacatcgacgtcaagaccggcaccacggatgagatccgcctcaactgcagcgtcgtcaacccgtcctcgtcgtcggcggccgccgccggggtgatcgagatgctgttcccggccgacgaggttgccacgagctgatgaagtactgatgatcagcaatatgtacacacgttacacgtacgcgcgtgtgcatgagtattgatcagcagtgtcgtctttgctttgcatgtatgtgattgccttttgtacgtacgtgtggacgtggacctactagcttgttgtttgttgcgcacagtcgtacacccgggcttggtgtgggaaattaataaacaaaataatgatcgatgtttt

SEQ ID NO: 11892 - DNA, 1550 bp, Sorghum bicolor
  Clone ID: SORBI-28MAY03-CLUS3534_1
gcacgaggcggtgggtgaacggtagagactagagaggaaagatggggaattgcatcgacacgacggcgcgggtggatcacagcatgaacaatgctgcctacccatcaaaagtgaccagcaagacaagtttgtcatctgtcccttccacaatcaagagcaactcaactcgttcaactttgactcttccatcaatgagagatcgaagtgagcttcctactcctcggacagaaggcgaaatcttgtcatcttctaatttgaaggcattcacattcaatgatctaaaaaatgcaaccaagaacttccgaccggacagtcttcttggggaaggaggatttgggcatgtctacaaaggttggattgatgaacacacgcttgctccttcaagaccagggagtggtatggttgttgctgtgaagaagcttaaaccagaaggttttcaaggacacaaggagtggctgacagaggttgattaccttggccaacttcaccacaagaatcttgttaagctcattggctattgctcagatggtgataaccggcttctggtgtatgaatttatgcccaagggaagtttggagaaccatctgtttagaagaggcgcggatcctttgtcatgggcaataaggctcaaagttgctattggagctgctaggggcttgtcatttttacatgatgctgaaaaccaagtcatatatcgtgatttcaaggcatcaaacattctgctagattcagaattcaacgcaaaactttcagattttggcttagcaaaagccggtccaactggggataaaacccatgtatccacacaagtcatgggtactcatggatatgcagctccagagtacattgcaacaggccgcctctctgcaaaggcagatgtctatagcttcggggtggtgttgcttgaattgctcactggaagaagggccctggataaatcaaaaccaggctttgagcagaacctagttgactgggccagacctcacttgggcgacaagcgcagactataccgtatcatggacacgaagctgggaggacagtatccaaaaaaaggcgcaaatgccattgcaagcattgccttgcaatgcatttgcggtgacgccaagctgcgtcctcctatgtcgcaggtgttggaagagctggaacagctacaagatgccaaatatggttcaccatcaccattagtcgacataaggacagcttcacacgccgccccaaaatcaccaatgagcaccaccccaaaatcaccaatgagcaccaccccaaagtcgccaatgagagttcaaccttcaccacggcgctcacttggagcagcggcagcatccccattggcaggatatcgcactgcacaagtgcactagaactggacttagaggggccacgccctgtaggttgtatatttgtgggttcatgcagtgagctctgagcagtgttgtaacttttgcttctactcatgttctggagatcgtgtatgacaccagaatctgaccatgtcaacctatgataagttatctggcccggttcaatgggtactcattattggccctgtg

SEQ ID NO: 11893 - DNA, 702 bp, Sorghum bicolor
  Clone ID: SORBI-28MAY03-CLUS35717_1
attcggtttctgtaggagaaaatgtggatgatcccattgttgttgctccagcagttgaagaaatgccactgcaaaacattgatattgaagacaatgttttgtggaagaaagaggaagcaaggtccaaggaagagaacctgtctaatggaagccttagaactagcaagaggaagtcttcattccccaacaaatcagaatatgtagaaaatgggactcacgctactcctgttcagccaaggcagccaagctatatggctgcgacggagtccgcaaaggcgaaactgcgagcccagaattcaccaaggctggattctgattcatcagcagagaagaatggtttcacccgacgccactctcttccttccagcacaaagagtagagcaatcaaagctgagtggaagcgctgaagaggcaaccaatcttccacttgaattgaattgtgcaatgctctgaaacttagctggatgaactcgatgatcttgccccttttaagtctcctgcgatgtaaagagagatattcttgttgtattgaacaaccttgtgaagttgtgattctggttcagtttgtcgtaggttcatgtgcaaccactagtgccttgtgtcattgtatattgcacgattcttgttgaaggaactatgcctgtgtaagctgatgttaggactgcattaactgaataacatcatccagttggccttgctgtt

SEQ ID NO: 11894 - DNA, 1001 bp, Sorghum bicolor
  Clone ID: SORBI-28MAY03-CLUS35358_1
ggggggggccaggccaagtcggctcttgcgtcgacatcgacggggagaatcggctgtgggcaggcgatgaactgtagcgcgtgacagcgagaggtactttgattggatccattgtccggccggtctgcgtgcatcacctgattgcagctctgcatttcctggctataaagcgaaggggcccttgggctggccgcggggactggagagggagagagtcctcccatccacaacttcttagcttttgcgggattgagatccggcaggggatagaggaagctgaatttcggaaaggagaacagaaaaatggggattggagatggatcatcaaatgggaaccagcaactggtgcataaggaaatacgagatgagacaacgccacttcttccagtcaaagtggaggaggacgaggggtttcatgagttcaacggagcttcattctctggggcagttttcaatctctcgaccaccatagttggggctggaattatggctctgccagcaagtatcaagatgctgggcatcatcccagggattctgttgatcatcattgtcgcactgctcacagaggcatccatcgacatgcttgtcaggtgcagccaccagggcaagattacatcatatgggtggctgatgggagaggttttcgggcagtgggggagaattgcgctgcagggctctgtcataataaacaacgttggcgtgctaattgtttacatgattatcattggtgatgtattatctggaacaacatcaggcgatgttcatcatcgtggtatattggagggctggtttggagctcatttgtggaattctcgttccattgttcttcttgccacagctcttttggtgtttgctccattggtgagctttaagcgtttggattcattgagatacacatctgcgttatcagttgccctggcagtagtttttgttgtaattactgctgggattgccatcatcaagctcttcaatggaactgtagcgatgcccaaactttttcc

SEQ ID NO: 11895 - DNA, 756 bp, Sorghum bicolor
  Clone ID: SORBI-28MAY03-CLUS36190_1
aaagccagaaggtgtcattgccactggcaagttctcaaatatcctgaaattcattgttaaggaggttgatccgtccacgggtgaagctgaggatgatggtgttgaggatgagtaccagcttgaagatcttgaaatagtttctgcggattatatgttgaaggtgggagtatctaacttccgaaatgcctgggaaagcatggatccggagagtgagcgtgttgacgagtatgggcttggagtaagggagagcttggctgaggctgtaagtgctgtgataagcatccttggcatgcagccttgcgagggaactgacgtggtccctagcaattcaaggtcgcacacttgtctgctctctggcgtttttgtcggtaacgtgaaagtcttggtgagactgtcatttggaatcagtgcaccgaaggaggtggccatgaagttagcagttagatctgatgatccagagatcagtgacaagatccacgaaattgtcgccaatggctaagaacactagtataatattttttttgactccttttttgttttggctttcatgctacgggaagcttgaggggattcaattaattctagtatatgtaagcttggtttccagttggatccatcttttgttgcaccaccattcttcctcgacacaatacaacagtttttggttgatttggatctgtacaattttccttatataccggggacataatagtatatgcaataataatcaagtaaagttttgttattgacgtcacc

SEQ ID NO: 11896 - DNA, 881 bp, Sorghum bicolor
  Clone ID: SORBI-28MAY03-CLUS36222_1
gcacgaggaccccgtgcgccgcctccgaccctgaccccgcgcgccccagcccgtcacgcagccgcgccgccccgaccccgcgccgcccagccccgcacgcagccgcgccgccccaacccggcgcgccgcctgcccagccgcgcccagcgccgcctgccgaaatttcgtggtgaagcacctcgccaaggtcttcgtggacggcctcctcgaggtcgtggacctcacgctcgtcccctacggcaacgctcggatccacgccggcggagtgatctcgtgccagatgaaatggtagggtcctctgaggacgaaccatgctcaggagacagacgccactgacctgggtcaggagcacagctcacggttggctgaccgtgagctcaaggagatgctgctgaagaagtacagtggctgtctgagccggctgcggtccgagttcctgaagaagaggaagaaagggaagctaccgaaggatgctcggtcggcgctgatggactggtggaacacgcattactcctggccgtaccctacggatcgcacggcgtgctatgcacacctagaccgtcgctgggatcgcaagctggggcgtcccaaccctcgccggaatcgcacactggacagtcgtcgtgagctgccttgggagttgtttttatgtattaaacttgtgaagttggaataatatgcactcttgaacgtgtggtttgtaatatattttgaatggcctctccaccggggccctgcggggggctgggacgtctgcagatggtgctcgagacagcggaggcgcgcaacggcgtcagctacaactccggcatcagcaagcctgcaactgctgaagatgggggtagggagcgtaaggtgtggcggggagaattataattgat

SEQ ID NO: 11897 - DNA, 1215 bp, Sorghum bicolor
  Clone ID: SORBI-28MAY03-CLUS33898_1
aaacgccccttgatgaaagatattttgcaagcatttgagagtgctaaagatgcagatcatgataacattggatggggcaactctctggatgtaatggtagacaggccagccatggcaaaccgcattaattggttgcactttaaggacaagcttgaagtgggtgacaaggtccgttcaagaaggcttaaaaactcttgcagtcctgaaactatggaaatccctgatggaaccatagttggcattgaggatgaaggagagcgtgatccttacattcttgtacgagtccatgggctacatggccctttaaaggttcgctgttcaacagtggagagggtgacatatggttttgctgctggagactgggtacggttgagggaggaggacaagaagcgctctcaggttggcattcttcatagcattggccgtgacggtgcagtgactgttggtctgataggaatggataccctttggaagggtaattattcagatctccaaatggctcaagcctactgtgttggacagtttgtgcgcctaaaggcccatatttcaaacccaaggttcgaatggcagcgaaagaggggtggaggattagtcacaggccgaatttcacacatacatccgaacgggtgtctcgtcgtgaaatttcctggcaaatttaatcttggtgaagtgtgcagttgcttggcagacccctatgaggtggaggtggtgagctttgacaagtgcgaggggattgtgaagaagtacgagcatcttgaggacttccattgggcagtgaggcccctgttcatagctattggtttcttcactgctctcaagctgggtgtttttgttgggaagagcattgcgaggccaaggagtcggaaggttgccagcatctccgatcagagcagtgattaccagcaacaacagcaggtgcaaaacagtgctaatggggcgtggcttcctccaccagttgcaaacatgcttttcggagatgttgttgggacttctggataagaaatcataaaaggtccatgtgaagatggaggtttgctaaaaatagcttcggggaattgtggttcctagttgtgcatatttaggcctgaaatgttttatctaagcatttgtgaatatctctattttcagcaactctgcagcacaagttctgtacataaactccataattatcgtcttataaacatacaactatgcgaagctatttcttgttcggtg

SEQ ID NO: 11898 - DNA, 666 bp, Sorghum bicolor
  unsure (1)..(666): unsure at all n locations
  Clone ID: SORBI-28MAY03-CLUS33912_1
atttgagggccatanagctgctgttctttgtgttcagtggtcacctgacagagcatctgtttttggaagttctgcggaagatggtttcttaaacgtgtgggatcatgagaaggttgggactaagaaaaatactaatgtcccagctgggcttttcttccagcatgctggtcatagggataagattgtagacttccactggaattcgtcagatccttggacaattgtcagtgtatctgatgatggtgagagcactggtggaggcggaacactgcagatatggcgcatgagtgatttgatctaccgccctgaggatgaagttcttacagaactggagaatttcaaggctcacttggccagctgtgctccaaggacttgagtcatgtggttatctgcggaattcaatcctgtgaaaactctgagtaggtgatttagtttcgtggccataagtatggccccaattgacattggatatgtcctctgatgctcctagagctgtacccttgaggggctcgtgcctttgtgagcttgtgttaaacctgttgtatgactaaattagtatgtccgcaaacacatcacagctggatgtctagtctgtaggccaactattgggatatttgccggatattgtcaacaattgttccagatttggttattggatctgatgag

SEQ ID NO: 11899 - DNA, 715 bp, Sorghum bicolor
  Clone ID: SORBI-28MAY03-CLUS33929_1
gcggacacagtaacctgtcggaaattcgctgagcgggcttacaagtacagaccactcaaagttgttgagtttgatcgaccctacccacagtgcatagcgtacttggacctcaagcgtgaggagtgctctcgactctttcctgcaggccgtatatactcgcaagcattccacctcgcagggcagggcttcttcctctcagctcactgtaacatggagcagcaaagcacgttctactgcttcggtctctttctggggatgcaagagaagggctcaatgagcgttacagtggactatgagtttgctgcaaggacaagaccatctggcgagtttgtgagcaagtacaagggtaactacacgttcaccggtgggaaggcagttgggtacaggaatctctttgcaatcccatggcagacgttcatggccgatgacagcctcttcttcatcgacgggatgctgcatctgagagccgagcttacgataaagcagccctagagcaacggaacagctacatagatgtgctgccgtcaggttgagtttgtccggccgtgggtgatgctgcggaaaatgctgtgtgctgcagataatccttctcgttttttttcacccttattgttcatgcaccttaatccttttgttcatagacagtttggtgatgacaagcatataaagaaaaaaaaaaggctgaaagctgtgccttttgtcgtttcactagtcc

SEQ ID NO: 11900 - DNA, 1325 bp, Sorghum bicolor
  Clone ID: SORBI-28MAY03-CLUS33967_1
gaaggcgtggacactggtccggggagtccacccgtggatccgggcaagcgcgagagccttgcaccctctggtccggtgaaccgcaccgccaccgctcgcaattctaagagcaatagtgatggcaccgctgcaaatttccctggtagaggagagggagctaaggcacttgtcctccgcggtggcgcgagcgctacagagcctgctcggcatgccctcgcgacagctaaacttaagtcggggtccgctctcgctgggccatcctatcggccgcagtcggccccggattatactcactctgcttgggattcttaggcagaaaaatggaaaatttggtgttgctggagtttgcaatggtggcggcggcgcttcagccctcgttttggagctcatgcaatcctcttcgcatattcattcatcattgtgaagttggtgcaagcaaattagcaagtcataagttgtaatatgcggtgtatcgtttgtcttttggaggggggattagttcgtgttggcggattcgctgcagccctggttttgaaggttgtgctggcctgtccagggctttattctgcacccttcttggcccaggtcgacgtattttttcatgaccgaagtcagcaagggaagccccagcctatctttttcttttttttgataatgcagacctgtttaaattcgctcccacggggagtcgttctccggtcccctcgtgcgtctccggactccagccgctaggctcgaggccctttcgcggaacaaatcttcagttctctatgctaatgttccatctgatcatcggtgggacacgttaacaaagtgtagttatcttcctactctaccatttcaagactccttgcactacttgatttccaacctgctaccgttagaacctttgctcattaaatcagaagctacttaaaagagttatttgagctactttcttagcgtcgctgacatgatgcaggcaatcctcttcgcatattcattcatcattgtgaagttggtgcaagcaaattagcaagacataaattgtaaaatgtgttgtatcttttgtcatttgtgggggggattagttcgtgttgtgtgattagacgaaaaactgtaaaataaggttgtgctgctcagcacagggcattatcctgtaccttacatgggaaacatcgacgtatatatagaaatagaaataacagaggcccggaagaataatgcacagacattgatagtcactatatcactgaggtagtgaaaaatcgtcatggacatgattttgctttaccatcttatgtgaactgagtacagttgtaagaaacgagatctttttaaccttt

SEQ ID NO: 11901 - DNA, 1123 bp, Sorghum bicolor
  Clone ID: SORBI-28MAY03-CLUS34030_1
gcacgagggtcggatgctctgtcgttccccgcggcctcacaggtcagtttgggcaatcagatgggatcagataatctgcaggcgacttcgcagcagcagcagcagcagatggatgctgtgcaggatatgcagcaccagcagctaccaatgtcttacaaccagcaacagttgccacctcaacattcgcagcagctccagcagccacaggctacagtgaagttggagaatggaggaagcatggttagcatcaagtcagagcagcagatggggcaacctgaccagaatggtcctggggcccagatgatgcgaagtgctagtgtcaaacttgagccacaacagctgcaagcccagatgatgaggagtttaagttcagtcaagatggagcaacagacgtcggatccatcagcattcttgcagcagcagcaacagcagcaacaacaacatcatttgttgcagctgacaaagcagattcgaaattgtccagaccttgtatcaatgggtggaccaaacacaattgcaaaccctcaagctgctgcggctgctcaactgaccctcttacagcagcaacggatcctgcatatgcaacaacagcatcagcagcagcaacaacaacagattcttaagaacttgcctttgcagagaaaccagttgcagcaacagcaacagcagcatcaacaacagcagcaacagcagcagttacttcgtcaacaaagtctgaacatgagaactccaggaaagtcgcctccttatgagccaggaacctgtgcaaagagattgactcactacatgtatcatcaacaaaacagaccacaagataacaacattgagtactggagaaactttgtcaatgagtattttgctccaaatgctaaaaagaggtggtgtgtctcgctttatggaagtggtcgtcaaactactggagttttccctcaggatgtatggcactgtgagatttgtaatcggaaacctggccgtggttttgaaacaacggttgaggtactaccgcgattatgccaaattaaatacgccagtggtacactggaagaacttttgtacatcgacatgccacgtgagtcccagaatacctcaggccagattattttggactacacgaaagcaatcc

SEQ ID NO: 11902 - DNA, 837 bp, Sorghum bicolor
  Clone ID: SORBI-28MAY03-CLUS36359_1
gcgatatgcacatgagcatgaacctgtcaaagatctcttgggtgctgttaaggctatcagaccgactgcactaataggatcagctggtgtgggtcaaagtttcacgaaagaggtgattgaggctatgtcttcgatcaatgagagaccgattatccttgctctatcaaacccaacatcacagtctgaatgtactgctgaacaagcatatacatggagtcaggggcgtgccatatttgggagtggaagcccgtttgatccagtgaaatataatgacaaactatttgtgcctgcccaggcaaacaatgcatacattttcccggggtttggactaggggtggtgatctcaggagcagtccgggtgtcagatgatatggtccttgctgctgctgaaggactagctgaacaggtaacaccggaacatattgagaaaggcctgatctacccgcccttttccatcatcaggaagatttcagctaacatagctgcccgtgtcgcggcaaaagcttatgatctcggaatggctagccagctccctcggccaaaagacctggtgaagtatgctgagagttgcatgtacagccccgtctaccgaacgtacaggtgatgtgaagagcgaacagtgacattggatacacggatgggtgtgtatacaacttcacctgaagattgcatatgcctatacattaacatctactgctgagctttgtacatatcttccctgtgaccgtgttgtaaaacgtgtggcgaagtccgctgctgtggagctgatactgcacgttcgtactttatgttgtgtaataaaagttcaggggacggactaagttttgacatgttcct

SEQ ID NO: 11903 - DNA, 1094 bp, Sorghum bicolor
  Clone ID: SORBI-28MAY03-CLUS37080_1
ctcgcacccctcacttgcgaaaagaaacccgcaccggcccccagaatcggcggcagcggcccccactcatcgacctcacccgggcatctgcgagcgcgccgccacctgcgcgcgactgccctggtgcaccacttcgcccacgcacgcccccgaggccacccttcccggcagcatagctgagcgtggcatcccatcggcggaggtcacgcggcgtcctggcggcgcagcatctcggcggccccctgcgctaatgtcgagcctcgccgccatctctacggccccatgctggcgcgcccccatctccgtccccctggctctagccggcgctgcgggaggcagctgaccggttagtgccgcagggggcgtgcgccatgtgctggggccatgccgtctgggcgaccgtctgtggcgcgggtgccgccgcccgccatgtctcatggatggtcagtgaaatggcatgcccgtgatatttgtgccacatggatggaacatgaaagtgtttactacaatagacacaaccttgaatccaaggtcaataaacaaatcgagagcacctgaatctggtggtgttgtcgtgctttttttcatgatgatctcctagttgtatcttgcattttcagaagttattgttttcatattagttacattccatgttgtctttaatattgtggtttgtgcaaattagctatcaagccggaccatatccatcgcagttatgtttccaaatgatgttaagaaggcaatgatctatgatgtcggccagcttgctcctccattgtgtgcagaaaaagctttgctcaaatggggctcaagtgagagacaatatttttactcatatttgatttacaaggcaagaagtggttgtagtttgttgccactggatcgctcagagtatattccattagaagtaaaggttatagtaataaaacaaaactataaatgggagttgttcgtctgtctcgtgcctcattttgatctcagatatatacttgtctgttagtagcagttatatgattttactttagctctggtgcaagaaggatttaagtatcaccagtcaacagagttgtatattatattaatgtattggatcc

SEQ ID NO: 11904 - DNA, 705 bp, Sorghum bicolor
  Clone ID: SORBI-28MAY03-CLUS37203_1
ccgtggcgcgcggagaggatggattccaggatctccgtcctctgctccctcgtcctcgcctcctccctcctgcactgcgccagatccgacggtaatgacggccagcttctcaagggcatcaacagctacaggtcctccctcaaggtcccggcgctgacggagaacacgaacgcggcgtgcctcgccgagcagctcgcgaagcagttcaaggggcagcagtgcaccaacaccacgggcgccaacaccgtcatcggcaccgagcagcagttcccggactaccccaagtacctggaccactgccacctcaatgcgtcggtgaccgaggacggccaggtgatgccggcgtgtgtgccggggctcgtccccgccgtcgtcctcaccaactacaccaagtcgcagtacaacaggttcttgaacgacacccagttctccggtgtcgggatcgccaatgagggcgactgggtggtggttgtcctcagcaccagcacgggctccggtgactactcgccggctccgccgggctccaattgggcggcttcggctctgccgttcacccaactggttcttttgctgataggatttgtgatcttgctcatcaagtgagagtttggtatgcatacatcacagagtggagcttacatttgtgtggcttatgttataacattcggggttacaacttaacttggcaggtctcattggcatgtt

SEQ ID NO: 11905 - DNA, 722 bp, Sorghum bicolor
  Clone ID: SORBI-28MAY03-CLUS36811_1
cagtctgaagctggggagtccaatgtgtttcaccaggaaaaagatgctgcagtagatggggcaccatctggcacagatggagcagtggctgaggccccagtggaagaaacaacagagaatgttggtgaagcgacatttagctatgaccgcttgatatccaaatctaccgatccagttcgtgggatagattacaaacgtagagaggcatacttatcagatagtgaattccaaactgtttttggcatgactaaggatgcattctaccaacagccaaattggaagcaagaactacagaagcgaaaagcagatctcttctgaagagaaagccttgtttctagtgtctgctgcaaaatgtgtcatgaatggtcggtcccatgggagtaagtctattaatatattgttggtcatttctgaggacgggttactggtggctttgctcggttggtttttttgcaaccaattttataggtcaattcttttatttgtacatggcctgagttgtgttgcttgcgaggtcctaagatgctcatagcttgctttgtgactgtccatatgtgtatatcgtttttttcatcagtttgttacgtatgggcattttctggtaggttaccattgtagtcattcagatgtatcgcacacgaaatatttgtgctatccgtttgctgttgatggttggcagttgtttgggatttgaacactgggttgaatttctccattttttc

SEQ ID NO: 11906 - DNA, 677 bp, Sorghum bicolor
  Clone ID: SORBI-28MAY03-CLUS37733_1
gcacgaggccccagatacatctccctccatgatcctcgcgactcctcgcatcactcaccaccttcacagcatcccgccaccgggtccgggccaccgcaggactaggagactcctctccacagcacacgccgccgtgcggccagatgatgccaccacggaggcagcaggagagggcacatcgtcgtcgtcgccgtcgtcggaaagcctgagggcggctaagcctgccgcgacgacgatggctccggctccagcggcgttttcgttgcccaaggactacagccatactctgttccactccgagtgcctggaggtgctgggcctggtggacctcgagtcgctgcggaagcggccgaggctcaccgtgggggtgacggtgaaggcgtccgtggtgctcccggtgctcgtggtgctggcggtcctgtacctcacggacgtggccaagggtgttgtcgactggacgcatcatcacctggagagcgaggacgtgggggactagctagctagttagagggacgccggcctcccaggcacagctctccattgtatcgatgcaggcatgcagcaggctgaacttgctggtgtaaaaaattagcttcaggcttcggctagctctgctgatatttctttccttttctattatttcccatttgtaataaactgtaaataaactgcctttt

SEQ ID NO: 11907 - DNA, 1292 bp, Sorghum bicolor
  Clone ID: SORBI-28MAY03-CLUS3697_1
tgccgtggcatattgccacgagaagggggtttatcatagggacctcaagccagagaatgtccttgttgatgcaaaaggaaacataaaggtttctgatttcggactaagtgcacttccacaaaaccaacgaaaagatggtttgttgcataccacatgtggcagccctaactacatagcccccgaggtccttctgaacaaaggttatgatggctcgatgtctgacatatggtcctgtggtgctattctatatgtaatgcttacagggaatcttccctttgacgaccaaaatgtggttgtcctttatcagaagattctgaaggggaatgctcacattccaaagtggctctctcaaggtgcccaagatatactgagaaaaatcctggatcctaacccgattacgcgcatagatgtggatggaataagggcacatgattggttcaagcaaggctatgctgctgctgtgccatttaatgatgatgaagatatcagcatagatgaagacagcctacatatgactgagcgtaatggcattcaagacaagatagcaatcaaccaaatcaatgctttccagctcattgggatgtcctcctgccttgatctatctggattttttgagaaagaggatgcttctgaaaggaagatcagatttgcatcaaattattccccagcttatttatttgagaagattgaaagcattgtcagaaaaatgggtttccaggtacataaaagcaacggcaagctaaaagtgatccaagattgcaagggactagcaaagtcaagagggcaagaattattattaatttctgctgaggtgtttgagatcaatgaatctctttatgttgtcgaactaaagaagtcatctggagactgctccctgtacagaaagctgtgtgagactctctcagaggacttggggacacgcaaaagccagcaatttttaaagcaggattctatccgacaagagataggtagatacaatagtagcttttaacaaagagccccttactaaataggctatagccacaaactaacacaaacaatatactgaatttaaaacagtatattggccatgcaccttttacaaatgtgctccattatgccaattgtcatgaaaccttaagaggcttagactatgacagattggcaactgacaatgtatcgaactcctaagggataatatgatgtaaacaagtaaactacacatataagagattcagagttaccgggtctctatgtttctcttatatattgatattggaatgtaagattgcttgcttttgaagcccctggcg

SEQ ID NO: 11908 - DNA, 403 bp, Sorghum bicolor
  Clone ID: LIB3481-027-P1-K1-E10
cgtccgcaatcaaccaaatcaatgctttccagctcattgggatgtcctcctgccttgatctatctggattttctgagaaagaggtaagctcaatgtttgctccaatctaattttttcatatgttttaatttcctcacatctactaaagactttaaatttgaactaagtcctatcccagatctacatacaaagcaagtcctaagttggaattggaagagttcaaggagatggtaaaaatgttaaaaagtgtacgaaaagaatagcagccaggaaccagaaattgacacagcctgctttgtttagttatctatgtgcctttattgggcattaacattgttaataatactctagagatattgatgtttttcatagtcatcataaccttccactaaagtcatacatg

SEQ ID NO: 11909 - DNA, 695 bp, Sorghum bicolor
  Clone ID: SORBI-28MAY03-CLUS34787_1
aggacctagttagcatggcctatctgaaagctgtcgtgaaggagacactaaggttacaccctcctgctccactcctcttgcctcgcaaatccatggtggactgtgacattgatgggtatagaatcccctctggaactcgagtcatcgtcaactcatgggcagtctgtagacatctagagtcatgggagaaagcggaggagttcatgccagagaggttcatggatggtggtagcgctagcgctgctgccatcgacatcaaggggaatgacttccagttcattccatttggagctggtagaaggatgtgccctggtatgaactttggattggccactgttgagatcatgctggcaaacctcatgtactgttttgattgggggctgcccgatggtatggagaaggaggatattgatatgacagaggtttttggattgacagttcatcgaaaggagaagctcatgctcgttccgaaactacctggcaccgctagctacgcataatctaaagcgatgctctgtaaaagattatatatgaatgtgctgcctgcatgtgagtttgtgtacctattgtatgtattttatgggtttaactagttgtatgcatagtcaagaaaaaaagttgtatgcacatatgtattgtacgcatgtccctcaaatatatctgaagccacagccatggattgttcaaagtttatg

SEQ ID NO: 11910 - DNA, 790 bp, Sorghum bicolor
  Clone ID: SORBI-28MAY03-CLUS34894_1
gagttggtgagctctgcattagaagtccatcccttttcaaggagtattggaaaagaccagaggtcacagcagaatccttcattgatggcggattcttcaagacaggtgatacagtaactgtagatgaggaaggatacttcataattttgggacgcacaaatgcagacattatgaaatttggtggttacaagctgtcagctttagaaattgaggcagtactgttagagcatgatgctgtactggaatgcgctgtccttggcttgcctgatgaagcctatggagaggttatatgtgcaataattgtgcctaaagaggatgcaaagaaaacggccgagcaggactcaaagccagtgctaaccttggaagcattgacaagttggtcgaaagataagcttgctccatacaagattccaacaaaactatacctgtgggattcgcttcctcggaatgccatgggaaaggttaacaagaaggagctgaagaaattattaggagcttagccatgatgtgtatagatgtatttatcttcatttccttcttcaagtttagtaagtcaggctcattatagtgattagcaaataagtgcattcgttatcatgcatggaacaataattttcgaaacggcctgagctgagatacattgcacacacatttctttccttatcagaaaagtttcgagtcactgtgcattatgaagttatgcattgacttgtaggaagactaaaagtctaaaactgcttgtgaccctgacaaacctaaacaataactaataagcaagtaaagttaactt

SEQ ID NO: 11911 - DNA, 1359 bp, Sorghum bicolor
  Clone ID: SORBI-28MAY03-CLUS34963_1
gaagacggcccgacggttttgcttttactcctactcctgcaatcggaggtctcaaagtcgaagagggttaatctaatcccgccgcgttccaccgtcgtctaaccgccagcgggatggcggccgccgcgaccgcagccaccgccgagatcgggaccgccgtgaccgcaaccagctccgagatggaggccaccgcgaccgccatcaccaccgcagccgccgccggaccgcctccggccatccccgataaatatatgcataaaaaccgcttgcaatcatttgctgaacgaacgtacaagaaaccaccagtctacaaggttgagtctgaaggcgcgtctcatcagcctaagttcagatgcacagtggaagtgggtggtcaacagttctcatcagctggtagttttgatcgcaagaaggaagcagagcaggatgctgctagaattgcttatgagatcttgtcagcagttggagaggatgacattaaagaggcatttgggcttattgatcaggacgcggttttctgcaaatcaattctcaatgaatttgctgtcaagacaaaaaccacttggccctcttactctctagtttatatagagaagcctttgacgctgtttgctgcaattgtggtgtttgatgggaatagctatactggtgaatctgcacgcaacaagaaggatgcagagcagaatgcagctcgtgctgtgatcaagtcgattttagctaagcataacacttgtatggtgggaattgttagatcgaagaaacaacttataactgccgtcaaatcttctggaagcagcccagctacttttactcctatacagtttacacgccctgtttcacacgcagcattcggcggaccagatcatgtagcacctatgttgcaaaatgcatcttcctcgttagctgttcaaggaggcaccaatgctgtacctgcagttgggacatctgccaacccatcatcagcaaatgtaggccactcaaagtcaaagaagcgcaagggcagagtttaaggatcaagagtcaatgaaacaagggttgccaaggggctggtattaacttctcagccatcaacatcagggataggacaatatggtcaaccttttagcattttattcgccttggtatctctgcatgtcgtgttggttgctcaaagcattgcattgcacatcgttttaggttgtttcttttaacctgaacttttgacacgttagggatttgtaactgcataacaatttggctgcatgtggagcaattcgtccttcctaaatagggcctaaatctatatctacatgtatatatatctcttataaagtaaaaccctactagaagctttaacttgcaccacggcgttttacgtcc

SEQ ID NO: 11912 - DNA, 978 bp, Sorghum bicolor
  Clone ID: SORBI-28MAY03-CLUS35074_1
gcacgaggggaaaaagataggcaagaaatgattaggcaaggcctcttggagccacccaagcccaaggtcaaaatgagcaatcttatgaaagtactaggctctgaagctgtgcaagatcccacacggttggagatggaaataagaactgctgctgcagagcgtgagcaggctcacgttgaccgtaacattgcccgcaagcttacaccatctgagcgccgtgagaagaaagaacggaagctttttgatgatcctactaacacagtggagactatagtttgtgtttacaagataagagacctgtcccatccacagacacgcttcaaagttgatgtgaatgcacaagagaataaactaacaggtgctgcggtcatcactgatagtatcagtgttgtggttgttgaaggggggaagaaatcaatcaaaaggtataataagctcatgctaaaccgtatagactgggctactgctgttggtggtgatgaagatgcagaagtggaagccgacaagccagtgaatagctgtgtattggtctggcagggtactgtggcaaagcccaccttccacaggttcactgtacacaactgccggagtgaggctgcagctaagaaggttttcattgatgctaaagttcctcactactgggaccttgctgtcaatttctcagaagattcttcctgagcaaagcacctgttcagaactttgctagctgcttctgatctttgctggccatgctagtgatgtgtggccaatgttataagcgcttgtcatgatggtaagtcttcttatcacgagtatctataccaacgggcacatctgctgaagtgctgaattgagtaatgcttggtgttgtcagtctgttgtgaacatgccatttcagagatgttgatgtctattgctggattttcctgtggactagaaactatgttgcgaccaactgttgaattttgcagtgtgcatttggaataaatctatttcgcc

SEQ ID NO: 11913 - DNA, 1119 bp, Sorghum bicolor
  unsure (1)..(1119): unsure at all n locations
  Clone ID: SORBI-28MAY03-CLUS38554_1
gcacgagggttccatggctcgcctaccaaagttgcgtgtctttgctgaaaaggagaatttgaagattatatctattgctgacttgattaggtataggaggaaacgagacaggctaattgaacgtgcttctgttgcgcgcttgcctttgaaatggggcaatgtccgtgcctattgctacaaatctgttatcgatggcatagagcatattgccatggtgaaaggtgatattggcgatggccaagacattttggtgagggtgcactctgagtgcctcacaggcgacatttttggatcagcgagatgtgattgtggtgaccagcttgcaatggcaatggagatgattgagaaggctggaaggggtgtattagtttatctccgtggacatgaaggaaggggtattggcctgngccacaagcttcgtgcctataacttacaggatgatgggcgtgatactgtggaagctaatcaggaacttggtcttcctgtggactcacgggaatatgggattggcgcacagatattacgggatctaggagtccgttcaatgaagctgatgactaataaccctgcaaaatatagtggtctgaagggttatggactgagcattgcgggcagggtgcccttgattacgccaattaccagtgagaaccgtaagtacctggagaccaaaagaacaaagatgggacatgtatatggattggctaatgtgcaggctaaccaaccaagtggcagccagagcacagaagagaagcattaggcccaacaaagcacggtctccatcccaattccagcttggtggcacaaagagtgatatggtttcttcttttggggagttcctgaaatcgtctcccccgatatctctgtagattctttcgcaaagaaggcgatatttcagtagatttgttcttcaattgtaactgtaggtttcaagatggctaataatgaaatgcacggagtttgtcgtcgatgctgtagttgtctggtgttgagctttgtcgccttggtgtggttgtcccgatggagttgtggcgcagccaagattttgcagcaggatattccatgtacaaaagaaatttctaatgcaaataagaaatatattggcccctaagtccatagcgt

SEQ ID NO: 11914 - DNA, 1270 bp, Sorghum bicolor
  Clone ID: SORBI-28MAY03-CLUS38794_1
gcacgagggataactgttgagcatgctgccttcatggcagaggagcttggatttggtgtggtagatgcagtgatcaaagcccttgatgactctggttatagcaagcagactgcccagagtgttatgattccgccagccaacagctcagttctagtgaagttcaagcaggaaaccaagtacaaccttgtctacatgattgaagaaaatgtcagagatgctgctccttcctcccttgcagatattaagaagtttgctagtgctgtttctgttagcaccacatctgttttcccggaagaccattattatttgacaaaccagaccaataatcttgttaagtcccttaagtctgctggcctccaagtttacgcttacgtgctcatgaatgagtttggtactcaaccaaatgacttcttcgcagacgccactgtacagattaatgcttatgtgcatgtgcgaggtgctaatgtggatggggtcatcactgatttccctgggactgctcacagatacaaattgaactcctgcacgagcatgggaaagaacgcaccaccctttatgtcgcctccaaaacctggtgacctccttacaaccatgcccccatttgcacaaccaccagcagcggcgccaatgccgctcttgacggatgctgacgtcgcagaaccagccctacctccagtcagtaacaccaccacgcctgcatcgccttcggatgctgccctcatgatgcggactgatgtctcgatcctcatcacattgctgatgctatgtgcttccctcctcatctgaagatagtcctgcacaacatcatacgcggcgtggcgcattagagttgaggatttcacattgagctgctaatagcaattctttccaccacctttatgtagcgattctttttcttgttctatccggtgttttggaggatggatggatgttcagcttgataccccaacggtgacacctgtgtgtgctgccgctgcctctaggtacattttggtacatatgtgtggtgatacattgttcaggtcatctttcctactgccaacctgccgctggagggcaagatattgactccaacattacttgggtttgttagaatgcgctccaatccatctcaatccacatggattcgaagggattgtggtgtaaacttagttaattttctaccataatctctgccaacccgtgtgaactgggggtgaatttgtgtgtatccaaaattccaaacaagcgcttgggagctttgaaaaggagtaaaatatatttgaggccc

SEQ ID NO: 11915 - DNA, 733 bp, Sorghum bicolor
  Clone ID: SORBI-28MAY03-CLUS39812_1
actccgtcgccgaaatcgcgcagctccggtcgccccgtgcagaccccccggcccgcgaccgccgccgcggcgggaggcggccggcgttcgtgcccgctctcgtgcacgcgccgcggcccaaccgctgcgagccgcaccaggcggcttgcatccccgcgcgggtcgccaggcagcggcgccacgaccacgcccccgtccccgccgccgtcgccgccctcgcccccgggtacggcaggtccacgcgcgcctccgccggccaccacgacccctgcgtccccgtcgtcctcgccaccgccgcgcgggccgcgcgggagggcctgaccgacacgtacgtgcgcccgccgccggcgacctcggtgcccctggtggcccacgtcgaccacggcccggtcgacctgacgccgcaccacgtcgccctgtcgacgtggggccccaacgacgtccgggtaccgggggtcgccgacgacgtggggccgaccacgctcgcctccggcccggcctgcggcgagtgcccgttgtccgcgtagcggaacacgacgaccgagacctacttgctctgcctcgcaggatacatacacgaaactttcgtccgtcctgtccatccccgcaccaccaactattaccgctgcagcggcgccgccaccaccaccaccccgtcgtcgtcgcgggagctctccttccggacgccgccgtccacgctccccttcaaattcgtcgtcgtcggcgacctcgg

SEQ ID NO: 11916 - DNA, 1154 bp, Sorghum bicolor
  Clone ID: SORBI-28MAY03-CLUS38961_1
gcacgagggcaccccaacgtctcggtttcctatccgactcgcgctcagcggcgctcagggcagaacttctgctcccttccccactcgcgctcagcggcgctcaggctcggctcggcggcggcgtcggcggctcccccttccgcctctcgccagtcgcctccgtcctctgcgcaccggccggcgaccctggatacaggtagccaagaagacatcacatgggggcgttcttgagctccgccgccaccaaggaggaccagcagtgggtgcacggcgaggctccgagaccagattcctccaagaagatgcggctttcgacccctctctgcagccacggccacccgaggctgatcccggggctcccggatgagatctctatgcaaatcctcgcgaggatgccgcggatggagtacctcaaggccaagatggtctcgtggagctggaaggcggcggtaactggcgcagagctgtaccggctgaggaaggagctcggcgtggccgaagagtggctgtacatactgatgaagatggcagatgatcagaagctggtttggcatgctttcgatccggttagcaaccagtggcagaggctgccacttatgcctgggatcagtcatagcagagtctatgggttgggcttgggggatctggtgagcgctggcataagtatctttgacattatcagaggctggcttggtcagaaggaattgctaggcagtataccattctgtggctgtgccgtcggcgcggttgatggttgcctctatgttttgggtgggttctctagagcttccacggtgaaatgcgtgtggaggtatgatcccgctgtcaattcatggcaggaggtgagcccgatgagcaccgggcgtgccttttgcaagactagcctgttgaacaacaagctgtatgttgttggcggtgtcagcaaaggcaagaatgggttagctccgctaaaatccgctgaagtgtttgacccagcaactggggtttgggctgaggtgccagatatgttattctccaaatcgcaagctctaccgatggccttagctgatctactgaagcctattgctactggagtgacctcgtaccgagggaagctatatgttcctcagagcctttattcctggccctttgctgttgatgttggtggagagatc

SEQ ID NO: 11917 - DNA, 666 bp, Sorghum bicolor
  Clone ID: SORBI-28MAY03-CLUS39815_1
gactcctttcctccgcctctcgtctgctaggtcccctctccgaccgaaccctcccaatccaaagcgattcctccggcccgccgccgtcccgatcacgccacgccgcgccgcgccgccggggcggcgtctccccgtgcgcccttagctcagctcgcgttccggtggaacagagacgagaggaggtgaggggatggagatccagtcgtctggccggtccatcgaggggctgatggagaaggtgctgtctgtgaacatcctctcctcggactacttcaaggagctcttcaagtacaagacctaccacgaggtggtcgacgagatctacaaccaggtggaccacgtcgagccctggatgaccggcaactgccgcggcccttcctccgccttctgcctcctctacaagttattcaccatgaagctcaccgtcaagcagatgcacggcctgctcaagcaccaggactcaccctacatcagagctattggattcctctacctgcgatatgttgcagaaccgaagacgctgtggtcttggtacgaaccctatatcaaggatggcgaggagtttgcccctggctcaaatggtaaatcgactacgatgggcgtttatgtgcgtgatcttctccttggtcaggtatatctcttgaagttatttccccgttcttccat

SEQ ID NO: 11918 - DNA, 577 bp, Sorghum bicolor
  Clone ID: SORBI-28MAY03-CLUS40867_1
gctcctcacctgggctcttgaccccacatcaacatccagcctccccagctcaacaaggacagtgaagacaatgtctgaagtcgaagcttttgctttgagggctgaagacttaaggtttgtggcaactcagttccgacgactccacagcaaacaactccagcacactttcagattctactcgcaacaatggagaacctgggccgcatgtttcatccaagcagcctggcaccggtactgcagaaagaagattgaagattctttgcgtgcgaaggagaagagattgcaattcgcgattgccaatgacagctccacttcgcttagcttcatggcagcactatatgcttcgcgtttcgctggaaacatgatacggatcctgaggagaaatgccacgcgcaaggccaggctgcaggaaagagtgcctgcaagactgttgcagaaaccagcagagcccaacttttcggcagaagagcagtagtatttcacttctaacttcccgtgtgcagatacagatatgtaaaattgtttgtgtgacttccgaatcctagttgctggtattgctgaggatggcatccccaga

SEQ ID NO: 11919 - DNA, 1018 bp, Sorghum bicolor
  Clone ID: SORBI-28MAY03-CLUS36237_1
ttgctgtcattcaggtaggagcacagacagaaactgagcttaaggaaaagaaactgagggttgaggatgccctgaatgctacaaaggcagcagttgaagaaggtattgttgtcggtggtggctgtacccttctgaggctttcatcaaaagttgatgcaattatagaaacccttgagaatgatgaacagaaggttggggctgaaattgtaaggaagtccttgagctatccacttaaattgattgcaaagaatgcaggtgttaatggcagtgtggttactgagaaggttcttgccaatgagaacttcaggtatgggtacaatgcggctacagggaagtacgaggatttgatggctgctggtatcattgatcccaccaaggtcgtgaggtgctgcttggagcatgctgcatcggtggcaaaaaccttcatcacctctgacgccgttgttgttgacattaaagtgcctgagcaagcacctgctcctgcaaacccaatggctggtggctcaggttttggattctaaattgtttggagtttaggttccccttcgttccatcggcagcaggcagcagtgcgcattgcagcgacagaatcttaccttacgatagtctccagatataagtctggatgttattgttgcatcgaattgtgaaaatcaagtgcaagtagccaagacagctgaaaaatatttttgatgagagatgctgcttttttttctcctatattggtgttgatgttgaaaatgttgacacggtatcgatcagtcacgcaagtcgcgacaatagcatatctgtactccttttgaatgtgcttggaaggcaagcccgtgactgcgcagcagccagtgttaacttttaagctatgcacttgccatcctttggttgcgaggcactggtaaaaagtctcaaaacccaattttaaagaggatgtgtggtcactgctcaaaatttcacaagcccggttttaaacaggatatgtgtaggctgatgttggcaatgaatgattttgctagtccaaggg

SEQ ID NO: 11920 - DNA, 1305 bp, Sorghum bicolor
  Clone ID: SORBI-28MAY03-CLUS36303_1
gcacgaggcagaggtccaaccgggctgctgcttcttcttcttcttgtgctgcccaccttgcccccgagtgcccctgtcctggtcctcctctctctccctgctggcacgagggcggagcggagcatagcgaggagccgccaggagggaaggatccatggcggggagatcgaagtacgacaaccccttcgaggagggcggcgccgacgaggtcaaccctttcgcggaccaagctaaaagaggaggatcaagtgctcagtccagctattctggtggcgcgttctacacgacgcagtcacaacgcccttctgctcctcctagcacacgcctttcgcctcttcctcctgaacctgctgacttctacaatgactttgctaccccagtggatatccccatggacacaaacaaggacatgaagacaagggagaaggagcttctggccaaggaggccgagttgaacaggcgtgagaaggaaataaaaaggcgagaagatgctgcagcacgagctggcattgtattggaagagaaaaattggccaccatttttccccatcattcataatgatattggcaacgagatacctgttcatctgcaaagaacactgtatgtcgcatttgcatcactcttagggttggtcttgtgcctgttttggaacataatctgtgttaccgctgcctgggcaaaagggtcaggtcctaagatatggtttcttgcaattatatacttcattcttggatgccccggtgcctactacctttggtaccggccactataccgtgcaatgaggaatgagagtgctcttaaatttggatggtttttcctcttctacttggttcatatcgccttctgcgtgtatgcagctgtttctccttcaattctctttgtggggaaatcattaaccgggattcttccagcaatcagcttgataggcgacagtgtcattgttgggatcttctacttcattggctttggattattctgcttggagtctttgttaagcatgtgggtcattcagcgtgtttacctgtacttccgaggaagcgggaaagaagcagagatgaggcgggaagcagcacgtggtgcagcgagggcagcattttgatgaaccatatatataatcacaaccggtatgtggccgtggtgtggcgggtagccgctcctggggctgcgggggccgcagtttcaggcacctgttgtgtaggctcggcgtatatactgttcatagtttgaaatgtatactgttcatagtttggagtgttcgtagaacagacatatgtagtgtagggttggggtactgtaatcttacag

SEQ ID NO: 11921 - DNA, 1496 bp, Sorghum bicolor
  Clone ID: SORBI-28MAY03-CLUS36334_1
atcccccccgttcccctccccatctccatccacccccccgggagcaccagcacgaggagcggcaccagtagtcgagtcgagtcgagtcgagtcggcgtcgtcacgggagataccagcttccctctcaccggatcccctcctctgcgtccctctgttttcttctgcgtgtcccgtccggcggccggagctgccggtgcctccatccgagccttcgcggacctcttctcagctgctcctgttggtcttgtgcttgtgctctcttgcttgatcttgtgtgcgtttgaggagggattctggccctcctacgggtgtaagacaaaaggggacgaacgtgctcgttccggtgggtcaacagtgccgtgccccggagaacgatgcggggttcaggattagaggtggcctggctcggggggccgtccttccggagccgcggacagcagtgccaggctcaggattccaggtcttctggcttcaggtcccggtcttccacaccacgtcacacgcgactcgctcaccggagctcacatccgacgagaccaaaacacagtcctcctcccaccgcctttcagttcttgcttacttctgcaaccactcactgcgaccgtacaccaaagaacactgcacatggcaagccgatctagcgcgctggaaggagggggggcagcaatacagcggaggaataatgccgtgaagcggcacctgcagcagcggcagcaggaggcggatttccacgacaagaaggtcatcgcgtccacctacttcagcatcggcgcgttcctggtgctcgcctgcctcaccttctcgctgctcatcctgccgctggtgctgccgccgctgccgccgccgccgtcgctgctgctgtggctgccggtctgcctgctcgtcctgctggttgtgctggccttcatgccgacagatgtgcgcagcgtggcggcctcttacttgtaaatagccagataaataggccaccacctttggccagttttctgtgttttcgggggtgattcgtcctaagatgagtcatgatcgagtgtaatgtgaagcatcttttccaggggtagtagatttcaatgaagtttggtagctatacgaagttaattggttggaatttggaaattatgggcattgtgcgaacatatatagttgtgcagaattttctgtaattgcagcaatcagttgaacagattgactgatccacttgtagtggagagtgggctgagatcaggagtaagttatttgactctttgaggcaagtcactgaatctcagtccacacggtcatacgtgaagtgagtatgcagcttaatttgggttcagagattactgatctcactttcttatgcacggataaaaatttataacattgctagtttgaggaagtcttcgacgagaatgcatctccattgttgataaattcagtttaacacatttgtttttacttaactaataatccctgcttgtaatttgcagtcgctgttaatagcaaggtattcaacg

SEQ ID NO: 11922 - DNA, 795 bp, Sorghum bicolor
  Clone ID: SORBI-28MAY03-CLUS36353_1
aatgttgcaagcactgacataccaaatgggtgtctcaccactgtcgattctggacagcaggaggcgtctgattctcacagctcagtggagtttacccagtatttccaagagggctattgtaaaatatcagaactcgatgactgccgtgagttaactgaagctgttactgatgctgacagcagcagcagccactgcgagagagagaagcccgaggaagatggggataacgatgacttgcttggaggagtttttgccttcagtgaagaaggttgaacttactatactgccttacttgagattgagatacaacggaaagaaagcgttcaaaacattcagtgtgcaatagtatgtagacgatggtgaaattctagtaggctttcatggaataaagctgtgcggaattgatcatcttccatggtacatatttttcaaggtaaaccttgcgcctagttctcaaattggtggggccaagattcctccaggcaatttactaatctgcggatcctcgttgaaatttggaaggcgttggtgttgtcgagaagttgctattgcctgccgcaacaccacttccttagtgttggtttgtacatatactgtaagacccatttgttttgtgccatacttctgggacatttgggtggttctgaatcccgtaccttggcagccatatttgttgacctcctctgccagggcctgtgaatgttccatgtttatttgtacatatactttctgttttattgggaaaaaggaaaaaaatctagccacgattaatgtgatattactttataaacgttc

SEQ ID NO: 11923 - DNA, 717 bp, Sorghum bicolor
  Clone ID: SORBI-28MAY03-CLUS41604_1
ttccaggagaaaattcatggaagctatactacttttgttgagagcctagttgatcaatttgcagctgtctcatatggagattttgtttttggtcggcaagtggccatttatctacataggaaggttgagccagcagtacggcttgcagcatggaatgcactgtctaatgcgtatgtgcttgaactgttacccccgctagacaaatgcattggcaacgcacaaggatacttggagcctcttgaggatgatgaaaattttttggaatcttatgctaaatcatggacgtctggtgtccttgacaaagctttacagcgtgattccatggccttcacattggtaaagcatcacctttcaggctttgtgttccagtccagcgattctggcaaaacgctgcgaaacaagctggtaaaatcgcttatccggtgctatgcacagaagcggcatcatgaggttatgcttaagagcttcgttctgcaaggcatcgcacaggattccaagagcagtggcaatgagcttgaccggcggtttgaaatcttgaaggatgcttgtgagatgaactcctccctcttaggtgaagtccagagactgagggcatgtcttggccaatgaaggccagaaacttaagtgtgtcattaactaggcagcattagttaggaaaactatacgacaaagcgacccaaaatatgcaattatgagcaagcttgcgattgactagtg

SEQ ID NO: 11924 - DNA, 779 bp, Sorghum bicolor
  Clone ID: SORBI-28MAY03-CLUS4227_1
ggcaacccacagttgcgccgttattataaaacgccacacgtaggcaccgggcgtccccgcggtgggcgtcctttttctgcaccgggagataaaccgaccgcacccctgaccgcgacccgcagctgctccgccgcgccgcgcagcgccgccggttcttcgcgagcaattcttgtaaagcattgtcaccaccacttgtaatgggtggaagccagtacgatgatgaatgggtgttgcccagtgccgatatcactcttgttcttgttgggaaacttggctatggcaagagtgcaactggaaatagcatccttggacgggaagcatttgtatcggaatattcacatgccagtgttactaatacttgtcagttgggaagcactaccctgaaggacggccgcaccatcaatgttattgataccccagggttatttgatatgagcatttcatctgatgaagctggtaaagagattgttaaatgtatgaacatggctaaagatgggatacatgcagttctgatggttttctctgccacatctcggttttctcgagaggatgcaagtacaattgagaccattaaggtcttctttggggaaaagattgttgaccacatgattttagtttttacttatggagatctagttggtgaatctaagttgaagaacatgctaaataatgcgccagagtatttgcaggttattttgctgccataatagacttctcgcctctcttacatcatttagtcatatggcctttagtcagttaatatatatggttgttttgaa

SEQ ID NO: 11925 - DNA, 546 bp, Sorghum bicolor
  Clone ID: SORBI-28MAY03-CLUS42341_1
gctcgcctccacgcctcctccgcctttcccgtgtcccccgcagcaatcaccgcgagcgcgagggtttccagcatggcggagcagtcgcagccgcacgaggaaggcggcgcgagccccaagcacgagtcgctgatggagaagctcgccgacaagctccacgtcggcggcggcggcaagggcgactcctcgtcgtcctcggactcggacaacgacgagcggccccgcccctcggcgccgcccgccgacgaggtcaagcagacctccttctccgactccgccgccacggcggccgccgaggccaaggcgaaggtgttccgcctcttcggccgcgagcagcccatccacaaggccctcggtggtggcaagcctgctgatgtgttcctgtggaggaacaggaacatctctgctggagtacttggtggtgccacagcaatctggatcctatttgaattgcttggctaccatcttcttacttttgtttgccacggtctcatattctctctgggtgttctctttctctggtctaacgcttcatcgtttatccac

SEQ ID NO: 11926 - DNA, 821 bp, Sorghum bicolor
  Clone ID: SORBI-28MAY03-CLUS4148_1
caactggcacgagggtggagtgtcgtatagcaaccagctgaccagagcagcatcagcagccatgtcggaggagaagcaccaccacttcttccaccaccacaagaaggacggcgaggagcagcccaccggcgagtacgggtactccgagacggtggccgccgaggtggtgaccaccggcgaggacgagtacgagaagtacaagaaggaggagaaggagcacaagcacaagcagcacctcggcgaggccggcgccatcgccgccggcgccttcgcactttacgagaagcacgaggcgaagaaggaccccgagcacgcgcacaggcacaagatcacggaggaggtcgcggcggcggcggcggtgggcgccggcggctacgccttccacgagcaccacgagaagaagaaggaccacaaggacgccgacgaggccagcggcgagaagaagcaccaccaccgcttccgcccaccgcaccgtaccacctgttgaattctgtactgcatgcgtgttaatttgacggttcacagtaaataagtcccttttccggaccttgctaataagctgtgttgcttgtgtttgtgtgagtgagactgagaagaggtggtggggtggggccggccgtgtgcgtcgaggtgttcctgtacttgcttcaatttctctggcgtgtgtaattgtgttgaataagtgggagcgacatgatgcgccctagtcaggctcatgtgtatccgtagttgaatgcttgtactatatttgagtatgacatgtgaatgcagcacgattttattaacttgtccaaaaaaaaaaaaaaaaaaaaaaagccaca

SEQ ID NO: 11927 - DNA, 561 bp, Sorghum bicolor
  Clone ID: LIB3481-035-P1-K1-D1
ggcgtgcgggacggcgaggagcagcccaccggcgagtacgggtactccgagacggtggccgccgagggggggacgaccggcgaggacgagtacgagaagtacaagaaggaggagaaggagcacaagcacaagcagcacctcggcgaggccggcgccatcgccgccggcgccttcgtactttacgagaagcacgaggcgaagaaggaccccgagcacgcgcacaggcacaagatcacggaggaggtcgcggcggcggcggcggtgggcgccggcggctacgccttccacgagcaccacgagaagaagaaggaccacaaggacgccgacgaggccagcggcgagaagaagcaccaccacctcttcggctgaccgtaccgtaccgtaccggccggcgatgatggagctccggcctccggcgcaccacgtaccacctgttgaattctgtactgcatgcgtgttaatttgactgttcacaagtaattaagtcctttttccgaaccttgttaataagctgtgttgcttgtgtttgtgtgagtgagactgaaaagaggtggtggggtg

SEQ ID NO: 11928 - DNA, 1384 bp, Sorghum bicolor
  Clone ID: SORBI-28MAY03-CLUS4255_1
cttcgcctgatcccctcgtcgcacgagtctccgaagaggcgagagcgacggccaagaaacgtggccgcgaacagagacgaccgcggcgacagccacgagctcttcctcgtcccccctgctcccaccccacaacccctcgccgcggcctcttcctccctccgcccctgagaccgctccaggccgctgccccgcttgcatcgcgcattcgcgggaggtggtttcagtttccctttctcagggcattatggaatgcttaacaacaagttttgcaagaaatgtgggaaaagagcacagcttcgtatgttcaagtaagttggtgtctgaaaaccaatgggttccaagaaggatttgctgctatgtctctagttcaacaaactccagtcaatggtgcaagttcactaatatggcataccccatgagcccaattatccggaaaaggtcacactggagatcctttgctgcaagtttgaacttagaagatggccctgcaccctctgactcaacgtcatcttcatcagagcagactaccgccgatgctgatggaactaccaacggtgatgcatctgaagatctgctttctcaaaagctgagctctgatgagttaaaggctcttttggctgattcggaacgaagtaagcttttgagaagactcagcgaagcaaatcaatataaccgattcctcaagagacagttgcaaataaaggatgatgcagttgtaaagttcaaaggtgaacttgctgttttggaactagaactgcaggctctggttggcccagcctgaagagattgctaattttgatgttccgttagggtctaggaggataaatggaaaatatattcaatctcatcttctctccagattagaagctgttcatgataagattgtggaacatataaaggatgttgactctttaaagaccaaagaaatttctgtctactgggttggcatggctgagaatgtgcaaattatgggttcattcgacggatggtcccagggtgaggcaatgtccatggagtattcaggtgattatggaagattctctgcgactctgaagctaagacctggaaggtatgagatcaaatttttggttgatggggaatggagattgtcacctgaatacccgactgctggagatggaatgacgcagaacaatattcttattgtggagtaacagaactttctcatgtagcattttagtcatccaaacaatgccaaagtgtaccttcacttcatgccttctaccatctgtaaaattatgctgccatgtggttgcctcacagaaaccagtgttcgttgaaatgcaaggtttccagtcgcatcagtgtgttctttatcctgacatatgctcccttagtatttaaatgtatgatgaattaattagcc

SEQ ID NO: 11929 - DNA, 731 bp, Sorghum bicolor
  Clone ID: SORBI-28MAY03-CLUS42633_1
cagttgtcagagttattgcacagacatttcttcaagttttgaaaccatcaacaaagcagaagttccgtttcgagggagattcatacaagaagacattggcagagttcttgcaggttgtgccagcgtttctgggcggtaaatgcagctgcccacaatgtgagaagcctcgtaatagttcagtgatacaggctggggaagggagcaagagccagcctcgcttggtcagcgttgatgacggatcgcctgtcacagacttcgacttcgatgaagaagagatcccatcagcctatagctgcgagaacgccatcagggctgcaataattggcctgctgatgatgtgcatcttcgttgcgtttctggctgggatgaacgatcccacatctgtttcgcccagtgcccagtgagagctatggaatcgcctactctcctatagactattagatcttagattgtcagttccgagtaatagagtatatatatgtgttgctgctaggatgctagggtgttgttttccttggcaacttcttctcggttgtcgtcagaccgccatgatagtgctgtgtctcaatatgagcgcagatgaataatatcctgtgtgtggcaaatgttggatcacagttcagtttgagcccgtcgatgtctctcttaacgggttttctgtattagggcaatgtgatttctcgttagtgtaagtcaaagttgaacggtttcagctctttatatagattatt

SEQ ID NO: 11930 - DNA, 671 bp, Sorghum bicolor
  Clone ID: SORBI-28MAY03-CLUS37741_1
gttacaatctaggatgatttctttaaccgacgaattaattgcgacaaagctgaagcatgttcagctgcaagaagagctaaatgcactgtactgccaagaagaaatcgtggacatgagagaggacgaaaacgaagaagcatgatgtggtcaagcctcccttaaatactactaggagggggcctaaaagccacattgtcccgggcccatgcaagtgaggcctgattaactggctgcgtacaaggacttgaaggagcatttggtgctgagccagacaactccgagcgcaatcgaagaacctgcagtgagttttgaaggagcggggagacctctgcctctaaggggtttatcatcgttggccttagattgaactgttatgtatattcactcgacccggtgcgttcgagtttggtttgttgggtgagttttttaggcgtcttgcgatgtgttttcgttttgatcgcattcgcatctattattaagatggctaggacgccagcttctaatatagtagtagtttagacgtatagtaccattgtacttgtacttcagaagtcagaaagactgcaacaaataattgcatcgcgtctatagacagcggaatgcatgtgtagctactgtatacaagggattgtctgtcctacatcgagcctttttggctgggacccttagct

SEQ ID NO: 11931 - DNA, 938 bp, Sorghum bicolor
  Clone ID: SORBI-28MAY03-CLUS37755_1
gcacgaggcgcgactgtttcttgcatcggccgcgcgccggccctccacacccatcgcaccagcatccagcaacgacacgccgccgcctccgccctccgcctgcgcgcgcgcatttcagctcgattatcgccatggcgccgcgcctgcagctccgcgccgccgccgtcctcgcgctgctgatggccgtcgtctccgtggccgcgctctcggcggcgccggcgtcggcggccggagtggccgtcggcgacctggccgtggcccatctggccggcgccgtggtgatccggcgcggcgggcggacgtgccgcggcacggtgggcgagtgcatggagtacttgggcgcggacgccgagggcgaggccgacgtcgcgggcatggccaccggcggcagcaagcgccgggtgctgcagggcggctccggctacatcggctacgacgcgctgcgcagggacaacgtgccctgctcgcagcgcggcgcgtcctactacaactgccagcccggcgccgaggccaacccctactcccgcggctgcagcgccatcacccagtgcaggggctgatggctgatgctgatgttttcagtccattctcctccccagttaatgttaatcgcagctgctagcgttaaggatgatcgatcggttgctgtgtgatagcttcatggtgattttcatttttgaatcttttaatttgagaagacatgcatatatggaggtcgtcgtctttgctgtgctagcacagctttgtccggctgatcaagcggcatctccatgactggtccatcgattattgtggtgcagtggatatgtgtctgtgctgttgttgctagcatccctttcaggatgaaagtaaaagtaattatttgtgatgatcgtgtaattttctggtgtctctgattttacagccaatgaataatttgcagtgcctgcctttcattc

SEQ ID NO: 11932 - DNA, 746 bp, Sorghum bicolor
  Clone ID: SORBI-28MAY03-CLUS37994_1
gcacgaggccacgccgcgctgcctccccagtcccctcccctgcacgaggaccaccaccaccaccacaagaaccgcgtcggcagacaccaccgctgtcattgccgcggccaggcgcgccagccaggagaaaggcgggaggcgcctgctgtgcttagccgcttgctgacctcgctcgttcgatggagctgcacaagtactggggcgtgggtggccggcggtgcggcagctgcgaggcggcgccggcggcggtgcactgccgcacgtgcgtcggcgggtcgtcgtcgttcctctgcacgacgtgcgacgcgcgccccgcgcacgcgcgcctggcccacgagcgcgtgtgggtgtgcgaggtctgcgagctggcccccgccgccgtcacgtgcaaggccgacgccgccgtgctctgcgccgcctgcgacgccgacatccacgacgccaacccgctggcgcgccgccacgcgcgggtccccgtcgcgcccatcggctccgaggccgccgccgcggccgtcgaggccatgctgttcgggaccggcgacgcggccgaggccgacgaccagcacaacaacgcggcggcggcggccgagcagcatcagcatcagcaccacgctcaccacgcgcacgcgctgaacctcaacgtggaggcgaaggacatgaagctggactacctcttctctgagctggatccctacctcagcgtcgagatcccgcgctttcaccacgccgacagcgtcgtccccaac

SEQ ID NO: 11933 - DNA, 666 bp, Sorghum bicolor
  Clone ID: SORBI-28MAY03-CLUS38103_1
gcgctccgcagaatccgagtccactagctctcctccccagggctttcaacttcccccaaaccccatcgcctcgccgccgaggccgagcgagcagagcaccacgtcgggcggcgtttccctgtctctccgccggatactactacgcccgccgccgcagcgccgatcctgtgccagttcaagcggagcgagggatcggattggttgcttcctttcctccatctcatgttggtggactgagagatggagttttaatttcaaatagcatcttgaggactgccactaagcttttaagttagatacataatgggtggctgttgttgctgttcgtcgagaacatctgaagcagttagagcaccagttgatatctatcgtcaacaaaatcttgaggagcatgagccgttgtcttcagcttttgatggatcatctccagcctctgcaattgttgcagtagacacaaatttggatacttccacacctgacacatatcgagcaccacctgcacccttgccttatgatgttgttttggcagtcccagataaccctggtttggagaagccagacactaagagcaagactgatgaccgtcctgaggccttcgatgctctgcagtcctttggggtggccgggccctgtgagcaaaactgatgaccatcaagagtccataaa

SEQ ID NO: 11934 - DNA, 1103 bp, Sorghum bicolor
  Clone ID: SORBI-28MAY03-CLUS38184_1
gcacgaggccatttcttatcccctctcctcccccttccctcccctctccctcccacgatggcgtccctcctcacgctccccgccctcgccctctccaaccccgccaccgcctccgacgccgtcaggctacgctccgcggccttccgctgctgggcgctccggcggcgcgggtgggcggcggtggccgccgtggcctcgcccaactccgtgctcagcgagcacgccttcaagcggcttcagctcgggagcgacgacgaggacgaggaggggacctacgggagcgacgccaacgaggggttcgaggccggggaggggttccagggggacgaggaggagctcgccattgccaggctcggcctgcctgacgagctcgtcgccacgctcgagaagcgcgggattacgcacctgttccccatccagagggctgtgttgattcccgctcttgagggccgtgacctgattgctagagcaaagactggaaccggaaagacactagcctttggtattcccatgatcaagcaattaattgagcaagacaatggtcaaattacaaggcgaggtcgcactcctcgggttctggttctagcacctaccagagaattagccaaacaagtcgagaaggaaataaaggaatcagcacccaagctcggcacagtgtgtgtttatggtggtgtctcgtataatgtccagcagaatgcactctcccgtggtgtcgatgttgttgttggaacacctggccgcataattgatttgataaatggcggaagcctccagttgggagaagttcagtatttagtcctggatgaggctgaccaaatgcttgcagtggggtttgaagaagatgttgaaacaatattacaacagcttcctgcgaacaggcaaagcatgctgttctctgcaacgatgcctagttgggtgaagaaactgtccaggcggtacttgaacaaccctttgacaattgacttggttggtgatcaagatgaaaagcttgctgaaggaatcaaactctatgctatcccactcacagctacatcaaagcgcaccattcttagtgatctaattacggtttatgcaaagggtgggaaaaccattgttttcactcg

SEQ ID NO: 11935 - DNA, 1070 bp, Sorghum bicolor
  Clone ID: SORBI-28MAY03-CLUS44607_1
gcaccgggcacaaggctctcgaacccaccagccagttcaccacttgtcacgtccaactttccgccatgggcaggaggcctgcgcgttgctaccgtcagatcaagaacaagccgtacccgaagtcgcgctactgccggggcgtcccggacccgaagatccgcatcttcgacgtggggcagaagaagcgcggcgtggacgagttcccgctgtgcgtgcacctggtgagctgggagaaggagaacgtgtcgagcgaggcgctggaggcggcccggatcgcgtgcaacaagtacatggcgaagcacgcgggcaaggacgcgttccacctccgcgtgcgcgcgcacccgttccacgtcctccgcatcaacaagatgctctcctgcgcgggcgccgaccgcctgcagaccgggatgcgcggcgccttcggcaagcccacggggacgtgcgcgcgcgtcgccatcggccaggtgctgctctccgtgcgctgccgggacgcgcacgcgccgcaggcgcacgaggcgctgcgcagggccaagttcaagttccccggacgccagcggatcatcaccagcggcaagtgggggttcaccaagttctctcgcgcggagtacctgaggctcaagagcgagggacgtgtagtccccgatggatccaatgcaaagctgctcacttggcacgggtctcttgctaatcgccagcacggcagagcggtgtatccaccctctgtcgcaggatccgcttagagagatccaccatccgtcgcaggatctgcattggtcagacggctgggacgtgtgccagcccttgaggtcttcgagaggtctgatgaggacatgcagacgcagtacaccgggacgactccgggagttgctctgtatataatacacgcacgtcttacgtctacctggcgtatatgtatgtatatcgggtgcttctgacggagatgcagtgtttgtactagtgctatatatgtgtttaatttacttggagctgtccaggccggtttaccgtacctatatatggagcacttcgtcaataaataaaggtgcattgttatatacggtgcgccgtgg

SEQ ID NO: 11936 - DNA, 1126 bp, Sorghum bicolor
  Clone ID: SORBI-28MAY03-CLUS45_1
gtctcgcgcccgaggcctagccccgccggcccctccctgccgccgccgagctaggaaggaattcaagaacgaagcaggatgtttagagctagaggcctgcaacgccttctcaaaccagcctcgtcgggcttcctcgtcaatggcggcttcttctcctccttggccgccgactctcagaggttagctggaaaggtagcggtgatcaccggcggcgcgagcgggatcgggaaggcgacggcagctgagtttgtcaggaacggggcgagggtcatcatcgccgacgtccaggacgacctcggacacgccgtagctaccgagctgggcgccgacgccgtgcgatacacccgctgcgacgtcacggacgaggcgcaggtcgccgcggccgtcgacctcgccgtccagctccacggccgcctcgacgtgatgtacaacaacgcgggcatcggcggcgacatggcggcgtcctcgctgggcgccatcgacctggccgacttcgaccgcgtcatggccgtcaacgcccggggcgtgctggccggcgtgaagcacgccgcgcgcgtcatggtgccgcgccgcaccggcagcatcatctgcaccgccagcaccaccgctgtgctgggcgacatggcccctacgccctactgcgtctccaaggtggcggtcgttggaatcgtgcgcgccgtggccggacagatggcgcgctccggggtgcgcgtcaacgccatctccccgcacgctatcccgacgccgctggcgatggctactatggcgcagtggttccccgataggagcgtcgaggagcatcggcggatcctcgagagggacatgaacgagatggccgggcctgtgctggaggcggaggacattgccagggcggcggtttacctggcgtccgacgaggccaagtacgtgaacggacagaatctggtcgtcgacggcgggtacacggtgagcaaagcgctgaacatgccagcccctgcagcacgctgaggggtctctcgttctgaaccccactaagcccttgttcggtttcttggaaggatttctcagccggagtggttcctaggaatggtttgctaatttgtataatcttgatcaaggctgaatggtttcgaggtgtggaataaaa

SEQ ID NO: 11937 - DNA, 739 bp, Sorghum bicolor
  Clone ID: SORBI-28MAY03-CLUS45031_1
cctcttcttcttcttctcccaaggcgagggcgaggcgaggccgcgataccacaacacaacgacgagggggcgaacgcggccgccgcttccgccccacatccccgtcccctgtgctggagccgggctgctgcggaccggactgcagatccgtcgtcactcggggcttgggatacaagcaactctcgggcttatactttgcgtcgatcaccttcttttgtcaatggagaccactgaacctctacaggatatcatgtgtgagtttcgtgctggtaagatgtctcttgagggaacacgagtggttcctgacacacgcaagggtcttgtccgcgttgggaggggtgaagaaggtttagtccattttcagtggcttgatcgtggacagaacatcgttgaagatgatcaaatcatctttcctgatgaggcggtgtttgagaaggtcacagaatcttctggaagggtttacatcttgaagttcaagcatgacagcagaaaattcttcttctggatgcaggaaccaaatgctaatggggatgcccagacttgcatgcaagttaatgcctacataaaccgaccattagatgctgaggctgatcttcgagtacctattgaagcagaaatgtctgaagatacggccgatgatgatatctcttccagagctgggaatttagttgagagcatgaccgctgatttggctggtgaagtgacgtctgctgctggacctgtacgcttggaggatctg

SEQ ID NO: 11938 - DNA, 678 bp, Sorghum bicolor
  Clone ID: SORBI-28MAY03-CLUS45164_1
catgatctcagagcccctcgatggcggtggtggtgtcggtccatcacggcagcttggaggcctgcctgtctcgggtgagcaccaccgtggcgccggctggcccctggccgccagggagaaccagacgctgcgggaaggcatggacagcatgaagcagcgtgtggccgagctggagaaggagtgctccgccatgagagaggacatcgagcggctcggccgcagccgcagcgccagcaagagcaggttcccgttcgcgctcaccgcaaagcccgtctgcagcaccaaggacaaagaggctgctccggagtcgtcaaagtcaaaggcaaaggcggcggcaacagggagcgaggacaagctggccgtggtcaagggcggtgccgccactgatggcgcggcgcagccgaagcacaggaagcacaagatgaacctgtcagcctgttagatatatctacatatacacaataggtccaggatgaacactactgtgagagagactatcgatttttttggcatttgctcagtgaaaatgcatagcgttaccagcatcttttggacttcgacatccatccagagttccaggggagtatgctccagctgttccatgcttcccgttgtacttgtacatgtccatgaatctgaaaagaatttactagtagaatatcctaccaagttcttgga

SEQ ID NO: 11939 - DNA, 1013 bp, Sorghum bicolor
  Clone ID: SORBI-28MAY03-CLUS45290_1
ccacaagtgcactcctgggcagatgcagccgccctgattgcaccatgccgcaccccaacagggagcagggttcaacgacctgctcgcacccccgggatcactcccccaggatccacccctacgtggaggcggacgagcggatgctgcccgtctgctacaccctccccgcacccgtcgcgcaacttggcagctataaaggagtttactcctgggcccatagaaatgagattctgtgaagattcagcatctcaacataaaccaagcttaaactactggtttagagctcggggaaaactttcagatgaccaagctctacatagatgtgttgtagcatatgcttcggacctactatattctggtgtgagccttaaccctcatcgggagaagggtttgaagacatactcgctcagtcttgatcattccatctggttccacaaacctgtgaaggctgacgaatggttgctgtatgtgatcgagagcccatctgcacacggtggtcggggtttcgtcactggacgcatgttcaacaggcaaggagagcttatcatgtcgctaacccaagaggcgttgattagaaaggagaagccacgaggacgaaatctgaggccgaagctttgagagatgcaccatcctttcttctaatttggtttaaatatttatgaattcacaagcaaaaatgtacaatcagtggtggagcagctttatcgaaaacctggagttcctagaggaccctttaggtgttctcttagctctattttttttcccctagagcagagtttgtagagctgcacctatttagctgaaaaatatggagcggtacagtcaaacacgcccttagtgcttgcaccattctctttctggagtataatacgtggttgatacgaaaaggggggaaggaaaacaatatttggttgtgcaatatatatgctcaagaccatgtgtagtagcagtcttagctaactttcagtgaatcaatagtgccaagaaacgtctcattttatggctcgtttgtt

SEQ ID NO: 11940 - DNA, 701 bp, Sorghum bicolor
  Clone ID: SORBI-28MAY03-CLUS45454_1
acccagaggtcgattgttatgatttgttttcagctgtagcaggaccggactgctgcctcaatacttcgactacatgcatcttcctacagcacggtccacaatcaacctctatcaaaaacatgattcacatgtcgcagctggtcaggaaatcatcgatcagaaagtacgactacggaaacgagaaggagaacatgaagcactacaatcagacacggcccccagcatacgacctctcgtccatcccgaggcatgtccccttgttcttcacccatggcggccaagatttcctcggcgacgtccctgacaccaggcacctcctgcggacgatcatcagagagcatgacagcgatgacatcgaggtgatgtacatgcctgactacgcgcacggcgactttgtcatgggctacaatgctccacaactcatatacaagcccatggtggaattcttcaagcgtcactaagaacttactccatgtcattttgtcataaagctgctacatactgcaattatttcaggtcatacttgtgtaattcggggaaaaaaaccgtatgtgaaagtttgaggtaaaccccagtctctgacggtatggaagcgggattatcttgcatgtgctcttatagatgcatcttgtaaggctatgctacagtggagttatattgccgtaagcaaatataaagttgatggcttgtaagcctctttg

SEQ ID NO: 11941 - DNA, 708 bp, Sorghum bicolor
  Clone ID: SORBI-28MAY03-CLUS74220_1
caatgatgaatcaagatttcacacggttgcttatctctcgcaaatttggtggtttgaagtcagaggggaggttgattttttcttcccagaaggtacatacagcctattttaccgcgttcatcttggtcgaccattcaagcgtcttggacggcgagtttatagctcagagcacatccacggctgggatataaagccggtgcgtttccaaatgtcaacttccgatggacagcatgttcagtccaagtgttatttaactgatcctggtatttggatcaatcaccatgtcggggactttatcgtgaaggactcgagcagaccaataaacatcaggtttgcaatgattcagatagattgcacacacacgaaaggtggtctttgtgtggattcagtggtggtgaaaccgcaatacctcacgcagaaaaaagcaccatggacttatgtgtagatttgtcaaacaagttgcgtctagagatgtgatccatagttttttttttttttgttctgcggatgtgcattttgtttatagatgtgcggttttacaattgcacttatacaagttacagagtattttgcagtactgcaatgtaactgaaggggtaagtgttttttaattcctcttgtccccctaggaacatgttggacctctgtaaattgttcatttgaactttgaaatgtacatctgttgtggtctgcacttgttcacccccc

SEQ ID NO: 11942 - DNA, 833 bp, Sorghum bicolor
  Clone ID: SORBI-28MAY03-CLUS40323_1
gctccgagcacgtgctgtcgccgtcgccggacctccccgaccgcgaccacgccgagagccagtccgccgggttatggtggcccgtcggcgtcggcggcgactgggccgccgccgaggacgggttcatggtcgacgtcgacgtcgacgacgggagctcgctgttcgggccgccgtccccggggctgccgttcgctcgcgtcgacgccgccgcgttcggcgacatgctcgcgtcgtacctccacaagccgttctgaagcaagcccctgatcgtctcggccagtcaccactgacatggacgttctggtcgtcgtgtacctcggttcaggtcgtcgtgcaccgttgcgtgctcgaccttttgggcacagctgcgccgcatgcatggagatcgatgagggctgagcatggtggatgacttgtgacgatcatggtgggtacttggtagaggagcttgctagccgtcggatctgctggcctcggattaatctgactgtcagtttttggtcgcgtcaagtacgtagctgacaactaagaatgaagcctactcgattcaggggctgttgaattgttgttggtggcatggtgtatgtaatctagtctagtctagtctagttctagctgtacttagaattggtttcaggttaattagtggcaaacaggcaacgagctttaatttggttttgttgagtgtttatgcactataattgcaacgtcatgcatgtactagagtcgctctcagcggtcgctttctcgtgacagggccgggaagccgaaaaattttgtaatgcaattatctaataaagtgttgtaacttgtaattaaaaaaaaaaaaaaaa

SEQ ID NO: 11943 - DNA, 1257 bp, Sorghum bicolor
  Clone ID: SORBI-28MAY03-CLUS40992_1
gcgccggccaccccgccacccgcccccggccgggccagtcgccccggtcccgcgcgctaggtggtagaccgaccgaggatggcgacgacgacggctgcgcgggcgccgccgctgctggttgcggccgttgcggtggcggtggcggtgctggtggaggtggcgacggcggcggcgccgcggaagcccgtggacgtgccgttccagaagaactacgtgccgacgtgggcgcaggaccacatccactacgtggacggccggcgggaggtgcagctgtacctggacaagtccacggggacgggcttccagacgcggggctcctacctcttcggccacttcagcatgcacatgaagctcgtcggcggcgactccgcgggcaccgtcacggcgttctacctgtcgtcgcagaactcggagcacgacgagatcgacttcgagttcctgggcaaccggacggggcagccctacatcctgcagaccaacgtgttcaccggcggcaagggcgaccgcgagcagaggatctacctctggttcgaccccaccaaggagtaccactcctactccgtcctctggaacctctacatgatcgcgttcttcgtggacgacgtgccgatccgtgtgttcaagaacacgagctcggacctgggggtgcggtacccgttcagccagccgatgaagctctactccagcctgtggaacgccgacgactgggcgacccgcggcgggcgggagaagacggactggtccaacgcgcccttcgtcgcctcctacaggggattccacgtcgacggctgcgaggcctccgccgaggcccgctactgcgccacccagggcgcgcgctggtgggaccagcccgagttcagggacctcgacgccgcgcagtaccgcaagctcgccgacgtccgccgccgctacaccatctacaactactgcaccgaccgcgaccgctacgccgccatgccgcccgagtgcgcgcgcgaccgcgacgtctgacgacactgattcctgatacggtaccaagggccaaggggtgtgctgcttgttgatccatcgagagcagccatgtaatgtacgtatcgtattgtattgtgtgtgtgtgtgtgtgtgtgtcaggttcgtcatatgggtgagcacgtgcacacttactacacatgctttgtgttgtaccgtgtactgtatctgctcatagcgaaatgaattgatcttatttgcattgcagtttttagtactactataaaaatttagcttaagttatgttaa

SEQ ID NO: 11944 - DNA, 701 bp, Sorghum bicolor
  Clone ID: SORBI-28MAY03-CLUS41085_1
gtactacaagacgaacgggcacgacaggtgctacggcaacagcacgggaccgccgtgcacggggtgggtggagatgatggtgcccgtgttctcgcgcgcggcgtggcggtgcgcgtggcacatgatccagaacgacctcgtctacgcctggggcatggactacaagctcggctactgcgcgcagggcgaccggagccgcaacgtcggcgtcgtcgacagcgagtacgtgttccaccggggcatccccacgctcggcgacgacggcaaggcgacggtgtcggcgtcgtcgttggggagagaccggttagcggtgagacagcggtcctacaccgagctgcaggtgttcaacaggaggtggaagaaggccgtggcggaggacgggtgctggaccgacccttacccgaaatcggcggcgaccaccgcctgatcgttggacgggacgaggcaccgcagtgcagggaagtacagtagttggtagctgtcagattgaccttgcctagaagatggtagcagatcatacatcatacaccgcattagtttacaggttcagagagttctatatatgatgtacagatatttttttttcatgtttcatgcccgtggtctatacaagggaataagcatgcatggataaagaaatttgttgtaattttttcttaaaaaaaataaattgtgagatgatgaatacagtttcagcatac

SEQ ID NO: 11945 - DNA, 910 bp, Sorghum bicolor
  Clone ID: SORBI-28MAY03-CLUS4117_1
gcacgtccgcccacgcgtccgaccttttcaagcttgcatctgtggctcaactaagttttaacagagtcgtggacatactaggaaaaacatttggaaggcgacacagagtacgtgttccacaaggagctatgggttggcaaggacccccacaaagccctggttcttacattgtcaagaagattttgcggttggaagtaccgacagaaacataccctaatttcaattttatcgctcgtcttcttggaccaagaggaaactctttaaagaggattgaagcctctacaggctgtcgtgttttcatcagagggaagggctcaattaatgattctggcaaggaggaacaactcaagggaagaactggctatgaacacttgagcgaacccctccatatcttgattgaagctgagttacccgctaatgtgattgatgcaagacttgcaaaggcccaggagatcctcgaagagttgttgaaaccagtggatgaatcacaagactactacaagagacagcaactccgagaacttgcaatgttgaattcgccactccgagaggagagtccacatccaggtggtgctcctcctagtcccttcagtaatggcggcatgaaaagagtgaaacaatgacaccgcggaggctcgttcctccatcttgactctccagcaaccccaatcgtccatgccttcacaccctatttttccatgagcaagctttcatgacggtgttgatagtgtgtgacatcctttactgtactagcaggtgaattttgatctctcatcccatgtgacattaaccttgagtgacagatgactatgcgtagtgtatcctctatggctgtataattagaacatttgatttatttgttactggtaatgctgagatatagtactgtgcagaattctgagtttcagtg

SEQ ID NO: 11946 - DNA, 800 bp, Sorghum bicolor
  Clone ID: SORBI-28MAY03-CLUS46210_1
ctgcgcccgcagcagcacttctcgccatgccccgggttcagaatcgttgttctggatgcttatgacttcagttgccttggctggcccaatgatcatcctgtgactgcagcagcaatgaagctactggatgagaagaacccaaacactgacaagaacagccctgatggtctggtcggcgtcgacaggcggttcgtgaagttcaatggcgcagttggcaaggagcagctgtcctggctcaatggtgtccttcaggacgcatcgacgcaccatcaaaatgtcatcatatgcagccatctcccaatggatcccggggcatcttcccccgcagctctcatgtggaactacgatgaggtgatggctattgttcaccggtacaactgtgtcaaggcctgctttgccgggcatgaccacaagggtggccactctgtggactcacacggtgtgcaccaccgcaccctcgaggctgccttggagtgtcctcctggcaccagcgcatttggtcatgtcgaagtgtatcctgacaggctgctgcttgtaggtgttgacagaatggctaatactgagatccctttctaagccattagagtgtttgtctagcacacaaaaattcatgcgacttcgttgtcataattccattgaaacaggattgcaataatgaaatgaaattccctatggtccttggtttctattgaggattgctcgagtataagcccataaacaatcatgctgtaatccctttgctgcagcttctttacacgaaatgtgtctaacaataatcaaaaaaaaaaaaaaaaaaggcc

SEQ ID NO: 11947 - DNA, 880 bp, Sorghum bicolor
  Clone ID: SORBI-28MAY03-CLUS47713_1
tggaaaaaggaggcagccagccgcacgaggacccagaggaagcggccgtttttgacatctcgtatgtgcgatttcgctggaatcctcctcgactgattttaccgcacagaagaaaagagataaaacacgacaaaaatctaaggaaaacgcaatcacatcctcttcgtccgtcgccgtcgtctctcttcattggtagcagcttaatccaaccccagtccagcccgccgccatggaggcgctgatggccacggacaaatgcttctccccggccagggcgatgtccccgatgccgattatgaggcccactcccactccatcaccagaacatgccagtcagtatctggaggacttgttgcaggagcaacagaagctcgggcccttcatgcaggtgctcccaatctgcggcaggctgttgaatcaagagataatgagaatatcaaacctgctttctaactctggagttagaggaaatgagaggttgccaccaattgcaagtccaaaccacatgcatccattgccccgtgtacctaatttctgtggaaacggtttcggtccgtggaatgggatgcatcctgagagaaatggttttcctaggggagccatgggctggcaaggggccgtacagaaccattcctcctacattgtcaagaagatcgtgcgattggaagttccaacagaggcttaccccaattttaacttcattggccgtctgcttggtccgaggggacactcactaaagagagttgaagctactacaggctgccgtgttttcatcagagggaagggctccataaaagatcctgtgaaagaggaacagctcaagggaaggcctggctatgaacacttgggtgatccaacacatatcttaattgaggctgaa

SEQ ID NO: 11948 - DNA, 1367 bp, Sorghum bicolor
  Clone ID: SORBI-28MAY03-CLUS4790_1
tggagtgcacgcccgtcttccgtttccacttcccgccgcaataaacaagtcccagttgggagtttgcttcggttgggccgggggttcagatcgttctttgctggagtagagaaagagaattcagtcggcggcgatgggtatcctctcgctcatcaccggcaaggcgggcgccagcgggttcgggtccgcgtccacggcggagcaggtcaccgacggcgtcgacgccagccgcctcaccgtcgtcatcacaggaggagctagtggcattggtctggagacctcaagagtcttcgccctgagaggagcccatgtggtcattgctgctagaaacacagaggctgcatcagaagcaaggaagaccatcatggagaagaacccaacagcacgtattgatgttctgaagcttgacctcagctccctcaagtctgtcagggctttcgcggaccagttcaactcgatgaaacttcctctgaacatcctgataaataatgcaggtgtgatgttctgcccttttcaactgtctaaagatggggttgaaatgcaattcgcgaccaatcatctcggacactttctgctcaccaatctcctccttgatactataaaagccactgccaagtctactggtattgagggtcgcattgtgaacttgtcatcagttgcccaccaccatacatatccaaagggaattgactttgataaactcaacgatgagaaaatatacaatgacaaaatggcttatggacagtctaagctggcaaacttactgcatgcgaatgagctctctagaaggctgaaggcagaaggagcaaacatcacagttaacagtgtccatcctggattgatcatgaccaatttgatgaggcactcctttgttctcatgaaggtgcttcaggttgccacttatatactgtggaagaatgtaccccagggagccgcaactacttgttatgcaggactgaaccctcaactcaagggagtgactggaaaatactttgctgactgcaacgtggagaagacgagcaagctggcgaggagcgaggagttggcgaagcaactctgggacttcagcgaggagctgatcaagtctgcgaaatgagagccgaaagagctggatcagagaaatgttctgttcctgcttggcatctggtggtacaagtgatgactggttaatatgtagcggtggttattaggaacctgagcgatgactggaccttcggtggtgttcagaaataaagtctgcttgcttatttcctagattaattagtctggtgtggcaaagatcaacttgtagcgctgttaatatctgttcaatatacatgcagctcagttctggcttgaaattcagagtcgtgtttgcctgaaacatg

SEQ ID NO: 11949 - DNA, 672 bp, Sorghum bicolor
  Clone ID: SORBI-28MAY03-CLUS48033_1
gcaccgatgatggcgacagtgtcttggagctgctgaaggttggaggggtgtataagcagagctcggacatggacaagaagaaggtgctgctcggcgagtccatggtgaccgtcgtcaggacagacgacggtggtgcgcttgacttgattgaggagcgggtggcgtactggtgcaaggtgaagctggacctgtcggcgatgtatgacaagttggagacggaggctgcaggggcgaagtccggtggcgatgtcacggaggctcttgctctccgggaggcgtccgtggaggccatcaacagagccatgtaccacgacatctacaacgccgtcctgctcgctctcaagctgaggcgtggcggcgacagtggcaacggcggcagctccgctatggaaaattcacctcccacgccactgcaccctgccaagacaccagtctaagaacataccagccgtggaagagaagaacacggacaggaaattaaagcatctttgtgttgttgagaatgaataatatgctggcaacagttcagaaaaaaaaagaacgcattgtgatctttgtgctgctatcatgctaaagtctaccatgtctaaactctgaacacatttcaacaacgcattgtgatctttgagtcatacttgtaataatcaatgtcagatacttcgatgcctcttc

SEQ ID NO: 11950 - DNA, 725 bp, Sorghum bicolor
  Clone ID: SORBI-28MAY03-CLUS4828_1
ctcttattctcaccatcttgattcagatataggtgtttctgttgtggataggtttacctattatacacttgctttctttgagaaactgaacatgtatagcaatgcctcactgaacagtcttttcacctcatacaatccttccatgctgatgtctactgcgtattatcgaatggatctttatgagcgtcccttaaatgaggtgcctgtgacaaatttctttggatcagtcatgaagactctccacacagattcagcctacacaggtttcttggctgcacatgacaatgaaactcccatggacatcggagataatctagatgatcagttcatgttaaaggatagagctaccgcaagaagatcaaacatagaaaaggaggcacaattaacgccacatggatggactgaagtgctgcttgaacagctggagggaaggaatactgatactgttgtgatatatggtctgggtgctatgggtatattgttggcactttcaacttggttatcaatgtaggcactaaaaagagttctgttcacacactatccaagaataaccccctcgcgacagccagacaaaaaaaaagaatatggttgtgattttttctttgtcttggtttttagattaattgagtagagttctctacaaattgctgtatgtagttctttggaaattactatattattactctgttaacatgatttttttgggaatgatttgtgtatcacat

SEQ ID NO: 11951 - DNA, 1060 bp, Sorghum bicolor
  Clone ID: SORBI-28MAY03-CLUS47356_1
gcacgagcccagcccgaccccacctagccccgctcgactgctccgccccgcttcgttgccaacttccgctccaagcgtcgcggtcgccaagtctcatcggcgagcccggtggctgtgctgccgccgcgatggattcgaggccccgcgagactgacgcccccggcgacccggccaacggcgccgcccctccgcaggccgcggcggtgacgtccgcgaccgcgaccggggacgtcgagatcatcaggccccgcaacgacaagcgtgggtaccgccgcgtcgtgctccccaactcgctcgagtgcctgctcatcagcgaccccgacaccgataaggcggcggcgtcaatgaatgtttcggtggggtacttctgcgaccccgatgggctggaggggctcgcacacttcctcgagcatatgcttttctatgccagtgaaaaatatccagaagaagacagttactcaaagtacattgcagagcatggtggttcaaccaatgctttcacatcatctgaacacacaaacttctatttcgatgtgaacagtgatagcctgcatgatgctttagataggtttgcacaattttttatcaagccattgatgtctccagatgctacacttagggaaataaaagctgttgactctgaaaatcagaaaaacctcttgtcagatccttggcgaatgagtcagcttcagaagcatctttgtgcagagaatcatccttatcataagttcagcactggaaattggaatactcttgaagttaaagcaaaggagaaaggattggacacaaggcttgagcttattaaattttatgattcacactactcagccaacttgatgcaactcgttgtgtatggaaaagatagtcttgataacctgcagaaccttgttgaaaataagttctgcgatattagagatgttgggaggaagccattttcatttcctggtcatccatgtacacgtgaacatctccagatccttgtcaaagcagttcccattaaacaagggcacactttgagaatcctatttccaatcactcccaatattcggcgttacaaaga

SEQ ID NO: 11952 - DNA, 1061 bp, Sorghum bicolor
  Clone ID: SORBI-28MAY03-CLUS11834_1
ctgtattgtttacatgcgtactgatatgtcaatatccaagagctctccttcctacttggccaagctgcaatgggatgaggtgcaagccactgttcagaaaatccagggtatctttgagcaatgcttagcagttcatgataaactggaggcctcgttgcgtgatttgtctaggacaggagacattcagtcttgcaaggcagctcgtaaagctgctgacgcacagtttaaggagctatcaaaagatctgaagccgctgttgatgactctacagtcatctccccagtcttatcagatatggccaaaggtagaggacttgattgcaaaggagagagagatgcaggagaagctcatgacaaggcattccactgttgtcgacagctttgagaagaagttgcgtgggcaagatgtagagaacaggattgctttgcagcagcagaaagttgccgcactgaggcaggaggttgaatctcttttagagtacattagtgagatttgagcaaatgagtggtgctgtggcgtgatacatctttagcgattagactgtctttgctgggtttatggtttaccccaatattgaaatctactacagagagattgtgtcggtaaccatctagtttcccagttgaggactggaagttgcaatgaccatgtaacatgataatcactgtaatccttctgagctgactcaattttgcatttgataaaaatatcacagagaacgtcatctggatcgagttccggtgccccgccagtatcgtttcaggtttcacagcagatgccacagtatggcatgccccctggtgctccgccgcatgcaccaccagctggccaaccaatgtacttcccgaaataagtggttttggttcagtattgtcagagagcaatcacagcacagtacctgcaacaattgtggtccgcaaatgccatcttcaaaattttggaagtgcattgtagctctttgatgtagctcttgtaacttgcgagcacccttcgcaagaatacctcagcgctggctgtctgtaaaactgtcaaaaatagtgttaacatattagcctgcaggt

SEQ ID NO: 11953 - DNA, 463 bp, Sorghum bicolor
  Clone ID: LIB3478-035-P1-K1-A2
tatgtcaatatccaagagctctccttcctacttggccaagctgcaatgggatgaggtgcaagccactgttcagaaaatccagggtatctttgagcaatgcttagcagttcatgataaactggaggcctcgttgcgtgatttgtctaggacaggagacattcagtcttgcaaggcagctcgtaaagctgctgacgcacagtttaaggagctatcaaaagatctgaagccgctgttgatgactctacagtcatctccccagtcttatcagatatggccaaaggtagaggacttgattgcaaaggagagagagatgcaggctctaatccaatatccagatataacaaccgcagccgttgctaaacaagctttggagggacactgcatatatgatggtggttactgtaagcttcatctgtcatactctcgtcatactgatctcaatgtaaaggcgcatgatgagaga

SEQ ID NO: 11954 - DNA, 1254 bp, Sorghum bicolor
  Clone ID: SORBI-28MAY03-CLUS12261_1
gcacgaggctgcgcctccttccccatccgcacgcacccgcccgccgctgctcctccggcagcgtcgccaccgccacgcgcccacccgcaacccgcccgaacggccggccagcgctgtctggtattagtggtactagtatctatcaaatcagccatctgccctctgccctcctatccaaaatcaagtccatttccatttccctttcctctctaccctcactctcgtctccggcgggcggtggtctcactcacctccctttccccgtcgccccctgatggctccctcggcagctctcgctccggcggccttccgctccgccttctcgacgccgctcgcgtccaaccctacccgtaatagaataaacatagaaggtgctttctgtttgccttgttccacaaggaagagagctagttatagaccttttcgagtgtacagtttatttggagggaagaaggataaagatgagaacggtgatgagccatcgaaagcaggaatttttggaaatatgcaaaatctatatgaaactgttaagaaggcccaaatggttgtccaagttgaggctgtccgggtgcagaaggagcttgcagcgactgagattgatggctattgtgaaggtgaactaatcaaggttacactttctggaaaccagcaacctattagagttgaaatcacggaagctgcaatggagttgggtgctgaaaaactttccgagttggtcaacgatgcttacaaggatgcacatcaacggagcgtccaggccatgaaagagaggatggctgacttggcacagagcttaggaatgcctgcaggcctcggcgatggtctcaagtgatgccgcaattcgggaaacctttccaataatttttttcctcaattttgtatactagccgtgtgagtcgtaagtttaacccctctgcgacctctcatagctgcgtaagaagtgtactcgtgagcacctgttgctttcagctttagctgtaatttgctgttttgcacaagcagatatttgctccctggtaaatgaatcatggtaattaggcttccacctggacgtcccacgcaacatgggtacatcacttgtggtctgctaggctatgttgagcatgtctccaacaagttgttgggctggagcagttgcagcctgtgaagatgagacagccaaagcccattctacatacataccacggaaagccttcagaattggtcgtgtgaccaaaggaggaatcatgacattggtgagcgtgattgaagaga

SEQ ID NO: 11955 - DNA, 1007 bp, Sorghum bicolor
  Clone ID: SORBI-28MAY03-CLUS12380_1
cttgatatgataaaaggcaacaatatccaagtactgatggattcacatttggagggaaactactcaacagatgaggcaaccacattggttgaccttgcctctcagtgcttacagtatgaacctagggatcggcccaacactaaaaagctggtttccgtacttgagcccttgcaaataaaatcagaggtaccatcctatgagatgcttggcattccaaggtatgaagaagaagcatctccccctccacaaccacaacaccctctttcacccatgggtgaagcctgttctaggatggatttgacagctatccatcagattctagtgagtacacattacagggatgatgaagggagtaatgagctatcgttccaggaatggacacagcagatgagggacatgttggaagctaggaaacgcggagactttgcttttcgtgataaagatttcaaggcagccatagattgctacacacagtttgttgatgtggggacgatgatatcaccaacagtgtacgcaaggcggagtttgtgccacctcatgtgcgaccaacctgatgccgccctccgcgacgcaatgcaagcacaatgtgtgtacccagattggccaactgcattctacatgcaagctgttgcgctctcaaagctgaatatgcagagcgacgctacagacatgttgaatgaggcgtcgcagcttgaagagaagcggcagaagaacacaaaaccttgaaagaccctctcagccccggttccttttgcggctcaaaaaggtttatgttgagacatgctgctcggtccttcctaaacattgtggttagttcctggtctaggggttgggaatgtaactggggggtgtgctgtagagtcctgtgattgtcactacctggtttggcatttctgtgatgcattttttgggcccgtgtacatgttacattgacaaaggtcgaaacaggcagaatgcaagggaattttacttctggttgggaaaaaaaaaaaaaaaaaaggccccta

SEQ ID NO: 11956 - DNA, 968 bp, Sorghum bicolor
  Clone ID: SORBI-28MAY03-CLUS12503_1
gccggccgggccgggcatatggaagtacatctcgatttgacttccaaaatgcaattgagaaacttccaaataacatatttgagaagagctatcctttgagagagtttgatctaccaaaacgaatcagtgcattcttttataaagctgctgagcttagtctggttgggtttgtggctggctctgttcaaggtggtatgtcaaaagtcttgtctgcaagaaaagaaaggaggttatcggtgactattccctctatcagcaccaatgctcttggttatggagctttcctaggactctatgcgaacttgcgttatcaattgctctgtggactagaccaatatatggtcaagcgctttgatgttttgggtgtggcaatcttctttagcacagcagcaagactgatgaatattcagattggtgaggcatcaaggcgaacatggcttggcgaggaagctgatccacagtactcagatcgactgctgagagcctacaagaggcctgtggaggtttacatggaccaacaggattcaaggtggtttatatccaaggatgcaattgtatctggccttggtcttctaggcatcaagcagggtggacccgaggctgcattgtctaagcctcgtcgaaagagagtcgtccgcaaaaaggttgcttcaggttgagtttagtggatttggtagcaatgctggaacaattttgcttctgttccactatgcgagagggaggtctacccaaataatggtaaatgagaaactatcaacgtcaaccagcacggtggtctatctgcgaaggcatcaaagggtttgttactgggaagggttggctaaaaggtgcccattactattttataatttaattgcactgatttccttgtttttggtaagaataatatgttggtttcttgtattgctgtgaggcaaatagacacgtttggtggtagctccgtaagattgttaatgtactgactttaa

SEQ ID NO: 11957 - DNA, 669 bp, Sorghum bicolor
  Clone ID: SORBI-28MAY03-CLUS50931_1
gtctcgctctccctgattccttccgcctcgtcagcgaaccagacccacccgagccaacaacccatggccgccgcggcgccgcctctcctgctcgcgggcctcgccctcgccgtcgtcgccgccgcggtctggccgtccctagctgcggcgccggcggcgctgcaggacccggcggagctcctgcgcagggccaaggagccggcgttcgcggactggatggtcggggtgcggcggcggatccacgagaacccggagctgggatacgaggagttccagaccagcgagctcgtgcgccgggagctcgacgcactggggatcccctacaggcaccccttcgccgtcaccggcgtcgtggcaacagtcggcaccggcggcccgcccttcgttgctctgcgggcggacatggacgcgctgcccttgcaggaaagtgtggaatgggaacacaagagcaaagttcccgggaagatgcatgggtgtggacatgatgcacatgttgctatgctgttgggatctgctaagattcttcaggagcatcgtgatgagttgaagggtacagtggttcttgttttccaaccagctgaggaaggtggcggtggggcccagaaaatgatagaagctggagctctggaaacatagatgccatttttgggcttcatatagctgattctg

SEQ ID NO: 11958 - DNA, 1293 bp, Sorghum bicolor
  unsure (1)..(1293): unsure at all n locations
  Clone ID: SORBI-28MAY03-CLUS51133_1
cttcggaatctgatgttacatgggaatggatggagaggtggacagccttaattccaccaatcactgtggagcacctgccagcacgaggagaaaatagtgagttgggtgaaactgtgaccgaacaagtgactgaactttctcagtgtgatgaagacattgttgagttggattcagacctttctttcccaaagttggtggctgatgatgtgaaagaaaaagtagagacatctgattctagtgccttggaggctcctgcaagtgtcccagatgaaagccctaagatggaaataaaacatgatcctgaatcagagttgatcgaaactactaatgtagatgctgagcaagtaactgaccaaaaggctgacaatgacgtggatgagttttttatgtccttggatcaacaatatacccaagctgatgcatcaagggatccctgtccacttcctggaaaatttgaatcatccaacgaggacagcggtgatgcatacaattctgagcagacgcaggagatggaaggtaaaaggtttgtggcgagaaagtcgtgcaatccagcgtttgctgctgcacaattgaaatttgaagagctgagtacaaattcgacagtcagcagatccaacagctcatcacatctggatggggtgaacaagtcaagggtgcacactccaagttcacaagaagattactcgtcaaagcaagatggcacaggcatacaagagagctcagttggtcatgatactaaaatgatagttgctgcatcagaatgtgggactgaaatatcaatttcatccacactggactcaccagatagatcagaaggtgatggtggggagatcgtgatggagattggagctctggaaaatagaaactatgtcactggcaaagctgataaagactccaatattgtccattctgaggtaaaaagtgcacctgaggtagaagcccagccgcagaaggaagtagaacagaatggccatgttcctgcccttgaaatagaagcccagccacaaaaggagcttgttcaggaatctcatgttgaaccagaaatgtcagcagatttgcatgaacaatttgaaaaatctgtcgcatcttatgccacacctgaaggaacaccaatgagccgaacaaccattgcggaatctcatggaacaccatcaagtgaggtctctgttaataccaaaaagagcaggagcaaaaagcctaagtcccatgcaagcaagaggtcgctggctagtccaggcagtgagtcagttggacggagcagcactgacaacttctcanaggaatcaaggcatg

SEQ ID NO: 11959 - DNA, 1092 bp, Sorghum bicolor
  Clone ID: SORBI-28MAY03-CLUS51139_1
cccgtctcgtccttaggggaaaaaaaagagagaggaagaaaaaaaaaaaaacgaaaccgcaacaagcaaaccctcgctttctccgatcgaattgctcgtccccgtgcaaccaccgcctgttcggccgctccccaccaccagtcatctcctccccgcgccggatgatctaggcctctcgcccgcgcgtgccgattttctcccccacctcgagctctcctgactcctccccgcgcgcggctggccatggcgagcacctgaggatacggtcggtgggctgtttctttgagagagtcccccccgagtcctccccacagaaacagcccgggggcagcatcagcgatcgattccttcttcggggcgccttaatttggtctgattattgcctgattggtggtttcgtctcggcctcggcttccgcacctggctagcttggaagccaagtctgggcttgctgcttcgtgtggcttgctgcatctggggaggcggtagcgtgcacgggtgaattccccgcacgaggctcatgcgggacggcgcgcaggctcctcgcggcggcgggggcttcttctcggcgcgctcgctctccaactacatgaggatcgtgtcgtcgggggcgtccacggccgcctccacgcttcgctcggcgggggcgtcgctggtgaactccatggccaaccacgaggaggattcaagtcgtgaccaggtacaatgggctggctttgataaacttgaatgtgggggtggcttgctacggcaagttttgttgctagcttacaagtctggcttccaagtgtgggatgtggaacatgctgatgatgtaagacagctagaatccagacatgatggtgctgtttcgtttattcaagtgctaaaggatccaattttcacaacaaattctggagacagatttgcagatgcatggccgttgctagctcttgcctgtgaaggaactcacacaggaagtggaaacaaccatgatactaatgttcctgtttttgatggaaccaatggtgctttccatagtataggcagtgaaaaccttcctactgtcatacgattttattcactgagaacccatgaatatgtgcatacatt

SEQ ID NO: 11960 - DNA, 902 bp, Sorghum bicolor
  Clone ID: SORBI-28MAY03-CLUS51159_1
gcacgaggatggcccgggccttgtcggcccatcccgcattcggaagtgtggcgtggatccgtggtcggtcaaaaaaacacgttttcacccttcccttcccagctccgttccctcccaagccctaactcccaaatccccccgctctcctctaatggccgccgccgccgccgccgccgacgccgacgcagcagaggtggagcggctttacgagctcggcgagcgcctctcctccgccaaggacaagtccgagcatgcggcggactacgaggcgattattgcagcggtgaagggacagagtgtcaaggcgaagcagctcgcagcgcagctcatccccaggttcttccggagcttccctgcactcgccacgcgtgccatgtcggccatgttcgacctcgtcgatatggaggagctcgcgatcagaatacaagctattcgggggtttccacttcttggcaaagatactgaatttgtgtcaaaaattgcagatgttttgggacaactccttacaagtgaggaaaatgtagagcgtgatgctgttcataaagcgctcatgtcccttatacgacaagatgttaaaaattctttacaacctttatttaagcatgtggagcaaggatcagagattcgtgagaagattatttcttttcttcgagacaaggtctttcctcttaaagcagagctactgaaacctcaagcagaaatggagagatttataacagatttgataaagaaaagtgtgcaagatgtaactggttcagaatttgaactattcatgggattcctgcgaagcttgagcatatttggggatactgctcctagagagtcctttcaagaactaattgaaattattcaagcacaggctgatctgaattcacaattcaatgtttctgacattgaccaca

SEQ ID NO: 11961 - DNA, 1314 bp, Sorghum bicolor
  Clone ID: SORBI-28MAY03-CLUS51165_1
gcacgaggctttctctcaccccgctccttctccccaccccagttcccactcacatattcgtccacacacagaatccatggccatggcaaccagttgtggctccatgactaaacctccaattaccttcaaaactccctttgtcaataaacaagcctctaattggatacctgctacaatcagcaatggcactggtggtatgttcactgtggcaagcagaaattcgagaaatgggttccaagttcgtgctgtcactggagacccgggctctcgcaatgcgtctgatgtaaagttcccaactgattacacacaacttctgatgcaggctaaagaagctgctgaatcagcttttaaggatggaaagcagctgctggaaattgagttccctacagctggactacaaactgtgccaggtgatggtgaaggaggaaatgagatgactggaagcatgcttctcattagagaattttgtgatcgctttgtacctgcagaaaaatcaactcgaaccagagtattcttccctgaggcaaatgaggtttcttttgcaagacagtcagcctttgaaggatgttcactgaagctagattatcttacaaaaccatctttattcgaagattttggttttacaacaaaagtcaaaatggcagatcgtgtcaaaccagaagatgagacattcctggtggcttatccttacttcaatgtcaatgaaatgcttgtggtcgaagaactttacaacgaagcagtagttgggaccaaccggaaattgataatattcaatggagaactagatcgaataagaagtggatactatccatcgttcttctacccaaaacttgcagagctttccaaaacatttctcccgaagctggatacagtttactatattcacaatttcaagggagttaaagggggaacacttttcaggtgttaccctgaaccttggaaggtcctgagaaaagcatcgtctggcagctacatctgcctgcatcaacaagaggaaatgccttcactgaaggaagtggccctcgacatccttccttctgtatagctaggatctttcgagaattacatgtcaataagaaagtttaccagaaaaggcataaactgttatccaatgcttcatggctgtttttttctttgttctacataggaaggtagaaagggtacaagcgatcaggtcttcatttcccacttgtttggtttttatatacttgtgcacaagattgtagattttgctgactgctaagttgaatattgccagaagatgcccatggagcattatagaaagcatcaatcatctctcctatttatagcaaa

SEQ ID NO: 11962 - DNA, 678 bp, Sorghum bicolor
  Clone ID: SORBI-28MAY03-CLUS45586_1
cgacatgggcgcgggcgccgtgaacgcggcgcgcgcgctggaccccggcctggtgttcgacgccgggtacagcgactacctccggttcctgtgcgcggtgcccggcgtggacaacgccgcggtgctgcgcgcggtgggcgcgccgtgccctcccccgccgtcgccgcgtgcgggggcgggggcggcgcggtggtgcacggacctgaacgcggcgagcgtgacggtggcgagcctgctgggttcgcggcgcgtggaccggcgggtgacgagcgtgggcgcgcagaacgagacgtacatggcgtacgtgcgcgcgcccggcggcgtggcggtgcgtgtgtcgccctcgcagttcgccatcgcgccaggcgcggcgcggacgctgcggatcgtgctcaacaccaccgcgcccgggaacgcgttcagcttcggggaggtggtgctcaagggcgacaagaagcaccgcgtccggatcccgctcgccgtctaccccgccgcggcactgagcccgtgaactcgatcgagcacagaagtatacccgctcgtagttactctagtacagtatgtttgtacgcaggcagggagcaaagcgtttcaaagttcaaacgtatacgtacatgtacatgtacccgttctaaaattaaaatgcagagccctgctggttacgcgggaattctcgtg

SEQ ID NO: 11963 - DNA, 1331 bp, Sorghum bicolor
  Clone ID: SORBI-28MAY03-CLUS45708_1
gcacgaggagcggttcggccagtcgcccgtgttcatcgcctccacgctcgtcgaggacggcggtctgccgcagggcgccgccgccgaccccgccgcgctcatcaaggaggccatccacgtcatcagctgcgggtacgaggagaagacagagtggggcaaggagattgggtggatctacgggtcggtgacggaggatattctgacggggttcaagatgcactgccggggatggaagtcggtgtactgcacgccgacacggccggcgttcaaggggtcggcgcccatcaacctgcccgagcgtctccaccaggtgctgcgttgggcgctggggtcggtggagatcttcatgagccgccactgcccgctctggtacgcctacggcgggcggctcaagtggctggagcgcttcgcctacaccaacaccatcgtctaccccttcacctccatcccgctgctccccgacggcaccatccccgccgtctgcctgctcaccggcaagttcatcattcccacgctgaacaaccttgcgagcatctggttcatcgcgctgttcctgtccatcatcgcgacgagcgtgctggagctgcggtggagcggggtgagcatcgaggactggtggcggaacgagcagttctgggtgatcggcggcgtgtcggcgcacctgttcgccgtgttccagggcttcctcaaggtgctgggcggcgtggacaccagcttcaccgtcacctccaaggcggccggcgacgaggcggacgcgttcggggagctctacctcttcaagtggacgacgctgctggtgcccccgacgacgctcatcatcatcaacatggtgggcatcgtggcgggggtctccgacgccgtcaacaacgggtacggctcgtgggggccgctgttcggcaagctcttcttctccttctgggtcatcgtccacctgtacccgttcctcaagggcctgatggggaggcagaaccggacgcccaccatcgtcgtgctctggtccatcctcctcgcctccatcttctcgctcgtctgggtcaggatcgaccccttcatcccaaaggccaagggacccatcctcaagccatgcggagtcgagtgctgatatgaatatgatcgatcagcgagctcacctagcttgcttgcattgcttgttgcatacaggcacctacttttgggggcaggcttcgattcgatctactcatattcgacttgtttaattctgtacaatgcaagttttgtgatcgagtgagataaagtgttaattgggtgtaagaactgtggtggaggatcgagttcactcaaattaaaggacattatttttttcccccttc

SEQ ID NO: 11964 - DNA, 703 bp, Sorghum bicolor
  Clone ID: SORBI-28MAY03-CLUS45742_1
gcacgaggctcagtgtcatttagaggccatccctgcagctgccccccaccccacctattcttggaagcacataaaattgtagcttatatatatatcctgtagagttcatggtttgacagaagaagttgcagttctagtgccaaaaatcatatagttctcatttctcaatagagatggctcaggatatctatctactcttcctgattcttttcattgccttgaacctgcaaagtgttctctcatggaggatgcagaattctacaaatgatattaatagtgatgatcaatgccccccacagccccaccctttagggatgtgcaactcacgggtagcagcttatggctatccatgtgaagaatataatgtaacaacagacgatggctatattcttagcctaaagaggattcctcatggtctttctaatgctactggtaactcgactgagaatacgaggcaaccagtactactattccatgggctgatggtggatggtttctgttgggtactgagcacaccaaaacaatcactaggcttcattttggcagatggtggctttgatgtttggatcgccaactgtcgtggaacaaggtccagtcgcagacataccaccctcaccccagaagacccggctttttgggactggacatgggaccaacttgctgattatgatcttcctgctgtacttcagtttatctataacca

SEQ ID NO: 11965 - DNA, 709 bp, Sorghum bicolor
  Clone ID: SORBI-28MAY03-CLUS46082_1
gaagagcaaacatgtctacgccagtttcaccatgctcaagcccgctgcggcagtttaagcaaaccaacgcgaggtgcatgcgttctccacctcatccaatgctctcccctggtcttggcaacacattaagttacacgcaaaatcagacaagacgcattccagctcctgccatttcagatccttggctggatgttggccagatgaaactccaaacccccaatatttcccccaaaaggttctgagaacgatttatgaaaaagagaatcaagagcgcaggatctccatgacaaggtagttattcagagatgttcaggaagcaacttgtttgtatagttactacaatacggcacttaccggaggttcagtagtacagcgaaatggggctcttgagaaattgtaacaggaagttctgtatattcgtaggctttaaggtttgttgtcgttcttggtatacatagttatacgtacatatacgtcctgatgtaaatcctacaaaatcttacagatgactacgggatgtaaattcgtaagcttgtgtaagctgatatttctgcgaagtagcagtagttagggacttccatggcagatgtaaccatgtctttccgaatgaatcggaggaatatacatgtaccgtttcatctccatttcagctcttgattcaagccaggtaatttgaaaaaaaaaaaaaaaaaaaaaaaaaaaaaaaaaa

SEQ ID NO: 11966 - DNA, 1436 bp, Sorghum bicolor
  unsure (1)..(1436): unsure at all n locations
  Clone ID: SORBI-28MAY03-CLUS46685_1
tgcacgaggcacctgtttctccacctctctccaattcgctgcgcccaacgatcatgtggaggctcaaggtcgccgaggggggcgggccatggctgaagtcgtgcaacaacttccgcgggcgggtggtgtgggagttcgacccggagctcggcacgccagaggagcgcgccgaggtggagagggtgcgccgggagttcacggagcgccgcttcgagaagagggagtcctctgatctcttattgcgtatgcagtatgcaaagcataaacatcttcaggtggatcctccacccaccaagctcgcagaaaatgtagaagtcacagaggagatcatattagcggcattgaggcgagccctcgatcaacattcaagtctgcaagcagaagatgggtgctggccagccgactatagtggcattttgttcattatgcctctcctggtattcgctctatataccactgggtcactcgataccgtcctatctaaagaacatcgacgtgagatatgtcgctatatttacaatcatcagaatgaagatggtggctggggtaaacaagtgttgggaccaagcaccatgttcggctcatgcttgaactatgttgccttaagacttattggtgaaaagcccacgaatgctgcattgaccaaaggacgtcagtggattttatcccatggaagtgcagctgcaattccacagtggggaaagatatggttctcggtgatgggtttgtatgattggtctggaaataatccaatagttcctgaattatggcttgtcccacactttcttccaattcatccaggacgattttgggtattttgtcgtatggtgtatctgcctatggcttatctctttggtagaaaattcatcggaacgattactccaactatattggaattaagggatgagctctattccgtaccatacagtgaggttgattgggaaaaagctcgtgatacttgtgccaaggtggaccttatatatcctcgaacaatggcacaaaatcttgtatggacctgccttaataaggttatagagccaatgctgaattgttggccagtaaataagttaagagatatagcattgaaaaacatcatgaaacatatccactacgaagatgaaactagtaaatacatctgtacatgtccgataaacaaggcgctagatatgatttgttgttgggcagagaatccaaattcagattcattcaaaaaacatcttccaaggatatatgatatgttatggattgcggaagatggcatgaaggcacaggtctatgatggtaatccaacatgggagacttctttcattgtccaagcctattgctccacaggtcttgttaatgagattggttcaacactccgtaaagctcatgaatttattaagagttcacagatttgtgagaaccaccccgactacnaaacttactaccgtcat

SEQ ID NO: 11967 - DNA, 792 bp, Sorghum bicolor
  Clone ID: SORBI-28MAY03-CLUS53530_1
caacaacaacaacaagttgaacagcagccacttaaattatttgcctcacacaaacgcggcatgttcagattatgtcgtcgttgctaataataactatgacaacggtgtgaacaagaggaaacggatgatgatgatgacagccgccggcgccatggacgagggtgcaggcagcaacggtttcagtaagaaactgaaggcggtgctgccaactgattcaaagaacagcagctactgcaaccagcaggttgtggacacgagtgggttgtttcagtacagcagcctgctcagctacccattcctggagatgcagtagtagtagctagtatctggcctgtttcgaacgcaggaatttcataagaatcgtcaggagtttcacagcagtttaattttacatgagaaactactcaggaacatgattttttttcccgtgttcgaaactgagagatcttgatgtgaattcatatacaaaagtttaacacaagaacaaacagagccgacgggtgatcgatttttccgccattggaacgttgtcaccgtctggggagaagtggagatccaatgatcagaggaagaactggattattgttgcttgcttgtgaccggaacgcacaactcaaattgagtttctcttgagtattttctttccatttttttagtgtaaaatatttttattgtaaaataggaggtgtactactacgacttaaagccacctgtggatcaatgaacgatgaccacgtttcttgtactatatctatatttttatgggagtatttgtattcagcatgtgctgct

SEQ ID NO: 11968 - DNA, 949 bp, Sorghum bicolor
  Clone ID: SORBI-28MAY03-CLUS53712_1
gcacgaggcagattgcacataagttgaaagaaatatccatgcaggctaaggatcgacaaaagaaaagacgagcgaagggcatcaaggttgacaaagaaggagatttgacactcgaagacttggatgatgctactgctactgctactgcagatgccgcgcgggataaaacaaccagcaaaaagaaaaagagctcccacaagaaacatactaatactcatgataatgacaatacggacaagaatggagagcccgatgcgggaggagatcaactggggagtagtcacacagaaaatgaacagattgccgaaccaaggcctaaaagatcaaaaaggctgatgaagagcattactgatgacaaggaattagctgctgctgctgtggttcctgaggaaccagcaaatgaagcggagaatcacagaacccatgactatgatggtacagaagaggttcaagatggcacaccagcctaatccactgacagaagatgagaaccggatgctaaatagcaagatgagtaatttattatgctgagcttgggcatcacaggtgtgtagatcaggagccttctacagactgaaggtgtggaaagcacaaagagaatttaaccgcacatctcccgtactgaaatcagcaaaatcgggtgattaagccgtcagtgcggtgggcggtggcaataagctgacagaggtgttgccttttagaggcgagggctatcctccagaggttagcatgagtccgcatctgcagtattcattgtgctggctgtggccatatgtacataagcatggaggttgaaccatgaccagcacatatagaaataattttgtgtaaagagggtagctattatatctgtactaatcatagttttgatgttgataattaaagcaaaggaacacggctggaaaatagctgccgtggagttggcaggtgtttgatcgtgtctgcccgt

SEQ ID NO: 11969 - DNA, 754 bp, Sorghum bicolor
  Clone ID: SORBI-28MAY03-CLUS53484_1
gagcggactgagccctcgactcctgcaccaacatccgagtctccaactcaagttggtgcttccaatagggaccccggagatcgaactgaaggaaccaagagcacctgtcatgagccactaacccccgattccaactgccagaatggctctcccgttgctagtccaaaccatgagagggcagcaaagaggcagcggggcagtggtactgaattcttagattctgagtctgagttttcccttccacgccacatctttgagtcgagctcaggctcagagttccaacaatactcaatgtcctactcaggacagtagcttgtgttgctcacataatcactgtatcgttgctagcttgttcagcacgatgggtaggctgatgtctcaaggagtgtgttgtggtagacaaagctgtaggtgttcagtgaatgtttacatggtatacgtgacagctatttacgttcctaggtttgtaacatgtatgtccgtctgcagttcagttggagatgcttgaaggctaaggttctgttgtgtgtgacctgtaggcacgaggctgtcagcttgtattctcttggtaatctgtgtcagcagagcgttagcattaagtcagttaattgaacagtgctgttatctgtaacgtctgagtttgatctgaaactgcagttaattgaggaagacatgaacagtgctgtgctgatctcaattggattcctgtgtttagattctcttcatttatgtggaagggcaacaacggtactgc

SEQ ID NO: 11970 - DNA, 728 bp, Sorghum bicolor
  unsure (1)..(728): unsure at all n locations
  Clone ID: SORBI-28MAY03-CLUS5396_1
gggagcaggcagagagagatagaatnggagacagtctagacttcgaaattaagaggtggtctgctgggaaagagggcaacttgcgtgctttgttatcaactttacaatatatactttggccagaatgtggatggcaagctgtatccttgactgatttgattactggagctgctgttaagaagcagtacagaaaggcgacgctatgcattcatcctgataaggtgcagcagaagggcgcaacacttcagcagaaatatattgcagaaaaagtctttgacattcttaaggaggcatggaataaattcaactctgaagagctcttttgaagcaatctctgtgaatataaatatatggacagcttaactgtaatacgaacatgaattgccggagtggccaaggcacagatgaacaaagtgaaagctccacctcaattaccttggattctgttcagttgctcgtgttgttgccctgatctgtacctgttcactccaaatgtatatgcagccttctactcatctgagggccaatggcatgtctttttttttggatagtttttacagggtggtttggaccacattgtaatgtcttcttaatactattttgtgtacaatggaccacagaaattcaaactacacttgctctctagccttgttgattttctaccaaaaaaagggatgtacaatgtacagattgtaccatagttgattgaaatgtgatttggtttactt

SEQ ID NO: 11971 - DNA, 773 bp, Sorghum bicolor
  Clone ID: SORBI-28MAY03-CLUS5401_1
ctctgctatctcgccagccgttcacccccgttcatccggcctccgttaaatctctctccctcccggcgacgactgggcgacagccgctgccgccctaccccagctctacgtcggacccttcgccggcgacgagcacccgccagatggcgagcacggggcggtcgatgctgctgtccctgctgctcttcgcagtgacgctgtcgctgctggagatgtacagagccaagttcgcctcgtcggagctcatgaccatcgccggtggattcgtctgctcccttctcttcctgctactcctcacctttattggaaactaccaagaagctagtggagatagaactgggtggggtgcagttgttgtagcacaacttgtagctcttattgtagctggcactgtccaccgtgtctgtatcacaacatgcttcctgttttccgctggactcctttacgaggttgacaagctctctggcatgatccttgcgaggagcgagtctaaggtgaggcggcactgagcacagaagcagcacagaagagatgattcatgtacgatgacatattttgtatgtcaaactgaagtgctagttcgcgctcaccatcggagttgaactcatcaggcctttttctgctaggcgtataggggccctggattctggatactggtgcgttggcaccgaggtcacattctgatgtttgtctaatcaattgactaggtaatttaccatcttttaccggtttcgcgatgtcaaaaacaaaaaaaaaaaaaaaaaaggccccta

SEQ ID NO: 11972 - DNA, 1158 bp, Sorghum bicolor
  Clone ID: SORBI-28MAY03-CLUS5638_1
ctcttcgtctcctccccccccgctccctctaccaccagcaccgcgggaccgcttgctcgtctcgtcgcagaccgtccccgagccggaaccctagcggctgccattgcccgcgcgccgcgcgcccgatggacggcgggggctccgggccggcgcccaacgccgcgcgcaccgcggacgaggtcttccgcgactacaaagcccgccgcgccggcatgatcaaggcgctcaccaccgatgtggagaggttcttcaagctctgtgaccccgaaaaggagaacttgtgcctttatggctatcccaatgagacgtgggaggtgaccttgccagctgaggaagtgcccccagagatccctgaaccagcattaggaatcaactttgctagggatggcatgaatgagaaggactggctggcgctagttgcagtccacagcgattcctggttactctctgttgcattctactttggtgcacggtttggatttgacagagaagctaggaggcgactctttagcatgataaacaacatgcccacaatatttgaggtagtgacaggagcagtcaagggccagcccttgcacggggcacctggcagtagcagcaagagcaacaagcctagttcaaaagtgcagtcaagagcagagtctcgttcaaaggctaaggttcccaaagatgaagaagagagcggcgatgacgatggggatgaggaggcggaggagcacgacaacaccctgtgtggaacctgcggaaccaatgacggcaaggaccagttctggatctgctgcgataactgcgagaagtggtaccatgggaagtgcgtcaagatcacacctgcccgagctgagcacatcaagcagtacaagtgcccagactgcaccaacaagagggccagggcatgagcgacgagcatcccatcggcgaccttgctaggaaggaagaaagcaccctcctggcgtcaaagatccctagatatggcgtagctccctagtctgtaagcctgcattttcattcatggttattattatatctgttcattagctgttcgacctagcagtgtcttaaaacgtgacatgtctcctgtgctgagcgttgacatgggccctcctccctctagtctgtaaacgctgtcactgaaggtacctctcaactgaccatttctcc

SEQ ID NO: 11973 - DNA, 982 bp, Sorghum bicolor
  Clone ID: SORBI-28MAY03-CLUS48323_1
ctctgggagcacccagagagaagagcctgctggtagctactgcactagcttgccgctaatcttgaaaccagctagcagagatggccgggcagcagatgccagggtggccccggcagcagaaggaggcggcggcggtatccatggtgcaactgagcaccttcacaagggtgccgtcgatcccgagggaccagagctaccgtgatttcccggtgacggtgcgcgtcacggcggcgccgccggatttcgtccaaggcgaacgcaccctggtggatgtggtggcggcgatcgacctcaggtggagcatgggcttcgacgacaagtacggcccccgacccaacgaccggctggtgagggtgaaggaggccatggccaaggtgattgacaacctgggtgtcgacgcccagaaccgccttgccgttgtaggattcaaccaagaggttgccaccagcacggagcttctggaaatgactgcccaaggccagcaaagtgccattgagactgtgaatgcgctgaaagtcttgggtcggccgtccaccttttctgttggcttgaatgaggccaaaaagatcctagatggacgcagtctggcggagaaacggcgtagtctaggcttcatcatcttcgtctccaacggagatgacgttaccttcttagagaaagacatcccgacagcgtacccaatccacgcgttcggtctcacagcacaacacagtccctccaagctgaaagccatggccaaccagacacttggaagctacactcccatcgagaacgacgacctcgagacgaagctcgccgagaagctggaccagctttcggtcaggctcacctccgtcgtcgccgtcgacacgaccatcgacctcaccacactgcaccatggagtggttgtatccaagctagagtcgtcttgggcctataacgatgctcttgtattctacaagagcgaaatcggtggcggcaaaacgtccggcaaggtcgtcgt

SEQ ID NO: 11974 - DNA, 1328 bp, Sorghum bicolor
  Clone ID: SORBI-28MAY03-CLUS48492_1
gcacgaggccgtctccaacgcccgccgccgtcgcctctgcatcacacgctccctcccctccgtcctcacccacagccgccgccccggtccctgcagcgcctcccctcccacgacctctccaacgacggcaatccccaaccgcacaggaaggaggaaggagaaaggaggaaggaggaagaagaaggggaggaagccgaggaggggaggaggaggtgcgtcggccgtcgtcttgttccgttcccggctgtcgtcttctccacgtgcccatcccgcgcccaccgccagccccgccccgtcgtcccgctccggccagcggccgcgctcggccgcctgccggtggaggaggagccccgtcctaccccggcgacccttgccggccccttccccgtcgcgtccccgctgtcggtccggctcgtgtcttcgtcgccgtgaagctgtgctgccaaatcaggagcaccaccagattgtaagggctagaaaactactattggagcactccagtactcaataaaacaataaaggcaaggcggcggcgtctccaccttcgccggattccgccaccgatggatcccgcagcgccagggaggttcgacaggctccagagctccttcaagatctccgtccagtgcctcctcacagcctgctcccgcgagcgtggttgtcaatgaggctttctcctcattcaccgatgccgagaaggcgcgtctgcacctaatggtcacacttgtgctgaagaatatgcatgtcaacataatggatgagtttaatgacttctgcgaagaaacacaggtggctgctgcccttgacaagatagatgactttgttgaagagcaaaacctggacgcattagcttcagagaaaactactgttgaagaaatccaagaaaaggtatcaagagcaaagaaggatgaagttgaacatttgactggtttactaaagaaggttgaaaaaagcaagaatgccatgaaagctcgaattgaactcctgaagaaaggggaggattcaactgctgcaacagatgtcctcaataagttgacgcggtggaacagtgcactcgtgttgtgtcatgacgagccactgacgctctgcgctcctgaacaacaatagcctttgaatcttgtcatgatgattcattggcgtcaaaggacatctttgtatagataggatgacatgtgaatacgtcattcatggatcagcctggatgttatgtgatgattaagaattgcttatgcatgttatgtatcgtgcaataaacacattgtctgtgctttggatataattcttagaacccatgaagtaatcgcaacgttcctgcagtgttttatctc

SEQ ID NO: 11975 - DNA, 895 bp, Sorghum bicolor
  unsure (1)..(895): unsure at all n locations
  Clone ID: SORBI-28MAY03-CLUS5042_1
cccggtctcggctgctccggccctttcccaaagccgagcagcagccacgagggagcgagggagccaccagccaccgcccgcccccagtcagtcccacaggccacaggccacaaacccagtaatcatcactagctagctgcgcactacgccgatcgagagcatcatcagctgctggcaatcgcagccgtccggccggccatggccaccgtgccagtagtgctagtcctgcatgttctgctcggtgctgcggccgccgcctgcgccgtggcggtggacgcggcagcggcagcggcaggaagtagcaaggtggcagcggcagggagtagcaaggtgccggcgatctatgtgttcggcgactcgacggcggacgtgggcaacaacaactacctgccgggcggcggcgtgccgcgggccaacttcccccacaacggcgtcgacttccccacgtcgcggcccaccggcaggttcagcaacggatacaacggcgtcgacttcttggctagcagcttggcgttccaccgctgcccgtaaacttcgcctgccgcaggatcaggcattctcgacacaacagggagctccatcatcccgcttagcaagcaggtggagcaattcgccgccgtgcagcgcaacatctcctcgcgcgtcggcaccggagccgccggcaccctgctgtcgcgttccctgttcctcgtgggggggcggcggcaacgacctgttcgccttcttctcgcgtaagaacagcacgccgtcggacgccgacaagcggcggttcgtcgccaacctcgtcgcgctgtaccagaaccacgtcaaggctctgtacgtgctcggggcgaggaagttcgcggngatcgacgtgccgccgatcggggggggggcctacccgnggagcctgcac

SEQ ID NO: 11976 - DNA, 981 bp, Sorghum bicolor
  Clone ID: SORBI-28MAY03-CLUS4932_1
cccacttctgactccccctccccgcgggtcggggcgccttaaacccacgcaatccagcggaggagcccatctccgcccccggcgacgccgctcaaaccctagccgctccgccggctctgccaccgcaagccaatgcccccacctcgaaccctggcatcaccatttcacttcatagccgtggcgagcacttgctgggaccagcaacacaacagccgagctttgtttaggcaagatgaacaggaagccaggagactgggactgcaggtcgtgccagcacctcaacttcagccgtcgggacatatgccagcgctgcagtgaaccacgcggagttgctgatcgtggcagtggtggtggaggtgactatgccaacttcggtggccgtggcggttcctccttcggaggtggctttggtgctggctctgatgtccgccctggtgactggtactgctcctgcggtgcacacaacttcgccagccgctccaactgcttcaagtgctctgcctacaaggaggaggctgctgtaaacagtggtgctggtggctttgatagtgacatgtcacgctcacggggctatggcttcggcagcggtgctgcccgtaccaaccgccccggttggaagtctggagactggatctgcaccaggtctggatgcaacgagcacaactttgctagcaggatggaatgtttcaggtgcaacgcaccacgggactccggtagcgctgccatgacctacgaaaattacttgcactgaggcgtaggagccaagtttgcagcgtcgtcgacgaagcggaagcagcaagaagagaggagtcctcagctcacatcataagagagtagtagatttgcaaaagacatccttgatgctctattactagttttgttctacccctaccgtaatttcttttagatttggttcgttctcatccccatttgggacagtacccccggacctattatgtttgctgttttatttaccgttgg

SEQ ID NO: 11977 - DNA, 1050 bp, Sorghum bicolor
  Clone ID: SORBI-28MAY03-CLUS50428_1
gggaattaggtgacacgaaatcagattttaaaggtgaagaattattcaaaaggaacaatattgtgagagtgaatctattgttgctacaagagagaatttgttaattgatccgtcctgtggtgctgagtcgatagatgtgtcagatgtattggaatcgttgatggaagaaaggggtgaaacttcgtacatgccaggatcagtagaggacttcctagctgcttcagccgaggaagaagtacaatactctagccctatcgcattatctccttggggtgaacctaattactaccaaggtgatgctgttgattctgcattatggggtattcaagatgatatgtggtcattgctttcaccaagacctatgctccaaccttcatctggtattggaactgagaaggaaacttatgatatcaacgaggtggctgtgacccatgttaatagtgaattgtttcaaagaggatcggccatcgcagacgagggcgtgaactctcctgataatgctaatcggggcagccaactgagtcatcaccaccgtggcaggtactcccaaatcagtgaatcttggctacttagttcaaatcactctaggagtaggtctgatagatttggcagcggtgggtcatcaagatcaacttcaaaggggcaaagtaggggctaatgtatattctcaagtgcgggagaaagggtgcatctttgtagctacctgcatccttgatctcacagcaggaataggttttaaaattctttgtcatatctttgcagtttgtataggctaattacaatttagtcgacagagtgtaaatgaccatctcagctccactcaactgtagcaaggagcatatgtttagcatagaggtgtgactgaatggccctgtccaagaagtagatttagctcttgggcatggtctgtatcatcttacattctgttagatgaagctgcaattgtatcactggcatctattgacaccgaaacgcctgatgtgatggaaacggttagatctgattgattggttatcttcagttcttctcgatgatgattagtcatcgtct

SEQ ID NO: 11978 - DNA, 1384 bp, Sorghum bicolor
  Clone ID: SORBI-28MAY03-CLUS57335_1
gcacgagggcttcttcggcggcccgtcctcgcccgccgcccccgccgacccctcgtcgcggcccgcgacctcgaccggcccccccccctcgtgcgccggcgccgccccctaccgccccggcgccgccctggccttcgccgccgccccgtcctgcccgcccggccgcccctcccagcacctcttcctgcatcctcgtcgctccgtcctcgtccgcagctctggccgccccttcatcgccacctgcttcgtccaccatgccccctccgtcgggtgccgactcggcacgacgccaaagtggggccacttaagggatgtgcacaaagccatcaagctctgcgaaccagcgctcatagcaactgatccatcatacacttctctaggtcaaaatgctgaggcagcggtatacaagactggttcagtttgcgcagcattccttgccaacatagatggtcaatctgataaaaccgtcaccttcaatgggagaatgtacaggctccctgcgtggtctgtcagcatccttcctgactgcaagaatgtggtgcttaacacagcacagatcaattctcaagtgacgagttcagaaatgagatacttggaatcgagcaacatggcatcagatggctcattcatcacgccagaactggcagtatctggctggagctatgccatagagcctgtaggtattacaaaggacaatgcactaacaaaggctggactgatggagcagataaacaccacagcagatgccagtgatttcctctggtactcaacaagcatcacagttaaaggtgatgaaccctatctaaatggcagccagtccaatctggttgtcaactcacttggacatgttcttcaggtctacatcaatggtaaaattgcaggaagcgcacaaggtagtgcgagcagctcactcatctcatggcagaaaccaattgaacttgtacctgggaagaacaaaatagatcttctaagtgcaacagttgggctgtcgaattatggtgcattcttcgacctggtaggtgctggaattactgggccagtaaagctgagtggaacaaatggtgcactcgatctgtcttctgcagaatggacataccagattggactcagaggagaagatctgcacctatatgatccttcagaagcctcaccagaatgggtctcagccaatgcttatccaatcaatcaaccactgatttggtacaagaccaagttcacgcctcctgctggtgatgatcctgttgcaattgacttcacgggaatgggtaaaggcgaagcatgggtgaacggacagagcattggtcgatactggccaacaaatctggctccacagagtggctgtgtcaactcgtgcaactacagaggaagctacaattcaaacaaa

SEQ ID NO: 11979 - DNA, 825 bp, Sorghum bicolor
  Clone ID: SORBI-28MAY03-CLUS57626_1
gcacgaggcacaaccacagcaactggcaagcctctgaatccatgcatccttagttccctttccttctgcacttcggcagcaaccacagtttgttgagcgtgttgtgcgagctcagatagctcagctcgctccatggagcccttctgcttcagtttgcaggtcagtcggcataccaccgctacttatctgccctcaactgcaagaattttgctagaaacaaatccatattgttcttactgtacttttatgttcttattactccctttgtatcctagataatcagctgtatgctaattgtgtcatcacttttttttttgcgagtaattgcgtcatcacttatcactgctgtccatagacatcgcaccaagcactttggaagatttggagctgttccaataaggtagtatgtgttggtctttccatggctttgtagcttctatatgctgttaattttacggggattaccgtataggcgtataccatctcagtaaagacatgaatttcagcttcctgactcaactgagatgcccagcccgcaggttctgaaaactcttaaaactccgacaatggatgttaattacttatttagctatttaggctgaagacatcataattatctgtgacttgtttttgaaaaatatttaatgccaaaagttgtgctttgagcactaagctgtccaaaacgacaagcacttgataaaggtgagttctccttccacttttggaaacttgtgaaactccgaccatgaatattaattcagatatatgtatatgtatccatgctgaaaacctgataccatgataatcagcttctatattttcccc

SEQ ID NO: 11980 - DNA, 1105 bp, Sorghum bicolor
  Clone ID: SORBI-28MAY03-CLUS5764_1
gtcgttgcccgcccccctgcactacacctgcacaccaagcggcgagagcgcgtgactgacagcgagagccgggacgaggccagcgagcgagcgagagagagctaggggataaccatacccaccaacaccagcaccatggcgacgcccggcgagcagaaggcgccggccgcggcggcggcggcggaggaggtcgtgtccgtggagatgcccgcaccagacgggtggacgaagaagtttactcccaagagagggggaagatctgagattgtttttgtttcaccaactggcgaggaaattaagaacaagaggcaactaagccaatacctgaaggcacaccctggaggacctgcttcttcagagtttgattggggaactggtgatactccaaggcgttctgctcgcattagtgagaaagtgaaggtatttgatagcccagagggcgagaagatcccaaaacgcagcagaaactcaagtggtaggaagggtaggccagggaagaaggaagccactaaaactgaagaagccaaagatgctgaaactggcgaggaggcagaggaggcccctactgaagatgctacaaaggagactgatgtggagatgaagcgcgctgaagaggcgaaggaagcttctgctgaaactgaagatactgagaagtctgcagacaaggctgatgatgctcctgctccagcaccaatggaagaagctcctgctccagcaccaatggaagaagataagaaagaaactgagaagccagctgaatctgttgtagctcttcctgcaccaacggaggataagaaaggagatgccaagccagctgagcatgaagctgtggctccagctccagtaagcaacccaactgagaactcagctcctgctcctgctgagcctgctgttgttcctgctccagcacctgaaaccaaatcagatgccgagcctgttgctgttgatgctccggcacctgaaaccaaatcagatgccgatcttgctgctgtcactgctccagcacctgaagccaaattagatgctgagcctgctgctgtcgttgctccagcgtctgaaaccaaaccagatgctgagcctgctgctgtcactgctccagcacctg

SEQ ID NO: 11981 - DNA, 1094 bp, Sorghum bicolor
  Clone ID: SORBI-28MAY03-CLUS57732_1
gcacgaggcaccgctccggtcgtccccaaatctaagcgagacggggcgcagggagaggagagcctaaaaccgcacgaggcccgaatcggatcccgccgccggagcgccgaacccccgtccctcggcccgccatggagatgggagggatgagtgatgcggagcggctgttcttcttcgagatggcctgcaagaactccgaggccgtgtacgagcagaaccccaacgacgccgacaacctgacgcgatggggcggcgcgctgctggagctgtcgcaggtgcgggccggccccgacggcctcaagctccttgaagatgcggaagccaagctggaggaggcactgcaaattgatcccaacaagtctgatgcactctggtgcttgggaaatgctcagacctctcatggattcttcactccagacactgcaatagctaatgagttctttgcaaaggcaaccgggtgtttccagaaggctgttgatctggaacctgcaaatgagctgtacaggaagtctttagacttgtcaacgaaggcacctgaactgcatttggagatccagaggcaaatggtttctcaagcagcgacacaagcatcctcagcctcaaatccaaggcaatcaaggaagaagaagaaggatagtgacttctggtacgatgtttttggatgggtgatccttggcgctggcatttttgcttgggttggattggcaagatcaatgcctccaccgccaccaccggccaggtgaactgagtcggctgtcaagaatgctttgcaaatgatggcacgcctatgttaaggtgcctcagatatgaatcttgctaggtgatagttttgtatggagaggagagaatgatgtttccatacggtttggtcaaattttcatgcttgttccttctgagagcctcgaggaggtttcttttataagcagcataggctgctggataattttgtacttgtttaccttgataccgtttcgaggctaaaaccattatgttgcgacatttagttttgttggttatgatactggatgttctcgaatggcaccatgcataaagtggcatcaccacgaaataaatgtatgtgtttgtgttttgac

SEQ ID NO: 11982 - DNA, 1623 bp, Sorghum bicolor
  Clone ID: SORBI-28MAY03-CLUS58277_1
aaaaaaaaaaaaaacaagatggcaggcaaggcaactagctagcgtgcccatcggtcggcgccggcgggtagcctgcctaacaatggcgggcgtcctgctcatcatcgtccttaccttcctcctcgtgctgccgtcagcaacggcaatagggcaggtctgcggcaacgccggcaactacacggccaacggcacctaccagtccaatcttgcctccctcgtcgccgccctctcaaccaacatctcttcctcctctcaagctcaactcttcgccaacgccaccgccggcaaagcccccgacgttgtctacgcgctcgcgctctgccgcggcgacatcaccagcagcaacctcaccgggtgcgccgcctgcgtcaacaactcgtttgcgtacgcgcacaagatgtgcccctacgccaaggccgccagcgtttacgacgacgactgcctcgtcggcttctcgagcagcaacatcctcgtcccagccaacaacatcacccgagacatgagcacgctgttccagtactggaacccgacaagcatcaccggcgacgccaccgtggtcgccgccgacgtcaacgatctgctcacgcagaccgctcaggtggcggccgccagtccgaggaggttcgccaccgccttcatggacgcctctagcagctccatccccacgctctactccttagctcagtgcacgcccgacctgtccgccggcgactgcctcgcttgcctccagcggatcgtcggcgtgatcaacgccacaacgtccgtgcgcctgggcggacgggtcctcgtgctgcggtgtaacttcaggttcgagaatatgatgttctacgaaggcgcagccacgacgcgcatcacgccgtcgtcgtcgtcgtcaggccctccggcgtcaccatttccggctccgacaacaaataagaggatgaagccctgggtaattgccgtgtctgcagcacctcctctagcggtagtagcactctgcttcatcttttactgtcgttggcgaagcagaaggtacataaaaggcagaccaagattacgacgaaagccatgggataacaaattgcgaggaggagatgaaccagattgggaaatggaagcggacctctccgagttttcggtttttgactttcatcagatattagaggccacaggtaacttttctgaagaaaataaacttggggaaggtgggtttggccccgtctataaggtaagtatatgcaacactgaaagttattgggaacttcatttagctttttttcactagttatattggaactgtgacttgtgtatcataaaacagctcagcgcagcaaaataccactgaagaacttctgaatattttctcttcacagggtcagtttcctgagggagtagaggtagcagttaaaagacttgcttcacattcaggacaaggttttatagagttcaaaaatgaagtacaactcatagcaaaactccaacacacaaatttggttaggctcttgggatgttgcttacaggaagaagagaaaattttggtctatgaatacttaccaaacaaaagcttggatttctttatctttggtatgtattgtagcttctaatttaggttttatattgatttataaagattttatattgatt

SEQ ID NO: 11983 - DNA, 1198 bp, Sorghum bicolor
  unsure (1)..(1198): unsure at all n locations
  Clone ID: SORBI-28MAY03-CLUS5832_1
accgggnccccccctcggagagagttctctcgctctctgtatggtcaagttcgcagccaccggagttctcgtatggttctaagagacagcagggcacggaagtttcagctgaaaagcaacggctggctgcttcactttttggttcggcagcagctaaagctgataggaaagcacaagcttctagaaagacagcaaaggacagtccctcaactgagaaagtagctaccactaatgtgactgcccagcctgttaaggagcaagtaatccctgctgcaccaccgcctgatctgctggatctgggtgatgagccagtttcatcaaatcctccattggctgatcctttctcacagttagaggggcttcttggaccagcatcggctgctccggtgctttctggaactccggctaccggcgcttccaaagcaccagatctgatgtcaatcttctcagatgatgtaccaactggagtggctagtggatccaccgatcccactctaggtgatgttaattcgacgagctcccacaaaggagcaactgcagtggcttcaaagaagggtccaagccttcaagatgccttgcaaaaggatgctactgcacggcaagtaggcgtgacaccaacagggaacaatcccaatctcttcaaggacttgctaggctaaagaggacagtaggacacaccatatgctccgtgtgtctttgggtaaatggagttcatctccaacatggttccatcaatgaaacagtgatgatctcgctgtttgatcagcataggaaaaaaagggttacaagggctatatttgtttgagagtcagaatacacgacctatctcctttccaattgggagggggttgcactgttgagatttgtggatggttgcgggtatttttcctttaacctcttgtaattttgtgctgagactagtgtacatgtgtttacattacatgatgtgtaatttgtacatgagaccgtggtccagaagcgtgtgctggcgcttttttgttcagctgggaggggcctgctcatctgtgcttttatagtttcccatatttgatgattgatatccactccagtagctgggcattggaaagtataataataattggtgtcattatctgtaactgggtggaataaaatgttaaatgtgtaaggttgttggtccccttgttttagctgataaaaaccgttgccggttttttcc

SEQ ID NO: 11984 - DNA, 775 bp, Sorghum bicolor
  Clone ID: SORBI-28MAY03-CLUS51292_1
gtcgagtcctgtcgtggggacatcattgcctcgcgggccgcaccccgctctccgctcgcttggcctccggggggcgcgcgccgtggaccctgctcgctgcctcggcgccccgtctgtccgcaccccccgctggtccactggaggggccgctccgcgaccgcaacttgccaccaaggctgcccgtaagtctgcacctacaactggaggagtaaagaagcctcaccgttaccgccctggaactgttgctcttcgtgaaatccgcaagtatcagaagagcactgagctgctcataaggaagcttccattccagaggcttgtcagggaaattgcccaggatttcaagactgatctgcgtttccagagccacgcggtccttgcgctgcaggaggctgcggaagcatacctggtgggtctgtttgaggacacaaacctgtgcgccatccacgccaagcgcgtgaccatcatgcccaaggacattcagctggcaaggaggatccgtggcgagagggcgtagtttctctgttactggattggctctggaagtatggtgtgcatctgttcgatgctttgcttttgtggtgcttaacgtttgtgggtgtttgaactctaatgctcattcgtagtggattagttggtaggaagtgctgcgatcttactatgtttttagagtctataattgttgtcgattagtataattgtctaagtgctggtttcgcccatcaacctgatgggttatctgaacctcgaattgatatgttaagttgtgaacttcgtt

SEQ ID NO: 11985 - DNA, 1119 bp, Sorghum bicolor
  Clone ID: SORBI-28MAY03-CLUS5260_1
ttgaaggagttatatctctcatatttgagaaggcagtttttgagcccacgttctgtccgatgtatgctcaactttgttctgacctcaatgtaaagctcccgacattctctcctgaagagccagatggcaaagagatcacgttcaagcgcgtgctattgaacaattgtcaggaagcctttgaaggtgctagtagcttaagagctgaaattgctaaattaactggccctgaccaagacatggaggtgggggacaaagaacggttggtcaaacttagaacacttggaaatattcgcctaattggtgagctactcaagcaaaaaatggttcctgagaagatagttcatcacattgttatggagctattggggtctgggcctgataagaagccatgccctgaagaggaagatgttgaggctatctgtcatttcttcaatacgattggtaaacagcttgatgagaacccaaagtctcggcggattaatgatacctacttcatccagatgaaggagctaacaatgaatcctcagctcgcaccacgattgaggtttatggttcgtgatgtgattgaactccgatcaaataactgggtgcctcgacgtgaggagattaaggccaagacaatcagtgaaattcactctgaggcagaaaagaaccttggattacgacctggagcagcatctgtcattaggaatggccgtagctcaccaggcggccccctttcgcctggaggtgggtttccaatgaatcgcccaggaactggaggcatgatgcctggaatgcctggttcaagaaagatgcctggaatgcctgggttggacaatgataactgggaagttcctcgttctagatcaatgccaagaggtgactcgattcgcaaccacgggccattgctcaataggccgtcaacagttcaaaaggcatcatctattaacacgaggcttcttcctcaaggcagtggcgcagcactaattggcaagagtgcacttttgggaactggtgttccaccatctcgtcctctcagctttacacctggaccaggaccagctcaaactacaccatcaccaaaaccattaattgcaggaccagctgttgcccctgctcctgataaaccaagcagtg

SEQ ID NO: 11986 - DNA, 910 bp, Sorghum bicolor
  Clone ID: SORBI-28MAY03-CLUS5254_1
agaaaatccctctgatttttggtgaaagacgccctggtgatgcagagattctcttttcagagactactaaagcagagagggagcttaactggaaagcaaaatatggtattgaagagatgtgtcgcgaccaatggaactgggccagcaagaacccttatggctatggatcgcttgactctaccaagcagaatggccaccaaacaaatggatctgctgactcctccaagcagaatggccaccacacaaatggttcaactgactcacccaagcggaatgaccactatgcctatgggtccgccgactcacccaagcggaatgggcactatgtttatggatcatcagacttcaagcagaatggtaatggtcacctgcgttgagcagagctgtttgacctgtgagctccctgtacattcggtcgcgatgtgagctccctgtaaggtctatcgtgaacccactatccgagattgatgtggatcattgggttgacaggtcatacagtatagagtcgttggcagcggaattccagtttgctgtgggtaaagcctatcttctgcgttgtttatttttcccttcttgcaattatggtgtaggaatgtggtcatagtgtatcagctgattctattctttccctgctaattgaactgtattacgcttcatcaagtttggctgattactgtttaacggggaaaacttgcacctgtgtatgattatttatttgtacatgtactatgctatgtatgtatgaaagggagaactagcctcgcccgcgatagccctgatgaatttagccgcaattgctcccagatcagactgttgtttcatgtgaatgtacatatgatgccgctgcaaactttgagcagacaaaagtcgcccttttttttagggaacaattattaaatgttcgcttccc

SEQ ID NO: 11987 - DNA, 1003 bp, Sorghum bicolor
  Clone ID: SORBI-28MAY03-CLUS52856_1
ccccgcccaggtctttcccggtcaaggggcactacaccacacacaagtaaatgctcgccatggtcgttgcgcctgcagctggatggcttggtccaagggacactgtgatcattgatgctactctgggagagcttgccaagctatttcctgatgaaattgctgccgaccagagtaaagcaaagattcttaagtatcatattgtgaagacaccgagatcggtttacaaaactgttccaaactgtgaaccttgccgacctctccaaaggtcaccgattgagggtttctatctggctggtgattacacaaagcagaaatacttggcttccatggaaggtgcagttttatccgggaagctttgcgcccagtctatagtgcaggattatagcaggcttgctctcaggagccagaaaagcctacaatccgaagaagttcccgtcccatcttagttttagttagtttagctatcgtcatccccactgggtgccatcttatcgcctatttcatgggaacccaccaaatggtcatgttggcgacacctgttatggtcctttgacaattctttagagttgaattgtgactgtagttgatatcatattcagaaaaagcgatatatatgtaaaaaggacctgcatagcaattgttagacctttgggaaagcaaaaggcgataaagagatcttagagagatacttgtgttgtagccctttcaggtggtggttcctatcaatcggttaattcatcccaccacacaggaagatttgtccattctgcttgaggtaagcttagcaaacctttggtggcccctgctccctgaactttatcaggagagctgctgtagcagtcactggccacatttctcttgtctgtttgtactggactattatataggagtgtttatgagtatctggcaacttgcatccagcaatggctggatgtgtgcctctgatgttacatctacctgaatgaagtagtgtaactggaccaagaaagctccggaacaataa

SEQ ID NO: 11988 - DNA, 777 bp, Sorghum bicolor
  Clone ID: SORBI-28MAY03-CLUS53081_1
attttggatggcaagattgaatgaagggctgtcattatttgatgcaatactgattgttccaatgtttcaaattgcttggaccttcttctctatttgtacaggatttgtttactttcaggaatatcaagtatttgatacgctcaggataattgggtgtgggttgggcttgacgtgcgtcctcgctgggatctccttgctagcacccgatgacagtaaagctgatacaaaaggtgattcgagcaccactgaggactccattattgatgtggacagaaatggaaagatgcagatggaggagacagacacagatgatagcaactcgtttgttacttctgtaaaagtaaaagcaaaacgtgtactgttgaaggcaaagtctgcatgctccatgtcccttggacttggggaggacacgataagcgcttcatcggtgcttgccatgcctatggtctcatcaagaacaaccggcttcagaggaatcggaaatgaccgttcaaagtatgtccctttaagaaccacagattggagtaatctatagccgatggtggtatatagatacacagcaaaggcctttacttttgatgttgcctagcggatggcagtgaagttttttttgttgcttccagaggcaattgtttgttgtgatgatagttagctgtaacaccagtgtatagttcaacgtttcccccccttcaaaacactgtccatacccagctgcatatacatgtgtaagttttagaatacacaactcaaatgattcaattcgcttcgtattgttcc

SEQ ID NO: 11989 - DNA, 1609 bp, Sorghum bicolor
  Clone ID: SORBI-28MAY03-CLUS59597_1
acgacgcccaacggctaacgtccaccccaatccaattagccagaccacctctgctctgcgctgcgggcgcctcggatggaagcactagctatcggatccgcgcctccccggccgggcctcgctgccctcgcaaggtactcccacctccgccgccccggaaccgtcaccggtactctagtcacagctgcgcgccgccccgtcacggcggcctccatggacgccgccgccggtggccgcccgagccccgcgcctatccgctgcaccagcgcggagacggacgccgaggtggaggtggatgaggtcgcgacgagctcgcacgccgcgggggccaccacggacacggagcaagggggcaacgggagccccgtggcgggtgccgcggactccgccgaggtcgtcccgggcgtcgacgggataaggatccggcggcggcccgtcacggggcccgcggtgcactacgtgggcccgttccagttccgcctcgagaacgaggggaacacgccgcggaacatcctcgagaagatcatctgggacaaggatgtagaggtttcgcagatgaaggagaggaggcccctgtacatgctgaagggcccgcttgaggctgctccccccgctagggactttgttggggcgctcaaggcgtcctatgatcgaactggcttgcctgctctgatcgcggaggtcaagaaggcttcaccaagccggggtgttatcagggagaattttgatccggttcagatcgctcaggcatacgagaaaaacggagcagcatgccttagtgttcttacagacgaaaaatactttcagggaagttttaacaacttggaggctattcgcaatgctggagtccagtgccctcttctgtgcaaagagttcattgttgatgcttggcaactttactatgcacggtccaagggtgcagacgctgttcttctaattgctgctgtattacctgaccgcgatatcaaatatatgttgaaaatttgcaagatacttgggatggctgctttagttgaggtccatgatgaaatggaaatggaccgtgttttagggattgatggtgtacagctcatcggcatcaataaccgtaatcttgagacatttgaagttgatattacaaacacaaaaaagcttctggagggtgaacgaggacaaattatagctcaaaaggatgtaattgttgtaggagaatctgggctgttcactcctgatgatatttcgtttgttcaaaatgctggggtcaaagcggttctcgtcggggaatccctcatcaagcaggaggatccagggaaagcaatcgctgggcttttcggcaaagatatctcgcacgctggtgctacctaaagagcaaaggcgcagaagagcaaccagaataagcgagaaacgcaactccaggttgcatcattttgtgtaggggagaaaatggagcggtgcaaatcagaaatccaccacccttccgcagagttttgatcggtcgttttgtttacctgaccagcaacttccccatgctgctgtttctttgtgaccgaaccatctcaaaataaatacagattttagtgcacaagatatgttcaatgagttgaatgtaaattgcaagcagcttgatttt

SEQ ID NO: 11990 - DNA, 1202 bp, Sorghum bicolor
  Clone ID: SORBI-28MAY03-CLUS59773_1
ccgccggcccgccgccccatagccacgtaccgccccgatcatatatacatatcgacgacgactgccgcggctaggtagctacctcgccctgcagcttcttctctatctaatcagctatagctagctagagccatatggccaccgtggacgtcgacacgacgacggagtccggcaaggccgccgccgccgcggcgccgtcccctccggcggcggcgtgcagaaggagcagcttctccggcgccgacctggccctgcgggcgctcctgttcgcggtgacgctcgcgggcctctccggccccgctcccaccaagactctcttccttcttgttctgctcgatgtgttatacgcagctatcatggcttcagcgacggggtcagcgggtggtgtagcgtggatcgggctcaagggcaacacacacaccaactggaccaagatctgcaacatctacggcaacttctgccgtcacatcggcagctccgtcttcctgggcctcgtcgcctccgtcatcctcgtcctgctcaccatcctcaacgcctactgcttgtaccgccgcagtcgctagatagctaagctactacacctgattatacatatatacatcgaagaatgtagctagagcgtgtgatctgtattctgtactgcactattgtgtgtttgtgctgttatttcacactctaggtgtttttttttttgcgaccatcgtcgttagttattgctgtatatgtcactatattctagctggttcttcatctgctgtttgtgcaaaaaatcatttcattattagttgcagtataacagcgtgacgtgcggctccagcttgctgacggcgctcacctcgctcaagctcatctccggctcctctcccaccaagactctcttccttcttgttctgctcgatgtgttatacgcagctatcatggcttcagcgacggggtcagcgggtggtgtagcgtggatcgggctcaagggcaacacacacaccaactggaccaagatctgcaacatctacggcaacttctgccgtcacatcggcagctccgtcttcctgggcctcgtcgcctccgtcatcctcgtcctgctcaccatcctcaacgcctactgcttgtaccgccgcagtcgctagatagctaagctactacacctgattatacatatatacatcgaagaatgtagctagagcgtgtgatctgtattctgtact

SEQ ID NO: 11991 - DNA, 967 bp, Sorghum bicolor
  Clone ID: SORBI-28MAY03-CLUS5961_1
gccggcgtctccttccaccccccccccgaaaacctcacaaaaccctcgctccccaccacccgccgccgcccacgccgccgcctgtaccagcagcttcaagatgagtcggcaccctgaagtgaagtgggctcagaggatcgacaaggtttacatcactgtacagttatctgatgccaaggatgctaaggtcaatttggaaccagatggtgtcttcacattctctggcagtgttggtacaaacgtgtatgaattgaaactagatctgaatgacaaagtaaatgttgaggctagcaaaataagtgtgggggtcaggtccatattctgtatcgtagaaaaagctgaggccaaatggtggaagaaacttgttcgagatgatcaaagggcacctcactttgtgaaagttgattgggacaaatgggttgatgaagatgatgatggtactgatgtgaacttggatgggatggacttctcgaatttcggtggtatgggtggtatgggtggtatgggcggcatgggtgatatggctggtttgggtggtcttggtggtcttggtggtatgggtggtcttggtggtatgggtggtcttggtggcatgggcggcatgggcggtatgggaatggatgatttcgaggatgagagcgatgatgaagaagaagtgtcaaaacctcaagctgcgggcaaggctgttgaggctgagaagacagagtcggcggaaggcaagaccgaggcggctcagagcagttgaagatgcttccgacgtgatctaaactagactgtatcctcgtgttaattcagctgaatcggagaacaaacctttacgttgtggcactggccggtcccagtgacttgccaagaaaatttacgttccgtctttaactgggcatccgagtgtcgtgctcagcatattatggatattgtttccgtgatgcttccctgtggcccccaatcatgtgctggagtttggttt

SEQ ID NO: 11992 - DNA, 1014 bp, Sorghum bicolor
  Clone ID: SORBI-28MAY03-CLUS6009_1
gccggccgggccgggtccaaaaggagaaacaaaagattgaagaagaggaaaataaacttaaagctgctattgaagaagctgaaaaacaatattcagaagttagttctgagatgaaagatcttgaaataaagtctgaacaatttgaggaattggaagagcggtactggcatgaattcaacagttttcagtttcagttggcatctcaccaggaagaaagagacgcagtttttgccaagatagaagtttcccaggttcatctggaactgttgaagcgtactaatgttcttaatgatgcattctatatttcacatgatggagtaattggaacaataaataatttccgcctcggccgcctttctaatgtagaggttgagtgggatgagataaatgctgcttggggtcaggctgcactgctgttgcataccatggctcagtatttcaccccaaaattccaataccggatcaagattcaccctatgggaagctatccaagagtcacagacatccacaataatacatatgaactgtttggtcccgtgaatttgttctggagcacccgatttgacaaagccatgacatggtttctgacttgcctgcaagagttcgctgagtttgccataagtttggataaggagaacaatgttccacctgaaaaatcactgaagcttccctacaagattgatggtgacaaagtagggagccacacgatcgtcctaagtttcaataagaatgaaaactggaccaaggcgctaaagtacatgttgtgcaatctgaagtgggttctctactggtttattggcaatacaagttttgcaccacactcgggatcgctgcacacacaatctctgaagaacaagagttgatgctgttttttttctcgttgactgtacatagtttatatactccctagccgctggatgtagccctagtgacaataacgacacatttgatgtacatgtgtttattgctcgaagtctaccgtgttgtcttgaggccaaaaaaaaaaaaaaaaaa

SEQ ID NO: 11993 - DNA, 874 bp, Sorghum bicolor
  Clone ID: SORBI-28MAY03-CLUS60168_1
ggagatctcgcgtgctgctttcggggtaaggactgggacagtatcaccattacatacgcagtgtgtttattgaatctcttgaatcctgattgacctgaagatggtggaatttcggatcaatataagtggcggggttgggttggttcttggcacaaaagcaagatcaaagctcatctgtccgtatcctagctttggtggcccgcagaacaggggaaggtgtaaaaagggggaaacaaggattaggtggcagaggaggcagtgaaatccagccaaatctcttgtggacgcaatatttcttcccgattgctggtgcgtaagatcctagctgaatccgtaggtcgggcgctaatcggaggaacttgcatcgattctttcgttctgacggataagagggacggtgtttgtggaattgcctccttggaggcggctggtgaagtggtgagagggagcaaggatgacgatgccgtgggggctcgcggcctgcatcgtggacatggtgtgggcggtgctcgccggctgggtgtccacctgcttggtcatcgccaacgaggtcgcccgcggcatgcgcagtggcgagatcggcccattcgttgtcggctgagttatttcaccggcttgggcccttcattcgttcctgcattttagatagtgtatttttcgttccagtacatttcatacacagcattatactgtacaaagaacatagattggacggcttcgggcttaagaactggaggatgactttctaggatttttcagttgtgatcatcttgcaagtgtttgtgcaatcacacaagaacatgtgatgtactttgagtggtatatgtcaagagattgtcccgtaaataattcaaaatttaattcgcatatttaa

SEQ ID NO: 11994 - DNA, 1389 bp, Sorghum bicolor
  Clone ID: SORBI-28MAY03-CLUS61_1
gcacgaggaattactgaagtatgagtgcggagctgaagagggactacgagataggcgcggagatcggtcgcggccgcttcggggtggtccaccgctgcacgtcccgcgccaccggcgaggcgttcgccgtcaagtccgtggaccggtcgcagctggccgacgacctggaccgcgagctcgcggagctggagcccaagctggcgcagctcgccggcgcgggcaaccccggcgtggtgcagacgcacgcggtgtacgaggacgagacgtggacccacacggtgatggacctgtgcgcgggcccggacctgctcgagtgggtgcgcctccgccgcggcgcgcctgtgccggagcccctggcggccgccatcgtcgcgcaggtcgcccaggcgctcgcgctctgccaccgccgcggcgtcgcccaccgcgacgtaaagcccgacaacatcctcatcgacaccgcccccgcagggagcgacgacggcgaggacgaggaagaggacagcggcgaggccgaggaggccgagacggcgccgcgcgcgcggctggcggacttcgggtcggcggcgtgggtgggcgccggtgggctgggccgcgcggaaggcctggtggggacgccccactacgtggcgcccgaggtggtgggcggcggcgagtacggcgcgaaggcggacgtgtggagcgccggcgtggtgatgtacgcgctgctctccggcggcgcgctcccgttcggcggcgagaccgcggcggaggtgctagcggccgtgctgcggggcagcgtccggttcccgcccaggctgttcagcggggtgtcccccgcggccaaggacctgttgaggcgcatgatctgccgcgacgagtggcggaggttcaccgccgagcaagtcctcgctcacccgtggatcgtgagcggcggaggagcacgggcaatcgagcggccaacctgaggatgaggagggcataccataccagcagaggaggagaccatatggcgggcggacgtgtattgccgtagagacacagacacggcaaggaatcccgacgtcgttatgtatacggttttgtatgtatgtatgtatgtacgtacggaccagagagtagtagagtacggtagctgctgccgaatgatgagtagcatcatcgattccgcgctgtgtaggcgcagcagagcagatcgatcggcaaagaagcttgtataggcttctggttttccttacttccgggtttttgggatgctctttacctagcagtgcagagcaccctttttttggatgtgcctggtaagtggtagctggatgtatatacactgaccgtcttgtacaaatggagtggagttggataaataaataaaatcgagcctttgtacttccaaaaaaaaaaaaaaaaaaaaaa

SEQ ID NO: 11995 - DNA, 675 bp, Sorghum bicolor
  Clone ID: SORBI-28MAY03-CLUS54365_1
cacccccggacgcccggaacgcccccacacggcacacgcattgcttgcttgtcgtgctgagccgctccactcctcttccccccgctgctcgcctctcgattccttccgcctcatcgcgtccggcgaaccccatgtccactgcgaccgcggccctcgccgccgcgcgatcccccgctgtcgcgcttctcagcctgcgccgccgcgcccacgcggctgctcccattcgcttccccggtctccgcgtcggctccggttgccgtcacgtagctatggcttccgcggcgcatgcccgcgcccccaccgacccgcttcccaagggtgctgattcatttttccgggcagtgatctcgaacatggaaaaggtttatttgagcaggaatcctacagccaaaaccattctagagcttgtacgatcttatgatggtgatcacatttgttatgaccaccttgctttccggacatttggggtcaatggttatggtataaactcactttctgaatttttcactgattttggttatgtacctcgcgaagaactcagatttccagctaaaaatcttagagcactatggttttccccgcccaccaatggtggctactctggaactggtacatatggacctttccctggcacttgcttcgcccatctgcttggggtggagtggactacaatga

SEQ ID NO: 11996 - DNA, 1411 bp, Sorghum bicolor
  Clone ID: SORBI-28MAY03-CLUS5405_1
tggatcaacatttcaccatcagcccctgctcaacttcgaacatagcccccggccaacctcctccgactcaaccagcaccttctacaggtggattccctggtttttccaacactacgaatcaggccttgatgggacagccaactcctagccaatccagtatggtcatgcagcctgctcctgtttcaaatccatttgggacgcttccagcaatgcctcagatgtccattgggaatggtggatcttcaccatcagttcaatatgggatatcaagtttgccggttgctgagaagcctcttcaaagtagagcattgtccatggcggttcctaggcatttgtcacagagaaggataaaactgctgccgagaaaatataatccaatatctgatggcaaggttccattctttgctgaggatgaagaatctccagcaacaccgaaggcggatgcttttttcatccctagagagaacccaaggaatctggtaattcgtccaattgagcagtggccttcacggagagaaacggaccggcaattgactttgaagaatgccacttatttgaacaaatatgaggatgcttccactgaaagtgagcgtggtaagtctgccatgtcaccaagcagcaggcctcctgcagtggaaaacaacaatcagcatgaggccagggccatggctcagcatgagaatgggaatgttacttcagtcgagaggctattgcctaagcttccacgtgcagattacttcacagagcctagtatagaggagattgcggccaaagaacgtgcacaggcaggttactgtggtcaggtgagggactttgttgtggggcgacatggctacggcagcatcaagttttttggggagactgacgtgaggtgcctagatctagagtcaatcgtggagttcaacaaccgggaggtgattgtgtacaaggacgacagcaagaagcccccggtgggtgaggggctgaacaaagctgcagaggtgactcttctgaacatcaagtgtgtgaacaagaagactggggagcagtactgcgagggggcaagggtggagaggtacagggagatgctggtgaagaaggccgaggagcagggtgcagagtttgtgtccttcgacgctgccaagggagagtggaagttcagggtgaagcacttcagtgcctatgggctttggtgatatcctaagtaatcctgatgccggaggagtgagggatggacgatggaatgtcttgtagttaaagtaaccttttttttttttgtttgctttgatggagcagtacgctttacacccttgtcaaatgtcatgctggggttctgttgtgctccttttgtgcaaaagatttgagttgctgtaaaatgtatgacataatctgctgctgacctctctttgttttgctgcacagcagtgttggc

SEQ ID NO: 11997 - DNA, 405 bp, Sorghum bicolor
  Clone ID: LIB3476-020-P1-K1-H9
gcagggcgcggagtttgtgtcctttgacgctgccaagggagagtggaagttcagggtgaagcacttcagcgcctatgggctttggtgatatacagtaatcctgattcctcaggagtgagggatggacgatggagtgtcttgtagttaaagtagcgtttttttttggttggtttgctttggagtagtggtagttattaagttgcccgctttacgcttttgtaaaatgtcatgctggggttctgtcaccttttgtgcaaaagatttgagttgttgctgtaaaatgcttgcaaactgagctatgctgctgaaaactgcagcagcagcagcagaatccgccataacagtaaggcgtgtgctacctataattaactatgactgcccatgcgctggtaagcacgggtccac

SEQ ID NO: 11998 - DNA, 713 bp, Sorghum bicolor
  Clone ID: SORBI-28MAY03-CLUS57141_1
atcctccaccaacgcgaccgtgcaaccaaccccattcctccgccggccgcccgccgcccgcgatgtcgaaggccgcggcagcgtccctcccgccgccgccgccggaggtggcgcacctggtggagcagctccagcgccaccacctcgccccggacgcgtccctcctctccaactccgcgcactccgacctcctccaggcgcgcgaggaggtcgcggcggagcgcgcgctctatctcgaggcgctggcggtgtacgcggaggcggtggccatggtggaggagtaccatgcggctggcggccccggtgctggcaagaagctcaactgctccccgcaggtgtacgagtctttggagcaccggttggccgtggcggaggcagcgcagaggctgaggctcccactgctctctcaggatggggaggtccatgagcaggagatcgaaaagctgagcaccttttcaaggagttcattcgatagcaccctcacaagcgcgacacccagctcaagttcaatctcgacaagttacaacaattatagcagcactgctagtgcggtgactgttgctgctgcacatggaagtggtagttcagatgcagttgaacctggagttggtggtgttcctgaccgttttcttgggatcacgtctgattatctctatcaagtgcaacaagaacagccagccatgtctgtggacatggttgattatcagagaact

SEQ ID NO: 11999 - DNA, 664 bp, Sorghum bicolor
  Clone ID: SORBI-28MAY03-CLUS5665_1
cctactgcccattagctgcggccgcgcgtctctggttcgctcgtgccgttgcgctgcggctcgcaagcctctctctcctccacccgcacacgccgcccccgcgggagcgaaaccctagctagggttctgcgccgccgccttcgatccagacgcgggcacccttctccgcgagcccgccatggacgccgggcgcaagcggaccgcgccggaggcgggcgccaacggcgcgggcggcccgaagcgcgcgagagaatcggagacaactcaaatgggtgtaggaagcaaatccaagccgtgcaccaaatttttcagcacggctggttgtccctttggtgcaagttgccattttctccataacttcccgggtggctaccaggcggtttcaaagatgaccaacttaggtggaccgcctgttccggctccaccaggaagaatgcctatgggacctggtggccctgatgggccaccttcacctgctgtgaagactcgcatgtgtaacaagtacaacactgcagaaggatgtaaatgggggagcaagtgccacttcgctcatggagaaagggagcttggaaagcccctgcagatggacaactcattgggagctcctcctccaatggggccagggcccaacggtcacttcatgccaccaccaatgcctcaccta

SEQ ID NO: 12000 - DNA, 1507 bp, Sorghum bicolor
  Clone ID: SORBI-28MAY03-CLUS6366_1
ccgtatgcttgatatgggatttgagccacaaataagaaaaattgtgaaacaaataccacctagacggcaaactcttatgtacactgccacatggccaaaagaggttagaagaatagcgtcggatttactgaataacccagttcaagttaacattggaaacactgatcagctggttgcaaataagtcaattactcagcatgtggaagtcatcccacatatggagaaatcaagacgacttgatcaaatcttgcggtcacaagatcctggatcaaaaatcataatattttgctccactaagaggatgtgtgatcagttggctagaaacctatcacggcagtatggtgcttctgctattcatggtgataaatcacagtctgagagggattctgtgttgaatgactttcgaagcggcaggtgtccagtacttgtagccactgatgtggccgctcgaggcttggacataaaggacatcagggtcgtggttaattatgatttcccaactggtgtggaggactacgtccatagaattgggaggactggtagggctggtgcgacaggttctgcctacacattcttcggtgaccaggattcgaagtacgcttcagatcttgtcaagattttggagggtgcaaaccaatctgtgccacaacaattaaaagaaatggctcttcgtggaggatatggtggaagatcacgtcggtgggcatcttctgatgactcttatggtggtcaaggatatggtgctaaaagatcaactgatagcttcaataacagcagcttcggcaaccaggctgggggtggttcaagctttcactcgagcttccataacagctccagtggcaatcagtttggtgatactacgagctttcatggcagctatgataacagcagccgcaacaatcagacaggtgacaatgcgagctttccacccagctccagcaacaatcagtctggggatggtctcagttttcatgaaaggttctatggatcacgtggaagggaccagagcaaaacaagcaatgatggattccgtgcaaggagcagaagtcctcctggcaagcccgtgggagtttccaactggtgattgcatccactaggtgcaatccaattttcgcgatggtgacgaaaccaagtagaactgtagaagatggtaccctaacaagttatattatttccttttcttatcctgcttaaatccaagaatttcctggaacatcactaacttaggatatgggtgatggtctgatccctaatggtcacctgctattttgatttgacgcctgggagtcgcctgattccgtaccatatgcctgtggtcgtaggttgtaaagcgttaaaacttgactttgctaagtatacctaatgctatgacccaaccctgggtaaacaagcgcattgggatgaattttggacaaaaccatggacaactgatattttaatgttatgtacaatctatgtcgaagactgtttgtaaatgctgcccgcatggttttatattgaattgagc

SEQ ID NO: 12001 - DNA, 746 bp, Sorghum bicolor
  Clone ID: SORBI-28MAY03-CLUS63747_1
gtgggctgacaaattcattacttgctgctaagaagccagatcaggcagttgatataattctgttatgccgtcaaaagttgaatgaaaagagtcaaacaggactagtggatttggaggctgcaaatgacaatgatcgccagaagcctcaagatattgacccgatccaagttgacctgcttttagggaaggcttattctgattggggccatatcagtgatgctatctccgtctacgatacactaataactgaacatcctgaagacttccgtggttacttagcaaagggaatcatattaaaggaaaatggtaaagcaggtgatgcagaaagaatgtttattcaggcaaaattctttgccccagaggcagcaaaggcactagttgatcgctatgcacaaagatagtttgtgagacgatgacagattgaatggtgctgttttggaccaatgaaattgtgcggtccattcctaggtgcaaatgtatccgcaagttagaaggaaattctaagtaatttcaccgaccatgtgcaaacattacattcatagacaaaatgagatatatttgtcagtaaataggtcacggttgtgttttacagagatgaccatcaggatgctaggaacgtcttgtatcatagcaatattatggaatctgaggccttgtttagttcaaaaaagttttaagattccctgtcacatcgaatatttggacacatgcatggagtattaaatataatcgaaaacaaaaattaa

SEQ ID NO: 12002 - DNA, 1594 bp, Sorghum bicolor
  Clone ID: SORBI-28MAY03-CLUS6619_1
ctggttcagcagggagccggatcagtctgtggtagagagtcagcgtatgctgatgaacaacatgattgggtcggcgtcatctagtgccatcaagaaattcgttcagatgctagattcgaagggccagtctgacagtgaagagattaggtcgcgtgccatgaggatagtggcgcattttgccagtgagatccgtctgaacaagatcccgtacggtatccaatgcatatcatcgttcctcgagagtcttgaagcatcgatatctcaccatcgacacaaagaaacaatcatagatatccttaagaaactcaccgatgacgaggaaaacttaaggctgatgagcaacgcgaatggtctcgccttgaagatcatcaagatgcttgtagattctgatggcggagaactccatgatagtaagcatgatagatggtgctcaaacatagcagtgcccgggatggaagtgataaagcggttcacctctgtcatcaaaagatccaacaatgttcagctaccacgtgatatcttagagagccctaatgccatcagcaccctggagagtatgctaaaatgtccaaaatgcaaagtgcaagaggagctgcagaaatcagtcataatggttctaacgcaaataacatcgaaggaaacatctttggctgcgggcgaggaaatcaagaagagactcgatgaagtcaagaatagactcatcttgtcgctgatagccattttcctcgacggcggcaatggcaagagttccgtgaaaaaattggcagctggtgaatcgctggcaaagatgtcccgtataaatgagaatagtgccacgatcctgggagcagaggatggtcgcattggtagtggactcactcaagttgttctagacaagaacagcgagtacagaaagagtgcggcagatatcctgaaccatctgtgtagtcattacaccacgaatgaagacagtcgtttcctaaagctgaagaaagcaatgatcgatgacgtgattctgccggtgctgagggaagtgcttggctgtaggccgacagcagaacccaggccacccccctggtacctgtacctagaagacaacgtcgaagagcaggaggcgttgtcatccctttgtgcaaccgtacacgacatactgatcagacaagatcctaatttggccactcagttcgaccaaaaagccgaggagatcggccaggagatggagacgaaggaggtgatgaccttcgctgacctcgtgaaaaaggcccaagacgttgtggacaacaaaaggcggcggcagtcctgggtagtgcatccgtacccgccgccgcagtatgttgtttgttctgctgaggaagatcccaattcgtgctgtatctcgtgagtacgcgagtatagctagatctcgtggcaattcatttccttcgtgtgtcaccagaaattcaagaaatgcgagagggagatgacagtgacacacttatttccctgtctaccaccgcgtcatccatgcatgcgtcgtcatatcatgtattccatgtcgtatatatcactatgtgtccatctgtgtacaatgagtatgtaaacagtcttaaataaaaaaagcgtagttctttaatgt

SEQ ID NO: 12003 - DNA, 994 bp, Sorghum bicolor
  Clone ID: SORBI-28MAY03-CLUS66491_1
gacccagatggcatggttaagttgttaccaatcccttctttgaagaaagtaagaatcacaaaacccaaaatccaacaaagaaatcgccccaagacagttccagtcccagtcccagtcccaaaagaatctccttacaatcaacaagacatgatgctccagaacgctcatggtccagtcccctttgctacctttgccgaaagaccccaaaaggagataatgatcccttggctttgtactagtattgccagtgccttaagaatcaggccaagaggaaaaaggagctcaggaaagtcaccaagaagagctccgccgagaaattacgttacaagaaagatctgcaagaattgttctcggactttagtttcaattggttttgtttgctttgctatttgctgagttgttgcgtagcatttttcaatagagaatgtgtgggggaaacaaggcaagtttccaaaggatttcccccaggaaaagagcttgagaacacttctcgttagatcgcatcagcaagaagacagtttccctgatgttaccattacaaaacccttccctggacccatgtcagggaggataaagaattgaacgaaaaagtaaaggaagaaggaagaacatgccaagagctgctaaggcgctgaaaaaaggctgtatttgaaaagaaaagaaagttacttttacaaaaaccaaaaaccagaaattaaaagaccaaaaccaaaaagaaattgacccccgctaacaaaaacaataattacaataatatttgcttgaagatctttggccccagtagcgcacttgaaagggggtttcaaggaagaatttagcaaggatctcgatacttgttgttccgttattacttttacgaaaagtatgaacacaagatttatatacagtgcttagagtgttttccccttagtaattgctcgttcttgaatacttggtatgccatgcatttcactataccatacaaatctatatactattgcacgaaaattaaacc

SEQ ID NO: 12004 - DNA, 1180 bp, Sorghum bicolor
  Clone ID: SORBI-28MAY03-CLUS6424_1
ctgcctatccgcccaacgccagtccgccaggccccactccgtgcaccggaccccccaatcctccacagcgacaccgcatccgaactcggaaggcgaagccgaagccgcggcgcggatcgaacgatggcggcggcgctggagcaactgagcaggagcaagatgttcgacggcttcaacctccgcttccgccaccaaagcgccaccctcggctgcgccatgactttctccatctacatgcccccgtccccggcgtccaacatacccgtgctgtactggctctctggcctaacctgcaccgacgaaaatttcatcatgaagtccggcgcccagcgcgccgccgccgcccacggcatcgccctcgtctcgcctgacacatccccacgtgggttaaatattgaaggagagtcagacagctatgattttggtgttggtgccgggttttatttgaacgccacaaatgaaaagtggaaaaactggcgcatgtatgattatgttgtgaaggaacttccaaaagttttaagtgacaactttgaacagcttaacacttcacaggcatcaatttttgggcactcaatgggagggcatggtgcgctgacaatttacttgaaaaacactgataaatacaagtcagtatcagcatttgctccaattgccaatccaataaactgcccgtggggtcagaaagcattctcaaattacctgggcccaactaaatcagattgggaggaatatgatgcaacctgcctgattaaaaagaacagcaatgttcccactcctatcctaattgaccagggggatgctgacaagttcctggctgagcagcagttgctacctcacaacttcgaggaggcatgcaaggctgtaggggctactctgatcttacggatgcagcctcgatatgaccattcctactatttcatcgctacgttcatggacgatcacattgcgcaccatgctaagtttctcaagagcgcctgactgcaaagtctcctgtaatttgtagcgtgaggaagacaaggaggcagagctctgtggtttctgaggtgtctgcttgcagcatgttacccatgccgacagtcctctcttgtctgccagcttgaggtgaacaacacacccacatgcgaaataatatgaaagatttgctgttcctgtacaaaaaaaaaaaaaaaaaagaacccta

SEQ ID NO: 12005 - DNA, 302 bp, Sorghum bicolor
  Clone ID: LIB3476-020-P1-K1-A9
gcttgaggtgaacaacacacccacatgcgaaataatatgaaagatttgctgttcctgtccattgaggagctcgaatgggactgatgttgcattgattgtagtttccttgtcattcgctatgcacaattattggccctgatgctgccatttcttttctggtgcaagaattgattgcccaagtgtgcagttgactcttctcgcaaatctgcagggcagcaaatcggtatgatcagagcctggtttgtaagttggtctcgttgtcgctgccctatgtcaatacgaattctgccatggttcccccc

SEQ ID NO: 12006 - DNA, 1215 bp, Sorghum bicolor
  Clone ID: SORBI-28MAY03-CLUS6653_1
gcacgagggcggcgaccttcgtgtgcccgctcgatgtcatcaagaccaggttccaggtgcacggctggcccaagcttgccacaggcacaattggaggtagtgtaattattgggagcttacagcagattgctcaacgggaaggttttcggggaatgtatcgtggcctctccccaacagttcttgcgctcttgcctaactgggcggtctactttactgtgtatgagcaacttaaaagcttgctttctcccgatgatggaagtcatcaactttctttaggggctaatgttgttgctgcatcatgtgctggagctgcaacaactattgtaacaaatccactttgggttgtgaagacaagatttcagacccaaggaataagagccgggtcaatcccgtataaaggtacacttgctgccttgagaagaatagcacatgaagaaggcgtccgaggactatacagtggtctggtccctgccttggctggtatcagccatgttgctattcagttccctgcatacgagaagataaaagcttatctggctgagcgagataatactactgtagaagcattgagttttggtgatgttgctgttgcttcatctctggctaaagtagctgcatcaacattgacatatcctcatgaggttgttcgatcaaggctgcaagaccagcgagcacactctgatgccagatacaaaggtgtaatagactgcatcagaaaggtttatcataaagagggtgtggctggcttctaccggggatgtgccacaaatctgttgcggacgacccctgccgcagtgataactttcactagcttcgagatgatccacaggttccttattgatctattccctgctgaacctgaaccgcaaatccatcctctaaagcattgaccatacaacacctgtaccctatccatgctgccattggagattaggaccccagtaaccatccagcaatgttgttactgtgccagatgtctcttgtaaaagagagagaggttttttcccggatatgcgacaggtagctgccattcaaatcaaaagtgaaacaatagtgtaggcagagcattagcatctctgtatgtaatagatttgttagcatgcatttggggggaggtatatgtggcgatgttgagtatgttttcttgatgatgatgatgaaaagaaaagaatgttccgattccgacatgaaggaacgattgctatttcttttctc

SEQ ID NO: 12007 - DNA, 1163 bp, Sorghum bicolor
  unsure (1)..(1163): unsure at all n locations
  Clone ID: SORBI-28MAY03-CLUS586_1
cgaagggcgagcgagcgacgggacggcaccaatggcgatgcgagcagctccggcggcggcgacaggcttcttctctccatcctccgtctctccgaggcgcttctcgtccgccacaccgccggcgtcactctccaccgggcgctgcatccagcgccatcgtctccgcgccttcccaagttcggaaatacctctagaggaactcaacccatccgtcgatctacttaggaaaactgcggaggccgtcggcgatttcaggaaaacgcccatctatattgtcggcacggattgcacagccaagcgcaacatcgccaagctgcttgcgaattccataatataccgctacctctgcagtgaggaactgcttgaggatgttcttggtgggaaggacgccctcagagccttcaaagaatctgatgagaagggctatcttgaagtcgagaccgaagggttaaagcagctcacgtccatgggtagccttgtgttgtgctgtggtgatggcgctgtcatgaactcaaccaatctggggctactgaggcatggtgtctccatttggattgatgttcctcttgaaatggcagcaaatgatatgctgaagagtacgggaacacaagctactacggatccagactctttttctcaggcgatgagcaagctccgtcagcggtacgatgaactgaaagagcgctatggagtttctgatattactgtttcagtacaaagtgtcgcttctcagcgtgggtacagcagcgttgactcggtgacacttgaggacatggtccttgaaatcgtgaggcaaatcgagaagctgatccgagcaaaggagatgatggaagctgcagggaggcccttctaaactagatagtagataccatgctgcatacacaatatttatgctccggcataccaattgcctgaactccaacgcttcgctgctcaagaaactgattgcaagcgtgtgaagtccaaggagctgaaggtcgttgttccactcgaacatgcttatattgtaattgcaagatcatttgccatttgatagtgcaaatgcattacgtgttcatctgccatggctgaatttactgtctattggaaatggcagttttgcctgtatacatgggcccagcagcccaaaatttgggaattntggtgaaaggaaaatttcagat

SEQ ID NO: 12008 - DNA, 1526 bp, Sorghum bicolor
  Clone ID: SORBI-28MAY03-CLUS59137_1
atagtgtttcagctctccaggaagagctacaaaccaccaaagaaaccactcactgaaaaggagattgatgagctatgtgatgagtgggagccagagccgctatgccctccaatcaaggagggggccagaatagatactccaatgttggaaagtgccgctggaccacataccattgttgatggtaaagaagttgtgaactttgcatcagcaaactaccttggtttaattggcaacgaaaagattattgattcttgcattggttcactggagaaatatggtgttgggtcttgtggtccacgtggcttctatggaacaattgatgtccatcttgactgtgagtcaaaaatagctaatttcctggggactccagactccattctgtattcatatgggatttctacaatattcagtgtgatacctgccttctgtaagaaaggagatatcatagtcgctgatgagggtgttcactgggcagtgcaaaatggtctccatctatcaagaagcactgtggtgtacttcaagcacaatgatatggcttcacttgcaagcactttggaaaaacttactcatggaaataaacgtgctgaaaaggcacgaggctacattgttgtagaatccatttaccagaattctggccaaattgcccccttggatgagattgtcaggttgaaggagaaatatcgtttccgtgttattctggaggagagccattcttttggggtgcttggcaagtctgggcgtggccttgctgaacattatggagttcctattgaaaaaattgatatcatcactgctggaatgggaaatgcattagctactgatggtggtttttgtacaggaagtgtcagagttgttgatcatcagcgtctaagcagctctgggtatgttttctctgcatctctgccaccttatcttgccagcgctgctgtttctgctgtcaactacctggaggagaatccctcagttcttgcaaacctaaggagcaatattgctcttttgcataaagaactatcagatactccagggcttgaaatttccagccatgttctgtcacctatcgtcttccttaagctgaagaaatcaactggctctcctaccactgatctagatcttcttgaaactattgctgacaaggtcttgaaggaagattcagttttcattgtgacatcaaagaagtcaaatctggataggtgcaaacttccccttggaatccgcctgtttgtatcagctggacatactgaatcagacatctccaggctttcctcatccttgaagagggtttctgcatcagttctttcagactacttttgatccacatcgatttcccttgaagatgaaagccatccattttctacgcactttgtactctaggccgcgtgtgtgtgtgtgtgtgtgtgtgtgtgtgtgtgtttggtaaatgtacataacctgtacatttctacatgttctgaattcaccttgttgttgctcatacccatagtacttgcaaaataaaattttgtagaaccggtatgttgaagaatagt

SEQ ID NO: 12009 - DNA, 1028 bp, Sorghum bicolor
  Clone ID: SORBI-28MAY03-CLUS59320_1
gcacgaggcaaacattcatttgatgttgtgtttgagtttgcctctgaagaaagtcaacatgagcctgtaatcctatttctgaaggatgttgagaaaatatgtggaaataattacacctaccatggtctaaagaataaacttgaaagtttcccagctggagtttttattgttgggtcccagattcagacggatgctcggaaagataagtcgaacaatgggtctccttggctcaagttcccatacagccaagcagcaatacttgaccttgcattccaggatagctttggtcgggtgagtgaaaaaaataaagaagcactcaagatgtcaaagcatataactaaacttttcccaaataaagtgacaattgaatcacctcaggatgaaaaagaactctcccagtggaaacagctattggatcgtgacattgaaattcttaaggcaaaggctaatgttttgaaaatgcaatcttttctaacacgccatggtatggaatgtactgatttagaatcagtggtttgtgtcaaagatcgtaatctgacaagcgaatgtgttgataaaatagttggttatgctttgagttatcaactcaaggatcgccctattcaaactcctggaaaggatgcgagagttgtcctttccggtgaaagccttaagcatggagttgatttgttggaaagtatccaaagtgaccctaagaagaagagcacaaagaagtcactcaaggatgttgtcacggagaatgagtttgaaaaacgtcttcttacagacgtcattcctccagatgagattggtgttacctttgaggatattggagcattagaaaatgtcaaggaaactttgaaggagttagtaatgcttcctttgcaaaggcctgagttattctccaaaggacaacttatgaagccatgcaaagggatattgctttttggtccacctggcactggtaagaccatgcttgccaaagctgttgcgacagaggctggtgctaattttatcaacatatcaatgtcaagcattgcttcaaagtg

SEQ ID NO: 12010 - DNA, 1186 bp, Sorghum bicolor
  Clone ID: SORBI-28MAY03-CLUS59423_1
gcacgagggatccttgacatgtacgaggcactcgcagaggtgatccctgaaatgaagcacgtgggcgtaggaagttctggggatggtgtgatcagtgacgtgcaagctattctcgataggcttggggatgccgtgaggggtaacctgtttgagtttgggaagatgttacagcaggagacctcacggagggcgatgacaactggagagatccatccaatgacacgctatgtcatgaactatttgaggttgctggttgtttatagtgagacacttgatgtgctcttggctgatgacagcagtgatcatgatgctttcagaagttctgatgatcaggatcaggaacacttggagaacatgaccccttttggaaggcgtcttctgaagttgatatcttacctggaggccaatttggaggaaaaatctaagctctatgaagatgctgccctggagtgcatattcgccatgaacaatttgctttatattgttcagaaggtaaaggattctgagctgggaaaggttttgggtgatcactggataaagaggcggagtggcaagattcgacaatattcaaagagctacctgaggctttcatgggccaaggctttgtcttatttcaaggaagatggacatgggagtggtagtggtagcgggagtggcagtggcagtggcagtggccattcaagttcgaggatgtccatcaaggataggttcaagaacttcaacatggcctttgaggaaatttataggaaccagacactctggaaagttccagatcctcagctccgggaagaactgaagatatcaatatctgaaaatgtgattccagcttatcgtgcttttctgggcagatatggccatcaagtggacagtggaagaaatccaggaaaatatataaagtacacaccagaagatttggagagccagctatcggatttatttgaggggtcacaagtgtctgccaatcactctaggagaagaacatagttcatggttggcaggatcatattgcaggtatgattttgttgaacggattgatattgatgagcgtttgtacacatcacatctgttgattggatgcttgttcccatagtagtcactacaatactgtaatacaacatgtgaaccttttgatatgcttactattgcatagtgtgaacgaagaaatgctgtacattgacctgttgtt

SEQ ID NO: 12011 - DNA, 1091 bp, Sorghum bicolor
  Clone ID: SORBI-28MAY03-CLUS5949_1
attccatgcaccagcaatgtatgttgctatccaagctgttctttccctatatgccagtggtcgcacaacaggtattgtacttgattctggtgacggtgtgacccacactgtgccaatctatgagggatacgcgcttcctcatgctattcttaggttggatcttgctggtcgtgatctgactgactgcctaatgaagatcctcacagaaaggggttattccttcactacaacagcagaacgggaaattgtaagagatataaaggagaagctggcctttgtcgcccttgattacgagcaggagctcgagactgctaagagcagctcctctgtcgagaagagctatgagttgcctgatgggcaggtcatcacaattggcgcagaaaggttcagatgcccagaagtgcttttccagccgtcactgattgggatggaagctcctggcatccatgagaccacctacaactctatcatgaaatgtgatgttgatatcaggaaggatctgtatggcaacatcgttctcagtggaggaacaaccatgttccctggcattgctgacaggatgagcaaggagattagtgcccttgcaccgagcagtatgaaaatcaaggtagtggcgcctccagagagaaaatacagtgtttggattggtggttcaatccttgcctccctcagcacattccagcagatgtggatatccaaggaagaatacgatgaatccggacctgctatcgtccaccgaaaatgcttctgagctttcagccgcacctttcgttgtgtgtcaggctgttgagatctgcattattgagtgtctttgtgaagtacatatagtttttgcgagcatgattgcatgagggaaggagtacacccaactaagcatttgcctttcatatgccctgctttagtgatccagatgctgcttcttcaagtgatttgtcgatatagtatgcgagcaatgtattggttttggctacagctgtcctgtcatgacattagctatgtatctatctatatctgcatacagtattggctataaaaaaaatttcccctgtgggcggaagactcgatatgatatttaagttcacagttttttt

SEQ ID NO: 12012 - DNA, 1234 bp, Sorghum bicolor
  unsure (1)..(1234): unsure at all n locations
  Clone ID: SORBI-28MAY03-CLUS673_1
gctttctgacaacnnccgtgctacttccacactgggtgggggggtgcgtgctgccagccttactattttgatgtattcaaggggcatnngcttcatgacctggnanactggncccgtgaaaactcagatggtgctgaccaaggctttttggttgggtgctacccagacttgctcgacaaaccaatgtttcaccctccggagagggggggggagctcaatgggacctatcgccttcctctcggctatcaaatggatgcatcctactactatctcaagctacattggcatgtcccgtgtgggccaaacagtgtcatcacattccccagcgcaccttggtttaaaccttggtactggtggtcttggccggtcttgccattaggactttcctggcacaagcagcgctgggacgatcttgggtatgctgctgaaatgccagtggttctgatggaggttttaatgtacatagttatcataacagtcaccagattggcaaggccagggatgaccaaactgtgttataaccgacggcctgagaagcaaagtgccctggtgcagtggctgatcaagctggctgcaattgtggctatggtggctgcctattccattccattctttgtgatcccacgcacagttcacccgatcatgggctggtccatctacctatttggtgcccttgccttgtcagtgctcgttatcaatgtttttctgctcccaccacttgacgtgcttacaacgtggcttgcgattgtcggcatgctcttcgttatggcattcccatggtaccatgatggtgttgtgagggctctggcagtctttggatatgcattttgctcagcgccattcttgtgggcatccatggtgaggatgatggactcagtgcagacgatgctggagagggatccattcttcccccggattggtgaaccagctcaggagactgaattcagcaagctgttctgattcttttatgcacagatttgagatgcttcgtcaccatatgaacagctgatccagatcagtttattctcgattgattctggtggtttttgctcaggcattccattgtgtactcacagtaatgtataaacattgcctgccgcaaccatgattgatgcagatgcaggaaagataggccaattgtactgaattgaaaaaaaaaagcatattgctgcatggaacgggacaggggattgttgcaaagtaaactaaaaaaaaaaaactcgaggggggcccg

SEQ ID NO: 12013 - DNA, 1003 bp, Sorghum bicolor
  Clone ID: SORBI-28MAY03-CLUS67898_1
ctggaatcttccccttaaaactccactctctcccggaaaaatccatccgtccataaaacccaaaaaggttagcagcctccttttctccatctcccagatccgcactgtcgctgatgctacctgcgatctccagctgctgtttctttattatgtgttcgatctccacatgtactgcctgcatcgatcgatacgattcagcgctgttgattgttcaattttggttcatgtagctggccacgtacacaatttgatttgattttgcctgattttcttggagtaccaaataatcttggtcaggtcgtcgttgtttatgctagcccctgacgagcgccgctctctcccggaaaatcctcccgtccttaaacccaaaaagtttcatcaggtttagttgcaaagcagcgatcaaaagcaggcctagacgacggcgatcctcagctcagtagccaggcaggagatggagcacgacgtgcaccaccaccaccatcagcagccggaggaggccatggagctgccgccggggttccgattccaccccaccgacgaggagctcatcacgcactacctcgccaggaaggccgccgacccccgcttcgccccgcgcgccgtcggcgtggccgacctcaacaagtgcgagccatgggacctgccatatcgggcgacgatgggggagaaggagtggtacttcttctgcgtcaaggaccgcaagtacccgacggggctgaggacgaaccgggccaccgagtccggctactggaaggcgacgggtaaggacagggagatcttcaggggcaaggccctcgtcggcttgaagaagacgctcgtcttctacacggggagggctcccaggggcggcaagaccggctgggtcatgcacgagtaccgcctccatggcaagcacgccgccgccgccgccgccgccagcagcagcagcagcctcatcccgtcggtcagagctggcgcgtcaaaggacgactgggtgctgtgcagggtgttcaagaagagc

SEQ ID NO: 12014 - DNA, 711 bp, Sorghum bicolor
  Clone ID: SORBI-28MAY03-CLUS6856_1
gtggtttgaggtggttggtgaagtcgatttctgcttccctgttggaacatatagcccggactttagggttcatcttgggaagttctacaaacgatttggccgccgacattgcacctcagagcatgtccatggttgggacaagaagcctgtccgcttccagctatcaacctccgacggtcagcaggcactgtctcagtgctacctggaggagcccgggagctgggtcttgtaccacgctggcgattttgtggcctcaaagcctgaccagccgatgaagctgaagttctccatggcgcagatcgactgcacacacacaaaaggcgggctgtgcatcgactcggtgctcatctatccgaaagggaaggggtttcagcaggagagggtggtcaggtctcagaaatgagactgtagattgttgtggaggtactactcacagtaggatgttagaccaaatgcagcttgcagcctgatcttatttttgctttgggctctagttcgcaacagaggtgaagtgtatatggttgtagaactcgagtttttgtgtggtcaggtgaccactagagtgctctgttagtcctttcccaaggtcgttttcgccccccttgtgctgaattgggacttcgagataaccatgaaactgtactgaaatgagtttgaagatgtcgttcccagtttctaatttgctatctactaagtttctgtcctttcttt

SEQ ID NO: 12015 - DNA, 937 bp, Sorghum bicolor
  unsure (1)..(937): unsure at all n locations
  Clone ID: SORBI-28MAY03-CLUS6860_1
agagccgccgcgcaccctccattagtctcgcccgcgctgtctctaaaatccgcacgaggcccacctcctcggcgcctcgcgtcctttccccctccgcaagaaagaaacgaagcaaactctccgccgcctccgttcttccgcaccacccaaagctctcgccgaccacagcctcggtccccgcgcctccttccgcagtcatgtaccgcgcggccgctagcctcgcctccaaggcgcggcaagccgggagcagcgccgccgctcgccaggttggaagcaggcttgcctggagcaggaactatgctgccaaggacatcaagtttggtgttgaggcccgtgctctgatgttgaggggtgttgaggagttggctgatgcggtcaaagtgacaatgggtcctaaggggcgcaatgtggttattgagcaaagctttggtgcccctaaagtcacaaaggatggtgtgactgttgcaaagagcattgaatttaaggatagagtaaagaatgttggtgcaagccttgtgaaacaggttgctaatgcaactaatgacactgctggtgatggtaccacatgtgccactgttttgacaaaagcaatatttactgagggctgcaaatctgtcgcggctggaatgaatgcaatggatttaaggcgtggaatctcaatggctgttgatgctgttgtgaccaatcttaagaacatggccagaatgatcagcacttcagaagaaattgcacaggtgggtacaatatcagcaaatggggaaagagaaattggtgagcttattgcaaaggctatggagaaggttggcaaagagggtgtgatcactattgcggacggtaacacgctttataatgagcttgaagttgtggagggtatgaaacttgacagaggttacatctctccgtacttcattacanactcaaaaacccagaaatgtga

SEQ ID NO: 12016 - DNA, 649 bp, Sorghum bicolor
  Clone ID: SORBI-28MAY03-CLUS6876_1
gcacgaggattttcggggccgtttcttcgccatttttttttcctctctctttctccttcctctcgctcgcttcccttccctgctcccttcctcctccagccccctttattcctccatccgctcgcgccaatctcttcagggggcgggcagggatcggtgcccgccggccgcccgtcatgatctcctggcggcgcagcgcgtcatggctgtcgtcggcgtcccgctcctcgcttggcgctgccgtcggcggggaggcgaaggtcacgccggaggtggatccggcggcagcccaggagatggaggaggacgaggaggccgacgaggagcggtggtcgcgcctgctgccggagctgctcacggagatcatgcggcgcgtggacgccggcgccgagcgctggccgccgcgccgcgacgtggtggtctgcgcctgcgtgtgccggcggtggcgcgacgccgcggtctcggtcgtgcgcccgccgctcgagtgcgggaggatcaccttcccgtcctcgctcaagcagcctggaccaagggatgcaccgatgcactgttttatccggagggacaaaaagaactcgaccttttctctctatctcagcttagcacaggctctaacggataaagggaagtttcttttggctgctcgaag

SEQ ID NO: 12017 - DNA, 983 bp, Sorghum bicolor
  Clone ID: SORBI-28MAY03-CLUS6953_1
gcacgaggcctctgtttgcccagttgtcgttcgcgtctccgccggccggcctacgaaaccctagcgaagcgagcgagggagagactagcggccatgttcgggttcaggaaggcggacccggacctcgaggccggcggggcctcgctgctgtacccggggatgacggagagccccgagctgcggtgggcgttcgtccgcaagatctacgtcatcctcgccgtccagctcgccatgacggccgccgtctccggcttcgtcgtcaaggtgcccgccgtctccaacttcttcgtctcctccaacgccgggatcgcgctctacatcttcctcatcatcctgcccttcatcgtgctgtgccctctgcactactaccaccagaagcatccggtcaatcttctgctgctcggcctcttcaccgtcgccatcagcttcgccgttggcatgacatgcgctttcactagcggaaaaatcattttggaggctgccattcttacagcagtggtggtgatcagcttaactgcttacactttctgggctgcaaagaggggccatgatttcaacttccttggtcccttcctatttgctgctatcatggtgctcatggtgttttcactaatccagatctttttcccgctgggtaaggtatctgtgatgatatacggtggattggcgtcacttatcttctgtggatacatcatctatgacacggacaatatcatcaagcgctacacctacgatgaatacatatgggctgctgtatcactctacctcgacgtcatcaacctgttcctgtctctgctgcagctgctgagggcagctgatagctgagctcgtcaagctttcacttgttctcacgtacatttgtgtatatcacaaactctgtaatgctcatggatactccaatttataattagattctatcggtgctaccttagttcaaatttatgtctaccttagcggttaagaataattttgtgcatgcaact

SEQ ID NO: 12018 - DNA, 766 bp, Sorghum bicolor
  Clone ID: SORBI-28MAY03-CLUS74186_1
tggaagttccgtgcccatacttcttccagcgcggcggagatcgaatcgagcgcccgccacggcgatggcaacgagagtcctgccgccggcgctgctctcgctcatactcctgccgctgctcttgctctcagcccgcgacaccgtcgccgcgggcgaggatttcccacgcgacgggcgggtgatcgacctcgacgagagcaacttcgaggcggcgctgggcgccatcgacttcctcttcgtcgacttctacgccccatggtgcggccactgcaagcgccttgcgcccgagttagatgaagctgcaccggtgttggcagggttgagtgagcctattgttgttgccaaagtcaatgctgataaatacaggaaactaggatcaaaatatggagtggatgggttccctactctcatgctttttatccacggcgtcccaattgaatacactggttcgaggaaagctgaccagctcgtgcgcaatctaaagaagtttgtctcgccagatgtttcgatccttgagtcagactctgcgataaagacctttgttgagaatgctggtacaagctttcctatgttccttggttttggggtgaatgactcattgattgctgaatatggaaggaaatacaagaaaagagcgtggtttgctgttgctaaagaattctctgaggacatcatggtagcctatgaatttgataaggttccagcactagttgcaatccatccaaagtataaggaacaaagtttgttctatggcccatttgaagaa

SEQ ID NO: 12019 - DNA, 998 bp, Sorghum bicolor
  Clone ID: SORBI-28MAY03-CLUS61462_1
ggaaatgaaagggaaagtgaaagggaagctggggcaagagggggatgccccccccaaccccccttccttagccccttcctgctgtcctatcttcggatccgggattcatcgggcgccccccgatcgcctcgccgcccccccgcccgggactgttcgctccctctggggcgaacggtggacgccccagccctcgggatcctgcagcccccccctgttcttcgtgggggtccccccggtggcgccgggcaagcgcgcggggggttcccggtgccccctgttgccttcccatgcgtaatggagtgcaaattctatggtttccaaacagtaccctctatgttcccacgaggagctatgcccaggcttgaagaattccatttccgtatgagcctgcaggatttcttgaaaggtgaattcagtaccgatgacctggccttggaccacctctcgtcccttcggagtgtggatgttcgtcttttcggtggtggacacgaaaagatggagcaggagttggaaatgaaagagaaagtgaaagagaagctgaggcaagaggcggatgcccaccccaaccacccttccttagccctctactagaaaaaaaaaaaaagatcctggattcaacgtgtgcctacctaaatgcatgtagctcccgggtctgagagtgttgtctccaattggtgcaaaatatatatgctacaacggtcttaaacaagcagccacacgctttagtttgttggtgtacacacggaggagcagggcaagctagctgtgtaaaacattagccgtattctttaccacttattattgtcaatcgtgttttctttttaatcctttcaaaatatgcttccattatcgttcgaattatgtaattcttcttctttttttctttttgtttctctcgtcctctggtctctgtgtcatgtctcttatttatacttctcgccacctttcttctataccttataataaagaggcaaaatttcaatctcctttttttgtct

SEQ ID NO: 12020 - DNA, 1631 bp, Sorghum bicolor
  Clone ID: SORBI-28MAY03-CLUS6230_1
atctttcacttcccctcatctactactgcgctgcgccgtttaatttagcccgcaagagtaaacaacaagaggaagaattcttgtgttgcggtccaatccgttccgctgcttgagcttgactgactatctctatccgatcttccgcgtgacgggtccgatacccgcacgagggtccatttcacttaccgttttggatagcgtggctcgttttggaattaactttatgttaacagagtctaggtatcattagctagattaagctaactgcttgacttagtagtgtgtaaatctgtaaagaaaactacttggtttgggttgagtctctataaaagaaatggagcagaggaacgttctggcattgggtgaacatgttctgaaagctactattcgcaagcgaaagcatgagactgctatggagcaccctgaaggcaatgatgtgatggtgttctctcagcatgatccaagaaaacaccctgcaacatttgatgacagagctaactgtaagaagtctaaattaatttcctgtgggagtggatctatattggagtcatatcggaactttaagacaagtgggctgcctgtgcgtgtgcttttctaccaacatggtgactggagtgattttccagaggatgttgtcaatctagcacaacaggacttccagttgaagaggccaattactactgctgtgttccagaacaagcacatcatgttggacttcgttcacatgatttgcatagattatgagatgaccatagacaaaccactagcatgggttgatgatcatggcaaacacttctttccagatttatctgctggactgtacacatctaaaccatctcagcatgagaaaggtgaagctgatgagtgtgatggagtgtcaagtgtagctgaaagctcaagttcggtatctgttggtgaagtagtttctcatagcaagaggatcagtaatattgcagaggacagcctgaaagcacataacaggctgtatgaagctgttggtgaaaataattcaggtccttcatttcatttgaatgaatattttagtggaaccatacaagctactggcaagccaaacaatggtccacgtgttgattcagctgtgcagaatttgttgctcaaaggattaggtcagccttttagcgagaaagatattattgctatctatagaacaccactgctagatcagcaatggcaagttcgttgtggtctcttccaaaaggaggttgaagagaccaggagtcgtcgggggaatgcaaatgtgcgttatgcttggcttccttgctcaagatataccatggagcagatgacgacgcgaggtgctctggaaactgcaaagcctaagaaggggtccatgtttggtgttgggacttgtcttgctcctgcaaactgttcaaattcatgtgccagatattctgagtttcaagaagatggcatcatcagaatgatgctgtgccgtgtaataatgggtaatgttgaggttgttttgcctggatcaaagcaattccagccatccaatgaaagttttgataatggcgtggatgatcttcaaaatccacagaattacatcatatgggattctaatgtgcataaacacatatttgctgaatatgctgttattgtcaaagtacctc

SEQ ID NO: 12021 - DNA, 759 bp, Sorghum bicolor
  Clone ID: SORBI-28MAY03-CLUS62487_1
gtcaatgttcatcagccaggtcattggcacagcaatgggctgcgtcattgcaccctgtgtgttctggctcttctacaaggccttcggcaacattggcatcgctggcagcgagtaccctgcaccaaacgctgttgtcttccgaagcatggcagtactcggtgtggatggcttctcctcgcttcccaagcactgcctcactctctgttacgtgttcttcgctgcagcgatcgtcatcaacctgatcagagacctggtgcccaagaaggtatcgaggttcatcccgatcccaatggcgatggcgatacctttctacatcggtgcatacttcgcggtggatatgttcgtcgggacggtgatattgttcgtgtggcaaagactggacagagccaaagcagacgcgttcgcgcctgctgttgcttccggcatgatttgtggtgatgggatatgggttctacctcagtcagtgcttgctcttgccaaggtgaagcctccaatctgcatgaggtttctatcgagggcgatgaatgacaaagtggatgctttccttggatcgtgatcatagaatgtttggtggaactggaaatgaaatggaacagttgtgacttatgaagccaaggttcagcctgattagcatttgccctgtctgtaattagcataatgtattttccatagtaaatccgtattaattaccagtggagtgaacaattatattattcttgttgctattgaacaaatcggttaaaacgagttaaagggccc

SEQ ID NO: 12022 - DNA, 811 bp, Sorghum bicolor
  Clone ID: SORBI-28MAY03-CLUS6252_1
ctcggccgggccgggctccaccacttttctcctcgtcgacgatctcgtagcggcggcgcacatggcgagcgacggcgcggcggctgcgccggcgaaggttaccccaaagaaggccaatctcctcgacccgtactccatcaagcacctcctcgacgagaccatctcagatgtcgtgaagagcaaggggtacaccgaggacacgcggctgggcaactggaagctgggcatcggggccgccgtgatcgccgtcgccctcctcgcgcagttttaccccaagaagtttccgcagaaccgcgaattcctcctcggctgcatcgcactatatgtggtgctgaatgtggtgctgctgattcttagctacactaaggagaaggatgccatcctcttcacgcatcctcctgcgggttctttcaacagcactggcctcactatttcttctaaattaccaagattctcggacatgtacactctcacaatagcaagtgcagatcctcagtctatctctgcaaacaagccagtccatttcactaagagcgtgacaaagtggtttacaaaggaaggagtccttgtggaaggcctgttctggaaggatgtcgagaagctgattgatgactataacagcgagcgcaagagtaaatgaattgatagttcgtgtctctaaccatctggggagacactggccgtctagagaaatcccttaaagcttagcttaatctaaacagacatttttgctatactgtactggttgaccagtgaatgaatgctgttctagacataaacctggttccaagctatcaaaaaaaaagcccct

SEQ ID NO: 12023 - DNA, 906 bp, Sorghum bicolor
  Clone ID: SORBI-28MAY03-CLUS6262_1
cagggcatagtgtgcttggtcctgtaaaagaatggcaaattcaagattgtatcgatgttcataaattgctggagacagtctttggtgatcacgatgttgcaaataggtggaaggcacggtgtgcggaatatttcccctactcgacatactttgaaggcatcaagagcgctatttcagcctatgctgttgaccatagtctcgagagctcaccagaaaatggaattgcttcaaaccctcagctgaaatcaaaagagggagaacaaggcagtttgaacgggactgtgcatattgtggatgatttgagcagcctaagcattcggtaatgcatgaacaagtagctggatggttacaactggaacaaaacatattttagaactggagccagtacccaattaaccaactcctacacagacaaggggaacaaagtgctctggtgaagtagtcggcacgtcacatttgaaagtatgttattgattgggagctgaggtgtcttcagtctggttattttgtcttggttccagcctgtacctttttgttgccattttgtagacagtgaaaggaaaatcttccgtcacagttacggtgaagttgcgtcagcatttgttgcctggcgatatcagggtgtgaccattcatttgaagcagcgatcatggattgtgtagttggttctcttatgaccagcgctgctccctcactcttgttggactacaaaattttggcataaagcaggtgtataaggttaaacctttttaaatttacaactatgtgtttcgggatagtttggtgtgtcggttgttgccttgatcccttctgcttctgcagcacttgctcctcgacgctgtaaattagttaatcttgaacacagaaactgtattacagttgttatgagaaataatgatcaatgtt

SEQ ID NO: 12024 - DNA, 652 bp, Sorghum bicolor
  Clone ID: SORBI-28MAY03-CLUS7146_1
gcacgaggggcgagaaaaaaaaaaaaaaaactcgtcgactcctccagtgccatcgccacccgcccccgcccccggcgccgcccctctcgctattgtcctcggtgcggcacctcctacatctctgcctcaccgctttagcacggccagtcacgccccagtcccgactgcgctagattccacccgaagccggcagccgtcatacccgtgcgcgctagctgggctggatctctcacctccgccgccggcaagcgagcgtggtctagcgctgcagtggtttcagcgacctgcgttcggcccacgtcggctgttaacatctgcgggtgcatctgcggtcagccttgtgcgaagctgccggcgatgtcgtctctcaactcgctcttcaaccgatccaccttcggcacaaaatgtaaaacatgtttgaatctcgtcatttcgaggatcaagctgctgcgcaacaggagggacttacaactaataaatatgcgcaaagaaatggttcaatatcttcagactggccaggaatctattgcaaggattcgagtggagcacattattcgggagcaaaatatcttggctgcctacgagatcatagagctgttctgtgaatttgttctggctcgtctgactggccaggaatctattgcaaggattc

SEQ ID NO: 12025 - DNA, 1147 bp, Sorghum bicolor
  Clone ID: SORBI-28MAY03-CLUS7283_1
gcaccggcgtctgggagtcgctggccctgggctctgggctgctggggtgtgcgagcgccattcttgcaccccttgtgcggggccattgcattcggacatgttcgggggcgcgccgtctggttttgctcgcccctcgatggtggtgtcggtcccctgggttcgcggtgatagctacccttgcgggtcgcttcgctgctcatggtaggggccgtcgttctgttgtgccgtgctcctcggactctgtgggatggagttctctgccatgcttgcatatagccgggcgattgtgttcgggggtccttatggatggcacggtctatgtaattggtggaatggccagtgacacagaagtgcttacttgtggagaagagtatgatttagatagaggtacctggcgggtgatagagaacatgtctgaggggctcaatggtgcaagtggtgctcctccacttgtcgctgttgttgaaaatgagttatatgcagcacaatatgccggaaagttagtaagaaagtataataaaacggataactcatggacaacattgggggagttaccagagcggccagaagctgtgaatggctggggtattgcattccggggctgtggagagcggcttttggtaatcggtggaccaagagtgttgggtggtgggatgatcgagctccattcttggatcccaagtgaggggccattgcaatggaacatgatcggaagcaaaccttcaggtaactttgtttataactgtgctgtcatggggtgctgatatatgcaccctcaaacatactgtcgacacggaagattatgatattggttttatcaaatggcataaagcactgattccacctgatgggtaatctctgcattctttttgacatttcagattttactcaaggttcaatagagtagtcagttccatgtgtactcgttaatagttacccattggtttctgttttcagcacattttatttgcagttgatgatttgtaccttgctccatatactctgttgaaatgagttttctgagatggttgcatataggtgataaattgtaattgaggtaactgtgcatctatatgattgtatcctgttgtgcaccatgtcaacgctgtagttccattgtgcaaatgtctcttttcaagaacgcata

SEQ ID NO: 12026 - DNA, 1272 bp, Sorghum bicolor
  Clone ID: SORBI-28MAY03-CLUS732_1
cgcgtcccctcccctcttcctcgccttatctcctcctccgtcactcgcctcgacaccgccatggccttcgtctccgcgaccgccgccgcctccaccaccctcttcctctccgtcctgtccccagcacgcagcgcgggcgcgtgcgtctgctcacaggcgcggaagccgtcgacagctccgctccacgcggcaaagggccccaactcggcgccggtggtgttggagagcaaggctaagggaaagaagaagaaggggtccggggccgggaacctcgccggagccctcgacgtcgagatcagggaggcgcaggagtacctcgacagcgacgagcaggaacctcttccagacaacttcccatttgaaataattgatgaagatggtatgagcgtggttattttgagaagggactacaaggacgagaagattgaggttactgtcagcatgcctaatttagaaggaggccctgaatttgatgatgaggatggtgagggtgatggtgagagtgctggcaaggatgacgaagaggcagaagaagaagatgagagtgctggagatagcagcatttctcttaaggtggtagtttccaaagactctggcccaaagcttgagttcacatgcacagcctttcgtgaggagatcaccattgatgatatgctaatagtagagaaaacagacgacgatggagaagagaagttcccctatgagggccctgagttcaccgagctccctgtgaatgttcagaaaggcctgttcaaatacttggagcaaaggggggtaacgctgtcggctaccaactatatgcacgattacatggtgactaagcaggctcaggagtacatacggtggatgacaaagctgaaggatttcgtcaagcagtgaggaacagcggcgcgatttgacaaatttgttttggtagcctagccttagtatgcgttacagccttacaggaatactacgattacacgaagttggtcacactccaaaaaggagaattgtatctgcctcaatgtatctgtatcagcgggcaaaacaggagcaagtagatttccagtaatgtttagtggtggctattaggtattacgatacatatctgtcttcctggctgttaggcgtgtgctctgaagagcgttatcctttagtgtctacgttagttggttttacctgttttcttgttgttagcaagggttgctgttgctgtaatgcgtgagtgttaactggtatccccagtaaagtcttatatgctttcttaaaagcaaaggtaatctcctttcc

SEQ ID NO: 12027 - DNA, 707 bp, Sorghum bicolor
  Clone ID: SORBI-28MAY03-CLUS711_1
cggacgcgtgggctgtgctactgtccgccgccgcaggcatccgcttcttctcttatcctaggttcaggttcagctctcgagttttcaggatgaaggtaatagctgcctacctgcttgctgttctgggtggaaacacttctccgactgctgatgatgttaagaacattctggaatcagttggtgctgaagctgatgaagagaaactggagttcctgctcacagaactcaaagacaaggacataacagaagtgattgcagccggaagggaaaggttatcctctgtgacttcaggtggtggtgcaattgccatgggagctccggctgctgcagctggtggtgcggcacctgctgaagagccaaagaaggaggagaaagtcgaagagaaggaagagtctgatgaagatatgggtttcagcttgttcgattaaagcaccactgcccgtttccagtttctctcgcgaatggtcccataatattggccggtgtccacgaaataacagtgtcaatagctactacatacttatgctattttgcgtgtgatatacgagtgtgcatcttcttcaggaatctttaagtcgaatggtcccataataatattggtaacaatgtataattgtatatgtctagtacgtaccttggtatcatgatatctcagtgtgcatcatcaagaatcacaagttgaatgttatctacatatattaaggcat

SEQ ID NO: 12028 - DNA, 333 bp, Sorghum bicolor
  Clone ID: LIB5048-005-R1-XP2-F8
ctgggaaatttggtgttggcatctccacaacggatataggatatgggtttcagcttgttcgattaaagcaccactgcccgtttccagtttctctcgcgaatggtcccataatattggccggtgtccacgaaataacagtgtcaatagctactacatacttatgctattttgcgtgtgatatacgagtgtgcatcttcttcaggaatctttaagtcgaatggtcccataataatattggtaacaatgtataattgtatatgtctagtacgtaccttggtatcatgatatctcagtgtgcatcatcaagaatcacaagttgaatgttatctacag

SEQ ID NO: 12029 - DNA, 1396 bp, Sorghum bicolor
  Clone ID: SORBI-28MAY03-CLUS7187_1
aggagtgaatgctcagctcaagcaggaagatgagtagatccgcgactatttttcaggttcttttggttttcacaaccattgttgctcagacccaatgggctagtgtatggggcatgtactgcgaggacttgacagcaagtgtagagaggccacacagtgcctcaataacggattttggtgctgttggagatggtgcgactcttaacacgaaagcatttcagaatgcactcttctacctcaattcatttgcgaagaagggcggagcgcagctgtttgtgcctgctggaaggtggctgaccgggagttttagtctaatcagccatctcacactctcactggacaaggacgcagtaaggcatggatccagactcatctacaaaccttccccctgtcgccttttccgtcacctcgcgcaatccctgcagttgccggccggcgtcctaccaccttccgagtcggttggccgtccccgcgggcccgacgagccgaacaggggtttcgccgtccgataagagggtcacctcacctcctcctttgctcatcccagctccaacgtttgcatccgcttcatcacgggtcagacatggatcagcgctggactcgccggggatagcgtgatctctggtggcatatcaaacgttcgacccggggccatccggatggtcaactcagcccatggggtcagaggcgcgacagccccctggcgcggaggacaggtgctggaggtgtttgtagccgatgtgggctttgacaacgtttccatagccagcaggatcactggagacgacggcgaacaccctgctgagaggtgccacaagtgtgcacttaccaccttaggcaatattaccctctgggcgggtgtgggtgtcaacaggtgtcttgcagcaatgttgcagggcatcccatccgcttacttcagcaatatttgcttgtttaatgtgtctctcagtggcagaactacagatccttggaattgctcactcgtcgaagggtatccgaactctgtgtcaccagaggtatgcgagcaactaagaaccagtccagggcccggacaaatttgctacggcagtaattatccagccgctgcagcacagccacagccacagccacagccgctgcagaaatcaagtgctagccggctggtaaatcctttcctttcgataagttggtttctatgtaggtaaccttgagtatatctacttgatcatttttccccctcgtccctgcagcttggtaattttaattttatggaaatcagtatcatgtactactattgttgtttcaaagcctctttgttggggcatgtaggtactgattattactcggaaatgaaataaattgtttgactggccagttattgatgctcttccatcctattgggcgtggtaagagaact

SEQ ID NO: 12030 - DNA, 714 bp, Sorghum bicolor
  Clone ID: SORBI-28MAY03-CLUS73575_1
cggtcctcccgccgcaaacctttcctcatcccacggcgcccatgccacccacctgttcgaccacctgacgccgcagccccgatggctcccgcgctcacctccaacccgccctccttccgtcccctctctttcccattccgccgtcgtgccgccaccgtcctctgccgcgtcggtaagcccggcaaggactccgcggcggatgatgctgcccccaagaagaggcccaacctcttcgcggacttcgggaagctggcggatgccacctccctcataccggcgttcccgtcgtccgcggcggggtcgctgttcacgggcggtggcaggggcaggaaggacccgcagatggtgttcgtcgccggcgccacaggtcagaccggggtccgcatcgcgcagaccctgctgcgtcaggggtttgccgtgcgcgctggcgttccggacctagcgtcagcgcaggagctagcgcggctcgcggcagcataccggctcatctccccagcggaagcgcggcggctaaacgcggtagcggcggatttcgatgaccccgaggcgatagccaagtccatcgggcccgctgcgaaggtggtggtcaccgttggcctggccgagaaggggccagaaggcggagccatcaccaccgacgacgcgcttcgggtggtgcaggccgcagaccttgccagcgtggcgcacgtggttgtcgtgtatgacgtcgatggg

SEQ ID NO: 12031 - DNA, 855 bp, Sorghum bicolor
  Clone ID: SORBI-28MAY03-CLUS6667_1
cccacgcgtccgcccctgccttccttttccggctccccgcaccgcgagatctccgtcccgatcccacgaccccggcggcggcgatgggcggcaaggacctgacggaggaccagatcgcctcgatgcgggaggcgttctcgctgttcgacacggacggggacggcaagatcgcgccgtcggagctgggcgtcctgatgcgctccctgggcgggaaccccacgcaggcgcagctccgtgacatcgcggcgcaggagaagctcacggcgcccttcgacttcccgcgcttcctcgagctcatgcgcgcccacctcaagcccgagcccttcgaccgcccgctccgcgacgccttccgcgtcctcgacaaggacggctccggcaccgtctcagtcgccgacctccgccacgtcctcacctccatcggcgagaagctcgaggcgcacgagttcgacgagtggatccgcgaggtcgacgtcgcccccgacggcaccatccgctacgacgacttcatccgccgcatcgtcgccaaatgatcccgtcctctttttttccccacctctccactccgatccaccgccgcctccccgccctcttcgtttgtaatgacttcgtctcccctcccccgtgatttgatcttgttaccctcctatggctggctcatttgaattcaatttcttcgtttcgggactgctccctaggtttggataaacggataatggttggtgtgtgagtgtgtgtgtgtgtgtgattatcacccaatcgatggatcgattaattaatggatctggctgatggtgcttttgcttagttacctgtaatactactactgcaatgtaaagtgtggatctgcttccttct

SEQ ID NO: 12032 - DNA, 839 bp, Sorghum bicolor
  Clone ID: SORBI-28MAY03-CLUS66889_1
tctggcaacatcactcgatcagacactcacagtgacacagctcagtgagcgagcgccgagcggtgaccaaccatatggccgacacatcatcggagcgcagcgacatccacgtcctcctgctcccgtacccgagccaaggccacatcaacccgatcctccagttcggcaagcgcctcgccgcggcgcaccggggccgcgtgcggtgcacgctcgccgcgacgcggttcctgctcagcaacagccagccgtccgcgtgcaccggcggcgacgccatccgcatcgccgccatctcggacggctgcgaccgcggcggccgcgccgaggccgccggcgccgtcgagtacctgtctcggctggagtcggccgggtcggagaccgtggaccagctgctccggtccgcggaggcggaacaggcaggccggcccgtggacgtgctggtgtacgacgcgttcctgccgtgggcgcagcgcgtggcgcggcggcgcggcgtcccgtgcgcggtcttcttcacgcagccgtgcgcggtggacgtggtgtacgcgcacgcgcgggccgggcgggtacggccgccgctggtgggcgacgagccggtggagctgcccggcctgtcggtcgcgctccggccggtggacatgccgtcgttcctagccgatcccagcggctacccctcgtacctggacctgcttttgaatcagttcgacggcctgcacacggccgaccacgtctttgtcaactccttctatgagttgcagccacaggaatcggattacatggcgtctgcatggagagccaagacggtgggtccaacagtgccgtcggcctacctggacaacaccttg

SEQ ID NO: 12033 - DNA, 637 bp, Sorghum bicolor
  Clone ID: SORBI-28MAY03-CLUS67115_1
cggcggtgtgggcgagctttggacgcacgcccgcgcacgcgaggaagctcaggatcaccgactcgccgttcccgctcagggacgacgacgcggccggtggccaggtggacctggaagccgaggagttcatcaagaagttttacgagcagctgcgcacgcagcagagcctggccaccgccacgccggactactacggcggcgggtatgcgccaccggtctctggaatcgcctagaagccatgaagccatatatatatatatatatatgcatccacattccacacacacacatatatatgtgtatatatatgtgtccatagggtattagcttggatgacccttaattttgttcataaggtgtgaagtgtgtgtcgtctgtgctaaactccatatactacatattagtagcagtgtttgtgcatgcatgcatggataaaagcatgttcgttgagagagcaagctactcatagagctagtctagagcttggtcttggtgagggagagagatgttgcacaacatcatgtttgcaagctagatccatgcatgtatagtatatatgtgtacacggtatgtgtaaattttgttttggcgcggcatgtattttgctgccagtaataagatatatatgtcccaaatc

SEQ ID NO: 12034 - DNA, 605 bp, Sorghum bicolor
  Clone ID: SORBI-28MAY03-CLUS67216_1
ccttctgggtgctaaaacgcaaaaccccaaagcagctccacgatcgaacaagcacactactctctcgatcgatcaccacaaaaaccaacacgatcgatcgatctcgaaaatcaaatcagcgcaagaaagatcaaggtcgatcgagcagccgcaagcagcagcaaaactgatcatcgaggagatcgaacgagagatggcgatggagccgaacatggcgcgtcgcctgtggcacgtggtgcgcgccgtgctgttcatgctccgcaagggcatgccgaagcggaagctggccatggacctgcacctcctcgtccaccgcggcaagatcgccggcaaggccctcggcaacctcatgaccgcccacgggcacaacagccaccacgacagcaaggctgaggcggcggcggcggcggcggcggcgcctccgcagcagcagttctcgtcgtccggccgcggccgccgcgcactcgacccgtccctcgccgtctacaacccgcgcgaggtggagttcagctgcagcaacaccccgtcctacccgtccctccacctcaacctcatccccaccggcaagcgccgccgccgcaacaacaacagcagcagccgccgcg

SEQ ID NO: 12035 - DNA, 690 bp, Sorghum bicolor
  Clone ID: SORBI-28MAY03-CLUS7573_1
cgcccgggcgtgaagcaaaacccctctggcttcgccccctcggctccgctaggaacctctccctcgccacgtccgtctccggcgagctagggtttgcgttccccgcctcgccaacccacggctcccgccctccctggatctccagccatgtacggcggagacgaggtttcggcaatcgtcatagatgtgggctcctacagctgcaaggcgggctacgccggcgacgacacccccaaggccgtgttcccctcggtcgttggttcagttgaacaaactgaaggcatggatgaccccaagccagagaaggaagctgactctgcatcagattctaagaatggggccaagcctatggatgtggacaaagccaaaacaaaacgcaaactttatgtaggccaagagttggagttcaggagggatcacatggaggtgatttcacctatgaaagatggaacggtaactgattgggatattgttgataatatatggaatcatgctttcagacggaggttgttgatcaatcctgaagagcatcccatgctcatagctgaaccatctacaaacactgctcaacaaagagagaaagcagcggaacttatgtttgagagctacaaagtgccagcactgttcctagccaaaaatgcagtgctcacatcttttgcgtctggacgagctacatctttggtgggtgac

SEQ ID NO: 12036 - DNA, 1213 bp, Sorghum bicolor
  Clone ID: SORBI-28MAY03-CLUS7579_1
aagactcagcagcagccaccccaccaccagagcacacagccgccaccaccaccaccgcgcgccgtcgtcggcgccatggcggtgagcaacaacatcacggcgtgcgtgacgctgctggcgctaatctgcgcggtgcccgtgatcgcgtcggggatctggttcgcgtcggcgcagggcgaggagtgcgcgcgcctggcgcggtggcccgtggcgatcctgggcggcctgctcctcctggcggcgctggcgggcttcgtcggcgcgtactggaaccggcggcgcctgctggcgttctacctcttcgcgatggcgtcgctcgtcgtgctgctcatcgcgctgctcgtcttcgccttcgccgtcacccggggatccggcgcgtacccggtgctcggccgcgcctacgacgactaccacctcgacggcttctccatgtggctcagaggctacgtctccgatgaccctggacggtgggagaagatcagggcctgcctcgctgtctctgatacctgcaagaagctcgccagacaggctgcgttcaccaacgccgagcagttctatcagtcccacctctccccgttacagtctggttgctgcaagccgccgtcggtgtgcgggttcagctacgtgagcccgacggtgtggacggcggccccgcggccgccggcggacccgctctgcgggctgcggcgcttccccccggggcagctgtgttacgagtgcgagtcctgcaaggcgggtctcctggagacgctccgggaccagtggcacaaggccaacatcgcgctcgtcgtcgccaccgtcgccctcgtcatcctctacctcgtcggctgcagcgcctacaagaacgcgcaggcagccgccatcttcagccgctacaagtactagtaattaattaagctgctgccgtctgcatgccgatgatccatgtggttaagggtttttacggttttttgtcatgtatttggattgttgattgtggatttgtgtgtgtgtgtgttatggtgaagcgtatgcatttgtagcggcggtggtgctggtgtgtttgcagacttggttcatcatggtagtggtagatgtgtaaggtagaggagatgtgtaagattaggtaatggtgtttttcctatttgccgacgagtaatgtatcttatctgatatctgaagttctgaacaagtggccagcaagtgagatgtactgctgctggatcaaggctga

SEQ ID NO: 12037 - DNA, 1089 bp, Sorghum bicolor
  Clone ID: SORBI-28MAY03-CLUS7590_1
ccgccgctgttccagttcagcgacgacgacgacttcacgggctcattccccagttcaggcgatctccactgccgccgcctccattccagttcagcagcagctctcagcgtcgttccttctcggccctccactatccgtgtgccggccgtactcatctcctgcggtccctacctggttaaaatcctgcaaccggctcatccgccgccacgccgggtcgctgcggagcgccgctgtccttctccattcccctccaacaaagctatccaaaagcgaagagttgctgctgcttctcggaccctgggcgtgtccgccgcgatgggtggaggcgtctgggttttccagttggtttcccttcttgcgcttggctttgtgctcagcagtgtcgaggctagcctgggagatattgatccgcggtacagaacctgcgtgagggagtgtcagaccacagggattactggggagaatatcatcagccactgccagtccaaagagaatgacacatctgttggaggttcttggtacaaccaggagcaaatttacgtgcagtggaaacaactgaactgtatgacagattgtcgctacttctgcatgatgcagagagaaggggaacggcaatcacttggcctgagccctgtgaaatatcatggcaaatggcctttcttacgtgtttctgtgttccaggaacctctttcagttgcactatctgctatgaacctattagtgcacttcgctgggtggctttcatttttccttctagtgaattacaaattacctcttagaccccagacgaagagaacttactatgaatatactggcttatggcggcatatctatgcaattttatcaatgaatgcatggttctggagctccatcttccatactagagatattgacttgactgagaagttggactactcttcagctgttgcgctgcttggatactcgttaatcctttcattgctaaggactttcaatgtcaaggatgaggctaccagagtgatgtttgcagcccctattttggcattcgttacaactcacatcttgtatcttaacttctatgagcttgactatggatggaacatgaaagtc

SEQ ID NO: 12038 - DNA, 1413 bp, Sorghum bicolor
  Clone ID: SORBI-28MAY03-CLUS76175_1
gctcgcgccctccttccccggcactgcgcagcgcgagtggggggcgctagtcactcacactcggctccctcgatcgctctcggtcgtcggacccgtctgcgtcgccaggaggcgagagaaggcaatggcggcggacgggaacggcgcggccgctgccggcggggacaccagggcggtcttcgcgcagatctacaagacgctcaaggaggagctgctcaccgaccccgccttcgagttcactgaggagtcgcaccagtggatcgaccgcatggttgactacactgtactcggaggcaagtgtaaccgtgggctctctgtggttgatagctacaagctgctgaagggtgctgatactctgagcgaggaggaaatgttccttgcttgcacccttggctggtgcattgaatggcttcaagctttctttcttgtgcttgatgatatcatggatgagtcccacactcgtcgtggccagccttgctggttcagggtgcctcaggttggcttcattgctgtgaatgacgggattatccttcgcaaccatatctcacggatccttaggcgccactttaagggcaagccttactatgctgatctccttgacttgttcaatgaggttgagttcaagacagcttcaggtcagctgctggaccttatcacaacccatgagggagaaaaagatctgacaaagtacaacataacagttcacggtcgtattgttcaatacaagacagcctactattcattttatctgccggttgcatgtgccctgctgctctctggcgagaatttggacaagtatggtgatgtagagaacatccttgttgaaatgggaacatactttcaagtccaggatgactatctggattgttatggtgatcctgaatttattggcaagattggaactgacattgaagattacaagtgctcatggctagttgtgcaagcccttgagcgtgctgatgagagccaaaagcgcattctatttgaaaattatggcaagaaagatccagcttgtgtggcaaaagtgaagaacctctacaaagaacttaacctagaggcggtatttcaggagtacgagagtgagagctacaagaagctgattgcagacattgaagcccagccaagcatcgcggttcagaacgtgctgaagtccttcttgcacaagatctacaagaggcagaagtagggtgctcttggataaggagctcaggagctgttactccatcccatgcttgacagataccggacttcctccccttgctgctctagtatgatgtggagcttatatagttaaaaaaaaatcgatgtagtatgatgccccttgctgctctgaatattaacaggcaactcaggcaaggtgctgtttcggtttggtggaccgcatgttgcaaacagtaaattggctgttctgtt

SEQ ID NO: 12039 - DNA, 883 bp, Sorghum bicolor
  Clone ID: SORBI-28MAY03-CLUS7622_1
aaaaaatttaccaatccaaagtcaagtccaagaaggaatagtattcaccagacaggtataggaaatctcaagcgggggcctcgggtgctcacgtgtggggcgggagcgccggagtcctgtgccctgctgttgtagatacaataagcagtattgtgcagaatgtggatgagcaagaccttggggccatgtttggttcaggcagggggcaaggtggcctggatttgtcaagaatgttgcagcaaatgatgcctgttgtatcccaggctcttggtggcgcagggggccgttctgctggtgcaaatagtagacaatctaggtcatggcctcagcgcattgacagtggaggaggaaatgtaccagctagcagcagttctcagattgatctccatcaagctcgtgaaagcattgaacaacatgaatctccagagaatatcttcagctctgtccttgaaactgctgctcaggcctatggtgaagatgacagcattcagggaatgatcgaagagcttgccagtgatcaagagcttaccgatgaatacttgaagtttttggtggaacaagttcggcagagggtacagtcagagtcgcagtcgacgagccagccttgaaggatcgggcagcagggtcgtgtagccagccattcgccgcaaatctgcaatatttatcgctaacttggaaaagacagaacccaagacttgtttgggcgttttcatgttttggtgcctgctgtacatgtggcgttgtaattttccgagatattgtatttgcggcggcagcatattccgtactctggttaaatctgtttttgacaatttttctagcggtacatacagcgagttttaaatgtgcagtgtactgttaaaactgtttttgacaatttgct

SEQ ID NO: 12040 - DNA, 1022 bp, Sorghum bicolor
  unsure (1)..(1022): unsure at all n locations
  Clone ID: SORBI-28MAY03-CLUS7625_1
gcaccatatatacagcaacaactgatgcagcagcgcacactggtgcagcagatgattcggttgcagcaaagagccgtccaccacctcccccagcttcacctaatgcaaagggccttcctataacaccaggtgaagcggaccaccccttttataatccgacaggcacctgcgaacctgcttctgttctgtgcgtcagcgatcctcatcggccggctgttgacatagcttttttatctccactcctagcttgtccggcaaccactgtgccttgagttcttcagaatccgtggctaaatttcctgcaaatgtaagctgctctcccatataaccaccacgaccggcgtaaaaggatctatcctcaaaggcccggagaaattgtttgtgatttttacatgaaaacaggatcttgcaagtattctcagaaatgcaagtttcaccaccctattgaccggtcggcacctcatttcaatgaaaacggggaccctcagccgcctgttacacttggctttccaaggagagaggacgctgaggcctgtgccttctacatgaggtctggcacgtgcaggttcggtgtgcactgcaagttcgaccaccctcctcgccagaaggctatttccaagctgcaggcagctggaaaggaaggaatagaagggctgagcgttgccctgcacgaccctgatgtctgatactgtaaacctgcatctggatctaataccattcgaatcgcactgttagttaatgcttgatgctgtcattgtcttgttgggagtctgacttgtaaagttcagtatcaccggaagtgtttgtcggaacagtgctggtactaacgatttatttaccttcggtcggttgctgcagatgacaattgacaatagtgtggtatgtactgtgttgctatgtcaaggtgcatattgcaggtttcaagagtaaatgcaccgctggttctctaactttcactggatgctaacctggtccccaaacttaaatttgtcctgtgagattnctagttaccataacggggt

SEQ ID NO: 12041 - DNA, 882 bp, Sorghum bicolor
  Clone ID: SORBI-28MAY03-CLUS23080_1
gtccgaggcaggacgaccggagcagtctgcactgcatgcgcctggtcatcaaggagggcctccggctacacccacccttgccgcttctgcttccacgagagtgccggagctcatgccaggtgctgggattcgacgtgccggcgggcacagtcgtgttcgtgaacgcatgggcgatcgggagggaccccagctcgtgggacaagcctgacgagtttgtgcctgagagatttgaaggcagcggcgtcgacttcaaggggacggacttcgagtacgtgccgttcggggcaggacgaaggatgtgcccgggcatggcgtttgggcttgtgactatggggcttgcactggctagcctcctgtaccattttgactgggagctgccgcctgggatgacggccacggattaggacatgacggaggaaatgggggtcacggctcgacggctccacgacctcttgcctgttccctttgtccgaatgcccgtgcccatgacctagctaggtccagcagcaggagaatccgaaaaacttgtattcgtccattttaaataaggccttgtttagttccgaaaagtgaaaagttttcggtattgtagcactttcgtttgtttgtgataaatattatctaatcatggactaactagaatcaaaagattcgtctcgtgtgttatggcccacttgcagtttagcgaatgatttgttggctggcgctctcgtagcggtttttttgccgttactgtggtgtgcttcgtcttaggccttgtttagttccgaaaagtgaaaagttttcggtgctgtagcactttcgtttgtttgtgataaatattatccaatcatggactaactaggatcaaaagattcgtctcgtgatttacaactaaactgt

SEQ ID NO: 12042 - DNA, 993 bp, Sorghum bicolor
  Clone ID: SORBI-28MAY03-CLUS23085_1
ctgcaatacatccagcacgcctccgagctccacggcaaacaaacaaccagcagaaaagcaaggcaaacaggctacgagcggcgagtacgcgaggccgaggcgacaccaccagttggattactgctccacccatggcgcccaagagatcgacgtcgctgtcgtctggaagcaacagcagcagcggcggcggtgtgtgcccgttggcggcggcggcggagcagccgaggctgcgcggcgtgcggaagcggccgtggggccggtacgcggcggagatccgtgacccggtgcggaaggcgcgcgtgtggctcggcaccttcgacacgcccgagcaggcggcgcgggcctacgacgccgccgcgcgcaggctccgcgggcccggcgccaccaccaactacccccacgcctcagagccggttccaccggcgagcgctcccgcgcggagcgcgagcggcagcgcgagcgcgtcgttttcgtggtccttgctgtcgccacccgcctcctcctcctcctcgtgctccctgctgccggagtcggtgacggtggccgtcacggcgccggccccgtcgctggacctgagcctggcgctgccggcttcggcttcggtcgcaaagacgtaccagctgttcatggatccgacaccggccctgctgccgttcctgcttccgaagagcgaggaggagcggagctgctctgggtcgccgtcgtcgtcatctgtggtgttcgacgcggcgccgccgcccgtgggcctgggtctagggctcgacctcaacctggcgctgctgccggccgagatggtcgtgtgattgccgctgtcgtccaggagtagtttttttttaattattttactgtcgtccaggagtagttggtaatcgatcggaggcagtcgttcaaatgtacaactgtaaataggatgcagatttgtgcatgcgcttagccgtgttttctttgttatacaaactgaccgatttgcatcaaaaaaaaaaaaaaaaaaaa

SEQ ID NO: 12043 - DNA, 1705 bp, Sorghum bicolor
  Clone ID: SORBI-28MAY03-CLUS2322_1
agtgtcagcctcactgaacaggtccagcagtctccagagtccagactgcatccaggatccagcagcaacagcacatgaccaaaatccttgagaatctcttggctctatatatctgatttctgagactaattgatcgatcatgaaaaaagaagcacatgcgtgttgatttagcatagccatcgcgagagagatagggaaggaagacgatggccggcggtggtgaagcgccgttgctggaagggaagcccagggtgtacttcgacggctgccccgggtgtgccaatgaccggaggaaggcggagaacctgggaattccctacggccaattcttccatatctggatcatcatcctcgtctcctgtttgccaatatcattgttgtttcccttcatatatttcatgataagagacttgcatattgctgaaagggtagagggtattggattctatgccggttttgtaggtgcttcatatatgcttggtagagctctaacttccaccgcttggggaatgatagcagatcgtattgggaggaagcccgttatcattctttcaattatctccacgcttttgttcaacactttgttcggattgagtgtaaattattggatggcgatagcaacaagattccttcttggttctttaaatggtttacttggcccaataagagcttatgctgttgaagtatgccgaactgagcatcaagctattggactgacacttgttagcacatcatgggcaataggtcttattattgggccagctattggtggatacctcgcacagttgaaaaatatccaaagttatttccagccaattcaatatttgggaggttcccatattttttaccatgtttgtgtgtatcattcttctgtttggttatcctcataagctgtatttggctcccggagacattgcataagcataaacttcacaaaactgaagatcaaggaatcgaagattttgctgagcaacaaaatagttcaactacaaataagagcttgcttaagaattggccattgatgtcatcaattatcttattttgtgtgaggatgtcggtcaagtgcttgcagttacaggtgctagcatccttttgtaccaaacatttgtttatccacgtattgtaaaagttcttggaccagtcaatacttcccgtattgcagctattttgtctatggtgctccttttcacttatccaccaatgacacatctatcaaaaccatggttatcagttgtagtgaatattgcatcaatgttgaaaaacaatttagttgttaccgttgtaacatgctcttttattcttcagaataattcagtgcctcaagagcaaagagcaactgcaaatggcttagcaactacattaatgtcctttttcaaggcatttgccccagcaggagctggtattgtattttcatgggcacaaaaacgccaacatgctttcctctttccaggtgatcaaatggtgttcttccttctggacattgtgatctttgttgagctcatatggacattcaagccatttctagccattccggagcaaatccccagaagttagccttcatgcatcatctctactggtgttttattgtggatgggtcaatatcagataacaattgggatacctatttcttgtgcaatgtgatggaattatattgatatttccaagtgtatatatacatggtgttgtatagcaatctaagtttccc

SEQ ID NO: 12044 - DNA, 755 bp, Sorghum bicolor
  Clone ID: SORBI-28MAY03-CLUS23747_1
tgttgcctactggatcgcatcggccgccagtgatcctgctccgtcctccagtccagctccccccaaatccgacgacgccagccatggccggcacgtgcgctcacgccgagttcctccgcgcgcagccggcgtgggcgctggcgctggcggccgtgggcttcctcgtggcgctccgcgccgccgtccgcttcgcgctctgggtctacgccgcgttcctccgcccgggcaagcccctgcgccgccgctacggcgcctgggccgtcgtgacgggcgccaccgacggcatcggccgcgccatcgccttccgcctcgccgccgcggggctcgggctcgtcctcgtcggccgcaacccggagaagctggccgccgtcgccgccgagatcaaggccaagcaccccaaggtccccgaggtgcggaccttcgtgctcgacttcgccagcgaggggctggcggcaggagtcgaggcgctcaaggactccatccggggcctcgacgtgggcgtgctcgtcaacaacgccgggctgtcctacccgtacgcgcgctacttccacgaggtggacgaggagctgatgcgcagcctgatccggatcaacgtcgagggcgtcacgcgggtcacgcacgccgtgctgccaggcatggtcgagaggaagcgcggcgccattgtcaacatcggctccggcgccgcctccgtcgtgccttccgatccgctctactccgtctacgccgccaccaaagcgtacgttgaccaattctca

SEQ ID NO: 12045 - DNA, 815 bp, Sorghum bicolor
  Clone ID: SORBI-28MAY03-CLUS771_1
tgaggacaatcccacgaagcagagctggtgaaacaaggcaaaggcaaggcaaggctgccccaaattacattgttgcgtcaggcaagaagaggagcaggaagaaatggctgcaatacctgcagtgatctcgggctgctgctcttcgtctcgcctgtcccagcctgctggcctcctgccctccacaagcagcagaaggcgcttcaaggtcacggccatggcgcccaagaagaaggtaaaccgctacgacgagaactggtcgaagcagtggttcggcgcgggcctcttcgcggagggcagcgaggaggtgaccgtggacgtgttcaagaagctggagcggcgcaaggtgctgagcaccgtggagaaggccggcctgctgtccaaggccgaggagctgggcgtgacgctctcctcgctggagcagctgggcctgctgtccaaggccgaggacctgggcctgctcagcctcgtcgagaccgcggcggggacgtcgccctccgtcctcgcctccgtctcgctgccgctcctcgtggccgccgtcgtcgccgtggtcgtcgtgcccgacgactccgccgcgctcgtcgccctacaggccgtcgtcgcgacggtgctcgcggcgggagccgccgggctgttcgtaggctccgtcgtgcttgctggcctgcaggagtcggattgacccaccggctgagttacgtcgtcaacagtaccgcattcgagtaagctttgtgtagtaggatcgatcttgttagcagagcagaaattcatcattaattataaaaatctacagtatgtgctgcaatatacataatataatt

SEQ ID NO: 12046 - DNA, 671 bp, Sorghum bicolor
  Clone ID: SORBI-28MAY03-CLUS7756_1
ttccctctagacctagctgctcttgaagttccatctcttaatggataaggtttttccccctggccacccattccattcccgagcccgatctcctgctcctctgcaacgcacgcacgacacgctcccatcccgcaatggcccagactatggccgccgcctccgagctggtcaccctgaagcgcccgttcggcggcaacgacgggttcggcgacggcagcggcaatggaggaaccgtcgccgaggagaagcccaaggcgcgccgccgggaggcggacccggcggcggcgctggcctcggcgcggcacgagttcggcgagcacggcggcgtgaacatgtccatcgaggcgtcggcgacgttcacggtgatggagccggacaccatgcgccgtctcttcgcgggcgagctgggccccgaccgcggcgacatgtacatctacagccggcacttcaacccgacggtgctggcgctgggccggcagatggcggcgctggagggcaccgaggccgcctactgcacggcgtccgggatgtccgccatctccgccgtgctgatgcagctggtgggcgccggcgggcacgtggtggcgtcgcggtgcctgtacggcggcacccacgcgctgctggcccggttcctgccgcgcacctccggggtgcgcgccaccttcgtggac

SEQ ID NO: 12047 - DNA, 832 bp, Sorghum bicolor
  unsure (1)..(832): unsure at all n locations
  Clone ID: SORBI-28MAY03-CLUS7841_1
gccggccgggccaaacaaaaaacgcccggtactagttcccgtcccccctctccccctagtctccggggagagtacactcgtcgactccagtcgctcgctcgctctctccctcccccgaggtaccggggacaggcagccgccgaagcgcgccgccggccgtgaatcaatggatttcaaggggttctgggagtccagattcgggggcaagaaggagccggaggagcagaacgggcacgccaacgggagcgtgccgaagaggacctccgatttggcggtctacgagcagttcgagcagcaggccaggcagacccaggtccgagccgccgcgattcgcgatggaaacgctgatgtgatccagaagccccttctaccttcatttgagtcagctgaaatgcgtaatcttgcagagacattgttgagggatattattcgcgggagcccagatgtgaaatgggagagcatcaaaggactggaaaatgcaaaacgccttctaaaagaagctgttgtcatgcccataaagtacccaaaatacttcactggtcttctttctccctggaaaggcatcttactttttggccccccagggacaggaaagacaatgctggcaaaagcggttgctactgagtgcaaaaccaccttcttcaacatttcagcttcatcaattgtcagcaaatggcgtggagattcagagaagcttgtcaaagttctgtttgagcttgctaggcatcatgcaccatccacaatatttcttgatngaatagatgccattatcagccagcgtggtgaagctcgtagtgagcatgaagctagtcgtcgcttgagactgactact

SEQ ID NO: 12048 - DNA, 682 bp, Sorghum bicolor
  Clone ID: SORBI-28MAY03-CLUS7872_1
gccggccaccaagccggcagtcaccttcaactccaccatcgaaggccccatcaacctcaggaaagaccaggccagcaagtccaaggggcaattggctgtacaaggaggatgacctgaggagcatcacaagcatccgctctgagcgcccaaggaggcagagcacaggtggaggaggctcagtccgggatgatgcaagcctgacgagcacaccacctctccccagttacatgcaatcgacagagtctgcaagggcgaagtctcgataccgcagtctactgactgagaagcttgaggttcctgagagagcacctttggtccactctgttgttaagaagcgcctgtcgttccctgtcgtcgataagccaagtgttgtgccgacagataagccaaaggaaagagtgagacgccattcagatcctccgaaggtcgatcctgcaacactgaaggatgtccctgctgcttgatcaggccttgtgatttaggttttgtgttttttttttaactccgtgatgtattatctgagttaggttgttttactcctgtcatgtatgatctgtccgggttgatttgagataattctaactgtgtttacagacaatgcgtgatgctaaatgtatgtgtggttggctttcaatgtacggatatggcaatatttgactagactttgttaaggtgcaaatac

SEQ ID NO: 12049 - DNA, 697 bp, Sorghum bicolor
  Clone ID: SORBI-28MAY03-CLUS7876_1
gtaaccctccgttgcccacgataaaagctccacccccgaccccggccccccgatttcccctacggaccagtctccccccgatcgcaatcgcgaattcgtcgcaccatcggcacgcagacgaacgaagcaaggctctccccatcggctcgtcaagatgcagatctttgtgaagacccttactggcaagaccatcaccctcgaggttgagtcctcggatacaattgacaacgtcaaggcaaagatccaagacaaggagggaatcccgccggatcagcagcgtctgatctttgctggcaagcagcttgaggatgggcggacgctcgctgattataatatccagaaggagtctaccctccacctcgtgctcaggcttaggggtggcatgcagatcttcgtcaagaccctcaccgggaagactatcactctcgaggttgagtcctctgatacaatcgacaatgtcaaggcaaagattcaggacaaagagggaatccctccagaccaacagcgcttaatcttcgctggcaagcagcttgaggatggccgtaccttggctgactacaatattcagaaggagtccaccctccaccttgtccttcgcctcaggggaggcatgcagatctttgttaagaccttgactggaaagaccatcacgctagaggttgagtcctcggacacgatcgacaatgttaaggcgaag

SEQ ID NO: 12050 - DNA, 1199 bp, Sorghum bicolor
  Clone ID: SORBI-28MAY03-CLUS80685_1
gcacgagggcgcagagcccgcccgttccacacttccacttcactccgccgcccggattcagagcaagaggaggcagaggcagaggcagaggcagaggcaggcatggcggcgatgctggtgggcgcgctgcggaggggaagtggatgccacggcggctcgcgcctcctcgcccagtcgcttcgcagattcgtgagcacgctggtcgtagcggagcatgaaggcgggttcgtcaagccgtcgtcgctgagcgcattggcagctgcagaggcgattgccaaggagaacaaaatctccgtcctgctgggtggttccgggccgtcgcttcacaaggctgccgaccatgccgcgtccagccatccactggtgtctgaggtgctcgtggccgattcggaagccttggcgcatcctctggctgaaccctgggccgacctactccgttctgttcagcagaaaggaggctactctcatgtcatagcttcgtccacgtctttcgggaagaatttgcttccacgtgctgcggctcttcttgatgtctcccctgttactgatgtcactgctgtaaaggagccacgggtctttgtgaggccgatttatgctgggaatgcactttgtactgtgaaatatactggagaggatccttgcatgatgggggctggggcttcttcagtgctgaaaattttaaattgttagagcagcttgctgagaaacttggcgcagcagtgggtgcgactagggctgctgttgatgcaggttatgttccaaatgaccttcaggttgggcagacagggaaaattgtcgcaccggagctttatatggcttttggagtatccggagcaatacaacacttggcaggaatgagagactcgaaggttattgtggctgtcaataaagatgctgatgcccccatatttcaggttgcagattacggactggttgctgatctgttcgaggttctggatgagttattgaagaagatcccagagaagaaataagtgaccgttatagttctgtactcttgcatgttcatttgcctatgtggccctaataagatgaaatcatctcgcgatgtcaatcccataatatgtggaatggtttatctcttggtcaaggcctgaaggctttctgaggaaccggcagggtagatccctacctattatgaagggataaactgggtgccctgacacccatttcgaagtaaa

SEQ ID NO: 12051 - DNA, 687 bp, Sorghum bicolor
  Clone ID: SORBI-28MAY03-CLUS7443_1
gccggccgggccgggctctctcccccttctcccgcggcggcgcgtgcgagacccatccgccgccacgccatggccaagttcaacgtggtgcagaagaacaggcgccagtggaagcaggaccgcaagcgcgccgcgcatggggagcccggcaccggcaagctcaagcagcgtaccgcgcccgtctccatgtccggcaagcggaagcgcaagctcgagcgccgcctcaaccgggagcagaaagaggctgcgatgattaaggcgctggagaacatgggggatgtcgacatggtctctgctgaagagtcttcagaggctgcaaagggcaagtctcaagtgaagttcagtgtgaagaaaaactcaagaatacagatcaagagattgaagggcaaaggcaggaagaaagccaaaaatgcaaaaccacctgcgaaggagaaagttgatgccatggtagaatgacggacaatactgcatcactggaattatgatatgaaccttgtatgttttctcagagcttgcagcaagggctgcagggactgacctcagggaacactggagcttgaactgcctcttgcatctactactgcctgaatgttcattagaagctacttaggtctggtgttagtgtatcgaacttcaaacatgaatgtacctttaatagtggaatattcatgttttcattcatgttcg

SEQ ID NO: 12052 - DNA, 806 bp, Sorghum bicolor
  Clone ID: SORBI-28MAY03-CLUS74795_1
gcacgaggattttcttccgaggtgcttacgtctgtggtcatgaaaagactatggataagatatctcgttccctaaaatattggtccaaaggtgaagtccagacgacatttctatgtcatgaagggttcttgggaacactaggtgcattttggagttatgagaacatggggatcgacagcttggcggcacatgaagtcatcagggaggtcttgcttggtgcgccatacactgggcagttcccatctttacctgtcactcaacaacaggagaatggagaacatagtactctcgaaggggaagtagaaaacttacggcatgacaatgccgtgctgaaggctgaggttgagcgattacaaagggagaacgcagagctaagagcaaagttggtaagatcaggcgagacttcaaccttgtgatttgtgacacaataaaaggacgagccgcagcttgttgtaaactgtaactgtttagaaaatggctcaaaaggtatctcgtataggaaaagtgaattctggcaaaaagaaatggaaaagaaatgccaattagcattgctcatctagtgatgagccttgttgtataattatttatattctttatacaagagcctctgtatttgctccgtttatgtaatcttgttcctgtaaatgttgtgtaaatggttaccaaaatccagagtatccggctttgtaattttgtcgaaacaatagtttctgtttccaagtttcccttggaaaaaaccttcggggtgagattgaagcattctttacccttcttaattgaaaggcagagctcctgccattaagttc

SEQ ID NO: 12053 - DNA, 960 bp, Sorghum bicolor
  Clone ID: SORBI-28MAY03-CLUS7514_1
cggcacgaggccgcgacgagccgacgagctctacttcccccttccggccttgggcgaccgtgacgagcgacgacgaccacggcgacgatggccgcttcctccctctgccacgggcacctgctcctgttcctcctcgtggccgtcgcgtcggcctgcctcggcaccgcggcagcgcatcaagccggatctggagaggggtacacgatcgccggccgcgtcaagatcgatggtgcgagtgcgaagggctttggtcttccagccaagacatcaaacacaaaagtgatacttaatggcggccagagggttacatttgccaggccggatggttactttgcattccacaacgtgccagctggaactcatctgattgaggtctcctcaattggttacttcttttccccagttcgagtagatatcagtgcaaggaatcctggttatattcaagcagcattgactgaaaccagaagagttctaaatgagcttgttcttgaacctctaaaagaagagcagtactatgaggttagggagcctttctctgtcatgtcacttttgaagagtcccatggggttgatggttggttttatggtcttaatggtcttcgtgatgcccaagttgatggagaacatagatcccgaggagatgaagcaagctcaagaacaaatgaggaacaaccccgtatcattctctggcttgctatccagagcgcagggctagaagtagagcatgaggatactgcaaaggtctatatactctataatgtgattaagagcagtactaaagtgcctgacacgtcattcactcagagtaatttcctggggacaaggcggaaactctttcccctgcttttactgtattttaagctgtaatttgtctgtgatgtagaaccttctgaaacctctagctgaactggtcatgtggcacattagcatataccgcagattgagacattttgtccaataa

SEQ ID NO: 12054 - DNA, 911 bp, Sorghum bicolor
  Clone ID: SORBI-28MAY03-CLUS7529_1
gcacgagggagaggagagagagaggaagaggatgggcgccaccgccaccgaggcggcggaggatggcgccgccgttgccggcggcgcgctcggcctgggcctcggggagacggtgcgcgagctgcgcgaggcgtacgagtgcgggaggacccggagcgtggcgtggcggcgggcgcagctccggggcctcctcaggctcctcgaggagaaggaggcggaggcgttccaggcgctccgcacggacctcggcaagcaccacgccgaggcctacagggacgaggtcggggtgctcatcaagtccaccaacggcgcgctgcagcagctcggcaaatggatgacgccggagaaggtgtgggttccgctgatcgcttttccggcgaccgcgcaggtggtgccggagccgctcggtgtcgtcctcgtcttctcctgctggaacgtccccttaggtctgtcgctggagccgctgatcggggcgatagcggccgggaacgccgtggctctgaagccgtcggagatctcgccgtgcaccgccaggttcctggccgacaacatcgggaggtacatggacccctcggcggtgaaggtcatcctgggtggcccggaggtcggggaacagctgatggagcaccgctgggacaaggtcctcttcaccgggagcccgcgcatcgcgcgcgccgtgatggccgcggcgtccaggcacctgacgcccgtggcgctggagctgggcggcaagtgcccgtgcatcttcgacgccatgggcagcgcccgggacctgcagatctcggtgaaccgtatcatcgcgggcaagtggtcgtcctgcgccggacaggcctgcatcgccatcgactacgtgctcgttgaggagcgcttcgcgcccatcctgatcaaggtgctcaagtcgacgctgaaga

SEQ ID NO: 12055 - DNA, 1188 bp, Sorghum bicolor
  Clone ID: SORBI-28MAY03-CLUS82790_1
tactggaccccctcatcgtcgcagcagcagcagctcacgccaccacggcaacaacgcctcgccggcgacatggccgtgtacatccgactcgatgacgccgtccgcgcgcgcctccgcggggacgccgcggggtgcaccatcaccagcagcggcagcgaccacgacgcgtccgcctgcctctccgagctcgtccaggcgttcctcgagacgggcgccggcgcggccgaggaaggcgtgcccggcccggcgcccaaggagtacgacgaatctggcgaggaagacgcgcccgggcgggcggccgccgccgcggcgtccgtgagggcactgctcgacccacccgcggaggaggacgtgttccggatcaggctggccgccgcggtggcgacggccatggaggtggaggccgcgctgcgggcgcacggcgcgtcgttccggcgcgcggtggttcggcggctgcgtggcgcagggtacgacgctggcgtgtgcaagtcgcggtgggaggcgtccggcggcatcactgccgggacgtacgagtacgtcgacgtggtcgcgccgctggcggcggacgggcggaagcgggccaggtacattgtggacgccgacttccgtgcggggctggaggtggcccgcgccacgcccgagtatgcggccgtcgtcgccgaggtgccggcgtcggcggtggtcgcaagggaggagtccgtcggccgcgccgtgcgcgtcgcgtccgacgccgcgcgccgctcgctccgcgcccacggcctccacgtcccgccctggcgcaagacgcggtacatgctcgccaagtggctcggcccctacaagcgctccaccgccacctcgctgccggcggcgaacgccggagcaatgccgatgaccggcggggccgggatggacatcaagtgccgcgccgtcgggttctttgcgcctccggccaccgcgccggcggccaggatcaagtagccttgctttgctcccgggcggcggtctacaaggagatcgatcactggaatgaaaaggaaaaagtttcttttagtgtagagaggtttctgctgcgatcgagagtttgattttgactttgagttgctctcgaacttgttttgtacagagaattttgttcgagattatcaagagcaaattgttcttgcacatcattttgcttctttgtttcttttttttatatacatatac

SEQ ID NO: 12056 - DNA, 1281 bp, Sorghum bicolor
  Clone ID: SORBI-28MAY03-CLUS8283_1
acgacaactggcattctcaactgttgggacaccagattatattgctccagaggttctgctaaagaagggatatggaatggaatgcgattggtggtctctgggcgcgatcatgtatgagatgctagttgggtatccaccattttacgccgatgatccaataactacatgccgaaagattgtgcactggagaaaccatttgaagtttcctgaggatggcgtccggtcaaatgaagcaagagatctcatttgccggttattatgtgatgttgaccacaggattggcagtgcaggggcagatcaaataaaggcacatccttggttccgaggagttgcatgggataaactttatgaaatggaagcagcatttaagcctcaagtaaatgatgaactggatacacagaatttcatgaaatttgaggaattggaaaatcctccggccaaaacaggctctgggccttcaagaaagatgatgctaaactccaaagatctgagctttgtggggtatacatacaaaaactttgatgcagtgaaagctataaaaatttcagatctgcaaaggaattcatctctaacaaggccttccattggttcgatattcggtccaccaggcatggattctcccatggaaccaaacgggagggacacacatatgcacacagtttcatctggtgatccaatgattccctaacctgcagtgctgtttgacctcagcaaatttccgaactaaatcagcatgcacgcctggatgatgtggctccagctggacaacctgctcatttttagccaggtttctgcttttcttaatcgtgggcaagcgatctgtagaaatccaccaaagcttctagttgtacaatagtatgccaccgactttaacaaaggtcccatgtactaagggctcatcagacatgggggcaggtttttttggagagattgcaccttgcggctggctgcccaggttggcagagcaaattgcggccttctcttgtggcagttcccggtccgctaacatttgatcatgggagggaaataagatggtgttgttgcggcaggaattctcatgggtgagttagtggtgttgttggtgtttgatatgtatcaggaatttttcccatttgaagtagggttttctgttagagttgtagctatttacaaggaacatacttttacagcaatatttctcattgatgtatggaaaacgcgtccttgttcgtttgagcttatcagccgaatctactagccatttaacagtgtttttcttttacaaaaaaaaaaaaaaaaaaa

SEQ ID NO: 12057 - DNA, 800 bp, Sorghum bicolor
  Clone ID: SORBI-28MAY03-CLUS82990_1
gcctactatcacttcttagttctgaatttctcttgactcgatcaaacctcttagagcgagtggcctgaagagatcgatacgataccaagcacatatagcagacacatatcatggccattgctgctacttcacccaagatgtcgtccgttttagccgcacttagcttgctgctcctagccgttgcgtgccaggccagcccttactaccctctggagctagggtactaccgttacaagtgtccccaggctgaggccatcgtgaaggccatcatggagaaggccatcgcccagaaccctggcaatggcgctggtctcatccgtatgctcttccatgactgtttcgtcgagggctgtgatgcttccgtgcttctggacccgaccccgttcagcccgacgccggagaagacaagcccgcccaacaacccaagcctacgcgggttcgagctgatcgacgccatcaaggacgccctggaggccgcgtgccccggggtcgtctcctgcgccgacatcatcgccttcgcggcccgcgacgcgtcctacttcctgagcggcggcaaggtccgcttcgacatgccggcgggccgcctggacggcaccttctccaacgcctccgagtcgctcaagttcctggtcccgccgacgtccaacctcagcaccctcgtctccagcttcgccgtcaaggggatgtcggtggaggacctggtcgtgctctccggcgcgcacaccgtcggccgctcccactgctcctccttcgtctccgaccgcctcaatgcctcggtcccctccgacatcagccccggg

SEQ ID NO: 12058 - DNA, 1440 bp, Sorghum bicolor
  Clone ID: SORBI-28MAY03-CLUS8558_1
gcacccacgatgtcgggtattgggctaacagcttcctcgaggaccttaagaggacctgcagtgatcattctcagagaaggtgctggggcattggctttgggctgcggttcagagtggtctcgctcgaccttcacttcaggaagctttccttggagagcattcttatggcataccggagagccaagacacgggcaattctgcttgactacgatggcacgctgatgccacaggcgattaacaagagcccctccactgaatctgttcggatcctcaatagcttgtgcggagacaagaaaaatgtggtgtacctatgcagcgggtatgaccggcgcactcttcatgagtggttcccttgtgagaaccttggcatagctgcggagcatggctacttcctgaggtgtaagagggacgccacgaggaagacctgtgtcactgctaccgactgcagctggaagcagatcgccgagccggtgatgtgcctgtacagggagacgacggatggctcaaccatcgaggacagggagacggtgctcgtctggaactacgaagatgcggaccctgacttcggctcatgccaggccaaggagctcgtcgaccaccttgagagcgtgcttgcaaatgagcctgtatcagtgaagaccacgcctcactctgttgaagtgaaaccgcagggcgtgagcaagggcttggtggctcggcgcatgctggtgtcgatgaaggaccgcggccagtgcccggacttcgtcctgtgcatcggtgacgacaagtccgacgaggacatgttccagctgattgccagtgctgcctgcggggactcgctagggtccaaggcggaggtgttcgcgtgtaccgtcggccgcaagcccagcaaggccaagtactacctcgacgacgcggcagaggtggtgaggctgatgcaggggctttcctacgtctccgaggagctggccctggcgaaccaccgggatgaagacgacgactcttctctggacgtgtgggagtagtagcattcccgtcgtcgtgctagctcctgcggtggctgggatttgcatgagccgggcgtaaaatgtttgtttgtgttggctcggttggagctatcaccgaaacgccgaggccgaatatttgagtagttaggtgtgtaaatgaggtatgcatgctttatcagggtaatgtattgtcagtgatttagtctaaggagctgctgagctgtcttgaatctagtgatgcagtagttactaccattgatcacagtacttgtttctagtgatgatctggtagtttagtttgtggtgttatttacctgatcagtggaaagcagtatgagctatgcacgatgcagacctgaaatttcattcatctaaagatcatagttttctcggaggcgtgtgtatacatatttggaaagaactatctgtctgatttgtttgtaagacctacaag

SEQ ID NO: 12059 - DNA, 1629 bp, Sorghum bicolor
  Clone ID: SORBI-28MAY03-CLUS8500_1
gcacgagggagagaggagcctttccctcccgcgagcacagcacgctacgaatcgcccgtggtaattgctcggccgcggcggccattagaaggcgctaatcacgcccagaatttaagagcccccgccttggcctcagccctcggctcacgcacctgcctacctacctgcgttgttgccttcttcgcttcgtcccccctgtgggctgtgggctgtggctgtggccgcaccgcagcggcggcggcggcagaggtgaacagcgaccggcgggcgactgcgctttccgcggccttggctcgtccggactccggagccggggggcggcagcgcagcggctcgcgggatccccccgaaccccatgcggcggcctcggtgtcagggtttgccagcagagtccacccaactatgatgaattagacaccccgtacataatggcgacggaagtcaatcaaacttatttttcatggtcacaaggagggtcaactgaacgggatggtcctcaaggagtatctgtatctcagacacttgatcatggttccatttccttcggaagatttgagttagagtcactatcgtgggagaagtggtccgtatttactaatgacagacgcaatgaagaatttggaaaattcaatggtttagtcgctcagaaaaaggcttattttgaagagtattacaagaagatcagggaactaaaggcttcacagcagcaaaaccagcaaactgaacttattctggaatacagtggtgatggtagcgactctagccagacagcagaagatgagcagggtgctgatcttgaaactcccactggatctggagctgctgtggatgtttatgtggaagaagctctgcatgaaactatgtcagagcacggactgcagtgctatgatgaccaaggaaacgaaaacttcgatacagaattttcctcatctaatctttcttcatcaggtgttctgcagcaaactgatgttagaggagctgttcgtggtagcagttctaccagtaaaatggatgcagggaagaagaatgctggttctgttcatggtgatactagaaccacatatgaagctgcaaggactcctagaagaattattgagaaagactccaggctcagacacagtcccaagataatacccaaatccatcaaaaccctttcaaaaagtgctatggactacactagtgagaggcctggttcaatgaagcccaatacaagtatgaaccagaaggctaagctggtgcaaaggtcaagtgcagcagcccagaagatgtgtggccctacagaagggaacaagcatacaggtctcagaagaccttcctcagcaggtgcgcgacggccctctactggagaccgacatgcaattgccaaggagaattcacaattgcctgcagttgtttccaccccacgacgaccttccactgctgagagacgcccagtcacccgagatcgtgcacagaaggaagccaatgtcaccacaccacgtcgaccttctacttctgaaagactccccgtcaaaagagaaaatgcagcgaagcataatgatatttccgctgtacgtcgaccctctacaggagagaggcgtgctattactagagatagtgttgtgagaacggatgtgaagacgcctagta

SEQ ID NO: 12060 - DNA, 718 bp, Sorghum bicolor
  Clone ID: SORBI-28MAY03-CLUS85966_1
gatcaggaccgggaagctggtgtcgctgtcggagcaggagctcgtggactgcgacgacgtcgacaaccaaggctgcaacggtggcctcatggactatgcgttccagtacatcaagaggaacggagggatcactaccgagtctaactatccgtatcttgccgagcagaggagctgtaacaaggcaaaagaacgatcccatgacgtgacaatagatggatatgaggatgtccctgctaacaacgaagatgctttacagaaagcagtcgcaaaccagccagtgtccattgctattgaggctagcggccaagacttccagttctactcagagggtgtcttcactggaagctgtgggacggagctagatcatggagttgcagctgttgggtatggcataactcgagatggcacgaaatattggatagtgaagaactcatggggcgaggactggggtgagaggggctatatcagaatgcaacgaggcatctcggactcgcaagggctctgcggcatagcaatggagccgtcttacccaactaaaatagcaacgacacacggtgccatcatgactgatgggcatgcatcctattaagcaagtgctctttgtttaaggagcagcataccatgtttcattatgctatgtaatttatgcagaatgtaatgttactcaagatatcggactaaataaatatagaactatactaagaactgatttccctcc

SEQ ID NO: 12061 - DNA, 1009 bp, Sorghum bicolor
  Clone ID: SORBI-28MAY03-CLUS7631_1
gaccttctcgttccggtcgatacccccggtcgcacgccgccactccccaagtcctccactcctctagatcgccggcccctcgctcggctcggctatggcggccggctccgcggcgtccctcgtcgcggcggccatctgcctcgccctcgccgtgcttgcgcctgccgttcccggaggtggtgccacattggagtcagttccagaccttgtgaaggcaatgtacctaaacattgaaagctccccttgtgtgaggctgctgaatctttctggtgaaattggctgttctaatcctggaagtgaaaaggtcattgcaccgattgtaagattcagaaaaagcagtgatcaattgattcaaccatccactattctccttcccttagatcagatgtcagatttctttctgagggtatccaatgatccagaactttaccagaaggtggctggtgtattgattgagtcaaatggtgtcaacggtgacttacaagagctgtcacctgatagaaaatttccacaagatgattttgcaccctactcaaatcacagccatgattggaatcttgctggatcaggtatcatgtggaacagatataacttccctgtatttctactttcggaagagagtacaaagactcttcaaaagatttcagaaaaaaatgagaagactagcaatggatatagagcaaatgttgcagaattcgaccttgttatgcagacaaccaaagctcaaacacatgattcagcatcctgcctcaaagaacaatcatgcttgcccctaggaggacacagtgtatgggcttcattaccgccacttaaaaatggatctacggagcatcagaaacctttaatattggctattgcatcccaagactctgcatcgttttttcgggaccgcagtcttggttcagattctcccatatctggattaattgccttgctcactgctgttgatgctctttctcacattcatgatctaagcaaccttaagagacagcttgtgttcgctgttttt

SEQ ID NO: 12062 - DNA, 1115 bp, Sorghum bicolor
  Clone ID: SORBI-28MAY03-CLUS7637_1
gcacgaggcacgcacctagcgacggaccagcacacagattcgttccacgccccacctcgtccgcgctcccagatctcgcgcgcctcccgcaagggtaatttgagccatgggcacagttgtggatgccgctccagctgttgtggctgaggaggtcactgagaacatgttgggtggcaagaaagttacagttgtatttgttctaggtggtcctggaagtggaaagggcacacaatgtgccaacattgtggagcactttggattcacccatcttagtgctggagatcttttgcgtgcagaaattaaatctggctctgagaacggaaccatgatcgagaacatgataaaggagggaaagattgttccatcggaggtgactataaagctgttgcaggaggcaatgataaaaaatgaaaatgacaaattcctgattgatggatttccaaggaacgaggagaatcgtgcagcgtttgagaatgttaccaaaatttctcctgcgtttgtgctattctttgactgttctgaggaagagatggagagacgtctcttgggccgcaatcagggaagagttgatgataacattgaaactatcaaaaaaaggtttaaaacctttgttgaatcaagtctgcctgtcattgagcattacaactcaagggacaaggttaaaaagattgatgctgcaaaaccaattcctgaggtgtttgaagacgtcaaagccatttttgccccattttcttcaaaggctgaatagagcaatctaagggacatgataaaggtgatacatggtgtcataggcaccacacaaacatatctgtgattatgaaccctttaatatagaacaaaagttttggctcatatgagctaccagcatatcagtaggcaattcgatttgttaccagcaataagtagatctgattcccagtggtcctgctagagtaacattttaccactgtgttgtttatgtatcctttgatgttgtgttgtaccattgtgtaattttactttacgcactgatgagaccttgtgccattccaccaggtttcttgttttattgaaagtgtaaaactgctgtcatattctttatgcgttgaaatatattcattgcaccgaactttgtc

SEQ ID NO: 12063 - DNA, 980 bp, Sorghum bicolor
  Clone ID: SORBI-28MAY03-CLUS7649_1
gcacgaggaggaggtccattgtgcagcttagaatcaatggcatctcaagattatccacatgatgaatacaatttagagagggaaaacagaaaccaggctagcaacccaggccctttactggaacggcctggtgataaaagtgagttggtcactggccttgatgaaggttgctatgtgcatgctgagcagccacctgtgatgggatggactgttggacctcagatgcttcatcctaaatatggtgttttagtagaagagagccaatttgagtcaaatattgccgacaatcatttaaccaggaagcctatttccataaaaaacattccaaggaatccactcgttgacgctgttgctgctcacgacagaagctcgatgagaaaggtttcagagcttgcaccatcaactgacaagctgaagcctaatgagagaaacatgttgctagaacagataagaagcaagaccttcagcttgaaaccggttgctcctgctaagccaacagccatgagatcacctgctagaaccagtactagaaacttgaaggttgccgctatcatagaaaaggcaaatgccatccgacaggcagtgggaagtgacgatgaagacgcagatagttggagtgatacataaatgcccaccttttgccctcttggtgtttctttccacgacagaaagataccaattcctcaagaacattggggacaggttggggatgcatagccatgtcatcgtttttgttagtagtgtaatgttagtcttgtgtatagtatatgcccataatccttctttcttctttcagttttctttctgtattctttcgaccgattgtttgtataccggcctgcctctcccagcagcaaaggctgttgcggttggcatgatcctaggatagcatgcatggtctatgtaaattaaacagtagttacaagtaaacacttatttcatcttctgaaaaaaggggagataatggcatcatcgattcc

SEQ ID NO: 12064 - DNA, 1028 bp, Sorghum bicolor
  Clone ID: SORBI-28MAY03-CLUS76584_1
gcacgagggcgtcctcgtgtccaaaacattctgcggcctgttggagggcagggcagcaccaagtatcagtctagccccgacctggcaccagcaagcttcttttctgccccgcggtggccagaatcggaaaccacagcggcaggcaaaaccttgcggcgtccgcgtggaagtggagtcggccgtcgccgcataaagccagagccggcgatcctgctgtgcccagcaatcccctcttctgttctcccaactaggaaacaaaactgctttcgtccagccttcttcgacctcggccgggctcgatcggtcccgtccatggctgtcgtcaccagaggcgccgcgtccctgcccttcgtcttgctgctcccagtcctagtcgtcgtcgtcgtcttcgcggcccagtctactctagccccgacctggcaccagcaagcttctttttctgccccgcggtggccagaatcggaaaccacagcggcaggcaaaaccttgcggcgcccgcgtggagggtggagtcggccgtcgccgcgcataaagaacccagccggcgatcctgctgtagtgttgcgcccagcaatccccctcctctgttctcccagctagtaagcgaaactgcttccagccttcttccacctcgggggctcgatcgggtccgtccatggctgtcgtcaccagaggcgcagcgtccctgcccctcgtcttgctggtcttcgtcttcgcggccccgtcgccggctgacggctgcgaccgctgcgtgcgccggtccagggccacctaccaggcttcgtcgctagccctcaacgccggttcgtgcgggtacggctccctcgccgcgtccttcaacggcggcttcctcgccgccgccagccccgagctctacaggggcggcgtcgcctgcggtgcctgcttccaggtgcggtgcagggacagcgagctgtgcagcgcggcgggcgcgaagggtggtggtgacggaccaggcgcggacgtcgttgaaccgcacgggcctggtgctgagcgccgcggcgtacgcg

SEQ ID NO: 12065 - DNA, 1594 bp, Sorghum bicolor
  unsure (1)..(1594): unsure at all n locations
  Clone ID: SORBI-28MAY03-CLUS7670_1
gcacgagggctcttcgtcgtcgccgccgcggctcctcgcggagcccggggcgttttcgagggattgagagcaaaaggctttgcaagcgtgtcatcttcgactggcaatgagaatatgtctactggaaccggtaccctgcctcccgtgcctcccccatcatcatactttggttcacctgttttctggattggagttggtgtagcattgtctgtggcgtttaccacggtctcttccatggtaaagagatatgccatggaacaagcatttaagtcaatgatgacccaggcaccaccaaactcatttggctccaactcgcctttcccatttggcatgccaccacaggcatctcctactgcaccaagcagttttccgtacttggaaccaaagaaagatacctccccacaggtgtcaactgttgatgtctcagctaccgaagtggaagctgctggaacatcgaaagaggtggatgtgactgaaactccagagccttcaaagaaatttgcatttgttgatgtttctcccgaagagttgcagcaaaagaacctccaatcttcactggagacagtagatgtaaaacatgatagtacagacagtgaaagtaaggaggatattgaggaaaaagttcccacaaatggagcgacttttaagccgaatgaagatgctgctcgtgggccaactgaacctagtaactcgggacctatgctatccgttgagacaattgagaaaatgatggaagatccaactgtgcagaagatggtgtatccctacttgcctgaagagatgaggaacccagattcgttcaagtggatgctgcagaatccaatgtaccgtcaacaactacaggatatgctaaataacatgggtgcatctcctgatcaatgggataaccgcatggttgatcacctgaagaactttgaccttagcagtccagaagtgcggcagcagtttgcgcaagttggcatgactcccgaggaagtggtatcgaaaataatggcaaacccagatgtagctgttgcattccagaatccaaaaatacagacagccatcatggactgttcgcagaaccctctaaacattgtaaaataccaaaacgacaaggaggtcatggacgttttcatgaagatatcacaaatcttcccacaaattaacggctagccgaacttcatcgcgggattgcagttctgattttttgtcggcccatcatccatctcctgtctggaggactgctgcggtttccacgtgtcaagaaagggaacacctgttgggtcatgacgctccagatagatccctcactgtgtcaaggtcctttgagttgcctatgtacgtcgtatgatgtagcggccttggtttagctatgagtatgaccctactttcataaagtcagtctagcgagcatagcagggtcaaaggcttttatttacatttgtatcggcaggcagtcagtgcgctgctttgacgttgcatggttttatctcgtaggatgtggaagccgcagcagaggtggttcgtatcagatcaattttgctatatataattgctatccactgtgtaacatattagagacaccaatggcgattcaangtaatctgtttcg

SEQ ID NO: 12066 - DNA, 793 bp, Sorghum bicolor
  Clone ID: SORBI-28MAY03-CLUS9227_1
atagatcccgtcccctttccatttccgcaccacgcagccggcccagcccaaaacccttcccttcctctcctcccttcccacgatggccgccgccgccgccaccacgccgcactctctcctcctccagcgcgcggcgagcccggccgcgccgccgagggcgaccgccaccgccacctccctccgtcttccggcccgcgccgccaggatctcatgcgcggcggtggcggcgccgtctccagccgccgcagccgcggcggacgaggcggagcgcggcgtctacaacttcgcggcggggcccgcgacgctgccgctctccgtcctcaagcgggcgcaggcggagctggtggactaccacggctccgggatgagcatcatggagatgagccaccgcgggaaggagttcgacgccgccatcaagaaggccgaggccgacctgcgtgcgctcctcgcggtgcccgacacccacgacgtgctcttcctccagggcggagccaccacgcagttcgccgccgtcccgctcaacctctgcgcggggccctccgaccccgctgacttcgtcgtgtccggctcctggagcgacaaggccttcaaggaggccaagaagttctccgccgcctccgtcgcctggtcgggcaaggacggcaagtacaccgcgctcccgcccttcgacgccatcaagcagaatcccgaggccaggttcctccacatctgctccaacgagactatccacggcgtcgagttcaaggactacccggagccccggaacaagtcgggcattctcgtcgccgacatg

SEQ ID NO: 12067 - DNA, 862 bp, Sorghum bicolor
  Clone ID: SORBI-28MAY03-CLUS9291_1
gcacgaggcacgcgcacgcggcggacctcgacacgaatacgagcacccccgggtgcatatatgcaaaacagccacgactcccccgggctccttcatcatcatcatcatcatccatcggcttgattcctcaatcaacaccgcaagagccctcgttcggatcggggcttgctgcgacttggcgaggtaaaaccctagctccagatcgcgggtcgtagccggcgagatgcagatcttcgtcaagacgctcacggggaagaccatcacgctcgaggtcgagagcagcgacaccatcgacaatgtcaaggccaagatccaggacaaggagggcattccgcctgaccagcagaggctgatttttgctggtaagcaattggaggatgggcgaacattagctgattacaacattcaaaaggagtcgactctccatttggtcctgaggctcaggggtggaactatgatcaaggtgaagacactcactgggaaggaaatcgagattgacatcgagcccactgacacgatcgataggatcaaggagcgtgttgaggagaaagaaggcattccacctgttcagcagaggctcatttatgctgggaagcaacttgctgatgacaaaactgccaaggattacaacattgaaggtggttcagtgctccatcttgtgcttgctctgaggggtggccaatagattaaaaagttatagtttctgcttatgctatccgttacatacggttgtttcagaattgaagccttgtattgggtggttgattgtgccatgcaattagcagactactagagtcaggtgtcatctgtactgtttgagaaatgcttgaactaaggtcattcagttgccatctcattcttg

SEQ ID NO: 12068 - DNA, 1269 bp, Sorghum bicolor
  Clone ID: SORBI-28MAY03-CLUS92913_1
ccaaaaacagagaaaaatcgagagaaccctagctagcatggcgaccggcgacgaggcggagacggcggcgccggcatcggaggaggcgagggactggtccgacatgacgccggtgtgcctcgccgaagcgttctcgcggctggcgctggaggacctgtggcgcggcgccatggcgtgctgccgctcctggcgggacgccgcccgctcacgcccggggctcttcgctgtgctcaacctcgagcccgggtttgctgagtccacacccggggccgaggcggcagcgtggtggacgcccgccttccagcgccgcgccgacgcgatgctacgctccgccgccacgctcgccgcgggggagctgtgtgagatccgtgtccgccactgctccgacgacgcgctcgaattcgccgctgagaggtctctaaaacttagtatcctttccatcaaaactagcccggcgataactgatcgatcaatgctcactgtcggagcgtgctgccccatgcttacagaattggacatcagcaactgctatgacgtttcatacaagtcactggaggtgattggccagagctgcctgaacctcagggtcctcaagcgcaacatattcaactggattgatccatcagagcatgttggaatagttcctgaggactacttaagagaatgccccgaagatggtgacagggaagccattacaatatccaagttcatgccaaagctgaaacatcttgaactgaggttctcaaagttgaccgccgtcggcctcaactctatccctgaaggatgcaaggatctggaggttctggacctgtttggctgcgcaaatcttacaagccgtggaatagatcaggctgctgctaatctgaagaatctcgtgacgctagtgaagcccaacttctacatacctcgttcctccttccacatggggaggtacggccactggcagttatatgacgagagattccagacaaatgtatttcagatatgattatagtctattcgagatatgattatagtttcaggctacaggaggtccctttgacctatatgattaagattgtgtgtatgtgggcgcagataatagcaataatgtgtggtttgaattgtttctctggataacattttgtacagatggttatgctccagttatttgaatgtaacttattgcctatataggcttgcaagacatgttttggcattctatttggttctgagaacatagcgggtattttgtcgccccagaaatcaaaataacattttgtacgagga

SEQ ID NO: 12069 - DNA, 1310 bp, Sorghum bicolor
  Clone ID: SORBI-28MAY03-CLUS9561_1
ccacgtggctgtgctttgctaggtttccgggcccgctcgctccaccggagggggctgttttggcagtccagaggcggtcttgcaacctcgcgcccttttggatatctccgaccgcatgggttcaagaattcaacaatactgccagaattgtgaagaagatcaagctcacaggcacaccatgcaagatatttaagaagactgcactaatcatagggatgttcacccctgcctccccggttgctaggtttgaaggtgctgccattcggactgtaagtggaatccgagggcaggttaaaaaggcagcaaagattgagccaggagacatgttgaagagaaaaggggaaaatacagaaggaatcgcaagatgcacatttgaggacagaattcttatgagtgacattgttttcctgcgtgcctgggttaatgttgaagttcccacgtactgtaaccctgtgaccactgctctgcaacctagagagcagacctggcaaggcatgagaacaactgctgagttgcggagggaacacaatatccctaccccacacaacaaggactcagtttacaagcctattgagcggaaaccacggaagttcaatcctgttgagatccctgcaaagctgcaacagttacttccttttaaatctaagcctaaggatacacctaagcagaagaaagtatcagttgaaaacagggtgccagtaatcatgcaacctagagagaagaagacacatgcagctatacaacagctaaggctgataaaacacgagaataatttatcatggttataagtgtaactgtttaactgtaagcacgcaaataatttcttgttcattacaggcagcaaagattgagccaggagacatgttgaagagaaaaggggaaaatacagaaggaatcgcaagatgcacatttgaggacagaattcttatgagtgacattgttttcctgcgtgcctgggttaatgttgaagttcccacgtactgtaaccctgtgaccactgttctgcaacctagagagcagacctggcaaggcatgagaacaactgctgagttgcggagggaacacaatatccctaccccacacaacaaggactcagtttacaagcctattgagcggaaaccacggaagttcaatcctgttgagatccctgcaaagctgcaacagttacttccttttaaatctaagcctaaggatacacctaagcagaagaaagtatcagttgaaaacagggtgccagtaatcatgcaacctagtgagaagaagacacatgcagctatacaacagctaaggctgataaaacaagagaaggc

SEQ ID NO: 12070 - DNA, 1448 bp, Sorghum bicolor
  Clone ID: SORBI-28MAY03-CLUS954_1
gcacgaggaggggaccaagttatggttatcgaggcagagtgatgcttgcttttgaagataatggatcctcaaaaattggagtccgatttgacaagcagatccctgatggtaatgatcttggtggtttgtgcgaggaagatcacggtttcttctgctctgctgaattactgcggccagacttttctgctggtgaagaagttgagaggctagctatgaccgagttaatagaggtcatttcagaagagaacaaatctggacctctgatagtgttacttaaggatgtagagaaatcattcactggagctccagggtcactttcatctttgaggagcaaacttgaatcacttccatctggtgttcttgttataggatcccacacccagatggacagccgcaaagagaaggcgcatcctggaggttttcttttcacaaagtttgccagtagcagccagacactttttgaccttttcccggatagcttcggtagcaggttgcatgaaagaagcaaagaaagtccaaaggcaatgaaacatctaaataaacttttcccaaacaaaatttcaatccagcttccgcaggatgaagctctacttacagattggaagcagcagttggatcgtgatgttgaaacacttaaagccaaatcaaatattggtagcattcgcacgtttctgagccgtaatggaattgaatgcaatgatcttgaaaaattattcatcaaagaccaatcactgagtaatgaaaatgtggacaagattgttgggtacgcagtgagttatcaccttaagcacaataaaattgagacgtccaactccaaggatgctaaacttgtactcgcaagtgaaagccttaagcatgggctcaacatgctgcaaagcatgcaaagtgataacaagagctccaaaaaatcactgaaggatgttgtcacagagaatgaatttgagaaaaggcttttggcagatgttataccacctaatgacattggagttacctttgatgatattggagccctggagaatgtaaaggacacgttaaaggagctggtgatgctccctttacaaagacctgaattgttctgcaaaggccagttaacaaagccttgcaagggaatattgcttttcggacctcctggcactgggaaaactatgcttgccaaagcagtagcaactgaagcaggtgctaatttcatcaatatatcaatgtcgagcattacatcgaagtggtttggtgaaggagagaagtatgtaaaggctgttttctcactagcaagtaaaatagcccccagtgttatatttattgatgaggtcgatagtatgctaggaaggagagaaaatccaggggagcatgaagcgatgcgcaagatgaagaatgaatttatggtaaattgggatgggttgcgcactaaagataaggagcgtgtgcttgttcttggtgctacaaatagaccg

SEQ ID NO: 12071 - DNA, 1176 bp, Sorghum bicolor
  Clone ID: SORBI-28MAY03-CLUS9616_1
gcacgaggcaccagctagctagcagagagccacgacaacaccaactagctagctagcttgccttgcttctctctttcacgtacgatgtatatcgatgatgagagcactggcggtgctggccatggtggccttgttcgccgcgtcgtccgcacgcgccgagcagtgcggcacgcaggccggcggcgcgctctgccccaactgcctctgctgcagcaagttcgggtggtgcggctccacctccgattactgcggcagcggctgccagagccagtgcaccggcagctgcggcagcaccccaagcactccgactcccaccccgagctccggcggcggcggcagcgtggcgtccatcatctccgagtccctcttcaaccagatgctcctccaccgcaacgacgccgcgtgccccgccaatggcttctacacctactccgccttcatcgcggcggccaacgcgttcccgggcttcggcaccacgggcggcgccgacacccagaaacgcgagctggcggcgttcctcgcccaaacctcgcacgagacgacgggcgggtgggcgacggcgcccgacggcgcctacgcctggggctactgcttcaaggaggagcagggcgccgcgtcggggccggactactgcgagcccagcacacagtggccgtgcgccgccgggaagaagtactacggccgtggacccatccagatctcctacaactacaactacggcgccgccgggcaggccatcggcgccggcatcctcgccaacccggacctggtggcgtcggacccgaccgtgtcgttcgagacggcggtgtggttctggatgacgccgcagtcgcccaagccgtcgtgccacgccgtcatgaccggccagtggacgccgtcgggagctgacaccgccgcggggaggttgccggggtatggtgttgtcactaacatcatcaatggtggcctcgagtgcggcaaaggcgctgatagccgcgtcgctgaccggatcggcttctacaagcgctactgcgacttgcttggtgtcagctacggcgataacttggactgcgccaaccagaagcccttcaacagctagatcaactatatatatatatatatgcattcagtcttttttatttactatctgtatacttcgctatatgtatacaacgacagtggcgtatacgctatttt

SEQ ID NO: 12072 - DNA, 645 bp, Sorghum bicolor
  Clone ID: SORBI-28MAY03-CLUS8109_1
aacatttgagcttgtgcgttagagggtagtcccaactcccaagtcccaagtcccaacgtcgatggccctgcccgccctaatcagcaccctcctcgccgccgtcatctggtgcgccgcttacctcgccgccgccatctcctccgccttctgattcccactcccccaaccacaaactatcctgtagcacaccccacctccagctcttttaggtcctaatactatactcgcaatccctcccaccgactcgcttcgatccgccgccctcgcgccgccatggggtacgcgcagctcgtcatcggccccgctgggagcggcaagtcaacttattgctccagtttgtacgaccattgccagactgtgggcaggacaattcatattgtcaatctcgatccagctgctgagcactttgactatcctgtagatatggatatcagagagctgatttcattggatgatgttatggaggacattgggctggggccaaatggtggtctcatctactgcatggagcacctagaagacagcttggatgattggtttgatgaacagctagagaactacttggatgatgactatcttgtatttgattgccctggccagattgaactcttcacgcatgttccagttttgcggaactttgttgag

SEQ ID NO: 12073 - DNA, 1027 bp, Sorghum bicolor
  Clone ID: SORBI-28MAY03-CLUS793_1
gcacgaggcgactctccgttccagccacagcaatgaagcccaggcctctagattacggttgcggcccggcagcggcggcggcggcggggtgcgctggatgggcgtggaggccgaggccgcgcgggggcgggaggtcaccaggggtgtcgcccaagtgctccaactctcccaactcggcggcggcggcgggagcggtgcactcggagcaccaccgccgcggcgacagcgtggtgctgctccgcccggtggagctgcccgggacggggtacgggtcggaggtggaggcgcggatcgagagggtcatcttcgcctgccgcttcatgaccttcctcggcatcggtggcttgctcctcggctccgtcccttgtttcctcaagggaagcgttcatgtgatgaatgccttcgtcgactactacctgcacggcggagggaagctcatactcatgctgctggaagccattgaaatgtttctcattggaacggtcacgtttgtcttggggattggcttgtacgagctcttcatcagcaccatagactcctcttatgggtccaacctcttcggccttttcagccttccggatcggcccaagtgggttgaaatcaagtcgttagatgatctcaagacaaagctgggtcatgtcattgtcctggttctactggttggcatattcgagaagagcaagagggtgaccattacatcctgtactgatctcttatgctttgctggatcgattttcctatgttcagtttgcctctacctactttccaggctcaataccagcaaatgaggcagccatgcctgaaataagagtgtttgtatataagtgattggtctgttctgttgctgtgcaatgcctcaggttgtgttcttgcagtaattaactgggaagtgtggagatacagatttcccatgtactcatgtatggctagggagtttcagttaggcacaaccacactacattgagtatcgtcctgtatgtgtagctccgtgcctcggccaccaatactgattttttttgagcaagtt

SEQ ID NO: 12074 - DNA, 510 bp, Sorghum bicolor
  Clone ID: LIB3478-054-Q6-K1-H6
ccggaatttccgagccaacacacgcggtgccgcgtgggctgtaacccttaacttcatgccacaaatgtacaattctactatgatatcattgccgcatgctcaaatctgttaacgatgggcctaatggctttctgttgtgcattgcctgtttcacatccagaaatgtttctcattggaacggtcacgtgtgtctcggggattggcttgtacgagctcttcatcagcaccatagactcctcttatgggtccaacctcttcggccttttcagccttccggatcggcccaagtgggttgaaatcaagtcgttagatgatctcaagacaaagctgtgtcatgtcattgtcctggttctactggttggcatattcgagaagagcaagagggtgaccattacatcctgtactgatctcttatgctttgctggatcgattttcctatgttcagtttgcctctacctactttccaggctcaataccagcaaatgaggcagccatgcctgaaataagagt

SEQ ID NO: 12075 - DNA, 946 bp, Sorghum bicolor
  Clone ID: SORBI-28MAY03-CLUS8128_1
tctggagtccacgggcgatccaccagacacgtacgagtgaagtgaccgaccacctgctgcccggccgggcatattgcagcagcggcaatggcttgcctcgccggtagcgtccgccctcctgcaattcttctcgtcttccacctcgcctccgctggtggaagcagcagcgtcgatcttgggcgaaaggccggcagcatcgccgccgccgccgacgagcagtcgccggcagtggaggaggcggcctcgagggggaggtacgccgtcatcttcgacgccgggagcacgggcagccgtgttcacgtcttcaaattcgacaagaagctcgacctcgtcccgatcggcgacgacatcgagttcttcaccaagataaagcccgggctgagctcatttgcggggaaacctcaagaggccgcaaactctatactgccccttcttgagcaggctaaggagattgtccctctccggcttcagaaagatactccgctcaaacttggggcaacagctggtctaagattaatcggagatgagaaggcagaggagattcttgaagcggttagagatcttgtccacaccaagagcaaatttcagtacaaccccaaatggatcactgttctcgagggaacgcaagaaggatcttacctatgggttgctctgaattatctgttaggtaagttgggaggggactactcgaagacggttggagtgatagatttgggaggtggatcagtgcaaatggcatatgccgtttctgggaatgctgctgcaaatgccccagctgtacctgatgggaaggatccatacattacaaaggagtacctcaagggaaaagattataacctatatgtttacagctacgtgttcatattgtctgtctggttgttcgagtttagattctgtttggattgattgggtcatttagccactgctttttgatcgggttcagggg

SEQ ID NO: 12076 - DNA, 721 bp, Sorghum bicolor
  Clone ID: SORBI-28MAY03-CLUS81491_1
cctacatggtgttcaagatgtccgatgaatcctatgggttggatgatccactccaggaggctgaagttagcattggggcaaccaaatccactcgtcgggtttgcctaggatatgacaatgaggacgaggacggggaagaggtgcctcagaatgaccgatcatcccgaccaattggattattcagaccacgggtagggtgaggaagccctcgggtccctcctgggctgcaagtacagcgccctcaggcaagggcgggcggctggatggggatggagcggcgtcggcgcccgcctgctgcgggtgcgcgcggcggcctgtccacctcccgcctgcggccctggcccggccactgccggaaggcgcctgccgcgcagccccgggcgcgccggccgtccgcgccgcgcccggcgccgtccgcgtctcggcctgcgccctgccgcgcgacctgcccccgctcgccggcggggcgcgccccgccgcactgccgtccttatgcaagctgcgcgtctggcggcgcgccggctcccactgccccgcactccctgccggtggcctcacggtcatggagctggacgggccccccgctgccacgtgctacatgctgtccgccaggaagctgtgcatcatatggggcggcacgccgcagtactggcgctggatccctctcaccgactccaggttcacagaaggcgcagaacttctgaacgtttgctggttggaa

SEQ ID NO: 12077 - DNA, 1161 bp, Sorghum bicolor
  Clone ID: SORBI-28MAY03-CLUS99789_1
cagtagcgagagcttgtaacccaagtgggggcattaaggtggtgagaatgcttagagaagccttctaggcttgggcctatggtgttcctttgctggtctgcccgtcccaagttggtagtggttagtgggggccttggtgaaagcttgggcctctgtaaacctgaagtggcaggaatggaagggaaggttatatgtgtcggatggtgacatggggtgatctgatgacccctttgtatattatatggtaaatgaataaatcgccgcggccgcaggtggtgcaggcgccggtccagtctgtcgttgccgcgtcggctcccaacccatgtgtggaaatcagtagctctgtggactgtggtcaggggaaaagaacagccaacaaataaacgtcctaggtcagaaagtaccgcagaaccaagcacaaaagcatccagggagaaaattagaagggataagctgaacgagagattcctggaattgggtgccattttggagccagggaaaactcctaaaatggacaagtcagctatattaaatgatgctattcgtgtagtaggtgaattgcgtagcgaagcaaaagagctcaaggattcaaatgagagcctacaagagaagattaaagagctaaaggctgagaagaatgagctgcgagacgagaagcaaaggctgaaggccgagaaggagagcctggagcagcagatcaagttcctgaatgcccgcccaagtctggtaccacaccacccagtgatctcagcctctgccttcactgctccccaggggccggcagtcgccgggcacaagctgatgatgcctgtgcttggctaccctggattcccgatgtggcagttcatgcccccttctgatgttgacacctctgatgaccccaagtcttgcccccctgtggcgtaagcaagtgaagaggcgatgctgccctccattgattcaagtctagatcgtgatcagtctgcagtgttgttggtgtagttgactcccctctccagaatggaagggaaggttatatgtgtcggatggtgacatggggtgatctgatgacccctttgtatattatatggtaaatgaataaattccgtgaccagttgcaaatgaggattagcagactagctcatgtctattcctgctttttgtcgtataaaccacgttgtg

SEQ ID NO: 12078 - DNA, 947 bp, Sorghum bicolor
  Clone ID: SORBI-28MAY03-CLUS9959_1
gcgcgagcctgtgtacgactgtgggaagagcatgaaccctgctgtggacttaggacagattgaaggttcctttataaagggaattgggtttttcgtatatgaagagtatcttacaaacagtgatggcctcatgattagcaacagcacatgggactacaagatcccaactgtcgacataatcccaaaacagttcaatgctgaggtgctgaacactggatacaataagaaccgtgtgctttcttccaaagctgctggtgaacctgccttggttcttgcctcatccgttcattgtgcactgagagaagctatccgagcagcgagaatggagtttgcaaacagcactgtatctggacgctcaccgctggaattcaagatggatgtccctgcaccaatgacgctggtgaaacaactatgtggtttagatattgtggagaagtacctaaaaagtctatctacctagaaaggagtggtatcatctttgtgcttgctgcttgcgcttcaacagaaaggaggaaggaggatttccatttccctcaatggaaatagggtttccctcgtgtggaaaggaaggagggaggtgttaaattagcacaatattgatgctcaccgctggagtttcagatggatgtcccagcaccaatgacagtggtgaaagaattatgtggtttagatattgtcgagaagtacttagaacgtctatctacctatgagcgcgtggctggggcgtaatctaatctgaagtcatgttatctcataataaagtgtggtatcagcctattgtttgtttgtatacaataaaacgtgccgcgcggcgtgggctctgtgtgtgtgtgggcacaatatttgaatgttttcaactatctgtattcatgactccttattaaaactactggaagtggttatgtttaagtaatctattgttatgaagtttgagtgctggtcaattt

SEQ ID NO: 12079 - DNA, 744 bp, Sorghum bicolor
  Clone ID: SORBI-28MAY03-CLUS102776_1
cgactcggagcgctcactcatggagagggtcaggcaggagcttaagatcgagctcaagcagggtttcaagtcaagaatagaggatgtgagggaggaaattctgaggaaaaggagggccgggaagctgcctggggacaccaccagcatcctcaagcaatggtggcagcagcactccaagtggccataccccacggaagacgataaggcaaagcttggcacgaggcttggccgacaggcccgggtaatcttgggaaatttcatcaaccagaggaagcgaaactggcacaacaactcccagacgtcaaccctcaaatcaaagcgtaaaaggtgatggagggcaagctgcacaatgtaatgcacacctgctgacacatataccaacacgctaatcaaacgaagctcgacgaccatggcgactcacaaaaataaagaggatcggccgatcgattcaactgtatatctagtgattagtcagaggtgacaggttgatgacacacacatacacgtacactagtctgaccactggcatatttgtttgctgtgatttttgagctcatgtgctcagagcatacttcattcttgttattattattgtatagccatattttgtcccccagcgtacatacataatctgaggattaaaaatccatcccctgtgcacatatatagtgatctgatctgaccatcatctgctggcagaaagagagaaaaaacagaggttgcattaaaaaaaaaaaaaaaaaa

SEQ ID NO: 12080 - DNA, 855 bp, Sorghum bicolor
  Clone ID: SORBI-28MAY03-CLUS10301_1
cctactgggccgccaaacacgcttctcccttcccatcgtttcctttcctctccctcctcgtctcgtcttcgttcccctttcctcctgcgcatcccccccgtcttctcctcaccgcgtcaaaccccagcaccaagcaaccgcccgccgcccctccgctcccatcccgaatcagccgccgcggtgcccaatccggccgatcccccctccgatccgcgggtgcccgccgcagaggcggcgcctctgggcctaccccgatgtatagcaacttcaaggagcaggcgatcgagtacgtcaagcaggcggtccaggaggacaatgccggcaattacgtcaaggcgttccctctctacatgaacgcgctcgagtacttcaagacccacctcaagtacgagaagaaccccaagatcaaggaggccatcaccgccaagttcaccgagtacctccgccgcgccgaggagatccgggcggtcctcgatgagggcggcgcggggccggggtccaacggcggcgacgcggccgtcgccacgcgccccaagaccaagggcaaggacaacggggacgggggcaacggaggggatgactccgagcagtccaagctgagggcggggctcaactccgccatcatcaccgagaagcccaacgtcaagtggaacgacgttgccggtctcgagagcgccaagcaggcgctgcaggaggcagtcatattgcccgtcaagttcccgcagttcttcacgggcaagcggaggccttggagggcgtttcttttgtatggcccccctggaacaagaaagtcttatttggcaaaagccgtcgcaaccgaggctgattcaacatttttcagtatatcttcttcag

SEQ ID NO: 12081 - DNA, 875 bp, Sorghum bicolor
  Clone ID: SORBI-28MAY03-CLUS10389_1
ggagagagaaagagaggcgaagaaggagatagcacgggggctttatcggagaaggaggccggagcaaaggtgccgaagaaggccgcggcagggcgtcgcggcggcggcggcccgaagaagaagccggtctctcgctccgtgaaggccggcctccagttccccgtcggccgtatcggccgctacctcaagcagggtcgctacgcccagcgtatcggcaccggcgcccccgtctacctcgccgccgtcctcgagtacctcgccgctgaggtcctcgagttggcggggaacgcagcgcgggacaacaagaaaaaccggatcatcccgcggcacgtactgctggcgatccgcaacgacgaggagctcgggaagctgctggccggcgtcaccatcgcgcatggcggggttctgcccaacatcaaccctgtgttgctcccaaagaagaccgctgccgccgccgccaaggagggcaaagagaagaagtcacccaagaaggccgccaccaagtcgcccaagaaggcggctgccgcataggctcccgccaatgccggtgcccttgtctcttgctctcttcctctgtccgctctgaactgaaacgctcctagctgtcgttgtcggtcaaggtcgttgttgcttgatgcatttgttgtggttgttcgtgtgtaattgcgcgcctttcgcccaatccgcatgtactgtgtaggttgacactggtttaggtttcgatctgtgaaacgctggtttagattcaaggagtgtgtgagctgtgaagggcaggggatggggtgggatctgtgaatcattagatgctgtttgtaataatattgcgaagatgtgtaaaatccgttctgtgcttccattccgtgcttgatgtctgg

SEQ ID NO: 12082 - DNA, 876 bp, Sorghum bicolor
  unsure (1)..(876): unsure at all n locations
  Clone ID: SORBI-28MAY03-CLUS10463_1
catacagtgctttgttgctgttgagaaagaggaatggaagtttgatactctttgtgatctttatgatacactcaccatcacccaagctgttattttctgcaatactaagagaaaggtggattggcttactgagaaaatgcgcagcaacaacttcacggtgtcagctatgcacggtgacatgccccaacaagaaagggatgccattatgggtgagttcaggtctggtgatactcgtgtgctaataactacggatgtttgggctcgaggactggatgttcagcaggtttcacttgtcataaattatgatctcccaaataatcgtgagctctacatccatcgcattggtcgatctggtcgttttgggcgcaagggtgtggcgatcaatttcgtgcgcaaggatgacatccgtatactgagagatatagagcagtactacagcacgcaaattgatgagatgccgatgaatgtcgctgatcttatttgagcaagaggattgggaggagggagcgtgttgtgttttatcatctcctgtccgcgcaaggtttggcttgagcctcctttgttgttggtgtcgctgtggactggaagagaggggctttgtaactggtggagcagagattgtttccgttttgatcatggcgtgaactgtatatattttagcttgctccagctcatgtaacactttcttgctgcgtttgtgcttgggacacgaagacctgtgttgatggcttcattagtgtgacaatgatttggtattggatttttggttgatcgtctgccattcctgtgctgaactgaagtgctgtttatttattattatggttttgatttgcgctgngaaaaaaaaaaaaaaaaaaaaactaattaaaaacaaat

SEQ ID NO: 12083 - DNA, 670 bp, Sorghum bicolor
  Clone ID: SORBI-28MAY03-CLUS8728_1
tctgcccttttcccctcttcccgagctcccttgctaggttaccttcctcaaccacattctgcccttctggccctcatctctctccccctctctctagtctcttcagtaacaccacaatttgttactgacacgccttcagtctgttgacctgctactagcgaaatttggagacccagccttctgtctctgaaacttggagttcccaggggggaggttctgccaaaattttggcttctgaacatccatttccagggggaggttctgccaaaatttgctcctgtgaacataagtttcccaaggggaggttctgccaaaatttccacctgtgaccatcaattttccagggggagattctgccaaaattttgtgcactaaccgtcagtcttccaaggggaggttctgccaaaattttcttctctcactgtcacttctccaaggccaagccctgccaaaagtttcttcacatacatcatagatatatacaacaaatactaatttgcagggtaaataaacaagagtactctcctccttgtccttgatgataagctagaagagaggccgcagcatctgttttagatgttgttgctcgtcctgtccgagcacctcctttcccaattcatggtcggttccgccataacccgccttgtccaggccttctctgttgttttcc

SEQ ID NO: 12084 - DNA, 1278 bp, Sorghum bicolor
  unsure (1)..(1278): unsure at all n locations
  Clone ID: SORBI-28MAY03-CLUS8839_1
gcacgaggctgaggttgccaaagaagcttcagatatggtacttgcagatgataacttcagcactatagtcgcagcagttggtgaagggaggtctatttacaacaatatgaaggcttttattagatatatgatctcctcaaacatcggagaggttgcatcaatattcctgacatcggctttaggtattccagaaggtctcatcccagtgcaacttctatgggtcaatcttgttacagatggccctccagcgacagctttggggttcaacccacctgataaagacatcatgaagaaacctcctcgaagaagtgatgactctttgatcactccttggatcctgtttcgctatatggttattggcctttatgttggggttgcaacagtgggaatcttcatcatctggtacacgcatggcagtttcctgggaattgacctggctagtgatggtcatacacttgtgtcgtactcccagctctcaaactggggccagtgctcctcatgggagggcttcaaggtgtcgccattcactgcaggagcgaggacattcaaatttgatgcaaatccatgcgattacttccagggtggcaagattaaagcaacgacactctctttgtctgtcttggtgtccattgagatgttcaactcactgaatgccctgtcagaggatggcagccttctgagcatgccgccatgggttaatccgtggcttcttctggccatgtctgtttcttttgggctgcatttcttgatcctctatgtgcctttcctcgctcaagtgtttgggattgtgcccctcagtttgaacgaatggctcttggtgatagcagtggccttcccagtggtgctgatcgatgaggttctcaaatttgtggggcggtgcctgacagcgcgtgcccggaaacaatcagggaagaggaaggcagagtagatgctagtgatcatcagtattagaatctgtagcaccacggggaattgatattggatgacaccctattgtttttgagttgctaagggctctcgatcctttctgagtgttttagattgggaatatgaccgtgcaggacaagctaggatattctatagaactcataatcagatcgcgttgaacacactgcatttttttttcgttgtaacaaatgctggtactgtgaacatgctggagatacagccaatggttacctgacgttttttcgctctaatnggtgcactatatatgctactgttatgttgcgaatcttctgacatgttgctcagtaataatacgcttgttgcagtcgt

SEQ ID NO: 12085 - DNA, 766 bp, Sorghum bicolor
  unsure (1)..(766): unsure at all n locations
  Clone ID: SORBI-28MAY03-CLUS8943_1
gccggccgggccggggcaagtccaaagggcagaccagaagttgcggttggcctcctcctcctcctcctcctcttctcctccgtcggctcagacttcagatctctgcgtgcggcgatggcgtcgttctcggaggctcccccaggcaaccccaaggcgggcgagaagatcttcaagaccaagtgcgcgcagtgccacacggtcgagaagggcgccggtcacaagcaaggtccaaacttgaatggtctttttgggaggcagtcgggtaccaccgcaggctactcctactctgcgggaaacaaaaacaaggctgtggtctgggaggagaacactttgtatgactacttgcttaaccctaagaagtacattcctggaactaagatggtcttccctgggctcaagaagccacaggagcgtgctgatctcattgcgtacctgaaggaagcaactgcatagtgcaatgacatgtctttgccatgaagagagaaattcgtttttgcagtttaataaagacattctagacaatttgggtcactctgtttgaacagggtgcaatccacgtttcagtattttcgttcttatggtgtcggtattgaatgcctaggtgtttagctgtgcacaaaaaaacagttaaactttgacggctcctatttcaactgctggagaaatgccagtgccctatttttgaccaccaaattaaaaaaatggaaatctggatggaaatgcatccattttngaaaaganaaaaaaaaaaaaaaaaggcccctaa

SEQ ID NO: 12086 - DNA, 997 bp, Sorghum bicolor
  Clone ID: SORBI-28MAY03-CLUS9184_1
cccacgcgtccgcccacgcgtccgctcgtctctttttcttcgccccgcccgaagccgaggaggagagggagaggggagcagcgagatcgcgcgcgcctccgagatctccacgaaggtgtggcaatatggggctcagcttcacgaagctctttagccggctctttgccaagaaagagatgaggatccttatggtcggtctcgatgcagctggtaagaccaccatcctctacaagctcaagctcggagagatcgtgaccaccatccctacaatcgggtttaatgtggagactgttgaatacaagaacattagcttcactgtctgggatgtcgggggtcaggacaagatcaggccattgtggaggcactatttccagaacacccaaggccttatctttgttgttgatagcaatgacagagatcgtgttgttgaggcaagggatgagctccacaggatgctgaacgaggatgagttgagggatgctgtcttgctcgtttttgctaacaagcaagatctgccaaatgcaatgaatgctgctgagatcaccgataagcttggtctccattccttgcgccaacgccactggtatatccagagcacttgtgctactacaggagaaggtttgtacgagggtcttgactggctctccagcaacattgcaaacaaggcctgattggacgattctgcggtttcatggagcacatggcgaggcattttctgcagaaacggagccatggtcattttgacctgacctgtttgtttcgctgaaatttggctgatgttgctgcttatgctgatttgttgagaagagaaaaatatttgttgtttcattgaaatgttaagtattgtatttctttgctaggcttttcagagagctggtttgttatgttgcgtgattactctctaaaaacctgttccgatatcaagactgtaattggccattggcactagtagatcgtttatactgagtaatgcagtttaaaatattaatgcatccca

SEQ ID NO: 12087 - DNA, 1308 bp, Sorghum bicolor
  Clone ID: SORBI-28MAY03-CLUS914_1
aacgtgcaatggaacgaagacagagaggagaggagaggagaggaggtcccccgccgccgcgccgcgccgcgccgctcgaaatccccaaacgcccaaacccctaggcaagatcaaatcagatcagatctctccacccccacccccacgccaatccccagccgaaagcccatccatggcgatcgtctacgccctggtcgctcggggcacggtggttctggccgagttcgccgccgtctcaggcaacgccggcgccgtggcccgccggatcctcgagaagctgccgcccgacgccgagtccaggctgtgctttgcgcaggaccggtacatcttccacgtcctccggtctgacgccgccggcatcaccttcctctgtatggccaacgacaccttcggaagaagaatcccctttctctacctggaggacatccaaatgaggttcatgaaaaactacggcagagtcgcccactctgcgctggcttacgccatgaacgatgaattctccagggtgctccatcagcaaatggagttcttctccagcaacccaagtgctgacacactcaaccgtctccgcggagaagtcagtgagatacacaccgtcatggtcgacaacattgagaaaattcttgacagaggcgaccgcatctcgctccttgtggacaagacatccaccatgcaggacagctcctttcacttccgcaagcaatccaagaggctccgcagagctctttggatgaagaatgccaagcttctagttgtgttgacagttgtcatagtagtgctgctctacttgatcatttctgctttctgtggaggcctttccttatcatcatgcagatcatgaataacacaccagatggttggccttcccttgactggaaggtaaaataccatggaatgatgcctgctatgttgagcacctgagcttccggaggcagaaaagatcgatcaatgttttgaggaggatacctccactgtggtttccagtttgcccttttgtggtgacatgagttagtcgtgcaacactgggatcagcgtgtacagtacgtggattgttgttcaaggagtggagttggcagttgctgtggtcaattggtttttatgtccccatgtgttgtgggtgaatcttaaaatcttggtgtacttattatctttttgggcctatcaaactgtcattgtgctttgtggggaatggaaatgagttgctgtgtagagttacttggttaatgtgcaaacatatatgtatgctgcaatgagtgttacatacttattatggttagcagtgtatgacaattacactcgggaatggat

SEQ ID NO: 12088 - DNA, 1000 bp, Sorghum bicolor
  Clone ID: SORBI-28MAY03-CLUS10657_1
gcacgaggccgctgcgaaggcgaacgaagcaaggctctccggatcgtctcgtcaagatgcagatcttcgtgaagactctcactggcaagaccatcaccctcgaggttgagtcctcggatacaattgacaatgtcaaggcaaagatccaggacaaggagggaatcccgccggatcagcagcgcctgatctttgctggcaagcagctcgaggatgggcggacgctcgctgactataacatccagaaggagtccaccctccaccttgtgctcaggctcaggggtggcatgcagatctttgtgaagaccctcactggaaagaccatcacattggaggtcgagtcctcagacactatagacaacgtgaaggccaagattcaagacaaggagggcattccaccagaccagcagcgcctcatctttgctggaaagcaacttgaggatggccgcactcttgctgactacaacattcagaaggagtccaccctccacttggtgctccgcctccgtggtggtatgcagatttttgtgaagacgctgactggcaagaccatcaccctggaggtcgagtcttctgacacgattgacaatgtgaaggcaaagatccaggataaggagggcatcccgccggaccagcagcgcctgatctttgctggtaagcagcttgaggacggccgcaccctggcggattacaacatccagaaggactctacacttcacctggttctgcgcctccgtggtggccagtaaaggtctgggtggtttggggtactgagtggtttggggtactgagtttagtttgtcgcgtctcatatgttgtccaagttactgagttcagtttggcgtggccgaggtgaggtcgagtcgatctgttgtcgaagtttctgatatgatcgagttgcatagtgttctgcaaaacatattctgcttgctgtagcagcttgattgttgtaatggttaagtgaacatggtttctgtcttggcatacagaatttgtttctgtt

SEQ ID NO: 12089 - DNA, 790 bp, Sorghum bicolor
  Clone ID: SORBI-28MAY03-CLUS10705_1
gcacgaggttcgccaccatccctcccctcgtcaatcaggttgagatcaacccagtgtggcagcagcataagctgagggagttctgccgggagaaaggcatccagctatgcgcctactcgcccctgggcgccaagggcacgcactggggcagcgactcggtgatggactctggtgtcctgcacgagatcgccaagtccaagggcaaaaccgtggcacaggtgtgcctgaggtgggtgtacgagcagggcgactgcctgatcgtgaagagcttcgacgaagggcggatgaaggagaacctggacatcgtgggctgggagctgacggaggaggagaggcagcgcatcagcaagatcccccagaggaagatcaaccagggccgccgctacgtctccgagcacgggccctacaagtccctcgaggagctctgggacggcgagatataagtcaacgtccgttctgcctgcaggctagctgcgccatgcatgacgacggaccgagaggagcggagctccccgtcatcacaagtcacaaggagtggctcgttcgtgctcaataatggtctttttaattatgtcctttccatctgcaacaaaaatgatgatgctcagctgtgcgtgaaataaactaaaaggatttcgggttagtgtaaccaccctagcgccaggaaaattaaaccgaccgaactagcaatagctagcacaaggcacacgaaacctgtagttgtccctctcgaagaaccgaatgccgcaaaaaaaaaaaaagtgcgctcgcacttgcgacctgcggcttc

SEQ ID NO: 12090 - DNA, 851 bp, Sorghum bicolor
  Clone ID: SORBI-28MAY03-CLUS10897_1
gccggccgggccgggaggcttgctctagctctctttcggggccacctgctgctggtggaggcaatggttcatgggaggctttcccttcaaatggtggcaacgaggtgacttcggcatggcagaatcctgcagctgaacctgggaaggctgattgggagcttgcccttgtagagacagcaagcaatttgtccaagcaaaagccagcaatgtcaggtggtatggacccgctgctgctgaatggtatgtatgaccagggtgttgtgcgccagcatgtcagtgcacaggtgaccaccgggagtgccagcagcgtcgccctacctgctcctggacagaagactcagatgcttgctctgcctgcaccggatggttcaatgcaggctgttggtggtgacccctttgccgcgtcccttgctgtcccaccaccgtcctatgtgcagatggcagatttggagaagaagcaacaactcttgacgcaggaacaagttatgtggcagcagtaccagagggacggcatgcaagggcaatcgagccttaacaagctcgaccgggcttacaacaatggttttgcccccaacccggccatgccttatgggatgcccacagcatacaacacgaaccccatgccaatggcttacacagggaacactgggtattactaccctacttactgaggaagcctattctttgttcatccttacagttgctgtgaatttttgttctgtgttgtgatcttactcccagccctggggttgtgtccagcatcagctgttgttcccctgtctctggatcaaaccttttggtctgatatatgtaatgtaattttatttgtttggaaaccaaatgaaaaaaaa

SEQ ID NO: 12091 - DNA, 617 bp, Sorghum bicolor
  Clone ID: SORBI-28MAY03-CLUS108013_1
ctcgatcggccgcgcgcggcacgtcggcctgcagctagctcgatcggccgcgcgcggcatgtcggcaacagccaccaacgccgtgtcccagcagaaggacgctgcggataagaagccggcgcaggagacggtgacgaagacggtgcagacggtggaggtgcggtcgtcggcggggcagcccgacgaggaaggcgtgctcaagcccgtcaaggtggtgcacgagatccctgcgaaggaggccaaggacaactccggcgtcaagcaggactaacggaggagtagctagctcgctactctagatcacgcttcgtgattgatgctcctcctgctgctaagctgcggatgttgctgcggtagctatgtgcaaagatctttccacttccacccgtactagatcctatagtaattaattgctggagagtgccgtcatcacatatggaaatgcagaataaactagtgtcgtgttggtgagcagactttatattgcgtgatccatcgggtttctatgatttacaacaaaagatagcaacctacatcaagaggtgctacatgacgagatcaccataaatacaaactatgccaaactgatcggcattagaagttgttgggtgaaaaaa

SEQ ID NO: 12092 - DNA, 1002 bp, Sorghum bicolor
  Clone ID: SORBI-28MAY03-CLUS10681_1
gcgaacaatggccctggagacgtgcttcagagcgtgggcgctgcacgccgcccctgccgctggtggcaaggacagcaggctcctcggcgtcggcagcagcagcggcagcggcagtaacctggttctgccgtcgcacgagggccgatcacagacagacaccgccttcttccgattgcgtttggcaaaagcggggaaaaaaaaaaaagtcggcgcgtgccctgcctctccctcctcgtcgtcaagtcgtcacccacctcctctcatattgtggtctggtgtggattggagatctgctcggacttggactgagttccccttccgttggacattcattgaggcagcatgcctaagataaaaacaagccgtgtcaagtatcctgaaggatgggagcttattgaaccaacaatccgtgagttggatgccaatatgagagaagctgaaaatgatccacatgatgggaagagaaagtgtgaagctctctggcctattttccgtatttctcatcaaaggagccgctacatatatgacctttactacagaaggaaggagatatcacaggagctttatgagttttgcctcgaccagggttatgcagaccgtaacctgattgcaaagtggaaaaagccaggttacgagcgcctttgctgccttcggtgcatacagacacgtgaccacaactttgcaacgacctgtgtctgccgggtccccaagcatctgagggaggagcaggtgatagaatgtgtccattgcggctgcaggggttgtgccagcggtgactaatcttgtcatcatgttgttgggctcacgaactcatcatcgcaacctaaccacatgagatgtcccgtgagcatggattggctgcggtgattagcatgaatgtattgtggtaactagtggcgaagactaaatttcctgacgtttggatgtttccaactgttatgtactatgacgatttctcatgcaacaaatgcttatgttaagttaaattagttagcgctttgc

SEQ ID NO: 12093 - DNA, 747 bp, Sorghum bicolor
  unsure (1)..(747): unsure at all n locations
  Clone ID: SORBI-28MAY03-CLUS10991_1
ttcaaggatcatgtctgcaagacatccatactggatgactttggcttttatgataatcgtgagaagttgatgcaagagaggaaagcaaagcagcagcagtcactgaaaaaggtcatcgatgtgaagctgcctaactctactgacacagagaaaagtctcaaaggagagactggatcaacagaactcactgaggctgatgtcttgaacaaagagctttcattagacaaagcaggagagaaaaatggcgagaaaggaaatgatgtcgctccacaggacctgaaatcaccaactgagaagttggcaggtccaaatggctgttgattttttatttttttgttagccattgacagtggtgtgggggtggaacctaaggctgtgtgggttgtttgaggaaattctgagatcccattaagcgtgtttcttgtccctgtttcctatagttcataggagctagaggatagctagttggttgtgtttggtgataggtatggtctgttctggcgtgtcaggaatttaggaatagaaggatgattaactgggttttccaatgatggatggatcatcggtttgagggtgtattttcatttatctgcctcttttttctctctgaattctagttcgtccctctctatattctggtgtagtgcttatttaatgttggctggtttaagaacctgaaatgaacatgggaattcaatcaagcatttacaaacttcttttccttggtatattatgtgtttatatgtn

SEQ ID NO: 12094 - DNA, 828 bp, Sorghum bicolor
  unsure (1)..(828): unsure at all n locations
  Clone ID: SORBI-28MAY03-CLUS9685_1
gcccttctccctcccgtgctcactgctcgtgctcgcggtcgcgttcgctgtcgcagcgctggggctgagccgcgagtggagtggataaaccctagccggggtggcgtagctgggtttggtggtggctttggcgtcggcgacggcccgctgttctccggaatggtgtgggaggtgacgaaggctaccatgtgctcaaactacaccacaattggattataggatagtcacgtacagctaccagtttcctagaatcaaattgttgatagcggagaggagtgactggattttgttcaatactttcacctcgatcatgggtggtgtctgctcaaggaagagaagccaattggtggatgaaggtgactctctccagacatccccaaggttctcaaagaccagcagcttaaaatggttgttgcttacactgccccgcagcaattctgatgtctctgggaaggggcaggggaatgaacctggacggtgcccgtccctcatggagctctgtgtcgctagaatctgccaggatatcggcaagtattctacttttgcaatgctgccgagggatctcagccagcagattttcaatgaattggtaaattcaaaccgtcttatggaggcatcgcttcaagttttcagggattgtgctctgcaggacattggcttaggggagtaccctggagtaaaggatgcttggatggaagtagtggcatctcaaaggcagtcattgttgtcggttgatatttcttgctctgaagtaactgatagtgngatagatcttcttagagattgctcaagcatgcaaaagcttgcatgtaattactggatcaaata

SEQ ID NO: 12095 - DNA, 936 bp, Sorghum bicolor
  unsure (1)..(936): unsure at all n locations
  Clone ID: SORBI-28MAY03-CLUS9584_1
gctcgtccccccccgccatccgccgtcaaaacatacaggagagagagaacggaggagcaccacgcagctgccggccaggagacctgcgcgtcacagcagcggcctcgggtggggcgcgcatgcgtaagccgaccggccggcaactgcggcaagcggtggcggcccacagcctgcgcgcggctcgcgcgtccggtcggcgtgcggggacggggagcgatctaatcccttaaaccatattgaacatgtcttgaactgcttgttgacttatagatctctagttgaggagcgtcttgttaagatttgctccggtccttaagcgcggatgttgacttgtagtgttctctagtaagcattggcccaagtatatgctggggttttcaccttaggtcctctatctatgcgtttctgtgatttccgttaagcgtactggtatttttctggtggtgcgctgtgtctggaagtttgacaccttcaacatcatatattagtgcttaagtttaaaattttaacagataatataattcgaggtactctgttaatttgattttaggttgatttgctttagattcttgggtcggttgcttacattttatctcaactcactgtcctgtagctaaaaattggaactaactgatatatgatggtttgaaagtagcaataggactctgaatgtgctggtgatcctgcattctgcaaagagttccttaaatttacacagagagtgcgggttgtgcagttgtcaaacttcaaggatgattccagcccaattggtctgtatttcttcaatttaagttagcctgctgttttatttgactctttaatttgtgttagcccaattaatttgtgttgtaacttggaaaaattactctttaagctttgattggtacaataataactttattgtgtcacgaacattctnttgactctttactatgc

SEQ ID NO: 12096 - DNA, 1220 bp, Sorghum bicolor
  Clone ID: SORBI-28MAY03-CLUS9718_1
gcacgaggcacggagaaacgccagatgcgtcagggcacgaatcctaaagcgtatccaagccgtgcagtttgtggggggcacagctgcactgacctggaggctcctctcatctctcggcacgaggacacacttggccggccctctctacctctgcaataccaacgctgtcgaccccaagcgccgccgccgccagcgcccgaccccaggacccaacaccgcgccgccgcgacgctcgacttcagcgccgcgccgcccacggccgctgtgtggcgccactccaggtccagcgccgcgccccccagccgctgcggcgctgcgtccgcagctcccggctcggcggcgcctcttcgttgatggattgttccacccggttcctcatcggaaacccgtcgccggctgcctcccacttttccggcgagaggcggagtccagcggacagggtatttctccggaccatggcgtcggcggccccggtggaggagcccacggcggcagccagagcgaaggggcggccgaccggtgactccttcatccggcgccacctcaggaccctcgccccgtatcagcccatccttcctttcgaggtgttatcagctcggcttgggcgtagaccagaggacataatcaagttggatgcaaatgagaatccatatggtccacccccggaggtcgctgcagcgttaggtagcctcaagtttccctatgtgtaccctgatcctgaaagccgccacttgcgtgctgctcttgctgaagattctggacttgaatctgagtacatacttgctggatgtggtgcagatgagctaattgatttaattatgagatgtgtgctcgaaccaggtgacaaaattgttgattgccctccaacattcacaatgtatgagtttgatgcttcagtcaatggtgcacttgttatcaaggttccaagactgcctgatttttccctagacgttgatcgtattgtcgaagttgttgaacaggaaaagccaaaatgcatattcctgacatccccaaataatccagacggcagtgtaataaacgatgaggatcttttaaagatactggatcttccgatacttgtagtgctggatgaagcttatattgagttttcaatcctaaagtcaaagatggcatgggttaagaagcattgataattgattattctccgaacatttagcaaacgagcaggtttggctggtcttcgtgtgggttatggtgca

SEQ ID NO: 12097 - DNA, 796 bp, Sorghum bicolor
  Clone ID: SORBI-28MAY03-CLUS97154_1
gcacgaggcagctacgtctactaatggagctcattgggacaccgaatgaggctgatcttgattttgtaaatgagaatgcaagaagatatatccgccaacttccccggcatgctagacagtcctttcctgaaaaatttccacatgttcaacctttagcaattgacctggtggaaaagatgctgacttttgatcctagacagagaataactgttgaaggcgcacttgcacacccttacttggcatcacttcatgacataagtgatgagccagtctgctcaatgcccttcagctttgactttgagcagcatgcattgtctgaagaacaaatgaaggatctgatctaccaagaggctcttgcattcaaccctgattaccagtagccgaagttcaatttcagccggtgattggcttcattgacatggagattttttttccccacctgatgtcagtgcaaaaagtcaccaactccgattgctagctgtaaataattgccttaccagaagatcctccattcctccttgattaaaaaagctggagacgtgtcattcaagggtagaaaagagcgagcatgtgaaagtcaaatttctgcgtagctatggattcttgtgcttacaatatgttgtttttaatcagactttacttttcttcttaaaaacttttcgatgttgtctgtaagagaggtagttcatgaacgatggctgcctgaattcagtggctgtcgtcaaagttaacatttctggtcgacttaagaattcttgtttatcgacttaattgtttaaaaaagacctgtaatccc

SEQ ID NO: 12098 - DNA, 1052 bp, Sorghum bicolor
  Clone ID: SORBI-28MAY03-CLUS99535_1
gcacgaggccgtctttgccctcccgctatcgctcgcctgcgttgcgttgcgttgcgttgctcggcgtacgtacgtgtacacacagcgcgagcccgagagggaggaagagcaacagaggaaagaaaaaaaaaagaaaagaaaggaaagccaagtcgtttgctcatttcatggagagctcttctcacaagcgggcgcgggaggtggtggacctcaccgccgccgggcccggagaggcagccgcgttgccggaggcggacgcgaagaggctgcggccgcaggatctcctggacatgctcgatgacgacaccgacgcggccgccgccggcgacctagcgtccgtcatgaggagcctggaggaggagatagctagcttcgacgaggccgtgggggccgcggaagcggcgcctacgcagcagcagcagcagccggagctggggttcctgctggaggcctcggacgacgagctggggctgccaccggctggcgcctccgcctcgtcgtcggaggaggccggcggcggcggcgggggcctcgccggggcgccgccggagtccgccgagctggacggcggccagatctggggcttcgaggacgagatagacggtggagcgggcttcggtggctactcgccggaggcggccgccgcggccgtcgccgccgcggcggcgtgggacgacgacggcttcgacgccggcctgttcgcgttcggcgaaagcgacgcgtacgggccgtcggatctcgccgcgctgcgccacgagaccatgccggccgtctgatgaccggccggggcagacacaacagccgcagccagtggtggattagccttgtttttcttgctttttttgttttaccttttggttggctaaccttagcgggcaggggggcaccctttttttaacctgaatgtaaagtttttttagaagggtaaaacaggggcgtggaaacttggggaaggttctcagctagcagggaaaaaagaatctgaaaatggttttccctcaatttgcccttcgaatttatttctcgcttattagtaaaaggaaaaagcaaat

SEQ ID NO: 12099 - DNA, 1197 bp, Sorghum bicolor
  Clone ID: SORBI-28MAY03-CLUS11301_1
ggcctggcggcggcgccggcgctgctgatgacgctggccgggctgttcctcccggaggcacccaacagcctcatcgagcgcgggcgcgtggaggagggccggcgcgtgctggagcgcatccggggcaccgccgacgtggacgccgagttcacggacatggtggaggcgagcgagctggccaacaccatcgagcacccgttccggaacatcttggagccccgcaaccggccgcagctggtgatggccgtgtgcatgccggcgttccagatcctgacggggatcaactccatcctcttctacgcgccggtgctgttccagagcatgggcttcggcagcaacgcgtccctctactcctccgtgctcaccggcgccgtgctcttctcctcgacgctcatctccatcggcaccgtcgaccgcctcggccgccggaagctcctcatcagcggcgggatccagatgatcgtctgtcaggtgatcgtggcggtgatcctgggcgccaagttcggggcggacaagcagctgtcgcggagctactcgatcgcggtggtggtggtgatctgcctgttcgtgctggcgttcgggtggtcgtggggcccgctggggtggacggtgccgagcgagatcttcccgctggagacgcggtcggcggggcagagcatcacggtggccgtgaacctgctcttcaccttcgccatcgcgcaggcgttcctgtcgctgctgtgcgccttcaagttcggcatcttcctcttcttcgccgggtggatcaccgtcatgaccgtcttcgtctgcgtcttcctgccggagaccaagggcgtgcccatcgaggagatggtgctgctctggcggaagcactggttctggaagaaggtcatgccggcggacatgccgctcgaggatggctggggcgccgcacctgccaccaacaatcacaagtgaagacagcatgcgtgcttgctttcgtggacattattacagtataaccaaagaaaacgaggcacacacactgacatgtactcctaggcggatgcttattcatattgtaatctgtatgtaagcaggttgtgtggtgatacgcgaatgagacgttcggtttgtgcgtgcttgttctttacttttttttaacaatatataaattagacacacataacctatacactcctctctcgtcacaccacatgcgtctgttttccccctttc

SEQ ID NO: 12100 - DNA, 1545 bp, Sorghum bicolor
  Clone ID: SORBI-28MAY03-CLUS1153_1
gcacgagggccttctgagtgtaacgtctggtgcaaatcctgtgtcacttaagaagggaatcgacaaaactgtgcagggtctaattcaggagcttgagaataaggctagaccagtcaagggtggtggtgatatcaaagctgttgcatctatctctgctggcaatgatgaatttatcggatccatgattgctgaagcaattgacaaagtcgggcctgatggtgttctttcaattgaatcctcctcatcttttgagactactgttgaagttgaagaaggaatggagattgaccgtggttatatttctccacaatttgtgacaaaccttgagaaatctattgtggagtttgagaatgctaaggttctcattactgatcagaagatctcaagcataaaggaaattcttccaattctggagaagaccacacagctgagagcccctttgttcattattgctgaggacattactggtgaagctttggcaactcttgttgttaacaagcttcgaggaattctaaatgttgcagcaattaaggctccaagctttggtgagcggcggaaggctgtacttcaggacattgccattgtcacaggtgctgagttcctagcaaaagatcttggtttgttggttgaaaatgctacagaggcacaacttggtacagcaaggaaagtcacaatacatcagactacaacaaccctcatagcagatgcagccagtaaagatgaaatccaagcgagggttgcacagctaaagaaggagcttgctgagactgattcagtttatgatactgagaaattggctgagagaattgctaagcttgctggtggtgttgctgttatcaaggttggagccgcaactgagactgagcttgaggaccgccagctaagaattgaggatgcaaaaaatgccacttttgcagctatagaggagggcattgttcctggaggtggtacggcatacgtgcacctatctaccattgtcccttcgatcaaagaaaaaattgaggaccctgatgagcgccttggtgctgatattattcaaaaggcattggtagcacctgcttcattgattgcacacaatgctggagtagagggtgaagtggttgttgagaagatcaaggacagtgtgtgggaggtgggctacaatgcaatgacggatacatacgagaacctgattgaggctggtgtgatcgaccctgctaaggtgactaggtgtgcgctccaaaatgcggcctcagtagctggaatggtcctaaccacacaggcaatagttgttgaaaagccaaagccgaagcctcaagtggcagagccatcagagggaagccttgccgtgtaaattttaacattcttgaggcagctgtctagacggttgagatcagttgaaagggtagaactttggtttgagaattttgattcaggtccactgaaaggtgtagagtaggattgccattttgcagatgaagagtaattttaatctggtctgaacttgtccaaatcagagaaatttgcatcaccatttttcaaagagagatttacttatatggcgct

SEQ ID NO: 12101 - DNA, 978 bp, Sorghum bicolor
  Clone ID: SORBI-28MAY03-CLUS12_1
gccggccgggcctggtatcacgtctcttcgacagccgcaaacctctctccctcgtctggtatcgtctctcccacacccaaaaaaaaccctcgaaaagcggcggcggcgcgacatggcggaggtcgaggttccagctgctgcggtcgcgacgacgatccctgaggcggcggaggctaccgagggcggagccgctgcggaggcgaagggtccgcacaagctgcacaggcagtggaccttctggtacgacatccagtcgaagcccaagcccggcgctgcgtggggcacctccctcaaaaaggcctacaccttcgacaccgtcgaggagttttggagcttgtatgatcagatttttcgtccaagcaagttgtctgggaatgctgattttcatctgttcaaggctggagtagagccaaaatgggaagacccagagtgtgcaaatggtggcaaatggactgtcccatgcaacagaaaggcaacctttgagaacatgtggcttgaaacgttgatggctcttattggggagcagtttgatgaaacagaggacatttgtggaattgttgctagtgtccgtgcaagaggagataagctcgcattatggactaggactgccagcaacgaagctgtccaggtgaacattggcaagaaatggaaggatgtcatcgactacaatgacaagatcacctacactttccatgacgactccagaagagagaagccgagcaggggcggacggtacaccgtgtaagctgcacatcaacaaggttgcttggactggatagcgggcggagtggaattttctgctgagatcagcaccaactttcatttgataagccttggcttacctgaggcaattttcgcacctattgtgatgttattttgctttcagatagcttatgtagtacaagaaagagaggttggagacattgacgattttgtatgcaactgaatttctatctgaatctgccccgattcaactgc

SEQ ID NO: 12102 - DNA, 1035 bp, Sorghum bicolor
  unsure (1)..(1035): unsure at all n locations
  Clone ID: SORBI-28MAY03-CLUS11508_1
gcacgaggccctagcttcaccgcgccggggccgcgcggtgcgggcgcttatctaatctactttcttcgcctcatcacgagcacccgccggcaggaggacacaacaaaccaaccacaaggcagcaagcagacagacgggcagcgagggcaacccgagagcgggctaccggaggaagcgtgagcgatcagcaatgggcaacttcatctcgagcttagtgacgccccctccggccgccgacgacccgaactgcgccgtggtggccgcccactccaagaccacctacgacgagcagtgggcggcccacaagaacgggggcaagctgatggtgatcgacttctcggcgtcctggtgcgggccctgccgcttcatcgagccagccttcaaggaactggcctcccgcttcaccgacgccatcttcgtcaagatcgatgtcgacgagctcgcggaggtcgcaaggacatggaaggtagaggcgatgccaacgttcgtactagtgaaggatgggaaggaggtaagccgtgtgatcggggccaagaaggacgagcttgagaggaagatccagatgttcatcatgtcatcttcctcatcctaacttagcagtgcatacaatcccatcttgtaactggtttctcgactccagtggttcgcttgggccggggttgctgaaatggttccctttgaatgctggaaaaaaaaaaactatgtgaaaatgatggtagacgtgcctgggtcaataagagtttctgaaacttgggtgtgaatgtgttagtttgcgtgttcagtttgcaaggaatggatcatgtgagttgctgcatggtttcagaaatggaacagagctggagattatgttgtatgttgtgctggtagtttctgctccccggaacaccgggcatcgtgattttgatgagttttgaacaacttccatgtgtgtgggtttaattttacgagggcttatttagatgttgtcggattctagttcacacatgtatatgaattagagtggaatttcaaataaatttcnaccccaattgactc

SEQ ID NO: 12103 - DNA, 387 bp, Sorghum bicolor
  Clone ID: LIB3480-027-P1-K1-B11
ctagttctagatcgcgagcgccgccctttttttttttttttaacacattcacacccaagtttcagaaactcttattgacccaggcacgtctaccatcattttcacatagtttttttttccagcattcaaagggaaccatttcagcaaccccggcccaagcgaaccactggagtcgagaaaccagttacaagatgggattgtatgcactgctaagttaggatgaggaagatgacatgatgaacatctggatcttcctctcaagctcgtccttcttggccccgatcacacggcttacctccttcccatccttcactagtacgaagttggcatcgcctctaccttccatgtcttgcgacctccgcgagctcgtcgacatcgatcttgacg

SEQ ID NO: 12104 - DNA, 1325 bp, Sorghum bicolor
  Clone ID: SORBI-28MAY03-CLUS12065_1
gcacgagggttgagacttctgtatccactcctaaagaatccacacctgttaaagaactagatagagaaaggaataaatccagggtaaagaggattgagaggaaggtgcgatcactcactccaacatctgaggagcttgcatctcttgatctcagagagggaaggaacgtggtaacatttactttctcaactgcaattgttgggaaacagcaggttgattgccacatatatttatggaaatggaatacacgcattgtaatatctgatgttgatggaactgcacgagggtctgatgttcttgggcagttcatgccactagttggagttgattggtcccaaaatggagttgctcatttgttttctgcaataaaggaaaatggatatcagcttctatttctgagtgcacgcgctatttcacaagcccacattacaagacagtttcttttcaacctaaagcaggacggcaaagcacttcctgatggccctgttgttatatctccagatggtctcttcccgtcactttacagagaagtcatcagaagagctccacatgaattcaagatttcatgtttagaggctatcaaaaatttatttccacatgactcaaatccattttatgctggatttggaaatagagatacagatgagattagctacctcaaggttggtattcctatgggcaagatcttcataataaaccccaagggtgaagttgcagtgaatcgacgggttgatacaaagtcatacacatccttgcatgctcttgtccatgggatgttcccgccaatatcgtcatcgtctgagcaggaggactacaatgcttggaattactggaagatgccactgcctgatgtcgatttgtgaggtacaagtcaagtctgcacaacaaacagcactgcagtaattttttgatgcgctgtagtgatcatgagaaggcagccatggtgaaggtagcgcaccctgaggccaattgttggttggctacatgtggatgctcctgatacaagctcctgcaagattgaaattgtatatataggatcataatagatgactcacggtctgtatgctgatgaggcggcaggagcaatgtagctatttcttgtgactcctgttgtcgttgtcgttgttgtcctaggactggaaatcatacctccatgtcctgtaagtgaaggtatataaattactgaatggagggatctgatagtggagtacatgttgcaaacccccctggcccttttcgattcatccttgatgtaattgtggtactgatgtaatttgtacaagagcaatttcaataatgcaatagaaagtcagctgttcatatgc

SEQ ID NO: 12105 - DNA, 636 bp, Sorghum bicolor
  Clone ID: SORBI-28MAY03-CLUS12073_1
tggcaaatgaccgtatcacgagataagatgagctgatgcagacacataaccaaacttctttttttttttttttttgagtcaaaggatagagtgatagagcttgaaggtttggacagcagcaacagccaacagaaatgcaagcttgaagaaagaaagaaaacgctgcttttattctccccgtacgtactacgcaccagaacctcgtcgcacaaaaacaaggcggcgaaatcaatcgcgcgatcacacagcgtctccacaagacgaacgtaatcccgatggggatccatcgatcacataattagggggggcatgggtcacacaggcaggatcagagcgccgtcacggacacggtggcctcatcagcctcggcctcgccggccggcgagcgtgtctgtgtctccgtctcctgccgctgccgccgcttcgtcgtcgtctcgctctcgcactcgtcgacgacggcgtacaggcggtacggcgacgcgtcggtggcgagccactgctcgacggtgaagagcgtctgcgcgcagcccaggtgtggcccggtcaccgtcacctcgaggtagttgcagtaccagccgtggtgcgcgccggagccgtcggaggtgagcctcgtgccgcaggggcgctggctcatgc

SEQ ID NO: 12106 - DNA, 1026 bp, Sorghum bicolor
  Clone ID: SORBI-28MAY03-CLUS10433_1
gcacgaggcagaaagaaaatataaacagagctgtgaagaagttttctgacaattttgctattctgttattccactatgatggtcgggtgagtgagtgggatgaattcgagtggtcccagcgagctatccatattagtgtcaggaaacaaactaaatggtggtatgccaaaagattcctgcatcctgatattgtggcagcttatgagtacatattcatctgggatgaagaccttggggttgaccattttaatgcagaggagtacatcaaacttgttaagaagcataatttggctatctctcaacctggattagagcctgatcggggtttaacatggcagatgaccaaaagaagaggcgacagtgaggttcacaaggacacagaggagaggccaggatggtgctctgaccctcatcttccaccttgtgctgcttttgttgaaataatggctccagtcttctcaagagatgcatggagatgtgtgtggcatatgattcagaatgacttggttcatggttggggcttggattttgctctcaggaaatgcgtggagcctgctcatgaaaagattggagttgttgattcacagtggatcgttcaccaagtggttccttctctggggaaccaggggcagtcagaaaacggaagagcgccatgggaaggggtgagagcgcggtgcagaaaggagtggggcatgttccagacgaggatggcggaggcagagaaggcgtattacaagatgatgggcatcacccctccaaactccacgcttgcctagccgcctcttttcttggttttccatccccgccccctgctgaccttttgcggtggtgggtgagctgatgatactgtagcactatacttgattatagggagttagagacggtgggtgcgtgtagctgcttatgatgagtgagaggtccttctgtaagtaaatgcgacgtgaaactgtgatgaaaaaacatgtacacgaggatgttacctgatgatctatctatacatctataatgttgcctcgtttggtgttt

SEQ ID NO: 12107 - DNA, 897 bp, Sorghum bicolor
  Clone ID: SORBI-28MAY03-CLUS105305_1
gcacgaggctctcctttccttaatattcaccgtcgagtcatcaaagccgtcaactaattcagagaggctcggctggcccggtcgccctacgctactggcgcttccaaaggcgaagctctcgtctttggcgaccagcaaacggagggctaaaacctttcgttttgaagcaagggatgagcgcgcgagccgctccccctccctccccccccctcgcacgaggcacgagcacgcagtgcagcacagcttcctgctcacaccgccgtagtagtaataatccatcaccaatggctcccaaggctgctctcttccttgccctcggcctcctcttggctgcctccgcgcacggctgcgaaccctcttgctcaggccccgtcgtcccgacaccgccggtcgtgccaacgccgccgacccacagccatggtgggcgctgcccgatcgacgcgctcaagctcagcgtgtgcgccaacgtgctgggcctcgtcaaggtcggcttgcccccgcagcaggaatgctgcccgctgctggaggggctggtggacctcgacgccgcattgtgcctctgcactgccatcaaggccaatgtcctcggcatccacctcaacgtgcccgttagcctgagtctcatcctcaataactgcggcaagatttgcccggaggacttcacttgctactaactaattataagctgatgagctgatggacgctccatctcgcgattccggccggttgttacttgatcatcatcggttccaatggccgacatgttgggctgttgcacgatagaataagtttgttacaaattctttttccctgtaccattattattccttgtattgatgatgtggatttatatttccatttttaattatcaataagaatattcatgtttttattttg

SEQ ID NO: 12108 - DNA, 920 bp, Sorghum bicolor
  Clone ID: SORBI-28MAY03-CLUS10537_1
gcacgagggtggaaagggagggcatgctgcacttcctcatcacactatagatccgatattggctgcctcaaatgttattgtgagccttcagcaacttgtttcccgagaagctgatcccttggactcacaggttgtaacagttggaaagtttcaaggaggtggagccttcaatgtgatccctgattcagttactataggcggcaccttccgagcctttctgaaagagagttttaatcaattgaagcagcgaattgaagaggtgattgtgtctcaagcatccgtgcagcgctgcagtgctagcgtggacttcctcacaaaggaccgtccattcttccccccaaccatcaacagccctgagctccatgatttcttcgtgaatgtggccagcgagatggttgggtcgaggaacgtgagggacagacaaccgctaatgggtgctgaggacttctcgttctatgccgaggcgatcccctcaacctactactactttgtgggcatgtacaatgagactcgtggaccgcaggcgccccatcactccccctacttcaccatcaacgaagatgccctcccctatggtgcagctgcacaagctgctttggcagctcgctatctactcgagcatcagcaacctgctgctaccactgataaggcaaaaccccatgatgaactgtagatacataacgtttgcttcgctctgttaatgaaattagattgagcaacaatttctttgccaagctattccacggctgtacatatcctgatatctccatgctttggtaataatcggttgctgatcaattgtgggatcaggcgttatttggcgtgatgttcagtcagcaaataatctgggaaacatatggtcttcgaatttgtagtattcttattgcaaaaaaaaaaaaaaaaagggcggcgttttaaga

SEQ ID NO: 12109 - DNA, 1082 bp, Sorghum bicolor
  Clone ID: SORBI-28MAY03-CLUS1062_1
gcacgaggctcagctcggcgcctctcgcaacccgagcgcggttagcccacgcaccgacccgacgcacgccaccgtctcccatcccgaatacctccggtgctcagcgtcatggacggcctctccaagaccatcggcggcggtggccctagcgttccggcgggatcccaccccgcgggcgggagccaggcggcggccggaggaggcgcgacgcagcggacgcagtacccgtatgtgactggtacttcagtcattgccttgaaatacaaggatggtgtgattatggcatgtgacactggagcctcctatggatcaactttgagatacaagagtgtggaacgcattaaggcagttggcaagcatagcatcattggagcaagtggagagtacagcgatttccaggagatcctgcgctatctggatgaactaactctgtctgatcatatgtgggatgatggaaactccctgggccccaaagagatccactcttatttgacaagagtgatgtacaacagacgcaacaagtttgatcctctctggaactcacttgtacttggtggagtgaaaaagggtccaaagggagatgagaagtatcttggcatggttaacatgattggcacccactttgaggaaaaccatgtggctactggatttggaaatcatctggcgatcccaatacttcgtgctgaatggcgcgaggatatgacttttgaagaagctgttaagctggttgagaagtgcttgctggtcttgctgtaccgtgacaggtcatctatcaacaaattccagattgccaagatcacaactgaaggatcaaccatctatccaccatactccttgaagacttactggggcttcactccctttgaaaacccaccccagggcgctgtggggtcatggtagatttatgttccgggcccgccccgaatcatgccatgaacttaggggaaaacaatctgtgctgctgaaattaaatcctttgtcgacgtttgttctgaacatccctggaactctgcatttgcttgtatgacatgcttatggttcagcgagtttaattccagggtttggtcgattgttgggaatgg

SEQ ID NO: 12110 - DNA, 727 bp, Sorghum bicolor
  Clone ID: SORBI-28MAY03-CLUS12581_1
gtgcctagctcgatatggcccagaaatacccttccaggaacgtcttctcctcaccttttttctcctctcctcgagaaccccaatccaaacctcccaaccgccaaaaatcctacgaaaatatagcacagaaatatcatcttggctcagatcgtgctcgaggtgatccagatctctactggttcatttccctcttgtcgtgacctgatcccgttacccattacctgttcttggattgcatcagtgaggaagccgtgagttttgaggggacaacgcgggatcatggcgtcgtcactggccgaggaggaggaggccttcgagcacacgctgctggtggtgcgcgaggtgtcagtgtacaagatcccgccccgcaccaccagcggcggctacaagtgcggcgagtggctgcagtcggacaagatctggtcgggccgcctccgcgtggtgtcctgcggtgaccgctgcgagatccggctcgaggacccggccacgggggagctcttcgccgcctgctttgtgctgccggggcagcgggagagcgccgtcgagaccgtgctcgactcctcccgctacttcgtgctccgcatcgaggacggcagggggaagcacgccttcgtcgggctcggctttaacgagcgcaacgaggcgttcgactttaacgtcgccctctccgaccacgagaagtacgtcaagagggagcaggagaaggagaccgccggcgctggcggcg

SEQ ID NO: 12111 - DNA, 767 bp, Sorghum bicolor
  Clone ID: SORBI-28MAY03-CLUS13114_1
gcacgaggaaataagctgttttgtgttactcatgtcgacatgggtcttgataccacggctgtccgggaggcggttatcaaagtcatggacaagaagggtttgcctataatgttattcagcactgatgaggcatcaaacaaagctgttatctatgctggtgtgcctcccaatgctcctaacggcttcaaggtgttggactggctaacaccttcaattgcaccactcaagggaagagggggtggcggcaagaacggcatcgcccagggccagggaagtgacgcttctcagctcaaggaagcaatggcacttgcgaacagcattgcttcaatgaagctcagctgattggtgataactggtgcactcccccatgggatcttatgcgtgggtgctgtggcttttagttttccatttacccaatgtacttaacataagttcaatggtgttcacagtttcatttttacttaccattaccatacaatcggaagcacagggcatgtaatgcaacagcacaaagcttgtccgatttgacgaaaggttctatagatgtacaagctggctttggtgtgccatcatttaaattccgcaactgccggagatgccttgaccaaattggggccgcgtgcatatatatgtacatgatacatgtctcgccttctcgacaattaatttgaatagtgtgatgtgcggatgtgctacccttgtaataatattttaatgggaagtatgattgaacttcgtgaggttaaacataatccttgaaggtatct

SEQ ID NO: 12112 - DNA, 1314 bp, Sorghum bicolor
  Clone ID: SORBI-28MAY03-CLUS13146_1
gcacgaggcccatcggctgcccgctccgccgtcgcgcgcctccccccctccccccctctcctcaaagaccgatccggtatccgataaaaagcgcgcaccggcgtggcgcgcttcctcccgagccccgatcatctccctcttcgtcatggctctgccgtccgccggctcgttcgcggcatgcagcctccagccaagggttagcattcgggcgtgccatgccccgaggccgccgccacacctgcagccgggtgcggctgcggcggtatcgtctgcgaggacgcggcagcagcgccgggcgaacgcgaccaagggtggagtgtccaccgtgtgcgagccgctgggccccgaccggccggtctggttccccggcaaacccgctccgccgtggctcgacggcagccttccaggagactttggatttgaccctctcggactaggttcggatccggagtcgctgcggtggttcgcgcaggcggagctgatgcacgggcggtgggcgatgctggcggcggcggggatcctgatcccggacctgctggcgcggtggggcttcatcgacgccggctactcgtggttcgacgccgggtcccgcgagtacttcgcggacccgtggacgctcttcatctcgcagatggcgctgatggggtgggcggagagccggcggtgggcggacatcctcaagcccggctgcgtcgacatcgagccgcgcttccccaaccgcaagaaccccgtcccggacgtcgggtaccccggcggcatttggttcgactgggccaactggggccgcgggtccccggagcccgtcatggtgctgcgcaccaaggagatcaagaacggccgcctcgccatgctcgccttcgtcggcttctggttccaggccgtgtacaccggccagggccccatcgacaacctcctcgcgcacctcgccgaccccggccactgcaacatcttctcggcgttcacgtcccactgatacgaccatgctgtttcggagttgaaggcttcagggagtgaagtaagccaagaaaaacaaaaggatctgttcttttttttttagaataattggagtacttcgcttgggccacgtacggtatcattttggccttggacatgtcgtttgtacctacatagaaatgttaaaccacttgtacaaacgtagtagaaatatataccagggatcgcgatgatactaaccagcacattttgtcctaaagctccaacacggtaccgtatatatagacggaatttattgacatggacaaaaaaaaaaaaaaaaaaaaaaaaaaaaaaaaaaaaaaaaaaaaaaaaaaaaaa

SEQ ID NO: 12113 - DNA, 992 bp, Sorghum bicolor
  Clone ID: SORBI-28MAY03-CLUS13190_1
gcacgaggtccccattattgctggaaaaaaaagaacacgatgaaaaatctaatccaagagacggggattccagagcgcccccgctcggctagggaagggaagggaaggagaggcgaagcggagcggaggcgagatgggggcggccgagtccgtgccggagacctccatacacgaattcaccgtcaaggattgcaacggcaaggaagtgagcctggagacctacaaggggaaggtcctccttgttgttaacgtcgcctccaaatgtgggttcaccgaggttaattacacgcagctgacggagctttatcggaagtacagggacaaagactttgagatattggcattcccctgcaatcagttcttgcgacaagagccaggttctaatcagcagataaaagactttgcttgcaccagatttaaagctgaatacccagtttttcagaaggtgcgtgtaaatggcccggacgccgcgccggtttacaagtttctgaaagctagcaagcctggtttgtttggatcagcaagagtcaaatggaattttaccaagtttctcgtggataaaaatgggaaggtcgttgagagatacggaacatcgacggctccaatgtcaattgagaaggacatccagaaggcccttgatgaggaataaagatcccatgtcctcttgtctcgtctcatccatcacccacactggcagaaataggcactcgcagaagtattccgtcgtagcaacatttgcttgtttgtagtaaatctgtataatgccctccttttcgccttcatgctcattgcgctcgtgtaagtattggttgtattaactagccattaatcttctccgtcttttttttttctttttgccctttttggactgaagagttaagtcatgctatatcgatgcaaaactatgtaacattggtgaagtattatactcctactagtttataaggtttgtgtttacgctcattccattcctaattatgcttgatagcctg

SEQ ID NO: 12114 - DNA, 1423 bp, Sorghum bicolor
  Clone ID: SORBI-28MAY03-CLUS13390_1
cagcaccgcgagggaagcggtcacgcggcggcggcgccgccatgggctaccaggatgcgtcgcgcggcggcgggaagctatcgctcgctagcgtgggcttcgccggccctggcgcaggggcaggaggcgggggcggctacaaggagctactcgtcatggcgctgcctacggacgacggcctcgatggcgccaaggtcgcggaggccatcggcgtcaggctaccggacgtcggaggggccgtgaggactattttggagagcagagaggccagagaatttgccagtggagcactagctggtgctatgtcaaaggctattcttgcccctctagagactatcaggacaagaatggttgtaggagtaggatctaggcatatttttggtagtttggtggagatcattggacaaaatgggtggcaagggctttgggcaggaaatacaatcaacatgctccgcattattccaacacaagcagttgaactcggaacatttgaatgtgtcaagaggagcatgacagaagctcaagagaaatggaaagaggatggatgcccaaagatacaacttggtaatatgaaaatcgagcttccacttcacttcttatctcctgttgctattgccggtgctgctgctggaatagctgccacattggcgtgccatcctctcgaagttatcaaggatcgtttgactgtcaatcgagagctttatccaagcattagccttgccttcagaaggatctatcagacggatggtataggtggtctctatgctggcctctgtccaacactaattggcatgcttccttacagcacatgctacttttttatgtatgatacaatcaagacctcttactgccgcttgcataagaagtcatctttgagtcgccctgagcttcttgttattggggctctttcaggtctcactgcaagcacaatcagcttcccgctggaagtagcaaggaagcggctgatggtcggcgctctgcaggggaagtgcccgcctaacatgattgctgctttgtcagaggtgatccgggaagaggggttcctggggctttaccgtgggtggggggcgagctgcctgaaggttatgccgaattccggcatcacctgggtgttctacgagacatggaaggatattcttctggctgacagggacaagccgcgcgcttagcgaacaaactgtttttttttttttaagaatggaggcgttgccgtagatgagtttgctcctttgctgggatttctgatccattttcagttttggagtcccgcctgtgccgaatgggtagataggatgtgtttatctttttggctgagtggaagcatttgttgcgtaatcaattctgaatatctgattgatttttgttatgttaagagacggatttcatgaactcctaatctatatctatgtatcctatacaaggg

SEQ ID NO: 12115 - DNA, 1290 bp, Sorghum bicolor
  Clone ID: SORBI-28MAY03-CLUS1345_1
gcactgctgggtcaaggacccctggcgctccatgagctacgtgctgcgtgacgtcgtcgtcgtcctgggactcgccgcggcggccgcgcgcctcgacagctggctcgtctggccgctctactgggccgcgcagggcaccatgttctgggcgctcttcgtccttggccacgactgtggacccgggagcttctaaacaaccccaagctcaacagcgtggtcggccacatactccattcctccattcttgtcccataccacggatggaggattagccacaggacgcaccatcaaaaccacggccacgttgagaaggacgagtcctggcacccgctaccagagaggctgtacaaaagcctggactttatgactaagaaattgcggttcaccatgccattccccctgctcgcgttcccgttatacttgttcgcaaggagtccagggaagacaggatcacacttcaacccaagcagtgatttgttccaacctaatgaaaagaaggacatcataacatcaacggcctcctggctggccatggttggtgttctggctggtctcacctttatgatgggtcctattccgatgctaaagctctacggagtcccatacttggtatttgttgcttggctggatatggtcacatacttgcaccatcatggccacgaagacaagcttccctggtaccgtggaaaggaatggagttatctgcgtggaggactgacgacactcgaccgggactatggattgatcaacaatatccatcatgacattggaacccatgtcatccatcaccttttccctcaaatcccacattaccatctcattgaggcgactgaggcagcaaaaccggttcttggcaagtactacaaagaaccaaagaagtcgggtgctcttccgtggcacctatttggggtgctagcacaaagcttaaagcaagaccactatgttagcgacaccggagatgtagtctactaccaaactgactcgaaaacgaacacctctgcacaaaaatctgattgacacggactatagaacgtagcgtattcttcatttttctcaggggggctgtgcctgaagacctgcccagcctcccgggacctctgattggtgtgacttggtacacgtcaattcaatcaagaatgtaaggtggcataagaattatcatgtatgggagggtaaatgtagttctttccaatgatggaaaacggatgctgcttccgatgtaacaacatgtgattctttggactagaggtatactatttacagtaaagagtgaaaaaaaaggacttagct

SEQ ID NO: 12116 - DNA, 1048 bp, Sorghum bicolor
  Clone ID: SORBI-28MAY03-CLUS10968_1
atgtcaaacatcttccctttgttgctggagccatgattgattctcatacaacggctgaatattggaagagcaggactagcgaccgcctaaaaatacagatgccacaaacttatgttgttcacctggggaatagtaaagaactaatggaagttgctgaagataatgtcgcaagaagagtcctacgggaacatattcgtgaatcccttggagtacggagtgaagatctcctgtttgcaataataaacagtgtatcacgagggaagggacaagacttatttcttcaagcattttatcagggtttgcagctcatccaacaccagaaactaaaagtgcctacaatgcatgctatagttgtgggaagtgatatgaatgctcagaccaaatttgagactcagttacgtgactttgtggtgaagaatgcgattcatgaccgtgtccattttgtgaacaagacattggcagtggcaccttatttggcagcaattgatgtgcttgttcagaattcccaggcccgtggagaatgcttcggaaggataacaattgaagcaatggcattcaagttgccagtattgggcacggctgctggagggaccacggaaatcgtcctggacggctcgactggccttctgcatcctgctgggaaggagggcgtgacgcctcttgcaaagaacattgtgagactcgcaagccatgccgagcaaagggtctccatgggggaaaagggctatgacagggtgaaggaaatgttcatggagcaccacatggctgagaggatcgcggcggtgttgaaggaagttctgcagaaatcacaggaacgctctaggtcttgagcttgcggtaacatgttaaactagaatttacccggctacgtggttcaggctggaggtacactgtagattacacagtctgttccatcagttgttctaggccttgtttacttccgaaaattttgcaaaatttttcacatttctcatcacatcaaatctttagacgcatatatggagtatcaaatatagacgaaaataaaaactaattgcacagttggtcg

SEQ ID NO: 12117 - DNA, 1058 bp, Sorghum bicolor
  Clone ID: SORBI-28MAY03-CLUS1096_1
cgccggcacgagtgtgcttcgcttcaacttcctcggcaagcagaagaggagggagggaggtcctgctcgctcgatccagacgcatccgccgaccgccgtcaccggagtcgccgacaggatgtttctcacgaggacggagtacgaccgcggggtgaacacgttctcgccggaggggcggctgttccaggtcgagtacgccatcgaggccatcaagttgggatccactgcgatcgggttgaagacaaaggatggtgttgttctcgccgtcgagaaacgtgtgacctctccactgctggaaccaagcagtgtggagaaaatcatggaaatcgatgagcacataggctgtgccatgagtggacttattgctgatgctagaacgctagtggagcatgctcgtgttgagactcagaatcataggttctcatatggggagccaatgaccgtagaatcttctacacaagctatctgtgacttggctctgcgctttggcgaaggtgatgaagagtcaatgtcacgaccatttggagtctctctcctaatcgctggacatgatgagaatggacctagcttgtactacactgacccatctggaaccttctggcaatgcaatgcaaaggctattggatcaggctctgaaggagctgatagctccttgcaggagcagtacaacaaggaactgaccctccaggaggcagagaccatagccctttctatcctgaagcaggttatggaagagaaggtgaccccaaacaatgtcgatatcgccaaggttgcccccaagtaccacctctacacccctgccgaggttgaagctgtcattgcgaggctgtaaaacacttcagatttctcgatttcccatcatcaatcacggtcgttgtatgaagcatggacatcttgatgctggcctgtcagcctagtgtgtgttgctatgtttgtcaccatgttctgtcaactccacaagggcagttcatgatagattaattggcagcccggtcagttcaatgatttaagtagcattgagaagtttgtactgccagaaagaatgtatactactttaa

SEQ ID NO: 12118 - DNA, 580 bp, Sorghum bicolor
  unsure (1)..(580): unsure at all n locations
  Clone ID: LIB5051-012-A1-XP1-D4
gcggccgggctcggctggactgatgagaatggacctagcctgtactacactgacccatctggtaccttttggcaatgcaacgcaaaggcaattggatcaggctctgagggagctgatagctccttgcaggagcagtacaacaaggaattgaccctcgaggaggcagagacgatagccctttctatcctgaagcaggttatggaagagaaggtgaccccaaacaacgtcgatatagccaaggttgcccccaagtaccacctctacacccctgccgaggtcgaagctgttatcgcgaggctgtgaagtgcttccgagctcacgccatcagtcggtaatagacaatccttgtacgaaacgtggacatcttggttcttgattatggctgtcatcgtactctgttgtaactccacaaggacagtcgatggtagtttgattcgcagctcagccggctcagttgtctgtttctagtagcgttgagcgttgagaacattgtattgccagaaacaaagtacacttatttttctttactgtttcgccttccgttttgtgggcaaaaaaaaaaaaaaaaaaggccccctan

SEQ ID NO: 12119 - DNA, 718 bp, Sorghum bicolor
  Clone ID: SORBI-28MAY03-CLUS1108_1
cccgattgaccgagctgcgacccacgcgattcccgctgcctgctgcctcggcgtaaagccctcggcgctgcgggagcccggccccggcacctacctcccccaccacttcgccgccggcgggtggagtcgggccggagcagccgctcgctctcctctgttaccttaccccccgaaacagaaaaagaaaaaaaaaggagagagtaccaagcaagcgagccgaccggcggcagctcgggcagcagccatggggcacggcgtcagctgcgcccgcaccggcgacgagcacgactacttccgcgcggcgcaggtcggggacctcgacgccctgggcgcgctcctcgccgccgacccctccctcgcccgccgcgccaccctctacgaccgcctctccgcgctccacatcgccgccgcgaatggccgcctcgaggtgctgtccatggtcctggatcacggggtgccgccggacgcggtgaatcggcacaagcagactccgctgatgcttgcggcgatgcacggcaagatcgactgcgtgctcaagctcctgcaggccggcgccaatatcctgatgttcgactccctgcacgggcggtcctgcctgcaccacgcgtcctacttcggcaacgtcgactgcctgcaggccatcctcacggcggcgcggaccacgccggtggccgactcatggggtttcgcccggttcgtcaacgtcagggacgaccac

SEQ ID NO: 12120 - DNA, 915 bp, Sorghum bicolor
  unsure (1)..(915): unsure at all n locations
  Clone ID: SORBI-28MAY03-CLUS11220_1
gcacgaggggcccattcaattattacgcaggcacgcagccgtggcgccgagcccccgagccctactcctcccgccgccgccttcggctcttcctcgcgacgcgacgcgccgctcgctctccgagctcctaggctccacctccaaggtctgactactacgccgctcctacgaccccgaggcgcctccaccgcgccactggcaagctaacacactttaccggagcaccatgggagagccgagcaaggagcttctggacctgccctccgaccccagacctcccgcctccttcatcgagtcgcttctcgctggcagggagcagcagcaggacaaggaagggaagcgtaagtcggggccgcccactgatcccttccccaaaagccaagttattgggaaagtgaaggatttcttgggggagattgcgaaggccaaccagaagttgcagcttgacgctcaaaacaagcctcctgtggagtacgatattgaagcccttaccgggaacgaggaggagtacattgagatggatctgcttcttggtgttgctgatcttcattcagagaaagctgtggaggctgctgaagcaacaataaacggctcccagccttcagaaatgccatttgcctgcagcccatctgactcggaagatgatagtgaagacagcgatgaagatattggtgacaaacctatcgtgtctgacaaagataataaatgtaaaagtaaagatgacgcgaagatgggtccagccaaaggaaagaagcccaataaaagacagaaaattgttgttctcaactagtatcctcgacttttctacctaaaaacaagggctggagtctcgttcagaaaatcagagcgcaagtgaatgtgtaggcctggtatcatcagaagttgcgtattattttccagtgttctacaatnngt

SEQ ID NO: 12121 - DNA, 860 bp, Sorghum bicolor
  Clone ID: SORBI-28MAY03-CLUS13628_1
ctttctaaggtatatatccgcccggccggaaccgcagatcgatcgacacacggttaattgagaacacaaaaacacagacatttccatcgatccgcagcagctagctagctactagtagcgatggcatccaacaactccattgcttcccctgcgctcctgctgtccgtagccatggcactcgtgttgttcacggctacgacttcagtgcgcgctcagtcaccggccccgacgcctgccgtgatgcctgctgcgccgccaccgccggcaccgacgacgccgccgcctgcaccggcggcaccatcccaaaactcatcatgcccttccggctttcctaactcagcctcattcgctcgaggcgtgagagagtatcttcgccgtggcatcattctcatcttgtccgctgtcaaggtcaccccaggcaccagcaccacaagatgcttttgctatttctctaccaacatcaccatccccgttcccttctcgccgcccattatggtgcccaaccccaatggacccctcgcatgcgtgccaggccgccaaatatgatatagcacgcctgagattcagcgtgctggcacgctggcacacgcactagtatactatatagtatatacgtacactatatatatatatatatatatgaataagctccatctgtctgcactcgtgtgcatgcttgtctgcatgcggagactaattcacatgttacacttctatacattggcatgtaagaggagtttacacaaagtaaagacacagatgatgtaacaatatgtgacatgttcatgttattgcacgtgttcgcaaaatactgaatatatatactgggactatatacaaaaaaaaaaaaaaaagcccct

SEQ ID NO: 12122 - DNA, 816 bp, Sorghum bicolor
  Clone ID: LIB5048-012-R1-XP1-A2
tccggagacagatcgatcgacacacggttaatttgagaacacaaaaacacagacatttccatcgatccgcagcagctagctagctactagtagcgatggcatccaacaactccattgcttcccctgcgctcctgctgtccgtagccatggcactcgtgttgttcacggctacgacttcagtgcgcgctcagtcaccggccccgacgcctgccgtgatgcctgctgcgccgccaccgccggcaccgacgacgccgccgcctgcaccggcggcaccatcccaaaactcatcatgcccttccggctttcctaactcagcctcattcgctcgaggcgtgagagagtatcttcgccgtggcatcattctcatcttgtccgctgtcaaggtcaccccaggcaccagcaccacaagatgcttttgctatttctctaccaacatcaccatccccgttcccttctcgccgcccattatggtgcccaaccccaatggacccctcgcatgcgtgccaggccgccaaatatgatatagcacgcctgagattcagcgtgctggcacgctggcacacgcactagtatactatatatatatatatgaataagctccatctgtctgcactcgtgtgcatgcttgtctgcatgcggagactaattcacatgttacacttctatacattggcatgtaagaggagtttacacaaagtaaagacacagatgatgtaacaatgtgtgacatgttcatgttattgtacgtgttcgcaaaatatcgaatatatatactggaactatatatattgaaaaaaaaaaaaaaaaaggccccta

SEQ ID NO: 12123 - DNA, 1116 bp, Sorghum bicolor
  Clone ID: SORBI-28MAY03-CLUS14146_1
cggacgcgtgggatacgcccccacctcccgttcccaaatcccaatcccccactccctccctccctcccaagaaccccgcgccgccgcctccccacctcgccatgggcagcgccgccgccacctcgccgccgccgtctgggaagctcacgcaggacgagctgaagcgcgtggcggcgcaccgcgcggtggagttcgtggagcccggcatgacgctgggcctgggcacggggtccacggcggcgcacgcgctggaccgcctcggggacctcctccgcgcgggcgcgctcccgggcgtggccggggtgcccacctccctcaagacggaggcccacgcgtccgccgtcgggatcccgctgctcccgctcgacgccgcctcgggcgccaggatcgcgctctccatcgacggcgccgacgaggtcgacccggacctcaacctcgtcaagggacgcggcgggtcgctgctccgcgagaagatgatcgagggcgccggggaccggttcgtcgtcatcgtcgacgagtccaagctcgtcccccgtctcggatgcacgggcgccatccccgtcgaggtcatccctttcggcgcgccccacacgctgggactcatccgcaacctgttcgacggcgtgtccggcttccacgccaggctcaggaccgcccccgccgccaagggggaagacttggaggcgccctttgtcaccgacaacggcaactacatcgtcgagatgttcttcgaggacggcatccgcggcgacctgcgcgacatcagcgaccgcctgctccggatcaccggcgtcgtcgagcacggcatgttcctgggcatggccaccaccgtcattgtcgccaacaaggacggcaccgtcgcagtcatgggcaggaagaagtagtagtagtttacaagtagtagcctgcctgttcttcgaagcagcgatcgcctgctctggatcaacggcgtcgtcgagcatggcatgttcctcgacgtggccaatcgtcgacaacaacgacgacaagcaataatttttgcaagtagcctgtgtctgtgcaacatccagctactattatataagttgaagttgtatcgtgtctgtgcgtcatcctcctatactgagtttctgctga

SEQ ID NO: 12124 - DNA, 796 bp, Sorghum bicolor
  Clone ID: SORBI-28MAY03-CLUS1408_1
gccggccgggctgctaggcatgagcaaccctcctcctctcctccggctccgccgtcccatggccgcagcgccctgttcctgttcctgggacacctccttccacgaaaagcaatagcagctctacccctaccaataccaatctggatccaaatcgaccgctaagctaacactaaatcatcttcccttcccgttcgagatccaagagctagcagaggcggttcgcggagagattcagtaatctgcgctgccggcgaagaagaagaagaagaagaagggggaggtagagcggctggagatgggcaagtacgtggagctgctggacatgggcgtgcgcatcgcggcgcggttccactcccactgcccgcagaccgcgcgcctctactaccacccgcccgccggcggcaccgggtcccacgcggctgcggcatccggcggggacggccgcaagggcgacgccgcggcctcggccgcgatgatgatgaagaagcagcaggggcagaggctcgacgccccctcggagatcatcctctacaccgtcgtctagactagtcttggccggccgggattgttgtcgccggaggagccgtcgtccacaggaccggcggcgatgtatcattcattcgtgggagtcgatgtgttgctcccgtttttttttttttccatttgtgttttgggttggtggaactcgtgtgtaccatgagttttatttaatccatttcttcccaaggggctcaaatcgctcttggttccaaaaaaaaaaaaaaaaaaccaaaaaaaaaaaaaaaaaaggccccta

SEQ ID NO: 12125 - DNA, 734 bp, Sorghum bicolor
  Clone ID: SORBI-28MAY03-CLUS14147_1
agcatgtggcaggtcttgacgcgcgcccgcgcctcagacttgtctttcctccatccactgagacattttatttcgaagagctaatcattttctggagcattgccttcccacggtggctggagctactgattcaaaagtgcaaaggcctgcgacggtttgagttgcagtgcggcctgtcattactcaggagctgccttgacagtggcaagaactggcatctcgtgcagcagatccctgaggtgcgcatcataagctgtgatggcaagaggtattttcggtataacaagagtcgtcgcatttacgaaactaatgcacagtcagaagagtgaagccattctgaaaattttggcatgacactggtttgttttgggtcagccacacgtttcagttgttgttgtcctttgttccgggagtttgtgtttatattgagagcttgtattctgttcacgattgatttaggagttctctgttttgcgtggtttctctttttatcgctctaccagtatatgcactggttctccggtggatcaatgcagatgctcacattttctttacctttgaatatgggtatccttcaccaggactcaatatgtatgattcttttctgtttcctggttatgatggtctgtaaattgtaaacattgggtttgatggatttgactttggagtgcaaagtattggcagttaaatacacaaaaaaaaaaaaaaaaaaaaaaaaaaaaaaaaaaataaaa

SEQ ID NO: 12126 - DNA, 816 bp, Sorghum bicolor
  unsure (1)..(816): unsure at all n locations
  Clone ID: SORBI-28MAY03-CLUS143_1
gcgtccgcccagcgtccgtttttttttttgtgggggtgagaaaggccttattattgcaacagaaatacaaattttgtacaacagcaacagcagtcccctcaattatacactcaacatcgcaaaagcatgcaccaggttcggcacgcaccaggaaaaatgggatatttctggatctagtgtctaaagccttttcagtgtgcgagcaggcagctcaagttcccaagacaagcacggtcacaacaaggtaatggacaatatgcacaacaggtaccggttgtcaggttctcatggtgcaaaaatgacagttggctcttgccgacctggagagatcagcaagaccacactgatttcttcctctttcctgatctgaatatggtgcccatgtttcactgttcagagcatatattggatcggaagcacaccgatttcctctttcctggtctgaatatggttccataaactttggttgtcaagatgacatactggttgctcacatgaaacaatcatcggcattgtccacgcagtgttcaagcaccatacgtactctaagcttgcaatccaagcaggggtcatttatcatgcttttcacttgttggatcactccagcattttgtaatctgacaactctaccagatgaggcttcacatttggggtaaatcaagttcagaaggcaccacagggtggcaacccgcaactgtttatccttgctttgcagaaagttcactacaaataatggtttgatgcgatctgctctgtgaggaagaagaacattcattacagcttccttgttcaattcgtttnccagccgccggacgc

SEQ ID NO: 12127 - DNA, 1726 bp, Sorghum bicolor
  Clone ID: SORBI-28MAY03-CLUS40_1
attccagtccaactctagcgcttcccttctcttttcctcttcttccccgaggcgccggctctggtcaggtcgggccttgccgccatttcgggacccgtccgtcccctccccccgcgcccgggtgccgcgcgtctgcccgtccctccgtgccggggaggcggggccgccttgtgtccggcgctgcccccccagcccgacgccctgcgcggccacggtccggcctctccgggcgtcgtgtcggtgctttactccggtccaactctagcgcttcccttctcttttcctcttcttccccgaggcgccggctctggtcaggtcgggccttgccgccatttcgggactcgtacgtagcttcttcctggtcggggttgctgcgcgtcttgcgtaccctgggttgagcatcattgggagtggaagaaaggaatcatgttcaggagaaagcatgcttctcatttcaactcaaatgatgctgagcagcaagaagcaaagataaatgaattaaaatatgcacttggtcctttgtctgcccatgacgagaagtactgcagtgacacatgtttcagaagatatcttgaagcccggaactggaatgttaccaagtcgagaaaaatgcttgaagaaagtctcaaatggagggcaacttataagccggaggatattcgctggcctgatgtttctgttgaagcggaaaccggaaaaatgtacaaggcaagttttcgagatagagaagggagaaccgtaattattatgagacctacaaaggagaattcaacgtcccatgacggtaagatccggtttcttgtatatgttttggagaacgcgatcctgggccaacatgaaggtcaagagaaaatggtatggctgatagacttcgcagggtggacaatggcccatgccacacccataaagactgcaagagaatctacaagcatcctgcaaaatcattaccctgagaggctggccgttgcatttttgtttaatcccccaaaagtattcgaagccttttacaaggctgtcaaatatttccttgacccaagatctatcgagaaactgaactttgtgtacctgaaggatgaggagagcatgaaggtcctgtacaaatgcattgatcccgaggtccttcctgtcgagttcgggggaaggaacagtgttatgtacaaccatgaggagtactccaagttgatgctgcaagaagatatcgaaccatcaagcttctgggaagatgacgcgaaaacagttgaccatgctgtcaatgggaccttggttcctgatgttgcacctcggtcgctgcaacttgctgctaaagccagttgagtatcatcctactatgatggatgggagctattcagaatgctttaatggaggaactggaaaagttgagccccaatagtttattgatagtaaacaaataatagaggaaataacagatgagatattacttgtccatagtcgaaatagttgcacttatcaaacactttatccagtacacgatgagttacaggaggatatcgccatgggtggatattggatgcaaaagcccaaaagaaatggtgtgagaggttggagtgccacctgcttattgtatctaaaagtcactaaatgctgaacatgttttagccgtggctctgcagaagctaattctgggttatggctaaaagtgctgattttatatttgtatttgattatggccgaagtagctcctcaccagcttgtggattctagtagt

SEQ ID NO: 12128 - DNA, 1047 bp, Sorghum bicolor
  Clone ID: SORBI-28MAY03-CLUS40353_1
gcacggcgcgcgccgcgactccgcctccttccctcgcgcgacggcacgcgagtacgtgacaccgagcgacaagtgacggcgccgacgcgccgccccctgccccagcccggtcggcgggctccccaggacctagatctccgcctccgcgcccccaagcagttcctgcgccgcccgccgccgtctcggcttgtccagccgcgccggcgcgcctcccagcccggcgccgccttctgtagccacgccggcgcgcccccagccccgcgccgtccgctctccagcccggccggcgacaagcctggccactgaaagccaaaacagactgattgaggtgccaccaccaaacaaaaccaagcttgcaatggaatcttcctcaagcaatgctagcaacgtgccactgcctgcatcccaacgccccctacatgcaacagatgcagatgaggaggacgacagtgtgaagcagcttaatgagtgtgccacagtatatctatctctccaggactgcctcatcgagtcaaaccgcaactggaaggtctgccaagcacacgtccaagcattgaaagcctgccaggctaaaagaaacaaaagtggtcaaacctaaagctttacatatgtgagtagctgatatcctaaaatggtcagcaaggatgccagtttgcagggaacaggaagcaatgctccagatgttagttgcagatggagatgggcacttctcaaacagctcagaatctctgatcgccatgatgtttctttgttacattctgcataagttcactgaacaacaatagaattttaattctgtttctgtattgcccaatccccacataagattaacggtttcagatttattaataggacaactggacaagacattcctacatacgattacaaatgagttcatgtgagagttggaagattagtgcaactgtaaatccgatcataatgtcagtctcaattcattccgctgaaatttggcttatgttggtgcttatactgatttgttgtgagaggaaaacattgttcgttcagtggcgagttgaagttgtgata

SEQ ID NO: 12129 - DNA, 988 bp, Sorghum bicolor
  Clone ID: SORBI-28MAY03-CLUS40089_1
ggttgctttgtgtattgtggagttgaatgctccaagtttttatccttctgttgtatcactttgggtaaatgattcctttgagagaaaagacatggaaagagagttgttggctaaacttctcgtcagcctttgcagtggtcgacataatttgttgagcaagcaacaactcagtgatggcctttcatctgttcttgcctcattggaagatactctaagtgatgctccaagggccaccgaataccttggacgacttcttgcaaggtttgtggaggaaagcgtactgcttttgcaagaggtaggtaaattgattcaagaaggtggagaagaacctgggtacctaatacaagatggtattgcggccgacatccttggtgcagttctggattccataaaatcagacaaaggggattcattcttgaatgaggttaagtcaacttcaagtttaaagttggttgatttcagaccacaacatcttaagcgatcaaagttggacgccttcatgtaggcacataatttattgttacctgattaccaacgggtgcagtcaccaagcagattactttcttcgcacccatcggcctttttgatgtactgtaaaacatccctctgatgctgctcctacttgctgtatctgaccatacactatttataagatggaaggggatgggtcacccattttttcagagttgatgctggttgtaagctactgtcaatgaagggtcgtggatggctgaagcagttagctaggcccccataagagtatcagggaatatttttgtgatcacagggagaagtctgctaaccaatattagttggtagtcgggggaactgtaggttgaacttaatgcctcctgcgggcttctgaccaaatattcctttgtgatcagaattgatagttggttaacttagcggcattttccggatagccaatgtttcctgtgacggtatgattatgttaatcttgcttaaattttgctgtaatttgcta

SEQ ID NO: 12130 - DNA, 1115 bp, Sorghum bicolor
  Clone ID: SORBI-28MAY03-CLUS40600_1
gcacgaggcccacctcctcatcagacagtcactctcccctgcaacttccatgatctccccaataaatttctctggtccttccatgccacgccaattcttttttaccggaaatggaaaagtttggaaggacccaacccaagaccaagagctagcaggcacgaggcactagctcacttgctccctcatggcctccctcgctcccaccaccagcttgcttcagagtcctgacccctagccttctcctccctcccccaccaccccacgcaagaaagaaaccccaggacgaggccggagccgctgcaggaacagtcagaccgtgaagagcccgctgtttgatctgctgcaagagctcgccgtcgatctcttccaggcattggagttggcaagttgatcttccacaaagcgatgaaaccacacactgaccttggtgatctcgattgagccctaccagttaccacattgctggagccttgaggtatggcatattctggacagaggcatggtggtgttgggagctcctcgaggccagggaatggtttcaagggggcagccaactcggtggagtttctgggtagggagatgctgggaatgcaactgagggatgccaagcccgatacagatgatgaaagggagatgggatcaagttcagatgtgactgatagttctagtaatgaagctggtcatgtaatagcgactacaattcgtgggcacaacggcctgcctaaacagtctgtcacatacatcgctgaacatgtggttggaactggttcttttggggttgtatatcaggcaaaatgccgagaaacaggagaaaattgttgccataaaaaaggttcttcaagataagcgttataagaacagagagctgcaaatcatgcatatgcttgaccatcctaacatcatcggtcttaagcattacttcttttcaacaactgaaagggacgagctttatctcaatcttgttcttgagtttgttccagagacagtaaacaggattgcaagggcagtacaaccgaatgaatcagcggatgcccctcatttttgtcaaactgtacacgtaccaaatatgtcgagcgcttgcttatatacataactgcattggcatatgccaccgt

SEQ ID NO: 12131 - DNA, 675 bp, Sorghum bicolor
  unsure (1)..(675): unsure at all n locations
  Clone ID: SORBI-28MAY03-CLUS40924_1
aatgcacgagggttaactctccagactccaacccctcttctcggcctcttcatttccaattccggcttcttcttcgcatcacaaaattccgattgcggcgcagtcttggattgctagctccagccccaaatgatcatcatcagcggcagcaacttcccaacggattcgtgatcctcccgcgatgggtctcatctccaacgatgcgtggcacaaacggttcttcagcgttgcgccgcccgcggcgctggtcttcttcttcgtgctgatattcgtcgccggtgcaattgtcacgctcgatcataaggagagtctgtccatattgcagttgcaaccgaaaggagtgattgcagcagtggagatgaggcctccagccactagcgagctgaggtcttcagcgacgaccgagccgcgtgctgagccagcagaggaacccgacatctgtgagaataaatgtagacctccaggcagcgagcccttgccgaggggcatcgtgcaggacaagtccaacttcgagatggagtcgctgggtggcaatcctgaacggaaggagaacggcaacggcaggcagccaaaaagcctcctcgccatccccgtcggcatcaagcagaaggcgatcgtcgacaagctcgtctccnagtttccggaggccaagttcaccgtgatgctgttccacta

SEQ ID NO: 12132 - DNA, 1644 bp, Sorghum bicolor
  Clone ID: SORBI-28MAY03-CLUS15266_1
aggcccgagggagccccggcgagttggaaacgaaaagcaagggaaagccaaaaggcagaatccgcgagacaagaaagcagtaggaaggagaggttgcgtcccagccccacccgccatctcctcttcttccctttcctcggcgcctttccacgattcagattcacaaagattggaggacccttcttcctgccgcgcggcaattctcgttcgttccagtgcccagggcgctgttcttgagcggagagcggagggcgccggccgggctcgcgatggggcaggacggccagcagatccgccgcgacaagctcatcatcgacacggatcccggcatcgatgatagcatgacgatcctaatggcgttcagagcacctagtttggaaatcattgggctcacaaccatatttggcaacgtggatacagtgggcgcaacacgtaatgcgctattgctgtgtgagagagcaggacaccctgaagttccagtagcagagggaagccacgagcccctaaagggaggaaagccccgtgttgctgatttcgttcatggctcagatggcattgggaatctgtttcttcctgcaccctctgctaagaaggttgaggaaagtgctgctgatttcctgattaataaggtctctgagtttccaggagaggtctctgtgcttgctttgggacccctgacaaatgtagcattggccatcaaaagagacccttcttttgcaagcaaggtgaagaaaatagttgtactgggtggagctttctttgcagctggaaatgtcaaccctgctgctgaagcaaatatccatggagacccagaagcagctgacatagtttttacttcaggagcagatatcgttgtggttggcattaacataacaacacaagtctgcttgacagatgaggatctcttggagctaagaaactcgaaagggaagcatgcaccgttgttatctgagatgtgcaagttctacagggattggcatgccaagtctgacggcttccatggaattttccttcatgatcctgtgagcttcactgccgtacttcatcccgagtacttcacattcaagaagggtgtggtgagggtggagacccagggcatttgcactggccacactttgatggatcacggattgaagaagtggaattcagagaacccatggtcagggtataaaccgatttcagttgcgtggacggtcgatgtgccaaaggttatcagctttgtaaagaagctgctcatggcacaatgagcaacgacatcagcgctctctgatgtccaagaaaatttgacaagtacagagcctctctcccagctgcattgtaattagtttctggacctaggaagcttcctatttcctccaatagtaagaggatcgccttgttgtttgagttgaggtcttaatgattcagatctattgtcaaaaaaaaagagagattcagatcaacctccgtacttgtgattaaaagatcaatatcacaagagtggataggttggtctaagccattccgtccttctaatctgacagtcaaaattatgtcatgtgtcctgagaaacataggaagcttccttgtgaaaggttatgcatcataccatgaagtaaattctggcatacgacatcacgtctcacatttgtatcaatacattcg

SEQ ID NO: 12133 - DNA, 766 bp, Sorghum bicolor
  Clone ID: SORBI-28MAY03-CLUS15481_1
gccggccgggccgggataagcaaataaattaaggtgccatccccctctatcagcaccaataatcccaatagcaaccacgtctcgatctccattaccaaagaaaatgaagatcgtggtggtgctcttcgtgttggtcctcgcactcatcgctggagccgctgccgacaagaaggagaaagaagacacttgcaaaaatctctgtgcagaaaagaagctcaaggagccagcctgcaaggagtcctgcgccctcaacaagcgcttcaaaaaggtgtggatcgaggctgtccaatgctcgttgaaatgcaacaagaagcacggctttggcactccagactccaagtcttgcgaagaaggatgcaaaaagaagtacgaggataaagtggcggagatcactgctagctgccacacggtttgcactaaggtggagaaggagcagcttgctattgaagaatgcaagaagatctgcaccccgtccctcatcttcaaggaaattaaggaggcgttgcattgagctatctatacgctggccaccatggtctgccaattaatcatttgatggatatggaccaaactaccaattaattaatttgatattttctttgctaatttgttttttgttcaaatcgatcagtcaaaggatccatcgatatatggtttcatctgctggacaggcagtccaatgtaatcccaatgtaatgccacacacggttttttaatttttttgtttgattaaataaataaaagggcatgttggcaattatcgctg

SEQ ID NO: 12134 - DNA, 1603 bp, Sorghum bicolor
  Clone ID: SORBI-28MAY03-CLUS1552_1
ccaaaatcttattttcgaattatccgagtccaaagcaagcgcactgctccccgggcagccgccgcggcagcagcagccatggcttgctccgcgcagcttctgtcccagagcctctactcgtcccaccgcgccagcccgcccgggcccaggaacctccgctcccaggggcgaccgccggcgcgggcgtctcccgcggcgaggcctggctcgagggccagggggtgccggggtgtcagcctgagggtcgacgcgtcgttcgaggaggggaggcggcaagtggaggtctcttatgacccacaagcaaggtttaaccagatagcggaccaaattgacaaggatgctggaatgacacggcttaacctattttcaccttgcaaaattaatgtgttcttgaggataacgggtaagagaccagatgggttccacgacctggcttctctatttcatgtgataagtttgggtgatacgatcaaattttcattgtcaccaagtaaaagcagagatcgcctgtcaaccaatgttccaggtgtcccagttgatgaaagcaatttgatcatcaaggcactcaacctttaccgacagaaaacagggactaataactttttttggatacatcttgataagaaggtcccaactggtgctggtctcggtggtggaagcagcaatgctgcaactgcactttgggctgctaaccagtttgctggctgtatagcttcagagaaggatcttcaagagtggtctggtgagattggatcagatatcccctttttcttttcacaaggagcagcatattgtactggtagaggagagattgtccaagatatcccaaatcccttgccggaaaatttaccaatggttcttataaagccgcctgaagcatgctcaactgctgaagtttacaagcgattcaaattggaacaaacaagtcaagctgatcccttgaccttgctcaaggaaataactcaaaatgggatatcacaagatgtttgtgttaatgacctagagcctccagcttttgaggtgttaccttcacttaagaggttgaagaaacgaattattgcagctagccgggatgattatagtgctgtttttatgtcaggaagtggaagcacaattgttgggattggttccccggatcctcctgcattcgtgtatgacgatgaagactacaaggatgttttttggtcagaggcttgcttgctcactcgcgatgagaacgagtggtacagggaaccaatctcgtccaatgccacgtctagcaaagatggtttggaagcctcggtcgctgactgattaagtcaggttctgtatcagttttgtgattatacggatacaggctttgatcaacatgccgacatgttaggaaagcattctacggtatcggcaattgctcataagacagtcgggttctgaaatggatcattttcagtatagcaactatcgatttgaccaacagtcagattaatggctccagcctccagaagtttagtccgtagatatattaggatcaaatgaacaagggaagtactatattatattactccctcaaacgggaataaaatgaaggcttgtgaggacctctacaactgtttagacgttattc

SEQ ID NO: 12135 - DNA, 1463 bp, Sorghum bicolor
  Clone ID: SORBI-28MAY03-CLUS15660_1
ggggcaccatcccagaaacctgcaagaaatcgaatcgagtcaggggaaggaaaaaaaaagaaaaggggaagagcacgcgccgccgccatggccgccgcctcctcccgccgcgcgtcgcaactgctggggtccgccgcctcccgcctcctccatgcgcggggattcgccgcggcggccgccgcggcgccctcgccggcggtcttcgtcgacaagagcacccgcgtgatctgccagggcatcacggggaagaacggcaccttccacaccgagcaggccatcgagtacggcactaacatggttggtggagtgactcctaagaaaggtggaactgaacatttagggctcccagtgtttaactctgtagcagaagctaaggctgaaacaaaagccaatgcatctgttatatatgttccaccaccatttgctgccgccgctataatggaggcaatggatgctgagctcgaccttgtcgtctgcattacggaaggaattccacagcatgacatggtgaaagtgaaggctgcattaaacaggcagtctaaaactagattgattgggccaaattgccctggtatcattaagcctggtgagtgtaaaattggaatcatgccaggttacatccacaagcctgggcgtattgggatcgtatctcgttctggtaccttgacatatgaagcggtgtttcaaacaacagctgtaggcttggggcagtcaacttgtgtaggtattggtggcgacccgttcaatggcacaaattttgttgattgccttgaaaagtttgttgacgaccctcagacagaaggtattgttctcattggtgaaattggtggtacagctgaggaggatgctgcaacattcatccaggaaagcaaaacacaaaagcctgtcgttgcattcattgctggacttacggcacccccaggccgtcgcatgggtcatgctggagctatcgtggcaggaggaaagggtactgcccaggacaaaatcaaggcactcagagaggccggtgttaccgttgtcgagtcaccagcgaagattggatctaccatgtttgaaatcttcaagcagcgtggaatggtagaatagagacacaatggtacagtagagacattgagaaaccgctttttggtgctcgtgggctattgcgagcaattcctagatctttttccctggccacaaacaaaactgctgaggcctccttttcttacgtgccttctgtttggaagatggcctggccttcttcacttggatcaccttccaatgagctcatttcaataagacgtttcggagccatggacatgctgttttgcttggagtcaatgtggatgcctaatttcaaatttttattgtttacacatttcaatctaggtttacctatctgtttgcttgtattataatttatattgtcagcggtaaagtgcccacacagctgaggaagattgatttgctttaatgtattcccc

SEQ ID NO: 12136 - DNA, 818 bp, Sorghum bicolor
  Clone ID: SORBI-28MAY03-CLUS1572_1
ctcacaagataaaggactacttcaaaagcaaaaagatggagatgacgattaaatacatagatcctacatacatgatccgtgctattccaagcaatgcaccagacccacgcgtccgcacacttctagctcacagtgctatccatggcgcaatggcggggtatagcttcactgttggaatggtcaacggaagacatacctatatacctttctatcgggtgacatccacaaggaacaaggttaaagtcactgacaggatgtgggcaaggcttctgtcgtccaccaaccagccaagtttcctgagtcagaaggatatcgatgaagcgagtgaggcggataggctggcaaacaggccaccactgccaacgggtgccagctctcgcgtggcgaggtctttcgatcaatcttcgtcgtgttcttcaaatggagagatctagtgattgctggtgcaccacaactgtgtacagaaactactacaatggttctgagctcaggtgcctgggcagcttggcgacgcaatgagttttgctcttgttagttgttatgcatatgccttgcgtataggggccacacggatatgaccctgttagcacgtgtaataaagaaacgccattgatgaagctacttcctggaggctccatctatcatgtatttgctgcagaatatgagttattatgcaatcggcagatgatctatatgatcttcacctatctgtaataccgtgccttctcttcacctgtgtgctttcacgtcgtgtgacacaaacaacattattctaacttgaaaaattatcagaaatatattcaaacaagacggaaacg

SEQ ID NO: 12137 - DNA, 1097 bp, Sorghum bicolor
  Clone ID: SORBI-28MAY03-CLUS13563_1
ccgggggagacgcgggtggtgtacgtggagaccatgtccaacccgacgctggccgtcgccgacatccccatgctggcgcgggtggcgcacgaggcgggggccaagctcgtggtggacaacaccttcacccccgtggtggtctcgcccgcgcgcctcggcgccgacgtcgtcgtccacagcgtctccaagttcatcagcggtggcgctgacatcatcgccggcgcgatctgcgggccggcgagcctggtgaacgcgatgatggacctgcaggacggggcgctgatgctgctgggcccgacgatgaacgccaaggtggcgttcgagctgtcggagcggctgccgcacctgccgctgcggatccaggagcactcgcgccgcgcgctggcgttcgccgagcggatgcaggggctgggcctgcgcgtgctgtacccgggcctccccgaccacccgcaccacgcgcgcctggccgccatgggcaaccccggctacggctcggggggcatgctgtgcctcgacatgggcaccgaggagcgcgccaaccgcctgatgcaccacctccagaacaccacccagtttggactcatggccgtcagcctgggctactacgagacgctcatgtcctgctccgggagcagcaccagcagcgagatgccgcccgaggaccgcgccagggccggcatctccccgggcctcgtccgcatgtccgtcgggtacaacggcacgatggagcagcgctgggcgcagttcgagcgcgcgctcgcgctcatgcacccgcccacgcaccacctcagcctcaagggcgccgccgccgccgccgaccgcgacggcagcgacgccgcgggcaacaaccaccgcaagcactgactgacgcttgcgcttccgactttccgagtgtgcatgcatggtgatatgtgctgttgtggacttgtgtcgtgttcgtgtgtatatactagtagtactaccattcaagtaaggttaaacaccaccgtctgatccctctggttcagatggatatgccggtgcaagcggcttgatctctggggaacttgggagtggacctcaataaatgggatgcgtctttaacggtttcccccttt

SEQ ID NO: 12138 - DNA, 1214 bp, Sorghum bicolor
  Clone ID: SORBI-28MAY03-CLUS13545_1
taccaacacaaatataaatggcaatggccaagatcctcctgctcatcctcctcggcgtcgtcactgcggtcgtagaggccggcgatccaccggtgaaatggaaggccgcccacgcgtccgagagcatccagcaggccgtggacgccatgcccaagggccagcaggggaggtacgtcatctacgtgaaggccggtgtctacgacgagatcgtcatgatcgccaaggacaaggtcaacatcttcatgtacggcgacgggcccaagaatacccgcgtgaccggccagaagagcttcgccgacggcatcaccaccatgaagaccgccaccttctccatcgaggcggccgggttcatctgcaagaacatggggttccacaacacggccggcgcggcgaagcaccaggcggtggcgctccgcgtccagggcgacctcgcggcgttctacaactgcaggttcgacgcgttccaggacacgctgtacgtgcacgccaggcggcagttcttccgcaactgcgtcatctccggcaccatcgacttcatcttcggcaactcggcggcggtgttccagaactgcctcatcatcacgcggcggcccatggacaaccagcagaactcggtgacggcgcacgggcgcacggaccccaacatgaagtccgggatcgtcatccagaactgccggctggtgcccgaccagaagctcttcgccgaccgcttcaagatcccctcgtacctgggccgtccatggaaggagttctcgcgcctcgtcatcatggagagcaccatcgccgacttcatcaagccggaggggtacatgccctggaacggcgacttcggcatcaagacgctcttctacgccgagtacaacaaccgcgggcccggcgccggcaccagcaagagggtcaactggcctgggttccacgtcatcacccggaaggacgccgagcagttcaccgccgggccgttcatcgacggcgcgctgtggctcaagttcaccggcacgccgcacatcctcgggttcaagtcctaaaggccgcatggcatggcatggcatggcatggcatggcacgatagtgaggtggcagtggcacatacgtacatttttgtgtgtatgtacaatgatcgacagacgtgcaagcagatatatgtacctgaggtgtcgcaggacaggagggctaacgttaacgtttgtacctttaccaattttctttcctttttc

SEQ ID NO: 12139 - DNA, 1026 bp, Sorghum bicolor
  Clone ID: SORBI-28MAY03-CLUS13660_1
gccggccgggccgggacctcaccaactcccctacaagccgccggtcaggagccgaccgaccgaaacatctggcttccaaagtccttaactacctgccaccaatccggggaggaagcaacccagcgggaagcggacatggcggcggcgaagatagcgccgtcgatgctctcgtcggacttcgccaacctcgcctcggaggctgagcgcatggtccgcctaggcgccgactggttacatatggacatcatggatgggcactttgttcctaatctgactattggggctccggtgatccagagcttgaggaaacataccaaagcatatttggactgccatcttatggtcacaaacccttcagattacgtagaaccatttggaaaggctggcgcttctggattcacattccatatagaagttgctagagacaactggcaagatctcatccaaagcattaaatcaaagggtatgcggcctggtgtatcattgaggccaggtacaccagtggaggaagtttttccactggtggaagcagaaaatccggtagaattggttcttgtgatgacagtcgagcctggttttggtggtcagaaatttatgccagaaatgatggataaggtgcgcacattgagaaagaagtacccttcccttgacatagaggttgatggtggtctaggcccttcaaccatagacgtggccgcatctgctggggccaattgcatcgtcgctggaagctctatatttggcgccgcggacccaggagccgtcatatctgtgctgaggaagagcgttgagggctctcagaacaaaaactgattttggtgtttctgctgtatactagttccaccctgcacgtcatatgagttgatcctcacattgccgaaactgttcagcgagaataaaatttgatgttggccttgatgccactatcatgtaacccacacatttcttttccgaaggacacggtaaagctgaacgtcttttacaacacgttttttttgacaaaaaaaaaaaaaaaaaaggccccta

SEQ ID NO: 12140 - DNA, 1024 bp, Sorghum bicolor
  Clone ID: SORBI-28MAY03-CLUS13677_1
cttccgccgagagtaccaacatttctcacattatcctcgcacaaataaaagtggggggaaaaaaattctcgtctccttcccccagcttgccagcagccgaagtcggcgagcgagagccagcagccgaagtcggcaagcgcgagcggcgatgggatcgagcgaggcggagaagccgctgcgtcggatcgcggcgtcgttcgaggagctcgccgccgtcgccaagcagcagcccccggcgtccatggacgcgggggccttttcgcgcgcctgctccaacgtctccgtcctcttcggctgcctcggcatcgccttcaagttcgcggagatggactacgtcgccaaggttgatgatttggtggaggcgtccaagtcaattttgacattgccttctatggttgagctagacattcagactgacactgtcaggaaaccagggagccatacaaggaatctgcttagagtaaagcgtgggattgatatggttaaagtcctctttgagcaaattcttgtcacagagggcaactccttaagggatgcggcatcagtagcttatgctcaggtttttgctcctcaccatggatgggcaataaggaaagcagttgctgctggaatgtacgcccttccctcaaagtcccagctgttgaagaaattgaatgaagatgaggaatcagcgaaggttcaaatgcagaactttgtcaggtcatcagctccagtaatctgctatgttgatgaccttttcacctcaaggaatttgggcatagattggtgaggaaaactatgcatacatttccttgatgtactaatcgagtcagatggtgtgccgtgagctgggctcggaaaacctttttctggattccatgtctccaagttgtaaccaaatctataagtttcggtctaaaactacttagcgatcctattatggagttgttggtgatggttcttgagtacgcatgtgacacatgcatagatgatgagaaaatatacgtgtcggctcatcgaaaaaaaaaaaaaaaaaaggccccta

SEQ ID NO: 12141 - DNA, 621 bp, Sorghum bicolor
  Clone ID: SORBI-28MAY03-CLUS1377_1
cccgaattactttggggagatgttcctttggtggggaatatttgtagcatcaaccccagttctctcagatgctgaatggcttgtgattcttggacctatattcctgactcttctgcttctttttgttagtggaatcccactccttgagtcatctgctgataagcgctatggacgaatggaggaataccgtgtatacaagaacactacaagccctcttatcccattgccaccagccgtgtacggttccctgcctgcatggttcaaggttgccttcctccttgagctccccctctacaatcctgggccaggagctgatccaatcagttgagtgacgcttgcaaaattgttctgctgcccttcagtgataaacatgtatagaatacccctgcgtatatttacggtttgctttgttttgttttgacagaactacggtgagcccattgatgggtcagcctgatatttgtgttgttattgtgtactgggcaattgtttccccttcgattccaagggttgcctacggtctctggcccctccaggactgaacctttgctcctgccatgtatattgttggttaaaagttagaatttcttttgtgccaaaaggcagtaaattcgaagaaac

SEQ ID NO: 12142 - DNA, 1502 bp, Sorghum bicolor
  Clone ID: SORBI-28MAY03-CLUS13799_1
gcacgaggccggggcctcggcgtgcacatcagcttcgtgcgctcggtcaccatggactcctggaccgaggcgcagctccgcaagatggaggccggcggcaacgaccgcctcaacgccttcctcacagcgcgcggggtcaccaaggagacgccccccggcgccaagtacaactccaacgccgccgccgtctaccgcgaccgcatcgccgcgctcgctgagggcaagccgtggaccgacccgcccgtagtcaaggagacgcccggatctggcgcgcccgccgccgctaggaagccgcccgttcacacctccgccgcctccgcctccggaggcggcgggtgggatgactgggacgacgattttcggccggacatgaggcggaatcagtcggtcggatcattcgcggccgcgggagggcagtcagggaggcagccgccgaggtccaaatcaacgcaggacatgtacacgaggcagcagctggaggcgtcggcggctaataaggaggacttcttcgccacacgaggcagcagctggaggtccaaatcaacgcaggacatgccatcccagggcggcaagtacgtcgggttcggatccagcccagcgccgtcggcaaataggaacggcggtgctgcccagggcgatgtcatgcaggtcgtctctcagggatttggacgcctttcattagttgcagcatctgctgcccagtctgctgccagtgttgtccaagtcggcacaaaagaaatccaatcaaagatgagggatgggggctatgaccagaaggtgaatgaaactgtcagtgttgttgccaataaaactgcagagattggaagcaggacctgggggatcatgagaggagttatggcgttggcctcacaaaaggttgaggaatatgccaaggagggaggaatgagtggctggggagatgattggcaacgcagcgagcagaacagtgagccttaccaaaggtttgagcacgagaccaacggcaacagttggaattcctcccaaaattcttcatcgaagaacaacaattccagttcttgggacgattgggacgaccaaggcaagaaggatgagcctgcaaaaccgcaccagagcagtgactcctgggctggctgggatgatgggaaggatgatggttttgatagtcctagttacaacaatcacagcacccccaacaaggggagcaaccagaacgggacaaccggtggcacattttggacggaaggcggcttccgctgaaaccagtctcttttccatagagctatactttcaggagttgttacatgccaggaaatgtgagggtccagtggtcggtattatttgggatactgaaaccgtcgggtgaaagggtttgtgtttttgtaccatgtctacaactgttattatatctagtgagatatatttctgtggtcaatgcccattcgaaactgcccaaatgactaagaaaggccgattggaaactgtaatttacacaactttgtcacatattctttattggtttt

SEQ ID NO: 12143 - DNA, 859 bp, Sorghum bicolor
  Clone ID: SORBI-28MAY03-CLUS16508_1
gttctaatcgcgagcggcgcccttttttttttttttttatgtgtttacccgatattctcattgccaaaacgggaacaaaagcaaagaatgacagaaaaacaaaacagaaaaacaaaaacgttttaattccttcctatacacagacgacgaccctgggcttgttcatgtatggacaattttttttttctgcctttctttttctccttttctttttctctggacacaccaacaaccaccgagtttacatccccccacctgattcattcattattattctcataataaacaaaaaaagaaaataaaacaaataataatgtggacgcggctccctctccagcgccagcccatcttcagttcgttcgtctttcggtatcatggagatcgatcaatcctttccccgtctactggcagcttgcaaatcgcgatcgctgaccaaagagcccggccatctggcacgttgcttctaacaatttacctcaccggagcttgatcttcttcttgtgggcgacgatggcgggaggcttcctgttcggatcggcggtctgggtagccttggtgtcgtccggcgcgaacagcacggcgtcaatgccctgcacggtgttccgcccgccggggtggatgtcccgggcgtaggggtcggcgcagccctcgcccgggccgaacttgacggagccgtcggcctcccgcgccaccaccttgtgcggcaggcgcagcgtgtcgtagcgcaccttgccgaagcggcgcacggcgttgtacatggactcctcggtctggtactccgggatcatgtggtagtagaggatgttctccggcgaccccggctcgctgagctggtccgtggtgaggcgcgccatggcct

SEQ ID NO: 12144 - DNA, 791 bp, Sorghum bicolor
  Clone ID: SORBI-28MAY03-CLUS1647_1
gcccgcctggctccgccgccgcgcgcccatcagcgggagcaccgtgctgccctacttcgcgcccatcgccgaccgcctcggcgcgctcccctacctcggccccttcgccgaccgcacgcggcgtcggggcgcaccaccaccggcctgccgcccactcgtcaacatccccttcgacaaggggcggctgagcaaggaggagctcgagaagatggtgcaggaggcggagaagtacaaggcggaggacgaggagcacaagaagaaggtggacgccaagaactcgctggagaactacgcctacaacatgcgcaacaccatcaaggacgacaagatcgcctccaagctgggcgcggacgacaagaagcgcatcgaggacgccatcgacggcgccatcagctggctcgacagcaaccagctcgcggaggcagacgaattcgaggataagatgaaggagctggagagcatctgcaaccccatcatcgccaagatgtaccagggcgccggcgcggacatgggcggcgccgcgggcatggacgaggacgcaccggccggcggcagcagcggtgctggccccaagatcgaggaggtcgattaagctggccctgcgcatcgaggggattgagatgcgtaatgcttccacctggctctttgttgccgatcgtgtcacttctcacttgcactcgtgtcgtcgtagaagttgaattagttgtttgggagcagcagactttaaggttgagggtggttaaaaactcaatgctgagctttactcagcctttgaatatgattatgcttct

SEQ ID NO: 12145 - DNA, 1262 bp, Sorghum bicolor
  Clone ID: SORBI-28MAY03-CLUS16511_1
ctggcccacttcgttgtgcccctttgccttccgaacacctttgtgataaacctttaggcgcagcagattactttggactctttaaaaaatttcacaccctggcacttgacggtgttccaaagtttgggtctagtaacagaacggcagcttatcggttcgtcacactgattgatgttatgtacgagaacaaagcaaggctgttatgtacagccgaggctggaccagtaggactgtttgagaatatcgtgactgttgctgaagcacagaaggtttcaccaagatcttcacgctcacagaaaagtgacgatcctgacttatgtgtgggtttcgtgacgtcgcaggagaaggggggcatcgtcgctgtcgagccagggagactggccgcgacgaagtggtcagaagcagcggcggccggcgcggtacagctttcttggctggcccgagttgttcgattcctctcctgatttgtggaaagatagttctagtacagagttgtctggaggccccgtcgctctctgtctcctcacgcttgactactcgccggcggcgccaccgtcggaggcagttgccaatcgccgcgtccggtggccgcgttgcagcgcctgggcgtctctttttgtgctgcggcggattgtcgcggcctgcacgcggtgaggccggcatccctcttcggaaggcgtgctcgggcggggccagcccaaccgccgttcgtgggctagagttcctcgctcaggctcataacttcctttggtgtctgcctagaaagtggatcaataatatacatatgggaagtggatgagatcagttgttcggtcacttcgccagctccaacgttgagcccagcaccatgcagagaggcaatttcaagcaaccagattgttcgggcagcagaatgctttaatcatgtgtggtttgacatcccgttcactgagcatgttacgtcgtaatggtgaaattagcagatttgcaagccctggcatggagttgatgaggtccatgttttccactgtagcggctgattcaattaaagatattggaagaggtggtccgatggtggaatatgagattgaggcaacagcagcagctgcccttgcaaggtctagataatggcggtgatgttgtactagcataataagcagaaggcttctgcccctcatatttgaaattcttgtattcacacccacctgtcttacataggcaactgagaagctatgcttttccaacagagatgcatgtaaatgtgcaataaagctatgtaagta

SEQ ID NO: 12146 - DNA, 1589 bp, Sorghum bicolor
  Clone ID: SORBI-28MAY03-CLUS16607_1
gcacgaggctctccctccctccctctctgtccaatctctcgctcgccatggacgctccgaggtccgagcatccgcacgcgtcctgcgcgcgcgctaagtaatcagagaagctgcgagagctcagcttgcccccctgaacaggaggtagctaagctagcagctaagctgtggtgcgtgtagcggcgcagctaggtagcgagcagtgcacgcgcaggtgtgtgctatagctagctagctagctgcttactagagctagcggtagcggtgtagagcagcacagtaggacaggagctagcagctgaagtaaagcgccggtggtaaattaaaaggaaccttttttggacatggcggcggagagagcaccggtgctggtgaggcatgccggcggcggcgtggaggcgctgcggcagctcccgccggggttccggttccgccccacggacgaggagctcgtggtgcagtacctccggcgcaaggccttcggcgtgccgctccccgccgccgtcatccccgtcgtccgcgacctctacagcctcgacccctgggacgtcgtcgtcgtccctggccctggtactgcaccacgccaagccacgacgcttccaacgaacatcgtcgtgtcactaagatcgagaaagaactaaagttgcaatctttttttgctccagatgcgagcagcgagggggagaagtacttcttcgctgtgcggccagcgggcgccggcaagagcggcggtgctagggcgacggcgagcgggcggtggaagccgtcggggaaggagaagccggtggtcctgccccgcccgtgcggcggagggagcctcctggtgggcgtgaagagggcgatgacgttcgtgccccggcggaagaagaaggcggcgtcgtcggcggcggcggccctgacgaccggctgggtcatgcacgagtaccgctcgccgcgccgctgcacaagaacggctgcagcctggctcaagctcaaggagagtgggtcgtctgccgcgtcttccagaagggcagcagcagcagcaggccgagcaggaggcgagcggtgccggccgcccacccccgccgccgtcgccgcgtcgccgtcgtccgctagcagctgcgtcacggacgggtcgagctcggacctggacgaggtcaacagctagctaggggcgggagccaccgaccgtcccagccggccggacagccacacaaacaagtcaagaaaagaacgtatcaccagctcgcagctgccgcgtgctagctgctagctgccggcggccggcttgcctctcaaagagaggctcagctcaagctgagttagcctagccttaattaagcggccggaaaacggaaacggaaaccaaaacgaaaacaaaaaccatccaccggcactaccttaattagttccctcttgcattgcttgctccgacatttgttgtcacttcaattagtttttctcttttcttttcttctttctttatttatttctttttttttcactctctatgtaatgtaatgcagtgtaatttaattagtgagagaagcaagcactactaccggccggattagtagttaacagaaaattactacgtactcaggttcagc

SEQ ID NO: 12147 - DNA, 1146 bp, Sorghum bicolor
  Clone ID: SORBI-28MAY03-CLUS16666_1
gcacgaggagacacctccgccgcgctctcggcctactgcgcggccgcgggaatccccgccatcgtgttcctgccagcggaccggatctcgctgcagcagctcatccagccaatcgccaacggcgccaccgtgctctctctagacactgattttgatggctgcatgcgactcattcgcgaggtgactgcagagctgccaatctaccttgccaattcactcaactcgcttcgcctcgaggggcagaagacagcggccatcgagatattgcagcagttcaattggcaggtgccggattgggtcattgttccaggaggcaatcttgggaatatctatgcattctacaaggggtttgagatgtgccgcgttcttggccttgttgatcgtgtgccacggcttgtctgtgcacaggctgcaaatgcaaatccgttgtaccggtactacaagtcaggctggactgagtttcagccacaagttgctgaaactacatatgcatctgcaatacagattggtgatcctgtatctgttgaccgtgcggtggtcgcgctgaaggctaccaatggtattgtggaggaggctacagaggaggagctaatggatgcgacggctcttgctgaccgcactgggatgtttgcttgcccacatactggggttgcacttgctgctttgtttaagctccgggatcagcgtataattgggcctaatgaccgcactgtggttgttagcacagctcatgggctgaagttcacgcagtcaaagatcgactaccatgacaaaaacatcaaggacatggtttgccagtatgctaatccaccgatcagtgtgaaggctgactttggttctgtgatggatgttctccagaaaaatctcaatggtaagatataaagttatatgttcagttaaccctccaaactgctcttttgttttttcgtcccaggaattctattcctgaatctttttcatctatggttgcctggttggtgaacatgatatggcgcaaagatctatacctaataccttgtagtactaggtctggaggctcttttgaagtgtaggttgaagtggatagagctgttccttgtactttatctgtatcatgtaatatgagtaataaatcatggtctaaatgtttgaataaaaaatcgtttc

SEQ ID NO: 12148 - DNA, 1123 bp, Sorghum bicolor
  Clone ID: SORBI-28MAY03-CLUS14521_1
ccggggttgcttatgatgatgacgaccatgtaaaaaagaaattcggctgggtgcccctgcaacccagtggatttcagtatacaattcaaggcaacctatgaagcagaggtaccactataatgtggctgacgcaaggttagcgcaacatgtggagaaaggaaatgaggatggtttgttgataagttcaatatcatcatgctcaaatctttgggcaatcattatggatgcaggaactggcttctcagctcaagtctatgagctatcttcacactttcttcataaggaatggattatggagcaatgggataaaagttactacatcagttctgttgctggctccaacaatggaagttctattgtagtgatgtcaaaaggcacaccatatacacagcaatcttacaaagtcagtgattcctttccatttaagtggataaacaagaagtggagggaaggttttcatgtgacttcaatggcaacatcaggcaatcgatgggctatagtcatgtcccgcagtgctggtttttctgagcaggttgtggagttggacttcttgtacccaagtgagggcatccatagacgctgggacaatggctttcgtatcactgcaatggctgccacaatggatcagtctgcgctgatcctaagcaagccaaggcgtcgtccgagagacgagacacaagagactctgcggaccacacagtttcccagtcaacatgtcaaggataagtgggccaagaatctctaccttgctgggatatgctatgggcgaaccgtggcctaacatcgtcggttgctgacctagctgttgtttgatgtatatttttgagttttcatcagctgctaccagcatgagccacaggtacaggggagcagtgtcctagtccatgggaagaagatgaatgaattccgatgtatgtacctgaacctgattctaggtttggtctcgtaagttaatcgggagaggtgggtgcagacagaatagcgtagtagctactgatcagccgtaacgtacccgtccgatccaataaaacgagtctgtaatgtggcttttgcagtgcattttctgcatcatgttaaggagaattctgtttttttatccagtgattatgaagagaaaatatag

SEQ ID NO: 12149 - DNA, 883 bp, Sorghum bicolor
  Clone ID: SORBI-28MAY03-CLUS1454_1
ttcggcacgaggctttcccaggcacagatccggctctccgccgccgccatggccgcccgccgcctcctcctgctcctcgccgttgtcgccgcgtccctcctcgccgccgacgcgcggccgtgccacaccttcctcgtcgcctttccggccgatcccaaccccaaccccaaccccagcagaggcgacggcgccgtccaccaccacctcggcatcccccacgtcgccacggtcatcaccgtcttccgcgtccgccgcctcggtccgcaggtcccccacggccaccggaaccaccacctccactccatccccgccaacgtccagatccaccgccccgatctcccgcaccccgccgcgggcgcgggcgcggccgccgggccccaggagcgcgccaggggcatcctcgtggtcgtcgtcgggctcctcttcggcatcgcctgcggcgcgctcaccgctgcctccgcgtacctcgtctggtccatggtcgccggcgccgccgcggcctccccgtacgacgagctctatgacgacgaggacgaggcgtctgacaccgagagccccaagaaggtcggcgacgtcatcatccaggagctcgaggcacgagacggcggtaagaactagtagggctacgtgttgagtgaatcctagtgtctgtatgactgtgatgcgtggttgtgacttgggagccttaggggtttgccctccatgtgaatacgcccgtgagtgaagcatgcctaagctatcaaatgtggtcgttttctgatgaacttatcaatgttatgcaccgttgtgaaatgttcaaatgttcttgtcaaacactgatgtttgatctgctgtctaatgtatgtggcctggcttcgagatcaaaaaaaaaaaaaaaaaaaaa

SEQ ID NO: 12150 - DNA, 1176 bp, Sorghum bicolor
  Clone ID: SORBI-28MAY03-CLUS1467_1
aaaaaggtccaagaagcgccaaagaaaaaggcagcccccacgcgtagaggggaactgctcctgcctccagcctcctgtctctccacaaccagaagcttgattcctcgctcggccatggcttcacccgcggaggagactcccgccgccgaggatacggcgtcgcctccgccgccgccgccggcgaggtcccggggcttctggttccttggggaggacaagtctgtgcacaaggctctcggcgggggtaaaactgctgatgtactgttgtggaaagacaagaagacctctgctgctgtagtcggtggtgcaactatcctatgggttctgttcgaaattgtggaataccatctcctgaccctggtttctcatgtgctgattgttgcactgaccatcttgttcctatggtccaatgccactgtctttatcaaaaagagtcctcctgatgttcctgaagtgcagatatctgaagatcttgctgtgaacattgcgctagcattgcgtgctgacatcaacaaggcacttgccttgcttcgggagattgctctgggccataacctgatgaagttcctaggggtgatcgttgccctttggattctatcagagataggagagctctgtgaactcctgagattcatgtacattgcggtcttgatcctccatacggtgccgatattgtaccacaagtatcaggaccaggtggacgatttcgctgcaaaggcacacagggagctctgcaagcagtacaaggtcctggacgccaaagttctgagcaagattccgagagctacaccaaaagataagaagcagaactagaacaacccacccagaaactcagacctggaggatgacaagcgacttgttttcagcttgggcggcgaaagtttgtattcaatggtctgatgcggttcgtcagtcgtgggctttgtataggtgtacaatttcatgtatatgttctggtcacataaccctatatgtttctaccctcaaaagtgtcgtaaatattccaccagtaattattttgggtcgtggatttaatggccttttggtttaatgtgtatatctagcttacacgagtctcggtggaaagtttggttgtgttatttccaaaattgtcatgtcatatatactgaaatgaaacttctatgaaacatcaatttcaatgcaaaattcctctct

SEQ ID NO: 12151 - DNA, 983 bp, Sorghum bicolor
  Clone ID: SORBI-28MAY03-CLUS14876_1
tctggctgccctctgccttgtgccttgtttatctatacacccaatccaatccaatccaatcctcgagttggtccaagtccaacccaaccaccgtcgtctcgtctgtcctcgtcgcgtaattcagggagctggcggcgtctactgcttctaagctggagagagctgcaccagtgcgcggcgccaccgccggagagggcgacgagataggcatcgatccggggaacgagactccggagcagcgcaacaagttcctcgtcctccgcctctacgaggcgctcaacgcccgggaccacgccgccgtgcagtcgctcctcgcccccgacctcgagtggtggttccatggcccgcccaagcaccagcacatgatgcgcctcctcaccggcggcggcggcagctctggaggcttccgcttcgtcccgcgctccgtcgacgcgctcgtcgcccccacccccaccacctccaccaccgtcatcgccgagggccacgaggggcggtgctactgggtgcacgcctggaccgtgggcgccgatggggtgatcacccagctccgcgagtacttcaacaccgacctcaccgtcacacgcctcgccgccgtcgccgtcgccgcctccgccaagtgcgtgtggcagagccgtcgccccgacagcgccaccaactcgctgccgggcctcctcctcgccctctgatctccaatccatatcagatcagatcagatcagatccatcacccaaagtcgaagtcgtcgtcgtcgtatattattggagtattttggtttgcgcctttttctttttctttcactttaatttcgtcctactatatactagtgagtcgtgagtatccatccccctacgtattgtacccccccgtcgatctatggccacgtcgacgcgttgcttctcgtgtcctcctgctttgttctactgcaacctactactagtattgttctactccaataaaacattatcatcactattgtgttctgt

SEQ ID NO: 12152 - DNA, 1363 bp, Sorghum bicolor
  Clone ID: SORBI-28MAY03-CLUS14969_1
gcacgagggtgcaactaacaggttctcaaaacgagggtgtaagacaagaagctgctggtgctttgtggaacctgtcatttgatgacagaaaccgtgaagccattgctgcagtgggtggtgttgaagctttggttgctctagtgcaacaatgtttgaatgcttcacaaggccttcaggagagagctgctggtgcattatggggattatctgtttcagaagctaatagcattgcaattgggcagggtggtggggttgcacctttgctcacattggcacgctcagaggttgaagatgttcacgagacagctgcaggggcactatggaatcttgctttttattatggtaatgctctccgcatagtcgaagaaggtggggtgcctgttcttgtaaaaatttgctcatcatcagggtccaagatggcacgcttcatgtctgcactagcactagcatatatgtttgacggaagaatggatgaagttgctttggttggagcatcctcggatagcagttccaagagtgttaatgttgagggagctagaagaatagcatttaagcatatagaaacctttgtgcttactttctcagatccacaaatgttctctatggctgctgcctcatcagccccggcagcgctgtctcatgttgctgaagcagtgtttatacacgaagctgggcacctgagatgcagtcgatctgagattggtagatttgttgccatgcttcggaatccttcaccaattctgcgtgcttgtgctgcctttgcccttcttcagttcacaatcccaggaggtcggcatgcggtgcatcacgcaggtctcttgcaggaagcaggagcaggtcgagtgttgcgtgcagcggcggcagcgacaacagcttctattgaagccaaaatttttgccaggattgtcctcaggaacttggagcaccatcagtcagggacgtcaacatgaacacccagcataggtgcatcctccaacaaactaaggcctctgcatcgatgggctgcttggccaatgcagaatgtaccagtttggctttcggggcctttttacatcacaacagttttggtccgtgcagacagtgactgaaggaactccagcgaaggtataactcacaactgtgaagtgactaaacataagtggcagctcttcccgtatcggacgtttaaggttgagttgaattttctagagatcatttgtgtgtacaagtaaaaaaaatagcgtcgatgagaattataaactggcatatagaacttatggatatttattacttgtttgttattgttgaggtgtgtggcggcgtcatgtagaaattggggtattcctcccagcatacatgtaactttataaatgtactgttatgt

SEQ ID NO: 12153 - DNA, 640 bp, Sorghum bicolor
  Clone ID: SORBI-28MAY03-CLUS17118_1
gccggccgggccgggagaccagcaccggccactcgctcgcgaataggcggcctttaaagggcgtccctgcaaaaacggccgggcccggacgcgatcgaattaccctctcggtgtcctccctctcggcggcggcgcagttccccctccatctccggcgcggcacttgacgtctgacctcaacaagcaagcaaatggcaggtggcagggttgcacatgccaccctcaagggcccgagcgtggtgaaggagatcttcattggaatgaccctgggtctgattgcgggaggtatgtggaagatgcaccactggaacgagcagaggaagactagatccttctacgacatgcttgacaagggccagatcagcgttgtcgtcgaggagtagtttcccacatgtcaattctgaagtttttttttccgccagttttcaaaactctctgaagagcatgacaaagtgaatgctgtggagatttgtcttgaaaataagcataaccatttgagaacaccagattttgttgaatttcctttccttgtcatgactatttaagcatgtctatgtcataccaaacattgatctaataaaaaaaaaaaaaaaaaaaaaaaaaaaaaaaaaaaaaggcccctaaaaaaaaaaggccccta

SEQ ID NO: 12154 - DNA, 660 bp, Sorghum bicolor
  Clone ID: SORBI-28MAY03-CLUS17239_1
gccggccgggccggcaacagccgctccaggtccctttcccctcctccaaactgaaacgaagttgcggttgcagctgcggcggccgcaaactgagagcagagatgctgcagttcccggcgctgatgcggcagtggccgtcgccgccgctgatcccggcgtccacgctgctccccgtgccagccacttcacaggaggacgagcttctcctcgccatggccgagtccgacctcgaggataagctgaatgagatccggaagaccaacagccacctggttatcatcgggaagcccacgggcgacaccaaggaggagtacgacgctgaggtggaggacgacgatgcagacaacgtcgaggagtctgacggcgacgacttcgaccaggagaccggttgacccaggcggcttcccccgtgcttcgctggcttcctggagcgtcgccatctccgctgcccagtctgtatttcgcaatccccgagtcgctcctgctatctggatgtattgtgtaaccctattctgctgctgtctgttctcaggatctgagcacttgtcatgtggaccttgtgtatgaaattactagatgattaatcgggtccaatttaaatgctatactagtttgctctatctgaaccagatactgctacttcttgccattttatgggtt

SEQ ID NO: 12155 - DNA, 843 bp, Sorghum bicolor
  Clone ID: SORBI-28MAY03-CLUS17307_1
tgttcgcccattaatgcggtacgtgagctgggttcagaacgtcgtgagacagttcggtccatatccggtgtgggcgttagagcattgagaggacctttccctagtacgagaggaccgggaaggacgcgccggccgggccgggggcaacgctaccacggccaggtcgcaattcgcaacacaaacgccgccgcccaaagagaggagacagaaaacagtcggaggagaagaggaggatgggcttcgagaagcagatcttgagagccgggaccggccccaagccggtaaagggccagaaggtcaccgtccactgcaccggctacgggaaggatcgtgatctatccaagaaattttggagcaccaaggaccctgggcagcagccattcagtttcaacattggtctgggttcagtgatcaaaggatgggatgagggagttatgaccatgcaagtgggtgaagttgctcgtatccagtgcacacctgattatgcttacggagctggcgggttccaagcctggggaattcaaccaaactcagtgctggcgttcgagattgaagtcctcagtgcccagtaattcacagtgtaatagctgatggagccttcgatcagctacggaaacattggccatgcctctgaagtaatgaaataattccgttgtcacctcatgctacatacagcagattggtgtcctgagtgaaatcctgtgaaactttagcactctgtaaccttgatgtcaagtttatggagttccttgtgtgacgactcaaaagttctcgtcaatgactataatccgatggcttccgatgtgatactcgtagccggccgtaataaacttgcaattctgc

SEQ ID NO: 12156 - DNA, 956 bp, Sorghum bicolor
  Clone ID: SORBI-28MAY03-CLUS17329_1
agcggccggggagttgcctcatctagaactagaaaagcagccggccggttgacgggtgccgtctcgcaaaactgcaaccaactaccacagggaggcagccaccggacgatcccacacgccatgatgtgctgcaagatcgtcgccgccctcgcgatggcgctgctgctggtgctcggcacggccgaggcccaggtcctgccgaccccctgctgccgctttgactgctgcgacggcattcggtgctgcgttgccgggacgacctggaacacgctcgccccgtccccgtccccgtccccgtcgcctgctgtggccttcgcccgcagcgacgccaaggcccggcctgggggtgcgtctcgtaagatcgcccctggaaactagtattgtacctctggtactggtaaaaccgtgccgttctttcgttcgtttgagcttatcagtcgaattgcattacccatcatagtttatcagccaaataaacatcgtgtttgcaacttacaaaaattaaaagaaccataaaaaatggcaccaggagcctgctggtgttggcattattttgcctagcaagcttttccgagatgagtttaattcctgtttttgcctaaagcagggatttgacctcttttcactcaaatactgatagtttggctacacaacgctggatagaataattttcagggcagccgaagtagcttctctttcctctatagacttgcaattcttcccgttcttttcatgcagaagcaattgcagaagttatttacatgcacccttttcttgtgagccttgttcattggcacgaggagcctgagactggagctgctcctttttttgtgtgtctgcaggagatgagtttaattcctgtttttgacatcatgagggatttgtcctcttagaactcaaatactgatgctgtggctacacaatgggtggatagaataatatttttggctaatgat

SEQ ID NO: 12157 - DNA, 1040 bp, Sorghum bicolor
  Clone ID: SORBI-28MAY03-CLUS1743_1
gcacgaggcggcactcgcctgagcgggatcctggtggtgaagggcacggcctactccccactacgggaggcccgcgagaacgaggacacgcacggcacgctgctctcccagaacgtcatcggcgtcatccacgaccactacgtgacgttccgcctggacatggacgtcgacggcgccgacaacaactccttcgtgcgcgtggagatggcgcggcaggagacggcccccggcgagtccccccggaggagctacctcaaggccacccggcacgtggcgcggaccgagaaggacgcccaggtgcgcctcaagctctacgatccggccgagttccatgtcgtcaacccgaccaagaagacgcgggtcggcaaccccgttggctacaagctcgtccctgccggcaccgccgccagcttgctggacccggaggatccgccgcagaagaggggtgctttcacaaacaatcagatctgggtgacaccctacaacaagagcgaggaatgggccggtggtctgttcgtgtaccagagcaaaggggaggacacattggctacttggtccgagagagaccgtccgatcgagaacaaggacctggtgctgtggtacacgctggggttccaccacatcccgtgccaggaggacttccccatcatgcccaccgtgtcctcaagcttcgacctcaagcctgtcaacttcttcgagagcaaccccatcctcaagcagaggcccaccaaggaggatgatctgcccatctgttccgccaccgccgtgtaatataatcagcgctgcatgcgacgccatccatggacgacggcggcgatcgatgtttcggtggccatgggcgtgggcgcatatgtatttcctagcctaggagggcgaactgattaactggacccatgcataagcttgcatcgctgtgtgttcttcctagctttagtacgtacctggtgcagccatatctcatctgtgtttgttatgtcaaatcagaactttgatcagctaatgcatggagcatatttggttgttaaaaaaaaaaaaaaaaa

SEQ ID NO: 12158 - DNA, 1011 bp, Sorghum bicolor
  Clone ID: SORBI-28MAY03-CLUS15779_1
cccacgcgtccgcaaaagtctgctgaagatatggaacttgaacaatttcactggtgtcattggagtgttcaattgtcagggagctggacagtgggtttggccagtgaaagaaactgcttatgttcctatcaacgtaaacatcattggtcagctctcaccgtccgatgtagagtctctcgaggagatagctggtgatgattgggatggagagactgcagtatatgctttcggttcatgttctctttcaaggcttcagaagcacaaaagtttggaggtttcattgtctactatggcatgtgagatttacaacatttcaccaataaagattttcagcgaagccgtttggtttgcgcctcttggactgatcgacatgttcaactccggtggtgcacttcacaatgtttcaagtgttgcagattcttcagctacgaccgttcatatcagatgccgaggaccagggtggtttggggcgtattcagccaccaggccagagctttgcagagttgatgaacacgaagtggagttcactcatgcagaggatggcctgctgaccttttatctccccctttcttcctcccaggacaacctgagacacattgaaattgtctacagagctttatgaacgacatttacccttatgattcttacgctcaagcatgcaatttctgccgtgttcttcagtaaccataacacgtgcacattgaggtaatgttccaaagaaacattgttcttgttggatttgattgtgtagcagtatgctgtcctgcaaatatctgttgtatatgattgtcatgccttctgggctgctgtaatgtgatggacatggtatatataaactatgatgaagagagattttggacatggcgccttctcttggacgcggacttggtggacgtgttgcagtaactcaaaagtatcagcaggctcttgaggaatccattgcccagaacttcaaaacaaacaacctaatctgctgcatgagtcacaattcagacagcatctttagtgcct

SEQ ID NO: 12159 - DNA, 1098 bp, Sorghum bicolor
  Clone ID: SORBI-28MAY03-CLUS15898_1
gcacgaggccgactgttcgtgttcgtacttcgcactcggcagaaacctcttgctcttgggggcgaacgcgcctaccgcctccggccgccccctccagccgcgtcaaatccgcaccctcctcggctgcgccggcgatctcccgccgcaagggcgaagccccgtgtccccttctagcggatcccctgcccgccgccatgacggagtattgggtgagccaaggaaacaaatggtgcgacttctgtaagatttatatagcgaacaattccttcagcatcaggacacatgaacttggtaagcgtcacaaggacaatgtcaccaaaagactgtcgacaatgcaaaaggagagtgaggcaaaggaaaaggaacagcagcaagctgcccgagccctacagcagatagaggcaaaagctaaaaagagctatcaaaaagatttagagaataaccagaggaatgttgatggagacacttcagcacctggagatggatgggtatttgactcggcatcaggatattatcatgacaaatctactgggctttactacgattcaaattctggcttctattattctgatagtttaggcaagtgggttactcaagaagaggcgtacaagtctgtgcaaatttccaaaacagacattggtcaatcctcaacttcacaaacaaaagctcctgctgcagaaacagctgttcctgctattaaaggaggtccagctccaggtcgggtagtcacaaaaccattgaacccaatgagacctattaagggcactccagctccatctgctgttgctgttaacaagaggaagagggaggacggcaaacccaaggtgatctccaaggaggaggaagcggccctcaaagcgcgggaagcagcaaggaagagagtggaggatagagagaagcctctgatgggattatacaaaacctactgacatcttgtccttgccaaactactcttcctccatatgggcttgccatttacagtctgatgttgtaaaagaaacaaaaactaacacaatgcatctttctcagaaagaatgccgataatggtgttgcactggattccagagctctttttgcatcagcaatgtgtgtaaaaaa

SEQ ID NO: 12160 - DNA, 1791 bp, Sorghum bicolor
  unsure (1)..(1791): unsure at all n locations
  Clone ID: SORBI-28MAY03-CLUS16066_1
gcacgaggtatccttgtattccttactggagaagaggagattgaggatgcatgtncggaaaatcaataaggaaattaataatatgggagatcaggttggcacagttaaagtcgtgcctttatactctacactgcctccagccatgcagcagaagatttttgaacctgctcctgccccattgaaggaaggaggtcctcctggaaggaaaattgttgtctccacaaacattgctgaaacatccttaactatagatggcatagtttatgtgatagacccagggttttccaaacagaaagtttacaacccaagaataagggtggaatccctcctggtgtcaccaatttctaaggcaagtgctcatcagagagctggtcgtgctggacgaacgcaacctgggaagtgctttaggctatacacagagaagagtttcaatgaggatttgcaaccacagacatacccagaaattcttcggtcgaacctggcaaatacagttctgaccttgaagaaacttggaattgatgatttagtacattttgactttatggatcctccagcgcacgaggctctaatgagggccttagaagttttgaactatttgggtgcactagatgatgaaggtaatctaacacagttaggtgagatgatgagtgagtttcccctggatccacaaatgtcgaagatgcttgtcatcagtccaaagtacaactgttctaacgagatcttatcaatatctgccatgctgtcagtacccaattgcttcctccggcctagggaggctcaaaaggctgctgatgaggcgaaggctcgatttggccatattgatggggaccatctgacgcttctgaatgtataccatgcatacaagcaaaacaatgaagatccccagtggtgttacgagaactttatcaattccagagcacttaagtctgcagacaatgtcagacaacagcttgttcgcatcatgactagattcaacctcaagatgtgcagcacggatttcaatagccgtgagtactatgtcaatataaggaaagccatgcttgcagggtatttcatgcaggtcgctcacctggagcgaactggacattacctgactgtaaaagacaaccaggttgtccatcttcatccctccaattgtatggaccataagccagagtgggtcatctacaatgaatacgtcttgaccaccaggaatttcatccgcacagtcaccgatatcggtggggaatggctaattgatatcgcgccacattactatgatctgagcaatttcccgtcatgtgaggccaagcgtgttcttgagaggctgtataacaagcgggagagggaaagagcttcaaatagaggctgaagttgatactacaaacctggtgaatcataattccacagcaggtctatccagagcccttatacaagctttggttgtcacagatagccaccccatttggcataggcaaaggcgtcaccatgacgtcttctacaccgtattgcctattgtgtttcatcagcatgatcattatgtagacatcctcagaaatcctttagcagctcaattagttgtgatgcagattaattgtgtgccaatctccttgtttttgtatgcatcagaaatttatattttttgtttctatgtggttaactggttatcctttggttggaatgaaaattcactgattttggtttattatcttagctggggttatgtatgcctattatgcctacttccggatgcaagaggaagggttgaacgaggttggcactgaagaaaagtttctgtcccccccatttttt

SEQ ID NO: 12161 - DNA, 1020 bp, Sorghum bicolor
  unsure (1)..(1020): unsure at all n locations
  Clone ID: SORBI-28MAY03-CLUS1628_1
ggacggtggacagcagcagcgaactcgaggccgtcgctccgccacctccgcactcgcctgtcgcctctcctcgctacggagggacgggaccttccgatcgcctccgccatggctggacctggtgttctcaatgagcgtatcctttcttccatgtcccagaaacatgttgctgctcacccatggcatgatttggagataggaccaggggctcctgaagtgttcaattgtgtggttgagattcctagaggcagcaaggttaagtatgagttggacaaggcatctggtctgatcaaggtggaccgtgttctttattcctcagttgtttacccacataactatggtttcattccacgcacactctgtgaggatagcgaccccatggacgtcctcatactgatgcaggaacaagttgtccctgggtgtttcctgcgagctcgtgctattgggctcatgcctatgatcgatcagggcgagaaagatgataagattatagcagtctgtgccgatgaccctgaattccgtcactacacggacatcacggacctccccccgcatcgccttcaagagatccgccgcttttttgaagattataagaagaacgaaaacaaagaggttgcagtgaatgagttcctcccagcaaaagatgccatcaacgcaatcaagtactcgatggacctgtatggctcatacatcattgaaagcctgaggaagtgatttccagctgcttgattgtggatgctacatcattttctcaacagctcatcgagagtaccgtagtacgacatatgttaacacgcacgaactggaatcatgaccaagggggatattaccttttgttcacgttgaaacaatcggcagtggcttctctttccattatatgtcatgtcaaatcaaggcacttggccctgaaatctttgtggtcaagtcaaaccagcactttgacagaacgattgctggatgcctggattactgttacataaatgcccatttgctgtaaaaaaaaaaaaaaaaaaanaaaaa

SEQ ID NO: 12162 - DNA, 563 bp, Sorghum bicolor
  Clone ID: SORBI-28MAY03-CLUS16358_2
ggacgtgcacccaccagagggattatggattggctggggcagaagcgcgctgagatgctgatgcaggtgctgctggtggcgtctgcggtggtggcgttcgtggtgggctacgtgcgcgcggacttccagctcatgctgctcgtctacgccgaatcatgagcggcgccaccaccatgtacttcctatcgctctccaacaccatcaccatcgccggcagcttctacctttacgcctgcatcgccaccgcaaggtggccggccatgtacttcttcctgccggagacgatgggcaagagcctggaggacaccgtgaagctcttcggaaaagacgcggacgacgaggacgtcggcgacgacagccgtcgtcacgtgcccagtaagaagccgtccactgagctgagtgctcagcagtgagtgatgtgccatgtaacgcgtgtccgtacacacgtgtcgtccctagtgtggccgaagcttaggctccgtaaagcttcgatgatatggtgatacagcatatatactactagtactagtattttgcaaaaaaaaaaaaaaaaaaggccccta

SEQ ID NO: 12163 - DNA, 675 bp, Sorghum bicolor
  Clone ID: SORBI-28MAY03-CLUS16358_1
ccccccgggcggcactcgcgtgcgctttcttcctcctcttctcgtggtgaccgccggcgtcgccgctgccgcgctacgtcaggtgccccaggcctcatctccggacccttctccagcgacgtgcacccaccagagggattatggattggctggggcagaagcgcgcggagatgctgatgcaggtgctgctggtggcgtctgcggtggtggcgttcgtggtgggctacgtgcgcgccgacttccagctcatgctgctcgtctacgccggcggcgtcgtgctcacggcgttcgtcaccgtccccaactggcccttcttcaaccgtaacccgctcaagtggctggacgctgctgaggccgagcgccacccgcgcccccaggtcagtgccggcggcgcggcgggagggggtaagaagaagtccgggaagaacaagtaattgatcgatatgtgttctcggtcgatttgactcgacttgtttaagttctattcgctgaactaattgatgataaaagagagattgagatattcccagttttggtacttcgaattgctcagctgtagctggaatttagcttgcaatctttgcatgctagttaccagttatatctgcaatgatgatctaaaaggatggcaatatgcttaaaaatgctcaaaaaaacaaaaaaaaaggcccctaa

SEQ ID NO: 12164 - DNA, 984 bp, Sorghum bicolor
  Clone ID: SORBI-28MAY03-CLUS1648_1
gttaaattcccgggcgaccctgactcctgagctccgccactaatcatcgctatatgctcgtgtgtcttatcgatggctcccgttcagctcgactactctaatctgcttctctctgtcatcctcgcggtttcctgcttcgtcatcgtaagaagcttcaggtcaggccgcaaagatggcagccgagtactgccgccttcccctccggcgctgcccatcatcggcaaccttcaccagctcggccggagccaccaccaccggacactgctggagctagcgcggcgccacggcccgcttttcctcctccacctaggttccgtacccactctcgtggtctcatcggcctccatggccgaggaggtgctcaaggcccaagaccacgtcttctgcagccgcccgcagcagcacacggcgcggcagtccaggacaccaagctgcacggctacgatatcccagccaagacccgggtcctcatcaacgcgtgggcgattggcagagacgaagagtcatgggagaatgcagatacattcaggccagagaggtttgtgcatactacaaactttgactacagtggtaaagacttccgattcatcccgttcggtgctgggaggagaggatgccctggcattggctttgggacgcgcctcgcggagcttgcgctagcaaatttgttgcatcattttgactgggagttaccagatgatcaggaccttgagtcgtttgaagtcgtggagtcgagtggcctttcacctggtcttaagtatcccttgacccttgtatcgaaaacaccgcaagcatgaaccatggggagacacagaacttaccatgtatgagtgtgtgtttgttttgggtaaaaatcaggtctacggtctcctccctataccgtgagaatgatcaagaaaatccttgtaattggggtacttgcatatcagaataagtatgatgtgacgatccagaaggtggaattaagaatttaaccacaactgc

SEQ ID NO: 12165 - DNA, 882 bp, Sorghum bicolor
  Clone ID: SORBI-28MAY03-CLUS1809_1
cccccccacaccctggccggacagctcccccaaccagacaacaggacagataatctctcgtacaattttagagacaaccgaaggcagtaacaactgcatgagatattcctcaaagctgcttttacagcagtaacaacaacacttcaatgtcaaaagatgatccaattgtacattattggtattcagatcattatttgggcccagtccaagcaataacccagaggctatccagctcggtgatacttgacccaacgaaatgtaagaaaacacaaacatttcagcagcttccccacaatgtactcagaagctaggcttgctctttctttggctcccagggctgatacctcgtccagtccctttgccccggattcaaagcatgccccttggagtggtagatcagctcttcaccctcaccggagtagttctgcttgtgctctacaaggtacctagcagtcttctggttcagcagcttatccccagtgctatctgtgacgtggtgcagccatccatgccattcaggaggcacttgggatgcattgtaacgacctttctctgcatattctacccacctatgccttccatactgagtgtcatgtagtttctcatagtatttgtttccaaacttgtcaactcctacaagtgttgcgccaatattgtgaattttcgtttgcaaaaggttcccatccagaaggcatttgaagtatccttcgtcgcgggcatcgcggatgaagttggtgagtcccttctccttgatgcccctcaagacgccgcgcaccaccgccgccatggataccggcggcacgacgactcactcgccggaccggagcgaagaggggggtgcggtggaaactggtggctcctttttcccgggcccgggccggc

SEQ ID NO: 12166 - DNA, 1621 bp, Sorghum bicolor
  Clone ID: SORBI-28MAY03-CLUS1819_1
cgtccgcacaaggcacgaggctcctcttcttgacgaggaaggcagcccgagcgagcgagcgaggcgtgcgtgcgctgcaatggcggactcgtcggcgccgacgagagtgatgatggcggtgaacgagtcgtcgctcaaggggtacccgcacccctccatcagctgccgcaccgccttcgactggacgctctccaagctcgtccgctccaaccccgggggcttccacttcctcttcatccacgttcaggtccccgacgaggacggatttgatgacatggatagcatctatgcttcgccggaggacttccaccaaatgaagcggagagacaagataagagggcttcatttgcttgagtactttgtaaaccaatgccatcagttagggataaaatgcgaggcatggatcagacatggggatccaaaggaggttatctgcagcgaagtgaagagagtccagcctgaccttctagttgtgggaagtaggggccttgggccatttcagagggttttcgtgggcacggtgagcgagttctgcgttaagcatgctgaatgccccgtcatcaccataaaacggaatgctactgaagctcctcaggaccctgtcgatgattgatgctttatacaagccatgtcactggagaatgagatattcttcactgcttataatgggtcaatgtacaaagcacgatatggaagtgcctggaactagttcgcgtagggaacttttgcacagtacgccccaaaactagagtgaagatgaaaacgctatcgttcgcccgagggatgatgagagattgtaccacgtatcatatgtgatacatcaatcaatcgagttgtgaacctaagctgctgctatatgttcatgtgccaggctttgctggaatgaatgccccgccccttatttgcccctgcctgaccacggcttccgcagggtatctgaagcccgcgtactccttgggcacggcgtagcctttgggaatgccaacgagctggtgctgctggtgctgatgctgaagctgatgctggccgtggccctggacctggacctggacctgatgccgacgccccttgttgtcggccttgctgtcgttcttccacgccgcaggcttccccggcgcgaacttgatctcgaagccgtcgtcgatgtcgtggatcatggcgcgagagctcgccatgggcttcatcgtcgggtacttgatctcgaagcccttctccaggtcgccgccaacggcgtcggagccgtagaagtcctggtcggcggacctcttcctggagagccggcggccgcaaagcctgccgacgacgcaggcggccacggcgaggaaggagatcaccgcgagcacggcgaagaccgggccgaacgagcccttggacgccgccgcggtggacgacggctgcgcgcgcaggatggcgttagaggacgcggggtagtacaccgtgggatcaggcaaggaagccatgtcctttgcttctctcagccagctagttccttctctcaagctgctgctgctgctgctgctactactactacccacgctctccctcgaagaaatggtcactcccctgctctctctccctctaagcaatggttcggccgtttgggcctcgcgctcatccagta

SEQ ID NO: 12167 - DNA, 1382 bp, Sorghum bicolor
  Clone ID: SORBI-28MAY03-CLUS18265_1
gcgcggggcgcgggcatccccctgggcggcgggttgcctccgtgcctttccggcgtccgactcgcctggcgtggtcccgtgggggacaaggcgcccgttccctcagagcagcattgaatgtatgagcagaatgctgaagcagaaggatcttgctagcaccaaacaggacatcttggtcccttggtctttgtgaatagagctttccccttttcccttcaccggctgttgccactgcttcgtgacttctccatacaaatatcattgccaccacaaccaccatcaaaactcccattcctggcgtctattcctcatgaatgtgatcatcatgcttatgagccgttgtcatcacggtgtataacaacatttggttcaaaatattgaggtaaggcaaaaatctgcattggggagcacaggatctcacccagtgggtatcttctgttgctgttgcatgatgggtgtgagcaatcacaccattgtcgagggatgtgatgttcttttcttgaatggtttgtacctagggttacagcagtccacctgtgtttcatacatgtgtcttgtgacatttttgtgttgagttgtcagaacacatcctttatgctctctgtaccagaaaactgtcgtgcccctttcatcgtatcttatgcatgctgttccgtcgccggtctggcttggatgatgtggatatgtcaggttcacaattgggtagtcctgctcacgcaggaaggaagaggggatctcctaggactgctgaaagccagcgtgctatagcagagaccaaaacttgtggggaaaaatcaagagggagaaagtgaccaaactctcacagcagcattgaatgtatgagcagaatgctgaagcagaaggttcatccactcatcattcagaaagaaaagatgagttccttgctagcaccaaacaggacatcttggtcccttggtctttgtgaatagagctttccccttttcccttcaccggctgttgtcactgcttcgtgacttctccatacaaatatcattgccaccacaaccaccatcaaaactcccattcctggcatctattcctcatgaatgtgatcatcatgctatgagcctttgtcatcacggtgtataacaacattcggttcaaaatattgaggtgaggcaaaaatctgcactggggagcacaggatctcacccagtgggtatcttctgttgctgttgcatgatgggtgtcagcaatcacaccattgtcgagggatgtgatgttcttttcttgaatggtttgtacctggggttacagcagtccacctgtgtttgatacatctgtcttgtaacattttgtgttgagttgtcagaacacatcctttatgctctctgcaccaaaaaactgtacgtgaccccttc

SEQ ID NO: 12168 - DNA, 591 bp, Sorghum bicolor
  Clone ID: SORBI-28MAY03-CLUS18288_1
gtgcggcgctcgagccggccgggttggggttgacccgccgcctctagccctctacgatacgccccttcccgtctccggaagcttcttccttctcgcctccgacctccgtcatggccggcggcaacctgttcgggcgggcgctgagctacgttgtcaacgagttcctcgtcgagggcctcgccaacaaccgtgcattccagaggtttgctgtgaagaccaacaggactcttgagaacctatcgtctaaagctaaggaagtgacggaggaattatccgagcaattgaaggaagctcgtggcgagaaagatcacttcaagcattgaagctggttcacacatcgattcaacaagatgatgctgacaatcttgctactgagtttttctagtcctcgtctgggtccctatttatgaatatgacatctgaaggaatttttggatgtcattcaattgtggaaccgttgtatagtcttcagtttctctgcacttgattagtagacgcggaacactatctcatgtcccatgtataatgcattttaataagatgtacctgtgtttattttttagttaaaaaaaaaaaaaaaaaagaaaccta

SEQ ID NO: 12169 - DNA, 544 bp, Sorghum bicolor
  Clone ID: LIB5121-003-A1-PF1-F1
ccatcgacccgccgcctctagccctctacgatacgccccttcccgtctccggaagcttcttccttctcgcctccgacctccgtcatggccggcggcaacctgttcgggcgggcgctgagctacgttgtcaacgagttcctcgtcgagggcctcgccaacaaccgtgcattccagaggtttgctgtgaagaccaacaggactcttgagaacctatcgtctaaagctaaggaagtgacggaggaattatccgagcaattgaaggaagctcgtggcgagaaagatgtaagttaaaatataacttatcttttgtagcatacttccgttactatttggttgtggtagttctctgtgctatatatataatacatctgatcagagatctgtttgcagcacttcaagcattgaagctggttcacacatcgattcaacaagatgatgctgacaatcttgctactgagtttttctagtcctcgtctgggcccctatttatgaatatgacatctgaaggaatttttggatgacattcaattgtggaaccgttgca

SEQ ID NO: 12170 - DNA, 1430 bp, Sorghum bicolor
  Clone ID: SORBI-28MAY03-CLUS18529_1
gcacgagggtcactctgtgcccgccaaggttgacgtcgtcgtctctctcttggcggcccgcccgtccgtccccatcccgtcccttgcgtaccccgccaccaaccgctttttgcttgttgctaccccccgcccccctcgagcccccccgccgcccggctcgcccggccgaagcgacgcctcacccgcatcccgctcccccgcgagaagcttctagaaggggggagaccccggcggagccatggcggaggagaaggagtcgacgtcgatcccgctcagccaggcggcggaggccgtcgaccccgaggacccggccaagtcgccgccgcgacccagctcgcccaccacctccacacgcaaggcatgctgtgctgttcttcaaagttgggtctcaagaaaatttatgactggatgcgtagtccttttccctgttgcagtcacattcttcatcacatggtggtttattcaatttgttgatggttttttcagtcccttatatgcaaaatttggagtcgacatattggtcttggttttttgacttctctggtattcatatttctggttggaatatttgtttcttcatgggttggttcaaccatcttctgggtaggagagtggtttataaagaaaatgccatttgtaaggcatctatattcagcgtcaaagcaagtcagcactgcaatttcaccagatcaaaatacaacagctttcaaagaagttgcaataattcgtcatccacgaattggtgaatatgcatttggattcataacatcaacggtggtccttcagactgacaaaggcgatgaagaactgtgtagtgtgtatgtgccaacaaatcatctatacatcggtgacatatttctggtgaactctgaggagattataagacctaatttatccattcgggaaggaattgaaataattgtttcaggaggaatgaccatgcctcaggtgattgcatcactggagcctatgccgcggaaaagccagagcattcgtctaaatagaatgacgtgatgtaacacaaagtcacatgcaacaagatagcatgacctgtggggcacgattcaggtgccttggctgtatgcttaccatgtgatttggatagaggagcaactctgtgccgagccatcgtggcattccaagtgcaggggaagcatcgtgttgatgctctgggatactattgtctcactcttgttgcgctactctttgtgcactgactagtgcttgtccaaaatgttaacgtcaacgcgtgaggtgtgtgagtgattaaattcgtttacaactgtgcgctgtataacatcttacgttataaagggagcacacaacttggaccagatttcttctttcagattaacattcctgtttgttgattttttttatcgtatgtgtctaactgactatgaatcagctttatgcagaaatacattgct

SEQ ID NO: 12171 - DNA, 711 bp, Sorghum bicolor
  Clone ID: SORBI-28MAY03-CLUS17809_1
ctgtgcggcgctcgaggcggccggccgggccgggctcccggaagcaagggccgcttcgtctctcctctccgctgccccctccccttctcgtgcgtgatcctagctagggttcgttcgcctcgtctcgggatggacaagggcaagggcgccgtcgtcgtggccccggcccctgccgctgccgccgggaagaaggccaagcgcttcgatatcaagaagtggaacgccgtctctctctgggcctgggacatcgtggtcgacaactgcgccatctgccgcaaccacatcatggacctctgcatcgagtgccaggcgaaccaggcgagcgcaaccagcgaggagtgcaccgtcgcttggggagtttgcaaccatgcgttccacttccactgtatcagtcgttggctaaagacccgtcaagtgtgccctcttgacaacagtgagtgggagttccagaagtatggtcactagagagtgactttggcgtggagttgcttcatgttcccctcgtagtttagcaccagtggctactgaatactgataacagtctatggatcggtgatgtttctgaagctctaattttggtgtatgccatattcatccttcaggcactgtttgcagtaatactctgtttgcagtaattgaagaatactctgtttgcagtaaaaaaaaaaaaaaaaaaaaaaaaagcaaaaaaaaaaaaaaaaaaggccccta

SEQ ID NO: 12172 - DNA, 840 bp, Sorghum bicolor
  unsure (1)..(840): unsure at all n locations
  Clone ID: LIB5052-011-A1-XP1-A5
gccggccgggttccgnaagatattccctgcccctcgctagtgccttccgcgaaccgaaagctcccgagaccaccgcgatgtccgccatggagaccgacatcaacgcgccgccgccgcccgcccctgccggcgaggggtcatccgcggccggtccgtcctcctccacctcccgcaagcccaacaagcgcttcgagatcaagaagtggaacgccgtcgcgctctgggcatgggatatcgtcgtcgacaactgcgccatctgccgcaaccacatcatggatctatgcatcgagtgccaggcgaaccaagccagcgcgaccagcgaggagtgcaccgtcgcttggggtgtctgtaatcatgcttttcacttccattgcatcagcaggtggcttaagactcgccaagtgtgcccattagacaacagtgagtgggagttccagaaatatggccactagttcctgggcaccctcatgtgatgtttgggcttgcttctggctactgctgccacaaaagtgtttttgtctgccaaacagctccatcttttactgctttgggatgcttgcatgtatcaccggtcaattatcactagtagtacgtccacatgggactctgtttggatgattcgttagaggatagtaggcccactttatcaatgttatgtggatcttcataagtgagcttgaattgtgctgtagtaccattttttaaaatctagtggtttttatccgtgtctgtgttgatcttgacttggaacgcagcgggtttgtctttcggctacatgtataattgtatataagttactgaaatggtgcgtacgatatcctgaaatatggtggggcatcc

SEQ ID NO: 12173 - DNA, 867 bp, Sorghum bicolor
  Clone ID: SORBI-28MAY03-CLUS16755_1
ggagactacacactacattttgggctctgttgctggtccgcacccatacccaatgatggtgagggagttccataaggttattggcaaggagacccggaggcaggccatggacaagtggggtggaaagccggatgtgttggttgcttgcgtcggtggtggatcaaacgctatgggtttattccatgagtttgttgaggatcaagatgtgaggctgattggagtggaggcagctggtcatggtgtagacactgacaagcatgctgctactttgacaaagggcgaagttggagttctccacggatctatgagctacttgctgcaggacgatgatggacaagttattgaaccccactccatcagtgctgggctggactaccctggtgttggacccgagcacagtttcttgaaggacattggacgtgctgaatacgacagcgtgactgatcaggaggcactggatgctttcaagcgtgtctctcgtctggagggcatcatccctgccctggagacctcccatgcgctcgcctacctcgagaagctctgcccgaccctgccagacggcgtgagagtggtggtgaactgcagtggacgaggagacaaggacgtgcacaccgccagcaagtacctggacgtctaaaacacaacataggaggctgaatgaaggttttttccatgtcaatttttgaagggttcagcagtaatttagcgctgttcttttggataaaagtacaaataacctggaagcttgtattgttgtagtaaccggtagggccctttggtttttttgttgttgttgtcctgtatctgagtgatgttggagtgcattatgatcaataaacaaataaataccaagctttctcccttgtt

SEQ ID NO: 12174 - DNA, 1964 bp, Sorghum bicolor
  Clone ID: SORBI-28MAY03-CLUS16917_1
gaccaaggtttcgcacactcaccgacgcacgtgaggcgagaagggaattccaaattcccaaatcccaattccccaaacccccacgtctccctctcgtcgcccccgccatggcagccgccgcctcagcctgcggcggcgccggctgcgggccgcagtgctcctcctctgcaggcggcgagggggatgcttcctcggagagcatgggacgcctttcgatctcctctgccgccgccgccgccgccacgtgcggcaagtgcgacggcggcggcgcggccgtcgcggtggccgggggcgttggcatgtgcgtcgattgctttcgggctcatctcttcgggaagttcaagctcgctgtcacgagcaacgccatggtgcgccccacagacgccgtcctcctcgccttctccggcggtcccgcctccagggtggctctgcaattcatacacgaaatgcagtccaaggcgatccaaagctgggagacgcgcgacgcccaggccctgccggccttcagacttggcgtcgcattcgtcgacgagagtgtcctttcagtgaggccggggcacgaaatcgacacggcgatcgaagatatcaagtcgattgtgtcgagtttgtcaccaggggataagcaattgcacgtcgcccctcttgaggacgtgatctcatctggatcagatgacaaggcggccaggctgaaggagctggtcggcgtgatcaatgatgagacgggtagggacgactttattcggtgcttgcgcatgctttcactgcagaagattgcactggaaaatggctacaccaagattatgctgggaacgtgtgcttctggaatagcatgccatgtgctatccgcaactgtgaaggggcaaggctatgctttaccagctgatgtccagtatgttggcacgcggtgggaagtacccgttgttcttccacttcatgattgcttggcccaagagcttaacttgctctgtgaacttgatagtttgaagacaccgcaacttctcgataggccttgcagtggcatcaatggcttagttgcatcctttgtttcacggctaagggaagagaacccgtcccgagagcataccattttaagaactgcacaaaagcttaagccattctcttttaacaagttctcagcaaacggctaccatgatttcctcccgtcacggcttcgtcccaagtttcagaacattgatgccaacgagtctactttctctgagattctttgcctgatatgtggaagcccgttcagtgaatcagaactgcagaatttggaaaacacaaagcacaaggctcagaagaaaactgatctgtatgctgctcattgttgtcaaagctgccatttccagattctcccagcagctacagatatgcatggacatttcttttcactactaccgaagttttggactgagaaagtggacactgcatctgctagccatagctcactaagagatcagatagcggactacctgctggatgaagacgatgaaaactgacattaatctctgatttcatgacataatttggagtcacaatgtttaattcatatggaatgtctgaatgctggtttataccgacatgttttgtttgttgtacaagaagacaccgcattggcgtcacacaggcatatgccaaacttatggataacagtgtttcttctttttttctcccgacgaaaccaatgttagtatgacactgctctattcagctcctgctattctcagactcatctgacctctgggatctgtatagtgatgaggcaaaccatcacttgccagcaaatttccactgattctataaagacagcacaggttggagagctgaatgtttcccacttacatgtgatctcagatcaattggtctcatctcccgtgctgtgccagctattctgccagcaaacattgtaacacgatgagtttatccagtgatttggacaaatcaaaaaaaaaaaaaggccccta

SEQ ID NO: 12175 - DNA, 997 bp, Sorghum bicolor
  Clone ID: SORBI-28MAY03-CLUS16927_1
gcacgagggaacgcgcggcggatgcagcacggcgccgagcgcatgtgcatgccggcaccgtcggtggagcagttcgtccacgccgtcaagcagaccgtcctcgccaaccggcgctgggtgccgccgcaggggaagggagccctgtacctccgacctctgctcatgggcagcggcccgatccttgggctggctccggcccccgagtacactttcctcgtctacgctgcacccgtcggaaactacttcaaggagggcctggcgcccatcaacctggtggtgcatgacgagttccaccgcgcgatgcccggcgggaccggcggcgtcaagaccatcgccaactacgcgccggtgctgagggcacagacggacgccaagagcaaggggttcacggacgtgctgtacctggactcggtccacaagcgctacctggaggaggtgtcgtcgtgcaacgtgttcgtcgtcaagggcggcgtcgtcgccacgccggccacccagggcaccatcctgccgggcatcacgcgcaagagcgtcatcgagctcgccagggaccgcggatacaaggttgaagaacgcctcgtttccattgacgatctgatgagtgcagacgaggtgttctgcacggggaccgcggtggtggttgctccggtgtccacagttacgtaccgaggcaacaagtacgaattcagaacgggcccggacacggtgtcacaggagctgtacacgactctgacatccattcagatgggcctggccgaggacaacaagggatggacagtagcagtagagtagattacttggtgacagcatttggggattgccatcgccacaacattcgttcgatcctacgctgcgaacagccatcggtattgtcacccggtagaatatactgtatttatacgcaattaattgatcaacacatgtagtgttggagttattgaaaaaaataaataaaccgtgtgttgttggcaactaaaaaaaaaaaaaaaaaaggccccta

SEQ ID NO: 12176 - DNA, 665 bp, Sorghum bicolor
  Clone ID: SORBI-28MAY03-CLUS17072_1
gcacgagggcgagagagcgagagcgagcggctggcggccggtctgagggcgacgccgagcgagaccgtgagagagagagagagcgggcgagagagagagagacaacgagcgagatgcgagagctactagctcctacgagaagtggtagagagaaaaacagctgctggcggccggtctgaagacgacgccgatcgagaccatgaagagcagcacgctcctgctggtgatcctgtgcctccaggccgctctggtcatggggatcttcgccgctgtggctaaagaaaatgccgtgggcgagagcaaggccatcgacatcaacccggggcagctcaagtgctgcaccaactgcaacttctcattctcggggctctacacctgcgacgacgtcaagaagaactgcgaccccgtctgcaagaagtgcgtcgccgtgcagacgtactcgggcaagatgttcaagtgcaccgacaccttcctcggcatgtgcggcccaaactgctagaagatttgctgcttgtggtttactactgtgtgtcattgtgcttctgggtttgtgtgttcgattcttgttctcgatggacgttgcacgccaacaataaaccgttgtttgcaataaataaataaataaaataaagttgttgaaaaaaaaaaaaaaaaaaaggccccta

SEQ ID NO: 12177 - DNA, 748 bp, Sorghum bicolor
  Clone ID: SORBI-28MAY03-CLUS17100_1
gcggcgccggcccggcgggccataggaaggaaatccaagcttctggcctgttcttgccagcagaaacaaagatgaggcctctggtgatactcgccgccgttactctggttgctctcggcgtcctcgcaactctgcctctcggcgaaggctcgtcgtggccgtgctgcgacaactgcggtgtttgcaacagaaagctcccgccggattgcaagtgcaatgacgtctcggtgcaggggtgccacccggagtgcaagaactgcgtcaaggtcggtgccgggattcgtcccggcggcggccacggccccgtcgtcacctaccgctgcgatgacatactcacaaacttctgcgagcaccgctgcacggcggcaccaccgccggaggcggcggcgttcctgggtgatggcttctgatggcaatctgctgcaagcatccatatggcaagtcgagtttgcttctctcagcttcgtctgagagaagaaatagaataaatgtcaccgctcagcttgatgtttgctattgtacgtcgtcagtgtattattagtactgtttctggaataattaagagccattcatgatgcttgttatatgcaaaaaaaaaaaaaaaaatgtcgactcatgacaataacttaaaaaaaaaaaaaaggcccctatgcccacatcttgctgaaaattgattgatgtttatgcttatttcattaaaaatttagttttatgctgatttattgtgagctgaaaacaaatcaggaag

SEQ ID NO: 12178 - DNA, 1058 bp, Sorghum bicolor
  unsure (1)..(1058): unsure at all n locations
  Clone ID: SORBI-28MAY03-CLUS1960_1
cgtgtgccagtgtgcaccataatgcaaatgcaataaatcgatggaaccgaaatcttttgtttattggaggaaatagagatgaggagtgtctgcaagacatggagggtgatgagtgggatggataatctattgaggctcatacatctacctgctcatgtgcgccccatcgagttgataataatagcgttgggataacagggttagcgttcgctcgcgtgagtgagctgcttgtatcttacaatgaagagaatatttacctattccctaaaaatggagggctgggatctgaccccaaaaaatctgttaagataggagcaaatgaagggtgcaaatcaacaacgttagcatctggacatgatgtttctcaacctgcacctcaggtatatgtcggtcatcgcaactgtgaaaccgtgaagcgtgtgagtttcattgggccaaatgatgaatatgttgccagtgggtcagattgtggtcggatgtttatttggagaaagagagatgggaagtttctacgagccatggagggtgatgagtgcattgtgaattgcattgagcctcatcctcatgctatgacaattgcgagctgtggaattgataatgatgtcaaagtttggactccctctgcaattgagcgggcacctgtggtaaatgttgatgagctccagtcgagacctcgcaagagaagagccaagttctggcgctttgacttaccagatctgttgatccaacacatactggtatcagaacataggcagcgatcagctgaagaagattcatcagaggaccatgaggacaatacaggattacttaatctagtgctacgggctgcagttggaggtgtgtcatctgatgatgatggtgatgacgatgatgatgatgagacctctgatggctctgaatagtgttgactcaaacgatctgttgtctacctttcagtaccgtttcaaaattgtaaatatatacgttaataagtcatcacattctcatggatgatataacagaacaactatttttagtagcttgtcatttnctatgttataagtatgtttttaggggct

SEQ ID NO: 12179 - DNA, 1018 bp, Sorghum bicolor
  Clone ID: SORBI-28MAY03-CLUS1961_1
cgtccgatattcctgagcttaaccctgaagtggatgtttatcgcataggaacccttatggaacttgtaagagaactttctctatcctttgctgacgatggaaaacgtgtcaagtcacttgatagcaggtctgtgttcaaggctccatggggcaaggtgcatttgctggcatcccactccaactggcaggaatcagaaaaattttggaattcatggactggggtgactatggggcaaagggcaccttcattaatattggggcactaggtgctagtgaggttgacaaagaagatgatatgtttgtcctcattgctccgcaaaatgctgttggaaactgcataattgatgatatgagagctatgactgatgctgctggtgacaggcctgtgattcttgtaaatcctcgcctaaaggatatgcctggatcaagtggtgtgatgcaaacaatgggaagggatattaggctgaagtatgctgcatcattcgagacgtgctattcattccggcttctctactatgctggttcattctatcctattatgggagctttaaggatgtcttatccaaatagatatgagatttatcgaagggttgacgagctcaatgggaaagagaagtatattcttatagccgaattcacgaacaagccaactcctgatgatattacctgcgctttcacaggacggaaaaaggaagaagaaaagacaccttctggattctggggtttcttaaatggtatattttaaggcaagcgatctactgtatgacgatgcaatccttcttggtatattttatcaggttaaaacagaagaatcaaatttagaaagttttctatttgcaagatgatatatcacttatgaaaagctctgattcgttggtttagcatgtgtttgccccattctgcctttgtttagtgcagcgcctatttcccccattccttagattctccaccatatctatatactgatttaatgcttgaaatgcttattggagttataaaaggttctgctgagactttt

SEQ ID NO: 12180 - DNA, 1129 bp, Sorghum bicolor
  Clone ID: SORBI-28MAY03-CLUS20079_1
gccggccgctgatcgctctgatcctctctgccagcaccctgcgcatctggagctgctgttctaaacccccaaaccctaacggcctagcctctgcgccgccggcgccgccaccgccggagccgcagccatgaacgccttccggttcctcggggacatgacccacctcttctcggtcctcgtcctcctcctcaagatctacgccaccaagtcctgctcaggggtgtcgaggaagacgcaggagctgtacatgttggtgttcgtcgcgaggtacctggacctcttcacggactacgtctcgctctacaactcggtgatgaaggtggtgttcatcaccagctcggtggcgatcgtgtggtgcatgcgccgccacccgcaggtgcggaggacgtacgacaaggagcaggataccttccgccatgcggtgctcgtcgccgcatcattcctgctcgcgctgatgttccacgagcgattcaccttccgcgagatatgctgggcattttcaatctatctcgaggcagtggccattctcccacagttagtgttgctccagagaagcagaaatgtggataacttaactggacaatatgttttcttccttggggcctaccgtgcattttacattctaaactggatttaccgttatttcacggagggtcatcacagcagatggatcccttggcttgctggtttggtgcagacagctctgtatgcagatttcttttactattatttcttaagttggaagaacaatgttaagctcgagttgcctgcatgagcatgcttcgctgtgccagaaagtgtgcatgctgcgtgactcaagttttctagaaattagttgattgtatgggcatggagagacttggtaatgatgtgagcagttgcagttgataccatacccttgatcttgcctgcgaaaattgatatttgtgtttcccatggcgaagtcgatacgattccaaagctaacagatgctgctgcacagaagtagactagttcctttttgtacctcaatatttttgatatggaaaatcacatacagttcagttggtctgttgtttaacatgctatttcacttgttgtgaacaaaaaatgttatactaatttccctgtgttattgggagtttttttt

SEQ ID NO: 12181 - DNA, 1117 bp, Sorghum bicolor
  Clone ID: SORBI-28MAY03-CLUS20277_1
gccggccgggtcccggccccacgttccacgcacagaacagttggaagcggaacttgatgcactgctcggaaacccattcaaatcctccgaggaaaatccgacaagtccgcggcgagcagggcacggcgccggtcgaccggatctagggtgaggtgagggtccgtggccgaagaagctcgcaggctgtcgcgaggaggcggaggagatggcctcggaggagatgaaggcgacggaggtggcggcgctgctggatctgaagccgcacccggagggcggcttctacgccgagaccttccgcgacggctccgtcacgctcaccacctcccagctcccgccccactacaaggttgaccgtgctgttagcactgcaatctacttcttacttcctgcagggagtgtttcacgtctccaccgcattccctgtgctgaaacctggcacttctacaagggagagcctctcacggtctttgagcttcacgacgatggtcacattgaccttactgtcattggcccacacctcgaggctgggcagcgcccccagtatacggtgccaccgaacgtgtggtttggctccttccccacactagacgtcgagtcgttcgcgtctgacggcagcgttctcgtcaaatctcgaaagagggaccccgagctgcactactcccttgttggctgcacctgtgcccctggcttccaatacgaggactttgaaatggccaaatttgaggacgtgagttccattgctcccaaggctgaacccttcctcaagttcctcattccctctaccgagtaactcctgagcggcctcagatgattctggatgggttcttagattctctgtactgcctacagtacggatgatgtttttagtgtggttccatgagggttctgcttttacaatcgtgtagacagtaaactgtatctatatgttgtggtacagattgaacatttggtgcattgaaacagaataacagctgggcttgatgttgaaactggaggtgcttttgcaaaactctgaaactgtcgctcgatgctaggagagcatcgtaggatcttgtaaggtttcacatggttaaaatctggccatcgatcgtgcagagctaaaaaaaaaaaaaaaaaa

SEQ ID NO: 12182 - DNA, 887 bp, Sorghum bicolor
  Clone ID: SORBI-28MAY03-CLUS20870_1
ccggagcccgtacatactaaatgacgctgtaacgctgtcccctccagtaccaccagtcggtactcgagtccgtcagtcagcagcgtgaagacacaaacatctcgtaataagcaagaagttcacaagaggaagaaaggggaaaagagaaatgagctaccagaaagtccctcccgaggaaccctaccctcctccagggtatcctcggccaccaccaccagatgtgtaccctcctcccccttggggccatggacatccaccacctccgccaccgccgcaggggccttattaccccccacctcagcaccctccaccggggtaccagggctacttcaacgacccgccgccgcatggagagtatcagcagcagcaccaccacaaccatggaaaccagggtagctctagctcttctgggttcctcaaaggatgtttggccgctctctgctgctgctgcgtgctggaggaatgctgcggctgcttctgagatgctagatatccgctaattgggtcctacgctattgttgctagcgtttggagcatccgagtattaagatatagtaactgtgcttgtaaagaatctggagcagcagtgtgttcttgagcttccagtccagcattctattttcagacagatcacatataacttgtagtatgtgttatgccttattatccgaaaataaaggatgctattcatgggattgtaaaaaaaaaaaaaaaaaagctcgcccagagaacacctgtcatatacccctggtcggtggacagtggtcactgtgttaagtgtaagtttacaatctgtttactgacatcaataaaacaagggagtccgtaagcatcacggttttcgtggtgtagttggttaagaaaaaaaaaaaaaaaaaaggccccta

SEQ ID NO: 12183 - DNA, 976 bp, Sorghum bicolor
  Clone ID: SORBI-28MAY03-CLUS17474_1
gccggccgggccgggcccactcctacagcgctgctcctcctcctaccagtgtctcccaagtcccaacgacgcgaacgcgattggcgattccatttccaccccgagacctccagccgtccgtcccctgaaccctcaaccttcgccgcccccgcctcggcactcggcggccgccggcacgcaccgcggagtctcgagacaggaaccggaggagcgaagcgatggaggaggactcgccgctgacgaagacggtgaagggcgcggtgacggggctcgccgcggggaccatctggggcaccgtcgtcgccacctggtacgacgtgccccgggtggagcgccacgtcgcgctcccgggcctcatccgaacgctcaagatgtgcggcacctacggggccaccttcgccaccatcggaggcctctacatcggcgtcgagcagctcgtgcagagccagcgcaagaagcgcgacttcgtcaacggggccgtcggcgcgttcgtcgccggagcctctgtctgcggttacagaggaaagagtattcagtcagccctcatcggaggctcctgcctggccttcacatctgctgtgctggacattggtggcaatacgaccagagtggacaacggcaaagagtactatgcctacacaactgagaagaagcctgcaaattgattttaagtctgtgtttgtagcaagcaatcttgcaagtcatcaactcagggaatttgaagctgatgtgcagttttattatctcagttttgctgatgcagttagttcctaagcaaatccatggcaactttatcactgatgcttgagagggatgggaatgatactcagaataaatctttggtttgctttcttgtgatcgttgatcacaataaacgcagtggcacgatatactgtgtaattgtctattttcccctggtagaacatgaaatgctgaagttcctcttttgtgatatataaagcctcagggtcctgca

SEQ ID NO: 12184 - DNA, 1197 bp, Sorghum bicolor
  Clone ID: SORBI-28MAY03-CLUS17650_1
gccggccgggccggggtgttcttgttcgtctcgtctcctcccctcgcctcaggcccctcacctctcacatacacctcgctcgctcgctcgctcccgctcccgcatcgcggtttccttttcgaagccttgctaggtttagagttgggggcctccgtctaccccgtcaatggctcctgaggcggctgtacttcagaggtgaggtgaggtgaggtgaggcgaggcgtgggggcgcgcgtggttggttggttcgaggaggcggggatggacccggacttctcgcgggcgagtggggggccgagctttgagttcgccttcaactcggtcaacttctccgaccgggtgttgcggatcgagatcgtcgctggggatgacgccctcggggccaagggcgccgccggcgaggggtgctcgtcgcttgccgactgggcgcgccaccgcaagcggcgacgggaggagctccgacgcggcaaagaatctggaaaatacatgccagacccaggaaactgcaaagttgaagctgaagaatgtgatgcctacgaggaaggcaatgagcctgtagctatgatagaagaatctccacctgatattgagccagatggtgaggatggagaaagcagcgactcatcctggagtatggagtgtactcaggttttgagagtaaagtctatctacatcagctctgcaattctagctgcaaagagccctttcttttacaagcttttttcaaatggaatgaaagaatccgatcagaggcatgcaactcttagaataactgcttcagaggaaaatgcgctgatggagcttctaagctttatgtatagtggcaagttgacgacaaaccagccaactgccctgctggatatattgatggtcgctgacaaatttgaggttgtttcctgtatgcggcactgcagtcaattgcttagaagtttgcctatgaccacagagtctgcactgctctatctggatctaccctcaagcatttcaatggctgctgcagttcagccactgacagacaccgccaaggaattccttgccaataaatacaaggatttgacgaagttccaagatgaagcaatgaacattcctcttgctggaattgaagccatcctatggagtaacgaccttcaggttgcatcagaggatgctatctacgactttgtgataaagtgggcacgtgctcaatacccaaaattg

SEQ ID NO: 12185 - DNA, 1350 bp, Sorghum bicolor
  Clone ID: SORBI-28MAY03-CLUS17698_1
accaacctcgaaagattcccaaagctgctgaccatccagaaaaccaagccagctggctcctctcctctctctctctctctctctctctctcccctcgccaccgtcgccatgacccgccgcgtcctccccttgctcctgctgctggcgctgctcccctccctagcgccgcctggtgcgtctgcacgcccgggcgcggggcaggatttgggacatcagtgtccggtgctggagcacgggctcccgccgttcgccgccgcgctccgggcaagctgccccgtctcgacggaggggtactcgccccccgaggaggttgttaatggggaggaacttcttaggatgttggatagcaaggaagagcacacagctgtccttttctatgcatcatggtgccctttctcgcaaagaatcagaccagtctttgatgatctgagctcaatgtttccacgggttaagcacgtggctgttgaagagtccaacatcgtgaaagccattttgtcgagatatcatgtccgtgcactaccttccataataatagctcgcagctcatacgtattctggcctcttggttcaaaagatctcgactccctggtcaacctttacactactgctacgggtcaagaaccagtcgcatatattggtactcggaagtggagcgcagcgcgaagtacagactatgctaagatttggaacagctctattagtgaaacagtgaagcgagaaccctacctagcattcagtatcctgtttatttgcctgaggatattctttttcttcttcccaaagttctttgctctcatccaagacttctggaccgaatactacgagcaaagcaccttggaatcctcgccaaattgacccatgctgtggatgtgaggaaggtgtggagcaagctgaggctcatggttggagctaagaatggtaggatctgggcatctctagcttcggtgtcgcttggtgggcaaccttctccgcgagttgctgttggactgatgggctcgaccatctgacagcaacaaaaacaagagaacgtgctgattcattgaattgcacttgacgaagtagctcctgtaaggctgtaactcacatgagcatattgagacagataaggtctctggctctcgtgctcagaaacatacatcctgtttgtagcatgtaaatcttagggataccgtggagcctctgtaaatcatattgtaacattagtcgtcagtgcccccatcaggcaggctgcctttggcaatgaaaatgcagcacaagtttctcctttccctccccagaatacatggtcaaatgcgcagttttatcatgtaatctgcaatggttaatggacatccttcattgatcagtgtc

SEQ ID NO: 12186 - DNA, 1351 bp, Sorghum bicolor
  Clone ID: SORBI-28MAY03-CLUS17798_1
gccggccgggccgggccttactttctcccaatgccttcgtcaatcctacttccacagcttctgaaatcaagaaggaaacacagaaaggacgggcaattcgagggaggaatctgccatcccgtctcaccgttctcccaatctgagagcgttcccaggacctagggttcatgagatccagccccaggatggacccgaaccccagagctcccctcctcctcgccatcatcgtcctcgcgctcggcgcatccgtggctgccggcgccaaggacgacgcgtcgggggtctccctgggccgccgcgccgggggcttcttgcatggcctgaagaagaaggacgcactggtggagggcgatcatggggtggcccttgacgaggttggaccggggctgttcgatgcgctcttcgccagcctctccatgatactagtcagtgagattggagatgagacctttatcattgctgcgctgatggcgatgcggcatcccaagtcaattgtgttgtctggtgcactatctgcgctatacgtgatgacggtattgtcaactggacttggtagaatagtgcccaacttgatatcaaggaagcacactaatagtgctgctacagttttgtacttgttctttggactacggttactctatattgcttggaaatctgacccaaagggatcccagaagaaggaaatggaagaattagaagagaagcttgagtctggtcaaggaaaatcaaccatccgtaggttctttgcaagattttgtacaccaatctttttggaggctttcatcttaaccttcttagctgaatggggtgaccgaagccaaatagcaacaattgcgctggcaacacacaagaatgcaattggagttgcagtcggagcatcactggggcacacattgtgcacatctcttgctgtggtaggagggagcatgttggcatcaaagatttcgcagcgaacagtagcgacaattggaggtgttctcttcttaggattttctgtttcatcctacttctaccccccgttgtgatgaaaaggtactagcagctacttccacttggatggtagtcttgaactgtttcatgtcctgctgtatgaaacatagcaacttcccgtacgttggtgattgaaacaaagatgatgaagtaacccaaatcattccagtatgcctcgagtcgcgggctccatgtaatgtacagacacattcctgacaacaatgttctctgccatgctgccttcagtcctatgtagaagctgtctcattgatagcatggccaattttttattgcttgtatccaaagtataacatactatacgctgctctgatctcttctccaagaaaaagtttccctatca

SEQ ID NO: 12187 - DNA, 811 bp, Sorghum bicolor
  Clone ID: SORBI-28MAY03-CLUS17874_1
gccggccgggccgggaataagccgctcgaaccgcctggcacccgtcggccagatcagccttcaaactagggtttactcctcccgctccgagaaagcaaacaagcgtccgctccgccggctgcctccgcgctttcgccccgccgccgctccttccctacgccttgcccgccaagatgaagctcgtcaggttccttatgaagctgaacaatgagacggtcaccatcgagctcaagaacggcacggttgtacacggcaccatcaccggtgttgatataagcatgaacactcatctgaagacagtgaagcttacactgaaagggaagaaccctgtaacacttgaccacctcagcgtgcgaggaaacaacattcgctattacattcttcctgacagcctgaacttggaaactttgctggtagaggaaacccctaaggtcaagcctaagaagccaactacaggaaagcctttggggcgtggtcgcggccgtggtcgtggacgtggtcggggccgggggccacgctgagctttactgttccctgctgtcggttctcttgcctgatgagtttcccgtacgatgtaacctctttcccctgcacgctttgtgaaagaatgttgcattgttacccttccgatgaacgcggatgaaatatctcatctcagtagttcttgttgtggagctcaccctgtctatttggcgtatcattcatgtcttaggcttacattgtagttaattcgtaatgtctttcccctgacatacatatgagatgccgcagaactttggatatctaaggttgtatgcttgtgttttcacat

SEQ ID NO: 12188 - DNA, 688 bp, Sorghum bicolor
  Clone ID: SORBI-28MAY03-CLUS2217_1
ggacctctccagcatcgagccagggaccacagtgaccgtgaagtggcgtggaaaaccagtcttcatcagacgccggacggaggacgacatcaagcttgccaacagtgtggacgtggcatccctgcgccacccagagcaggacgcagagcgtgtgaagaaccctgagtggctggtggtcattggcgtgtgcactcacctcggctgcatcccactgccgaacgcaggagacttcggtggctggttctgcccatgccacggttcccactatgacatttccgggaggatccgcaagggccctgcgccgttcaacctcgaggtcccgacctacagtttcttggaggagaacaaactgctcataggctaagatctggaaaaccacctgtctatttatctacttcactcaggtgaacccctgctgtgctgttatattgttccttctttttatggtttggctaaaaatttttttgcatcacgaggatcattgccatgccttgatggtcgactgttatctgccaaagtgcattttccaagtacaaaataatgtgatactgtgctgctactgaatgtaagttggaagtcatttgggacttcatttttctgggataccataggaaagatatggattattacatctttgtggcacatcctcgtgtgaagaataagcagttaccattattttttccccaaa

SEQ ID NO: 12189 - DNA, 803 bp, Sorghum bicolor
  Clone ID: SORBI-28MAY03-CLUS22524_1
gttcgacgagaactacccgcaatcaagtccccattcactcgcctgcgcttcctctcctcgccgcgccgcccggctgccccccaccccacccttcctgcacgcaaggccatggctccgatcgctgtcggcgactccctccccgacggccagctcgggtggttcgacgagaacgaccagctgcagcaggtctccgtccacgcgctcgccgccggcaagaaggtcatcctcttcggcgtccccggcgccttcaccccgacctgcagcaaccagcatgtgccaggcttcattacacaggctgagcagctcaaagccaagggtgtagacgagatcctgcttatcagcgtaaacgacccatttgtcatgaaggcatgggcaaagacttaccctgagaacaaacatgtgaagttccttgctgacgggtctggagcatacaccaaggcactcgatcttgagcttgatcttacagagaaaggactgggtgtccgctccaaaaggtttgctcttctggcagacgacctcaaggtcactgtcgcaaacatcgaggaaggtggacagttcacaatctctggtgctgaggagatcctgaaagcgctttaggagtttgatctcttctatcaaaaagctcggcaatgttgtggacaccagtctaatttgaactttgaactcatctttgaataacttgccgtcggacaagatcagttccatgatgtatatgaaacggtcgtcgttgagtcatgcacaatttggtattttcatatgttatattcgccggttcgaggaaaaaaaaaaaaaaaaggccccta

SEQ ID NO: 12190 - DNA, 1197 bp, Sorghum bicolor
  Clone ID: SORBI-28MAY03-CLUS21501_1
gcacgaggggaggttccaatatactacaactcaagaagggtggaaggacaggagatggcaaaggataggaatggtgatccagtgacaggttatgtgaggatatcacaccaggtttacaatgtcaccaaggactatgagagactcagagatgctgtcaataaacttgtttctgaagggttcaccagcatcaacttgcggccttctgagaagccaggtatcatccacctgaaggcgctgtggccaactacttaagtgtggatcggaccagcgcagccagtactgctgcttcgtgatcgtgacgtagttcctggcatagccagccagttgatggatgtagtgtacctccaggaactgacatgtgttgtatttggcgttcagtgtatgtaacaataatgccctggcatgtcgtcttccctcttcaccaacattttgggagttgctgtcacctgagagttatcgggatgggtgggttgcttccgctgccgtggggcacttttcttggcacacctccggaactgtgtggtagcatggttatggtcgggatgcctggttgccttggtgtcgagagtgatgatgatgcattgagagtgagaactatgttgaggaaggatttccaggtggaggttccaatatactacaactcaagaagggtggaaggacaggagatggcaaaggataggaatggtgatccagtgacaggttatgtgaggatatcacaccaggtttacaatgtcaccaaggactatgagagactcagagatgctgtcaataaacttgtttctgaagggttcaccagcatcaacttgcggccttctgagaagcaagaggcttaggtgtaatgatcttccagccaggtatcatccacctgaaggcgctgtggccaactacttaagtgtggatcggaccagcgcagccagtactgctgcttcgtgatcgtgacgtagttcctggcatagccagccagttgatggatgtagtgtacctccaggaactgacatgtgttgtatttggcgttcagtgtatgtaacaataatgccctggcatgtcgtcttccctcttcaccaacattttgggagttgctgtaacctaagaataatctgaatgtaaggatatttacagctgctgtacatcgattgttggttactgataactgatcacattgatcattaatacagtacatcaaagtggcggtggatt

SEQ ID NO: 12191 - DNA, 533 bp, Sorghum bicolor
  unsure (1)..(533): unsure at all n locations
  Clone ID: LIB5048-012-R1-XP1-D8
tggtcgcacagtgacaggttatgtgaggatatcacaccaggtttacaatgtcaccaaggactatgagagactcagagatgctgtcaataaacttgtttctgaagggttcaccagcgtcaacttgcggccttctgagaagcaagaggcttaggtgtaatgatcttccagccaggtatcatccacctgaaggcgctgtggccaactacttaagtgtggatcggaccagcgcagccagtactgctgcttcgtgatcgtgacgtagttcctggcatagccagccagttgatggatgtagtgtacctccaggaactgacatgtgttgtatttggcgttcagtgtatgtaacaataatgccctggcatgtcgtcttccctcttcaccaacattttgggagttgctgtaacctaagaataatctgaatgtaaggatatttacagctgctgtaaaaaaaaaaaaaaaaaaaaaaaaaaaaaaaaaaaaaaaaacccaaaaaaaaaaaaaaaaannnccctaanncccccncccgctccaaa

SEQ ID NO: 12192 - DNA, 853 bp, Sorghum bicolor
  Clone ID: SORBI-28MAY03-CLUS22731_1
ccgggatcgtccccaaccacgcgcgacactggtagtacagcggcagctgcgaggagtgcgagcgcgtgaagcagcaggaagaccggcaagaagccgatggcggttgtgagcggcagcggcggcgggaggctgaacccctgggcggagcccttcgtgccttccggggtgcggtaccgcggcctgatgcagacgcccgagcagcaggaggtggaggacttctcccccgagtggtggcgcctggtctccgcctccccggccttccgcgaccgctggctccgcgagtacggcgcgctcggcctgctcgacgccgaggaggacctggacgacgccgaggtcgacggcttcctccccgacgacttcttctccgctccggccccgcgccaagagagcgagcgggagggcggcgtggccggggctggtaagaaggtcggcggaggcctcgaggtggcggcgtgggggatcgacaagtggtggcgggcgcacggtgggccgccggaggccccgaggtacgcggagaaggcgccgcggagggtggcggccggcgccagggtgagcccccgccccatccagcagccgcgctgaagtacccgatccgttcccgcgcacgcgtccatccgccgacggctgctcggtgccagatcttggcacaggaaaaactaggcacccccaaaaaaaaaaggtttccttttccaatcttgcaatttgctttggtgtgttcgtcttgcgcagtttctggatctggactctgcttcagctcgagatcgaatgggaagatcctctgctgcgttgtctgtgctcatccctgtactgtgtaaatatgataacaataacatgcagccagacttttgccctc

SEQ ID NO: 12193 - DNA, 622 bp, Sorghum bicolor
  Clone ID: SORBI-28MAY03-CLUS23048_1
gactttgactacaaggagtatgcggggcagagattcgagcagtactggcagaagaagtctgcaatcttaacatcttgaacatgtgtataaacacccgtggcctcaggagctccctgagggcctgtgctgcacacagaaagttgtgcaatgtcactgacacagagagaagctgtgaaagaagcaacactgacgacaacgatgaataatcccgttttgggatcgggaagttatttctccgcaactcaatgagctccagccttcaggcttcagcttcagaaatgaagaagctatggggatttggctgtccgtttatagtacgagggcaattaagataaagatccagtccggggttgcgtgttgtatgtttagtttggctagcactgccgagagccgtggtgctgttgtggtgtccatagtttctatatgcttgatgttaatgtgctggagaatttggctttgtgcttgaggagtccttagctttgggacaacgcatcctctgtatactaggtagatgtatataaacataaaacagctatgggaatttggctttgtacttattttttctcgagcaggctggatagcctgtatttcattaaaaaggcaaatttggcttggtagtttg

SEQ ID NO: 12194 - DNA, 745 bp, Sorghum bicolor
  Clone ID: SORBI-28MAY03-CLUS2063_3
cgtccggtttgaggacttagggaataaccggtgcatccagaaaatatcaggtgaggcagcaagtatatctgaatatctgaacatattggcagtaacaaatgaacttttcgtgtatggcattgtctctctcttcattaagattgttccaggctttcttttcttgtaatttcaggcccgtaactctcgttgttcatttgaaaaccaccggaagacaggagatgtggcatcacgagccagacctttgatcatttgaaaaccactgaggctctttctgtttctatcaaccagcttagtgcatggaagaataaaaaatgctttggaagaaggtgtcacaattgtggatagttagacatccagtatcattgagttgaggaaacaaagaaaattcaaattagaaggaaacctgccagttcgagttctcatatatatgccgaattcagcagtagatacacataaaccctcgctcctgatctctcaccatgaacctgcatctgcagcccaggagactggtttgtacgcttctcgtgacaacagcatttcaaaatataagcattgctcctgcctgattcgtttgggaaaaaaacaaaaacaaaaaagctaagcattgtgaccatcagaatagcagagttgctaatgtaatggctgctaaagcaaaacttctactctatgagcaaaaatctattgaatcgatccagattttgagaagcaagaatgtgctcagcctgaagtactagaagcaaagaag

SEQ ID NO: 12195 - DNA, 1098 bp, Sorghum bicolor
  Clone ID: SORBI-28MAY03-CLUS2063_1
gcttcatcatcttgttacacattgttcaaaaccataaatgaggccaagtttgggttgtggcaaactttggcaagtaaagccaaggaagttctcaatggggatggcttggcgcctaagtttgaggacttagggaataaccggtgcatccagaaaatatcaggtttcttttcttgtaatttcaggcccgtaactctcgttgttcatttgaaaaccaccggaagacaggagatgtggcatcacgagccagacctttgatcatttgaaaaccactgaggctctttctgtttctatcgtccgcaaccagcttagtgcatggaagaataaaaaatgctttggaagaaggtgtcacaattgtggatagttagacatccagtatcattgagttgaggaaacaaagaaaattcaaattagaaggaaacctgccagttcgagttctcatatatatgccgaattcagcagtagatacacataaaccctcgctcctgatctctcaccatgaacctgcatctgcagcccaggagactggtttgtacgcttctcgtgacaacaggttgctaatgtaatggctgctaaagcaaaacttctactctatgagcaaaaatctattgaatcgatccagattttgagaagcagagatgtgctcagctagaagtactagaagcaaagaagaaaggggacaaaaccgaagagtgatttccatgcaactggagacattgctgtcccatgaatcaaggctggcacaggaaaacttaacatatgccagtgaaaaccggttcctacgtgagacagtacatttttatcaattcaccacccaggacaatgccttattggatgatgagggcacagatgttggaatttgatctgaattctaacgtaagtcttgttggaacgcttggtgggcccacatgatacgtgctgtgtttagtggaatcatttccctattggactatagtccatccgtcctatatatacatcttataagccgctcgggaagagtatacgactcattgtattccctgcattttgttaaaactcttgtcgtgtagccaagattgccattggggcccgtggttttttttttgtaagggtttttccatg

SEQ ID NO: 12196 - DNA, 484 bp, Sorghum bicolor
  Clone ID: LIB3481-003-Q6-K1-A8
cgtccgcaaattagaaggaaacctgccagttcggatctgatatgccgaattcagcagtagatacacataaacccacgctcctgatctctcaccattaacctgaatctgcagcccaggagactgaactgtacgcttctcacgacaacaggttgctaatgtaatggctgctataaagcgaaaagggggggtatgagcaaaaatctgttgaatcgatccagattttgtgaagcagatatgtgctcagctagaagtactagaagcaaagcagaaaggggacaaaactgaagagcgtggtgttgagctaatttgggctgacgggactgttccctgggccaccaccgggatctgctctgcccccgcgcgcctgaggctacatattcagacatgcctgcactccatgggatttccaccggtgggcagatcagcatgggaaggagatcgaaggagggggggagctaaacggaggggttcacatcgttagctc

SEQ ID NO: 12197 - DNA, 778 bp, Sorghum bicolor
  Clone ID: SORBI-28MAY03-CLUS19111_1
cgacctcgtccgcatcgacgcgcactccatgtgctcgccggggttctcgtgcgactcggcgtaccaggtgacgtacatcgtccgcggcagcgggagggtccaggtggtcgggcccgacggcaagcgcgtcctggagacccgcgctgaaggtggggtgctcttcatcgtgccgaggttccatgtcgtgtccaagattgctgatgcgtctggcatggagtggttctccatcatcaccacccccaacccgatcttcagccacctggcggggaagacgtcggtgtggaaggcggtgtcggcggaggtgctgcaggcgtcgttcaacaccacgccggagatggagcagctgttccggtccaagaggctcgactcggagatcttcttcgcgcctcccagctccaactgaagcagaaacagcagccggaagccggacgcccactcccctacggggaggagagtcaatctcggtgtcgtcgtcgtcgtcaggtcgtggttagcttggtttaataaagagagtggtggtggtcgtcgtcggcttgctgcctgcatgcttgcttcttgagtcgtcgttcagtgcgtcggtcggtagtcttagcgtcgtcaagtcagtcagggtattagagaagaagaggtcccgtcattgaacatttgagatgtgcttcggagatgaataccatctctcatgcacgcttttgttaattaattattatcattgtggcggttaattatcggctctctctgttttgtcttctgtcaaaaaaaaaaaaaaaaaaggccccta

SEQ ID NO: 12198 - DNA, 839 bp, Sorghum bicolor
  Clone ID: SORBI-28MAY03-CLUS18363_1
gccggccgggctcgaagtcaatacgataaaggaaggaggcccgtctccgtctcccactccccacagcacagcttctccaactccaatctccattccccaatctcgcaggcgacgcgcgccaccggcggcatcgatgcgggcgatctcgacggccgcggccgcggcgggaggcatgctgcgcgcgcggctacgctccgcgtcccgcgtgcgcggtggcggcgagggcgcggggcggtggacgacgccgggccacgaggagcggtccaaggggtacctcttcaaccgcccgccgccgccgccgggggagtcgcggaagtgggaggactgggagcttccctgctacgtcacctccttcctcaccgtcgtcatcctcggcgtcggcctcaacgccaagcccgacctcacaatcgagacctgggcgcacgagaaggcactcgagcgccttcagcagcaggagctagctgccgccgccgctgtctccggcggcggtgacgccgacgctgagtgatccgctggtcagatcaccctgaactctagatttttctgatttcctgcttgtgtcggtccaataaggctgtctgtactgtgatgtatgtcatgactttccagaaattgatgggcatcagattgaacaccgtatccccgatgctgttttactggttttcctgtggtgttttctctttttccttcggtgcttgttgttctgtttcgctttgaaaattgccccatgatgatggccaaagccttaaaagcttttaaatgttttgctgtcggattatcattttatccttcaaatgcactcctacatgaccacaacttaagattttaattgtcttctc

SEQ ID NO: 12199 - DNA, 1297 bp, Sorghum bicolor
  Clone ID: SORBI-28MAY03-CLUS19148_1
gccggcggcttccgcgtcccgcccgctccgtctcccccccgcgccagccgcgtgcctttggttcgctagcgtagcgacaccggtgattccgggcgccggcaggcgggcaggccaggccaccaacgccggcgcaacgaaatggcggcagccggggacgccggcggcctcctcgtctgcgtgacgggcgccagcggcttaatgcgctcctggctcgtccgctgcctccttgcccccgggccgacgatcgcgaccacatctcacggagacggcggcgggggcggcagccagcacttgcaggccatgggcggcgccgacgcgcgtctccggctgttccggatggacctcgtcgaccctgcttccgttcagccagcgatcgaaggcgcccacggcgtcttccacctggcgtcgcctatgatactgcaggcagaagatccggagaaggagctgctggaacctgcggtgaagggcacgctcaacgtgctgcgagcagcgaaagattgtggagtcggccgcgttgtgctcatgtcgtcacaggcggccatggtgcccaatcccaactggcctccgggtaaggtcatagatgatgactgttgggcagacgttgagctgctcaagaagcttcagctctggtacagcgtttctaaaacactggcagagaaggctgcatgggattttgccgaaaaggaggagttgcagatagctgtgctcaatccagggatggtattgggcccaatgttaacaccatcagtgaacgccagcctgcgtctcttgctgcaaattctgggaggcgagaggattgacttggacgacatctacatgggttgtgttgatgtgagagacgtcgcgcactctctgataatgttgtacgagaacccatcagcacaaggacgccacttatgcatggaatccgctgaacgcctggttgatttggccaataagattgctgatctttaccctgaacacccagttcagagaatccgggaggacaagcaagggtgggtggtgagagcaaaggacccttccaagaaattgatcaaattgggtgttcgtttcactccactggacaaaaccatcagggacaccgtggattgttttaggagcaaaggactcatctagcttgtgagtgtgcttcaagaaaaacttttgtaaactatgtggtcaaataaatcacccgaaatgtggcaaagtaatatctgcctttaaaggcatgtagaatatgccaggtggatatcatcattagatgtacatgttgcctaaatgcatatgctctttctaattccataattctgagcttttg

SEQ ID NO: 12200 - DNA, 676 bp, Sorghum bicolor
  unsure (1)..(676): unsure at all n locations
  Clone ID: SORBI-28MAY03-CLUS194_1
cgttcgggccgtggnggagggcttcatgagcggcagctgggggcgcatcatcgtcctcgcgcccaccgcgcaggagctcatggacaagctcgaggagtacgagccctaccacgacagggtggcgtccacgctcaactgggagatgggccaccagctgggctactgacactatactgctgctacccacgcaaagagccgccagagccagcgcggcaacgcctgaagcagccaaacaacggggcaggcgattgcgacatttgatcatcggtgaattaaggaacaagattagctagcgccgtcatcggattgggatttttcttctgtttttttaacttgatgcagatcggtttggagtgccggccggagggggaaaaaaagagaagggtttggttggtgtagccggagtacgtacgtacggttttgtatatgatgccttgtgtttgcttccactggggatgatggataatggcttgcagtgttgtctgtagtagcagtaaaaagacttgaccggttcgccccctccctggtgtacgttctagtaatagtattagcagccagtacctgctatgtatgttagcttcaagatgtatgctgaattcgattgaatacagcaaatcaaactcagcaagtgtgtaatacaattcagtgcatgcagatcttttggatcgaatctccc

SEQ ID NO: 12201 - DNA, 1066 bp, Sorghum bicolor
  Clone ID: SORBI-28MAY03-CLUS19414_1
cctgctttccccacccaaggccttgcctgccgcccgactttgctgttttctgcgcgcaaccatcggtgttcactcttgcaaaacctgaccggaaaaggaaaacaaccccaaacagattagaaccagcacacacaacgcagccaggctaatacaaaaaccaggcagaagagtcattccaatgacgctcatcttcgcaccatgcaggcgcctggttctccttgttgccaagctccaggaactagaagcaagcatcatgcacagtaggtcatcatatccagcagtatggagtcacatagcgaggatacaaacaataaccatcacgctgtgaaggaagattggaagtaatttctaatcgatatatgcaattgagctttcaggtgggcagccctcattagattcttttcctttcaagcctgtttgtttgaactgcagttttggggcttttggctcaaagctggctttctagcttttggattctggctgttgccttttttttttctattgacttctctaatttcaacttctagcttctgaaacaaacaggccgagtcatgtatcgggtgagtgccacctcaactaccctagttcatgactagtcttaccctacagatgttttcttgaaaaagctgaaattcctccttgtatgcaatgcaagatggacatagtaaggaagcaatgttatcttcataagtacaataaaaaaatacaaaactgatatctcatgctgacccttcagactgtagtaatttgcaattatgcagcaagattctgggcggtatttatctgtcaaaaatactctgtgcgcaaggaaactcaaagcagtcaagctttcttttgcatatagtaaatttgagtaaatatccatagaatccgcccgatgtaaccagatcctgggcagtccggcgttaatcatctcagcttcatcaaggtccctcatactgtactgaactgttgcaatttgagcctgaatgtaaccactgcagcggaagacccccatcaagcgttcatatcttttaagagcttcttcatgcatctttagttccaaatatgcactagcaagaaagaa

SEQ ID NO: 12202 - DNA, 826 bp, Sorghum bicolor
  Clone ID: SORBI-28MAY03-CLUS23271_1
tgcaagacagctctctcgctctcctcctgtcctttctcatctctcacgagcaccaccaagacagctacacaggctcccctcccctttccccaacttgccgccgccgtctgcacactccgtccgtcgcgccggcgccatggctaggctcgcgctggcactcctgctgctgctagccgtggcggcgtcttcggcgtcggccacgggcgggagccaccacctggacctggacctgggcttcctctcctcctcctccggggcccgccggagggagtgccgcggcacggtggccgagtgcctcgccgcggaggagtctgaggaggaacgtctggacctggtctcctctcccgagtcccaccgccgcgcgctgtacggcaacgggtacatcagctacggcgcgctgcggcgggacaacgtcccctgctcccgccgcggcgccagctactacaactgccgccccggcggccaggccaacccctaccaccgcggctgctcccgcatcacccgctgccgcggctgaggtgctgcgcgcgtccgccgccggcaccgctcctccgcctccgccggcccagaataagttgtttgtttctcctaccgctgctacccgctgctggcctcctgctgttttacgagtactagtagagctatggatttcattgcattgttgtatggatttgtttgtcaactcaaatctttgtgctgttgtaaagtaaggggaggggagaggggaagatggatggattcttgcccttctccctgcccctatgtcggcttaatactcttatgaacatatatatactcttatattcaaaaaaaaaaaaaaaaaaaa

SEQ ID NO: 12203 - DNA, 812 bp, Sorghum bicolor
  unsure (1)..(812): unsure at all n locations
  Clone ID: SORBI-28MAY03-CLUS23960_1
ctgccaagcagagacatacacgtatcaatatcacgcgtgaattccaaagtccaagaccgggagcctcatgatgcagcaaagcgtgcagtcttgaagaagtggtcgcagctagagcgtccagattcatttgattcttgtgacacttatcgctctcagaacttctcaaacgctatgtttcttgggggtactctgtcatcaaagaatagcttcaagggcgatcatggtcaagaagagaaggtcgaatactcaggccctttgttgtcccagtcacacaaggttgatgaactgttacagaagaacgagcgccatatccggcaagttgttcgaacatcatggttcaggagaggaagaaaggtggacaagtgaggaaaaagcttgaccgtttctttccatggaagggcttgacccttagagaagggggagcatgtcattagcttctgatgtgcctctgctgccagtctgcgaagtgtgcaattgctgctgatgattccattgttaactgaaaacgacatgaactttggtgatcccagcttacagcaaaattttagctacctcgctgcttctgcgtgtcagcggcgtgtgttgtagattccccgaagacgccaatgccatatccatttttgttgtacaaagaaatattaacggctgatggggaagtgtggttgaacgttgaacagacaattgtgtagtgggaagaaccaataagcagcacaacatggtgcggttgtagtaaaggtagattctgaacaaaatcaaagataaaacccaataactgtttggtgtcacnaaaaaaaacagaatacaataaataa

SEQ ID NO: 12204 - DNA, 1421 bp, Sorghum bicolor
  Clone ID: SORBI-28MAY03-CLUS24342_1
gcacgcgcctcgccgccgcacgaggcgcgattgcggcgacgagtcggcgagagagagagagagagagctgccccgcaagaaaaaaaacggataagagagggagaagttgacagcgagggggagacggaggaccaggagcggcgtcgagctaaaagcgccggcggcggtcatggccaccgcggaccggacccggtctttcatgaaggatgttaaacgcgtcatcatcaaggtgggcactgcagttgtcacgaggcatgatgggcgactagctctgggtagattaggggctctttgtgagcaggtgaaggagctgaacgccctaggatacgaggtgatcattgtgacctcaggtgctgttggtgtggggaagcagaggcttaagtacaggaagcttgtcaatagcagctttgctgatctgcaaaagccacagatggagctggatggaaaggcctgtgctgccgttggacagagtggcctcatggctctttacgatatgctatttactcaacttgatgtatcctcttcccagcttcttgtgacagacagtgattttgagaatccaaacttccgggagaggctccgtgaaactgttgagtcactattagatcttaaagttgtaccaatatttaatgagaatgatgccatcagcactagaaaggctccatatgaggattcatctggtatattttgggataacgatagtttagccggtcttctggctatagaactcaaagcagatcttcttgttctactcagtgacgtggatggcctctatagtggtccaccaagtgaacctcaatcaaagataatacatacctacatcaaagagaaacatcacagtgagattacttttggggataagtcacgtgtaggtagtggaggaatgacagctaaagtgaaggctgctttcgtggcttcaaacagtggcacacctgttgttattacaagtggattagcgtctcaaagcattgttagagttctccaaggagagaaaattggtactctctttcataaggacgcaagtatgtgggaaccatccaaagatgttagtgctcataagatggttgttgctgcaagagaatgttcagggcgtctgcagaatttgtcatcggatgagcgagaaaaaatattgctagacgtttcagatgctttggaggaaaatgaggatctgattagaactgagaatgaagctgatgtagctgctgcacaagatactggcagctctcctcttctttcataaactttaattcaatttgaataaaacaattcctggcaagaagcatggcagagaggcttctctcatcttccaaaaattccaattatttagcttatctctgagattgttcttatattttctgctatgccctttgatacttaacctccacactttgaggaactcttaattctgttcatttcaatgc

SEQ ID NO: 12205 - DNA, 1167 bp, Sorghum bicolor
  Clone ID: SORBI-28MAY03-CLUS24406_1
gcacgaggcaacaacaccttgacgcccgcgcctctcccgtttcttggtcggtgccgcctttgcccgccctgtcctctccttctctgctggtttcctccactggtcctatgtcgtctctgcgagctgcccgttccttttctctcctttccttgtgacctgcgcgcggtcgctggtgaccatgtataacaggtgacgtcgtagccccgcgggacctaccccccccaactagctcagtgtgtgtgtgccgcctcctcactttgcctgtggtctcttcgtcaagtgcgtcctcgcctgggtcctgcccggggccccagagttccaggtcgctgcctgctccgcctcctccggccctcttggagtggtggtggttcccaaggttgccgtcgcaccgcggatccgcgcgggggtcgaggccatggctccaactgctccttgacgacctcacctcacaggtaaatcagctgaaggaccagaacaagcagctcagcatggcactgagcataaccagccaaaaccttgtggcagtgcaagcacaaaactctgtccttcagacccagaagatggagctggacagcaggctgggcgccctgacagagatcctctggtacatcaactcaagcaccagccccagcactgctcctgcagatccagccatggtgaacagcttcacaacatggagcagcgcctctgatattcttggcgccaacgcatggaaccagcagcagcccatagacctgtaccaatgcttctagctctagctctagaagatggaaggtggctgtggcatatgacatagtggtagggccagggggaaaggaggcaggcagcaggcatcaagtttctgttcaatcatgtagggcctttgtgtcactattgatgtgtgcttgatgcttctcccttgattgtttattttggaggcgacggcgatgttttggttttcttgctgttgttggtagagcctaaaggatggacaaatgacaaagtttgtcttggctttgtgtgacgtgaaggctgttgttctctggtagttgaggagtatatatatatataggggaaataatattgggccagatagtgaaaaggagaggcaggtgatttggtggctcttgatatatagcagaaataatatgcgtaatgatgatgataatgtttattaagatgtcgatt

SEQ ID NO: 12206 - DNA, 830 bp, Sorghum bicolor
  Clone ID: SORBI-28MAY03-CLUS24517_1
gcacgagggtccttacagttactacagaagccatgatagagcacatgaacaaccttctcaaaatacaaggatcgaaggttctgtttggtggtgaaccgttggcgaatcactcaattcccaaaatttatggcgccatgaagcctactgctgtatttgtccccctagaagaaattctaaaaagtgggaacttcgagcttgtgacaaaggagatatttggtccattccaggtagttacagaatactctgaggatcagcttgaattggtcttagaagcctgtgaaaggatgaacgcgcatctgacggctgcagtagtctcaaacgacccgctattcctgcaggatgtacttgggagatctgttaatgggacaacgtacgccgggattcgagcgaggaccactggtgctccacagaaccactggtttggtccggctggcgatccacgaggtgcagggatcggaactccggaggccatcaaacttgtctggtcctgccacagggagatcatatatgacgtcggccccgtgcccaagagctgggcgcttccttccgcgacttgattagctagacggggagaggagagaccattccatttcatggggaataaaaggggaagagaagaggagctggcagggcccggagttgtcaggaatcgagagcgagtggccttgaatgaataatataacctgtatttctaggtatgctctgctccctcaacctcaataaaacacaataaatgggtcttatagcctgatgtaccaatgttcgttccccatattggatcggattagttacaaacaagaaacgacatgcatgaattggttgacttcctc

SEQ ID NO: 12207 - DNA, 1133 bp, Sorghum bicolor
  Clone ID: SORBI-28MAY03-CLUS24525_1
gcacgaggcgcagttcatcggtttggccgcgggccggccaaaaaaatcgagcgctcctgctctgctgctgaggagcgaagagccgaagaccacacacgccttcccacgctccgcacctaccgcgagggccgcccccaatccccatccgccggcacgatgtgcaccctggagcagcgcggccgcgtattcgtcctcaccctcaccggcgacggcgagcaccggctgggccacgccctcatctcctcgctccgctccgccgtcgcctccgccgcggagggcgcggccaaggcggggcccgggtgcgcgctcgtgaccgtcggcgagggccgcttcttctccaacggcctcgacatcgggtgggcgggcacttcccgcgcgcgcctcggcgagctcgtcgccgcgctccgcctgctcgccgccgacctcctcgcgctgcccatgcccaccgtcgccgccgtcacgggccacgcctccgcgggcgggtgcctcctcgcgctctgccacgactaccgcatcatgcgcggcgaccgcggggtgctctacatgagcgaggtcgacatcggcctcccgctcccgccctacttcgtggccgtgctccgcgccaagatcacctccgccaacgcgctccgtgacgtcgcgctgaggggcaagaaggtcagggccgccgagggcaaggagatgggcatcgtggatgccgtctacccttctgcggacgagacggcggccgaggccttcaagtttgccgagcagctcgcggccaggaagtgggatgggggcgtctacgcgtccataaggatgtccatgtaccctgaggcctgcaggtctgttggaattgtcgaggagagcgatgaggagaagcggaagcacttcgcttccaagctctgatgtcgtgattcgagagagggtttctgtggaagcatggaggaaccttcacattctgtatttctacgtcgtccaaccattgacgctgtcgctatgtatgaagtacgcaccgtgtacttgtacaaaccttgtaacttgcctggtagtgggaaataaattgaagctcctctccccaccttgcttgaagaatttcaatgtgcctgctagactctataattattccaataatattattgatgtgtgcctcgtgc

SEQ ID NO: 12208 - DNA, 841 bp, Sorghum bicolor
  Clone ID: SORBI-28MAY03-CLUS21343_1
ccgggattctgtcgcggttcttctcagcggcggcggcgaggcctctgcgagacttccagatctcccccgacggggtgggagcctccgaagcggagcggatcggcgtaggggaggggagatgtcgtacatgcggggtgacctgctgacgaagatgcggaagatggtcaagggcctcgccaggcccgagcccaggtggctcaaggccatggaagaggcaccgccagtgacatttcctcgcccagaggggaggatcaagcagatcgagtttcctgaggatgtgtatgttaggaagttcaacaaaaaacatccagattcgctctaccatgatgcaatcaagataagtggatttgatccaccaccagctcgagtttttgcttggcgtgttctggagctgaaagagcaaggagtcagtgaagatgatgcgatggctgtagcagatatggagtatcggacacagaagaaagcaaagaagaaagcatacaaggaactgaaagaaatcgcccgcagtgaaggaaagaagccacctccaaatccatacccaagtgccataaaagaaatacaagcagaggaaaagaaatatgttatggatcgtttatttaacccgaaggtaattgagattgcgaacaagatgaaagaggagagagacaagttgcgtcaagagagagcagcaggtcaatggtagtagcaggtattatttggactggttgactatgtatgtttatgatactggtcaactgtcatcataataattgttgcttatttgaaattgatatggcaaacatgaaactcatgtgttttattcgtatctttgcgattgtagatggcctctgaaatgcagtat

SEQ ID NO: 12209 - DNA, 650 bp, Sorghum bicolor
  unsure (1)..(650): unsure at all n locations
  Clone ID: SORBI-28MAY03-CLUS2113_2
ctgccgtcctcttccgccgccgccgtcgtcgtcttcgtccgtagctcagagagggaggaagaagaaccgatcgatggcgtccaactacgtggacacgacgggcgaggagggcaggttccacggcccgcacagccacagcagcagcaccaccccgacgggcgccgcggcgtcgccgcgccacatgcgccgcagcttctcctccgcgtcctccgggagccacagccacggcggcgggggcaagtgcgtgtgcgcgcccccgacccacgccggctccttcaagtgccggctccaccgcaccaacttccagtgccacgtctacggttacgcgcacccgtncccgncgatctcccccgccgncgncgcgcccgcgcagggcgtnccgtcctccgtgatgctgcaggcgtcctcggacggcgcggtggcgctgtgctagctgatccttcatggacgctgctgctgttgctgttgtggataactgtcctaactgtccccctccccacgttcagttcaaagcaagtgcaaaaagcatggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12210 - DNA, 828 bp, Sorghum bicolor
  unsure (1)..(828): unsure at all n locations
  Clone ID: SORBI-28MAY03-CLUS2113_1
ggcactgggtgttcaagagcaagagcagccagaacagtaccagccttagtggagcctgcaagggctacatcttcgccatggaggtcaccgaggagctggagacgtggccggagcaggacacgcacaaccgccgatgggtctctcccgccgaagcctaccagctctgccggtacgaatggatgcgggaggcgctcacggcgctgctggagaggctgtcggtgctcgagccggtggccgcggcgacggcggcagccacaccgccggagctgaccgaccaacaacctggcatgtacatgatgctgcaggcgtcctcggacggcgcggtggcgctgtgctagctgatcctccatggacgctgctgctgttgctgttgtggataactgtcctaactgtccccctccccacgttcagttcaaagcaagtgcaaaaagcatggcaaccagaagataaaacccaagaaattcaggtcctctctgtctagtcgctcgttttaggccttcgattctcagctagtcatgacgagttttcagtatgcctgctgctagtgtcgtcagtctttgcctcttttttttttaccctgctcgtttctgcgtgggattccctgctttcgtgattctgaatctctgattgccggccgccgtgccatcctccttgccaagatgagactcccccaggctcctccctgtccctgctcctgtcaactggtgaactggatccttgatttgggagacggtgaaactggatgcctatgtaattaattgcctctctttaccattctactactatttcaagtatgatcacccctgttgtgaaatcactggatntgag

SEQ ID NO: 12211 - DNA, 1442 bp, Sorghum bicolor
  Clone ID: SORBI-28MAY03-CLUS2140_1
aaatcccgaccccgcctccccccctcctccggccgaccccccccccccgctcccgctccgccccattcccaccaccaccaccggggcccagacaggcgcccaatctccaccccacgccgcgccttcgccgtcttcttcctctgctgcggtcggttagcctggccgtggccgcctcctgctcttcttcgatctcgcgctgcgagctgcgatatggagcggtacgaggtgattagggacatcgggtcgggcaacttcggggtggccaagctcgtccgggacgtcaccaccaaggagctcttcgccgtcaagttcatcgagagagggcagaagattgatgaacatgttcagagggagattatgaaccaccggtccctgaagcacccaaacataattagattcaaggaggtcgtgctaactcccacacatttggcaatagttatggaatatgctgctgggggtgaactatttgaaaggatttgtaatgcggggagattcagtgagaatgaggcaaggttcttcttccaacaactgatttcgggagtgagctattgtcattccatgcaagtatgtcatagagacctgaaactagaaaacactctcttagatggtagtgttgcacctcggctcaagatctgcgatttcggttactccaagtcttctgttcttcactctcaaccaaaatcaactgttggcacacctgcatatattgctcccgaggtcctctctagaaaagagtatgatggaaaggttgctgatgtttggtcttgcggagtcacactatatgtgatgcttgtcggcgcatatccttttgaagaccctgatgacccaaagaacttccgcaagacgatcactagaatactcagcgtacagtactcaattccagactatgttcgtgtttcaacggagtgcagacatctgctgtctcggatatttgttggaaatcctgagcagagaataaccattcctgagatcaagaaccacccgtggttcctcaagaacctgcccgtggagatgaccgacgagtaccagcagagcatgcagcagctggcagacatgaacaccccggggcagagcctggaggaggtcatggcgatcatccaggaggcgcagaagccaggggacgccgtgagcctcgccgggcagctgccctcctgcctggggagcatggaccttgatgacattgatttggacgatatcgatgacattgacatcgagaacagcggcgacttcgtttgtgcggtgtgatgctctcatgcgtgcgtgattcaggtagcagagtagcagagagctccctttggtggttggtgtatgtctgtagatccttgttgtgttatgttacttccattcgtttctggatcacgcatgttgtgtaaccgagaaattggcgttcctgtggacaacatacatgatgaacttatatgctgaaatctaccgaaaatcct

SEQ ID NO: 12212 - DNA, 1189 bp, Sorghum bicolor
  Clone ID: SORBI-28MAY03-CLUS2149_1
gcacgaggcgcagggagtaccgggggatccccggggacggtggcgacatgggggatgttggggtcaccagccccaagccgtcgtggcctccgcagaacagggcagatgaccccaagctgcacaatccgctgctccgcctcgagcgcatgggctgcgggtggctcggcgtcatcttcgagtgggagggggtcattgttgaggatgatgccgaattggagaggcaggcatggttgaccctggcacaggaggagggcaagtcgccgcctcccgcttttgtgttgcggagagtcgaagggatgaagaatgagcaggcgatttctgagcgtccgcccacgcgtccggacccctcggagcttaggagattggcctcgaggaaggaggagattcacaacagcctccgaggcggctcctaccaccagatgaggaacggttcccgggagttcatgagcacgctcgccaattacaagatccccattgctgtggccaccacacgcccacggaaggttattgaggaagccattgaagctgttggtgtgcgcagcttctttgatgcggttgtggcagcagaagacgtgtaccggggcaagcctgacccagaaatgtttctgtacgctgctcagctcctcagtttcatccccgagaggtgcatcgtgtttgggaactccaattcggcggtggaagcagcacacgatgcccgtatgaagtgtgtcgcggtcgcaagcaagcacaaaatctacgagcttagtgccgcagaccttgtggtgaaacaattagacgagctatctgtcgttgacttgaagaacctcgctgatatagagtccccggagtttggcatggaacctgaaccagagatggaggaggaggaagtgcccccaccatcgacgtctgtgggtgtagatgatttattctggtaagaggccagattgtacatttgattgattcctctcctgcacagatgtattattgtcaactgtcgtagcgatcagaaagaagggcttatcacccttctgtaatcagtagaatgtgatatgtaaaaatgttgtttagagctcacacactgtatatatactcagaaagaaaccaggggactgaatatatgaatcaggacacttgaaactgcagttgctgaaacaatgtataacaccacaaggtttctgtctcagaatcagtattccagatgctgtttata

SEQ ID NO: 12213 - DNA, 891 bp, Sorghum bicolor
  Clone ID: SORBI-28MAY03-CLUS21762_1
gcacgaggctcgactcttccatcagcgcccatcgaaatcgttcgaccgccccgctccggcatccatggctcgtctgctcgcggcgcgagcccttacgctggcccgcccctcggcggcgccgtccgccctccgcttctgcctctgccgctcccgtgcgctgtcggacaaggtggacttcgtcgagatcgacctatccgaggagtccccttcctcttcatccggagggggagacgcgggcgactccgccacgggtcaggcgaagatggggtcgcggcgcctggaggacgccatccatggggtgctcgtgcgccgggcggcgcctgaatggctccccttcgtgccgggggcatcctactgggtcccgccgttgccgccgccgctcggggtggcgaacctcctcggcgcggcattatacacctcgaggggcgaggcggcgatgacggaggaggaggcgttgagcttcactaccgtgcggggttggccatctgcggcgtactttgtgggagggaaattcccgccgccagtgaagaaatcatggaaagatgctactaaaactgatgatgatgaaagctaatcctataatgcttcacctggggctcctactgaagaggcagctcggggttgtgaagttcctctgatgattgtagatatagacaactagggagccctgcaataatgaaaccccccaagcatctttggatggtgtggtactgtggtcagagctggtaaaatgacactggttcgatattatgtatttggcagaacctggtgcactagcactgggacatgttgggtgtatggtccacggaagccgtggcgcttgatgtaatagtgtttgtaccatgtttttcgttttgaataaaagcatgcgctaggctgaacacttgtggc

SEQ ID NO: 12214 - DNA, 1051 bp, Sorghum bicolor
  Clone ID: SORBI-28MAY03-CLUS25391_1
gcacgagggctccacgccgagacgatcatcactacacggcctcaagtcaccaccagccattgttgatcagcaaattaaacccagctcgatcgagctagcaatggagttcatgctcggcgacccggcgttctcggcggcggtgcagcacctgatggagctgccggacgagctggagcggcagctgaacgcgccgacgcgggcctacgtgcgcgaccgcagggccatggccaacacgcccatggacgtcaaggagctgccgtcggggcacatcgtcctggccgtcgacatgcccggggtcagcctcgccgacgtcaaggtccaggtggaggacggcaacgtgctcgccatcagcggcgagcgcaagcgccccgccgaggactgcggcgccgacgccgaagccgacgccacgcagaagcagcagcagcagcagcagcagcaggcggccgacggcggcaagcagaagcagcaggccggcgccggcgccggcgagcagcagcaaggggtggtgaagtacctgaggatggagaggcggatgggcaagttcatgaggcggttcccgctgccggagagcgccgacctggacagcatccgcgccgagtacaaggacggcgtgctcaccgtcatcgtcgacaagaagcccccgcccgagcccaagaagccgcgcgtcgtccaggtcacggtcggcggcgagcagcagggcaagtaaggaggcgacatcatatacgtaccgtgaccgcgatgctcgtccatctcagctggatatggcgggtgacgagcgaataacagtgtgagggtgtgatgctttgttgtgcttggtagccatggtacatggctgcatgcttacatagttacatgcatgtacttccgagtgtttgtgcgtgtgtatgttcgaagagtgcttcgatcgagttcccggtccccttcctcttcccctccggccggcagctcgccggcggcgaggggaggtgggccggcacctgtggcgccagtcgtccagtgtatctagtttaattacctttccgtaatgttgaatgaaagcctccacgtctgg

SEQ ID NO: 12215 - DNA, 1517 bp, Sorghum bicolor
  Clone ID: SORBI-28MAY03-CLUS25321_1
ccctcgtccctcgtccatagatctatagccgctacgcgcaagcgggctgacgatgcggcgccgctgatgcgatcaagcttccgtagcccgacgctagctagaagacggaagcgccgaagtaccgaggtctcggccaggtgtcaatttgagagagcaactgtgcaatactataacaacaacaatgctggatctggttgccatggcagctgatgattttgccctggctgaggatctgcaggttgaagaggttctccggttctcagttcagtcggaggatgtctgtgcagtttgcaaacatgttatccgatcattggaagcctcatggaaacctgaaaattgtgaccatgtcatctgcattgcctgcttctgccagcacgaggctgagacggaggccactggactgcccaggtgcgctgtatcgtcttgtgattctttgcgcaatacagagacacatcagggcatcagtgtgcctcagaacactttgatctcaattgaagacatggaccagaaagggaagaaaccactagatagtacacttcaagagcttggtcaatgttctcgaggtgctaacacaaagatcagcagtgagttctactgtgccatctgcatggaaacagtgcacatcggagagttctttcccattgatggatgcacacacacattctgcaccagttgtgtgagccagtacattgctgcaaaggttgaggagaatgtgttgtctattggctgccctgacccagggtgcaaggatggtgtgttgcacccagacgtgtgccgcgatgtgatcccaacacagctgttccagagatggggtgctgcgctctgtgactcatcattggggtcactcaaattctactgcccctttaaggaatgctctgctctgttggttcatgatcctggccatgatgagggggtgataacaaacgtggagtgcccacactgctgccggatgttttgtgcccagtgcaaggttccatggcatgatggtgtcgcttgcgcagagttccaacgactggggaaggatgagcagggcagggaggacctactgctgaggaaggtcgcacaaaagagcaagtggcagaggtgccccaagtgcaagatatatgtggagaggatcgagggctgtgttcatatcatctgcaggtgtgggcactgcttttgctacctttgtgcatccccaatgtctagggagaaccattgttgcaaaacctgcaagcgaacctggtgaatgacctccaagctctgatggaaagaaactattagtatgtgtgaactgccaagctctacctgtaggaaagaaattcttaactagtagtatgttttttagatggtaagttgctgttacgacagtttcagttagcactaccttgttgcactagtagcaaattggttagcactgcagtttattaggctagtctcggtgtgagtttcatggcgttgttaccaagactgtcatttcagcttttgtgtttgtagctatgacagcgggtttcatctagatgaaattctctttatag

SEQ ID NO: 12216 - DNA, 762 bp, Sorghum bicolor
  Clone ID: SORBI-28MAY03-CLUS25345_1
ccacggggttgattcaagtgcccataggctggctcaagcggtgtgtattgaagaagtccacttctctttaaagccagaggataaattaaataaagtaaaagcagttccaagggaaggaggtgggcccttcgtgccggtgcgtctgcggtggctggtgccgccggcccgtgctgccgcgacagttggtgcggggcgcccccctcctgcccgtgcgcccgccgtgcctcttcctggggctctcttggtgcagctctggccttgccgggtgccgttctgcctgcccttccctcggccctcgacttcattggtctttcgttgtctggccctcgccttgacgggggttcccttctagtgtgcttgaactcgatacgagcgctgaacgccccgacatggtccttggtagatgacatccggcagctcgttgatagcttaaggaattatttctcatccaagttcaacagctcttcctcaaactacgtcgcaaacactgttaccttgtagattaccatgtacagcaacggttgccttttcttaccttgtttgtgtggcaccgtttgaatttaggcgaggggttctaacctaatttttgtaggctctgtactcttatcactaccatgtaaagaaggaaatctggcttcaggttgagctgaaagtcaaaagactgatgaacatcctgttacgatgtggcctagaagcaaacatttgttaggcccgttggttttctggcaggcatacaggtgcaggtgctgtaccactgttgag

SEQ ID NO: 12217 - DNA, 2045 bp, Sorghum bicolor
  Clone ID: SORBI-28MAY03-CLUS25404_1
gtcaggtggagtttgaatccaaaagacgggatttcgaattagaattagagagggaaaggaaatcttttgatcaaaagatgacacagaatcaagcggatttattgaaaagggagaaaaatgtgaagtctttggaggccaaactttctaaaagtgagcaggcattgaatgataagaagaaatcaatggaaagtttgcagaatgatcttgatgccaaatccaaggctctgaagaggtgggatgaatcattgaaaaatgatgagaaaagattactggaagaaaagcagcaactggatcatgaaagagagcaattggagacatacaaattggagcttgaaaggaccaaatcagcattagaagctgaaaaggaaagaatatcagaagagcagaataatctgaaactcacagagcaagagaggcaggagcatagcttgttgacagcagaacttaagaaggagattgaggaatacagaatgcgaagcaactccctgtctgaggagatggaggatttgaggaagcaacggcagaaatttgaagaagagtgggaacagctagacgaaaaaagagccctcctagtagaggaggacaaaaggctgaaaattgagaggatgaatttagaacggtggcgtgacaatgaagaaaaaaggttaaatgatgtgaagctcgaaatggatgaaaaattaaaggaccagctggagaatcttgagcgcaaggaaaaggctttgactgatgatataaagcacaagcaaatggaaaatgatgagtttctgaagggagaacgcgctgatctgcaacgtaagttgcagctgagacagcatgaattggagatggagatggagcaaaaacaagcaagtaaagagaaggaactggaagaaaaggaaaatgagttaaataagaaaatggattttgtggaaaataagctccaacatgctattgagttgaacgagtccaagattcagaagatattattggagaaaagggagctgcagatggaaagagagatactgctagaggaaagaaagaaactggagactgacaaggcagatattaaaagggatattgagattctgcactcactgagcaagagtttgaaggaacgtcgagagagatataacagggacaggaaaagcctcatcgatctatctgaaaaatacaaggcatgcaaaaactgtgggatttctatttttggtgaggaattaaattctctgttgcttaaagatggcgctgaaattgaacatcccagtttggctgttgagggagatgatcgtgccttgaccaccggtacatcagggccagatacaggaacacttgttagttcaggtggtcgtctttctttcttacagaagtgctcagggcttttcaagttctctcctagaaagaaaggtgagcagtcatcagaacaaccagcagaaaaaaatataccttttggtgcaagacttgaggaagcagcacagatcgatggagattatgagccaactcctgtctatgaggtagcctcttttgatgcagaggatgagctcccttctgatggtggaaccagcgcgagcgaagagtctgaaaggcttgacatagctgatgatgctcagatggagtcttctgttggtgtagcagataacagtatagatattgtcggtacccagtcctttgatggaaccaacaacatagcagttgaaccaactattgcttctgttgatcaaaatggcaaggattctgcagcccctgctgaagcaggtgtacagcctgaaacattaaagcaaggtcggcgccaacaaaaccggagaggcagagggaaaggtggtgtgaaaaggacacggtctgttcgtgctgtagttgaagatgctaaaacaatacttggtgagacctttgaggagaagaatgatggtcagggagataaagtcaaggtgggtgctacacgtaagcggcggtttgttggagctacaataagtgaacaagatgaagaaggcagcgaggcacattcagaaagtgtttcacttggagggcagcgtcgcaagaggcggcaaacttctggggcagtgacagaggcccca

SEQ ID NO: 12218 - DNA, 1315 bp, Sorghum bicolor
  Clone ID: SORBI-28MAY03-CLUS25502_1
ggtgcttaataagcacgaggcgcctctcccgctgctgcggcctcgctcagatccgccccgctccgctccccacccttcccccctgctggccgttgctctgcatctgctgctctcctcggccgggaaaaaggacgctgctgctaggctgacagcggcgaggaggaggaggagacgagggagccatggctcagatcctgctccacggcacgctccacgccaccatcttcgaggccgagtcgctctccaacccgcaccgcgccagcggcggtgcccccaagttcatccgcaagcttgtggaagggatcgaggataccgtgggtgtcggcaagggcagcaccaagatatatgctaccattgatttggagaaggcccgcgtcgggcgtacacgtatgatctccaacgagcccatcaatcctcgttggtacgagtccttccacatctactgcgcgcacatggccgccgacgtcatcttcaccgtcaagatcgacaaccccattggggcgtctctcatcgggagggcctacttgcctgtcacggacctcctggacggagaggagatcgacaagtggcttgaaatctgtgatgagaaccgcgagcctattggagacagcaagatccatgtgaagcttcagtactttgatgttttcaaggaccgcaattgggcgaggggtgttcggagcaccaagtaccctggtgttccttacaccttcttctcgcagaggcagggctgcaaggttactctgtaccaggacgctcatgtccccgacaatttcgttcctaagatcccgcttgctgatggcaagaactatgagccacacaggtgctgggaggatatctttgatgccataagcaaggcccagcatttgatttacatcactggctggtccgtgtacaccgagatcaccttggttagggacaccaacagaccgaaacctggtggtgacgttactcttggggagttgctcaagaggaaggccagtgaaggtgtccgggtcaatatgctagtgtgggatgataggacttcagttggtttgcttaagaaggatggcttgatggctacccatgatgaggagactgcaaattacttccatgacacagaagtcaactgtgttctgtgccctcgcaaccctgatgattctggcagctttgttcaggatctgcagatatcaactatgttcacacaccatcagaagatagtagtagttgaccatgagctgccaaacgagggctcccagcaaagaaggatagtcagcttcattggtggcattgacctttgtgatggaaggtatgatactcagtaccactccttgtttag

SEQ ID NO: 12219 - DNA, 737 bp, Sorghum bicolor
  unsure (1)..(737): unsure at all n locations
  Clone ID: SORBI-28MAY03-CLUS760_1
gctgttcgcggncgcgtgggcagnattcagcttctatgaccgttctgctccaatttatacacaacctcacacctgccaccttcaaggttcttgatgctgatgtgacagacagtgttattggtgaagggtgtgttattaaaaactgcaagatacaccattctgtagttggactccgatcttgcatatctgaaggtgctatcatagaggacactttactaatgggtgcagactactatgagactgaagctgataagaaactccttgccgaaaatggtggcattcccattggtattgggaagaattcacacatcagaagagcaatcattgacaagaatgctcgaattggagacaatgtgaagatactcaatgccgacaatgttcaagaagctgcaagggagacagatgggtacttcatcaaaggtggaattgtcacggtgatcaaggatgctttactccctagtggaacagttatatgaatgctgcaggtggatgtgggacatgcagctgagtgtcattgacaatgatcagcacctggttacatgcttgatctgcagatcagcgtgttggagatcatcgaaacaataagagtgtcattcaaggcactttttctttctctttgctcttttgtgtcctttaatgttgtagggtataatgttgtatcagcaactgttagttacatgttgaatcaaaattggatgcctggatttgggataaaaaaaaaaaaaaaaaaaaaacaa

SEQ ID NO: 12220 - DNA, 712 bp, Sorghum bicolor
  Clone ID: SORBI-28MAY03-CLUS7496_1
ctcccgcatctcgacccgcctcccccccgctcgctcggtctccctcgccctcccgctatggctccccgctcggtcgctctccgtctcccccccgacacgggcggcgtccaccgcgcccttccggcccgcgcccccacggtgcccatcctcgcctggcacgggctgctcccccaggacctccctcctcccggcggcctgcgctcgctcgacccctacctgcatcctcctcgccgccaccgcccgtcgctcgcctgcatgcgtcggcatctatgctgtgagtagcaggggagcatcattggacctttgtacaggctgcaaagtggctggctaggtagcggggtcaaatacccttctgctaatcagtttgttaaggtgcgttcattcagatagcaagcaaaaagtgaataagtgtggccaggacctacacaccctactttgggtcacactgtgtactactatgtcatatcctttcttctttttcactgatccgttctcttgttgccatctcccctcaattttggcagaaaaaggcatgtgttctccttattttgttttcatctcgacattcttacctgtatagctctgactgtgttatctttgttgttggaccgtactgccatagctataaatcgcctctagttctcgcccccatttctcaatcccttagctatatattttacttagttctttccgccatctttgcttggatgat

SEQ ID NO: 12221 - DNA, 494 bp, Sorghum bicolor
  Clone ID: LIB3476-035-P1-K1-C1
cgtctccctcttgatatgggcagcgacgacagcgcccttgcggcacgcgcccccacggtggccgtcccccgactgccacggagcggcgcgaccggacgccactgcttgccgtaggctcggctcctcccggagtgcctccttccgccggtgggcgtgcgctcgatgaaaccctacctgcatcttcctcgccgccaccggcggtggctcggctgcatctggcggtgcattcaatcagatagcaagcaaaaagtgaaaaagagtggacaggtgaacaacttttgtttgaaatgcttctttattttttgttcatatccagtttggtttacctacacgttacacagcaattcttgtgaattttatatatttcttgtattaggactagttctattgactgaactaattagacacaaccccctcctaattagatgactttaaactaaaacattattagtccggcagtatgcaatattgattcttctttttttatctccatg

SEQ ID NO: 12222 - DNA, 478 bp, Sorghum bicolor
  Clone ID: LIB3478-026-P1-K1-F6
ggcgggcacgcgtacgatgattatcttcttacagtaggactgtcgccatacctagaaaaaaaagaaattagacaaataccggtcaaatgggcaggcccttcatttgtggtatggcataacttttacctttcaaaaatatgccagtgccatatgatcggacctttaggtagaaaccttggacttcaacagggaaacttactaactcagaaaatcatgatgtcctactatacagagatagatattagtcacctcataggttcataaactattctaaagataaaccttcgaccccatcacccttcgggcccataaagctacttttctatattgatagatttcaggaaacaggatattttaaatctccattttcaccaaaataaggtagttgatgcttataacaatgataaattctcttatgagatttgcagttcttctaaattctcgtttaatgaatatgatcaacattcatgtgattcat

SEQ ID NO: 12223 - DNA, 1443 bp, Sorghum bicolor
  Clone ID: SORBI-28MAY03-CLUS7302_1
tgctggaggtatcagaagtgcgaatgctgacatgagtagcgataaagggggtgaaaggccccctcgccgtaagcccaaggtttcctactgcaacgccccgcctcactccctgagctggcacatctccacttctgtctcctcactcctccacccccaccaccggccccgccgaattccaaggtctattcttctgcccctccgccgttcccgagatcgcattttccgagttcctgatcacggaaaaccccgggaattcctccctcagatccgcgctttcctcggaggcgtcgctgaattgcgggttctttgcgcaggtttcccgcgtgcggcggcgagcggggcgggacggggacgggggttggttggattggatcggggtagggacagactgagctgccgcccgttgactagcccggccgccagagatgggcaagggcggcggctgcgtccccagcaagaagcgccagccaccggccgccgcgccctcgtcgtcgtccgccgaggccgcggtgccgcgcgaggcgcccgaggaggagttggccaaagcggcttcgccgacgcccgcggcggcggggcggaagctacggctgtacatcgtgttctactcgatgtacgggcacgtcgagtccctggcgcagcgcgcggcggccggcgccggcgcggtggacggcctggaggccgtgctgcggcgggtccccgaaacgctcccgctggaggtgctggagaagatgcaggcgccgcccaaggaccctgctgtccccgtcatcgcctcggccgccgagctgcaggaggctgacggagtgttgttcggcttccctgagtcggcccctggggcgcgccggagctccctggctggcccgccgggttcttcgtcagcaccggaacgcagggcgggggccaggagaccacagcttggacggccatcacccagctagcgcaccatggaatgcttttcgtcccgattggctacacctttggttcaggcatgttcaacatggatgatatcagaggaggcagcccctatggtgctggcgtctttgctggcgatggcagcagacaacccagtgagacagaactcgcccttgcagagcaccagggcaagtacatggcctcaatagtgaagaagctagctcaccatgcttgagccagccacccctgtgcagtaaaggtcacaccgtcaccttcctctagcccttggcttctcctatcgtttccggatatatccggcccgtcgtatatgtgcacagcttgccctattgtttgtcaaagtagccacccctaaattaaggttcctttgtacattgttgacataaacatattgttgtccatttgaataataagtgtcccacaaagtgttcatcaataaacatcatatgtcatattggttttggaaagtttggtgtctgttttgttgcgcagaaccgtttttatactataaaagaa

SEQ ID NO: 12224 - DNA, 428 bp, Sorghum bicolor
  unsure (1)..(428): unsure at all n locations
  Clone ID: LIB3476-032-P1-K1-A6
gtcatcgcctcggccgccgagctgcaggaggctgacggagtgttgttcggcttcccgacgaggtacggctccatggccgcgcaaatgaaggcattctttgactccactgggtcgctctgggaggcgcagaagctcgctgggaagcccgccgggttcttcgtcagcaccggaacgcagggcggnggccaggagaccacagcttggacggccatcacccagctagcgcaccatggaatgcttttcgtcccgattggctacacctttggttcaggcatgttcaacatggatgatatcagaggaggcagcccctatggtgctggcgtctttgctggcgatggcagcagacaacccagtgagacagaactcgcccttgcagagcaccagggcaagtacatggcctcaataagtgagaagctagctcaccatgc

SEQ ID NO: 12225 - DNA, 1427 bp, Sorghum bicolor
  Clone ID: SORBI-28MAY03-CLUS77519_1
ctggagaaagtcgcagccgccaaccaccggacccgaccccacgtccgcgatgcccacgccgtgagcccgtgaggcgcgccgctgcagccgccgccgccaccgccaccgcagccgcagccgttactatgacctcgcaggcccccacatcctggctctccggcctcgcgcgctcctcctcctccaccatggccggcggcgtcgcctccgcccccgcctccgcctccgcgtccgcgtccgcgtccctccccgacgcgcccaagtcgtccgcggtcggcgccggccccggaggaggcaagcggaatcacctccgcggggcgctgttccagtacggccccaaatccgcgcaggtagcattcaggactggtgattttaaccatcaggtgatcttcattggtggcctcacagatgggcttttagctactgattacttggaaccattgtccctggcaccggtggctctggcatgggccgtggtgcagccgtccctggctccgccattccctgcttctgcattctccggctttgggcttgccgccttggagctagatccgctcgtccgtgacctgctcatcagtgacctttctgatggagtaatttcgcttggtcttagttcgcgtggccagggtactggatgccaggatattgtgcattatatgcgcacaaactttgcttgttccaaagcagtttctggggtcatattacaggctccagtaagtgatagggagtatagagcaacccttccagaaacagctgaaatgatagacctggcagcgaaaatgattagcgagggccgcggaatggaattgatgcctagagaagcaaacccagatgctcctattactgcctacaggtaccactccctttgttcatatatgggtgatgatgacatgttcagttcagatctaagtgaagatcagctgaggcagagacttggtcatatgtcaaccacacagtgccaggttattttttcaatgggggatgaatatgtacctgaatatgttgataaggaggctctagtagacagactatgtagagcgctgggaggtgcagagaaagttgagatagaatggggaaaccatgctctgtccaatagagtgcaagaagcagttcgggccattgtagattttgtcaagagggaggggcccaaaggctgggatgatccatggagctagatgtagcagttatatctcatttgtaactagtttgtgcttttttgcttttctttttctccaattgtaacatcatctttgttttgcattattcttggtccatttttttatacaatgatatgctaattttctcattttctccttagcatgcatcatgttctcattctggtatgatgtatcacatttgtaaattgcaattgcgttccgaatcttggtaccctgatcagtttagtgattacaactgctccatggaagtat

SEQ ID NO: 12226 - DNA, 868 bp, Sorghum bicolor
  Clone ID: SORBI-28MAY03-CLUS7829_1
aacgccttgaagttttatgcttctgttcgctagaacatcaggcgtattggtttggtaaagaaaggtgaagagacaataggtaggcagattgctgtgaagattgtaaaaaacaagcatgctccacccttcaagaccgcacagtttgagcttgaatttggaaaggggatatgccgcagttctgagcttttcgaactcggattgaagcacaagcttatcaaaaagactggtggtgcattttatagtttcaatgatatgtctttctgtggtaaaaataaccttaaatcttaccttgatgaaaacaagagtgttgcaaatgatctggagatggaactaaggagattgatggcaactgaagcacctaaagagcaggaggcagaagatagttcaccgagtgatttgcctgaagagattgtcacacctgaagtatcgtcagaagaggatctgggagctgtaatcgaaggttagccagtgatttgatgtgctggcaagtgggaagagaatttctggagcagttgttcccgtattttgggccctgaagtcaccaccgtttggatcaacatgacctgtggtgttctggtgatctcattgtaacagacttcagttcttactgtgcttatacggtagtgtagcatgaagagaattcgcattgtgtgaaatcatgctgataactgagaggtggaagttgaagtaagccgggaatggtgaggtactgtggtccgtgtggcaatttgaactttattaagcgatggtaaaatgtagtggcgtggtcgtgtatatatgatgtgcacattttgagctcttgttgtcacgtcgaagtcaatttcaaaagcattctttattgagtgctgctagaattacattgagctcc

SEQ ID NO: 12227 - DNA, 726 bp, Sorghum bicolor
  Clone ID: SORBI-28MAY03-CLUS27449_1
gagttagggtcccagtagagcaaggtttacagcaatcacatgcgccagcaaggggtttcatgagcccaaacatgggtaaacctgttggagaacttgaattgggcagaaagccaatatcatgggatgaacctcggtcagcagctgatatcagagatttggaggttggtttaggcggtctattggacgagaaggaaggcagagtagcccatgcatccccggatcttagcagagaaacccttcctgagcttgtggaagggagggctggcgtgcattcgaggcgatcaagttggggtcaccgaagcgggacctcagagtccatggacagcgttgctgtgcagatgggaacgggagattctcactggggctccattagcagtgtccatggaacaaccagtggagctcactagcaagccatgtcacgtctctgacgcatccttttgtgaaacctgcctgataccaacaacgaagaagcaacttttgtgtgttctgtgtgcgcctgtgctttcactccacctaggatatatacgtctgctgcagtgctttcttactcagtgtcctgggagcgcatcagttcttctgatgtgcttctcgtttggtgttctaagaaaaaaaataacagaagagctcctttaactccttagctgtttggattatccactgtatatagatatatgtgttattgcaaattggaattgcctgtagaaagggtttgtcatgtttggcttt

SEQ ID NO: 12228 - DNA, 669 bp, Sorghum bicolor
  Clone ID: SORBI-28MAY03-CLUS27087_1
aaaaatttttctttcctgttcggatcgggtcaggtcagtgctccgtgttgcgtcccctaacaagaagaaagaagaaaagaaaaaggagagtttctttcgggtcgtccttctctcggattgtcgaaaggccgctcctttaggagatttgcgcgcttctcgtcgagattagtcgtccggtgttcggatcgagctgtttggggtggaggaattttgaggccaagacaagaagagagtcggaatcggatcgggagttcttgtggtccgaggttgcgggaaaaaaagcgagggatttttgggaggatttcttgtttgaggggaaaaaaatcggtttgttgagcggattagaggcggagatgggagccggggctgaggtcatgcatcaggtcgtgccgctgctggagccgccgttccaccggtgcgtcgttaagagcgtcgatgtcatggaggaggtggtcaccgtggcgcctgggcaggtgcagccggcgacgtcgccgaaggcggtggtggaggttgccgtagaggtgcccgatctggagttcaagagagcttctaatgctgggagtagtgtatctgcagaacaactgcaatttgtccctagcattagatctggtagctttgctgatattgggcctaggcggttcatggaagacgaacatattagaattgatg

SEQ ID NO: 12229 - DNA, 1767 bp, Sorghum bicolor
  Clone ID: SORBI-28MAY03-CLUS27489_1
tcctggtgctcttattccagcagatatcttaagctggaaaggcaattcgttaaactctaatcgaaaacttgccctgaatcaaacagttggatcatcaagtactgttgattctaatatggatcctactgtattgccacttgaacctaaaggtggccaactgcctttgttcagcagtggtgattggatatcacacagtggttctggatatgaggcagcagaaactgcaggttctactcaaacctcttcgggtgccacatcagctcgtcctgctggaaatgtttttgacagttcatggctgctggttaatcatgaccaatcagatggaccatcaacttctgctggtacatcatcccagcagaaagttgtacctcaaagtgaacatcagcagaatttaaatcgccttccagatttgcaggaaattccagagtcaaaaaacctttttgctgaccttaatccttttggggatatgaagtccaagaaaacgtcagtaccattcaaaggaccagatcataggaacaatgagttgcaaaagcgcagaggcaccggggttcctaatgctggaagaccacagcagcggttagttatgaagaattggtctccttacaatgatgtttccaacaacaaacagtacaattatgtcgaggattcgtttgctcgtagaaatgttggcaataatgctgcatcatcatcatcccagatgccacgaccagcctcaaggtctaatcttaattctggcacgaggaatgatgcatcatatcataattatgatagtattatggctggtacctctgccatgaagattacatctacagctgagactgggaaggttcctgaaagggttctgcgtggtgatttggacaaaggtcaaacaaattatagactggaggaccaacatgtcgtagttcaaccaccacaggaaagacttccatggggcaatcctgcagaaggaagatttccaatgaatagagttcagagtccagcaaaacaacacattgaaaacatggatgtaaagcaagaccataagaaaatgctccctgatccaaaaaaaatctccccttgacagattcatggacacgtcattgccatcaagaaacatggacatgaggtcacagaggcttgactttgatgatgtgtctgagtgcgaaattccttgggaagatcttgtgattggtgaaaggattggcttaggttcatatggagaggtttatcgtgctgactggaatggaacagaagtagctgtaaaaaaattcttggatcaagatttctatggtgatgctctggatgagtttaggagtgaagtccgctttatgcgtcggcggccggattatgcgtcggctgcgccatccaaatattgttctctttatgggtgccgttacacgccctccaaacttatctattgtatctgaatatcttccaaggggaagcttgtataagatccttcaccgccctaattgcctaattgatgaaaagcggaggatcaagatggcccttgatgtggccaaaggcatgaattgcctgcacactagtgtacctacaattgttcatcgagatctgaaatctccgaacttgctggttgacaataattggaacgtaaaggtttgcgactttggactttcacggttgaagcacagtacatttttgtcatccaaatctactgctggaacacctgaatggatggcacctgaggttctgcggaatgaacaatccaatgaaaagtgcgatgtttacagctgtggtgtcatcttatgggaactggcaacacttaga

SEQ ID NO: 12230 - DNA, 1440 bp, Sorghum bicolor
  Clone ID: SORBI-28MAY03-CLUS27690_1
gcacgagggggaactctctttctggtcggcggccatggccaagcggcggagtagattcggtctggctaggtatatcggccgaattcgggggtccggggttcttgctttcctcaattccattactggttttgggcaaaaaagggttctttttctttttgaaaaggtggagtttctgtagtagtagaattcggggaagtccaagctctgtcgaatgggctccgtctcgacctcgtcgcgcgcgtctcctcccgcctctgcactccacccgcgagcttctcccgcgcgaggacgcaacgcaaccgaggcgattcgttccccttccatacacccgcccgccctggtatctgcatatcctccccggttcagctgcttcgggggccaagctcgggcggagaagatggcagaggatgggtacccggtgaagctgcacatctacgatcttagccaagggatggcgcggcagctctcggcgacgatcctcggcaaggctatcgaggctatttggcacaccggtgttgtcgtctacggccgcgagtactactttggcggcggcatccagcaaggccagcccggccggacgccctacggcacgcccatccgtgtggaggacctgggcgtcacccacgtccccagggaggtgttcgaggagttcctccgggagatcggcccgcgctacaccccggccacctacaagctcctcagccacaactgcaacaacttcagcaacgaggtcgcgcagttcctcgctggcgccgccatccccagctacatcctcgagctgccgaaccaagtgatgaacagcccggtcggcgctttgatattgccgatgatccaggggctggaggcgagcttgggagctggggctgtgccgcagccaccacaattcaggccggctcctgcagccccggttggcgccgccaccgtgactcggccgctgacgccgaaagacgacgtggtgccaagatcgacgactgctgatgatgataaaccggaggctgccaagacagcagcgggcaataatggcagtgccaatgacagcacggccgtagttccaccggcggtgcagcccgcagcagcaccggcgacatccgccggtgaggtgagcagcgcggcgcctactacggtttcaaccaagctggcggcgcctcctcctccagacccccttgcggcggcgaagagccgggtgcaggaggagataaagcgcgagttcgcggccatcatggcggccggcacggcgcgtgccggcgaggccgccgcgctggccacgcgcagggtcatggagcggcacggcctgcagcgcgccgctgccgctgccgctgccgcccaccgagggtaggcggcataggtaacacgtagtgtcggtggcgttcgtcgtgcaactgtaatcgctcgttccgttacgcttgttaaatttgtggatggtcggtcggtcggtcagtc

SEQ ID NO: 12231 - DNA, 990 bp, Sorghum bicolor
  Clone ID: SORBI-28MAY03-CLUS28033_1
tctgaccccggccggcctccctgtccggctgcccctgccccgcggctccgggctccggcgggcccccgctgccggccgccggctggtcccgactgcgctcgtgctccgacccgcgggggcgtccgcagctctcctgccccagcggctcctccagccgctgccgcccctgtgggccgccgccctcacgccggcggccgtgcgcccgcgccacgtcgccgtcgccgagcccctcggcagcttaactgaagttataagtaactgcgacgcactgtgcaagagaattgctgcagaaggaccggaaagcctacgatcatctgttcaacctttcattcctgctagcgcagaggcagaagcaagcaatccgaatccccctgtcctggctgcgtgtttcttccaatcccgcgaatggcaacatgtgaatgccaactaaattggccgaaagcagggggaaatcgaaaacaagatagaaacagctgatgcattggcagttaagcttctccagcggttcaactattgtctgacctccatgcgagccgcctcccacactcctgctgaagttcatccgctgcagatcgaacttggtgcgttgcagggcagcttaactgaagttataagtaactgcgacgccctgtgcaagagaattgctgcagaaggaccggaaagcctacgatcatctgttcaacctttcattcctgctagagcagaggcagaaggaagcggttcacttgacccaaaacaggagtcgtgaatcgtacaatctaactgctggcagcatgtgcaaagaaacttcagaggatggttagtaggtcctggataaatgcagtatatatacatacatgtttccaaatgtctgaaattctgtctgtcttgttgtagtatctagagtcatgaccgtgtctgtgcacagcaccgtctctgcgtgcggtgcggcactaatttttacatcagatgaagctcggactttttacctggtgtctgaaattcatctgc

SEQ ID NO: 12232 - DNA, 1215 bp, Sorghum bicolor
  unsure (1)..(1215): unsure at all n locations
  Clone ID: SORBI-28MAY03-CLUS28856_1
gcacgaggcccccgcctcccttgtgtcatccccatccgcctcgacctcgcggccgcaacagcgaaaccctagcctcgacctctatctcctccggccacagctgttcaggtcagcggtgaaggatgagcaggcgctggagccgcacgatctacgtcggcaacctccccggcgacatccgggagagggaggtggaggatctgttctacaagtatggtagaattgttgacattgacctgaaggtccccccaaggccacctggttatgcttttgttgagtttgaagatgctcgtgatgctgaggatgcaattgctgggcgggatggatacaactttgatggacaccgtctaagagtggaggctgctcatggtggtagaggtaatacttcctcgtatgatcgttcaagtggctttggtggtggcggtggtggagcacgtcgtggtgtgtcgagacactcagagtatcgtgttcttgtcactggactgccttcttctgcatcatggcaggatttaaaggatcatatgcggaaggctggtgatgtctgtttctctgaagtgtatcgcttttgcttaatttttctattgttagtgattgatgaatacatgctgtgtggatttgtgcctataaagaagctggatgatactgaattcaggaacgcctctgggcgagcctatataagggtgaaggaatatgatggcaaacgtggtcgctcctactcacgtagccgaagcccaagccgtagctacagtaaaagcaggagcccgagcaaatcacccaagactcgccgttcatcatctagatcccggtcgaggtctgtttcttcccgttcaaggtctgcatcaaaaggacgttctccgtcaagatcaccagcaagatccaaatctcctaatgcttctccggcaaatggtgaagcagcaagccccaagaagcagagcccaaacaggagcccatctggctcacgctctcctgatgcgaaacctgaataaaattgctatgctattaaaggattgcagatggagtccagagctcttcttttctggacacttttcctccatgttgttctagcaccatctttgtcttagcaacagtacgagattggatgatattaactatcagtatcagcttgtatcgatggatcccaaccccatttgcttttgcttaatttttcntattgttagtgattgatgaatacatgctgtgtggatttgtgctatgtgg

SEQ ID NO: 12233 - DNA, 630 bp, Sorghum bicolor
  Clone ID: SORBI-28MAY03-CLUS33435_1
gcacgagcgcggggagaactaaccatctatccatggcgacgcttcacttgttccacgtagtgtaccagttcatacggacggccgctacgcctctagtaccaccacaacagccacttttgttcgtgctcgtgcctctcatcctagtgctgctgcctctcatctgccggcgcctccaacaccgccgcaacaacgccggcgatgacgagaggaagcagtcgatgactctgctgccgtcgcctccggggaggctgcctgtcatcggccacctgcacctcgtcggcgacctcccgcacgtctccctccgtgacctcgccgccaagcacgacctcggcggcggcctcatgctcctccagctcggcgccgtcccgaacctcgtcgtctcctccccgcgcgcggcacaggcagtcctacgcacgcacgaccatgtcttcgccacgcggcctgcgcccaaggtcttggacaaattgctctacgggccgtcgaccatcgcctttggaccctacggcgaccactggcgcaaggtaaagaagcttgtcaccacgcacctcttcaccatgaagaaggtgaactcgtttcgccatgcccgccaagaggaggtgagcctggtgattgctaagctgaagaagccat

SEQ ID NO: 12234 - DNA, 1216 bp, Sorghum bicolor
  Clone ID: SORBI-28MAY03-CLUS24593_1
ttctggagcccagaaagagagaaggttctccaagtcaatcacaatcacgaggagtcatcagttcatcacgccatacaacacggacagcgacgagacgacgacgccggagagtaacggcgagtcggccgcgagagtgaaggcgagtcggcgaccatcaaggaaggacatggccacgttgcccggcagcgcccccgccgaggcggcggagctcgtgccgacgctctcctcgctggagccggtctacggcgcgggcgcgcagctcgacgaggcgcgcctccgcttcgcccgcctcggggaccgcttccacgccgtctacggcgcccgccccgcgctcttcgcccgctccccagggagggtgaatctgatcggggagcacatcgactacgagggctactcggtgctgcccatggccatccgccaggacatgatcgtcgccatccggagggccgacggcggccaggtgcgggtcgccaatgtcgacgacaagtaccccctgtgcgtctaccccgccgacccagataaggaaattgacataaaaaatcacaaatgggggcactatttcatgtgtggatacaagggagtttacgaatactgtagatcaaacgggatagatctgggcaaacctgttgcacttgatgttgttgttgatggcacagttcctcaaggctctggattgtcaagctcagcagcttttgtctgttcagcaacaattgctatcatgggagtccttgagaaaaactttccaaagaaagaagttgctcaattcacttgtctgtctgagcgccacattggaacacagtctggaggcatggatcaggctatatctatcatggccaaacctggattcgctgagttgatagattttaatccaattcatgcaactgatgtccaactacctccaggtggtacatttgtgatcgcccattgtttggcagagtccaagaaagcagagacagctgcaacaaattataataaccgtgttgtggagtgtcgcttagcagcgattgttcttgccatcaaactagggatggataggaaaaaagctgtctcctctgttacaaccctctccgatgttgagggtctatgcgtttcttttgctgggaaagaaggttcatctgatcctgcaatagctgtgaagaaacttttgcatgagaatccatatacagctgaagaaatagagaacattacaggtgaaagcctgacatctgtcttccag

SEQ ID NO: 12235 - DNA, 1165 bp, Sorghum bicolor
  Clone ID: SORBI-28MAY03-CLUS24569_1
gcaccacgggcgacgcagcgagcgaacgcgccagcgcacgcgcagtcccggagagttgagagagagtagttgtagcagtagtcgcgatgtccacggaggaggctgttgttgccgaggtcccggtgaccgtggtggaggccgaggcaccggcggcccaggaggcggagaaggacaaggcgaagaagacggcaccgaaggagaagaaggcggcgccgaaagagaagaaggacacggcaaagaagccggcggcgcaccctccctacgctgagatgatttcagaggcaatcgctgccctgaaggagcggaccgggtcgagctcggtggccatagccaagtacgtggaggagaagcacggcggcaagctccccaccaacttccgcaagcagctgacctcgcagctgaagaagctcgccgccgccgggaagctgacgagggtgaagaactcgttcaagctgccggtcaccgcccgccctgccgccgacgccaagcccaaggcggccgccaagcccaaggcacccaaggccgccaagaccgcggccaagcccaaggcctcgccgaaggcgaaggctaagacggcggcgtcgcccaagcccaaggcgaaggccaagcctgccggtcccacgcctgctgccctgccgaagccccgcgggcgccctcccaaggttgccaagacctccgccaagtcctcccccgccaagggagcagccaagaaggctgctgcttctgctgctgctgccaagaaggagaaggcagtggcatcgtctaagaaggcggtgggatcgcccaagaagaaggcggcgaccccaaagaaggccgccgccgctgctgctccagccaggaagggcgcggccaggaaggccaagaagtaggctgcttgccttggcgccggcgatcccttgcgtccctccattccgcctatagtatagatttccccctcctatctggattttgatccattcgtagtcttgtcattagctctagagtctagattcgccagtagctactctctgcgtgtatgatgaacatcaagttaagctataatggattcagaggtagtagtctgttgtctgtaaaaaactttgcgatggttgattgtgtgcgatgctcctctctgcctgtatgatgaacagcaagttaagctataatagtattattatgcttactc

SEQ ID NO: 12236 - DNA, 1440 bp, Sorghum bicolor
  Clone ID: SORBI-28MAY03-CLUS2463_1
gcacgaggagcctgttaatgttgggaggcctttgattggtgaagcacctaaaaatgatgagatcgatgccttccttgaacttcaggattcgatgagtgtggctagcaatactgaagctgatgatgctggtatgcaagagcggtggtggaagcccagttcgccttttgggacctctgttggcacacctggtgctgaattctatgatgcatttgaagaaatatcaagtgatggtggaactcgatcttcacgagccatggatgatgaccttcgtgaaatgaggttaagtctgttgcgtccgattgagaggaggaagcaagcagaagaagcacttgagatctggcagaaggaatggaagaagctgagtcaccacctatcacatgttgccttatcacttccatctccaagtatagctgaggatactgatgattcaagcgtggatcctggagctgagttgtgccagcaaataactgtttcacaacttgtagctgctgctattgcccagggttttgctcgtgctgaagttgaatcagagatggaaactgtgattgcagcaaagaactttgagattgcaaggctgtcggatagggtccagtactatgaagctgcaaacagggaaatgtcccaaagaaaccaagaagctatcgagatgtcaaggcaacaacgcaaggagcgtaagaagcgacagaagtggttctggggatcagttgggcttgcagtcacccttggtgccacagctattgcctggtcttatttaccttcatcgcagccccaagctagtgcagattcaaagagtactgccaacaactagagctaggatgaagacatatctcatttcagaagcctaacaaagctctaactatactcctagaggggaaaaaaaggttgtataagttttctcttttggtgatcggccatgatcgctacaatctcttcatttgttgcttcgtctgtaaaaatgttggatgggccatctccattcaggattggccccattccaatcaccgtaaatctctctctgcatagatggttgagcaaataatacaagcaatgtggatatggttagtaatccatgcccaccgaccccactcaagaggagttgattttgtcaaccacagttttgttctgctcatcctttttttctgttttcaaacaaagagataaggactcagttctgtgcgcttgtaactgcattaagtgtggttctgtagccgagggttatctgaaccctttgtggctatgacagagcaactaaatgccgtggcctgggcaacagaattgcacattctgtttccattgctctttgaattttgtatatttatgtttaagtaggaactgtcactacattgaaataacgttgctggacacgcagcgcccatatactgttagttgttgcatctacgttgaaacatttatagggtgttcgtttaaggaatagttaaa

SEQ ID NO: 12237 - DNA, 890 bp, Sorghum bicolor
  Clone ID: SORBI-28MAY03-CLUS24875_1
acttgccaaggttgtccatgaggaatttggcattgtggagggccttatgacaactgttcatgccactacagccactcagaagactgttgatggtccttcgatgaaggactggagaggaggacgtggtgctggccaaaacataattcctagctccactggtgcagcaaaggctgttggaaaagtcctacctgagctgaatggaaagctcactggcatggccttccgagttccaacaccaaatgtctctgttgtggacttgacatgccggattgagaaaagcgcctcctatgatgatgtgaaagcagccatcaaggcggcatcagagggtgcactcaaaggtattcttggctacacagacgaggacgttgtttccaatgattttgttggtgattctaggtcaagcatctttgatgccaaggctggtattggactgagctcttccttcatgaagctcgtgtcttggtatgacaacgagtggggctacagcaaccgggttctggatctgatcgcccacatggctcttgtcagcgccaagcactgatgttcgtgctcgttcctccagtagtagcctgggaaaaaaaggctgcaattttgacggccattttcttttagctgttgtttggaataagataaaaatgctggaacgctttgaactcgcgcaaaaatggactcagatccatgagctgtattttagttgtagaaggggcaaatttgcaccatagtaccctgcggaattgttgattgatgagtcctatggttcgtcgacttgatgttttgttatgatgtgtgggcccttgaatgagttgatatttttttaggccatccatgctttaatggaaatatatataggatggcaatggcaatccgtcgacttgcccggtatttggttg

SEQ ID NO: 12238 - DNA, 916 bp, Sorghum bicolor
  unsure (1)..(916): unsure at all n locations
  Clone ID: SORBI-28MAY03-CLUS25303_1
taatacgaaaaaggctgtcactcccaatgctgctagaagtggcaagctggaaacaaaaagcaataacaacagactgaagggaccttcagtattggacagccattctactaggtcaaaaagaatggacttgcaagcatctggcaagcagaaatcgagttctgttaaccttcctccaaggaaaattttcagttctactgccggagaaccagcagttgaaaccatttctaggtcaaaaaagaaagagggcgttcaggcgacagtgcaatctcgagcatccacttcaaagagaacaactcctttgcagactggaaacttaaaggcgagggctccaaatccaccagcaccgcctgcgccacctccaccacgtcggacatcacgaatgataagcaaaccaactggtgcctcatcgattgtcggaagaaagccaaaggcttcagcaccacaatggcactgatgcagtgtagagcaggaaaagccgttcagtctagtggcctgcagaacatgatggatctgagcgacgtcattacttgccttcctttgtatggtgtacctcagtatctgtaaaaaatctcagtacctccgttggcccgtctcttccgtctcttcctttgcagagcagctagtcccgaagtgtagtctagtgtatgtagtcgcgcgtatcatatccaccggtgcctagtttcgttgtccacaaggaacttagaacagtgtaaatacctggaaataaattcgcggtttagctaaagtaagtttcagcccaaaatttgtgaacatctatgtatgtcattagcaatggaagccctcttttctctttcttagttctttttttttttgtcggattcttcttttttttgttgttgaaagggttattggcaaccttttgattctaagatgaacctgaactttcncctgtttt

SEQ ID NO: 12239 - DNA, 961 bp, Sorghum bicolor
  Clone ID: SORBI-28MAY03-CLUS30225_1
gcacgaggaaacatctcctacatatgctcaaggtattaccgagcaccagagctcatatttggggcaacggaatatactactgctattgatttgtggtcagcaggctgtgtcatggcagagctgcttctaggacagcctctgtttcctggagaaagtggagtcgaccaactagttgagatcatcaaggttttgggtactccaacaagggaagagatcaagtgcatgaacccaaactacacggagttcaagttcccacaaattaaagctcatccgtggcacaaggtttttcaaagaaggcttccgcctgaagcagtggatcttgttagcaggtttctacagtactcaccaaatctacggtgcactgctttggaagcctgtatgcaccctttctttgatgagctgagagacccaaacactcgtctaccgaatggtcggcctctgccgcctctcttcaacttcagatctcaagagctgaaaggtgttcccctagaagtcgtcgaacgccttgtcccagagcactcaagaaggcagagtttgttcatggcgctacggacctagttttcgccggtctttttgccccctttcccccctgctgtttgccaccctcagggaagcttgtaaagctgtagcttctcctttccttcgtcctcccctttctttcttcagagctttgtgtggatgagatccttgagatacactgctagagctgtgctccaagtgtgctatgtagattgctgcctttgagtttgaggttggagagttcggttgcagtgttgtgagaggcttgtgaagggtgttttttttctttttgtctaattttccgtgcttctctggcttggattgttccttaaattgttttgaactggcttcaagatttgggtatgtgaaggctgtgtgtagtcaaagtagttggatcatactaacagcatcctgctgttaaatgaatgaagttgtttgtggt

SEQ ID NO: 12240 - DNA, 714 bp, Sorghum bicolor
  Clone ID: SORBI-28MAY03-CLUS30227_1
gcacgaggagacgctctcctccctcctcctctagtcctcttcctctcccactccactccacattaccggaatcgaatcgaataaagtactagtctagtggcggttctcagtggtggccgctccggctggattcctcattttttgttggcatcttctctgatctgatcagatgcaatctcgccgtcgccgtccctagcaaccgcacgcttcctcgctcgccgcgaaccctagagggttaggtgtcgccgcgaacccatggccttctggtggccgctgctggtgctcgccgccgcatacgcgctctgccgcctgctcctcttccttatcccgccaaccgtcccatccatcgacgtcgacgcttccgacgtgttggctaaggaggacagcttcatctacataccgagaaagggtaaagcagctcagactgacaaggtccaatgctatgaaccagcgaccatgaaatacttggggtactttcctgcgttgactcctgatgaggtcaaggaacatgttgctcaagccaggaaagctcaaaagatatgggcaaaaagcagcttcaagcaaaggcgccagtttcttcgaatccttctcaagtatatacttgaacatcaggatctcatatgcgaggtatcatctcgggacactggaaagactatggttgatgcttcattaggcgagataatgaccacatgtgagaagattacctggctttta

SEQ ID NO: 12241 - DNA, 1055 bp, Sorghum bicolor
  Clone ID: SORBI-28MAY03-CLUS3046_1
ccgggagtaccacaggctctggtagcacgacacggtccccccccacaaccaccacccgtcccaacgcctccaacgacctccgtcctccgcccaaaatactccgctcgctctccctgttcctgtttctcggtgttgccccctcggctcggccctcgtcggcggactctgctgctcctcatggcgccgtcctcctcctccccgtcctcgttgtcgtcgtcgggcggctcccacgcgggcctcgccatcgcggccaccgccatggcgctctccggcacgctcgtcctctactccctgtgccgcgccaagcagccgcacctggtcccctccgacgccgccccgtcccctcgtctccgcccgtgcctcgcctcgtccgacaagcggaagaagaagaagcgggagatggcgcggcgagggaagagccagcagaagcgggtgcgcttcgcggacgacgtcgtggacaccaaggacaatggcgccgccaacgccgctgccgccggggcggcgcgggaggaggcggaggcggaggccgagccgtcgtgctgtaccgcggcgctgaggacgacgcccatgccggccaaccgggaggcgctgtaccgcggcatgctccgcggccggtccatgctcagggtcacctgctcctactagctaagctagcagggtagcagtagcaccacctgccggcggccccccgacgtaaccactccatcatccattaatctagacctctccgacctccagcaagcttgctcctctccgtgtctcttctctactcttgtgtgcgcgtgctgtgctgtgctgccaactagtggcggcgctgctaattagttgcccggaattaattaatcgggcctagatagctccctccctcgcccatttgtttgctgggaaagttttgtaattagtggccgtccccgcgaggcgagggagctgatccgtgcgtgctttactgttgatgctgtgttgcttgtatgtatggtagcttctttgcttgtactacattagtgttgtactgagtgatgatgatcagtgaaacgattcttcactgttccaagctt

SEQ ID NO: 12242 - DNA, 1202 bp, Sorghum bicolor
  Clone ID: SORBI-28MAY03-CLUS30540_1
ccgtgtcttgccatctgaagaccttccccagtgtgcacttaaaagtgatgaactggtgcagatatctggagcaccttctcttgtaagaaaagctctatatgaaatatctactcgtctccatcagcatcctcgtaaggaaaatagacctcttgaagaaataataaatgcaagcacacaaaggaaacgcgagtccccaatactactacaacatgaaaatccaatgttgccgcacctgcatagtgatcatccacctccaatacccctgctcgatccctatagaagtggactgcaatatcatgttactgaaactgaagagttttctatcagaattctatgtgcttctgagctcattggttcagttattgggaaaagtggggctaatgttaagcgagtagagcagcagactggtgctcgcatcaaagttcaagagggtgacaaagatgcttctggagaaagtctgatcattgtttcatctaaggaggtaccctcggagccagtttccccagcattcgtggctctcgttgtgctccttgtgcagactgctggacaaattcatggacgcgaggattacagaggactgacaagtgctactggaaggttcttgagcactattgaactgaggattccaaatagttctttggagtctattgtcggtgttggcggggtcaatctagcagagatccgtcagatttctggtgcaagactgaggctacatgaggctcatgctggttcttccgagtctgtggtggagatccagggcacactggaggaagcaaaagctgcgcagagcctcctgcagggctttattagcgcaaacagccggagcattcagcagcaaccccaatcttctcgcatgccactttacccaagctggggatagcttctggtctcatagtcgtggcagaagccgtcagtgcgggcatgtcaatcaaaatggttgcattccctgcgggcatgtcaatcattctttgcagtgccgtcagtgcggtaaacaatttgcactcgagcatataatgaacctctatgtatgtacgaggaaacctgtgggatggttgtattgtacgtgcacacgctgccatatacagctaacagcttcactttgttccctccactgttcttatatgcatgcaaatcttggacttctaaactaggcatgcatgcatgggattaatctgttcgcaactgcacgatttgatactgct

SEQ ID NO: 12243 - DNA, 1569 bp, Sorghum bicolor
  Clone ID: SORBI-28MAY03-CLUS3064_1
gcacgaggccgacgccctccaccgcctcgccacgcgcgctgttgagatcctccacgccatggccatccccattgagctatccgaccgggagtccctcgtcaagtccgcgtccactgctctcaactccaaggtcgtctcccagtactccaccctcctctcgcccctcgccgtcgacgccgccctctctgtggtggatcccgctcaccctgaccttctggacctccgtgacatccgcatcgtcaagaagcttggtggcaccgtggacgatactgagctcgtccgtggcctcatctttgacaagaaggctagccatgctgctgggggcccaagtcgggtggagaatgccaagatcgctgtcatacagttccaaatctcaccacctaagactgacattgagcagagcgtcattgtatcggactatgcacagatggaccgcatcctacgtgaggagcgcaattacatcctcgggatggtcaagaagatcaaggcagctggatgtaatgtcttgctcattcagaagagcatcttgcgggatgcggtcactgacttgtctctgcactatcttgctaaggcaaagattctggtggtgaaggacgtggagagggatgagatagagttcatcaccaagaccctaaactgccttcccattgccaacattgagcacttccgcacggataagcttgggtatgcagatgttgttgaggaaatctctgttggggagggcaaggttgtgaagatcactggtatcagagacatgggtaggaccgcaactgtacttgtcaggggatgtaaccagtcggttattgatgcggctgaacgcagtctccatgacgccctctgtgtcataaggtgcttggtcaacaagaggtttttgattgctggtggtggtgctccagaaatagagatgtcaatgcagctggctgcttgggcaaaggaacttcgagggatggagagttactgcatcaaagagtttgctgatgcacttgaggtcattccttacacactggctgagaatgctgggctcaacccaatctccatcgtcactgaactcaggaatcgccatgccagaggtgagaagaacgctggcatcaatgtgaggaaagggcagatcacaaacatcctggaggagaatgtcgtgcagcctttgctggtgagcacaagtgccattacgctagcctgcgagtgtgtcagaatgatcttgaagattgatgacattgtcactgttaggtaaagagcgtgaagtcggtggtcatgtcagcctgctctgttctgtctggattgatattagttaggttactacttaatgtagaactttattgcgtgtttttggatgttttaaacacgtggttttgatgttagtacggagaggacagtaatgtaccctatccttgcatgaaactaccagggctgcacctgcgatatccattttcttttgattggccgtctatgcctttgtttccgttgccgcttacatgtaaggcatgcttttccatgagattttgcgcaggttgtgctgtaaactgttattagctttatcatcttaaatatgttttttttaaatgggggggg

SEQ ID NO: 12244 - DNA, 792 bp, Sorghum bicolor
  Clone ID: SORBI-28MAY03-CLUS25901_1
ccgcgacaccatggctgcatccaacggcggtggcggcggcccgggccccgggccgatctcggccgaggcggaggcggcgtttggagaggccatcaggctagtgttcgggcggtggacggcgctgcagatggcggtggagaaccagtggggcggccgcgactctcgctccaaggccgatcagttcggcgagtccatcctcttctggttctgccgcactaagggtccacattatttcgaagacttggtggatatgatgtatgacacaatttctgaatccttcaattctgactttgaggataatagtgttgaggaggttgctgaacagttattgatcatacatgaagaatgtctgcaaaacaattattcttctatagagaagttaaggaactcacatgttcaggggaatgctgtttctcaaagtagacagatagtggccgatgatgacgatgacagtgatagctcagatgatggtgatgacacatcaatgatggaggatcaagaggctcctccggaagaaatggcagtggacaggccaaggccgcccaggcctacacccgatgccgatgggtggaccgttgtgcctcctaggcgtggtggtcgcaacaggaattaggcacagctggaaaccttgctgaatatatacatgttgctagctgccggctttcgtacgcggtgtttctgagtgttgcggcttcatcctttacaatgtatcactcgggattttactcgacagggatgatgttgagtgtgtagtagtatgttttgtttgccaccgcccaccaaattgtgtaa

SEQ ID NO: 12245 - DNA, 891 bp, Sorghum bicolor
  Clone ID: SORBI-28MAY03-CLUS25807_1
gcacgaggcacaaccagccagcttcctccgcttcctcacgcacacaccgccgccggcaggcaggcatggagaagaagcgggtggtcatcgtcggagccggcgtcagcggcctcacggtgtgcaagcacctgctggagctcggctgccggccggtcgtcttcgagggggacaccgtgctgggcggcgtgtgggcgcgcgcgccggcctgcaccgagctccagacgccgcggcccatgtaccagtactccgacttcccgtggccggagaccgtgacggaggtgttcccgaaccaccgccaggtggtggcgtacctcgacgcctacgcgcgccacttcggcgtgctggggtgcatccgcttcgcccaccgggtggtcggcatggagtaccacggcggcggcggcggcggcgtcagcgagcaggacatggacgcgtgcgaggagtgggctgggaacggccaggcgttcggctccggcgccggcgagtggcggttgtcggtggctgacgccgacggccacgttgagacacacaaagcagacttcgtcgttctatgcatgggaaggtcacgattcagcgattggtttgaggaataggacacacaaagcagacttcgtcgttctatgcatgggaaggttcagtggtattcccaacatacctacattcccagcaggcaaaggtccagaagtatttgatgggcaggtgattcactccatggactatgccaaaatgggcgcaagtaaagctaaggagatgatcaggggcaagcgtgtaactgttgttggctacctgaaatcagcacttgatattgccgctgaatgcgccgaagtaaatggcactgctcacccatgtacaatggtggtcagaacaaagcactggatcttaccggactacttc

SEQ ID NO: 12246 - DNA, 689 bp, Sorghum bicolor
  Clone ID: SORBI-28MAY03-CLUS26017_1
gcacgagggcaaaggttacatggaccgagactagcgtaactgttactggcccaccacggcagccatttgggaggaaacacctcaaggctattgatgttaacatgaacacaatgcctgatgttgccatgactcttgctgtggttgccctctttgccaatggcccaacagctatcagagacgtggcgcccgggggagtaaaggagaccgagaggatggttgcgatccggacggagctaaccaagctgggagcatcagttgaggaagggccggactactgcatcatcacaccgccagagaagctgaacgtgacggcgatcgacacatacgacgaccacaggatggccatggccttctcccttgccgcctgtgcggaggtccccgtcacgatccgggaccctgggtgcacccggaagaccttccccgactacttcgatgtgctgagcacgttcgtcaagaactaagcgtgtgatatactaccacgcagcgggattgaagtgatcttgctaggcatgcgcggaggaaatacattttttttgttctcttttccgggataagttttgagcatgtaatattagttgctcgtagcatgtttctatgacagatcttgagagtgtattgtacgtccaaattcgtatccagagtggttcattggaacaataataagaataataaattacgtttcagcggtt

SEQ ID NO: 12247 - DNA, 723 bp, Sorghum bicolor
  Clone ID: SORBI-28MAY03-CLUS26772_1
tcaaagggttatcgagtgtggtggatacattgaggatggctacctcaacggtgtactctctgtgacccgggctttaggggactgggatatgaaactgccccaaggctctccatcgcctcttatcgctgagccagagatacactggaccaccctgacagaggaagatgagttcctcatcattggctgcgatggcatatgggacgtgatgagcagccagcacgcggtgagcacggtccgaaaggggctccggaggcacgatgaccctgagcggtgtgctcgggagcttgccatggaagcgaagaggcttgagacctttgacaacctcactgtgatcatcgtgtgctttgtccctgacctcgcgggggctgcctcagcagctgcgccttcttcagagcaggctccggctcccgctggaaggatcaggtgctgcaagagcctgtcgccggaggcactctgcaagctgaggagatggcttgagtctgaccattagacgctgctgtagagagaggcctgtgtttctgtgctgtggctgtgtaaatatttctgcgctgatgttgttcgtacgtctagtacggctgtgcttacacggccagcaattttgtagcgagttcctgaggccgcggcgccgcctcttttgtttcacaccgttttgttggatgtacataccattgttgccgttgctactcggtgcggctcagtttggcagaggggatatctggcctc

SEQ ID NO: 12248 - DNA, 812 bp, Sorghum bicolor
  Clone ID: SORBI-28MAY03-CLUS2681_1
cgtccgagccacttggttttaggacttaggagcaaggtgtagttatctgtaatttccttttggtataaaacatcaactcttttcttgtattagatttatggcagatcatgatgcctggagagaactttctgaaacatacgttttcttacaaatgtacaagcaagctgccttttgatatgaggagctaatattagcctaaccaactattccactctatcatatagcctatgctgaggtactgtacactatgggtggcttggaaaatcttcagacagttaataagtactatgcatcaacaatccagttgactggaggcaagaatacaagagccgtctttggtgtatgtctgtgtacgtcggcaatcaatcagttaaccaaaggaaggaataaagaggaagagggctcagagctgcagagattagctgcagaagtactgttgaagaattacaagcaacaggctccatcaaaggtgccgcttatcagcaccatgttgaagaacatgaaactcagctgataccaactagcttcgcacattcacagtggcccggttgatagatagttaaattaaattgatgtggcataatgcttgtttttttatggcaccaactttgcaaggcttataaaagtacatgctcccaaggccatgggttgtacttgtacaatacaacacctgtttgcttaccaagacatatgcatggcttgtttttcctcggatgttctactatagatcaagaaacccccgattgtatttcagcacaaacaaaattttggatcagtcactgatgaaggtcctcctgttgattttgtttggt

SEQ ID NO: 12249 - DNA, 1060 bp, Sorghum bicolor
  Clone ID: SORBI-28MAY03-CLUS3113_1
gccggccgggccgggaggttttcggccatcgggcgctcctcctctccgttttcgcgaagcagctcggcacccgcagcccgctggcgagattcccggaggagcaggaaggggagcagcagccgtcggaacacccgcaggagagaatccaggaggagcaggaaggggagcagcagccgtcggggggaagaagaagaagatgtcgtacctgctgccgcatctccactcggggtgggcggtggaccaggccatcctcgccgaggaggagcgcctcgtcatcatccgcttcggccacgactgggacgagacctgcatgcagatggatgaagtgctggcagcagtagctgagaccataaagaactttgcagtcatctaccttgttgacatcacagaggtccctgatttcaacactatgtacgagctgtacgacccttctacggtgatgttcttcttccggaacaagcacatcatgattgatcttgggacaggaaacaacaacaagatcaactgggccctgaaggacaagcaagagttcatcgacatcgtggagactgtttacaggggcgcccggaaaggccgtggtctggtgattgctccaaaggactactccacaaagtaccgttactaagaagtgaagcattcacgcggagcagcagctgctgtttgctagcctagtatgttccccttatgcaatctattaggggatgtttactcagacagtcagttcgactggcaatgcttaactgtatcttggcatgccctagtatattcaagttgctggcgttaactatatcttggcatgccaaagtgatcttgtgaagttgtgatttgaggtgattgctggagtacccccccccaaaaaaaaaaggatttgcgttctccctccctttggaatggctatatgtttactaatgagaaacagttacatgtttggaacgtgggaactgtgctttgctattttgtatgaacgagtgcccctcaatctgtaagtccaatataaattgagctctttttgatggtgcccactgcccaggatatgcagaagctttgcttgaccgcgtcc

SEQ ID NO: 12250 - DNA, 379 bp, Sorghum bicolor
  unsure (1)..(379): unsure at all n locations
  Clone ID: LIB3478-007-P1-K1-G1
agcagcgcagcacccgcagcgacaggagagaactcgagaagccccggaggaggagcagccgtcggggggtcggggggaagaagatgtcgtacctgctgccgcatctgcactcggggtgggcggtggaccaggccatcctcgccgaggaggagcgcctcgtcatcatccgcttcggccacgactgggacgagacctgcatgcagatggatgaagtgctggcagcagtagctgagaccataaagaactntgcagtcatctaccttgtcgacatcacggaggtccctgatttcaacaccatgtatgagctgtacgacccttcgacggggatgttcttcttccggaacaagcacatcatgaatgatctcgggacaggaaacaa

SEQ ID NO: 12251 - DNA, 1606 bp, Sorghum bicolor
  Clone ID: SORBI-28MAY03-CLUS3093_1
gacgcttgggaacgagcgacggagacctaggcagaagcaggacaggagctcccccatggcgaccggcaacctggcgagcgtggtggtggcggtggacggcagcgaggagagcatgaacgcgttgcggtgggcgctcgacaacctccgcctgcgccccgacggcgagctcgtcgtgctccacgtccagccgccgcccaacatcgcagcggggctcaacccggcgcccatccccttcggcggccccagcggggtggaggtgccggcgtccgctggcacagtcaaacatgaaagaaatggaaaaacatattagcagtcttcaagaggaggtaaagggtcatcaagataaggccactgaccatcagcaaatagaagaatcgctgagaagcacaatctcagaactcaaggtggtacaagaggcactggagctgtcaaagtcacaagtggcagatttggagcagaaacttgcctcccaggatgctgatatcagtaaactaactgaagagttgaatctccattgttcgtctgaagaatcccttaaagagaagactcttaaactagagactgaacttactactgctcttgaggaactacaagcaaagctattgagtttgcaggaaatggagacaaaacttgatgagcagtcaaaaggcagacaaacaagtgaggctgcactagagaagcaaaatgggcagctcatcgtattacaggctgagcttgacaacttgaaggatgaaaatgaaactctccaagggtctcttgctgatcttaactcaaaattttctgagaaagattccatgctgcatcaggctgaagatgagcttgctaaagcacaattggtcctctcagaagcactgtcacaaaaagaagagttggagctgaatctgaactctcttagtgagcagcatggtgaatccaaagcttttggagaaaatgcaagtcagaagattctcgagcttgaggcacaagtacacgcaatgcatgcagctgaagaggcactcaacttagagctaaaagaagccgaggcaagtgtcaaagctgctgagaataaaagctcagaccttgagcaacaactcagtgagattgagaataaattagttgcatcaagtgaagaaatagagttgctgaaagagcgtattcaacaagaagctgctgtatcagcagaaagaggaatgcagcttgaagaaacaatgaccagtgtagagggatacaaagaaaaaattaccgagctacaatcctccctagattcctcggtgtctaaaaatcagctacttgaacaagaagtcaaggagctgactgataaatgttcagagcatcaagaacaagcgcattcagttcagcaaagaagtctggagctggaagatttgcttcacacatcaaagactcatgctgaaggtgcacactctcggacacaggagctggagcaggagctgaacaatacatatgaaaagctcaagggggttgaagaagaactcgagcagtacagaagcaaggcttcacagctcgctgatgatctagaagcttatcagacaaaagcagctagtcttgaagctgtggtggaagcagcaagcgagaaagagaaggagcttatggagtcattgaaccaaat

SEQ ID NO: 12252 - DNA, 1130 bp, Sorghum bicolor
  Clone ID: SORBI-28MAY03-CLUS32_1
gcacgaggcaggccttcttctaccccccatcccgcctcccccgacgcccacgccccaccagcaccgcgccctcttctccgtagccgagtcccagcccctcacgcccgcgctcctcggcgccctgtcgagtcgagcccgcttctcggccgatcgacagcgaacgcagccccgcgccgacgagagctttgctttcggttgtgtataacgacgacagcaggaggtagataaaaggcgcgcgatgtgcgacgcggcggtggctactgcagcggcggcgcggtacaggggcgtgcggaagcggccgtggggtcggtttgcggcggagatccgggacccggcgaagcgcgcgcgcgtctggctcggcaccttcgactccgccgaggccgcggcgcgcgcctacgacgtggccgcgcgcgccctgcgcggcccgctcgccaggaccaacttccccgcccaccacctccccgcgctcacctcccgccctcccgcggccgtggccgcgcccacgtgcagctccagctccaccgtcgagtcctccagcgggccccgcaccggagtgcccagggcgacgccagcggcggtgcatcgcaggcgtgctgctgcgaagccgcggcccctgcggcaggccgcgcccgccgacgccgactgccacagcgactgcgcgtcgtcggcctccgtcgtggacgatggcgacgacgcctccacggtccggtcgctctcgtgcccgcgcccgacgctcgacctcaacctcccggcgccgctcgacgtcgatgatagccacgagctcgggctctgcacggagctgcggctctgagcgatcggatccacggacggagacgaagcaggggagagataggcggttttgctttggtcttcttttcttgaccgggttctgctttgacttgtcgtgctcgtgagagagcttgtaccagtgctgccctgtactaatggcaatagaattggatgatgattcctgcaacgaattcattcagaggtcagtcagatcgtcgagagtgttattttttccatatctcttgtatttggatctgatattgccattctgtttgtactagaaacatctatctaagagagatgtttacgaatcaacacggatcttgccacaatcttgagat

SEQ ID NO: 12253 - DNA, 968 bp, Sorghum bicolor
  Clone ID: SORBI-28MAY03-CLUS3251_1
tgattatggtagccgtggcaggtatgactctggtgaaactgatgggcgatctcgtaggtctgctagaggtcgcagtagaagccgtagcagaagtcacagtagaagccgtagcccaagtcccaagaggtctcgccgacatgaagctagacgtagcaggactaagagccggagtaggagcaggagcaggagctatagaaaccatcgtgctagccgcagcaagagtcgcagccctgttgctagccgaaggtatgaaaagactgctgctatttcaggatctgctcggcctaactcggggcatgcagagcacaaaagccctccaagatctcactctgtggatgaccatgtgaaccactctgaccacaaggatgaccacatggaagatgggaagatggaaagggttgatcttgatcgctcgcccagcccacaagatgacaagtctgctccatatagtcctgtgtacaatggcaaagccagtggctcgatgagccccaacgttcagccagaggcagatgccaaatatgtcaaaccttctgggaaacctgagcctgcatctccagtgcgccacagcaaaggcagagatgatgatgaggaaggtatcatagacgaggatggagagattgctgaggatgatccacgtgcaaatgcagctgtgcagaatggtaataactgacggagagtggcctgcatcttatgtgacaacaagcctctgttatgcaaactgcagtcattcccatctgcaagagtccagaatacagaaatgcatttgtgtaccattacaaatttctcgtagaacatatgatagtgatgcctctgccatctatatggaccaaaactgttgatgcatgtcatgttatgttgttaaacttaatgacattgttgtgttctggtgtcttacggccagttctggaactgatttaggcctttgtttagttacacccgaagttacacttgaaatccaaaaacttttt

SEQ ID NO: 12254 - DNA, 654 bp, Sorghum bicolor
  Clone ID: SORBI-28MAY03-CLUS3310_1
gtcaccgacgccggccgcgtcgagccgctcgccagctgtgcccaggcggctctcgcgtggtcgctgcgttccgacagtctccacgaggtcaaattcccacacgagtggaaaatcgatcctccactgctgagcacgagggcccgtcagcaaactgttgaaccagagacacaaccgatgcaaactactctagcaagcactgaagaccagcactagaggacatttcttttttttttttcgtggacagtacaagtcagagcaaatcaggcagctgttgcccccaatatttgtcaaaagtccacagcagttgcacactgatgcaccgtcggtgccaaccgctgccaaagtaacagaagccgcctcagctcagctcatttctttggactctacagataaagctaccaacagtacatgtaatcttggacacttcgtcgtctaaatccctttgtatcgacgtataaaaaataggtaaaaattttaattatccgtaccttcgttcccccttgctgtagaatagcattgtaggcatattgttttcgtgtaaaatagatgagagcagggacttgcaaaagtcttgtggtttgggaatcgaagcattggttgtacacttgtatgaaataatgaagatccagttttcacttcgttttcaaaaaaaaa

SEQ ID NO: 12255 - DNA, 1194 bp, Sorghum bicolor
  Clone ID: SORBI-28MAY03-CLUS29361_1
gcacgacccggctcaaagcacacaaattaaaaggcgagaagagaagagaagagaagagaagagaacgcagggcagccagcgcgcggctccgctatctgaagcaggccggcagggacgagcgagagaatccggaggtcgaggtcgacccaagctcgagcttgaaaggatggactcgaaccagggcgtggtggcggtggtgaagccgacgctggccaaggggacgccgtcggcgtcgttccggctccgcaacgggagcctgaacgcggtgcgcctccgccgcgtgttcgacctgttcgaccgcaacggggacggcgagatcacggtggacgagctggcgcaggcgctggacgcgctgggcctggacgccgaccgcgccggcctggccgccaccgtgggcgcctacgtgcccgacggcgccgcgggcctccgcttcgaggacttcgacaagctccaccgcgcgctcggggacgccttcttcggcgcgctcgcggaccaccaggacgacgccgcggacgccggcggcaagaagggagaggaggacgagcaggagatgcgggaggcgttcaaggtcttcgacgtcgacggcgacggcttcatctccgccgccgagctgcagacggtgctcaagaagctgggactccccgaggccagcagcatggccaacgtccgggagatgatcaccaacgtcgaccgcgacagcgacggccgcgtcgacttcagcgagttcaaatgcatgatgaaggggatcaccgtctggggcgcctgatcgtccatctaaaactgtgtcaaggtcaaggcagggcataaaaatttaacccaagctcctggatatggtggtcaagagatggcaagattatgggtagtaggttaatttcctaattaactattcttccaggctccgtgtttcgtccagacagtgcggcgttcttattcttatcttattaattagtggcaccgatgcgtctctaattgtctagttgtgtctgctggtgtttaattttgtcgtccttcactggtctagtggtgatgagaatgccctgtgctgtgtgtctgactgtcgcataaccatggcacggcatgacattactgaaatttaggcctctgccagttgataaaaatgtatcaaactcggttattctgaattctccatcagtgtcttgggttgatgctcggctcagtttccgcgatgtgatt

SEQ ID NO: 12256 - DNA, 1519 bp, Sorghum bicolor
  Clone ID: SORBI-28MAY03-CLUS2940_1
gcacgagggagttctagggaatttgttgatactatcacccgagatcttctgggaagccgtgtctttgtgtttactcctaaaggcgagattaaaaacctgcctgagggagccacagtggttgattatgcttatctgatccatactgaaatcggcaacaaaatgattgcagcaaaggtgaatggcaatctggtttcaccaatccatgtacttgcaaatgctgaagtggtggagattataacttatgataaattatctagtaagtatgcgctccagcgtcaccagcagtggctacagcacgcaaaaactcgcagtgctaggcacaaaattatgaaattcttaagggagcaagctgctctttctgctgctgaaattactgctgacgccgtccgtaattttgttgcggatcttgaagacgaaagtgatagtgagctttcacttccaagcaccaagaacgaagatagtaaattcaactgggagaagatattaagttctgataaattattctttgtcaacaaaagtagcgatggttttttacctgttaataatgtccatccaaagctcaatgggaagcaaaacaaaactgttaaggagttgggcatcaaaatcaatggtcattctacaattcgaggtgatagcttcaatgagttaatgcaccctggcaattccacctgcaaggaagttttccctggtttggatcgctggaaatctggtaaaatttctagttggcatagtacggaaggcaactctgtccaatggctttgcatagcctgtgttaaccgaaaagggatgatggcggaggttacatcagctcttacagcttgtggaattaccatatgttcttgtgtggcagaagtcaataaaaggaggggaatgggtgtgatgctgttccattttgagggaagctatgagaatgtggtcagtgcatgttccagtgttgacatgattcttggtgttcttggttggtctgtgggatgtagctggtgtccattgggtgttcttgagtgctagtgagtatcaagagacgttataccacaatagtccaccactatcttctccaagatggagataattttggaagcaccaagacatggttggtgactgctgagctagtggaatcctttacttctctgtcaaatcagaaagtgagggtgaccaaagtagaaccagatatataaatataagggacattttgaaagtgagtgtacattgcagagcgagtagggtactgttagtgcagggattgattggattatacagaaggccttaaaaaagattgtttaaggcagttctttcttctccccacttgtgtggctcgcatatacgagtttgcttaaatgtgcagctagaattttgacctggacactaataccaaattttgtctgtatttagttctctcactctgcctgtaaatgtcattgtatatagcttcaattttgcaagtgaaaatttgagcatagttaacttgtagatgcacgcttctgaattacttgccatttcctgctgtatgaatggtgacttg

SEQ ID NO: 12257 - DNA, 1730 bp, Sorghum bicolor
  Clone ID: SORBI-28MAY03-CLUS29461_1
gcacgaggctcagcgcagatcttctgctccttcccccactcgcgctaggctcggtctcttccgcgcgtcggcggctccccctcggcggcgtccagcgacgaggggcagtcccaggttcggcggcggcctcctccccctcccgcctcgcgtcctcgcctccgtcctccgcgcaccggccgccggcccgccgccccgctgcgtatcgcttgcgattagtgtaaccccagagcaagctgcatacaggacgagatagaagatgggtatccttgagagaatcaaggagattgaggccgagatggctcggactcagaaaaataaagcaacagaatatcatcttggacaactgaaggcaaaactagcaaagttgaggacacaactattagagcctccaaagggttccagtggaggtggagatggttttgaagtcacaaagtttgggcatggtcgcgttgcacttattggatttcccagtgttggaaagtcaactcttttaacgatgttgactgggacacattctgaagctgcatcatatgagttcacaacacttacttgtattcctggaattattcattacaacgacaccaaaatccaacttcttgatcttcctggtatcattgaaggagcctctgaaggcaaggggcgtggtaggcaggttattgctgttgcaaagtcatcagatcttgtgctgatggttctggatgcctcaaagagtgaaggacatcgccaaatattaactagagaactggaagctgttggactccgtcttaacaaaaggcctccccagatatacttcaaaaggaagaagactggtgggatttctttcaataccactgtgcctttgactcatattgatgagaagctctgctatcagattctgcatgagtacaaaattcataatgctgaggtgttattccgtgaagatgctactgtggatgatctcatcgatgtcatcgaaggaaatcgaaagtacatcaagtgtgtttacgtatataacaagattgatgttgttggtatcgatgacgtagataagcttgctcggcaaccaaattctctagttatcagctgcaatttgaagctgaacttggataggctactggcgagaatgtgggatgagatgggcctagtgagggtgtatacaaagccacagggtcagcagcctgatttcacagatccagttgttctttctactgacagaggtggttgtacagttgaggacttctgcaatcatatccatagaagtttgctcaaggatgtgaagtatgtgcttgtatggggaaccagtgcgagacactatccgcagcattgtggcctcagccatggtctccaagacgaggatgtcgtccagatagtaaagaagaaggaaaaggaagagggtgggcgaggccggttcaagtcgcacacgaacgcacctgatcggatatctgatagggtgaagaaagctcccctcaagacataactgattccctgagcgcgttgcgactagcttctccaaatcagatagacaacctcgattgagatcacataatccggaactatctgagccgcagcgtgctattttttgcagccttgttttgtatcagaacagaatcttggccatgtttggagtactcgcatagtaaccttcggtgctgtatcttgctcagatcagatgatgcgggctggcttttatcactgtgtgttacctgctacatatgccaaatacaaatacttgccaaactcccgagttgtgc

SEQ ID NO: 12258 - DNA, 1307 bp, Sorghum bicolor
  Clone ID: SORBI-28MAY03-CLUS29914_1
ccctctcctcgcgaccaccgttctgctgcgccccccccctctacgttcccccatttccggtgcttctgccgtgtgacagagagcgcccagtggcagagaggggcggcgatggcgcggcacttcgtgctcaacaccggcgccaagatcccctccgtggggctcggcacctggcagtctgaccccggcgtcgttggcaacgccgtctacgccgccgtcaaggcgggttaccgacacatcgattgtgccagagtttacggcaatgaaaaggagattggtgtggcgctgaagaagctatttgaagagggtgtagtgaagcgagaagatctgtttatcacctctaagctatggaatgatcatcatgctcctgaagatgtgcctgaggcactaaatgaaagtctgaatgatttgcagcttgagtacttggatctttatcttatccattggccagttagagtcaagaagggaacaaaccacagtcctgagaattttgttacacctgacatccctgctacctggggggcaatggaaaagttatatgatgctggcaaagctcgtgctattggtgtcagtaacttctcctcgaagaaattgggtgacttgcttgctgtagctcgtgtacctccagctgtggatcaggtggaatgtcatcctgcttggcagcaaactaagctccataacttttgtcagtcaactggtgttcatcttactgcttactcaccactaggttcacctggtacaacttggatgaatagtaatgtccttaaagaaccaataatcatctcaatagctgagaaacttgggaaaactccagcacaagtggctctgcgctggaacattcagatgggtcacagtgtacttccgaagagcacaaatgaagaaaggataaagcaaaaccttgatgtttatgattggtcaattccagatgacttgcttgcaaagttctctgagattaagcaggctaggctacttagaggcaacttcgctgttaacccagcgagcgtttacaagacccatgaggagctctgggatggtgaactttaggaaggacaccgttgttcatcctgagcagggagcagcgttccattagggcctgtcagatcattttatctccaaatttgctctttagaattgaaggttcagtgctcggaagctctgatgccatcctgtgtcacgagctgctgcagtccatcctagtcctagtatcaattgatttttctggtaaactgtgaccaaagaagttaattcgccaggcatcattggtctgtattggaatttcatcgtttatctcctcaccactatttcttttt

SEQ ID NO: 12259 - DNA, 874 bp, Sorghum bicolor
  Clone ID: SORBI-28MAY03-CLUS29925_1
cgtagtgagcatgaagctagtcgtcgcttgaagactgaactacttattcagatggatggtttgacaaagacaaacgacttggtatttgtacttgcagctacaaatcttccatgggaattggatgcagctatgctccgcaggcttgagaagcgaattcttgtaccgcttcctgaagctgaagcaaggcaagcaatgtttgaggaacttctgccagcgactacctcaaagttagaggttccgtacaacatactagttgaaaagactgaaggttactctggttcagatatccgtcttgtgtgcaaagaagctgccatgcaaccactcagacgtctcatgtcagttcttgaagccagtgatgagttggtgccagaggaagaactgcctgaggttggtcctctgaaacctgaagatattgaacttgcattaaggaacactaggccgtcagcccatctccatgcacatcgctatgagaagttcaaccaggactatggtagccaggtcctttgttcagagtcagcatgatcttgttatcaggttgatgttccattgaatcacggaactagagcgtaggttgatgattgtcccgtgttgtcaaaatggttgctctggtaacgaggctcccagtcccagcagattgcaatttccctctggctgcagtacgcataggttgaagtgcgaggtgcaggtgcttgctgctcagatctctgtggctcttctcatgcaggctgagattttcccgaagccttgaacttacagcaaaaaaaaaaattgattcgttgtctagttacgtgtcaaataaatgttaggtaccctgcagaaaagtacactctggttatatgaacggaaagcgagccagagagctggtctaagtttc

SEQ ID NO: 12260 - DNA, 821 bp, Sorghum bicolor
  Clone ID: SORBI-28MAY03-CLUS3418_1
gccggccgggcggggggttcagtcagtgcccacccagcgtgcaacctaggcgagagccctcctccgctccttccagctcgctctctagtctgcaccagcctcgtcgcccgccgccggcgccgctatggggaggggaaagttcaagggaaagcccaccggccgccgcaacttttccacgcccgaggagatcgctgctggtacttcaggccgcccacgcacctttaagaagaaggaggaagaggaagaggaggaacatgaagaaagagaagaatccgaggaggaagaatctgaagacgagtctgacgacaaacctaaacataaaggtactgagggtattattcagattgaaaatccaaacttagtgaaagccaagaatataaaggccaaggaagttgatcttgggaagacaactgaactctcaaggcgtgaaagagaggagcttgagaaacaaaaagctcacgaacgttatatgaagcttcaagagcaaggaaaaacagaacaagcacggaaagatttggaacgtcttgctttaataagacagcaaagggctgatgctgcaaagaaacgcgaagaggagaaagctgccaaggagcagaggaagtccgaagcacggaagtaacagcaataatcatggaccacgagtccacgaaggcgttgcatatttatttctaaatgcatcagttatcttctttttataaacccagtctctattctatatttccataaaatatgcattgacagcagtaacgtggtcttgtggtcgtggcttcctataaacttgagcttggcaaaattgaaaagtagtatgatcagcttgtgcg

SEQ ID NO: 12261 - DNA, 1547 bp, Sorghum bicolor
  Clone ID: SORBI-28MAY03-CLUS34423_1
tgcgcagtcgtgttgggccaaaacacattgcccagaaatctgctcgctcgtttttcgcccgcaggcgcgcggcttcctcccgtccgcccccatccgtggtcgccggcctccgtccccaccaccaccgccgccccaagcccgtcgccggacctcccatctgccggatcgggaggtcctccgccggtgccgggcttcctccgccgcggccggcgctttcgtccgccggatcccgatcccgacgctccgtcctccccaggcgaatcccgcccgccgacctgtctatcgccggctgggaggctccccgacgccccttcccccgccggccatcttctgctccctaccccacacgcgctcggcgcgcaggcgaaggaggcggcgctcaggctcggcggcagcgtcagcggctccccctcccgcctctcgccctcgccctcgccctcgcctccgtcctccgcacaccggccggcgaccctgcattacttctttggtgcattcatgatttagcaccaaccacattgatatccaactctggtgacttaggctgttgctagggtaggaaatcaggagctaagaatggcggattcaatggtagcgagcttctgggggcctgttacgtcaacgactgagttgtgcgaggagaattatgcacactcatcatatatcgcagaattctacaataccatctctaatgtcccatgcgttcttttggcggttattggattagtgaatgctttccgccaaggttttgagaaacggttcagtgtccttcacgtatccaatatgatacttgctattgggagtatgattttccatgccaccttgcaacttctcctgcaacagagtgatgagactccgatggtctgggagatccttctttatatgtatgtcctttattcaccggactggcactacaggagcacaatgccaactttccttttcctatatggtgctgcctttgcagtagttcatttctttgcccggttccaagttgtattcaagttgcattacattgtcctgtgcttcctctgcatcccccggatgtacaagtactacatactgacgaaagacatggcggcgaagcggcttgcaaagctttgggttcttacattaacccttgggactctctgctggctagttgatcgcatcttctgtaagaagctttcacattggtatgtcaacccgcaggggcacgcatggtggcatgtgcttatgggcctcaactcatactatgcaaacacattcctaatgttttgtcgggctcagcaacgtgggtgggagccgcggatcacacaccttcttggattcttgccttacgtcaaggtccagaaaccagaaaagagggaatgatttctatctctgttgaacattgatgctattcagtccgccgccagtaagctaatgcccccaatgctcgcagacaaggttttttttttttttgtatatgggcgcccaaatgatcacagactataaatgttctgatgtcacaacagatttttggtaacttttgactgactcctgttttgtaccatactcgatcatgaaccggg

SEQ ID NO: 12262 - DNA, 798 bp, Sorghum bicolor
  Clone ID: SORBI-28MAY03-CLUS34629_1
tcccgaacagcaatgagaggtagcttcccacttaatggcacatattttcaagttaatgaggcatttgcggaccatttctcaagccaaaatccaattggtgtcccacgaagctggatatgcgacattcctaggcggactgactactgagcaaccacaattcttcttttggtgaggggtttttcgtctgaggggctataacagggctgtgggagcaccttggcttctttgaggggcgttgcttggtccgggcaggcacgttggccgctgtatgcaaggtggcgctttcctgccagcaaggttgttagaggcagaaagcctggagcggcaagagagggaggatgattgtccagtgatgagatgctgacccaataagccgacggagcacctcctagttttaacccagtgactatgcagctgtagtgaatggcactaccttgaacacctgtgatgtagatgtgttgagacgacatgtcctgttaaattagattccttctttggtaacagtctacctgtcctgctggttaagttcatttttctttcgcaacggcctagctgagcttgcgaaaaaaaatattcgctactctgagcttttctaattgtacctctgtgagtggaatcagttgttgtacaacaggaagatggacctatctgtacaatggtcttacatgttctttgatcagacctttatctgcgttggcctcacctgctgtttgttcatggtttcaacaatgtaagtctcatcaggcgctatttgattgtttcaaaacaaaggaaaagccttgccaattcatgctgttc

SEQ ID NO: 12263 - DNA, 1319 bp, Sorghum bicolor
  Clone ID: SORBI-28MAY03-CLUS3390_1
gcacgaggaaaatgatgatttggaggaaattagagagctgggttcaggtacttatggtgcggtctatcatggtaaatggaggggatgtgatgttgctattaaaagaataaaagcaagttgctttgatggaagaccatctgagagagagcgtttgattgcggatttctggaaagaagctctgatcctaagctcacttcatcatccaaatgtggtttcattttatggtgtagttcgtgatggtccggatggaagcttagcaactgttactgagtttatggtcaatgggtctctcaaacagttcctgaggaaaaaagacaggacaatagatcgccggaagagagtaatattagccatggatgctgcatttggcatggagtatttgcacgggaagaatatagtccattttgacctgaagtgtgagaatctactagtgaacatgagggatccgcagcgaccaatctgcaagatcggtgatctcggactatcaaaggttaaacaacatactttggtatctggtggtgtcagaggaaccttaccatggatggcaccagagtttctgagtgggaaatcttgcatgcactcagtagagatcgacgtcaataggcacggaaaaagctggacacagttatcctttttccccatacaaattgtgtcctaggagagatggatcgaacacgactagagctatccttgttcagattgtacatagtctaaaaataatagtataatactgtttcccgggttgatggaaagctgttggtccagtgatccagctgagagaccgtccttcactgatatatctcaaaggttgaggaaaatggccgctgcaatgaatgtgaagtaaaggtttggaagccataaatggatcatcatctcagtttaccctactccaagtgattatttatcaagtgcttacttcatggaagaaaaagtatgtcatggagattccaaagcatgtttaatgatatttttttttaatcctgcagtaaaccggctatcaaatgccttcggtcgaaaacaagtatgctatatagcgtattgtcttgatgggaactgttggactgtaattgtaaataagttttgacttgcttcatcttgctggcacgtattagatgtgcaaagtaataggcacgatcaaagctggacacagttatcctttttccccatacaaattgtgtcctaggagagatggatcgaacacgactagagctatccttgttcagattgtacatagcctaaaaataatagtataatactgtttccctgtatatatcaccacttcctatttgaatgaccatatgtttgcatcgtcctgtttc

SEQ ID NO: 12264 - DNA, 516 bp, Sorghum bicolor
  Clone ID: LIB3481-022-P1-K1-E7
cgtccggcgagctgcttactgtggatgagccatactctgatatgcgtgctgctgaaattattgggggcattgtaaacgattccctacgtcctgaaatcccttcgtggtgtgatcctgagtggaaggggttgatggaaagctgttggtccagtgatccagctgagagaccgtgcttcactgatatatctcaaaggttgaggaaaatggccgctgcaatgaatgtgaagtaaaggtttggaagccataaatggatcatgtaagtgttcccacatccaatatagtgattacaagaggaaggcagagttcaaactggattatgagtatgtttcaaatgtcttggcagcatctcagtttaccctactccaagtgattatttatcaagtgcttacttcatggaagaaaaagtatgtcatggagattccaaagcatgtttaatgatatttttttttaatccttgcagtaaccggctatcaaatgccttcggtcgaaaacaagtatgctatatagcgtattgtc

SEQ ID NO: 12265 - DNA, 819 bp, Sorghum bicolor
  Clone ID: SORBI-28MAY03-CLUS34644_1
cttgaggagggaatcaaccgtctagttctttgctctgggaaggtgtattatgaactggatgaagaaagaaggaaggcagagcgcactgatgttgctatatgtagagttgagcagctctgcccgttcccctatgacctcattcagcgcgagttgaagagatatccaaatgctgagatcgtgtggtgccaggaggagccgatgaacatgggagcgtacagctacatcaacccgcggctgctgacggcgatgaaggctcttggccgtggtggcatcgaggacatcaagtacgtcggcagggccccttcggctgctaccgcgacgggcttctactctgtgcacgtgcaggagcagacggagctggtgcagaaggcgctgcagcgcgaccccatcaactacccgttctgaaagaaacgagaccccctgtagattcttggaattggggaccttttgattttgatatacctctatagagagagcaggccttaagttatacagtacctgtgcagccatttggtgaaataatcatttcggactctacagtgctgcatttgaaaggaacggttgtaagtttggaaaaactccatctcgcagcttcatttttgtgttcgtgtatgctgaaaagcttgcatggctgaaagcctgaaacaccgactgccggaaatttcttgtgatgaatgtataaaggcaatgaacaggtatgccattcatcttgcttttgaatgtcgtaactatttggctggctgaaaaaaagctgctgctaatgctgatttgttataagagaaaaacattgtttcatggctgctgttgattcagtctctt

SEQ ID NO: 12266 - DNA, 769 bp, Sorghum bicolor
  Clone ID: SORBI-28MAY03-CLUS30754_1
gcccgcgccttcaacatgatgttcgtcacctgcgccgtcgccacggactccagggcggtgggtgacttgcccgggttagcagtcggttccgcggtttgcattacgtccatcttcgcagggcctgtgtccggcggatcgatgaacccggcgaggacgctcgcgccggcggtggccagcaacgtcttcacgggactctggatctactttctcggccccgtcatcggcactctctctggagcctgggtctacacctacatccgcttcgaggaggcacccgctgccaaggacacacagcggctctcctccttcaagctccgccgcttgcagagccagtccgcgctcgccgccgacgagttcgacaccgtctaacggccgggaccggcaggtgcatccacacctcaccatgcgtccatgcaactactgttcgtgcgtgggcacgctgtgtgagagtactgtgtgctcgctcgcgctctgttcaggacctcatcaggtggtgggagagagctagttagagctgcgtgtgtcatgcttggtgtacctagctaaacctacgtgtttgtattcttctcccgtactacgtcgcctaccacgtagcagcggatcggagcaagtgtgatgtgtactatgtatcttcggctttgtactgcgtcagagtttgcaaaagttaattgatgcagatgatgcctgattatatcgtggctttgctggtttgcagaagatgcatgcatgtgttggaacaaatatatggatttatgtctttgcctcgtgc

SEQ ID NO: 12267 - DNA, 654 bp, Sorghum bicolor
  Clone ID: SORBI-28MAY03-CLUS30799_1
ttcaggtcatgatcagctttataatatgcaaatgctcgaagctgcattccacaggcttccacaacccaaggactctgagcgtgctaaaacttacattccgcggcaccctgcagttacccctgctagctacccccaaattcaggcaccaatcgtatcacatcccaccttttgggaaagaattggtagcgacacattagctactgacatgctgttctttgcattctactaccaacagaacacataccaacaatacttggctgctagagaactgaagaagcaatcatggagatttcaccggaggtacaatacctggttccagcggcatgtggagccacaggtcacgactgatgagtatgagcggggatcatatgtatactttgatttccatgtcaccgaggatggctcaggatggtgccaaagaatcaagaatgacttcacatttgagtacaactaccttgaggatgagctatcagtacaaacaaactagagtgccatggcagtaggtctaattaaaccattgtgtccaatgtgaattttgtagttttcataaggtgactggctgttataacctggactcttgaaaaaaattctccagctgtaaactaatggggtgattgtttcaaaaaaaaaaaaacctaaaaagaaaaaaaaaaa

SEQ ID NO: 12268 - DNA, 900 bp, Sorghum bicolor
  Clone ID: SORBI-28MAY03-CLUS30900_1
gcgtcgtcgacctgacgccgttgcagctcaggtccttcaccaagaactcgaacaagacatgcaagcacaccttcagctcgccgggtgacttgaattatccggcaatctccgcggtcttcgcggagcagccatctgctgcgctgacggtgcgtcgcaccgtgacgaacgtcggaccgccatcttcgacttaccatgtcaaggttacagagttcaaaggcgcagacattgtcgtcgaaccaagcaccctgcatttcacaagctcgaatcagaagctgacctacaaggtgacgatgacaaccaaggttgcccagaagacaccggagttcggagcgctgtcctggagcgacggcgtccacatcgtccggagccccctcatcctcacatggctgccaccgatgtgagcttcgtttgtgtaccatgcgtttagtcaagtaagcaatggagcaggaacctctgggcctgggtaatcaagccagagatctgttgtctcgcagcggcagcagcagaacaggtccactaaccgacgcaaaaatactgtcaaagctccacacgagaacagcctttattcctcaatgtattcatgtttattccaaacgttcggttgccagtttgattgtttctacattaatgggggtacaacatacggaagcaaatagtatgcaaaatcccctggcagcaggtttagcttgattcccaaatgggggcaccatcacaagtgcaaagcttcttgtagttctctcctacgccggcgcttcttgcaatcacggctgcagcaatgccggggtctgatctgtcctcggttgcatacagagcaataaagcggccaatcaagtcaacgactctcagtttctccttcggtcctgaaaaatgggcttccccattctctccagcttctagtgt

SEQ ID NO: 12269 - DNA, 805 bp, Sorghum bicolor
  Clone ID: SORBI-28MAY03-CLUS31377_1
aaatcagatgacccggtgtggtgcatgtcatggtcgaggtttacttgctcaccaagatggatctgatacaatatgcggaatgtgcaatggtaaaggaatgttaccttgtatagcatgtggatcacgtggcttggtgacatgcaacacatgtactggatatggttccctccttgcacaaagcatggctcatgttcaatggaagacgctgtcagctagaaaagttagcgcagctagaggggctgcttcggtccctgaagaagtttttcacagagccaaaggggtgcagctatgcaacatacaggcatatcagtgtactcctgcattttttgctgattcatacccactcaaccagttttcctcagaagtcattgctagccggctgccagttccaccatctgcaagggttatttccgagagacacatcatttcagttgtgcctgtaacccgtgtcacaatggcccatcggaagaaatcatttagcttctatgttgtcggctacagcagggatgttttcataagggactatccttcaaagttttgctggggcctctgttgctgcttcgagtggctggggaaatagttatttcctggcacgaataatgaatgtttcatggtagagaaggtggtgtgaaagagttaaaataagcattacaaattattgtattttctattatagaagatatctctgcgtataatattggaatctgcatattagatttcctgggtacaagtacatcaccagtatatattgttcggtgaaaaataaaaatggtgacatttgtccattgcagatgtgagtgttttg

SEQ ID NO: 12270 - DNA, 1004 bp, Sorghum bicolor
  Clone ID: SORBI-28MAY03-CLUS31190_1
agtattaccgccacgctcccgctaaaggaagtggccgtagcaggccccggcgcctcttccaaaaatcgcctcacgcttccgtttcgaactcttcgtcgcctcacactgctcctcctccccatccctccgcccctcccatggcgtccctcttcggtgctcgccgccggcgatcgccggaggacgacggcgaggacgatagatccggcagcgggagggcccagcgccgccgcctctcaccggaggatgccgccgcgtcgccggcggaggcgggcgcggcgacggggactagccccggttggctctccggcttcgtctccggagcgaagagggtcttttcttccgttttactgttctcctcgcccgaggagaccggctcgggggaggatgaggaggaggaggacgacgacgaagaagaagaagagggcgtcggcttgaatgaaaatgaagatattcatgacactcagggagcaatagttccttttagtgagtcaaagcttgctattgagcaaatggttatgaaggaaacattctcaagggatgaatgtgataggatggtagagctaataaaatcaagagttagagattctacttttcctgaagcccatgagtatggaaagccagaagaaatcccaagtaggaatgcaggcattgcgcatgactttacaggaacatggcgctccttgagccgtgaccggaatttccctgaatcagtcccactctctagtatgagaatgggacctggtagtttttctccaggttctccactccaagcatcacctgagctatgcagtgcagcagttacggaagcaaaaaaatggttggaagagaaaaggcagggactgggcttaaagcctgaagacaatgggccgtgcacattaaatactgatatgtttagttctcacgatgactctgacatgggtactccagttgatttagcgaaatcatacatgcagtcgttacctccttggcaatccccattcttaggacgtcagaagtttgacaca

SEQ ID NO: 12271 - DNA, 699 bp, Sorghum bicolor
  Clone ID: SORBI-28MAY03-CLUS37081_1
gctgcacggcgcccaagtccaagaagcctccatccaactctctgtctctgcaacgccacagccggaggcaaccatggatcagcagcaccagcaagggctcgacgcggcggcggctaggcggatggccacgctcgcctcacacctgcgcccgcaccctgcctctccccctcaggtggaggatgttcccctcctgaggggttccaattgccgcgcaaaaggggcggcgccgggcttcaaagtcgcgatcttgggcgcagcaggtgggatcgggcagccactcgcgctattgatgaagataaaccctcttgtttcggtgctccatctatatgatgtcgtcaacacacctggtgtcacagctgacatcagccacatgagcactggtgctgtggtacgtggcttcttgggccagccacagttggaaaatgccctgaccggaatggatcttgtaataattccggctggtgtccctcggaaacctgagatgacaagggatgatttgttcaacataaatgctggaatagtccgtaccctgtgtgaaggaattgcaaaatgctgcccaaatgcaattgtgaatgtgatcagtaatcctgtcaactctactgttccgattgctgctgaagttttcaagaaagctggaacttatgaccctaagcgtcttttgggtgtgaccacacttgatgtagtgagagcaaatacttt

SEQ ID NO: 12272 - DNA, 1743 bp, Sorghum bicolor
  unsure (1)..(1743): unsure at all n locations
  Clone ID: SORBI-28MAY03-CLUS3614_1
gcacgaggtgaggatccaatccgttggaatcccctcacagatgttgtagatggttattctccaacacttcctcatctcaaaggtcttcagaatggtgacacagccacaagtgccattaagcaggttgcatctgggcgttttggagttacaccaacatttttagtaaatgctaaccaaattgagatagcacgtgcgcaaggtgcaaagcctggtgaagggggtcaactntcctgcggaaaaaagtcagtgcatacattgctcgtctgagaaactccaaacctggagttcctctgatctccccgcctccacaccacgacatttattctatagaggatcttgcgcagttgatttatgacctccatcagatcaatcctaaagctaaagtgtccgtaaagcttgtgtctgaagctgggattggaactgtagcttctggagtttcgaaaggaaatgcagacataattcagatatcaggtcatgatggtggtactggagctagcccaataagctccatcaaacatgctgggggtccttgggaacttggtcttacagaaacaaatcagacacttatacaaaatggattgagagagagggtagtacttagggtggatgctcggggcaggagtggtcgagatgttcttatggctgctgctatgggggctgatgaatatggctttggttctgtagctatgatagctactggatgtgtcatggcacgcatttgccacacaaataattgcccagttggagtggctagtcagagagaagagcttcgtgcaaggttccctggtgttcctggtgatcttgttaactacttcctctttgttgccgaggaggttcgagctacattagcccagttgggttatgagaagctggatgacgtcattgggcgaacagatttgcttcgaccaaagcatgtctcgttggtgaaaacacagcacatcgatcttggatacctcttatcaaatgctggattgcccaaatggagcagctcccagattaggagccaggacgtccacactaatggtcctgttcttgatgagacaatccttgcagatcctgagatagctgatgcgattgagaatgagaaggaagtttccaaggcatttcaaatctataatgtcgatagagctgtctgtggtcgggtagcaggtgtgattgccaagaagtatggagacacaggttttgcaggccagctcaacatcacgttcaatggaagtgcagggcagtcctttggttgtttcctgactcctggaatgaacattcggctagttggagaggccaatgattatgttggaaagggtatggctggtggagaactggtggtagttcctgtagacaaaacaggatttgttcctgaggatgctactatagttggaaacacttgtctgtatggagctacaggtggtcaggtatttgtgagaggcaaggcaggagaaagatttgcagttagaaactctctatgtcaggcagtggttgagggcaccggagatcattgctgtgagtacatgactggtggttgcgtagttgtacttggcaagtgctgtatgaatgttgcagctggaatgactggtggccttggctacattctatttgaggatgatacaccttttccccaaggttaacaaggaaattgtcaagatgcagagagtgaatgctgcanctgggcagatgcagctaaagagcttgattgagtcctatgttgaaaaaacgggcagcgagaaaggagccacgattttgagggaa

SEQ ID NO: 12273 - DNA, 1386 bp, Sorghum bicolor
  Clone ID: SORBI-28MAY03-CLUS37190_1
taggagggcgcggcggccgctgcaaaacccgggccggaagcaaactcatctgtcttctctctacgctttccccttcgtctccgtcgagaggaaggaagccagagctggtccgggcgccgcgccacgccgcgagcggaaggagaagggggcgacgatgcaggtgaagcagaaggtctacgagctctacaagggcacagtggagcgggtcacggccccgcgcaccgtctccgcgttcctcgagaagggcgtcctctccgtccccgagttcatcctcgccggcgacaacctcgtcgccaagtgccccacctggtcctgggaagcgggcgatccaagcaagaggaagccgtatctccccgccgataagcagttcctcgtcacccgtaatgtgccctgtttaagacgtgccatctcggttgaggaagagtatgatgcagctggagccgaggtggttctggatgacgatgaggatggcgaaggctggcttgcaacacatggggtgcaagcatcaaagcgagaagaggaggaagacattccctctatggatacattggatatagggagatctgatggaataaagtctatcccctcttactttagcggtggtaaggacgaagaggaagaggaagatatacctgacatggacacttatgaagacacagggaataatttggctgctgctgagccatcatacttcgtcgcagaagaaccggaagatgacaacatccttcataccagaacatatgatgttagcataacgtatgacaaatactaccaaaccccacgcgtctggctgactggatatgatgagtcaagaatgccactaaagcctgaacttgtgtttgaagatatcagccaagaccacgcgcgaaaaacggtgactattgaagaccatcctcacttattggctggaaagcatgcttcagtgcacccgtgcaaacatgcagctgtgatgaaaaagatcatcgacgttccaatgtcgggtggagtggaaccagaagttgacaagtaccttttcatatttctgaaattcatagcgacagtcataccaactatcgagtatgattacacaatggacgtcgacctcggcagtacaagctgattattgattggttgaagcctgaagggaaacgaagcaccctacagaaggcacgcacaggaaggctgaatttgcctgtttgtggctgaatatctgtgcatctgtgttggtgccttggattggtttgcatttgtgaacaaactctgaaagctcaaaggcaagaccccaccttgtacattctaacgctgtcagcttgtgtatccattcatataaaacccataatctgttcggcgtgcgtgggaccataaatcttgcaagtgcaatgcatcacttatcgaagtgaggaacag

SEQ ID NO: 12274 - DNA, 754 bp, Sorghum bicolor
  Clone ID: SORBI-28MAY03-CLUS3710_1
cgctcgacgccggccgggccgggcaaggcgccgccaccatcggagtcgaaggtgatgcagaaggcaacgcgtctcagcgtggcgacgaccaccatcttctacatgctgtgcggatgcacgtcgtccgccgcgttcagctacgccgcgcggaacaacccgttcaccggtttcggctcctgtgagtctttctggctgctcgacgtcgccaacgtcgccatcgtcgtatagctcgtcggcgcggaccaggtgttctgcctgccgaccttcgccttcgtggagcgccgcgccgccgcggcttgtccggacagcgccttcatcgcccgggatctccgcgtgggccccttcgcgctcagcgtgtcccgcctgacatggcggtcggcgttcgtgtgcgtcaccaccgtgggagacatgctgctgccggtgttgggtaacgtggtggagttcctcgtcgccctgtcgttctggcctcagagcgtcgtgttccccctcgtgaggtacagcaggcagcgccgccttggacgcggcagcacaaggggtattggcctgcagacggtcagcagcaggtgttgtcttgagtctattgccgctgcagcgggctatatagcatacttcatttatgtcctttattactagttgtattcctgtatatgttttctctccaaccatatagttagctatatcaggtaacgacgaaacatagtattcttttttttagaaaggcctgcatcgcaaaactccacaaggatttgagctc

SEQ ID NO: 12275 - DNA, 328 bp, Sorghum bicolor
  Clone ID: LIB3481-027-P1-K1-F12
cgtccggcttcctcggcgccgtctcgttctggccgctcaccgtctacttccccgtcgagatgtacatcaagcagcgccgcgtgccgcggggcagcaccaagtggatctgcctccagacgctcagcgtcgggtgcctgttcgtgtccatcgtcgccgcggccggctccattgccgacgttatcgacgcgctcaaggtctaccacccgttcagcagtttattgttgtttagctggagaggaggatggacgtatgtactgcatgcagtattcaatgcgttcaacgactttggtcaatcgtactacaaggggtcaaggggagggagagagaa

SEQ ID NO: 12276 - DNA, 1063 bp, Sorghum bicolor
  Clone ID: SORBI-28MAY03-CLUS37802_1
gctcgtggccgacgcccctgcatccagtccattccaggggcgggcgactgcttccttgcccgatttattccccatcttgtccctccctataaggtcgcctttcctccctttgctaaatagaacgaggcagaggcatcttcttcgactcgacgtgcgcttcctcttcctcgctcgctcccagtcgcagtgatggctgatgttgatgagtaccgttgcttcatcgggaatctgtcctggtcgacgactgatgaaagcctcaaggatgcattcagcaaatttggcaacctaactgaggcgaaggtggtccttgacaaattttctggccgttctcgtggtttcggctttgtaacttttgatgagaagcaagccatggaggatgctattgagggaatgaatggactggacttggacggaaggaacatcactgttgataaagctcagccacaaggacctggtagagaccgcaatggtgaccgtgattatgaccgtgatcgtggatctcgttatgaccgtggtcgtgactatggtagtgggcgtgcaccgcgaggaggtggtggtggggactgcttcaagtgtgggaaacctggtcattttgctagagaatgcccatctggggatggtgggagaggggacagatatggtggcagagatgacaggtatggtggtggtggcggcggtggcgggcgttatggatctgagcgtggtggcgaccgatactctggccgtagccgagatggcggcagctatgggggtgaccgctacagccgtgaccgatcaggtccttactgatagcctagttcttgagaagtatgtgccatccaggtatgaaagtctatctactattataaggcttgttattgtgtctggaacttagttatcctgtcgttggagtcgccatgtaccgtgagaaatcagttgctttgttatagaccgtattactgaccggtttattattgtttcctgcttgccaggcatatgacttggtcatagtgcttggcgcttggatcctgcatgtttgcttgatatgctatttggctattaaaagatggatattgttctgtgt

SEQ ID NO: 12277 - DNA, 1028 bp, Sorghum bicolor
  unsure (1)..(1028): unsure at all n locations
  Clone ID: SORBI-28MAY03-CLUS33540_1
gcacccgccacctctgctcctcctcccccccccccccctctgctcggcctcctgctcccttctcccaccgaccaactcgatcccgcgccgccgcgccatggatcgcgccgaccccgcgccgcgccgcctcgccctgctctcctcccacctccccgccggtggccccgcggcagcggacgcgccgcgcctgcagaggtacccggtctcggccgccgcgcccgggccccgcgccggcgcgctcgccgtggtggacgggaggaccgggaagcggcacgaggtcaaggtctccgaggacggcaccgtgcgcgccaccgacttcaagaagattaccgctggtaaggatgacaagggtcttaagatttatgatcctggttatcttaacactgcccctgttcgctccaccatctgctacatcgatggggacgagggaatccttcgctacaggggttatccaatcgaagagttggctgaaagcagttcgtttgttgaggtggcgtaccttttaatgtatgggaatctgcctactcagagccaattggcaagctgggaattcgctatttctcagcattctgctgttcctcaaggactgttggatatcatacaatcgatgccccatgatgctcaccccatgggtgtccttgccagcgcaatgagcaccctttctgtcttccatccggatgcaaaccctgctcttaaaggtcaagatctttataagtcaaagcaggtgagggataaacaaattgtccgagtacttgggaaggcaccaacaatagcagctgctgcctacttgagattagcaggaaggcctcccatccttccttcaaatactctatcttattcagagaacttcttgtacatgctggactctttgggtaacaaatcatataaaccaaatcctcgacttgctcgagctctagacatcctgtttattctgcatgctgaacatgaaatgaactgctctacagctgctgttaggcaccttgcttcaagtggntgtggatgtcttcactgctctttctggtggtgtt

SEQ ID NO: 12278 - DNA, 1175 bp, Sorghum bicolor
  Clone ID: SORBI-28MAY03-CLUS3277_1
acctcggcggcggcggcggcggcggcggcggggttggcgttggcggtggcctgggcatcggcacagggatcggcatcggcattggtggtggcggcggcggcggctctggctccgggtcaggatctgggtcttactccggctccggctcgtggtcgggctctggctcgggatcctggtccggctcaaactcaggctcgaacgcggggtccggcggcggcgcaggatcgtacgctggctctcacgccggctcgtacgccggctcgaacggtggaggctcaggttcgtacgcgggctccaacgccggctcctacgctggctcgaacggcggaggctcgggttcgtacgcgggctccaacgccggctcctacgctggctctaacggcggaggcgcgggctcgtacgcgggctccaacgccggctcctacgctggctctaacggcggaggatctggttcctacgcgggctccgacgccggctcgtacgcagggtccggcgctggccctcactgggggggctctggtgctggctcgtacgctggctctgaggctggatcctacgctgggtctggcgctggcccgtatggtggtggctctggcgctggctcgtatgctgggtctcgagccggctcctacgctggcagtgggcacggcaagtgagccgtgaatcgaccttggagctggaggacgcggtgctcaactgctcatgctagttgttctgtagttgtgtgtttgcgctagcgtttaccattatttgtgtccgtgagtaatccattatgtgtgtatgtgtgtacttgtactaaaatacccggatggtggtggctctggcgctggctcgtatgttgggtctcgagccggctcctacgctggcagtgggcacggcaagtgagccgtgaagcgaccttggagctggaggacgcggtgctcatgctagttgttctgtagttgtgtgtttgcgctagcgtttaccattatttgtgtccgtgagtaatccattatgtgtgtatgtgtgtacttgtactaaaataaatggagatgcgaaggacgatgaataaggtgattattacagtgtataagaacctattgatgtaaacatttatattaatgcataattcggcatgtacacttatgcttatgtaattttcacatgggatgtttcaaaaaaaaaaaaaaaaaagg

SEQ ID NO: 12279 - DNA, 703 bp, Sorghum bicolor
  Clone ID: SORBI-28MAY03-CLUS33623_1
gcacgaggcacagcaaagccgttagccgtcttctccctcatctcctcttgtccgacgcgggtgggccgcggtcgggtgagtgagtgagcagcgttgcttctccatctcccccattcttcccttccccggcccggcggcggtacgtgacctcgtcggaagaacggcaggtgtccgcgcgcgacctgagagcacagcaccggggttcaggcagaaaagatggctggagcagcggtggcggcggccaacggaggggcgtgctgccacgctgccaaggggcccgggtacgccacgccgctggaggccatggagaagggacccagggagaagctcgtctacgtcacctgcgtctacaacggtactggaattaacaagccggattaccttgcgacggtggatttggatcccgactcccccacatactcccaggtgatccacaggctcccggtcacccacatcggcgatgagctgcatcactctggatggaactcctgcagctcctgccacggcgatccatcagcctggcgccgcctcctgcagctcctgccacggcgatccatcagccaagcgccgcttcctgatcctaccttcgctgctgtcaggtcgtgtgtatgttgttgacacagcgacagacccgagggcgccatccttgcataaggtggttgagtctgaggacattgctgagaagactgggcttgggtttcct

SEQ ID NO: 12280 - DNA, 672 bp, Sorghum bicolor
  Clone ID: SORBI-28MAY03-CLUS33640_1
aaaaactggagacagtagagactagagacgaaggagaggcttctagactccgagctcgacgaaacaagccgaagcgtctcgcctgcgcggtcgcgagcgtgcgagtggggattagggatggcggcgaagaaagtgctcatgctctgcggcgactacatggaggactacgaggtcatggtcccgttccaagcgctgcaagcgtatggggtgtccgtggatgccgtctgccctagcaagaaggccggcaacatctgccgcaccgccgtccatcaggggatcggccaccagacatactctgagacaaaaggtcataatttcacactaaatgcttcatttgatgagataactgctagtgaatatgatggattggtaattcctggtggacgtgcacccgaatatcttgcaatggatagacaggtgcttaacctagtcagaaatttctctgatgctaagaagcctattgcatcagtttgtcatggacagttgattttagcggcagcaagagtagttgagaaccgtaactgcacagcatatccagctgttaaaccagttttggttgctgctggtgctaagtgggaagaacccgacacaatggcaaaatgcactgttgatggcaatctcatcactgcagcaacttatgattctcatcctgaattcatcagcctatttgtc

SEQ ID NO: 12281 - DNA, 698 bp, Sorghum bicolor
  Clone ID: SORBI-28MAY03-CLUS33819_1
tatgaggttgatttctatgcctgggttgtccatgtttgatctatgcggaccctcaatggacatagcattgggccgtatcagatacatggtggaaaatcagttccgattgtgaaaggtggagaacaaacaaaaatggaagagggggagttttatgctattgagacttttggatctactggaaggggatttgtccaggaggacttggaatgcagccattacatgaagaacttcgacgttgggcatgtgcctttgagggtagcaaaggctaagcaactacttgggaccatcaacaacaactttggaacactcgcattttgccgccggtacttggaccgccttggcgagacaaaatacctcctggctctgaaaaatctttgtgatagtggtatcattcagccgtatcctccattgtgcgacgtgaaagggagctatgtctcgcagtttgagcacaccatcttactccggccgacctgtaaagaggtcatatcgagaggcgacgactactgattgctgctgaacaggctcctgctgtactgggttgtttatgctaaagagtacacaccgtttttttgcacaacctgtgtggctatgtccatctgttttatggaccatatgatatgtcatagtccaacaaataatttggcactattgctctgatatttgagtttggaatatgtggaagcgtgttcttttttcct

SEQ ID NO: 12282 - DNA, 1256 bp, Sorghum bicolor
  Clone ID: SORBI-28MAY03-CLUS39614_1
actcgcgctaaccacgcgaaccacgagctgagcgagtgcgataagagggagaggctgatatcggggggctggaaaaagaaatagagaaaatcttcatccgcatcgattccgttgagcctctcttctgatctaagcgctcgccgccgccggagctcgcacgcgatgggcgcggtagggtttcggcggctgctacttctgccgctggcgctgctcgcgtcggcggcggcggtggaggcgcgcttcgtggtggagaagaacagcctgatggtgacgtcgccgacttcgctgcggggacagcgcgacagcgctataggaaacttcggaatcccacagtacggcgggagcatggcgggcgccgtcgtgtaccctaaggacaacgccaacgcttgcgacgatttcgacggcaggcaccctttccgtgctaagcctggcgcgatgcccactttcctcctcgttgaccgcggggactgcctatttgcgaagaaggtttggaatgcgcaaaatgctggtgcctctgcagtacttgtagttgacgacaaggatgaaccattgataacaatggatttacctcgtgaagatgatgatgctgcaaagtatatacaaaacataaccattccttctgcacttatagataaaatatttggtgaccagttgaaaaaggctgttaaagatggggaaatggttaatgtgaatcttgattggagggaggctgttccacatccagatgagcgtgttgagtatgagttatggacaaacagcaatgatgaatgcgggcctaaatgcaatatgttgatgaattttctcaaggaatttaaaggagctgcccaactacttgagaaaggtggctatagtcaattcacgccccattacattacttggtactgccctcaagcatttgtcatcagtaaacagtgcaagtcccaatgcataaaccatgggaggtactgtgcacctgatcctgagcaagattttagcacaggctacgaaggaaaggatgtggtggaagaaaacctcagacagttatgtgtgtttaaagttgcaaatgaaaacaagagaccatgggtctggtgggattatgtgactgattttcacataaggtgcccaatgaaggaaaagaagtacaacaaaaaatgtgcagaaactgtcatcaaatcactaggtctggatgtgaagaaggttgataaatgcatgggagacccaaatgctgatttggaccacccgttgcttaaaatggaacaagatgctcagattgggaa

SEQ ID NO: 12283 - DNA, 1762 bp, Sorghum bicolor
  Clone ID: SORBI-28MAY03-CLUS3905_1
tcagcgggcaagtggcaagcggccttgtgctggaacaagtgaacaactggataagcccggccgcagaagggcactgcccggacggcgacggactccgagagggaaccgggcagcgccgcagcggcaatggagggccagccgctccatctcctcctcgcccagccccaccaccctcccctccccggtctcatccccaaccgccctactcactacctgcccacctcccgcctccgattccgcgtacaccgtcgcaagccgaagcagctcgccgcagtgccttcgagacgtccatcgggcagccaggccgacgcacctggccgtagcggctgggagcgggtgccgaacgcggtggcggcggcggtgttccagctggccgtatgctcgctcctttttctcttccccaaccgtgcccgagtcctcgcgctcccgcctcctccgggcgccgctgcggtggttgaggcgacgcacgaggaggaggacaaggagtgggaggctgcgctgcagaagtggaagaccaagacctacgcgctctcggtgcccctccgggtggtcgcgctccgcggctccttccctccatcttggattaaggatttcgttgaagttcaggggaagaggctcaaattcagtcccgagctccgtgctaatcttgatgggatcttctctgagatgtcacaatgtatggacaagggtcaagttcagccaaagtccgcaatggctgctgatgccgttacccttggggactcctggctcggctatgccatccgccagggattgctagagcctgtcaagaatgctgaagaacaggattggtttcgtagcctgagtgacagatggaaggttcatttgtgcgtccgccagaatggagaagcagatcctaatggtacaatatggggagttccatacagatggggcaccatggtcattgcttacaagaaaaacaagttcaaaagacataatctgaagccaatacaggattgggaggatttgtggaggcctgagcttgccggcaggatttcaatggtcgattctcctagagagattattggtgcagttctgaagcatctggggtcatcatataacacagttgatatggaaatagatgtcaatggtggtagagaagcagtcctaaatagctttacacaactacagaagcaggtccaactattcgatagcatgaactatctgaaatcatttagtgttggagatgtatgggttgcagtgggttggagcagcgatgtcatccctgctgcaaagcgaatgtctaatgtcgcggtggttgttcccaagtcaggcagcagcatatgggctgatctatgggcaataccatgcgcgacaagatttcagactgaccaaatcggtagccgaaccagaggcccatctccactgatccaccagtggttcgacttctgcctgcagagtgctaggagcctacccttccgccaagacgtcatccccggagcatccccgctgtacctcgagaaccctgtgccagaggtccctcaagataagaacaagaggaagccgaagctggagacgaaccttgtcaggggagtgcctccgcccgagatcctggagagatgcgagtttttggagcccctgtcaggtaaggcgctggaggattaccagtggctgatgtctaaggtgcagagacctcgacttggtttttttgggaacgtgttgcaaaagatgtcagctgtactagacttcaaaagaagattttagagccactgtactgtacttgaccaagggtttttacttcgtc

SEQ ID NO: 12284 - DNA, 1305 bp, Sorghum bicolor
  Clone ID: SORBI-28MAY03-CLUS39723_1
gcacgagggagctgttctgataatatgccagtttttgttttacattaaccaaggcccttctagtaaaaacacctctacatatgtgtggatccaaagttccaagcatatgaacatgtctttgttacctgttttctgttttggagagttgtaggttgcaattcttttctaactcagtaactttatgttttttttgttggcccatgttaactggaaggcacatatgatcaatgtgctaaaaaaacacatttcattgaaagttccctggaataaaaattgataggtcattaggtcattagtcattacccatttggagctgcgatcccctaattgtctaattgcagatgaatctcatgagtgggcatatatctcatcttcttgaccttctatggtcatggttatcacctgctgaagagaaccatagtaatactgcaaggccccttgatgaccctgagatgatacgcttcggggcacatattgttcttgtgctgaggcaccttttcagtgatgaaatggacgatgagttggatgaaaaactggttactgttggtggtctcatcatcaacatggacgtgaggtatttgttctcagaggatcaagaggagttggttggagtatatgcctctcagcttcaacatgacctttgcattaatttgtttgtggaaatgatggaactaaggttaaatagcagtttgcatactatgtacaagctcttcctttctgctgtggagtatcttccattctcatctgatgatgcatccaaggcttgttttgaagagatcattgagagagtgctttcaagatctcgacaaacaaaacccagtaagtatgatgaggatttctctgatgttgcacatcaacatcatctgcaatcacttcaaaaggcaatggttattcagtggctttgcttcacaccaccatcctcgattccagactttcaaatgatcactgggaagcttctgatacgggcattggtgcatagcaatacactgttcagggagttttccctgatatcaatgaggagagtccctgagctaccagcagggccacacaagttgcttgccattttagctgaaccgttaaagcaaaaagaaaatttaatttcactggaagatccggaggtatctgataacttactggagtttgaagattggcatgaatattactcccttgatgcaacttaccgcagttggcttaaaattgagatgaagaatgctgctgtttctcctgagatgctttcggcagaggaaaaggatcaagctgttgctgcagcgaaagagacactggacttggcattcttgttactat

SEQ ID NO: 12285 - DNA, 839 bp, Sorghum bicolor
  Clone ID: SORBI-28MAY03-CLUS39829_1
ccccgcggtcgccccctcccgccgccccgcctctcccccccgcggcgcccctccccgcggcctcctccctctccctcctcttctcccaccccaactcccactcccgccaaccatccgtgcgcggggggcccgccgccggctcccacctccgcctgcctccccgcgccagccccagccgcgcgcgctgcgcctcctccgacacgacggccacgaagcaccgccgcccagcggaggagaacatccgcgaggaggcggcgcggctccggggccccgcgcagggcttctcggcgtggtacgagcccttcccgccggcgcccggcggcgaccccgacgagcgctactcgctggacgaggtcgtctaccgctccagctcggggggcctcctcgacgtgcgccacgacatggaggcgctggcgcgctacccgggctcctactggcgcgacctcttcgactcccgcgtcggccgcaccgcctggccctacggctcgggcgtctggtccaagaaggagttcgtgctccccgagatcgactccgaccacatcgtctccctcttcgagggcaactccaacctcttctgggcggagcgcctcggccgcgagcacctcggcgggatgaacgacctctgggtcaagcactgcggcatctcccacacgggctccttcaaggacctccgccggccccggctgcgcgtccacgggggacacctccgccgcgctctccgcctactgcgccgccgcggggatcccggccattgtcttcctccctgccaatcgcatctcgctggagcagctcatccagcccatcgccaacggcgccaccgtgctttccctcgacaccga

SEQ ID NO: 12286 - DNA, 905 bp, Sorghum bicolor
  Clone ID: SORBI-28MAY03-CLUS40027_1
gacgagggagatgaatccattcaccatggtcaacggggagccatatcctctggacatgaggggagaactagatgacacagcagctttcaagaacttcaagaagtggggagatatagagttccctctaccttttggaagagtactcagctctacagaaagtttcatccatgaacttgatgagaagacaagtgcctctctgaagttcacagttttgaacccaaaaggtcgtatctggacaatggttgcgggtggtggtgctagtgtcatatatgctgatacagttggagacttgggatacgcgtcagagcttggaaactatgcagagtatagtggtgctcctaatgaggaggaggttctgaattatgccagagttgtacttgattgtgcaactgctgatcctgatggccgcaagagagcccttctcattggaggtggcatagctaacttcactgatgttgctgccacattcaatggcatcatccgggccttaagagagaaggaatccaagttgaaggcatcaaggatgcacatttatgttcgccgaggtggtccaaattaccaatctggactggccaaaatgcgcaagcttggtgcggaactcggtgttccaatcgaggtgtatggaccagaagagactatgactggaatctgcaaacaagcaattgaatgcatcatggctgcagcgtaagcggagtgtagttctgggtagtttggcatctgcaaacacgcaattgaatgtgtcatggactcggcataaatgagagacggacagtagttgcagtagtgtaccacacatggttctctttttttgtttcagatatgttgtagcgtgttgtttgaacgaaaactttatacatcattactgcaaagataattattgttgtgctaaaataaattcaaaatct

SEQ ID NO: 12287 - DNA, 2022 bp, Sorghum bicolor
  Clone ID: SORBI-28MAY03-CLUS35097_1
ctcttttctccctcctccgtttcgcttgcccgaaatcgaagttgaagtgtccgataccataccagcagtagcagcacagcgcagctagtagctctcttgctcctccccacccccaacctctccgtctcctccaaatctcgccggattccgcctccccgcccgcccccgcatccgccgcaggtgagcgctcgctggcccttggccgccacggtggcggccttgggggtggcagctggagccccggcgtggtggagggagctgacccccggcccgtgggcgctttcaggttcgcgcccgttgcaccaccgccggtggtgtgggtgctggttggcggagtcgaccccgagggtcggccatggaataccggccctccgacagcagcggaactgatgatgatcttccacaatttccaaatagtaggagtatcagaggcagtggacgtgtcagtggtaatgggagagctcttgttcctgccagttcatatgctagggcaccgacagatatggaagcacaaattcaacaacttgagcaagaagcatattgctcagtccttcgtgcattcaaagcccagtctgacgccattacatgggagaaggaaggtctcatgactgaacttaggaaggagctaagagtatctgacaaagcacgcacgaggctgttaaatagagtcaacaacgataatattatatgtagcataagggaatggagatcaacaggagggcttcaggcaggcttgtccaataacccacaaccaattcatgaccctgttcccagtcctaccacctctggacggaagaggcaaaagacatctcaatctgttcctgctttacctgcaccgcctcttgcactgcattcacagcagctggctacaccaacacagccatcgtcttcaactgctacgaaagcagttcccccaggccctaaaggcaaaaagatgaaaccaggtcagaaggtaccaggtggctctgcagccaagcccatgtcatcttcagcaggtcctagtggaagaggaccacacatgaataggaattttcctggtggttctgctcctgaagctcaagctcagaatcttgatccattggttggtcgtaaagtgatgagtcggtggcctgaagataatagtttctatgaagcagtcatatccgattataatgctgaaacgggcctttatgcgttggtttatgacatcaatacggcaaatgaaacctgggaagtgggttgatcttaaagagatgggacctgaagacataagatggcaagaggatgactctgggatagaccctgtgacatatctgcgcagccgaggtgccccaactagtggggttaggaagccaacaggtcgcggtgggcccatgccaggttctggaagaggaagaggattacagaagaacatgtctaagaaagattttccacctccacaaaacggtgttggcaagagaagttccgatgacattgatatccttcatactgagagcctaataaaagaggtggagaaagttttcagcattagcaatcctgatccacaggaagtagaaaaggcaaagaaagcactgaaggagcaagaacagtcgttgattgacgcgatagcaaggcttgctgaggcatcagatggtgaaagtgatgggcacaatcgtgggcgaaggaacttgtatgctggtaaccagcatcaagcaaactacattgatgccatgcccgttggtgaccaagctgatgccatgtaaacactgcatgaacatgtatacacaacataagataattgtctgttgtacaatccattgctaatattggttctggatttaggtatctgtaggctaagtatctttttgttttgggtcacttgaattttttttagtagaattgtaattcagaatgctgaccaagtaaagcttgtagatgtgtgtttctttctctagctttttgttagtgtggtctcagcttctatatgcataataaaaggaaaaagatcacgtttgtaaaatactaagtttatctttcaccattttaatgcagcaatcattcgtc

SEQ ID NO: 12288 - DNA, 800 bp, Sorghum bicolor
  Clone ID: SORBI-28MAY03-CLUS3520_1
gcagcacgaggcacacacagggggaggaatccggccatccgggagaggagccctaatctcaaggccgctgctgctgcgagccccctcctcccccagccgccgccagccgcacacccaccgagcgcgctttccctcggctctctctgcgttcctccctcgcgcggctcagggtttcgggatggaggccgaggcggcggccaagagggcgcgggagagcggggaggacgccgccgcgggtgcgggtgcgggggccgaggctgcggcagccggggccggcgagcaggcggggatctccgccgtcatcccgggatggttctccgagattagccccatgtggcctggtgaggcgcactctttaaaggtggagaaggtgctgttccaagggaaatcagactaccaaaatgtgatggtttttcagtcctctacgtacgggaaggtgctcgtcctcgatggggttattcaggtgacagagagggatgagtgtgcctaccaagagatgattactcacctgcccctttgctccatcaaagatcccaagaaggtgttggttattggagggggtgatggtggtgttctgcgtgaggtttcaaggcattcctctgtggaacaaattgacatctgtgaaattgacaagatggtggtagatgtctccaagcaatttttccctcatctagctgttggatttgaagaccctcgtgtgtcattacacattggagatggtgtcgcctttttgaaaaatgctccagagggtacatatgatgcagtaattgtggattcatctgatccgataggtcctgctc

SEQ ID NO: 12289 - DNA, 706 bp, Sorghum bicolor
  Clone ID: SORBI-28MAY03-CLUS34708_1
gcacgaggcggcaccctacgccatcgtgtaccgcaacatggccatcctcggcgtggatggcttccgctccctcccggaaaactgcctcaccctctgctacattttctttgcggcagcgatcgtcatcaaccttgtgagggacctgaccccacagagggtgtcgaggttcatcccgctgccaatggcgatggcaatcccgttctacatcggatcctacttcgccatcgacatgtttctgggctgcgtgatcctcttcgtgtgggagcagctgaacaaggcgaaagcggacgcgtttggacctgcggtcgcgtcgggactgatctgcggagatggcatctggaccctgccgcagtccattctggccctcgccaaggtgcagcctcccatttgcatgaagtttttgtccagatcgaccaatgccaaggtggacagcttcctcgggttgtcatgattttacatagaatggcaagtaggcacgccttcatcctgtaattattggtgtaaaatgtagaagagaagaggtttgctgtggagtgatcaaagctttgtccgtgtagtctgtaagaggaaaggctttactcaatgtccctctgcctttttttggttcaatccatgactagggtatttcacggttatataggtttttttggaatgtgaaacgttcaaatttgcacgaatggaaatcacaaaaggcagatctagcgcc

SEQ ID NO: 12290 - DNA, 790 bp, Sorghum bicolor
  Clone ID: SORBI-28MAY03-CLUS35795_1
gatgaggaattagagcaaacttcagaggcagttggatatggtgctgtgaagtatgctgatctcaagaataatcggctgactaattacacatttagttttgaacagatgctgagcgataagggaaatactgctgtgtaccttcagtatgcacatgctcgtatttgttccattattcggaaatccaacaaggatgtggaagagctgaagatgagcggagccatttctctcgaccatccagatgagcgtgtgttggggctatatcttatccgatttgcagaggttgttgaagaggcctgcacgaatctacttccaaatgttgtatgtgaatacttgtacaatctatctgaaatgttcacaaaattctataccaactgccaggtggtcgggtcaccggaggagacaagccgcctgttgctttgccaagcgactgctgttgtcatgcgacagtgcttcaacctgctcgggatcacaccagtctacaagctttgatcggatgcatgtttgatttatacattcaacatcactttacgtagaaaccccaattcatcatggttgcagttttggtcttgtaacctagttgaggcagttaacatactgtaatccactgtcctgtttgaaaacagaagcaactcaaaaggttgtagcgaaatctggttgcagatttcctattgatcccatgcgatatgtatttttgtgttgtcttgcctggtggtagctcatcaatcaatgctgtaaggcaagtttaagttctaaaaaaaaaaagaaaaaaaaaactaaagggggggcccgg

SEQ ID NO: 12291 - DNA, 1034 bp, Sorghum bicolor
  Clone ID: SORBI-28MAY03-CLUS36848_1
gcacgaggacctcctctacactcggttccattatcagttgcacttcagcagcatccagtagagggtacagccacacaacagttcgttcataacgtgccagtagacaagtccagtacaaataaccgatttcaggagtcctctgtttctgctggaccatcagatggtaacaagaccttcctaaatgcagctgcctcccagtacagagatgagttaggtcttgtccaacagccagcctcaactagttcaagctcccaaactgttcagccttcatttggccaggcaggcgtgatcagcaatgaagtctcgaccagtgccaaagtcacggttagagcaaccccatctaaagtcaaccctggaactgcagcaggggttgctagcaaccccgagggtcctcaggtcaccagcataccttccaagacccatcagtcgtcgtcgtcatcagaccagcagtaccagcatccagttaacaatcaggatcgccgggcccgtgcgacccaaaaggctggtactggtaatgagtggcaacggcgatcagggtaccagggtaggaatcaaggttctggttccgacaggagttcaggcactggtaggatgaagcagatctacgttgcgaaaccctcgtcgacaagtggccatgccccatcaggctagagagtggtactgacttcactgagcctgctccacgctggtacagctcagagcatccttggtatcagacacatgcgaaacatattttcgcaccatgtctgtctattctggtttatttggtgattgtggcttgtgctggtaagctggttgtgtatgtttttggttcattttgttgcatagaagaaaatatagtgctgttgcactgcaaaaaaacatttgaagcgataccatatgatgcctgataaattttgcagccgatggaatcggctgcccgtgtaagtcacttctgtgtgatgtaaggattactattgtttattattatttgctgccggctcaaggtctggacaggcgaggaaatgtaacgtgcgctattttgttaaaaaacc

SEQ ID NO: 12292 - DNA, 1057 bp, Sorghum bicolor
  Clone ID: SORBI-28MAY03-CLUS41057_1
gcacgagggtcatttggtttcgacacagcagtcgaggaggctcaacgtgcaataaatgctgctcatgtggaagctgttagtgctgagaatggtataggccttgtcaagctaatgggccgtcacagtggttttatcgcacattatgctactctggctagcagggacgtggattgttgcttgatcccagaatcaccattctatttggaaggtgaaggtggactttttagatatatagaaaaacgtttgaaggacaatggtcatatggttattgttgttgctgagggtgctggacagaaacttattgctgaaaccatgcagtcaattgggaaagatgcttcaggcaatgagctgcttcttgatgttggtctttggttatctcagaagataaacgaatatttcaagaaaaacaagatgaccattaatctgaagtacatagatccaacgtacatgatacgtgccatccctagcaatgcttctgataatgtgtattgcacactgctggctcacagtgtggttcatggagccatggctggatatactggtttcaccattggtcaagtgaatggtcggcattgctatatccccttctataggataacagagaagcagaacagagtttcgataaccgacaggatgtgggcaaggctgctctcgtcgaccaaccagccaagctttctctgcaacaaagtcgtcgaagaggcaaagaaggaacaggaaagagcagctcaacttttagatggctcgccttcccatcggaaaggttgaggagaaggttcccaccggtcatgctcagtgctccctgtccagttttttctagaaaaaagaaaacattatccatatctagtgtagtagagtgttaaaattaaataaatagcgtatgtgtagtttggctggcacatggctgactatctgaacatgccatttttcagtgttataatatggaagcagtttcttttgtaattttgtatgtactaatataataagttcaaagactcccacagaagttattagaaattttgtgacagaaatctaataactgtactggagttgttttggt

SEQ ID NO: 12293 - DNA, 664 bp, Sorghum bicolor
  Clone ID: SORBI-28MAY03-CLUS41122_1
ggaggctctgatagcgcgtttgttatgggattgagttctgctcaatcgcagctctcagcgctagatagttcttcgcggcttggactaaagtcatggcaaaaaacaaagccatgtattgagatattgtgcaataaccaggttctatcaccagagatgagtttggctacagtgcgaacatatatatggaagaagccagaagatttgattcttcattatagagtggtccagtcgagatgatcacggcttcagatgtacatgctcacatggttctccagatatgttcagcatgtctgcacgatagatggttttgttgaagatacccttggcttagagaggaaaccatcatctcactgaggaaatattttgcccttgtgcccccgtagccgttcccagaatcccgacttgtttgcatctttgtaaagttcctgatctcgccctggtagtaagatgtatcatagcacaggtataaggttctctgctggctgccaagcttgtaaatgtagaagattgggtgcttaataaaggtcagatggatatgtttttcttttttttttcgtttttctttgacaacgtttgtaagaaaaaaaaaggctgatgctctgctcagaccgtggcgttccgacgtcgattattggattggatttgaccctggcgcatggtctgg

SEQ ID NO: 12294 - DNA, 939 bp, Sorghum bicolor
  Clone ID: SORBI-28MAY03-CLUS4168_1
cgtccgcccacgcgtccggtcgtcgccgcgtcggtgtcgctcgctcgctcgccatatcccctttccccccgtctcctccctccgtcccccgactccggtgatccgcccacctgaaccctactccacgtcgcctcgcctcgcctcgcctcgccggttgggttggggctgagcggatctgatccgatcggggcgggtccttgcgccgtcgctgcgtgagctcatctcggtcgtccgcctgctcggctcgatcggccggggacggcggcggccagatctgcgatggagggcaacaaggacgacgcggccaagtgcctgcgcatcggtaagggcgctctcgacgccggcgaccgcgcgcgcgctatcaagttcctgtccaaggcaaagcgcctcgacccctcgctgcccatcgacgacctgctcacctcccttctcagtcccgaagatgactccccggcttcctcgtcatcatctcagccgccgcctccgccaccgcaaactgccacagcaggggcatcggaggcagctgagcctgatgggctgagagagaggaagcacaagggaaagaagagggaggaggaggaggaggccactcctgctgccagggagtacacggcagagcagctcgaggtcgtgcgccaggtcaagaagcacaccagggactactaccagatcctcggcctggaaaaggactgcagtgtcgaggacgtgcgcaaggcctacaggaagctctccctcaaggtgcaccctgacaagaacaaggcccctggcgcagaggacgccttcaaggctgtctccaaggccttccagtgcctcagtgatgctgagagccgcaagcgttatgatcttgttggttcggatgagccagtaacacaccacaggaggccctccactgcccgtgcatacaatgggttctacgaggaggactttgacccagatgag

SEQ ID NO: 12295 - DNA, 1163 bp, Sorghum bicolor
  Clone ID: SORBI-28MAY03-CLUS41935_1
caaaaccctaaaccctcggtttccggcggcgtcggcggcggcggctacaagctcttcgtcggctcagcaccatgaggccaccggctagaggcggacgcggcgggaggggaggcaggttcgatggcggcggtcgtgggggcggcggtggccgggggtttggtggtggtagaggcggtggcggaggcaggggcgggagaggcgcgaggccgccgcccgcgggccccggcggcggcggccggggcggccgtggtggtggcatgaagggagggagcaaggccgtcgttgtgccgcacaagcacgccggtgtcttcatctccaagtccaaggaggatgcgctctgcaccaagaacatggtcccgggagagtctgtctacgcagagaagcgtgtctctgttcagaatgaggatggaacaaaggttgaatacagggtttggaaccccttccgttccaagttggctgctgctgtgcttggtggtgttgacaacatctggattgctcctggtactcgtgtcctatatcttggtgctgcttctggcacaactgtttctcacgtgtctgatatcgtaggaccggatggactggtctatgctgttgagttctctcacaggagtggaagagaccttgtcaacatggcaaagaagaggaccaatgttatccccattattgaggatgccaggcacccggcaaggtaccggatgctggttggcatggttgatgttatcttctctgatgttgcacagccagaccaggctaggatcttagcccttaatgcttcatactttttgaagaatggaggccactttgtcatttcaatcaaggcgaactgtattgactccaccctgcccgcggaggccgtgtttgctgctgaagtggagaagctcaaggcagatcagttcaagcctgctgagcaggttaccttggagccctacgagcgtgaccatgcctgtgttgtgggtggttacaggatgcccaagaagcagaaggctacctcttagatctgaatcggtgcctgtccctaccaaagaatgctatatgttgtattggggtgacaagaaactttgaagtattagggttctatatagcatctactatgtgtacggtacctgctgcagtgttgctggtttaacggcagtttttttgttgatgaaaaacgtttgagccat

SEQ ID NO: 12296 - DNA, 1248 bp, Sorghum bicolor
  Clone ID: SORBI-28MAY03-CLUS4231_1
cgtccgtggggatgccgtaaataacttcaccagaaagatggatgatctgaaaagaaaaagggatgatctgaagactcgtgaagcgattttggagcagactgtacaagatggcgccaaagacttggaacagttgatgaacagcaggagcacttatctagccaagcaagaagagtgcacgaagaagatccgagacttgggctcgttgcctgctgatgcttttgaagcgtacaaaaggaaaaacaagaaacagctacataagatgctctatgactgtaatgagcagctgaagcagtttagtcatgtgaaccaaaaggctcttgaccaatatgtgaacttcacagaacaacgcgaacaactgcagagaaggcgagctgaacttgatgccggtgatgtgaaaattatggaactcatatcggttttagaccaaaggaaggatgaatcaattgagcgcacatttaaaggggttgcaaggcacttccgtgaagtgttctctgagctggtgcaaggtggtcatggatatttggttatgatgaagaaaaaggatggggatgcagttgatgatgaggatgaggatgaggatggacctcgtgacccaggccctgaagggagaatagagaagtatattggtgtgaaagtcaaggtttcctttactggcaagggagaaactcagtctatgaaacaattgtcaggcggacagaagacggtggtcgccttaacactgatttttgctatccaacgatgtgatccagctccattttatctgttcgatgagattgatgctgctctggatccgcagtaccgaacagcagttggaaatatgatccgtcgtctagctgacatggctgacactcagttcatcgccaccacattccggccggagattgccaaagtggctgataagatatatggcgtgacacacaagaacagggtgagctacatcaacgtggtgtccaaggagcaggcgctggacttcattgagcatgaccagacgcacaatgccagctgaggctgctgcgtattgatctgcaagcagatgctaccgcagaaaggatagttctggttctgtgatggatattctggcccatggttggagttgtgtatatagctaactattggataagcttgtttaactagttggcgcttagatgcgcaatctgtgattgtgaatgtagctaccacttggtttggtaccaacttacaattggcaaccgctgattagacgtacgttacatgttgcttcaaatgttg

SEQ ID NO: 12297 - DNA, 837 bp, Sorghum bicolor
  Clone ID: SORBI-28MAY03-CLUS37916_1
gcacccggaagtggagggctctgccttcggcgactcggacctcaggttctccgtcgtggccggcggccatccatgcccccctgtccgccccgcggtcctaaagctagccaagtccatatggttgttgcacaggttggcctactccttcgatccaaaggcaaaggtgtttcaagtgaaaaagggaagtgaattttcggaaatccacatggaaagcattgtgaagaacatcatcatagaagagggtgcggagaggccgaaagttggcctgatgattatgcctggtttcctgattgggaccagcgtcatacagtcccgagtgtatccttcggctgtggtgtttcctgtctgactggggaggccgctgtcgcacatccacctggagggccccgtgctgctcggcatcctaggagagctaccagctgcataagtttgaggtggactgtgtgtgtctttgtatgtaatgcgtgagatctgttgtttcgctgctgtgctgtcttcaatgcactttgtggagatttccatgtgccatgtgattctgtccaatggtacaatttgtttctattccccaatgttgcatttccatgtgctatactgctatgtaattctgccgcaatgtttgtactacatgttatcagtgtgatttgagagccctgtgtgatgactcctttgtcaagttttccatgtgctatgtgattctgtccaatgggcttttgccgttttcaggattagtacaatatgttcctgtttcccaatgttgcgtttccctgtgctatactgctgtgtaatcctgcccaatgttttgtacatgttatcagtgtgattcgagagcttttttgg

SEQ ID NO: 12298 - DNA, 1262 bp, Sorghum bicolor
  Clone ID: SORBI-28MAY03-CLUS3853_1
ctccctccccccccgcccgcgccccgcccccccccccccgtccccccgcggcgtcggcccacccccttctccgtgtctctccgcagcggcgggagcggttctccggccatcaccgggcgcatccggaaaaactatgaggaggtacagccccccttatcgtagtccccccaggagggcatatggtggcagaggaagaagcccccctcctcctaggagggggtatggaggacgcaacaaagagggcagtggaagccttttggtccgcaatatcccattaagcgtcagagcggaggagcttcgagttccttttgaaaggtttggccctgtccgggatgtttacattccaaaggactattactctggggagcctcgaggatttgcctttgtcgagtttgttgacccttatgatgcctctgaagcccagtatcacatgaatcgccaagttttctttggccgggagatagctgttgttcttgctgctgagtcgcgaaagaggccagaggaaatgcgcagcagagctagagtcagaggttactctggtcatgaaggtcgccgatcttcatattatgggcggtctcggtcccgttcccgctctcctcgctataggggccgtcctcggtcaagatcatactctcctgctccaaggcggcgagatgactactcagcttctccaaggagaaaggaagcgcatcgcacatctcctcccaggcgcccgccaaaggagcatgacgaagataagaagcggaggtcctactctcctgccagtagagatgatgctgacaatggttatgagaagaggtcgcccccagcagacagtaatgggtcccctccgcaccgcaggtcccccaaggaggagtactcaggctcacctcccggatcccgctccaggtccgccgacgaatctcctgttcgcagtgactgactgaccggtggatgctacaaaaatgatatgcacatgaccgtgtctctccggcacgagtcagtccaatgcctttgtcaggccgagcttactattacccccttttgggggtgatgttgtattgctaaagtttcatttgtgcttagtatcggcatatactgctagtctttgctatgtacgtacggtatgcttttaatcttgagtgaggtttgaggaaccagtgatggatgctgatgaacattgttacatgtagtagcatgttacttgcttgctgggccacggcccgttccttgttgcatttgatgagtttggtttgagctcaaaaaaaaaaaaaaaaaaaaaa

SEQ ID NO: 12299 - DNA, 674 bp, Sorghum bicolor
  unsure (1)..(674): unsure at all n locations
  Clone ID: SORBI-28MAY03-CLUS39005_1
gcacgtggcatacccgccataccttggactatcaattattttgaataatgcatgtgtgataaagaataatcatgctgttaccatcattacaggcactttcatccttccaaataatgctgtgcctcaggaccaaagaggagctgcaaatggactgtccatgacagggatgtcctttttcaaggcacttgctccagcaggagctggcattgtgttctcatgggcacagaaacgccagcatgccttcttcttcccaggtgatcagatggtattcttcctcctgaacgttgtcgagctggttgggcttctcctcacattcaaaccctttctggaagtaccagagcaatttgagagcagataattgtcccttgaatgaattacaaaatttttgaaatattaaaaattcatcatgtacggttgtaccagtgaggagaagggtgaaagcacgcccttacgccgcgaaggtctacagagacctaggaaggagcaagaagttgtgtacttttaactgtaagtggtgtatgtagtatcagcatttctgcataggaaatgcctatgtaggtggtaaatgtggccatggatctagagttgctgcactgtactgtaagtagtaataatgtaaggttcagcgactcanatattatttattggaaatgaaataagtagtagtcatgtgt

SEQ ID NO: 12300 - DNA, 639 bp, Sorghum bicolor
  Clone ID: SORBI-28MAY03-CLUS39121_1
gcacgagggcggagcagacccgactaactgggcgagcggcgcaaccctttggccaggtcctcgtcggcccttcgccggcgacgagcatccagcgcatactccccctccttccccttcccctgtgcgaaaccgagccaccccatatccacactaagctattcctagtcacaactgacccaatttcgtgcacatatatgaatacccactaaatttcgattttttccacaattagtggatccgctcctgccctcatggcccaggtcgggtcggccactgcctcggagaggccgccgccgcaggacgcatgggtcgtcgagctccgcagtctcctcccgcagtgggagtcgctgcgggattcctccaaggtcattatcccgatttcaatatctagggtgaaccagtttgatgctgcaaggctagatgtcgagatgtcggcagtgttgaaagagcagctagtcaaagtgttctccttgatgaagccaggactcttattccaatatgagcctgaacttgatgctttcctcgagttcctcatctggaggtgctcgggcagcacccatcactggaaaagaagttagaaccggatgggcaggacctgggctttctgtttctcaaaagatcttttattgtattagtttt

SEQ ID NO: 12301 - DNA, 703 bp, Sorghum bicolor
  Clone ID: SORBI-28MAY03-CLUS39546_1
gcccccccggaatcggacaccaaagtcggccatacgcccaagcgcaaaacctctcttagtcttcgctccgctctcgcacccgtgggtgctccgttccccgtctcctccgcccgcactcgatcgtccgcgcgcaggaaggttgatctgtcgagggccggcgagcccggtaagtaagagtgaaaatggatggaagtacaagagggggtggacattctgaagcattaaggaactacaacctgggaagaactttaggtattggcacatttggaaaagtgaagattgccgagcataagcttacaggacatagggttgctataaagatcatcaactgccgccaaatgaaaaatatggaaatggaagagaaagcaaagagagaaatcaagatattgaagttgttcattcacccccatatcatccggctttatgaggtcatatacacaccaacagatatatatgttgtgatggaatattgtaagtatggtgagttgtttgattacattgttgagaaaggcagattacaggaagatgaagctcgccgcatcttccaacagatcatatctggcgttgaatactgccatagaaacatggttgtccaccgtgacctaaagccagaaaacttgttacttgattcaaagtataatgtaaaacttgcggactttggtttgagcaatgtcatgcatgatggccattttttgaagactag

SEQ ID NO: 12302 - DNA, 1193 bp, Sorghum bicolor
  Clone ID: SORBI-28MAY03-CLUS3578_1
attatgagactaaacatatgccatgcatgtttttgccctccgaatgggtaaagctgtaaaaaaaaaaaaaaaaaaaaagggcgtccgcaccgactgcatcctctgtaccatcatcagtggcttcgtgaagaggagaggcctagccatcagagcatatgacaagctggtctccatagggtgtgagcctgggcaggtcacctacgcatcagtcatcaacgtgtactgccggcttgggcgcagcgacagagcagaggccgtcttctcagagatgatcgagcgaggtttcgacaagtgtgtggtcgcctatggcaacatgatctccatgtatggcaagatcaggagggcgtcggaggccatgaggctgctggccctgatgaagcagaatgggtgcgagcccaatgtcttcgtgtacaacgccctgctcgacatgcacggcaggctggggaactcgaagcaggccgagaagatctggaaggagatgatgcggcgcaaggtccggcctgaccggatcagttacacggccatcatcctggcgaacaaccgggcaggggagctgaaccggtgcgtggagctgtaccaggagtacagggagaccggagggaaggtggacaaggtcatggctggcctcatggttggggtgctctccaagagcagccgcttcaacgagctcatcgagctgctcaaggaaatgaacgggacaaagctggaccggaggctgtacatgagcgtcctgagaagcctccgggatgccgggctggaggttcacgtcaagtggcttcagagtaacttcaccttcatggaagagaaaacctgatgccaggtgcctggagttcttgctgtgcatattcataccgaagtatattgggcgcctgaaggaaaaaaaaaatgctctgtaaatggagacttaaaaaaacaaaaggtaaatatttgcttgcctcagtgctctcttccgaagcttgtatgctattgctgcacaattctgacattcattggctcaggtgatgtaaatgtattttaagggatgccaactttgtaccagtaatgatctgattccaaaattctcgaacagattgcctagttcagtaactctgcttgtcagatttgctgaaactgttgtaccatagccactttgggtaaatgtatctttgtatctataatgaaaaaaaaaaacatattactttggtactgctcct

SEQ ID NO: 12303 - DNA, 1067 bp, Sorghum bicolor
  Clone ID: SORBI-28MAY03-CLUS786_1
ccgaatttccggggccgaccaacccgtccgccagaaggcacccaagaggtgacaatatccagattgatacaaaaaacattctcttcatctgcggtggtgcttttgtagacttggagaaaactatttcggaaaggagacatgattcttcaattggtttccgagcgcaggttcgttcaaatatgcgatctggtggtgttataaatgctgagatcacatcatcgctactggaatcagttgaaagtggtgatctcattgcgtatggactaatcccagagtttgttggtagatttccaattcttgttagtctatcctccctcagcgaagatcagcttgttgaagttctcacagagccaaagaatgcccttggcaggcagtataccaagttgtttgaaatgaatgatgttaaattgcattttacggaggaagccttacggcttattgccaaaagagcaatagcgaagaatactggggctcgtggtttaaggtccatattagaaagtatattgacagaagctatgtatgagattccagagacacgaactggaaaagataaaatagatgctgtggttgttgacgaggagtctgttggatctgcaaatcagcatggaattggagctaagattctttgcggagaaagagctttggatctctatctggccaagcacaataataaagaatcaatgggtcaacaccaggtgagatcgaacgtggaatctgagatcgatacagaagccccctctagagtggccagcatgtagagggtttctgacaacaataattatgtatataaataatttgttgtcggccttgtaactgtagccaattcaaatgtaaattcgggccatataaattcatcatgtataaggccggtgctggggttgtaatttgttatgttgaatttggggggactgaagcttgatcttgcaaactttacgttcaaggaaagtaaagggggcagcgttccattttgggcaaatcagggagggagggttgggcaaatcagttacccccggtccccgttcgactctgatttttatttcatctttccctcgagggattgctaggct

SEQ ID NO: 12304 - DNA, 874 bp, Sorghum bicolor
  Clone ID: SORBI-28MAY03-CLUS44270_1
tgaccggcaggctgctccgcgagaaggtcgacccggcggtgcagagggtggtccggagccagatgaacgcggtggactcgtcgccgttcagggagtcgccggacctgttcgaggtggaggccaccaacggcatgccgcgggcgtccatcgacaagctccccgagtcgtggatcaccgaggagtacaggcgcgacgccgtcggcgacctctccggatgctccgtctgcctccaggatttccaggtcggggagaaggtgcggagcctgccggactgctggcacgtgttccacgtgccgtgcatcgacggctggctcatcaagcacggctcctgcccgctctgcaggaggaagctctagaccagtacgccatggatgatgcatactcgtcgctgcgatcgagttgatgctgtgcccccaccgccgccgccaccgccacagctgctgctaggatcggaggaggttggagctggaggaggaagaagaagagactgacatctatagaacccttaatttatagagagcttttggtttttgctttgctgctgctgctgctgcttgtacgtgtcctactacgtacgtaccttttgcatcttttttgatccccgccatgatcgacctccttcgtccatgcatcgatctcctctcggttcggttcggttcggttcagttccttctatcttgatgaagatcgatctcatgtaatatataccctggaccggcttgtgcttcgatccattccatgcatctccggactgtgatcttggtgtaatatatataaaactactagtatgtatatcatcgcactttcgacatgcatgctgattgccgttgctgtatgttccagtttcttcagagacgaactcactccaaggatt

SEQ ID NO: 12305 - DNA, 1264 bp, Sorghum bicolor
  Clone ID: SORBI-28MAY03-CLUS44073_1
cgagcttaccagctcatctgaaagctgtgaacttcgagcttaaaaacagcagcaatggcgaagctttgcactttgctgttggccgcagtggtggtcctgccacgccctctgcgcccccgtgcccgccgccggcggccccgccgcccccggcctgatggaggccggcagcagcgtgtggacgcccatggcgcacaactggggcgcaacgtggcgcctcaacaacggcaggaggctcagagcgccgttcgggctccggctcacctccgactccggcagggtgctcgtcgccagcaacgccatcccggccgcgtggacgcccggcaagacctaccgttccttggtcaactacccctgattttgctgctgccaagcaatggagctagcagagcaaggccggaaatgtgcgtccgggtttcgtgggaggccgtgtgtcagaagacgaggaggttgaagaagggaatggagttcttccctccctccacacggcctcgctgcattcgcctagtgatgtgtgaacggcggtgctgtaattttatttcttccttgttggtctctgttgtgctgttgtggttgtggaaagcaaagagagaaactagagctgcgcgactaatgtttgcgcgccaatgcatcaagttgtggttttgaatttgtgtacatcgcaatcctttcagaattcaggaaaaaagatttaagtgaatggtttgcattccgtaccagggcgcgaacccgttctacttcgacgtgctgatcgagttcgaggacgacgacggcgacctcaaggccgtcgacctgatggaggccggcagcagcgtgtggacacccatggcgcacaactggggcgcgacgtggcgcctcaacaacggcaggagactcagagcgccgttcgggctccggctcacctccgactccggcagggtgctcgtcgccaacaacgccatcccggccgcgtggaagcccggcaaggcctaccgttccttggtcaactacccctgaaaagtgaatggcgtgtaatgtgcgtccgggtgttgcgagaggcggcggcggtgtaatggtgtcaaggaagaggaggttgaagaagagaatggcgttcttccctccctggacggtctctgcagtccccaagtgatgtgtgatggcgtgagtcaaatcatgcctgtaatttgattcttcatctcgatttgaattttgctaatatactcctgtacttgaggaaagagagaagcttatttgagttgtgactaatgttgcatgccaatgcatgtta

SEQ ID NO: 12306 - DNA, 1811 bp, Sorghum bicolor
  unsure (1)..(1811): unsure at all n locations
  Clone ID: SORBI-28MAY03-CLUS4446_1
gtctggtgccagcagccgcggtaattccagctccaatagcgtatatttaagttgttgcagttaaaaagctcgtagttggaccttgggccgggtcggccggtccgcctcacggcgagaaccgacctactcgacccttctgccggcgatgcgctcctggccttaattggccgggtcgtgcctccggcgccgttactttgaagaaattagagtgctcaaagcaagccatcgctctggatacattagcatgggataacatcataggattccggtcctattgtgttggccttcgggatccgctggatcccccctgtcgtcgctggttatctccgcccgtcggggcctcctctcctcgtctcgtcgtcttctccctcccaccacgcctccaccatatcccctgcccctgacctgataagctaagcttgtggttgaggtgcgttcctgcacagggaggcgtgcaggtgcagcagagatcagaggaggacagctgggatcccaaccaatcccatggacaagtacgagcccgttcgtgagatcggggcgggcaacttcggggtggccaagctcatgaggaacaaggaaaccagggagctcgtggccatgaagttcatagagcgaggaaacaggatcgacgagaacgttttccgcgagatcgttaaccaccgttcccttcggcaccccaacatcatccgtttcaaggaggtggttctgaccccgacgcacctggcgatcgtgatggagtacgcggccggcggtgagctgttcgagcgcatctgcgaggccggcaggttccacgaggacgaggcccgctacttcttccagcagctggtgtgcggggtgagcttctaccacgccatgaacatctgccaccgggacctcaagctcgagaacacgctgctcgacggcagccccgcgccgcgcctgaagatctgcgactttcgatactccaagtcctccgtgctgcactccaggcccaagtcaacggtcggaacgccagcctacatcgccccctatgtcctgtcgcgacgagagtacgactgcaagcacgcagatgtatggtcctgcggcgtcacgctctacgtcatgctcgtcggagcctacccgttcgaggatccaaaggatccaaagaacttcagaaagacaatctcgcgcatcatgtccgtgcagtacaagatccccgagtacgtgcacgtctcccacaactgccgccacctcctctcccgcatcttcgtccagaacccctacaagaggatcaccatgagcgagatcaagagccacccatggtacctcaaaaacctgcccagggagctcaaggaggaggcacaggcagcctactacagccgccggggagtgggagacgccgccgccggcagcagcaatgccaatggcaatggcaatgccaatgccgtggcaccagcagcctactcgtcgcagagcgtggaggagatcatgaggatcgttcaggaggcgcagacgctgcccaagcccgcgaggcccgtctccggctacggctgggacgccgcctccgacgacgacgacgaccagtacgaggaagaagcagagcccgaggaagaagacgactacgacaggacggtgcggcaggtacacgccagcggggagttcgacatgagcaggctccaaatctgacatggcacacacctctctctctctctcagttcctctcttggcaattgccaacaacccaccaccacagcttaagcttagcagtcagttttgtgttgtgaaaaaattgcgcacctgtaaccccgcaacgctcccctggttcaattcagattcagatgcatttntcagtc

SEQ ID NO: 12307 - DNA, 1187 bp, Sorghum bicolor
  Clone ID: SORBI-28MAY03-CLUS44623_1
gcacgagggttgacctcgcgcagctccaggacgccatccgcccggacaccggcctggtgtccgtcatggccgtcaacaacgagatcggcgtcgtccagccgctcgaggagattggccgcatctgcaaggagaaaggcgtgccgttccacactgatgctgctcaggcgctgggcaagatccccattgatgtcaacaggagcgcgagggggctcatgtccctgtccggccacaagatttatgggcccaagggcgtgggggccctctaccttcgccgccgcccacgcatcagggtggaaccgcagatgagtggcggtgggcaggagcgtggcatccgcagtgggactgtgcccacgccgcttgttgttggattcggggctgcctgtgagattgctgctcaagagatggattatgaccacaggcgcgtcagtgctctgcagcagaggcttcttgatggcatacgtgcgcaggtcgatgatgttgtcatcaatggaagcatggagcaccgttacccaggcaacctcaacttgtcatttgcgtatgttgaaggggagagcttactgatgggtctgaaggaggtggctgtgtcaagcggtagtgcctgcactagtgccagcttggagccttcatatgtgctgcgggcacttggagtggaggaggatatggcgcacacctctattcgttttggcatcggtcgctttaccactgaggaagaggtggacagagcaattgagcttactgtgcatcaggtgaagaagctccgtgacatgagcccactctatgagatggccaaggctggcattgacctcaagagcatcgagtggtcacaacactgaggcagatttcggtcacttgaaagtgtacacggatcgcatacgtaggcttatgtctggtgctggtgaagacattcatgtggacatgtggtgctcctacctttgatagggttatcacacttttttacctctcacatgggtgccgagtgtattcaagagggttaaatatgcttgttttctaaggtagggtatcttgacctcaaaataaggatacttcaaatacttggtaatgtatcgtctgaaatacagttcggtgtgaagtagtagcgaagcggtgatcaatgatgttaatatattttagtgcggttagatctggtgctgttccctgttttgcaaagttggaacaagaataaatca

SEQ ID NO: 12308 - DNA, 868 bp, Sorghum bicolor
  Clone ID: SORBI-28MAY03-CLUS45405_1
gcacgaggggccctcgcccgaactttctcggctcttacatgtttcagccgaagcacactagctagatctatcaacctcacttcgatcattgtttcagcatggataaccaccttaaatcgcccttgatctccctactgctcttttgcactgccacaacagtagcataccctgcttgcagtgaaatactatctcacaaggtgagcaaacattttgtatcatacagcccacagccaagggatttcccaaatgaacaactttatcgcgcctacttcgtcatccagcgcttcaagaacaccatcaccggcgaccccaagaatatcaccgccacttggactggtcatgatatctgcggaaagacatcctatgttggtttctactgcggagcactgccagggcgagataacaagttgacagtcacagcggtcattttgaatggctacaatctacatgcacctaggttgcatgggtttgtagatcagctacccgatctcgcgcttttccatgctgcttccaacaattttggtggcgacgtcccccgccttgccggcctaggatacatgtacgatataagtgttagtaatgatcatcccatacatacacttattgacacatatggggcgcaaggcgcaggtagtatcaacgttgtgtctcagtgtgtaactgctaccataaacttcaattttcatttgggaattcccggcagtaaggaagggaagcatagtactggagctacggatgctaaggcgctccttctgaacacaacaacttgtcggggccacttccttcgaacattggtttctcccagttgagctacctcgccctcgccaacaacaagctcaccgggccaattccatcgtcaatcatccac

SEQ ID NO: 12309 - DNA, 2351 bp, Sorghum bicolor
  Clone ID: SORBI-28MAY03-CLUS1443_1
gcacgagggtcaacaaattgtttgagttcatgcatgagatgcatcctggagttcaggatatggcatgtgataccttcttgaaaattgttacgaaatgcaagcgcaaatttgtgacgcaacaggtgggcgagaatgaaccatttgtttctgaacttctgtccaaccttgctacaacaattgctgatcttgagccacatcagattcacacgttttacgaatcagttggccatatgattcaagctgaatctgacaacactaagagggatgaatacctcaagagattgatgagccttcctaatcagaagtgggcagaaataattggacaggcaagccaaagcattgatatcctgaagaaccaagatgttatcagatcagttctcaacatcctacagacaaacacaagtgttgcgagttcccttgggccacacttcttcccacagatttcgctaattttcttggacatgcttacagtctacagaatgtacagcgagcttgtatcaagcacgattgctgaaggaggaccctttgcctcaaggacatcatttgtaaaactcttgagatctgtcaagagggaaaccctaaagttgatcgagacttttgtggataaggcagaagatttaccacatataggaaagcagtttgttccaccaatgatggatcccgtacttggtgattatgctagaaatgtacctgatgcaagggagtctgaagttctgtcgttgtttgcaacaatcattaacaagtacaaaggggaaatgcttgaggatgtacctcgtatatttgaggctgttttccagtgcactcttgagatgattactaagaactttgaagattatcctgagcaccgcctcaaatttttttctttgcttcgcgcaattggtactcattgcttccaagcattaatccagctttcaagtccgcaattgaagctcgtgattgattcgattaattgggcattcagacatacagagagaaatattgcagagactggccttagtctattgttggaaattttgaagaattttcaggcttcaggattccaaaatcaattctacaaaacttactttttaacaattgagcaagagatttttgcagttctcacagacacattccacaaacctggcttcaagctccatgttttggtgctgcaacacttattttgtgtggttgatggtctaacggagcctctatgggatgcttcttcagtaccatatcaatatacagacaatgccatgtttgttcgagattacaccataaaactcttaggaacatcattccctaacatgacagtaaccgaggtgaccaagtttgtagatggccttcttagttcaaaacatgatcttccaagtttcaaaaaccatattagagacttcctggtgcagtcgaaggagttctcagctcaggataacaaggatctatacgcggaagaggctgctgcccaaagagaaagggagcgccaacgaatgcttgccattccagggctcattgcccctagcgaattgcaagacgagatggtagattcatagtgtttcttgtcgattcagctttcgctaatgtagcttcctgtttgttggtctggcctcggaatgcctctggagccctcgacttccaagtgcccgagttttcttacagggtggtgaaagaaggtgcctgctgtaattttatttttggttacctccacatgacgctgattccaagatttgtggtagtagacttgggaacggactagtcagttttgccgcaggaggtgtctgggactgttgctgggtctcagcagctgtgcttgactggatgtgttagcagcggctcttgtgctcagtgtatttggctaacattggtgcgtgtgctttgcccatgatatatcgtggtacagcattgtatccctctttagttgaagtttatagatggatggagatttctgtatccggacactatccaaagctgataggaaccttgttatatctgtagtttactattctgtgagatgtctcatacacattccccacacctcttccctattttttgggtgcatttgaatgtgtagattttctgtatcttaaagcttgggtggatcgtgtatgtgtgcctcagccagttgtctgaagcacatctgaaaaaggtattactgaaggaatgtatgctttttttttttttgaggagtgaatagatagctactgtttcttgttttgttagcaccctggtgcggttattatggtgatcttgtttgtgataacatagtccttgtttagatccatttgtttttggatttggacactagcacattcgtttgtatttggtaattattgctcaaccatgaactgatttgtttcgtaaattataagcaaattggt

SEQ ID NO: 12310 - DNA, 914 bp, Sorghum bicolor
  unsure (1)..(914): unsure at all n locations
  Clone ID: SORBI-28MAY03-CLUS14806_1
atcgctcgattacttgnggtctcaggtcaatggagcgacatgcagtggacttctacatctctgatttccagtctggactgcgggcactggtaaggacaggatctggtgcacgcgtaaccccatatgtggatgaatctgttgttattgacataaacccagacaacaaggatatgtcgcctgaattcctgaggtggctccgtggaaggaatctctcgagtgatgatcggattatgcgccttaaagaaggatatatcaaggagggcagcactgtgagtgtgatgggtgttgttcaaaggaatgagaacgtgctgatgatcgttcctccagctgaacccatctccactggctgccaatgggccaagtgcatcctcccggccagcctcgagggcctggtcctgagatgcgaagacacatctgacctggatgtgataccggtctagctagagggggattggttctggcgatcctctggtgtgcggaggagaggaaaaagatgccttgacttttgatttggtttctgtgggttgttagggttgaaagaatgtgcaaatgcagggtgtgattatgggctaagtacaatatcagtggtcgttcagtcagttacccggagcttggtcgtatagtatattatatgtaattttctctttctcttttttggttgagccaagccatggatggtgcttgtaacaaggatggcttgatgtcagtactacctaccctaccatggagcctgtttggagattcagtggtttccagttcgtgttattatgttcctgtttttgttgtagggttccagcaatgtcttgaaacctgcaatttccttttgtacccaaatctccatagaaatcgcttacctgcacatggcaggtatgtttccgatggtgagaaatcaatctaaagtgtaattgattcct

SEQ ID NO: 12311 - DNA, 1497 bp, Sorghum bicolor
  Clone ID: SORBI-28MAY03-CLUS15296_1
atttgcagagaagaaaactgtatcagcacaatgcagcgtcgaaccagagaccgatgcaataaggccttcaagtgtgaatgacaaggagcaacctgttcctgcaccagcaaaaacagcaagtaaagctgtggctatttctgttgatgtaaatatggtggaacctcccagttatgaaacaccaaaagatgttcatgttgtggagaagccttatgttacacccatgaattcaaatgccaccacactggctaccaatgccaaagaagtaggccatgcagaagctcaaaaggattctcagcggtctgcaccatctgttccggtttcatatagcacagcgcatccgacggaggatgcagattcgagaacactttatgttagcaatgttcactttgctgccaccaaggactcattatctcgccatttcaacaagtttggtgcagttctaaaagtagtcattgtcactaatgctgcaacgggccagccaacagggtctgcctatgtagagttcttacacaaagaatcagctgaacgagcgttgtcgttgaatggcacatcatttatgactcgcattctcaaggtcgtccggcgaagttctcatgaagcagctcacttttatggttggcctggtagtggacggtcatcattatatggtaggcatggtaggatggcatacccaagagctgttctccccggtggttcctttagagggcgtgctccgatgaaagctggcgctagaagtttacagtggaaacgggagccttcaggcactgattcaagtgcaggtgcgaaaactgacatgagtgtgccattttcctctgaacaggtgctcccacctgcaacatagggatattatagttgagctgatataatgagaaccgaatggtatcttactcatcgctcctaatggctgaaaatggacagcaagctgagaagattgttccttcctgctgcactgtaaaaaaaaagtccaaaaaaagcatgaaaatacaaaaagctaaaaataaaaaaatgtgggggagtttggcatcagaatatggctatcattggatttggtcctcttcaccatatgcgagtaggctgacagcctgagcaattttctatggactccagcaatctgaagaggattcacatttgaaataatcacaactttttggttgtgttggatggaagatgcttatcaagtagaacaagatgggcagattttggatgaggtatttggtgataatctgggcatcatcgatgtaagcctcaactgtatagaagtaacctatctatttgtaccctaatctgaatcaatctctttcccaacaaaaaaaaggaaacacaaaaatgtgttgttctctttcatttttctctcatgaactgtttatttattgtactgagttgattttttagttggacattcattttttgtcaaacggtttaacaatacttgttctgtgtggtctgttctacctgactattccaacatttcatttttaagttacaaagtccagttct

SEQ ID NO: 12312 - DNA, 1269 bp, Sorghum bicolor
  unsure (1)..(1269): unsure at all n locations
  Clone ID: SORBI-28MAY03-CLUS15377_1
gcacgagggccccgcgaaagggtcccggcacaccaaggccgccaaggccaaaggcgttctctttcagccggccagccagttcctgcccatgatagagcaggtgcacgattctctggtggaaaagaccaagtgcatacctggagccaagggcgcgagcaacaagttttgtgtgtctgtccacttcagatgcgtcgatgagaagagctggagcacattggctgacctggtgaagtcggtgctgacggactacccgaagctgaagctgacgcaggggcggatggtgttcgaggtccgccccaccatcaagtgggacaagggcaaggccctggagttcctcctcgagtccctgggcttcgccgactgcaccgacgtgctccccgtctacatcggcgacgaccgcaccgacgaggacgccttcaaggtgctccgcaagcgcggccagggcgtgggcatcctcgtctccaagcaccccaaggacacctccgcctcctactcgctgcaggagcccgccgaggtgatggagttcctgctgcggcttgtcgagtgggagcgcctctccaaggcccgccccgccaagtggtgatgctccacgatgaccgaccgacgcgacggccacctacccggtgccgccgccgccgccggcgatcaccatcgaggagattacttaccggccagagggattaaattagtatatatatactatatatatttataagtaactagtatgaattatactacgggtgatcgattaattagagggatcgaaggggagtaaattaattaagatgatcccggccgcgtccgtcagcgtggtgtcgtacgttgttttaacccacactcctactcttactgagagagtgagctgagacgagatgagagagttcgatcagtctgtgctgtgcccggcacagtcgtcatgtgcgtccaccacggcgactcccttgtttttacgggagccgccctctgctgtgctgtgcttgccggggacgaagaggccgggctctaaaaaaacggaaagcctttttgctttcttggcccctggccctttggctacagccatctggctcctgctgccgctgcatgcgcagcaaggtgaaggatgtacatgtacatgctgctgtgtagtgtagtgtagtgtatgtacgtagtaattactactacagtctactactactactagctgctcctccgaccatgaaccatggctgctgaattctgagattgtacgtgtacaatagcaattgtcgatgttatgtatgaaatctnctc

SEQ ID NO: 12313 - DNA, 885 bp, Sorghum bicolor
  Clone ID: SORBI-28MAY03-CLUS48905_1
cagcaacacaaattacaacacaccaagcagcacttagtaataataactatgacaacaacttgccgattgctgcagtagacgcagtgttaggttcagataacagcggtgtcaagaagaggaataagagagtgatggccgtggacggcgccgccgctgaatcgtgcttcgatgatggcagcagcgacagtttcagtagcaagaaactgaagctgccaagtgattcgaggatcgccggccatttcggcaccacagcaagcagctactactactgcaacaaccagctgcagcttgtggacagcacgatgagtcgtagtggctttcatcagtacagcagcctgttgctgagcagcagcaatccgttcttgagccagcagcagcagctgctactcaacagccacatcgggatgcagtagaaatgctgaagaagggacggatctgaagaacctctcgcctgtagaaaatcttcgacagacagactgaaggattattattggacggattggattggatcagagcaaattgattcgagttttcccttccctctttgcattgctttatttcattttcatgtaaaattaattaagattgtaaattaggtctggctggggtgtactggaaattcatgtggccatccatcagtgagtgaatgaacgatgacccacgccgccacgttccttgtggatgtgtagatatgctggctgtgtttttttgcatgtgcgtgctgtttgaatccttatccagactgacaaaagttagagattttagtacatttgcactcgggagagctggaattggaagatacctagttgcttcctgctgatacctttttttatagatagatggacggttccgtacttagtacgtagacccagttatatatatata

SEQ ID NO: 12314 - DNA, 1258 bp, Sorghum bicolor
  Clone ID: SORBI-28MAY03-CLUS492_1
aaagaattgcaaaccggtggcaataaaaaagctgtatgcccactacccacagagccttaaggaatttgaaactgagcttgagactgttggtagcatcaagcaccggaatctagtcagccttcaagggtactcattatcacctgttgggaacctcctcttttatgattatatggaatgtggcagcttatgggatgttttacatgaaggttcatccaagaagaaaaaacttgactgggagactcgcctacggattgctcttggtgcagctcaaggccttgcttaccttcaccatgactgcagtccacggataattcatcgggatgtaaaatcaaagaatatactccttgacaaagattatgaggcccatcttacagactttggaattgctaagagcttatgtgtctcaaaaactcacacatcaacctatgtcatgggaactattggctacattgatcctgagtacgcccgcacttcccgtctcaacgaaaagtctgatgtctacagctatggcattgttctgctggagctgctgactggcaagaagccagtggacaacgagtgcaatctccatcacttgatcctatcgaagacggcaagcaacgaggtcatggataccgtggaccctgacatcggggacacctgcaaggacctcggcgaggtgaagaagctgttccagctggcgctcctttgcaccaagcggcaaccctcggaccgaccgacgatgcacgaggtggtgcgcgtcctggactgcctggtgaacccggacccgccgccaaagccgtcggcgcaccagctgccgcagccgtcgccagccgtgccaagctacatcaacgagtacgtcagcctgcggggcaccggcgctctctcctgcgccaactcgaccagcacctcggacgccgagctgttcctcaagttcggcgaggccatctcgcagaacatggagtagggaagagagagaggtctggggagttgaaggatgcagggagtagtgggagtagctgactgacattttgtgggatgcaggaggagattaacatggggaactcagtagggtgttggttaactgtaaaaaaagtcatgtgcctctagagcagcagtagagcttcttcctcatctttcttttttttatcaccccccatttttccttggtggtctctaacttgttaggaggctgtattggtcatctctcacagttgtgtgcctgatgatcttttgtgtgacttttgccgtgttggaatcatgggaggtgactttcttg

SEQ ID NO: 12315 - DNA, 924 bp, Sorghum bicolor
  Clone ID: SORBI-28MAY03-CLUS50133_1
gcacgagggtcaaacttcaaaagaaacaactcaaaagaagtttgaggcagaatttggctcaaacagtcaatctactgggcagaatatcaaagaaaagttctctcaaagtcccatgaagaaacgtaagcagaaagagaaggctgacaaaattactgaggatgccaggagcaacaaaccagatttctctcagaaagaaaacagtaagaggccaaaatctgccaagtcatctgctgagagaggatcaagtgccaagaacacccgtgaaggcactgatgctagtgccagcatgatgttcttgaagggctctgtcaagaggaaatccccaggtttcctttcagataaaccgagcctcaagaaacaaaaacatcacaaactcgtttctggtagaccagacggtaaactttttgttcgagatagtggtactagtgcaccgtttgtcaagaatgctggcaaacagaaacagtccattgctgagctcgcggacctggctggtaaggagaagctgactgcgtctgaagttcgcaaattgctgaagcctgaaatgtcaggcaagagctaattagttccagaacttgccagcaggtgtaggaaatataaatcaggtcttgcccctgttgtccttagggcgagcagagggccagaggcagcaatttgttggtcatctttcctcatatgttgcggaaagaaattgtagcacgcgagatgggtttgtttcagtagagatgtattcgtgatgcctgtcttgatacctgtttattttgctaatgaatttgtttgcccctgcaaaggtttgtttgatccgctgcttgctgatagtacaaaacatgtaaaaagatggtagccctgcccagggcaacatcatccattgtaagaccaaatactcagtaatataatgttaatgcaggaaatgccaagagactagct

SEQ ID NO: 12316 - DNA, 804 bp, Sorghum bicolor
  Clone ID: SORBI-28MAY03-CLUS52493_1
gcacgagggcgccccccacctccccgcctgtggccttccgctctcccccggcccggcccccagacgcaagcgagcgccccccacctccgctccttagtcgcggcgctcaaccggggcacggcgcctggctgctccgaggcgaagccggaggacgacggcatggcgcggcgcgaggcggcgaggcttctccgccgcctgggcccgctcgcggtcgagtcgccgacgcgaggcatgcctcgttgtcaacatgaatctgcaaaccacattgtgaattcttgtagaagattccactggattcccagtctacagcgccctctgtgtggacctacaacttgtcggggaatatatgaaggtcaaagcagtgctaacaaggcttgtgaagttcagaagcgcacatttggttctgctgcaactgcaacacacattcagaggaatccagcctattcacagctgagctctgatgatgtttcttacttcaagagtgtcttgggtgaaaatggtgtagttcaggatgaagacagagtcgcagttgcaaatgtagattggatgggtaaatacaggggtgcaagtcagttactacttttaccaaaaaatactgcagaggtttctaagattctttcatattgcaacactagacgattggctgtggttccacagggtggcaacacaggccttgtaggtggcagtgtgcctgtttatgatgaggtgattgttggcctcgcaggcatggacaaaatcatttcctttgataatgtttatggcgccccttctcgtggggccggttgggtgttgccgcgtttaagt

SEQ ID NO: 12317 - DNA, 1237 bp, Sorghum bicolor
  unsure (1)..(1237): unsure at all n locations
  Clone ID: SORBI-28MAY03-CLUS52656_1
tgccccctgggcctgggctcctcccgcgggcctcctttcccccttcccgtcctactgtcgctgcccgcccctcctctccctcaccccatttgtgttggcaccaggccaatctccccctcctcttcttccccgcaccagatcgaagctacccccgttcctctgcgatttgggatcgtcctgtatccttcctgttgctcaaaagctcgctcctttgatttccaaggctgaaaggcgacaaatccgacgggaattggagcactgagctttcaatccaggagcaaaacttttgctcatctctcagcatcttctctgcgtgtgaaaagtcggatctttttcacagattcggtttaaaattaccaagcaggtcgacgaccgcggtgtccataagacttgctttgaagatcttgatcaccacaagagaattcgtggatttctggttattgtaccttttctactggacatgtcctttcgcagcatagtccgtgatgttagcgaaagctttggtagcttatcaagacggagctttgaggtcaggatttccggtttgcctggtctgtctggtcatcatagagggaaatctgttggatctctgagcgacagacctgtagtagttgatcaaagcaggtgggttggtcttcctcctgaattgcttcgagatgtaatgaaaaggcttgaggaaggggagagcaattggccatcccgaaaaaatgttgttgcctgtgcagcagtctgcggaacatggagagagttgcgcggggtgcgccctgctccgtccggtgcctcgtcgcctcctcacccttcctgtctctcttcatcagccgggaccaagaagtggaatgatccagtgttttataaaaagggacaaatcaacgtcaacttattatctttacctatgtcttagccctgctgtcctcagcgaggatgggaaatttctgctagcagctaagaggaatcgccgtacgacatatactgagtacatcatttctgtggatcgtaaaaatatatcacggtcaagtaatggctatgttggaaaaatgaggtgaagtatcttacttgactacactttctatctaacctcaaattatttgtgagttatgggcggtgttttctatttgggcctgacattgttgtgtcaacaggtcaaattttcttggcactaaattcgtcgtgtatgacactcaaacaccacacaatgctgggagccttctctcgtgtgagcgtgggagccgcanaatct

SEQ ID NO: 12318 - DNA, 816 bp, Sorghum bicolor
  Clone ID: SORBI-28MAY03-CLUS42086_1
ccgcggcaaacacaatgagcagatagaacgtggagaagccccactggagtgcgctggggtccgccagtggcgaactccaatattagccatgaccgcagatgttattcaggcgactcatgaaccctgctttatttttgttgttggcggttatgcttccaagacattctggggcgagcatttgtgcgctgatgcatcacgctttttcctgaatcgaaaccaagttcagtagggtggctaatatggtgagtatatcagtggaggatatcgtcaacgggtcacctgtccagcctcatagattttcgtcgtagatcttaggcatcgagacgcggaactcgggagcctgttgaaacaaccacccatgtgcggtgccttcgtccaccaggtggagacgctaaaggctgtggacagtgtcacccatgttcgctgcctgcgcaccccttctcccgctacaatactgagtgggcagcgtcttgaaacctccacccgcatgcaccaatgtacgcggtactttgccgctgtcagggcgggtatttatctacgcctcctttcccgtccagctgagggcctccgctactatgtaattgactcgtgcgaagaggtttcttttcccccgcaaggcaccgcctgccatctgagggtctgcctgtttgtccatccatctacggatgcaccctctccgccacgtatcagccggagctctgaattttgaatgacacattcatcgccggctgctgggtctctcaacccgccagctgccacactgaaaactgcctgttggtgtggctttatctgatgaaatagcttttgcctgatgtc

SEQ ID NO: 12319 - DNA, 718 bp, Sorghum bicolor
  Clone ID: SORBI-28MAY03-CLUS42582_1
gtatgatcgtgtcatgtatcatttaatttttagtttcttcattgtactcccaatcctcatggtgaactcaaccctaccctagacttcattgggccaccaggtttgactacctcaggtaggtttcaatcgtcattgatgaacttggtgctaatagaaatttaagtaaaccttcgtgtgcacctctacctgtttgcttctcgtgaaattgttggtttagaatttgatagttcatacgtaattcaactactgatagtgaagtcaactgtctgcataacttcattttttatctgcttaaatttaccaaagcttgatatgattatttctccggtgcaaacataagaagagttccagttttgtgcacaactcaaaagaagctatgtgaaagttggcaggatctagctgttgtcacaaaatttccatctcagagatgataccaggtactgggcaagaagcaactcaactgaatacgaacctggctgtaaatccgaccgcagcatcaactactaatcgctcttccacaattttagcaagctgttacgacatccttgtctctactttatttagtggactaccgagttaagaacctccttgtattgtataatattactacccatcgttatcgctataccatctacgatatatgccatataaatgtaaccttccatggattttacccatataacaatctatgtactaaataaaacttcaccttttatcc

SEQ ID NO: 12320 - DNA, 1083 bp, Sorghum bicolor
  Clone ID: SORBI-28MAY03-CLUS4302_1
gcccctggcgcgggccgcatccttgcgagctccactgccagggccccttggcgtgcagccttcgccttcccccgggccttcggctgggcgggctgccccgtgttcgccgggccccctccgagccggcgggtggtgtccctcacatcttctcacacttcatcaccaatctccctgccatccactccactctggtcttcgtctgtgtgaaataccttcctgtttacactgtgccactagatgaaaggttccttgtgaagcgaattggtcccaagaacttccacatgtttagatgtgtggcgcggtatggctacaaggacatccacaagaaggatgacgacttcgagcagatgctctttaacagcctgatgctctatatcaggctggagagtatgatggaagagtacacggattctgatgactacagcacccgtgagctgaaccaggcaggcaacgccaaccaaagaatcaatggcatcagcaccagttcaaacatggatctcagctatacatcccatgactccattatacaggtgcagtccccaaatcatatagggaacagccaggttgtgtcatcaggtcagatgtaccagactgtgggcgacgagattgcgtttctgaacgcgtgcagggacgctggggtggtgcacatcctagggaacacgattgtcagggcccgtagggattcagggttcatcaagaagtttgctatcaactacatgtatgctttccttaggaagatctgcagggagaacagtgccatcttcaatgttccccatgagagccttctgaatgttgggcaggtgttctatgtgtaagcactgaaaccaaatacatgtagatgagagttcagcttcagaaccactcgagataatctagctgtgttttgtacttttgttcgtaggtcatataggagtacaatagttgaaagaattgtacagaaaacagcatcatgaccatttcgagcctgatcaatagtggacagtggtcatgttcatcatgtagaacttgtactgtatgcacatctgtaatagctggtggttaaatccagagtaattttggcgcttcattagtaattgcagtatg

SEQ ID NO: 12321 - DNA, 1069 bp, Sorghum bicolor
  Clone ID: SORBI-28MAY03-CLUS4333_1
cgtgcgtggtcatcctccgctaggctggcatgacaccatatgctaccttgtattgcctgtgctacttgttgcttctcagtatgtctctatggagatcatgaagccacctcagagtgatgacccatcacagaagaacacactgctcattttgaaatttcttccatttatgattggctggttctctttgtcagtgccgtcaggattgtctatttattggcttacaaacaatgtcctcagcacagcccagcaagtttggttacggaaaatgggtggagcaaagcctgtagtgagtaagggaggtagtgggataattacagcaggacgagcaaaacgctctaatgctgaaccagctggagagaggtttaggcagctaaaagaagaagagaacaggagaaaactcagcaaagcacttgctgcaggagattcagatgcatcatcatcaacatatgacatggaggatgaagaattagatgatgagaccacagaagagggaggacctgtggaggaagcatccagtactggcagtgacaagaaacttccaagttactcggggaagaagggcaaacgatccaagaggaagcgcatggtgcagtaatcgttacagcctaattggatgcattttttgtcacaactggttaatttagttgaccagttaggtgccacagttgatctcggagacagttttggtggtctgttggaggcctatatttgaggtgcagacaaatagacgatttccggggtcacaggtgagctcagtatatgctaggcctgagggtaatggacaggagaacaggagtcgggtatatgggcaagcagagatacaggaatctgtagaagtagataagatactctggtgtattctgtacaagttgggttccaaaattgggcaggatctggataccattcatatgcgttgttgtatttgttttcctcttgtaacctaataaaccattgtttggactttggagggtatattgcgcaagctgacaaccatccagtcatacaaataagtttaattcaacctgtcagaattgttaagagggggggcgggctcaatagaggaagcggt

SEQ ID NO: 12322 - DNA, 735 bp, Sorghum bicolor
  Clone ID: SORBI-28MAY03-CLUS43496_1
gaatccatacatctactgatgcatcatttgttcctaaagctattgacctagcagccagagagctcacttcccttgcaactccaggacaagttgaccaaagccaactagaccgtgctaaagcctcagctaaatcagcgatactggcgaacctggaatcgcaggcatcactaacagaagacatggggcgccaagttttggcatttggtgaaaggaaacctgctgagcaccttctcaaggctattgacggtgttactctgaaagatgtaacatctgttgctgaaaagatcatttcatcaccattgacaatggcatctcatggaaacgttctgaacatgccaacttatgagtcggtcagtggcaagttccgctcaaaatgaggagtacatgacccttcattttatcaccttgtttgctggacaagtttagcagtccattgtcattcacgcctaggccatgattcttggtcagtttcagaagaaataaggaacctcatacagttttgttcgttaaatctgtgatcatttcacaattactcctttttccctttcttttgcggagcattcatgatgttaatgctggtgatagaccagtaacgagcttgtaaatttaactgaaccctggccccctctttcgatgacaaggccccaaaagagtgtacaaaattttcgtaaaacctttgacagaaatgttgaagcacatgaataatgtttctacagaactgaagtttgcatggtt

SEQ ID NO: 12323 - DNA, 765 bp, Sorghum bicolor
  Clone ID: SORBI-28MAY03-CLUS43903_1
cctactgggcatcgacactcgacacgcaccgcccccgccaccaccacaagctgcggctcacggctacgcagcccgctctcccgcgactcccccgtcccctcctcctcctctccttcctactagcacctagagtttcgcccgaatcgatcgccgactgactccgctagggttcggcccgatcgccacttcgtcctcccggctcccgcggggacccgtcgccgcgatgtctgaccggagctcgtcggctgggccgacgtttttcccctttggcccgcaggccgaggcgtgggacgtcaccttcaaggtcaaatatggtgatactctcaaaaggttttatggttgtgccaatgggaatcattttgacatgaatttgtctgctctgcgggcaaagatagctactgcctttaagtttggttctgatgctgacttcattctgacttacactgatgaggatggggatattgtcatgctagatgatgatgatgacttgcgtgatgcagctctgcgtcagaaattaaaccctctgaggattactgttcaactgaagaaaaatcaaccaactgataaaaaagatgtctctgcacctgtgaaacccattactcaggattcactatcccagataatgtcagctattgaatttttgaagcctgtccaggaagatagtcttgctcatataaaatcagctattggtgaagcaatcaagtctgtcccagagccaatacctgatgcccttgcaaaactttctcatgaaatacttgatgcagc

SEQ ID NO: 12324 - DNA, 639 bp, Sorghum bicolor
  Clone ID: SORBI-28MAY03-CLUS5515_1
gcacgagggcaacctggagccggaaaaaaggagaaatacaagcaaatgctacggaccgccaaggaatttttttgggatcggaaaacattctcccttctccaccaccgccttcgctccttgtacctcgccccgtctccctccacaccgctgctatccagaactcggatcgatcgctcctcgtcgcgtcgactgccaagatggataagctcagtggttctgcacgtcttatgattgtttcagatcttgaccatacaatggttgatcatcatgacgaggagaacttgtccttgcttaggtttggtgccctgtgggaatctgtttactgccaggattctctacttgtcttctcgactggaagatcaccaactctttacaaggaattgaggaaagagaagcctatgctgacgccagacatcactatcatgtctgttggcaccgagataacatatggggaggcaatggttcctgatgatggctgggaagaatatctgaacaataagtgggacagaaatattgtcgtagaagaaactgtgggcttttctgagctgaagcttcagccagagacagaacagcgcccgcacaaggtcaggtttttggttgataagaagagtgcccaggaagtgataaaatctgttgccg

SEQ ID NO: 12325 - DNA, 969 bp, Sorghum bicolor
  Clone ID: SORBI-28MAY03-CLUS55321_1
gcacgaggatcttatactcagtgcttataactgctgtgatcactgatgcaattaaggatggtgttggccgccctcgcccagatttcttttggcgttgttttcctgatggcaaacctaattatgataatatcaccaccgatgtgatttgccatggagaaaagagtgtcatcaaggaaggtcataagagcttcccaagtgggcattcttcatggtcttttgccggtctaggttttcttgcgtggtacttggctggaaaacttaaagcttttgatcgcaaaggtcacattgcaaaactatgcttagtttttctgcctctacttgtcgcgtcacttgtggcggtttctcgagttgatgattactggcatcactggcaagatgtttttgcaggcggcatcttaggtcttacagttgcttcattctgttacctgcagttcttcccgtttccctttgacaatgatgctctatggccacacgcatacttccaacagctagctgagacacacagcaatggtaatgcaaactcaatcaacataagacctacagagtctgaagatgaacaagaagaccatggtggcattgcccttagggataccagccctatcttggagtcaatggagtctggccggagactatgaagaagcatgccactgtgagtttgtccaaggtgcaaattcttccattccttcaaattctggaagcacaatgagttgtggtttcaccatgtagccgtccaatgtaaagagtatggaggtatatctaccgccttctgatgatttgatgatccacagtttcttgtaactgcccagcaggccttaataccatggaataacatgtgttgtggttagctgtaaatgacagtgaatgtttatgtttccagtgacaatgtgaatagttggttttgcactgctgtggtatggaaagtttgtttcaaggttccctttggtggtaatgaaattgtccgacaacctg

SEQ ID NO: 12326 - DNA, 1150 bp, Sorghum bicolor
  Clone ID: SORBI-28MAY03-CLUS55730_1
gcacgaggcaagtacgacggcaagtacctccactccctcgtccgggagctcctcggcgagacgaaggtcagccaggcgctccagaacatcgtcatcccgaccttcgacatcaagctcatgcagcccaccgcgttctccaaatacgatgccattaacgatgtctccaaggacgctctgctctcggacgtgtgcatcagcacgtgcgccgccccggcgctcctccccggccgccagtgcgacccccgggtccaggacggcgagccccgggccgtcaccccctccgtcggcggcgccgccgcggacaacccgacccgcctcgccggcgccggcaaggcgctgctgaagaagccggcgtccaaggtgaacttcccgaccgagagagaggagtcgggcgggctcaggggcccctcgcaggacgcccgcgcccccttcgcgcagatgctggtcgatgcgcggcgggccaggctgcgggagaaggtcggcagccccagcctcgaggacaacgcgccggccagcatcctcttcagccagtcccgcgccgttctcgacgacatccacgactccgtgctcttccaggcgctgcactcggagaggcagtacctccggatccaggacgacgagctcaccggagaaacgtcgtccgtcgacgtgtccaccatggagaacctgaaccgcctcgtcgacgtcggcaaggggctgctgaagaagccggcgtgcaaggtgaacatcgagacaggcaagaacgagcccgacgtcaaaaggggcaccaatgaggatgaactcatccgtttcgccaagatgctggtacgcgagcgccgggctaggatccagagaaagggtgacaacacaatctaattaaacctggagatatagaggccgcccggatgatacttgtgtcaaatatgtgttcaaaaagtgtactacatgatagctccctaataagccgccatgtgttctgcatttcattcgttctgtgtatcctcttcagttagttcttctaaagtgtctatcctatcatgatgcacaatgtacagcttgcataatttgtctatttacacgctactccaccaaatctgcctccaacacggactatcttatttatatgagttcttttgtattggttgatgggtactatcatgtactttgactt

SEQ ID NO: 12327 - DNA, 1318 bp, Sorghum bicolor
  Clone ID: SORBI-28MAY03-CLUS5623_1
aacaaccgtttttcctgtttccacgcgtccacccacccgcaaggtcgcgtcgtcgtgaacccgcgggcggagaagaagggggacacgcaggcaggcacagccaccgctgccggcggcgcgagatcgaggaaggaggggatcccacgctcccctgccgcgccgctcgaggtcgagtgccgagcgagatggtgaacgccttcttcctcttttgcggctgcgtggaccaggccagcgtggcggtggtggagaagtggggccgcttcctccgcctcgccgacccgggcctccacttcttcaaccccttcgccggggagtgcgtcgcgggcgccctcaccacccgcgtccagtccctcgacgtccgcgtcgagaccaagaccaaggataatgtcttcgtccagctgatctgcacaattcaataccgtgttgtcaaggaaaatgcagatgatgcattctatgagttgcagaatccccaacaacaaattcaggcctacgtctttgatgttgtccgggccatagtgccaagaatgaatctggatgatctctttgagcagaagaatgatgtggccaaagctgtactggaggagcttgaaaaggtgatggcagcttatggttacagtattgagcacattctcatggtcgatatcatccctgacgctgctgttcgcaaagcaatgaacgaaataaatgcagcccaaaggctccagctggcaagtgtttacaaaggagaagcagagaagattcttatggtgaagaaagcggaggcagaagccgaggcgaaatacctttctggtgtcggtatcgccaaacagcggcaggcgataactgatggcctcagagagaacatcctgaacttctcacactcggtgtcaggcaccagcgcgaaggaagtcatggacctgatcatggtcacgcagtacttcgacaccatcaaggagctcggtgatggctccaagaacaccacgatcttcataccccatggaccgggccacgtgaaggacatcagcgagcagatccgcgatggcatgatgcaagcctcaagtagcaatgtgtaaatcacctatagtcctacacgtggattggaggcgtttcagctcgggatgaggtctcgagtaccatgttcatagtattagattgttattagtggtaaataatgagtgctggggctttcggcaagtctggagttgtttgcggccttaaaactagtgaggttgaattttctgtaaaaaatgtgttagcccgaatgctcgaccttacacgttctttccagatacaagtcatagcgagcagagtttaatatatagtgatatctttgtgccgg

SEQ ID NO: 12328 - DNA, 1086 bp, Sorghum bicolor
  Clone ID: SORBI-28MAY03-CLUS564_1
gcacgaggatgaaaatgaacagggagaagatgttattgctatcctgccctgggaggaatggtgggagtttgaagtgacaaaggatgactcaaatcctcagattgcactgcttccattgcatccagatttgcgagcaaaatttaatgagacagcagcttggatttatgcaaaaagcatggatgggaagccttatgggtaccacaatatgatatttagctggattgataccatcagtgataattatccaccaccattagatgctcatgtggttgcttctgttatgactgtatggaccaagcttcaaccagagtatgctggtaatatgtgggaagaagcccttaacaaacggcttggaactaagggtcttcacctttctgaaatcatagtggaatcagagaaacgtgggataacatttgacaagttactaactgttcctgagaatgatagttgggtctatgaagatggccagtcagcatcttgtatagctttcgtccttatgatgtacaaggaggctggactctttgaccctattaccagctctgttgaagttaccgaattcacaataaaagatgcttacaccctcaacttttttgaggacaacgccacccgacttccggaatggtgcaacaaggatgacgacgtgaagctccccttctgccaaatcaagggcaggtaccggatggagctgcctggattcaacaccatggaaccctatgcccacatgaacgaaagatgtccatccctgcctccagattacaataggactaagggttgctagtgttaaccacagatatgcggtgtgctttttattcacgctgccttatagccattgcttcagctgtacataatactagtattagtataatagtactgtgggtatgtactgcttgtccttgagacgcacgtatggattgtgggtaacttatgtgagacttcctcgaataaggaagaccatagtcacacaaatgtacagtaaccatgcctgttccctttacccgagtttatacttgtgtaagaggggaaaaaagtatgtgcatctttgaagtttggactgaaagctgataacaaaaaaaccctgcttcggcc

SEQ ID NO: 12329 - DNA, 745 bp, Sorghum bicolor
  Clone ID: SORBI-28MAY03-CLUS4558_1
cgtccaaggccttccgcaacctccctggcgttgatgttgccaatgtcgagcgtctcaacctgctcgacctcgctcctggtggccaccttggccggtttgtcatctggactgagtccgcgtttaagaagctcgatgaggtgtacggtaccttcgacacgccatcggcgaagaagaagggtttcgtgctcccgagggccaagatggcaaacgctgatttgtccaggctcatcaactctgacgaggtgcagtcagtggtgaagcccatcaacaaggaggtgaagcgtagggagcctaggaagaatccactgaagaatatggctgcagtgctcaagctgaacccgtaccttggtactgcacgcaagatggcagccctagcagaggcagcgcgtgtcaatgccaggaagcagaagcttgactccaagaggaccaaactcagcccagaggaggcttctaaggttaaggctgctggaaaggcgtggtacaaaaccatgatctcagacagcgactacacggaatatgagaacttcaccaagtggcttggtgttacacagtgattgtctgggtcaagcctttgtagtttgtcaagtcagaaattatgattttgttttctattgtcaaatgtcgcttgttattggtatcttcagacatgatatctcgttttggctttggtagtttttttaccgctggacttttacttccagatacctatgacacctattattggaacaaagtatatgcaattttc

SEQ ID NO: 12330 - DNA, 1374 bp, Sorghum bicolor
  Clone ID: SORBI-28MAY03-CLUS4733_1
gcacgaggagtgcatctaaagagtctgattccacagagacctactgttggtgatgtcaatggagatggccacactgatgttgtggtcccaactgtgtcaggaaacatctatgttctcagtgggaaggatggctcaaaaatccaacctttcccatatagaacacatggaagaatcatgagtcctgttctattgctcgacatgagtaaacatggagaaaatgcaaaagggctaactcttgctacaacatcctttgatggttatttatatctgattgagggatcaagtggctgtgctgatgttgttgacattggagagacctcgtacactatggttttggctgcccgtggggatggtggagatgaccttgatcttattgttaccactatgaatggaaacgtcttctgcttttccacgcagtcaccacaccatccacttaaggaatggaggtcatcaaaccaaggaaggaataatgctgcatatcagtacaaccgtgaaggtatttatgttaagcatggttccgggaccttccgtgatgaagagggcaagaatttctgggtagagtttgaaatcgttgacaagtacagagtgccctatgggaatcaagctccttataacgtgacggtaactttacttgttccagggaattatcaaggagataggcgcattgtggtcagtggtttgtatcatcaaccagggaagcaacgaatgatgcttcccactgttcctgttagaactactggaactgttgtcgtggagatggttgataaaaatggactgtatttctccgatgagttctcactcaccttccacatgcattactataagctgctgaaatggcttctgctactgccaatgcttggaatgtttggtgttcttgtcatcttgcgcccccaagaaggtgcaccactgccatcgttttcacggaatgttgactagtgactcatgtggtgaaatgccggcgacccattgagaagctgagaaagcaactcagagtatccccaacattttcacagaatgttgactagtgcttcacgtggtgaaatgccggggggccattgaagcagacaaagtgacttaagttagagttcccaacatctccatgacttaaatgtcttattcacactgtgatatactgggggattttaatctatatagaaaacatgcaatgtattactcccgacatttaaccgttcaaggattatagttttagttttacaatagacccatttagttctgcagaagaattttgtacacaccttgagccattttcaaactggtatgcactatattggctcacccgaagaacaagcgtactgtcactatactgagcttcgagtagccttggaaacggtatttggttgccttggtctgttg

SEQ ID NO: 12331 - DNA, 745 bp, Sorghum bicolor
  Clone ID: SORBI-28MAY03-CLUS47447_1
ttggtgcagaatgagcggaagctgcttgagaaaatcaatattctttgtctgatggagataatctttagccggccatctgaagatagaactattccattaagtgttattgccgagcggactaagctttcaatcagtgacgtggagtatcttcttatgaagagcctctcggttcatcttattgagggaataattgatgaagtggacagtacagttcatgtctcgtgggtccagcccagagtgcttggaattccacaggttaaggctttgcgcgaccgcctggatgcctgggttggaaaggtgcataccacattgctttcagttgaggcggaaacccctgatcttgttgctgcgtaatttcgcagctgttacactccgcaagatgcttggtcagcaaggtctcattgcaaaatgggagatgctttgtgtgacacttgtagtcatttgctggataatgaaacctgctgccctgagcgtttgtctgcctgcgtcctactgatcggggcctgtaatttctttttttgatgtcctctggacatggatggttagaacttcacgcagtgtcacgaagacgggaccaatggattgaaaatttcatactagggtgttactgtagttttccccagttgaatttaatttgtaaccaagtttatactctgttggacgtggatgcaggagaatcttgctggaacttgagttgtgcctgatttttttcatgttgcattgggataaatcgtttgttatcccc

SEQ ID NO: 12332 - DNA, 1594 bp, Sorghum bicolor
  Clone ID: SORBI-28MAY03-CLUS478_1
aagtccccgaggagcgaggagcagccgcagctctcacacagtctcgcactctgccactctccctgtctgagctctgttctgctctgcctctatccatggcctcgccctcgcggatcttgatcttgctcccgctgctcttcctcctgctgggctcgcattgctctaccggggcggcggcgaggcggcagctgctgcgagccggggacccgagctcgcaggtcaagttcgacttctctccgttcctcatcgagtacaagaacgggcgcgtgaagcggctgatgggcaccaacgtggtggcggcgtcctcggacgcgctcacgggcgtcacctcccgcgacgtgaccatcgacccgtccacgggcgtcgcggcgcggctctacctcccgagcttccgcgccagcacccgggtgcccgtgctggtctacttccacggcggcgcgttcgtggtggagtcggcgttcacgcccatctaccacgcctacctcaacacgctggccgccagggcgggcgtcgtggccgtgtcggtgaactaccgcctggcgccggagcacccgctcccggcggcgtacgacgactcgtgggcggcgctcaagtgggtgctcgcgagcgcggcggccgggtccgggtcggacccgtggctttcccagtacggcgacctgtcccgcctgttcctcgccggcgacagcgcgggcggcaacatcgcgcacaacctggcattgcgcgccggggaggaaggccttgacggcggcgcgcggatcaagggcgtggcgctgctggacccttacttccagggccggagccccgtgggcgccgactccacggacccggcgtacctgcagtccgcggcgcgcacctggaacttcatctgcgcggggaggtacccgatcaaccacccctacgcggacccgctcctgctgccggcgtcctcgtggcagcacctcggcgcctcccgcgtgctggtcaccgtgtccgggcaggaccgcctcagcccctggcagcgcgcctactacgccgcgctcaggggcagcgcctggcccggggaggccgagctgtacgagacccccggcgagggccacgtctacttcctcaccaagctcagctcgccacaggcgctcgccgagatggccaagctcgtcgccttcattaaccgcgacgactagctaaccggccggagtacacctacctgccgccgcggcaaccagtaactgcagtctgcggtaccgcgacaacatcatcagtactatacctatactagtaactagcgagagtgagaggtgattagtagtagtagtagtagtagtaattacttttttgtcctttggtgattactgtgcgtgggaagggaagaacggttcctgcccagcaacccgtccggatggagagggggaccggggtgtgtgtgttcgtttgcgcgcgttgcgtgtcattgactgcaatcgctagagtgccgtgcactgtgctgacgcagctgtatctacccgctgcggtagcggttaccgccagctacagtagccccagagtataatattttactccgtagtagtatattctagcgtcactctacccattgcatggtgtaatttttgttccattg

SEQ ID NO: 12333 - DNA, 715 bp, Sorghum bicolor
  Clone ID: SORBI-28MAY03-CLUS4817_1
tgtgcggcgctcgagccggccggcccgggacgcgaaaaccctagcagctcggcagtcccccgctcgaggtattccattcgcagtcgaccgggtcctcggagcgccggagatcacgatgaagttcattgctgcctacctgcttgctgttcttgctggtaactccagcccctcagctgaggacttgacagccattctggagtcagttggctgtgaagttgacaatgaaaggatggaactcctgctgtcccaactgagcggtaaggacattaccgagctcattgctgcgggcagggagaagtttgcttcagtcccatgtggcggtggcggtgtagctgttgcggcagctgcccctgctgctggtggagctgctcctgcagctgaggcgaagaaagaagagaaggtggaagagaaggaagaaagtgatgatgacatgggcttcagcctcttcgactaagctgcgcagtcatagagtattattttgggcagtggtaccagacgaaaaccagagtcatgtttagattttaaccttgttttgtgtggaaattactggaaagacagctactgtcttcatattttgtattcagccgtagattgctatgctggttggggtttactggtgaaccaaagtttctctatcttatgaattggttaccccaaaaaaaaaaaaaaaaaactgtcctgttgttacaaaaaaaaaaaaaaaaaaggcccctaa

SEQ ID NO: 12334 - DNA, 860 bp, Sorghum bicolor
  Clone ID: SORBI-28MAY03-CLUS59808_1
ccgcgtgcggtggtgcaggccctggtcctactgagcctggcctctcacagattcagtctgatgtgagaggaacagcaggctacgtggatccagagtatctgaggacaaactatctttcgttcaagagtgatgtgttctctgatggtattttgcgcctaggaatcctttcaggccgtcgtcctattgaggcaaggaggggtccaacagaaaggattacagtgagatgggccttcagtaagtaccacagaggcaatgttagggacatactggatccaatgttaactgaagcagtgaacgaggatatattgaacaaaatcttcgatgtggcgttccagtgtgtcgctcctacccgcgaaggcagaccatccatgaaagaagttgtggagaggctgtggaaggtaagaagggattatgcaaaaatacaaaggatagcagaattgactctctgaatacttaattgaatccttaaaccatctgatcctggttgccgttcttgcttgggagaacatgggtcagttccttgtgaagaccaaagatggccacataaaaacaatgcaaatttgtgattatgaacaagtggaattttgtagagggttgccaaaatgttgttgtatgttgtatatggctctatgtttaagagatgtgcggaacaatcaccaacaatgtcctgcgattgatggtttccctgtgtagccattactgttaatcagcataagctgttcagtaagttcagtaatctgtatcgtcgagaagtaccgtgtagcttcgagtgtatggatcttgtactttaggaaacagctgcattttctggtgaggcttttaaaacagttagatactccgtatgaatgaaacctttgact

SEQ ID NO: 12335 - DNA, 1205 bp, Sorghum bicolor
  Clone ID: SORBI-28MAY03-CLUS608_1
gctctctctctctctctctctctctctgcgacggctggggctaccgacgccgacgccgacgacctacgccaggtcccgaggccttcgtcttcgttagtctcttcgccggcgacgagcacgcatcagtttggttggaacttggagtttagagggaagatttggtgatgagcagccgcagccccccgccgaaggatcgcaggatgcgtaccgaacgcacctcataccgtgacgcaccatatcggagggacagccgccatggtccaagcaggtttcgtaatgatttgtgcaacaattgtaagcgtcctgggcattttgctagagactgtcctagcgtggctgtctgccatacctgcgggcttcctgggcacatcgcagctgaatgttcttccaaaggtatttgctggaactgcaaggagcctggccacatggctaacagctgcccaaatgaagggatatgccgtaactgtggcaagtctggccacattgcaagagactgcactgctccaccagtgccgccaggagaagtgatcctttgcagcaactgctacaaaccagggcactttcgtgaggaatgcaccaatgagaaggcctgcaacaattgccggcagagcggccatattgcccgtaactgcaccaatgatcctgtttgcaacctgtgcaatgttgctggccatctagcccgtgagtgccccaagtctgataaattgggtgagaggggtgggcctcctcccttccgtggtgttggcgctcccttccgtggtgttggcgttcccttccgtggtggcttcagtgacgtgatctgccgggcctgcaaccagattggccatatgagtcgtgactgcatggctggtgccttcatgatctgtcacaactgcgggggccgtggccacatggcttatgagtgcccctctgtgagtctcatggaccggttcccccctcgccgtttctgaaggacgcggaggggtgttcaaatgactgttcttttcagcccagtgtgtcaacaacatttacttttgtttgctttatgtattttctaaactgcaatggattctagatatttcagattcataataactcgctagcagtatttgtaattctggatttgctacttgactcctatgttctgttgatggtaatgtttaaagacggggatatttgtccttataaactcaaattcatcccgtgagtttttaatattattcgaa

SEQ ID NO: 12336 - DNA, 1495 bp, Sorghum bicolor
  Clone ID: SORBI-28MAY03-CLUS609_1
tcctccatccatctccattttcttgcaatgtccaagacctgagtgagagagcttctcagtccatggaggtgtcgtcgaggctccaaagcctcctcaggcccctcctactctgccgctcccgcgccgcagggagagccttccaaaccctagctcttcgctccccgccgccgccgccgccgcctcctccgcgcctcccatcttccttcctcctccgaacgcgccgtctaccgccttcccatccgtatggcgccccatcccgcgtcctcttccaccgccccttcgcctccgtctccccggctcccgcccccgttccagggagtgaccacctcaactccaaggaccagggacccccgcccgcgcccttgcctccgccgccgccagaggatctcgcctccgaagacgagtcctactaccacgagcacctcctcgaggtggcgcaggagaaccagtcacgggtcgtccccgtcaaggcattcttcctatgcaccagcatcgacctgcggagcctccagtcccagaattccttcaatgtcatcccaccgacatcgcgtgccaccaactacgttgtccttagatactacgatgtcaacggagaccccgagggttttaagtctggcgtcatagatgagagccattgccactacatggtcgttttccaatatgggtccattgtgctgttcaatgtttctgatcatgaagcagatggatacttgaaaattgttgagaagcatgcatcgggtttacttccagagatgagaaaggacgattatgctgttgttgagaagcccaccttagagacatggatgcaaggtggtcttgactatattgtgcttagggatctgagtattgatgggatccgtacaattggaagtgtcctgggtcagagtattgctcttgactactatatccgtcaagtggatggaatggtagctgagttcacagatatcaatcgtggaatggaaaaaaccggtaccttcactatggagaggaagaagcttttccagcttgtagggaaggctaactctaacttggctgatgttattcttaagcttggactctttgagaggtcagacatagcatggaagaatgcaaactatgctcaaatctgggaataccttcgagatgaatacgagctaactcagagatttggaaaccttgattttaagttgaaatttgttgagcacaacatcaggtttcttcaggagatccttcagaacaggaagtcagattttctggaatggcttatcatcatcctgatcagtgttgagatcttgatatctgtttataacataatacaggagcagatgtaggcctttgttccatcctgaacacgagttgcatatgtcttgactctggattttgtgccaccctgccgttggcacagcctcagtttgtaaagaaacatacgtactagagagactggatccgactcgaaatggtaaacgatggtcgcacacaacatataatttgattgttctcctctgacttgatttgt

SEQ ID NO: 12337 - DNA, 1143 bp, Sorghum bicolor
  Clone ID: SORBI-28MAY03-CLUS6174_1
gcagggtctgcaaacatgtttggtggctctgttatcaagatggtttaaacctgctgcagaatcttttgtgaaagtaccgttccttggagctgtttcacatcttactcttgcagtttgcccattttgtgtcgcatttgctgttctgtgggctgtttttcgccagcttccctttgcttggattgggcaagacattctgggtattgcactgatagttacagtcatccaaattgtcagagtacctaacctcaaggtgggttcagttcttctcagctgtgccttcctgtatgacatcttctgggtgtttatctccaagaggtggtttcatgagagtgtgatgattgtggttgcacgtggcgacaagactgacgaggatggtgtgcccatgctgctaaaaatcccgcgaatgtttgatccatggggtggatacagcatcattggctttggtgatatccttcttcctggtcttttagttgctttcgcgctaagatacgatttttctgcaaagaagggcttccggtctggttactttttgtgggcaatggtggcctatggctctggacttttaatcacatatgttgcgctgaacctgatggatgggcatggccaacctgcccttctgtacatcgtgcctttcacgcttggcaccttgatcgcgcttggatggaagagaggggagctgccaaacctgtggacgaggggagagccggagagagtgtgcacacatatgcatatgccgctgttgccgacgaccccaaactaaccagaggcactgctgggtcataatgcataccctgaccctgcgtcaacggtcggtaaaaaccttaaaggtgtgccactgccgtgacatcagctccttccggcaaatatactagtaactagtaactaaatgtgttgcctgctggcaatatatatggtcagtaagaagtgttttggtcgagacatttgactgatttgtgaattactagtgattatgtaagcaagttgttgtatttaatggagatagtttgttagcttggtttatatatgatcagtttgggttgcctgatgtatatatatatatataataactagtgcagatggcaacatgtctaatgtttgttgccatctgtactgtagcaagcagaagcagtgataagtccatgt

SEQ ID NO: 12338 - DNA, 665 bp, Sorghum bicolor
  Clone ID: SORBI-28MAY03-CLUS63766_1
ccctgagaacccaaagaaagcacaggcaaagaaagagaacagcgcaaacccatcagctctcaagctgcaaggctctattaccctaagcaacaatatcaatgaccggaaaacgcctaaaaagaagccattgccttcaccttctcctactgatcagaagaagccatcaccatcgccttcttctgatcagaagaaaccggtaccgaaggagcagagagcaaaggcagctggcactcctccaaaaccaaaggccaaggatatgaagggtagccaagagaaaaagccgcagcagaaagtggctccttcggtcagcgcatgaagcttgctgctgcgaaaatggttactgatcatgtaagatacatcttgtgaagttctctcgtgtttatcactcatacttgtatgtcttcgcttttgtgtttacggtgatatgggaccaggagtgtccaatctagaatgtgcttggtttgagcggttgcgcacatacaacatatctgatgagaaatgttttggttaggactttaggatctctgttattcattgttgtgctgttgtaataagacttgcctggctatctgcttgaatggaaggtcttgttggaacaaaatgtaagctcgttctctgtccataacattaggatcaaatggcaaatcagtccatgtatgtttcat

SEQ ID NO: 12339 - DNA, 656 bp, Sorghum bicolor
  Clone ID: SORBI-28MAY03-CLUS52907_1
ggacttcagctcctcgcgcttctcagagataagtggattggctcagcaagatgagggcagtggccaggctaaggagaggcctttggctctccgcaataaggagccaaggtggcatgagcaactgcagtgttggtgcctcaacttccgtggtcgggtgaccgtggcttctgtgaagaacttccagttgatagctgcaccacaactagattctgaatcgtcgcagcaagctcagcagcaagcccagccttcgaattcatcttcagtactggatcatgacaaagtgatcctgcagtttggtaaggttgccaaggacatgttcacgatggactaccgatacccgctctcggcattccaggccttcaccatctgtttgaccagcttcgacagcaagctggcttgtgaatagattatacatacataaagaacagggatgcatgtagattgtatctctgtgcaataagtatttatagtgtgcgtgctgtagtagtttattgccgtgtttattcagtcctttgttcgctttagtgtgacttgtcaaaggttcaaagctaagaatcggcagtagttatgagctgcagttgtttattacactttcatgtctgtaacttggtaacgtaaaatgttcagatattaagtttcaatacctttccgccttt

SEQ ID NO: 12340 - DNA, 973 bp, Sorghum bicolor
  Clone ID: SORBI-28MAY03-CLUS5203_1
cttcttcggttcttcctcctccccaacttggttcctctgtttttttttttttaaaaaaaacttggttcctctgtttcccatcttcttcctccgctccgccacactctgcttggctcgaagtggccagtccgccgacaaagccaaaccttgcgcgcgggcgcctgagcaatcgccattccccgatggagaacagcgccagggccagcaatggggaggtggcggctgtcccggactcgtggaacttcgtgccgaacgagaccctcctgggcctggcgtcgatctcggtgcgcggcgtgctagccaagatcaaggccgagatgggtgccgcaggcggcggcggcggcgggcggccggtgatcccgatgggccacggcgacccgtcggcgttcccgtgcttccggacgtcgccggaggccgtggacgccgtcgccggcgcgctccagtccggcgagtacaactcctactccacttgcgtcggccttgagccagcacggaggtccattgcgcagtacttatcccgtgatttgccatatgaattgtcactcgatgatgtctacctcacaaacggctgtgctcaagcaattgagataatctgctctgtgttagctcgtcctggtgccaacatcttggtttcaaggcctggctacttattctatgaggcgcgcgctgttttcaatggcatggaagcacgatacttcgatcttctacctgagaaagactgggaggttgacattgaaggcgtccaagctcttgctgacaagaacactgttgccatggtcattgtcaacccaggaaacccctgtggcaatgtgtactcctatgagcacctggccaaggttgctgagaccgcgcggaagcttggcatatttgtcatagcagatgaggtttatgcacacttgacatttggagagaggaagtttgtgccgatgggtgtgtttggggctgtggctccagtgctcacactggggtcatt

SEQ ID NO: 12341 - DNA, 725 bp, Sorghum bicolor
  Clone ID: SORBI-28MAY03-CLUS5392_1
cctactggagttccagagccctccaagcaaaaaatatatattagcgaatattaaagcattttccttatagagatatatataaaaaattagaacaaaaaggtttttccttttcgcgactccgtcgtccaccaccaacctcctccgatccggccgccgtagcgtagccgaattgtcccactccgggactcgctcggtcgacgagagggtgtttccggcgagtgctctcggccgatctcctccgcgcggctgaggagatcccgcggtcgcacgggggctggggcgtgcatgatgggattttggttgattccgatggagactccggcgaggcttctgtggagcaccagcttcttccgccacaagatcgccgccatgctcgcctcctcctcctgcttcttatagatcccacccctcaccgtcgtcgtcggcagctagctcgctagcttctgtacatacgtcgacgcccatataaatattattagtcttcatcgatccactcccgattaagtaataattcgggcaaagaatctccaagcttttgcctcgacgatctttgcattgatccatggagtccggacggctcatcttcaacgcgcccggctccggcgccgggcagatgctcttcctggactgcggcgcagccggtggtcccggcggcggcggcggcggcggcggcggcttgttccatcgaggcgggagaccgatgcttggccttgaagaagggcgcg

SEQ ID NO: 12342 - DNA, 792 bp, Sorghum bicolor
  Clone ID: SORBI-28MAY03-CLUS54023_1
ggattattcgccaacaaacccattttcccgtctccacttgttcctcctcctctctcgccttcctccaccggcctcctcccccaactccgtccccccattaccgtcagcgccttaacgtcagcgggcggcgccaccgccggcgacggggcccgcatcgagccaggcttccccaggcccgtcctccatcgtcggggaggcgacgccgtggtcccgccctctgggctggctgggcgtggaggggacgggactactggagatccgcgcgtctctgcttggattgcgtccttctctcgccgagggtatgagcaatgtactcaccaaaaccagaatctagttttgccccaaatcccaactcaggcacacaccagcagcaaatggaattacctggagccaacatgggtcctagtaatggagcaaataacaataccaacatggctgcaaggcaacgcttacgctggacaaatgaactgcatgaaagatttgttgaggctgttactcaacttggtggccctgatagagcaactccaaaaggagttctaagaattatgggtgtacaaggattaacaatataccatgtaaaaagtcacttgcagaaatacaggctagcaaaatatattcctgatgcttcaactgatggaaacaaagccgataacaaagacccaggggatttgcttgccggacttgagggatcctctggattgccgatatctgaagccctcaagctgcagatggaggtccaaaagcggctgcacgaacagttagaagtacaaaggcagctgcagttgcgaattg

SEQ ID NO: 12343 - DNA, 1361 bp, Sorghum bicolor
  Clone ID: SORBI-28MAY03-CLUS5378_1
ttgtggcattctgctccagggtccttgacaatgatctcatgctttattatatctgcccaatgcacaccctatttactcttatggtatatggatcacttggtctatttaacaaatacaatgagataccatcaatcatggctattaagattgcttgctgcttcctgtctgtaattttgatatgggaaattcctggggtatttgaactattgtgggccccctttacatttctgctaggctataaagatccatccccatccaaggcacacttacccctgctacatgagtggcatttccgatctggcctcgatcgatacatatggattgttggaatgatttatgcttacttccatcctaatgttgaaagatggatggagaagctggaagaatctgagactaaggttagattatcaatcaagggaaccattgtcactctttcgttgacggctggttttctgtggtacgaatatatatacaagctagacaaagttacatacaacaagtaccatccctacacgtcatggatccctataactgtttatatctgcctgcgtaattgcacccagcagttgaggagtgcctctttggctctttttgcatggcttggcaagattacactagagacttatatttctcagatccatatttggcttaggtctaacatgccaaatggacagccaaaatggcttctttgtttcataccagattatcctatgcttaacttcatgcttactacggcgatctatcttcttctatcataccgtgtgtttgagatcacaagcgtcttgagggcggcctttatccccagtagggataatagccgtctataccaaaatttcattgctgggatcgccatctcagtgtgcttgtatctctgctcacttattctcctgaagattcctgttgtatagggatgaagataccccaagcaagcacgagggaaggtttcttgtaaaacgtttgcttgataggatgttcaggtctggcctcgattcccttctgctgttgtggagatacttggggatgtcaggagaagcggctaagttggacatatgggaattgggaaattgaattgccagatgctgcagatacagaagtccaatttttgatctttttgttcgttcaaaacactgctgtatacaagtaggcaatccgctcattcttttggaagttgtagcaactactgctcgccagcctatgttgatgcaacctcgtgtaagagttatcctgtagaactgcaccgtgttgtaccataggtattttgatgctgtacaaaaacaacgggcttttcctctttcttgaaaagaagaatataaaggcagagccctttgcttcccccaaaaaaaaaaaaaaaaaactcgggg

SEQ ID NO: 12344 - DNA, 264 bp, Sorghum bicolor
  unsure (1)..(264): unsure at all n locations
  Clone ID: LIB3480-026-P1-K1-D5
ggtctatntaacanatacaatgagataccatcaatcatggctattaagattgcttgctgcttcctgtctgtaattttgatatgggaaattcctggggtatttgaactattgtgggcctctcttacatttctgctaggctataaagatccatccncactagttctagatcgcgagcggcccgccctttttttttttttttgagtcgcaaaatataaagctagtagtagtattttgctttaaaaaaaggaaaaagaaacacacaat

SEQ ID NO: 12345 - DNA, 953 bp, Sorghum bicolor
  Clone ID: SORBI-28MAY03-CLUS5507_1
caagtattgcagtgcaagagcccatccatcatacccatgcattggccaatggccatgaatggccatggccagccacaaacagatcaaacggtgttgaatagtaccctgtacagagtgagagagagagattaaaaaaatatataaaagggctaggagtaactaataaacaaacacagcaagcaagcaaacagaggcataattagcaccaccttgtaaggtgtaatccatgtgcctacccctgctatataacaatccaaaccccctctcagcagctgctgcctgctttttgccttactctctctttctttcacacaatcccactacttgttagtttggttttctctttacttcctcattggtgagtagtgtcctggccatggcgtcgaggaggaggggcttctcgggcctgccgccgccggcgtgcctgccggtggtggtgctcgtcgtgtgcctggcagccgccgtggcggtgtcgggcgagccgctgccgcagtactacaatgccatcttcagcttcggcgactccttctccgacacgggcaacttcgtcatcatcaactccggcaagctgcccaacatgcccaagttcccgccgccgtacgccaggtgctccaacggccgcctcgtcatcgacttcctggccgaggcgttcggtcttcctctcctcccaccgtcggcgaacaagggcaccaacttcagccagggcgccaacttcgcggtgatgggggcgacagcgctagacctgaaatacttcaaggacaacaacgtgtggagcatccctccgttcaacacctccatgaacgtgcagctcgagtggttccaagaagtgaagcagagcatctgcccatcggacccatccacctgccgcgcgctcttcgccaagtccctgttcgtgttcggcgagttcggcggcaacgactacagcttctcgtggaaggcggactggtcgctgg

SEQ ID NO: 12346 - DNA, 706 bp, Sorghum bicolor
  Clone ID: SORBI-28MAY03-CLUS6524_1
cgacccgccccctacgtcgccgcttcaatacctcccttcttctctcccaggagatgggtccccgcctccatgaatatggaggcgacaaagccgtagatgctagcagctaagacactcattaccgccaacccatctggtggaatggtcccagaccagtctgataatatgaccgcggtaactgctgggaagcaagccgaggctgagccttccgaaaccgcctggattggccccgtgctcgcccccaacccctggtgcgcaaagctgtcgaaggtgaaccggcatttctatacccgccagtcggcgtgccgcgttgcagggaaaacctcggcggccgtgaaacagcctctatgtaaagggaacaggagccggagggtcagttctgactctgcgcttgactacgacgacctgatagctttctacgatgctgccacgggggtccttttccaccgcacgcattggaccgccaaacctctgttccatgccacgcatgccttgcctgctaaggtgtctattcagtttaacatggacgcatgtaggtatgaaaccggcgattcaacgaataaggccataagacgtgcgttcatgaataggttgatacggtggcatgtatgaaaacggcaactacatccaggcttaatcattttatgctacactgctccgtggactgcggggggcgctgcgcgagagatgcgcctgtaatcaaata

SEQ ID NO: 12347 - DNA, 448 bp, Sorghum bicolor
  Clone ID: LIB3476-021-P1-K1-D10
cctaaacctctcctctccatcggagtctcgccgccgcgccatggcggcggaaccgccagagcccgcatcctcgcaggatgcccagctcgcggcctcctcctccgccgctgtagacggcgttggcgaccccaacccgtgctgcgcaaagctgtggaagaagtaccagaaattggagacgagccggacggcgctgcgggaggcggtgaagctcctgcaggccgagaacgagaagctgcagaaggagaactcggagctcagcaaaggttcagactctgcagtatactacgaggacatgtatattaacttcaatattgccaaggagatcgtcttccaaatagcgggtatgcaaccagcaaatgtacgagttaggccaaaagacatgtgctgagaaaaagtttgatgcaagcaggaatttaaaagctgaagtccaaacctgaatatatatttt

SEQ ID NO: 12348 - DNA, 1663 bp, Sorghum bicolor
  Clone ID: SORBI-28MAY03-CLUS6550_1
gtaggctctttgtaaaggcttcaggaagaccacaggacattctgccgaagttaaggatgctggcaggtttttcacaagatgatgatattgaactgtatgaggaaattaagtttgagcccaatgtgatgtgtgaatacattgataacaggcttctgtttcgatcttgtcagcttgaagatggggacataatttgttttcaaaaatcttcaaagccagatagtgctgaccgatatcgatttcctgacgtcccatcctttttgacgtatatacgtaaccgacaggtggtccacttccgttcactggagaagcccaaggaggatgatttttgcctcgagatgtcaaagatattcacatatgatcaagtcgtggaaaaagtagctgaaaaacttggcgtggatgacccatcgaaaattcggcttacatcacataattgttattcgcagcagcctaagccccaaccaataaagtacagaggcgttgaacgtctacttgacatgctgatccattataaccagacttctgatattctgtactatgaagtattggacataccacttccagaattacaagcgctgaagacattaaaagttacatatcatcatgccacaaaagatgaggtgtcagttcacagtataagattgccaaaaaacagcactgttggtgatgtgctaaatgatattaaaacgaaggttgagttgtctcatcccaatgctgagctaagattacttgaggtcttttatcacaagatatacaaggtatttgcagcaaatgaaaagattgaaaacattaatgatcagtattggacactgcgtgcagaggaggttccagaggaggagaaaaaccttggtccctttgatcgtttgattcatgtatatcattttacaaaagatactcaaaaccaaacgcaagttcagaactttggagagcctttctttatggttatccgtgaggatgagatcctatcttctatcaaagaacgtatacagaaaaagcttaaggttccagatgaggacttctctaagtggaagtttgcatacatttcacttggtcgtccagactattttgaagattcagatactgtagccgtaaaatttcagagaaacatgtacggagcttgggagcagtatcttggactggaacatccagacaccgctcctaggaaggcacacacgattaatcagaaccggcattcatttgagagacctgtaaaaatttataactaggcatgttagaaatttgagggatgagctaccaaagcaagggctgaaattgctgtcttgaaataaagtgtgccatagcccgggcatgttgctcaggtttttcgctggagctgttgagctagttcaggagacttttaagtatgatcggggtggcttctcatctttccccgttttgccccggatatataaagttgtgcagagatgaccccaccgaacaatgtctttagtagataagccagtatttcccgttaggtgactttatacagtcgaataggcgacgttttagtcgatcactttgttcagttggtgctaggaagccttgagctgttgagggtacttgtcctgctgtatattattgacgcggagtgtacaagtctctgttgttgacaattacacggtgtcttgtaatttcaatgatacatttctacatcctttcgtgtgct

SEQ ID NO: 12349 - DNA, 1402 bp, Sorghum bicolor
  Clone ID: SORBI-28MAY03-CLUS6600_1
gcgcgcggggcggcacctccggcgccggcgccggcagcggaggaagggttcgtcagagatggacttcttcagtgaatacggtgatgctaacagatacaaaatccaagaggtcattggcaaaggaagttatggcgttgtttgctcagctattgaccaacataccggtgacaaggtggcaatcaagaaaatacacaatatcttcgagcacttatctgatgctgcccggatccttcgtgagatcaaactacttcggctattacgccatcctgatatagttgagatcaagcatataatgctgcctccatcaaggagggacttcaaagatatctatgttgtatttgagctgatggatacagacctccaccaagtcatcaaggcaaatgatgatttaaccagagagcatcatcagttctttctctatcagatgctccgtgcactgaaatacattcatactgctaatgtttatcatcgtgatttgaagccaaagaacatattggccaatgctaactgtaaacttaaaatatgtgattttggattggcaagagtggcgttcaatgacactcctacaacagtattctggacggattatgttgctacaagatggtatagggcccctgaactgtgtggatctttcttttctaagtattcaccagctattgacatatggagtatcggttgcatttttgcggagatcttaactgggaagcctttgtttcctggaaaaaatgtggtccaccagttggatttgatgaccgatctcttgggtactccatcacttgatacagtttccagaattcggaatgagaaggcgcgcggggatttgagtagcatgaggaaaaaacatccagtaccattttctgaaaggttccctaaacgagatcctgctgcactcaaacttttgcagaggcttttggcatttgatcccaaggataggccaactgctgaagaggcattggctgatccatactttaaaggcctcgcaaaagtagagagagaaccatcatgccagccaataacaaaaatggagtttgagtttgagcgaagaaaggtgaccaaagaggatgtcaaggaacttatattcagggagatattggagtatcatcctcaacttctcaaggattacatgaatggaactgagaaaacaaactttctataccctagtgctgttgacaatttccgaaggcaatttgctaacttggaggaaaatggaggaaagagtggggcacacacggcttcatcagacaggaagcatgtttcgctcccaaggacaaccacagttcattctaatccaatccctccaaatggaatctcccaagttcctcaaaagattcccacagctagaccaggaaagagtggttggtccagtaataccatttgagaatgcaactgctgtgatccatac

SEQ ID NO: 12350 - DNA, 1030 bp, Sorghum bicolor
  Clone ID: SORBI-28MAY03-CLUS66532_1
cccggagctggtgcgcacggggaaggcgaccccggtgacggacgtgttcgccttcggcgtgttcgtgctggaggtggcctgcggccgccggccgctcggatgcatcgcgcccgacgagcagagcgtgctgctggactgggtgcaggagcacgaccgcaagggggccgccctcgacacggtggacgcgcggctgtgcggcaagtacgacgccgacgaggcccggctggtgatcaggctggggctgatgtgcgcgcaccctttgcccgacgcgcggcccggcatgcggcaggtcgtgcagtacctggagggcgacacggcgatgcccgaggtggcgccgacgtacgtgagctacaccatgctggcgctgatgcagaacgacgggttcgactccttcgccgccatgtcgttcccgtccacggtctcgtcgagcgtcagccctgtctccggcgggttctcttcggtgtccggactctccggcgggaggtgaataattagacggtcgctgtcggagtagacttttgcggttttgcccgacttgcgttgttgacaatatatagtggtactgtaacaccgagtggtaaatttctcgccgtactgattttgtacaattgtactggcaagtaaaatactctccgaggccggacggtcatgctgctcgccgtcgactacgacggcgccaccacgcggctcgacgtgaccatggcgcccgtcgacgtgcccaggcccaggaagccgctcatctccgcgccggtcaacctctcggcggtcggggcggacgacaccgcctacgtcggcttctcggcggccacgggcgtcatctacacgcgccactacgttctgggctggagcttcgccacggacggcgcggcggccccggcgctggacatctcgaagctcccggcgctgccgcggttcgggcccaagccccggtccaaggtgctggagatcgtgctcccgatcgccaccgcggcgttcgtcctcgcgctggtcgtcgtcgccttcctgtgggtgcggaggcgggtgaggtacg

SEQ ID NO: 12351 - DNA, 659 bp, Sorghum bicolor
  Clone ID: SORBI-28MAY03-CLUS66538_1
caagctcagatcaaacaacaatggcggcaacaacattggtgttactcgtgctcttgtgcctctgcactgccctaacctgcagcagcagcggcggcggcggcaccggcaacacagggatccgcatgaagctcacccatgtcgacgccaaggggaactacaccgcaccggagcgcgtgcgccgtgccatcgccctcagccgccagattaacctggcctccacgcgtgccgaaggcggcggcgtgagtgcgccggtgcactgggcgacccggcagtacatcgcggagtacatggtcggcgacccgccgcagcgcgcggaggccctcatcgacaccggcagcagcctcatctggacgcagtgcaccgcgtgcctccgcaaggtctgcgtgcggcaggacctgccctacttcaacgcgtccagctccggcagcttcgcgcccgtgccgtgccaggacaaggcgtgcgcgggcaactacctgcacttctgcgccctggacggcacctgcacgttccgggtcacctacggcgccggcggcatcatcgggttcctcggcaccgacgccttcaccttccagtccggcggtgccacgctcgccttcgggtgcgtgagcttcacgcggttcgcggcgccggacgtgctccacggcgcgtcgggcctcatc

SEQ ID NO: 12352 - DNA, 1312 bp, Sorghum bicolor
  Clone ID: SORBI-28MAY03-CLUS56978_1
aaaggctatggaaatggagtcgaaacgaacaagctccggggggaaaagccaccgccagggttgtgccacaccattggcagccaaatagcggtcttgtcatgacaaatgatacagcagataccaatccagaggaggcagtcccgtgcattgcactctcaaagaatgattcctatgtgatgtctgcttgtggtgggaaggtttctttgtttaacatgatgacatttaaggtgatgacaacattcatgccacctccaccagcatcaacatttttagcatttcaccctcaagacaataacatcatagcaataggaatggaagattcaaccatccacatatacaatgtcagggtagatgaggtaaaaactagactcaaaggacatcaaaagaggataactggcttggcattctccaccaaccttggtgtacttgtttcttcaggcgccgatgcacagctttgtgtgtggaccaatgacacctgggaaaaaaagagaacagtttcgatacaaatgccagctggaaaggcgcctgcgggggattcacgggtccagtttagttctgaccaaagtcacttgctagtagtacatgagactcaactagccatatatgatgcatcagaaatggagaggatctatcagtggataccccaggacacattgtcagcttccatatcgcatgcatcatactcatgtaacagccagctagtttttgctgccttcactgatggcaacataggtgtttttgatgcggagaacttgagattaagatgtcgaatcgcaccatcggtgataaacagcaatccacctgttcaccctcttgtcgtcgctgcacatccccacgagccaaaccaatttgcggttgggctgtcagatgggtctgttaaagtgctggagccatcggagtccgaagggaaatggggaacacccgctccggcagacaatggcatccccaacggcaagatgccagcttcgtcggctactagtaaccctgctgcggaccaagtccaaagatagactgtatttcctaagcgttttttctgtaaactttctagttacactgacttatttgtatgtggatgccattaggatattattgtcatttgttggaaaaaggacagaataggtttaagctcaggtgtggttaacattcagatggagttctctttcagatactaccctagttatcctgttcaagtttgcgatagggggataatagtgtccataaagtgtgtcgcctgaggttttctcaggtttagctcgaatgatgtaagctatatatttcttcatgcatgtaaagcaatacatagttttagctc

SEQ ID NO: 12353 - DNA, 964 bp, Sorghum bicolor
  Clone ID: SORBI-28MAY03-CLUS57939_1
tactgggagaaaaaaaaatccaccgatctcgctgaaacaagaaggaatccaatcgagagcaaatgctgtcttccaccacgctccgggcgctggttccggctgcggtggcgtcgccgtcgccggcgcacgtcaccgcctgccccgcgcccgcggtggggcggcgtgtgccggcggcggtggtggtgcgcgcggtgcggaactacgactccatcccgaagcgggagcccttcagctccagccgcagcatcctcgacgagttcctcaggcaggacaagcccctcgtccagcgcaccaaggaccagatcacagattattgcacgaccactgaaggtgatgaatgttgcagctgttgggatgcttactttgaactgaataaacttgagcaagagctgcccaaagaggaaatctcaaggatggttaaggactcagagggtgacgtgaggtacctgattgagagcatccatcatcgctcaaatttacggaagaagatggcagagaaatctcgtaatttagtaccatcaacctcccaggggcaaactgcaaagccaaggccattccctgtgcctgatgggataccgaaaacacaggaagagcttgctgaagaagaggaggcgttgatgccagagtctccatacataaggttgctgagaaggatgggtagataccctgattggtacccccccccccctgatcatgagactgactgaatcaaatcatcccccatccaggtgccccttttggaagttttgcagcatgataatctgaagctctttttatggcctgtggtaagattagcgttgcccctatgcagattaggctgtacttttctacttactaatgaaaatgggggggttttattatgctgtatgtaaatagctggaacgttcggaatatcttttattggatgttctgtaaactgatgcatctctgtatatgtccctggtttttattaaagtttttggtt

SEQ ID NO: 12354 - DNA, 1379 bp, Sorghum bicolor
  Clone ID: SORBI-28MAY03-CLUS57969_1
gtaggctgtagcatttgtcgggttggattgggttgttccgcttgggtagccgggtgggatcgaaatctgtgtggcatccatggcggcggtcgaggggacgacgaagaagaaggtaatcatcgacaccgaccccggaattgacgacgcgatggccatcttcgtggcactgcggtcgccggagctggaggtgctgggcctcaccactaccttcggcaacgtccacaccgccctcgccacccgcaacgcgctccacctgttggaggctgttggaaggacagacatccccgtggcagagggatcccatgcaacaatcaagaaagccaccaagctgaggatcgcaagcttcgtccacggttcagacggcctgggaaaccaggacttccctccaccggctaccaagcctgtagatcagtcggctgctgccttcctggttgagcaggcaaatctgtaccctggacaagttaccgtcgtcgccctcggtccacttaccaaccttgctctggcagtcgagcttgacccttcattcccgaagaagatagggcagattattattcttggcggtgcgtattcagtcaatggaaatgtgaaccctgcagctgaggcaaacatctttggggatcccgacgcggcagatattgtgttcacctgcggtgctgatattttggctgtgggactaaatgtaacccatcaagtagttctaacagatgctgaccgggagaagcttgaacagtgtgagagcaaatatgcccgctacttatgcaagataatgggcatttattttgattaccacaaggatgcctacttcataaaaggagtgtatcttcatgatccaacaacgcttattgctgctgtgaatccatcgctattgacttacacagaaggtgtcgtgagggtacagacagttggaatcacaaagggccttactgtttttgataacaccaagaaaaggtacggagagatcacagcctggactggcatgcccaccgtgaaggtcgctgtcaccgtcgatgctcctgccgtggtagagctgatgatgcagaggttgatgaccgatgactaggagcaatatcagctgattggcagcacggggattaaggctatttgcagagaaaggttggaacttggatgtgcatacctcactagaaatttggtccgcattgtcaccaaaacaaaaggatgcattgcacgctagctatccacttatgtggttatgtgcgtgccttggtgtttatgtacagtttatatgctcgataatcggcacatggccagttcgacaatgtcatacagtcatactagtaatacgtcgcgcatgcttctgagagaacagagtgaaattaacatggtgcaacacttcaaagaatttttcaagattctccgtc

SEQ ID NO: 12355 - DNA, 1643 bp, Sorghum bicolor
  Clone ID: SORBI-28MAY03-CLUS5820_1
ctgcgactggaatatcccaaggagaccctatgctgcagcaagagtactttcttcctgatggccttctatattcacccacaccagggtatcatcatccattcagctcattcgacagagcaccgacacaaccaaataatgctcctgggctgtttggtcaagggaatctaccactggcttctggcatgcatcatggatcgatgtatggtcctggatcctacaagggacgccgccggggtagcaaatttggtggcactactccaagttggagttctgctggccgcagatttggtacttttgacttgagtggcaatcaacaaaggggaagcatgccatttggtagtcacaatggctctctggagtttatgaatgagcaaaaccgtgggccacgcgctacaaaaccgaagacacaagacactgagaactcctcagatgagaaaaacgagaaaactgttcctctgattgacagtgaactgtacaatcgctctgattttatcactgagtacaaggatgccaaattctttgtaataaagtcctacaccgaggaccatgtacataggagcattaagtataatgtttgggccagcacagccagcgggaacaggaagctggattctgcttaccgtgcggccaaagagaaagaagagcattgccctattttcttgtttttctcggtcaatggaagtggccaattctgtggcgtggctgagatgattggacctgtcgatttcgacagaagtgttgattactggcagcaggataagtggagtggccaattccctgtgaagtggcacataattaaggatgtgccaaacaaccttctgaggcacatcattcttgagaacaatgacaataaacctgtcacaaatagcagggacacccaggaggtgaagctggaacagggcctccagatgcttacaatcttcaagagccatgaggctgagacaacaatcctggaagatttcgacttctatgagcaacgggagaaagccttgcaggagaacagacgtcaacagcagcctgccagcaccgaccctcagaagctggtggataccaaggctcaaggtcctgtggccgatatatcggatgcatttgctaaggccgttcagttgaaggatattgagaacagtgggacaaccccgaaagctgagggcgcatcagctgaaaacggatccgctgccacagccaaggttgaaggaagtgcagacctgaacatgggccctgcggaggaaagcagttgatttgtttcccttctgtctgcaaatttggagcagcagatgaatagcatgctgcaatgtgaaggtcggaaaggggaaagtgcaggttgattgtgttaaatatggtcgtgcccgcgtcagttgtacaacatcataggctttgtttttatctccatttaggttatataatttcaatatcatagttccaaaattattgttcccagttctctttgttcctgttttattttacttccgtcttccatgttcctcgtgtcgtgtcgcaccatgaatgatggttcaattttagtgggtttaggcataagaagctgcagaactatgctgcggtaaagttgcattttctgcagctgaatgtgatactgtcgagtctccatccttggtaatttcagagatcctttctctagtgatctt

SEQ ID NO: 12356 - DNA, 952 bp, Sorghum bicolor
  unsure (1)..(952): unsure at all n locations
  Clone ID: SORBI-28MAY03-CLUS58668_1
taaaactctataaagcggtcggcgcgccggccggcctccccgcctcccccccccctcccttcccctgcctgtccgcacctcctctcctctgctttcccaccagccaaaccctctctgtctgtcatcctccattgtcgacgccgccgaggaagcaccacccctgacggacggccatggggacgcaagcgccggagaattacccccctgaaaaggatgcaaggactgcacgggagaaggccatcgacgattggctcccaattacctcttcgaggaatgccaagtggtggtactctgctttccacaatgtcactgccatggttggtgctggcgtgctcagccttccctacgccatgtctgagctcggctggggtcctggcattgcagtgctgattgtgtcatggatcatcacgctctatacgctgtggcagatggttgagatgcacgagatggtaccaggcaagcggttcgacaggtaccacgagcttggtcagcatgcctttggcgagaagctgggcctgtggatcgtcgtgcctcagcagcttgttgtcgaggtcggcgtcaacatcgtctacatggtcaccggcggcaagtctctgaagaagttccacgacgtcctggtctgtgatgactcggggtgcgacagcaagcacaacatcaagaccacctacttcatcatgatctttgcctctgtccactttgtgctctctcagcttccaaacttcaactccatctctggtgtttcccttgccgccgccgtcatgtcacttagttactccacaatcgcttggggcgcatcagtggacaagggtaagcttccggatgtggactaccacctgcgtgcgacaacaacgccggggaaggttttcggtttctttggtgcattgggcgatgtggccttcgcgtatgcagggcacaatgtggttcttgagatccangccactatcccatcgac

SEQ ID NO: 12357 - DNA, 841 bp, Sorghum bicolor
  Clone ID: SORBI-28MAY03-CLUS5931_1
tcgggaacatttatttaagggggtacgaaggttcattgtcctcgagaaattcacatggcgcatttgaaggactccgcattcaaattatcacatggttgacattcttgatcatgaccctttttgccatgctttgttctgtcccaagcaagatggctagaaggatctctaaccaacctagtaggcatgatgactatcgtgttgaatatcctcaagaacaggagtacaaggaggaatttcgacctccatctcctgccccatcctatacagaaaaggatgtactttcatcgatgctaagacgactaggtgagctggaggacaaggtgcaggtgcttgaaacaaagccgtctgagatgccatttgaaaaggaagaattgctcaatgcagccgtccgccgcgtggatgcattggaagctgagttgatttccacaaagaaggccctttatgatgctttgatgcgacaggatgagctactcgcatacattgacaggcagcagctgatcaaatttcgtaaaaagaagttctgcttctaaggtttgaccgtggagcagctgttcatgtccggagccgttcgtgtatattggattgcggctaatatgttgaatgtaatgtgtccatctgtagaagtgtgtaacagtgtaagtatagtaggaaaacaaaatagttgcgttgtgcgcctcccctcccctacgtatatcatgttccgagttctccagacctactggaacgacgacttgttcaggtcaagaatgtgttgtgtggtctagcacttgtgtgctagcctaaattgtaatcttgcaaaagttggtgcatagctgattccgtgctaatacatagctgtaaa

SEQ ID NO: 12358 - DNA, 765 bp, Sorghum bicolor
  Clone ID: SORBI-28MAY03-CLUS67878_1
tcagtggccggcggcagcaagaggtcatcatcatcggttgcgtgcatggggatggaggacgtcgtggggccgtccaggtccatggcggacgacttcgccgcgtccacgctgcccccgctgatggacgtgtccggcggcagcggcggcaacatgtcactttcagcggcggcggcggctgcggcgtccatcgagctgacgacgccaccggcaccacacgtgacctgcttctccaacacgctggagggccacttcctgaccccaccaacctgcctcctcccctccgccgccgccgcctccgccgcctcgccgttcctggcgagcatggcgcagtacgacggcgacgcgggcgtgggcggcatggtgcacgagctcctgcaggaggccggcgggtggtacagcaagctgggcgagagggagcggctgagcggcggcgcgtcgcaggacaccggcgtcacctcggaggtgaaccccgccgagatctcctcgacgcggcaccacatggatcacgaggcctccttttggggcttctgatgaactcccccgtcttttccgttatcgttaaaaaaatggattagaattagtcactggattggaaatggagattgtattgtgctattgaatgaatactgttatgtgcaaatggggcaaaaaaaaaaagttgtgaacaaagcatatatgcttgtgtagtactaaatcgatttggttttagaggaactcagcgtgtaattgttacgtgaacacttagataatctcgtagcgtatatc

SEQ ID NO: 12359 - DNA, 1370 bp, Sorghum bicolor
  Clone ID: SORBI-28MAY03-CLUS6814_1
cttgaaaaaattgatcctgaaaaaactgctattcaagttgttatactagtagcaacaagggaactggctctgcaaatccaggctgttagtaaagagcttgggaagtacctgaacattcaagtcatggttagtactggaggaaccagcttgaaggatgacatcatgcgtttgtaccaacctgttcatttacttgttgggactcctggccgaatacttgatcttattgagcagggcatttgtgtgctgaaagattgttcaatgcttgtcatggacgaggcagacaagctattagctccagagtttcagccttctgtggaggcacttattcatttccttccacctagtcggccaactgttgatgttttcagcaacctttccttgtaactgtcaaggaattcaaagagaaatatctgcctagaccttatgtgattaatctaatggatgaactgacactgaaaggaatcacacaatattatgcttttgttgaagaaaggatgagacgagacttgttgttaacacttttctcaaagcttcaaattaatcaatccattatattctctaattgagtttcctgagttgatctacttcatcttccattttgtcttctttccttatcgttatgacacgagatgtctttctgtagacgtatcctttgttgattttgatttttacatggtgtgtgtatacagtttaacttgaaatctgtgcacagatctgtttaccagaggaattgatatccaggctgttaatgtggtcattaattttgactttcctaagacatctgagacatatttacacagggttggccgttctggaagatatggacacctcggtttggcagtgaacttgatcacatatgaggaccgtttcaacttgtataggattgagcaagaacttggaacagagattaagacaatacccccacagattgacctggccgtatactgccaatgatgagtgccacagtttcaggatcatcaaacacattttatttttttaagaaacttatcaggcaaatacatctgtacatagcaacccatcaaggttttgttttggcaccttgatgacgtttgtaacattggattagtagaggaagtgcttcctgtaggcactgatactaacccgtttagctgaggacatgcacactgggctgcttcgagatgagacgagacatcttacctcacttgacattttcattctacttgttttccagtctcagttctaattgagttgcctgttatcatttgattcatcttccattgtcttctttcctaatgttatgatgcatagagatgtctttctgtagacgtatcttttgttgattttgatttttcatggtgtgtatacagtttaactgaaatcatttctgt

SEQ ID NO: 12360 - DNA, 1319 bp, Sorghum bicolor
  Clone ID: SORBI-28MAY03-CLUS6820_1
gcacgaggcggagttccatccatcccattgtaatacactggcctaccccacgcgtccgggttctatccgccttattgatctacgtcaatcagcactgtgtgacaaccattccaaaatattcgaggaacatgaagcacctggatcaagatccttctttacagaaattattgcatcaatttctgatataaagttttcaaggaatggtagatatattcttagccgtgattatatgactctcaagctatgggatctaaacatgaattcaggccctgtttcaaccttccaagtccatgaacatttgagacctaggctctgcgatctgtatgagaatgactcaattttcgacaagtttgagtgttgtcttagtggggatggacttcgtgttgcaactggttcttatggtaatatatttcgcgtttttggttgtacttctggaagcatggaggcaacaactttggaagcaagtaggaatccaatgaggcgtcagattgcgaatccagtaaggcccacacggacactaacttcttttacccgtggtgttcggagaggtggagaaaatcaaggcgttgatgctaatgggaattcatttgacttctcaacgaagctgctccacctcgcatggcacccgaccgagaattccattgcatgtgctgctgcaaatagcttgtatatgtattatgcgtagagaatgtcctacagaaaatttgttgtttttttggcttgctctcggtgaaggcccagggcccttcaactgcaacgagagggtgcaggacattgtcgtcagttccacccgttggggccagaagctgctgatgtccacaagatcacccattgctgtgctaacggactgcggcctgttgattctttagtacatgtgtaaattataattctataaacatggaaagttttgatccaactattcaatcgtggcaattgtattgagagtcggtggaaaggacatatcgaaggtacaattctgcattggacttgaggacctgcattgcaatggctgtagtatgattggcaatccttagcatgtaatgccacctagacagggctaatgttgttttgggacttgaatttcagaaagatagatagtacccagttattgtagctattcatcttagttaccgttctattcgttggactgttaaaataaggcaacaccttgtaatcttgtttctttcgtctgagtggcctttgtacactgaagcatttgcaagaacggaattgactgaattaaagcatgactaggttcatgtaaggttggccatgtggcaggtcctcttcttttttatagtggtgggtcattatctttt

SEQ ID NO: 12361 - DNA, 930 bp, Sorghum bicolor
  unsure (1)..(930): unsure at all n locations
  Clone ID: SORBI-28MAY03-CLUS6850_1
cccacgcgtccgcccacgcgtccggacccacgcgtccgcccacgcgtccggacccacgcgtccggacccacgcgtncgcccacgcgtccgcccacgcgtncggctgatgaagttgtggaggaaagaattgctgatgatgatgttattctggtgaaaggcacaaagaacactagcgcggtctctataatacttagaggtgcaaatgacttcatgcttgatgagattgaccggtccttgcatgatgccctgtgcattgtgaagagaaccctggaatcaaatatggttgttgctggtggtggtgcagttgaggctgcgttgtcagtttacctggagaaccttgcaacgaccctaggttctcgggaacaactggcaattgctgaatttgctgaatctttgttaatcataccaaaggtactatctgttaatgctgcaaaagatgcaactgagcttgtagcaaagcttagggcatatcatcatactgctcaaacaaaggccgataagcaacattattcaagtatgggtcttgacctctccaaaggtatcattcgcaacaaccttgagtatggcgtgatagagccatcaatgagtaaagtgaagattattcagtttgctacggaggctgccattacaatcctgaggattgacgacatgatcaagcttaccaaggaagagggtaacgaagaagagtaagcagcccacccgtaggagggtagtggactcttgtgtgatggttgtcatagcgtgtaacatttcttttaaatttttcgtttagcttttgctagctgtggcctgtgggcattcgtgtaggttgttgtaggaaaactggatgtgtatcagtgtatccctgtgggggtgacgatgactcacggatggatcaaattttgcgtatattgggggccaaaacagttctatttcaaggatttaagttgc

SEQ ID NO: 12362 - DNA, 992 bp, Sorghum bicolor
  Clone ID: SORBI-28MAY03-CLUS8266_1
gagtctcgagagtgagttcgattcgttgccgtccacttgtctcacgtcacggcctgtcgccatctccttcctggttgctccatccctgcctcctcggcgccgccggcgacgactccatagagccactcggccacaggaaccggcgaccatgtaccgagtcgcctccggcctcggcgccctcaagaggcatggggcagatgctcaaatgatgaatgttgcaatcaggtgtgccagcacaagtgttgcacaagggtcatctggtggcttctggacctggttgactggtgcacgctcaaatgaaatacctcctccagattttgcacttccgggagtgactattcctcctccgctacctgatcatgtggaggctggcaagacaatagtcacaacacttcccaatggtgttaaaatagcctctgagacatctgcaggatcatcttgttctgttggagtttatgttgattgtggttctgtatatgaagcacctgaaacaacaggcgccagtcaactggtgaagacaatggccttcgcaaccactgccaacaggagcgaattgcgggttgtgcgtgaaattgacgcaataggtggcactgccaaagcatctgctagccgtgagatgatgagctacacttacagggccctgaagacttacatgcctgaaatggttgaggtgcttattgattgtgtacgcaaccctgcttttcttgattgggaggtcaaggaacagattttgaggctaaaggcagagcttgtgaaatcatcaagtaatcctgaaaaattccttttggaggctcttcattctactggctattctggtgctttagcaaacccactaattgcatcagaatatgcaattagcagattgaattcagatgtcctggagcaatttataattgagaactacactgctccccgcattgttctagctgcatcaggtgttgaccatgaagaattggtatctattgctgggccccttctgtctgacattccca

SEQ ID NO: 12363 - DNA, 1385 bp, Sorghum bicolor
  Clone ID: SORBI-28MAY03-CLUS616_1
cgtccgcccacgcgtccgcccacgcgtccgcccacgcgtccgcccacgcgtccgcccacgcgtgcgcggacgcgtgggcggagcggtacgccatcttcccggagatacaaatcgtcatgcagcccatgggcatggtggcgggcggcgcgcctgttgggtctgacgccggcaaggtgccccggctcggcgtgctccccaagtatgccacggacgagtcggagatgcggtggttcgaggtgccggggttcaacataatgcactcgctgaacgcgtgggaggaggccgacggcgaggagctggtgctggtggcgcccaacgtcctgtccgtggagcacgcgctggagcgcatggagctcgtgcactcgtgcgtcgagaaggtgcgcatcaacctgcgcacgggcgccgtgtcgcgcaccccgctatcggcggggaacctcgatttcggcgtgatccacccgggctacctcggccggcgcaaccggtacgggtacctcggcatcggcgaccccatgccgaagatctccggcgtggccaaactggacttggaccgcgccggcacgggagactgcacggtggcgcggcgcgacttcgggcccagctgctttgcgggggagccgttcttcgtccccgacgacgtggaggggaacggcaacgaggacgacggctacttggtgtgctacgtccacaacgagcgcactggcgagaacctgttcgtggtgatggacgcgaggtcaccacagctggacatcgtcgctgaggtggagctgcccacccgtgtcccctacggcttccacggcatctttgtcacgaaggccgagctccaggcgcagcaacaatgatcaaagcaccaggcgttcgtcttctgtttacctgctgtagtgctgaggatctgtaccacaggattccaagagaaacacacacaccgctggatactgaatagattgtagtaagaacaactctaggccacatagcattcactaatacgaattatgttgtatagcattcactaatacgaattatattgtattgcaaatgtagcagaacccataaaaagggttcatgagtagaattgatatgaaatttcaagattttactggaatagtacaatgttcatatcgatgggtccaccaccgactttgtggactgtgcacggtgcacggaaacagggcaaggggttgggacaagggcaactcaaccgacgaggccccgacaagccgacacacaaggcgtcagccaagagcagcacaatgacgattgctggaacgaagcgggagcacatgtcaaacgtgcgagggcaacgcaaaagctgcgattccagagttcagcgtctaatagaaacatggtgcaaactgtggacaatatgattatacgagctgctctacaaa

SEQ ID NO: 12364 - DNA, 365 bp, Sorghum bicolor
  Clone ID: LIB3478-047-P1-K1-C12
tcgaccacgcgtccgtcttctcagtgcagcagccgtcgttcctgcacgacttcgccgtcacggagcggtacgccatcctcccggagatacaaatcgtcatgcagcccatgggcatggtggcgggcggcgcgcctgttgggtctgacgccggcaaggtgccccggctcggcgtgctccccaagtatgccacggacgagtcggagatgcggtggttcgaggtgccggggttcaacataatgcactcgctgaacgcgtgggaggaggccgacggcgaggagctggtgctggtggcgcccaacgtcctgtccgtggagcacgcgctggagcgcatggagctcgtgcactcgtgcgtcgagaagtgcgca

SEQ ID NO: 12365 - DNA, 1672 bp, Sorghum bicolor
  Clone ID: SORBI-28MAY03-CLUS6378_1
gcacgaggattgatgaagatgtatacatatttagacctctacgtttcaacaccttgcctgttgtaaaaatagctactgagcctctcaacccaagtgagcttcctaaaatggtcgaaggtcttcgtaaaattagcaagagctatcctcttgctattaccaaggttgaggagtctggagagcacactatcctggggactggtgaactatatctggattccataatgaaggacctcagagagctttattcagaggttgaggtgaaggtagcagatcctgttgttacattttgtgaaacagttgttgatacttcttctatgaaatgttttgctgaaacacctaacaagaggaacaaaattactatgcttgccgaaccattagagaagggcttagcagaagatattgagaatggtcttgttagcctggattcaaggcagaaagaaattactgacttctttcgccaacgctaccagtgggatgtgcttgcagctaggtcgatatgggcttttggacctgacaagcagggtcctaacattcttctggatgacacactttcaattgaggttgacaagaacctgctcaatgcggtcaaagattcaattgttcaagggttccagtggggtgctagagaaggtcctctgtgtgatgaaccaattaggaacgtgaaattcaagatcttaaatgcaaacatagctccagaaccattgcatcgtggtggtggtcagataattcccacagcacgtcgtgttgtctactctgcattccttatggctaatcctcgccttatggaacctgtgtattatgttgagatccaaacaccaattgactgtgtgtctgcaatttatacggtgctatcccggcggcgtggtcacgtaacagctgatgtgcccaagccaggcactccaatatacattgttaaggcatttttacctgttatagagtcttttggatttgagacagatctcagataccatacccagggacaagccttttgtttgtcagtattcgatcactgggctattgttcctggtgaccccttagataagagtattgttcttcgccccctggagccagcacctatacagcaccttgcccgtgagttcatggtaaagaccaggcgaaggaagggcatgagtgaagatgtgagcatcaataaattcttcgacgaggccatgatgaatgagctggctcaacaggctgctgatatccacttgcaaatgatgtagtccaaaagcgagatgaggtgcacacttgagaagatgcaaatgccttcagcttctttatacactagctgcagatgggacttccggagttccagtcacaccactatatgctggcatttgcccgtaccagtttttgcttggctgacacattttgattgctgggtttcatgtagcgaatgatcatggtggtaccgtatgcaatcatgtatgtactagcttctacaccatctaaccaatcagcacccttgaggatcgagactaattttttttactatttttattaaactctgagcggcaatggcatcttcgccggtgtagatttgaagtaagattttacttatttgatcccttttgtttttgctgctcggtttcttgaaatctcaacaaatgtaccactgaaaatggtctgaaagtgttcagggacaacgtggaatgcaatgatattttttttt

SEQ ID NO: 12366 - DNA, 800 bp, Sorghum bicolor
  Clone ID: SORBI-28MAY03-CLUS6465_1
gcacgggccccagcctttaggagcagcagttatgtcatatcattgccgcgccctcgtccagggtccatttctccacccgcccttctcccccggagctgctggtgctcctgctccctcgctcggagttcgtgtagggttgccctcgagagctctgcggttgccgcggccagcaagggcgtccgtggagaagcgagagcagcaggtgacgatggaggagaaagccggccaggcggcgttcggatgggcggccagggacgccaccggcgtcctctccccctacaacttctccagaagggttcctaaagacgacgatgtcacaatcaaggtgctctactgcgggatctgccataccgatctccacatcatcaagaacgactggggaaacgccatgtaccctgtcgtccccgggcacgagatcgtcggcgtggtgaccggcgtcggcggcggcgtcacgcggttcaaggccggcgacacggtcggcgtgggctacttcgtcggctcctgccgctcctgcgacagctgcggcaaggggaacgagaactactgcgccggggtggtgcagacctccaacggcgtcgactacgcgcacggcggcgtgcccaccaaggggggattctccgacgtcatcgtcgtgaacgagcactacgtggtccgcgtcccggacggcctggcgctggaccgcaccgcgccgctgctctgcgccggcgtcaccgtgtacagccccatgatgcgccacggcctcaacgagcccggcaagcatctgggcgtcgtcgggctcggcggcctcggccacgtcgccg

SEQ ID NO: 12367 - DNA, 1465 bp, Sorghum bicolor
  Clone ID: SORBI-28MAY03-CLUS6207_1
gcggaccaggacgggccttaatcaaccttttatataaatatttgaggaacggggtagccaaaggcgaaggacaaacggcacctcgtccgcgccgtgcacgtgctaaccacgagaagaaagctcaaacccttgcggtggtggtcgagctggcggcagctcagagttggaacccccacgcacgcagcatcgtcgtcgaactcttcgtctcttcccgttgcggcggcggcggagatggcggcgaatctagaggacgtgccttctctggatctgatgcacgaactgctccgccgcatgaagtgcagctccaagcccgacaagcatctcatccttatcggtccacctggctctggaaagggtactcagtctccccttattaaggatgaatattgcctgtgccatttagccactggtgatatgctgagggctgctgtggcggccaagacacctctaggtatcaaagctaaagaagctatggataagggggagcttgtttcagatggcttggttgtggggcttattgatgaagctatgaagaaaccctcatgccagaaaggattcattcttgatggcttccctagaactgtcactcaagcacagaagctcgatgagatgttggcaaagcaaggtgctaatgttgacaaggtcctgaactttgcaattgatgatgctatattggaagaacggattactggtcgttggatccacccagccagtggtagaacttaccatacaaaatttgcacctccaaagtctccgggagttgatgatgtaactggggagccattgattcaaaggagagatgacacagctgaggtcttgaagtcaaggcttgaagccttccacagacaaactgaacctgtgattgactattactccaagaaaggcttagtggtgaacctgcctgcagagaaaccaccaaaggaagtgactgctgaggtgcagaaagcactttcgtgatgaagtgtccactcttcaggctaagcatgacatctaccaaagtccctttgtcctggtttcttccaaatttatacttaggccaacatcatgggttttttattttctgtatcctttttgttcgagcactgttttatcccagccttgaactgccaggataaatctctgtttcgaatgaaggaagttgttttcagtaacaaaactgagatgattacagcaattcatctgtggaaaggaatttccggtggcaaaccatgttccagttcttacatcaatgctatgttactgactatgataatcaggaagatacctaggtattctgttcgctcagccccttgctcaattgggtggaggtattggtgtgctacgaggtcaaatgagcgtttcaagttgtatgattctgaccctgtagtgatgttaattcaaattggtgtacctattgcagttaagctgtacccatacttattactttgtgagtagatgtacaacttgagaaattccttgatagaaa

SEQ ID NO: 12368 - DNA, 1325 bp, Sorghum bicolor
  Clone ID: SORBI-28MAY03-CLUS655_1
tccggtcgaccacgcgtccgaatgaagatagacgacactgcaagagttatttcattcagtgagaagccaaaaggagacgaattaaaggcaatgcaagttgacactacagtgctaggctgatcaaaggaggaagcagaaaaggaaccttacatagcttcaatgggggtctatatttttaagaaagacatacttctaaaccttttaagatggcgttttcccactgcaaatgattttggttctgaaataattcctgctgcagcaaaagaaatcaatgtaaaggcttatcttttcaatgattactgggaagatattggaactattaagtccttctttgaggcaaaccttgctcttgctgaacagcctccaaggttcagtttctatgacgctgacaaaccaatgtacacatcacggagaaacctaccaccatctatggtcaacaatagtaagatcactgattcaatcatttcccacggatgtttcttggataactgcaggatagaacatagtgttgttggagttcgttctcggataggctccaatgtgcacctcaaggatactgtaatgcttggcgctgattattatgaaactgacgcggaaagaagagaattgcttgcagaaggaaatgttcctattgggatcggagagaatacaacgattcaaaagtgtatcatagacaagaatgcgaggatagggaagaatgtgataatctccaattctgaaggtgtagtggaagctgatagaacctccgaaggcttctacatccgaaccggcgtcactgtcgtactgaagaactcgataattgctgatggattggtcatatgaactgaaaaggtctcacaaggctggtatttgcggcagaaacaaccataggagttcttttgtagttgtacaataagatgctgtataccagtcaagaggttctgcttgtctatacaagagaacttttgtctacaaatcttgtctcaccatgcgtatttgactcaaacaacgttgcagatctttttacgagaacacgtctgtggacgagacgtgttttttcattattaagaggaaaccaagatacaagcttcaggcacaaatcactagctctggtgcagtgacgcgaggagcgtttgcactaggtttgcgactgctgaactgccctcgccggaggaccagctccctagaaaagttgctgatggattggtcatatgaactgaaaaggtctcacagcgttgcagatcatgaatatttgtcggtttcattttttctttcttggacatttacacaaaccttttcaatttttctttcttaattaacaccaaaagctttaattctaatcagta

SEQ ID NO: 12369 - DNA, 876 bp, Sorghum bicolor
  Clone ID: SORBI-28MAY03-CLUS6475_1
gatgagggcatagcgtacagctgaaacattaaccatggactaccatcgtggtgccaaccttgaggtaaggattgcccggatcttcaacacatatggtcctcgcatgtgcattgatgacggtcgtgttgtcagtaattttgttgctcaggcgctgaggaaggagcctttgacagtttatggcgatggcaaacagactaggagctttcaatacgtatcagatttggtggaagggctgatgaagctcatggaaggggatcacattggaccattcaacctcggtaatcctggagaattcaccatgctggagctggctaaggtggttcaggacaccatcgacccagaggcgcgcatcgagttccgtccaaacactgcagacgatccacacaagcgcaagcctgacatcagccgcgcaaaagagctccttggctgggagcccaaggttccccttcgtgagggtcttcctcgcatggtcactgacttccgcaaacgtatcttcggggaccaaggagaatccactgaggcagctggtggcctttcttagtcctcaacttgttggaagtgacacgtttgttcagtttgtatgatcacttgatacaaaagcgggcgggagcataagatctggacagttttggtggtatgctctttggttgctctatacgacacggacaaaaaggtcatggttgcatacgtagttcttataataggaatatataaatgttcgttaccaagtacgaaaatatcttgcactgctgtactgctgttctttcctaatttggatgtaatgctatagtatgtaacaacgtactttttgtaatgtattgttaacagattgtccggaaagctaatgacatctcaaggtcatagcgctataagctt

SEQ ID NO: 12370 - DNA, 236 bp, Sorghum bicolor
  unsure (1)..(236): unsure at all n locations
  Clone ID: LIB3476-020-P1-K1-F9
atcgtggtgccaaccttgaggtttttgtgccatccaaatgtctgatatcaatagcattcagattaacttttgtggctgtagtacaattatgttagattgcttccttttttacttaggtaaggattgccctgatcttcaacacatatggtcctcgcatgtgcattgatgacggccgtgttgtcagnaatttattttctcaagctctgaggaaggagcctttgacagtttatggcgat

SEQ ID NO: 12371 - DNA, 1713 bp, Sorghum bicolor
  Clone ID: SORBI-28MAY03-CLUS69681_1
aaaaaaatccgtttgctgtttcgtttcctcgccgtcaacgcatgcgcccgtgcgccttgcctcttcttccctaccttcttccctaccgctgcggatttggttttggcaggtgccgctccttttcggttgcgctgctctgggcccggtgcggtgctcctcttccttgacaccgccggatccgcagcttccaggggccgtgcctaacaccgtcagatccgcggcctccagggactgcgcctccgcaactgtgcggccggtgcggtgaggtctctcactgtggcagccgcgccttgctcccggcggcggcttcagccacatatcctctgctttgtccgcgtcctttgccagatccacctggtctccaaacgtctgttcagttcactctgattgttactgcaactcgctgccagctgaagctttgagtaccataaatttcggctctgctttttcttcttataaggtgcgtggttgctgaggtctgccccttcacggtttcttcagatattctttgagattttgtttcttaggttgttttatatgaattggaattgttactatctatactgacgacctcttttttacaatttgttccttcaaaataatattcttttaaaaaaggaggggtgcgtggggagtgggtggccgaacctgaccatctgttcccgagcatgcaccactttttttaaaaaaagagagaagccacggccaggaccaattttttttccgaaagcaaaacagacggctgtagccatgtttgttttccagttatcttacgagtctactttaaaattaataagcgaacgttgtcgtcttccttttatttcaagaatcgatgaggtggcccatgatggttctatattatatggtattgaaatagaactgccttcactgtttgaaaatgaggcacctcgccgcatgtttttttggtcttctttgcaggctaatttggaccaaccatacgaacatgcttgcttgcaagctattattttcctacaaaacctatatcggttgactattgtggactataattaccaaaatatggtttgtcagcagttgtttattagacaacttttttccttggctaatcggggtgtgcaactagcacgcattatcataggaagagcccataatgaaattgtatctgacacagacggcttacgaatagctgaacaactcattgagaaagttgatggccttgttaatgtcgatatttttactcattgttagttccctgatacgaaacaagaattagttttccccttcattttttcccagctgttctctgtgctgtgctgctctatgttgaaataatgaggggtgcagtgcgcctttagttaccattttttttgttccttggccatttaatttaaatgaaaaaaagacacatacgttatgactttgtatatataagcattgcattacagcaacatggatgcacctacggcatcacctgcgccgcttacatgtacgttcttttctctggttctttcatgtgtgtttatttgacgatcttttttatatgcttatgtatcttatatgcatttttttcgtttggtttgtgcctatatatgcatgtatgttataacgacgtggttgagcagcgcccacgttagcatctgcagctgacgctagggcgacggcttcttatcatgtacctccaattaactgtatggtttaacatattccctagatttacatacaaagtttactcaa

SEQ ID NO: 12372 - DNA, 936 bp, Sorghum bicolor
  Clone ID: SORBI-28MAY03-CLUS706_1
gtatggcggaagcgctacggagccttttccaccccccaaagtgctgcctccactgcggaaagcggctcgtgagggggaagtgccccgcctattttcactaccatgcccgccgcgccgcagtctagaagtctccgccggacgtccgcgctgtgcactccccacccgcaacccatggctgtcgtcgaagaagacgcggcgccgtctgcagatcccgccgccggttccagtgataacgagatcacagagccagaggcttaattcgtgcaatggcgattgcatacggatggcagcgctttcatctttcaattatttggcatggaggtgcttcaggccttggctgtgaagcaagtcatccatctaaatatagctgcatgtctgatcaaactgacgacgtgcgttgagcatattgcgcagtgcagcattgttttgtcacataaatttgaggatgtgaaagcagtgtaccatcgaatcgaacttaaatctgaacttggccagacacaatcggcgggggtaggcttccgggttgccaggatgtactccccggagcgcgcgctgttccttcgtgggcggcggctgcgcgctggccaagacggggccctgtccctcccgcaggtcccgccattcgcaggcctcgttgggccaggtcctcttgtgggacctgaggaggcaaactacctggttgttttctggcagtggctggtgtcattttttctttatctgtttaggatgttcaaacgaaagaaagagtaggatgctttaccagaaaattgtgtagaactggtggtcaagatgaccaaacttgtactataagattgaattttctgtagagctgtcgattgatcgggataaatagttgttatgaactctccacgatgttgtgtactggccaccttggagccatacttcatgcgttctttaatctgaagttcaaaggcc

SEQ ID NO: 12373 - DNA, 1211 bp, Sorghum bicolor
  Clone ID: SORBI-28MAY03-CLUS721_1
gtgattttgtaactgtatgtaaaaaggtctatgttaggactcggagagtgcgattgcttggattagagggggcaggcaaaacatccctgcttaaagcaatgttaggacaagttaaagaaagaaatagcgctgttcttgaatgcatacatgtcgatttgcatggcaagggaatatcaagtggattgtgctacatagattctacaacagtaaacttgcaggagctacctttggaggttgggcggttcaaagaagaactgtcattaggactccatgatatcagcaggaagactgaccttgttattgctgtgcataacctagcacaccgaattccacagtatcaacagtccaatacttctcagcctcagcctgctctttcacttctcttggatgaagccaaggcactaagcattccttggattcttgcaataagcaacaaattctctgttagtgcgcatgagcagaacacattgatcagctcagctatggaagcatatcaagcttctcctgagatgacaaaagttgttaactcttccccatttctgatgccaagtgctagaaacagtttgcagcggatcagatcagctgctgagaattcagggaacaaggatcctgcaaacagatctgcttatcttcctgtaaactttgcactgtcaccatttcagaggaaggacgttgttatgcatgtggagggtgttagtgcccttcgtcaacttgtacatcaagtagtcctcaacaatgaagaacaagcatttgaggagcttgctcgtgatagattgttacaggaactagcgagagagaaagcagcgtccctgcaaatgaagcagaagcccccgaaaagagatggctctgttacagctgctgctgtaggtgcttctctgggtgcgggcctgggaattgtaatggctgtgataatgggggcagcatcagcccttcgaaagccgtgattcatgtcttcttttgattcatcatttatttcttatttaaggatgtccgatcagtagccactagtgtaggcaagaaaactgaaattttagggcagaatagttagctgatagtgccacattttggctgtgtacagaatgtaggttagcccttctttatttttgctgatctgaagtttgttgtgtacttgtgttactggagtatggtttggatatgtttacttcacattttaatttaattatatatcgttatcatatctatgagtaaaa

SEQ ID NO: 12374 - DNA, 1439 bp, Sorghum bicolor
  Clone ID: SORBI-28MAY03-CLUS72836_1
ctactggggaaataacacttgttgtcgtcagtcatcctgatctcagctatctgaatcactcgtcggctcgtggagttcagcgttcagtagcatgggctgctgtggcgccatgtccgccaggccgcggggcatccacgaggagacgctgctgcgcgtcccgggcgcgtccgtgcacctcatggcgggctccgacggccccgtcgagctcgcgcgcggggacctcgccgtcgtcaggctcaccaaggacgacgtggccgtggccaccgcggtgcgcgtcggcaaggacctgggctggccgctcgcgcgggacgagcccgtcgtcaagctcgaccgcctgcactacctcttcacgctgcccgacaaggacgggacgttcctcaactacggcgtctccttcaacgccgacgccgccgacgactccgcgctggcgtcgctcgacggcttgctccgctccagcgcatgcttctccgcaccttcgtacccggtggttccgtccaagagctccaggcggccgccgccgccgccgcagcagcagcagcagccggttgcgtcggacgggtactggaacgagttcgcgccgaggatggaaggctacaacggcgtgcttgccaaggccatcgccgcgggcaccggccagctcgtcaagggcatcttcatgtgcagcgaggcctacgccagccaggttcagagaggagccgatctgtttcgtcctcaggctggcggcagcgcgcggagccgattcggcgacgctggtggcgccgacaggagcagccaggcgagcaccaagcgtggagcagtcaacaagagtctcaagagggtcaggaagctgtcggagatgaccgagaagatgagccagtcgctgctcgatacggtcatctcggtgaccggcgccatcgcggccccgctgctccgctccaagcaagggagagcattcctcgccagcgtacccggcgaggtcgtcctggcatctcttgatgccatcaacaaagtaatggatgcggtagaggctgctgagaagaagtcgcttgctgcaacttcaaatgtcgtcgccggcgcagtttcaaggaggtacggcgagagcgcaggggaggcaaccgaagacgcgttcgcgacggccggccacgccgtgggaacggcgtggaacctcttcaagatccgcaaggccgtcacaccgtcgtcctccatgcccgggaacatggtcaagagcgccattaggaacaggaactgacgtcgacactagacagttgttcattgtgctgctctggatgtacatgtacccacaatgactagaaagttgttcgacgtgctcctggatgatcatgaaccgacaatgactgacagttgttcattgtgcttctctggatgatgatcatgtacccacaatgacatgtaactatcatgttcacaccatcgacatgggctgtgacaaatacttttcc

SEQ ID NO: 12375 - DNA, 2212 bp, Sorghum bicolor
  Clone ID: SORBI-28MAY03-CLUS73190_1
acccctccctcttcaaactccccaccccagtcggtcaccttgctcagtccgtaacccatctccaggaccaggaaggctcgcgagggaaggcagctctcagcgcaggagccggccggccggcaggtagccatgtattcggccaaccactggggcggctcgttcgagatcgccgatggggcggcggaggacgaccacagccgcaacatggacctggaccgcggcgcgctgtcggcgcggcagcaccacgagctggacgagacgcagcagagctggctgctaggcccgccggaggccaagaagaaggacaagtacgtggacctcggatgcatcgtcgtcaagcgcaaggtcctgtggtgggccttgtggtgcgtcgtcgccgctttcgtcctcatcggcctccccatcatcatcgccaagtccatcccacacaagaagcctggcccgccgccgcccgatcagtacacagaggcgctgcacaaggcgctcctcttcttcaacgcccagaaatccggccaccttcccaagaacaatggcgtcaagtggcgcgggaactctgggctgtcagacggctcctatgccaaggacgtcaagggcggcctcgtcggcggctactatgacgctggcgacaacatcaagtttcacttcccgatggccttctccatgacgctgctgagctggtcggtgatcgagtacagcgcccagtacaaggccatgggggagtatgaccatgtcagggagctcatcaagtggggcaccgactatctgctactcaccttcaactcctctgcttccaccatcgacaagttatacgctcaggtgggtagtgcaaagatcaacggcagccggccggacgaccattactgctggaaccggcctgaggacatggcgtaccctcggccttccgtgtcggtgggctccgccccggatctgggtggcgaggtggccgcagccctggcggccgcctccatcgtgttccgcgacaccgccgcctactccaagaagctgagccagggcgcggcgacggtgtacaagttcgcgcggcagtcggggcggcgcaccccctactcgctccggcagccggatatcgagtactactacaactccaccagctactgggacgagtacatgtggagcgcggcgtggatgtactacgcgacgggcaacagcagctacatcagcttcgccaccgacccgcggctgcccaagaacgccaaggccttcttcaacatcctcgacttctcggtgttcagctgggacaacaagctcccgggcgcgcagctgctgctgtcgcggctgcgcatgttcctcaacccgggctacccgtacgaggagtcgctcatcggctaccacaacgccaccagcctcaacatgtgcatgtacttcccgcgcttcggctccttcaacttcaccaagggagggatggcgctcttcaaccacggcaaggggcagccgctgcagtacgtcgtcgccaactccttcatcgccgcgctctacgccgactacatggaggcagtcaacgtccccggatggtactgcgggccaaacttcatgacaaccaacgacctccgggagttcgcaaagtctcagatcaactacattcttggtgacaaccccaagaagatgagctacgtggttggtttcggcaaaaagtacccgcggcacctgcaccaccgtggcgcgtccacgcctcacaacggcgtcaagtattcgtgcaccggcggctacaagtggcgagactccaagaaggcagaccccaacctgctgacgggcgccatggtcggcgggccagacaggaacgacggcttcaaggactcgcgcaacaccttcgggcagaacgagccgacgcttgtaggcaacgccggcctcgtggcggccctggtggctctcaccaacagcggcaggggagtcggcattaccgccgtcgacaagaacaccatgttctccgccgtgccgccaatgttccctgccgcgccgccgccgccgtcgtcatggaagccgtgagtgctaccggatcagctagtacggtggttccttcgtttggtcatacgatttttggtgagcgagatcgccgatcatgtacgcgcgcgaattcttttgtacaataccacgttaacaaatacgtactgcgcacggtggcatgcatcatgcgtgacctgtagatgtttttatggattacattacagttaatgaatggatggatacatatcttcgc

SEQ ID NO: 12376 - DNA, 792 bp, Sorghum bicolor
  Clone ID: SORBI-28MAY03-CLUS66547_1
atcctacttgctccgtatccatctcctgatcccgcgagttcccgtcctacttgctgcagccgtctccactctaaccctaactgtttctgagagaaaagaaaaagaactctccatccctagtggcctagtgtgagccagccaagccagccgagcacagctccggcgactgatgtttcaggaccccgttccgttctgctgcaggttccctgatatcggcggccactgccagcagccgacttggttcttggtcccttcacttccggcggaatccgttgcggaccacctcgcccagctgctcgcgacggcggctgataccctgagttgagtgagcggcggtggcgtccgagaatcgatctgaaccaacacagtttatcagggagggaggagtgagttgggggagaatgcctgatatccagctaggatgccacactatacagtcccatggcaccaaagtggcaagattacacatgtatgactggattatacttttatgtcttgctgtacttgatggactgttaaacttaatcgagccctttcaccgctttgttggacgcgacatgatgaccgacttgagttatcccctcaagggcaacacaatcccattttgggctgttcctctgattgccatagtgctaccttgggtcatctttggtgtcatttacttcaaaaagaaaaatgtctatgatttacaccatggcatactagggatcttatactcagtgcttataactgctgtgatcactgatgcaattaacgatggtgttggccgccctcgcccagatttcttttggc

SEQ ID NO: 12377 - DNA, 707 bp, Sorghum bicolor
  unsure (1)..(707): unsure at all n locations
  Clone ID: SORBI-28MAY03-CLUS6642_1
nnggccggggccgggtttgccgggcttccacgcaaagaaagaagccaaggcaagttcttgttcttgagcgcgcgaggagcaggcggagagcatcgacgatggcgagcggcagcatgaagagggagatcagcgagacccacgacactctccgcttcggcctcaacgccggtgtcaaggctgacctcgcgccgccgcacccgctccagtccaccatccaatcggaggccaagttctgggcggacaagaagaagttcgggacagaggccatctacggatccgccttgaacatccgcaaggatctcgatgcccaaatcctctccaggttccaaagacctcctggtgctttgccatcatctttgcttggatatgaggcactgacaggttccctggatgattttggatttgaagattatcttaacatgcctcaagattctgacagtttccgtcaaccggatatgcaccacggaatggaggttcgccttggtttgtccaaggggcctatctgccctagcttcaattgaggcagtgaatgtagttctgccgcacgttgtgcacctcagttcagtactttggtcaatagaccatattatgatcgtgaaacgtgaaaactgatggcttgcatctgttcagtgttgtgtttcaattaacaccaaatttaatatttttctagtttgaacttcgatttcgaattaatagtttttttcgcg

SEQ ID NO: 12378 - DNA, 558 bp, Sorghum bicolor
  Clone ID: LIB5047-010-R1-XP1-A6
gccgggccgggaagaaggctagtagttctagcgacagagagagaagcgcaggcggagtcgcggaaagcatcgatccatcgacgacgatgcagagcagcagcatgaagagggacatcagcgagacccacgacaccctccgcttcggcatcaacgcaggcgtcaaggccgacctcgcgacgccgcacccgctccagtccaccatccaatcggagaccaagttctgggcggacaagaagaagttcgggacagatgccatatacggatccgccctcaacatccgcaaggatctcgatgcccaaatcctctccaggttccaaaggccccctggtgctttgccatcatctctgcttggatatgaggcgctgacaggttccctggatgattttggatttgaagattatcttaacatgcctcaagattctgacagtttccgtcaacctgacatgcaccacggaatggaggttcgccttggtttgtccaagggacctatctgccctagcttcaattggggcagtgaatgtagttctgctgcacgttcacctcagtccagctactttc

SEQ ID NO: 12379 - DNA, 1161 bp, Sorghum bicolor
  unsure (1)..(1161): unsure at all n locations
  Clone ID: SORBI-28MAY03-CLUS6690_1
gcacgaggggngaaaagatcatacaatactcatgtaatcgatatagaggataactgtgcagggaagattgaaatccctgagagtgggggtcttttaaaacaggaactattttccttaacaataccacaggttggaggcggagaagatatatttgccacaatcagatggtcacagaagttgctatatcacaacggacagttttctgtcgaagtaccttttcgtttcccacagtatgtgaaccctttgccgaaggttttcatgaaaaaggagaaaatacagttgactgtcaatagtggtgcaagtaaagaggttatattgcagggaacaagccatcccttgaaggaaaaaaatcggcaaggtgagaaattgtctttcctgcacgaagcagttgttgagaattggtcaaccaaagattttacctttgcatataccgtttattctggtgatttgtctggtggagttcttgtgcagccctcaacattgcgtgactatgacgacagagatatgttctgcctttttcttttacctggaaataacgcgaacagaaaggtcttcagaaaggctgttgtttatatcattgatacaagtggaagcatgcaaggaaagcctcttgagagtgttaagaatgccatgtccactactctctctgatcttatgcaaggagattacttcaacataataacatttaatgatgagcttcactcattctcatcacgtttggagcaagtaaatgaaagaacaattggaaatgctattgaatggatgaacctaaactttgtcgctcagggtggcactgacatgatgcatcctttgagtgaggcaatggctttgctgtcaagttctcatgatgtccttccacaaatctattttgttactgatgggtcagttgatgatgaaaggaatatctgccatactttgaaaactcagcttattaaaagtggatcgaagtctcctcgaatttctacttttgggctaggttcatattgcaaccactatttcttgaggatgttggcatcaattggtaagggtcactatgctgctgcacttgatacaggatcaattgagggtcgaatgcttcaatggttccagaaagcctcgagcactatagtgtcaaatgtttccattgatggcataaaacatattcaaggttttgaagtggat

SEQ ID NO: 12380 - DNA, 1223 bp, Sorghum bicolor
  Clone ID: SORBI-28MAY03-CLUS6724_1
ctgggacttcgactcatccgttcgcacggttccccttcccgttccacaaccctcgagaagcttccgccctcccctcccgcgccgccgccgccaccgccgccgcagccagggccgcggaaaccctagccacctccggccctccgcgcaccgggcgccccgccgccgtcgtacctgccgccggcaccgccgaagcgatcggatctcgagaccgtcaggagccacgatggaggactgggattctgaagatttccagccagttgcccctgttgtgaaagctgagccacttaaaaatcagtgggctgatgaagatgttgaagaagatgatgtaaaagaatcgtgggaagaagaggaggaggagaaaccaaagccagcgcctgtggaaaaggctgcggcgaaacctagcactaaggctcctgctaaaaagggaaaacagcaagcatcaacaagtgctgcagaaccagatgagccccctcttagtcccacttcagagaaaattcgccaacaaaggcttgtggaagaagctgacttcaagtcaaccacagaactttttgcaaagaagggtggtgagcaaaagtcactagatacttttatcccgaagtccgagagtgactttgcagaatatgcggagcttattgcaaataaactgcgcccctatgagaaaagctttcactatatggctctccttaagaatgtcatgagactttccatgacatcgttgaaaggtgcggacgcaaaagaaatatcttcatccgtgacagcaattgctaacgagaagatcaaggctgagaaagaggctgcagcaggcaaaaagaaacaaggagcgaaaaagaagcaactccacatcgagaaaggagatgatgacttcatccccggacggggtggtggctatgatgatccggacgagtacgacttcatgtgattttgctggaagggaatagttggttcctgtcatgtatacctttggcaagcagagaatatatcactagattttgcggcatagctggcatactattgcgtggaatatgcgctatctgtttgaggatgatttttgactctgctggataagaagagcacctgtggtctggaatggatccacaggtgttttcttgtccttgaatcttcgtggtaatttattttttaacattgcatatttatttttcttttggccaactgtactatacgtaccttgtactatctggttattactgcgtgagttatgcaag

SEQ ID NO: 12381 - DNA, 1515 bp, Sorghum bicolor
  Clone ID: SORBI-28MAY03-CLUS6730_1
gcacgaggctacaacaaagtagtcagagaaaatgacatcttcaggccttcgagtgtgtcctttgctgaagttgtttcaactggcaactaggctatgtgcttctgcaccacctttcattccatctctaccatctgtacttagccccctttctggcaatgttggtctcccgccaccaggtgccattccaggagtagcgccttggcctgtgaatgtctccctgcatcctgggcattcaactatggtgccaagtggtcctcctttgtgcacttcccctcatcatttgtaccctcctgctccccgatctcctaatctcatgcatcctgtgccgtttctttatccaccatatagtcaaccacaggtggttccaagcaccacatttcccatgaacactaatatttttcggcctaaccattatggatggcaaccttatatgggcccagcgccatcagaatttgtgccaatgtcatcatggtcaagtagccatacagttgacttcattcccacgccacatgttgttgaccctatttctcaatctttagcagataaacatattcaatctgatgcagctgttgttagtataggcccttcactggacagtaatgctgtagtggccaaggaagagatggagactcctgcagtggtagcaagtggcaatttgataagcaacaaacatgatgatcaagataaacaattaaaggatgccattagaattgaactgagtcctgacatgcaagaagacaacaggcatgatgaaggtagtttcaggatatatgtgaaggggaaaagccgtcggaaacaaactctgagaatcccaataagtttgcttaacaagacatatgggtcacgctcatttaagcttgtctacaacaaagtagtcagagaaaatgacatcttcaggccttcgagtgtgtcctttgctgaagttgtttcaactggcaactaggctatgcaaattctaaagcatctaatattgacattagtacccaagagcaaattgtcatggatctccaattgaaatgtactgaaatgaagtttttatttggaaggcagcattattctcataccatattccagatatgaaacaatcactcgaaactattcaacaaggataaatgcttttttttttcacttcaaatacggtgtcgacaatcctgtgtagagtccagaagacttggaaagagttttgtgagagatccagaaataataggagatggaagtattacgaataatactagactgtctagacaggctgatttttcttcaattttgatagattaagagaaaggaatcttcttcaattttcggagctcacttttgggtttttgaaacctagcatttagattttttttcccccgttgcgctgccgcatctaataattgacttacctttttgttctcgagaaactaacattattcttttttatataacaataatactgtgtattcagtaaagctgcttgtttgtggatgccattttccccccacaaagcaagaatcaatttgatacgattattcc

SEQ ID NO: 12382 - DNA, 722 bp, Sorghum bicolor
  Clone ID: SORBI-28MAY03-CLUS67535_1
tagtcatatgcttgtctcaaagattaagccatgcatgtgcgtggcgggcctggtccggcccgcctgcctccggatcgctccgccgccccgcccgcgcggcggggacggggcgcgctcctcccctcccacgagcctgagccccaggcagagcagcggcagcggcagcagcagcggggacgaggagggcgctgggcccagcgacggcgcagggtccgagagcgacggcgacggcgagagcagcgaggacagggcgtgcgccgaggcggccatcctgctgaccaagctagccctggcgcggcagaccgcggacaacgtcagcgtcgtcgtcgtcaacctcaggcggcgcaggaggtcgtgatcggcggatccaacggactagccgttcttggctgattgatttgctggccgtccgtgaattcaaatcggagccacagttcacatttgcttcggccgtgcaatcattgaacaaatgtcaaagcaaagatcgaacagaacagtgagatccttagcagaattgcatactgcttccttttatatacagtagtgcagcaggattatttcgttagcatttcttttaggctgatctggtcggaaagatcagcccgtctttcttcttccccgagcaaaattctccaaatagaaaagcttgctcgtgcctttccgatgtttgaagaaactttatcaagcgtccgagaagttaattaattgtaatatactagtcc

SEQ ID NO: 12383 - DNA, 675 bp, Sorghum bicolor
  Clone ID: SORBI-28MAY03-CLUS765_2
gccggccgtcgaggcgaggggcagccgggatccaaacaagtcatctcaagctacctcccttgacaagttcaccgagaaacatttgacgagtcatggccgaggagaagcaccaccatcacctgttccaccaccgcaaggaggaggagagctccggcgaggtcgactacgaaaagaaggagaagcaccacaagcacttggagcagctcggcgagctcggcaccattgccgccggcgcatatgctctgcatgagaagcacaaggccaagaaggacccggagaacgagcacggccaccggatcaaggaggaggtggccgccgtcgccgccgtgggctccgctgggttcgccttccacgagcaccacgagaagaaggacgccaagaagcatggccacaactgatcgactgcgtgagttgaaccagcacatcatcgcggctgcttgatttgttctcaactcgtatgtgcaacaggtctttgatttgggctaccgatatttgtacgtcgtaggaactctggatcctcggcgatcttgtatcagttacaaatcaagccttgaataagggtgcatatatctttttttcttaatttccctttctctttgtatcgagagttgttttgatctatactcgaataatgtgaatttacatgtgtttataaactgatttcatttgccccta

SEQ ID NO: 12384 - DNA, 764 bp, Sorghum bicolor
  Clone ID: SORBI-28MAY03-CLUS765_1
gccggccggtccgggatccaacaagtcatctcaagctacctcccttgacaagttcaccgagaaacatttgacgagtcatggccgaggagaagcaccaccatcacctgttccaccaccgcaaggaggaggagagctccggcgaggtcgactacgaaaagaaggagaagcaccacaagcacttggagcagctcggcgagctcggcaccattgccgccggcgcatatgctctggtgagatcaaaatccaacttctttaatttgatcgcctgatcgatgcatatatgattcagctcttgatctggcatgcatcgatgtgtttcctgtgcatgtgactgcagcatgagaagcacaaggccaagaaggacccggagaacgagcacggccaccggatcaaggaggaggtggccgccgtcgccgccgtgggctccgctgggttcgccttccacgagcaccacgagaagaaggacgccaagaagcatggccacaactgatcgactgcgtgagttgaaccagcacatcatcgcggctgcttgatttgttctcaactcgtatgtgcaacaggtctttgatttgggctaccgatatttgtacgtcgtaggaactctggatcctcggcgatcttgtatcagttacaaatcaagccttgaataagggtgcatatatctttttttcttaatttccctttctctttgtatcgagagttgttttgatctatactcgaataatgtgaatttacatgtgtttataaactgatttcattttaga

SEQ ID NO: 12385 - DNA, 448 bp, Sorghum bicolor
  Clone ID: LIB3480-058-Q6-K1-B4
gtcgtggccatcgaccgggaccggcacagccaactggccgtgaagtgggtcatggaccacctcctctccggcgcctcccagatcgtcctcctccacgtggccgcccattacgccaccaaccatgggttcgccatggccgagacgacgcagggcgcgctggaggctgaaatgaaggagatctttgtcccctaccgaggattcttcaaccggaataatgggctggtggaagtctccgaggtagtgttggaagaggcagacgtgtccaaggccattctaggttacatctctgcatgagaagcacaaggccaagaaggacccggagaacgagcacggccaccggatcaaggaggaggtggccgccgtcgccgccgtgggctccgctgggttcgccttccacgagcaccacgagaaagaaggacgccaagaagcatggccacaactgatcgac

SEQ ID NO: 12386 - DNA, 1013 bp, Sorghum bicolor
  Clone ID: SORBI-28MAY03-CLUS8025_1
cgccgccgcagtcctctgttccctccacccagcgccgccgccctccgccttgtcctccatgaccggcgccgcgacaacgccttcacgtcaagcctggacgccaccgaggccccggcgtcctccgcgaccgcggcgtcgtgcggactcgcgaccgcggacggccacgcggatgccacggccgcaccgggacgcaggcgcttgagttgtccgcgacgagcacccactgcgccaccgagagcccgagacgacggcgcccttgcctcgacggctgacatgacgcccagaagccaccttcgccgagccgtggccagccgcgacgctgccctcgccgcgtcgagcttcgaccacggctggccgcgcgggcgccacagcactgccgagccgcctcggtgccccgcgacgccgagcaccgccgcgccgagcttcgactgcgaccttgcccaggacgcgctcaggagccccgaccaccgagcgcgacgtcgggccccgacgcgtccccgtcctcgccacggtcaccgcgtcaagctcttgtccctgtcttcgccaagccaaaccccggtgagctcgccaagaccaaagttttccccttcctgcgttcaccatgctgagatcggccttcgtgccgtgttctacaccttgcagggaggatgtgcccttggggcaccattgccgcatggctggaccacactgctgccctcggctaacccctggactcgctgcagcaagccgcaaccgcttccaaccagccgcagcaagccacagctggtcagcggcagatcatagccggatcagagtggcagcagcaggtctccgccaccttcctcatgttcgtcaaggtcgaaaaccccccctaaaccctagtcgacgttggaactccatattaattcatatctattcatacatcattttgttatctatcgtatgtccttatcatgaattatctatacttgtagcacgacccatcttcgcctatatcattgcctgtgccgtgccttcatgccggtctaattatt

SEQ ID NO: 12387 - DNA, 1737 bp, Sorghum bicolor
  unsure (1)..(1737): unsure at all n locations
  Clone ID: SORBI-28MAY03-CLUS8161_1
gcaagtcatcgggtccacacttttcatcaccgcctacctctcgtggcttccgtggaatgaactgccggtctttccactctggtggctgcgtcggtgttctcccatccccaccacctccgcctgcccgcacctactcatccccggagcccaagacacccaagcagcagccacgccatggtggcaagcgaagccggcccatttccataagcccctccacatctcctcccacccattctgagctgtgggcgggcccagcattctccaactcaccaccacccagttcgctgcccatccccaaattctccctccgccagaagcgcagcatctctctcgagctgccaccagttgagcgctctgatgatgtggaggtcaggcagcatgctaaatcagcaccttcatccccagttgagggatcagggtatgacttcttcaatgatgatgcaattgctagtgctattgcaacggagaatctgaggaggattctccagttggatatcactgatcattgagtaatgggaggatggaagggtggttcctgtgtacataggttatctttcactgacagctttctacttgcattggtagggtatagggtaacgatgatagatacttggtggttgtaagatatggtcaggctcatggtggaggtgtagcttgtaggtgaagctacttcgaaagcttagatagttttagttgatactgccctgttaggtgttgtgaaggtgggctctgggttgaggatggccggtggtgtgcagggcagttatagtattcacctatatgcttccttcatctcttaggtgtagggtttaaacctcttaaaacagcatcatttgcatccatagttacctgttctgaactgacggtggtactttgccatagcagcagcctcattttctgcttcagttggttcatatatggtagaataacattcgtcctaacctngaaccagatgtcaaatatttgtagggtacctgcatcttgcatattcttgcatacttatttccttctgtcctctagccaactggctctagatgtccttgcttcctggtgctctgcaaagaacgcctggtgctcctcgccagctcttctggtttttggtaaggaagaagctgagtgaaaggtggaagaaattctgttgtcttcctcttgttccaacactaacttccctatccagcccttttgttgcatatctggcatataccatgtatccgttacatctccatgcatttatgttcatctagtgcccctgcattgcatctagtgcccatagtcagttagcatgctcattcactcccacttcgatttcacaaaccagtttgagggttctgattttcttcaagagtcgaaagatactgagagtgccagattctggagccctgcatgcatacaaaccctgatgaggtttggttgtgttgctcaatgttctacctgttctgtagttacagaatgcccaagctcctgctggtgttacatgcttttgtagcccagtagttttagcactagcagtgaagcagcaatatctgaacttctggaactagactatttagttctctgaaatgctatgtttggttagttgtcttttgttctggtgttatcagcagatgatactatgttgtcagtttaatgtcataatggctctatgctgttaactagttcatgacgttagaactagaaactataatgttgctttagagccaatagtttgtttaaacccctctgggcttataatgtttc

SEQ ID NO: 12388 - DNA, 1223 bp, Sorghum bicolor
  Clone ID: SORBI-28MAY03-CLUS8182_1
tgctgtggttaagtgtttagaattggctctaaagaaacaaaagcctttactgattgttgcagaagatgtggaaagcgaagcattgggcactctgattattaacaagcttcgtgcaggcatcaaggtctgcgctgtcaaagctcctggttttggagaaaacaggaaggcaaacttacaggacctcgctatccttactggaggagaggtaataactgaagagctaggaatgaaccttgagaatgttgaacctcacatgctgggtacatgcaaaaacttccgcgtctctaaggatgacactgttattcttgatggatctggagacaagaaatctattgaagagagggcagagcagatgagatcggcaattgagaatagcacttcagattatgacaaggaaaagctccaggagcggttggcaaagctctctggaggtgttgctgtactgaagattggaggagccagcgaagcagaagttggtgagaagaaggatagagtcacagatgcactgaatgctacaaaagctgccgttgaagagggtattgtaccaggtggtggtgttgctcttctctatgcatccaaggagcttgataaattgcagacagcaaactttgatcagaagattggtgtgcaaatcattcagaatgctttgaagacacctgtacacaccattgcctccaatgctggggtggagggagcagtagttgtgggcaagcttttggagcaagaaaatactgacctgggttatgatgctgctaaaggtgaatacgttgacatggtgaaggctggtatcattgacccgctaaaggtgatcagaactgctttggtggatgctgctagcgtgtcgtccctgatgaccaccacggaatccataattgtagagatccccaaggaagaggcgccggctccagcaatgggtggtggcatgggtggaatggattactaagacatcacacccatgatacacatcaaagcagggactttttttttccgtttttggcggtgcaagttcatctttactgtattttggtcgatgatgagttggttgtcaggcggatacaattttgagtctgcggacgtaggacctctcaatagctccaaacggagctatagtgtgggaataataaatatatgaacagtaggttctttgagatctgaagctgtagatcaagattggattcagacaccttgtgccgaacaaacagtagtctgattattacattttt

SEQ ID NO: 12389 - DNA, 874 bp, Sorghum bicolor
  Clone ID: SORBI-28MAY03-CLUS68623_1
gcacgaggtacccggctcaagcattcgctatgcgaaaggcgcggacgtacatcaaccctgacctcatcccacacgccgacgccggtaagggtaacgacgccgaccacctcctctacgacggcggcggtggccacgtgcactccggcgagtagtccacggctgatccctaggtgttgcggtacggcgcgttcgactaccgatccgtcctcgacttcctgaaggcagcccgtgagcgcggtatcgccttcgtcatggccccctgggagcttgacacgcccaagtccgagtgcgaccgcggtgtcgcccccggtctcgctgtttgcaagttcgacatgctccgcgactcttcccccgccgttgtggctccccgcctccgtgactcccgtgaggacgagttcgaggccggttccccggacgattgtcacacccgcgtcctcgccccccgggcttgcgccttcgatgtcaagcagttgatcgaggtctgcacccggatggacaacctccactcggccgagcacggtgacaaccacctccagcgtcaggttgcgcgctacctgaaggtcggcggcgccttccccgggaacctcccgttcgtgccgatctctggcttccacggtgacaacatggtggacaagaccgacaagatgccgtggtacaagggccccacgctcctcgaggctctcgatgacatcaagcccccgaagcgccccatggacaagcccctccgtgtccccctccaggacgtctacaagatcggcggtatcggcaccgtgcccgtcggccgtgtcgagactggcgtgctcaagcccggcatggtggtgaccttcgcccccgtgaacgtgaccactgaggtcaagtccgtcgagatgcacca

SEQ ID NO: 12390 - DNA, 1159 bp, Sorghum bicolor
  unsure (1)..(1159): unsure at all n locations
  Clone ID: SORBI-28MAY03-CLUS6877_1
tgtggcggccgcttcgaggnnccggccgggccgggaaaaaaagggtaaaaaaattcgatctccatctcccttcaccctctctctgttcgaggagaactgcctgctcctgctccctccgcttctccgtgctccaactcgccatccccatacttcttttcaggcggggatggacgattatgcccgggagatgatggagctcaagacgcttgtcacccgcaccctcgagaagaagggtgtcctcgccaagattagggctgagctaagagcaagtgtgtttgaagccattgaagaggaggatcgggtggtggagaacgatgatggcgtgaatcctgctttgcttggtagctgtaatgaccgagctaagcaactgcatgcttcaccttcaggaaggttactaactgcacttgtatgcgaatacttagagtgggcgcaactaagtcacacaatgaaagtttacttgccagagtgtaacctacccaaggacttttggaagaatgaattgaaagatttttctaacaaaagtggagctgaagggagcaggagcgctgaaagtggtccaatgcttttagatgttctcgaaggttatctgaaatatgagaatttgtctcaaacaaggatgggtggcaggaggatgatgagttcagaatctgatacatcactaaatgctgaccatcggagcatgaggaggccaccatcagcgtcagttgggagccttcctcctatggggaggccaatctcttcgtcacaggcatcagatcgcagagggggaccttcagcttccaacacaaggaaagatgagtacaactggagatacgatgccgatgatatatctgaagaggtgctgcgggcatcggctgctctagaaaatgtccagttagaccggaaatctcggaatctgccgacatcgtggaggcattcaggggacggcaccgagtaacaagcaacaaggctttggagctggttgcttgactgaccctgtatcgtgtaatttgtataccactcatttgcggtggtacaatgcttggattgctgttatattattagggagatgccacactggtatgtatggttgtcttgtaacgaacaaaacaaatcaaatattacattttgttgaactatgggtggacttgatccgataggattggcacgccgtttcagt

SEQ ID NO: 12391 - DNA, 1483 bp, Sorghum bicolor
  Clone ID: SORBI-28MAY03-CLUS6930_1
caagatgctgcactgttagtttaccaaattgatgtaagcgcgagcatcgatcctctcatctcatctgcccacccgcaagccattccgccgccgctcgtgactgggaagatgatgccattgagccaacccgacttctcgccgtcgcagttcaccgcctcccagaatgccgccgccgactccaccacgccttccaagatgcgcggggcgtccagcaccatgccgctcaccgtcaagcaggtcgtcgacgctcagcagtctggcaccggcgagaagggcgctccgttcgtcgtggatggcgtcgagatggctaacattcgacttgtggggatggtcaacggcaaggtggagcggacgaccgatgtcacattcacgctcgatgacggcaccggccgcctcgatttcatcagatgggtgaatgatgcttcagattcttctgaaactgctgctgttcaaaatggtatgtacgtcgcggtcattggaagcctcaagggacttcaagagaggaagcgtgctactgctttctcaatcaggcctataactgatttcaatgaggttacgctgcatttcattcagtgtgttcggatgcatatagagaacacgaaattaaaggctggcagtcctgcacgaaccagttcttctatgggagtgtcagtctcaaatggattcagtgaatcaagcacaccaacatctttgaaatcaaatccagcaccattgaccggtggaggaagtggatctgatactgatttgaacaagcaggtgctgcatttttttagtgaaccagcgaaccttgagagtgagcacggggtgcatgttgatgaagtatacaagcagttcaaacaactgccaaaggataagatcaaggaggctattgctttccatgtggacgccgggcatctttactcaacaattgatgacttccacttcaagtcagctttaaccgattgaagttgtagccgaaataaagtgcagtcagcctgctcgaatggcagaggactaagtatcacttgacagaactgattctgcctccctgtactaaccaaagtctgaaaagggagggaattttgctggtgttgaacctatctatgatggtcctcaatgtatgggttatggaaatatcatgttgcgtcaactagttgatttgcatcatctgatgaagttatgtcaaggaagacttttgatggtgttagacctatcttaggtcctatatgcatgggctatggaaatattatatcttgtgtcaactagttgattttcatcatctgatgaagttgtgccaatgaagatgagtaggaactcttcgtctcagtagtgacaaatcgatatggtgtggtatgttgtcatcattgtgtagtccttttgccagtatgatgtgctattttgttgatgagattatgcgctgatgcagtgctgggttgggataaagttagaagttattatgctgcttttaagcaatagtgctgccagatggaatcgcatcttatcc

SEQ ID NO: 12392 - DNA, 899 bp, Sorghum bicolor
  Clone ID: SORBI-28MAY03-CLUS6951_1
atggcacctttggttgatgaaagctggaggtcaaagtttgagagagttagagatgatggcttctcccgtttaaggggtctgtgggtcctccatgaaattataatgccgattgtcaccaagctccttacagctctctgtgtcccatacgtccttgcaaggggcatcttcccggtgctgggttaccctctcatagtgaactcagcagtgtaccgctttgcctggcttggatgcctgatcttcagcgcactcttcttttgtggcaagagattccatgtctggttcaccaacctccacaactccatcagggatgaccgctatctgattggccggaggctgcacaactttggcgaggactcacactcacccgaaccaagtgaatctggagcaactatagggtcagatgaccaggaccgagcccttgtcctgcgagatcaggaagaggacgtggggttgaggatgaggcgcaataatatgcgtgcaaaccaacaacccaggctggctttataagcaggaagtagttttggataaagagctcataatcatggtataagctggtctgcagcttctgcttgtgctttgtaatgggtgttgtagagtgagtttgtgttagtgatagagaagagtctaaagactgttctacgacgaagcctgggagaaagataaagtggttggtgactataagactggtggcgaactccctttcctgtggtagtcttggctgactgtaaatatcgtttgatagagcattaccaggccaactcagtttgttgtgatcctcttgtaatgactaatgaattaagttgaactgttgggtagatacgagatactaggttatatcactttcaccttttttttggtgccatttttgttttttggcaactgcaatattgaatttataa

SEQ ID NO: 12393 - DNA, 631 bp, Sorghum bicolor
  Clone ID: SORBI-28MAY03-CLUS69555_1
tactgggaagacaaagccaaggcgcagccaccagccagagtaagcagagagctgcacttgaacccaaaaaaaaaaaaaaaaagctcctactgtgcagtgagcatggattcgcttgtgaagtgtggcaatggctacggtggctacggctacggctacggctatggttacggcaacagcaagccccagatgaactacaaccggcagaacaccgagtccgtgaccaccgtcgtcacggagatcaaccgcatgaccgtcaacgacaagcccagctgctacggcggcggcggcgacgtgcagaagcaggcctgcaaggtggaggcgttcgaggagcacgacgaagcgtacaacggcgccgtggccgtgcagaagcactccttcaaggaggagaaggaggagaggtacggcgctgccgccgtgaagaagcacgacgagtacaaggaggagaagtacggcgaagtaatcgacgcggagtacggcgcccactacggcggtggcgccgccgccttgaagaagcagcagggctacggctacaagcaggaggcgtacggggagaccgagggtgcagcaggggtacggcggcgcccactacggcgccggcgggatgaagcaaggctacaactacaagcaggag

SEQ ID NO: 12394 - DNA, 464 bp, Sorghum bicolor
  unsure (1)..(464): unsure at all n locations
  Clone ID: SORBI-28MAY03-CLUS6921_2
ccgatccccaagccccgccgctgctccctcgtacgcacgcgcgcaccgcgtcgccctttatctgctcccgctgggccgctggtcggctgctgagtcgtcgtcgtcgttgttgttgttgctgggattgcagcgttggcgggccttgtagcgaggagggggtgtggaggcgcggcgattgttcgcgggatgagcttcggcggcagcagctccgtcgcatccggtgcgaagaggccgtttgagtacgggagaacgcatgtggtgaggcccaagggcacgcacaaggccaccattgtctggctccacggccttggggacaatggagccagctggtctcaactactggaaactctntcccttcctaatataaaatggatatgccccactgcaccttcaaggcctgtgtcagtgtttggcgggttcccctccacaacatggtttgatgttgctgatctttctgaggatgc

SEQ ID NO: 12395 - DNA, 1235 bp, Sorghum bicolor
  Clone ID: SORBI-28MAY03-CLUS6921_1
gcacgaggaaccgacggaccaacccccacgagcagaaggatccggacggccactggaacgagctcccctgtcgcctcctcgcctcggccggcgctccgcgacgacgacctcctcctcctcctcctccggtcccctgcaaaaccacctcgtcgccggcagcgttggcgggccttgtagcgaggagggggtgtggaggcgcggcgattgttcgcgggatgagcttcggcggcagcagctccgtcgcatccggtgcgaagaggccgtttgagtacgggagaacgcatgtggtgaggcccaagggcacgcacaaggccaccattgtctggctccacggccttggggacaatggagccagctggtctcaactactggaaactcttccccttcctaatataaaatggatatgccccactgcaccttcaaggcctgtgtcagtgtttggcgggttcccctccacagcatggtttgatgttgctgatctttctgaggatgctcctgatgacattgagggcatggatgcctcagcagcacatgttgcgaatttgttgtcgactgaacctgctgacatcaaacttggtgttggtggctttagtatgggtgctgctactgctctgtactctgcaacatgctttgctcatggaaaatatgggaatgggaatccataccctgtgaacctaagtcttgccgttggacttagtggctggcttccatgtgccaggaccttgaagaacagaattgaagcctcaccagaggctgcacaaaaggcttcatcaatacctcttttgctctgtcatggaaaagctgatgatgtagttctctacaagcacggggagagatctgctgatgccttgaaggcaaatggcttctccaatgtgctattcaagtcatacaatagtcttgagcactacactgttccagaggagatggatgaagtttgcaaatggctcacagcaaatttggcgctcggcactaagtcatcttgatcagaaaatgttgcgagaaagctcgcaatggcggtgtccaaataatacccggtgtctgttccagggaggtaaatggtttaatagcaaatttgggcttgggtatacggccatgttctagtttttctcacgcaggcttgtctgcgaatgctgtacgcttataatttccatattttggtctacgtcgatttggttgtggcacggataatgtttgttcaaatattctgttttccgattggggttgtgatgtttgct

SEQ ID NO: 12396 - DNA, 1199 bp, Sorghum bicolor
  Clone ID: SORBI-28MAY03-CLUS89763_1
aaatcgacccggatccgagccaggcacccgcacgatcccaccgcctcctgccgatcaccgggacctagcatcgccgcggcggcggcgggagaggggaaggaaggcgatgaggaaacgggagcgggagaacccgtgcgggatctgcggtcactaccacaagtacgaagagggggaggtctgcggggtgtgcggccaccgcttgaagccatcggatggggagggcgccccgtcgagccatgagtccgccttccccacagaggtgctgaaggagttcctcttcctcgggagctacgacaacgcctcacgctccgaggtcctcaggacgctcagtatctcgcacatccttaacactgtgcctgattgccacaatctttacaagaattcattcacgtatcacagtcttcaacgggacaggcctttggattttgacgaggcaaaccagtatctagagaaatgtgaaagagataaatcgcgtgttcttgttcattgcatgactggaaaaaacaggtctgctgctattgtcgcagccttcttgatgaagtctagaggatggagacttgcacagtcttttcaatgggtgaaagaccgaagaccgcaggttcaactgacagatgcttctcagaatgagcttttggagtatgagctgaagctttttggacccagtgctcaacccttggttcccactgaatcatttgcttctcttggatttggttatgaaaaaccagcaggtgacatccaagcacctatgttcaaccaaatgaccatgccatccatatttgagcgagtcaacccaaatgatcaccccaccaatttcacttttggagctgagaggatagcggaagttaaccctcacgataacaatagtgatggtggggtaaacccaactaaaacagagaacctgatggacggctcttaagatggtttcatgatgtcactgttcaatctccatgttgcagtgtactccttgctgcggaagtaaacccaactgctcagtgcaccgaatacatcggctgtctaggtttcagggaggttttgccctttgtcacttgagaaatggttctttggcaaccgaccttttctttagaatgactatgaaattagtctcaacttgtagtaatagatgtttgtggctcatatctctgttccctgcaaagctgctggaggttcttgcccatattcctaatcctatatttccggtt

SEQ ID NO: 12397 - DNA, 854 bp, Sorghum bicolor
  Clone ID: SORBI-28MAY03-CLUS8916_1
gcacgaggcctcccctctcgcccgcgtctcccttcccacgctcgccgccgccgcgagggctggtggaatcccatctggcagaacctcgtccggcgagcagaactccatccagcggccacctctccgctccttctctgtccaggcaacgcaagcactgtgggtgacagttcctcctcctatcggaaccccatatagcgaatcctgatctggtgaacccccatccgctaggatccgcggcttcttcgggagttttgggcgaacgactgtggaggaggagcagtagctgcggagcacctcaacaccttctccctctgctctgtttgctcgtgtgctacaggcttggcactacgtactatatgcaggatatcgacgagggcactatctgttacctggcccctatcttggtgacctccgctattccaaacctgcttctgtgatttatgagtttatttcgttcggtttgggttcgcctcccacttgtgctgagcctgcgagctctttttcatgtttgggtcggtgcgttcgttcaaagctggacaccaagggtcaccacctagaacccagatgcattatagattacatctcattcagccttgtcgacaagaagtaccttttcgccgctaccacagcagtaccggccccgcgctctggttctcattcctccccgcttcatgactttcatgtccaggttgctgatcttctgcctggcttgccatgccgggcttcaaactatccatgtacagtagtggccgacgttccaaagtgtcagctaatgtaacctacaccgttaagcttcagctcgccatggaaagacctacggctgcgcctttaatttgtttatgtttcagaaacac

SEQ ID NO: 12398 - DNA, 483 bp, Sorghum bicolor
  Clone ID: LIB3476-055-P1-K1-E8
gattggcactacgtattaaagtcaggatattgacgaaggcactatctgttaccttgcagcagaccgggtgatctccattattggcaacctgcaatttgtatccatgtcttaataacttgagatttgagaataccacccacttgatgatagtctgagagcacatatacatgttttggatgattcgtaggttcaaagctggacaccaagggtcaccacctagaacccagatgcattatagattacatctcattcagccttgtcgacaagaagtaccatatcaatgcaacaacagcagaaccaaaccaacgatgatgaaatgatagaacctcacttgaaaacaaacataaccagattgatgaactactgcttgtcattcaaagcgaggcttcaaactatccatgtacagtagtggccgacgttccaaagtgtcagctaatgtaacctacaccgttaagcttcagctcgccatggaaagacctacag

SEQ ID NO: 12399 - DNA, 1173 bp, Sorghum bicolor
  Clone ID: SORBI-28MAY03-CLUS898_1
cagctgctggccgaatcgctccttattttgtagaaaggtttcagtttgataagaactgtttggtcattcagtggtctggagacaatcctaatagccttgcaggtttaactttgaatactcctggtgatcttgccattagccttggtactagcgatacagtattcgggataactgcagaagctaaaccaagcattgaagggcatgttttccccaatcctgttgaacccgatggttatatggtgatgctatgctacaaaaatggctctttgaccagagaagatgtgcgaaatcggtgtgcagacaaatcatgggatgtttttaacaattatctggagaaaacaccccctctaaatggtggaaagttaggattctactacaaagaccatgaaatccttccaccacttccagtgggtttccatcggtacgctgtcgaaaacctcaatgacgttacatcagacactctgttggagcgtgaagtggaagaatttgacccaccgtctgaggttcgtgccatcattgagggtcaaatgctgtcaatgcgaggccacgccgagaggtttggcatgccgaaccctcccaagcggatcatagcaaccggtggggcatcctccaacgaaagcatcctcaagtcaatcgcccagatcttcggctgccctgtctttacagtccagagacctgattcggcttcgctgggggcggcgctgagagctgcccacgggtggctgtgcaacgcccaaggcagcttcgtccccatctcatgcctgtaccagggcaacctggagaaaacctctcttggctcgaagctggcggtgccggccggcgacaaggaggaggaccgggagctcctccagaagtacaccctcctgatgaggaagaggatggagatcgagagacgcctggtggagaagatcgggcgatcataggaaaatcacgaatttagcacttttgaagctgccaggaccgaataatttgtgaataactgttgattatcatcctttatacgcaagctctcttaggtgagagtcagtattggttctgattttataagcctggctctgtggctcagctgagaaaaatttgtgctgggactctggacatcgttgtgagacacgcacaaaacctttgaaagagacagcacttcgcaagggtaaacgaatcttaaaaatctttgtt

SEQ ID NO: 12400 - DNA, 761 bp, Sorghum bicolor
  Clone ID: SORBI-28MAY03-CLUS893_2
ccgaattaccgactcgtccgaccctcgtcacatgccggccgtgctcttgacgacacttgacgcacctaccatctccgtccatctgcggcgtcggcggcgaaggaagaacggaagcgacggccacgtgggcaggcggcgagcaggagaagcccacaatggagaagtgtaacagcaatgctcgatttgcacccttgagtgatactccatttgctctccgtggagctcttggtagtactagttcaaatcttgagcaaaccaggggctacgcatcttcccccctagcagctcagcggcccaagatatctgcacctggaagccgacccctgcacacaagtcgccccctgtcatctcctgttgcaaaccgcccactgtcaccccaccttcctctgaagaagccgcagttcagcgctactttctctatctcgcaccgaattttcggtgtcgcattgggagttgccatcatatctgtccctctcgccaccaagttcagcctgatgtttggtgtttgagagcgatctgctgtgtcgtcttatgagaaatggcattacccatttccgtgactgttttgtcgttgtctctggttccttgcaacgcaaggtgcagtttggattaacatctttgtcatgtgtgcaaaacttctataataatcagtactttctactgctacattatgaaaatatcagatgctagtgtaatatgagtatcaaatatcagtacaaggaggtttgccccatcaaaaaaaaaaaaaaaaaaggccccta

SEQ ID NO: 12401 - DNA, 845 bp, Sorghum bicolor
  Clone ID: SORBI-28MAY03-CLUS893_1
gccggccgggccgggaagcttttcctcgttcatctctggtctctcaccgcaccgccgccccccgcctccagacgcgtccctccggcggagaatcggtcccgagctcgcttcgttcggatcttctgtgtagccagcaaggaggcctctccatctcctccggagcagcaaggctgtgcaggaatggagaagtataacagcaacactcagtttgcacccctgagagagactccatttgccctccgtggtgttcttggtagttcaagctcatatcctgagcaagccaggggctacacatcttctcctctagctgctctgccaccaaagatgtctactcctggaaatcggctcctgcacacgagccgccccctatcatctcctgtagcaaaccgcccactgtcgcctcatcttcctctgaagaagccacagttcagcgctactttctctatctcgcaccgtatcttcggagtcgcgttgggagttgccatcatatccgtccccctcgccaccaagttcagcctgatgtttggtgtttgagagtgattttgctgcatcttatgagaaacagcatttcccatttcacatcgtctgggttaccttgcaacacaactgtaggtgctgttggaataacatctttgtcatgctgtcagacttctgtaataatgactaaaactatacaaatatcagtttaaggagatttgccccattatggatgtacatttcccatttcacatcgtctgggttaccttgcaacccaactgtaggtgctgttggaataacatctttgtcatgctggcagacttctgtaatatgactaaactatacagataccagttaaggagcacttg

SEQ ID NO: 12402 - DNA, 733 bp, Sorghum bicolor
  Clone ID: SORBI-28MAY03-CLUS9111_1
caaaagatccaaacaggccctttccgagtggtcaaaatgaaactcctctggtgaaatggagaatccaggggatggacgagtcatctttacctctgtcagtcaattgctggccgtccgtatctggaaatgaaacctatgtgaacattgaatatgaagcttctgagatgtttgatctgcacaatgttgtcatatctatacctctgccagcacttcgggagcctccaagtgtcagacagatagatggagagtggaagttggactcaagaaactccgtgttggaatggtctattcttcttattgatcagtcgaatcgcagtggttccatggaatttgttgtccccccagctgacccatcatcatttttccccatctctgttggattttctgcatcgagtacattcagtgatctgaaggttactggaatccttcctctgaaggaaggcaaccctccgaagttttctcagcgggctcgtttgctcactgctaactatcaagttgtttaatgcttgtaccacagtctgagtgttgatccacttaaacatattccaatagcagatatttgtgatatgccatgttattgccattgacttttgcaagccatggcacggaagatcattttgtgtttggaaaatcttttactatgtgactcttattgttagcatgttgcacaaatgttgttctgatgtattggtaccagagaaataagtaatgttcttgcatttcgtttgcctgc

SEQ ID NO: 12403 - DNA, 955 bp, Sorghum bicolor
  Clone ID: SORBI-28MAY03-CLUS30852_1
agagaaaaaccagaatccatgaatgcatttgctcttatttcgagatcacagggcttcaaccttggaaatttgtttgagaaggagatgatgggaatggtaaagagggaaacatctttcacgtctcaatgtacagcacaggagatcatgacaaaaatagaggatgcatgtgggccacttggtttcaacgtgcggaaacaaaattacaagatgaaattgaaaggtgacaaatctggaagaaaaggtcacttatctgttgcaactgaggtttttgaggttgctccatcacttcacatggttgagcttcgtaaaaccggtggagacacattggagttccacaatttctacaagaacttctcaacagagctgaaagatatcgtgtggaaagctgaatctgacgcaactaagaaatagacgaagtgatacccaggaaatctgtgtaccttatgaggccacattgagataaaccaccacttcgggtgataccgcttgcttggtactgcatgtttttttttactggtaccacattagctgtcaaattctctcgtaattcgtaaaccagagctcctgcatgaatgagcgcagttgtacacaatacatatgaagaggccctccctggcacgaggcaaacacagcaatgggatgtcaaaatagctattctgaatgctttggttgtcccggggttgagtgcctttcttttatgaaaatagcgaatggtttatgatggtatgaagctaaactctagtatttttgagcaactgaacggttattcaggtggtgtttgggattgttccgctccacattttttagctttgcttcttgtttttttagctaaacggttttagcttcatgtactctgcttgagaaaaaagtatggagttatgaaagtacttaaaaaggtgcttcacaaaattctgattttttgtgaagttgcgctacaaaaaaaaaaaaaaaaaaa

SEQ ID NO: 12404 - DNA, 1006 bp, Sorghum bicolor
  Clone ID: SORBI-28MAY03-CLUS31848_1
cctctgcatagcaaacgcaaaggcaaaggcaaacatggtgttggagcaggagcaggaggaggtgttgccgggggcggtgcacgggcaccggctctccacggtggtgccgagctcggtgacgggggaggtggactacgcgctggcggacgcggacctggccttcaagctgcactacctgcgcggggtgtactactacccgccaggggacgtggcgcgcggcctggcaaccaaggtgctcaaggaccccatgttcccctggctcgacgactacttccccgtcgccggccgcgtccgccgcgccgagcagcaggagcccgaggccgccgccgccggggcgccgcgcaggccctacatcaagtgcaacgactgcggcgtgcgcatcgtggaggccaagtgcgaccgcgacatggacgactggctccgtgacgacgcgcccgacaggctcaggcagctctgctacgataaggtgctcggccccgagctcttcttctcgccgctgctctacgtccagatcacaaacttcaaatgcggcgggctggcgctggggttcagctgggcgcacctcatcggcgacgtgccgtcggccgtcacctgcttcaacaagtgggcgcagatcctgagcggcaagaagccggaagccaccgtcctcaccccgccgaacaagccgctgcacggccagccccccgcgggttgcctgcttcctctcctggcgagagatggagatgcagctgtagctttcagtatggttccccggcagtgcagttgagcaagcctttaattgtgtgcggccgtagctgttaaccatcacacatgcgtaccactgtctagtggtcacctagagctggtcaccgactgcaacccctcatcatctgccacaactgtcaactgtgtagtgtctgttggctcggctgtcaccactaattcagactaataactgcttctctgaatctgctcgattatagatttatactggtagctaaaatcgtgtggtactagtagtggtagt

SEQ ID NO: 12405 - DNA, 1468 bp, Sorghum bicolor
  unsure (1)..(1468): unsure at all n locations
  Clone ID: SORBI-28MAY03-CLUS32289_1
gcacgagggatgattcatattatgctgctcccaaggctcacccagttagttctgaggttcgtcgaattcggattgaccttgagcaagctcaagctctcatttgtaaacttgattctgagaagggtattgaaaacagcgttctctcaagtagtgaccatgaaaaatcagacagggataagtcacatggttcaatggggccaattgttataatacgaggatcatctactgtgaagggtcttgagggtgctgagttgctggacactcttgttacttatttatggcgtatccatggtgtggactattatggtatgtctgagacaaatgaacctaaaggcctaaggcatgtgaaagctgatgcgaggacatataatggggctagctcaaatggcgccgaatgggagaataaacttgattcattctggcaagacagaattcaaggtcaggatccattagaaatgttgaaagcaaaagagaagattgatggagctgctactgaagtcttggatccatatgtgaggaaaataagggatgagaagtatggttggaaatantggatgtggagccaagggctgcacaaaacttttccatgccgctgagtttgtccagaagcatcttaaactgaagcatgcagaatttggtggttgatctaacttcaaaagcgagagaggatatttactttgagaactatatgaatgacccaaaggcgcctggtggtacgcctatcatgcagcaacctgctccaaggggaaaaggcagacaaaggccaccaatagagagtcggctgagggatgagcgtggtaatcataggttcgacaggaatgttgattcaccaacacatgatgggtctagtgaaaatcctgacgatcctatttatgattcgtttggtgatccaattatgcatggtgcgttccctccagatattcctgctcccccggttctaatgcctgtgcctggtgctggtccgctcggaccgtttattcctgcaccaccggaagttgctatgcatatgttgagggatcagggtgcgccacctccttttgagccaactggaggtccacatcctaggaaagcagggagaggtgttggtccccaaatccgtggtccatccccaatctttactgctcctccgcctcatcagatgcatgaccctcgtagaatacgaagctaccaagacctcgatgctccagaggacgaagtgactgtcatggactaccgaagcttgtagacttcctccacttcatgtgcctccagatacttgtaggtaacataatagtgggaaaacaaaacaccttactgtccctagaatcactgcggaggaaccccagcaggcatttgtgtgtcgactccagagctgtcagcttctcagtgtttgtaaaatgtaacacaggaactcaggaagtacattacaacccctcaccattaaacaaggtgttgcctcagtttgtgcaatgtgaaagatttttcacct

SEQ ID NO: 12406 - DNA, 1112 bp, Sorghum bicolor
  Clone ID: SORBI-28MAY03-CLUS33010_1
actcgtacgtgcccgagataacagcgactcgggcgagccgcgagagtgagagacccacccacgaaaccgcgagcgccgcacaccaacaaccacccggcgctgcccgtaaatgcgaacgcagcaggcgtgggggcgcggggcggtggcgcgcttgatgacgccattcaatcgccgcgcggcccacgcctcttctccccacctgctccgcggctgctcgtcctcctcttataccgtcgccctctctcgcctccgccgcgcgcggctccctcctcctctccagcatacagtaccagacagggtacccatacattcatggaggtggttcaagaagtccttaagcatggctcagtagatggtgtccgtgctgtcatacgagctgacaaaaagagctacagccttgtccagctcattgcagcctcttttgatgtccacaacattctgtgcagcaaaaatatgacacacaatggaatacaagattcttcttccgaaggaataaatggaacaggattccttcatggagctcgtgttggcattgtggctaaaccctctcctgaatttgttgctggggtctttggaacctggctttctggtggagttgcagtaccccttgcccttagttatccagaacctgagcttcttcatgtcatgaatgactcggatatttctatggttttaagcaccaaagagcatcatgaagtcatggagaacctttctatcaagcgttctgcttattgttctcttcttccacctatcactagtatatcttcagaaataaatccccaagaaccttcaagcaatgaggcgacttcatcagtctctactttaataactcatatcaacagttcaaagaaaatcaaaggtgatgaccctgctcttatcctttacacaagtggcacaactggtaaaccaaaaggagtagttcacacccacaagggcatactttctcaggttcaaattctatcagaagcgtggggatatcgaagtgaagaccaatttctgcactgtctcccgctgcatcatgtgcatggccttttcaatgctctatttgcgcccctttattcaggatcagtggttgagtttataccaaaattcagtgtaagcgggatatggca

SEQ ID NO: 12407 - DNA, 1193 bp, Sorghum bicolor
  Clone ID: SORBI-28MAY03-CLUS33030_1
gcacgaggccgaattggcttatactggctatatctcctgccaatcaaggtatagcaacatcagatgctttcaagcttgcccgggatgtggatccatctggtgtgaggacatttggtgtgtcgtcaaagcttgatttaatggacaaggggtcaaatgcacttggtgttctcgaaggaagagctgtcagtctgcaccatccctgggttggaattgtgaaccgtccacatgccgatatcatctcgaatgttgacatgattattgctaggcgaaaagagcatgagttcttgcattctagtcctgaacattctcatcttcacagccggctgggtgcatcatctctcgatgaatttccttgacagcctcaagcccctgcaggcggggcccccattgtgcccaaacccccggtgatgatatccattggagagactcttgagttgaaacgatttccatctctacaaacggagcttgctgctgcatgctataaggccctccagagactccgtgacgatggcaggaaaactactctccggctggttgatatggagtcagcatatttgactgtggagttcttccgcaagctcccacaggaagttgacaagactggaactgcaaatcccagaactgcaaatcctcctgctcctggaaatcccagaactgcaaatcctcctcctccttcggatgatcgttacactgatgcacatttcaggaggattgcttctaatgtgtcctcatacattggcatggtatctgaaaccctgaagaatactatccccaagtctgttgtccactgtcaggtccgcgaagctaagcggtccctgcttaatgatttctatactcaagtgggcgggaaagatgctaagcaacttgcagtactccttgatgaggatcctgccctcatggaacgcaggttgcaatgctttaagaggcttgagctgtacaagtctgctcgggacgagattgattccgtgtcatggacacgatgaaggtaacacttgtcttccattagacacattgtaatttgactaatgcagaattagcagctagctagtatgcacaatggttgtcaaatattactagaccgatcacctgtctcgtatcatagcctgttaatatcagttgtgtgcttgactgcttgtgttgtatctatgtctaacttccaacacttattaggtgcaaatctttctgtccttcgt

SEQ ID NO: 12408 - DNA, 1202 bp, Sorghum bicolor
  Clone ID: SORBI-28MAY03-CLUS9321_1
gccggccgggtttccgtccaaaaaggaatgggatggtgctaccttgcggaacaatgagacattgtgtaattgtatctttccattgagggggcgatctgttcctcttgggcagtacactaggtgtgttgatcagtactgggaccaattgaattcacttggacgagctgatgggagtcgtctccgtttgttgacatatgacattgtgctgatgctagcgaggtttgcaacaggcgcttcctttagcacagactgcaaaggtgggggaagggaaagcaactcccggtttcttccattcatggtccagatggcttcttatcttgcagatggaagtgctaaccagcagcgtcatgtaatggccaaggctgtcacgacatacttgtccggctctgcatcaacactggattctcctattcgagtttcagcatctgtctctgggtcccgtggtggttcagggtcctccgaggagactgtacagttcatgatggtttattcccttctgtcagagtcatacgagagttggctccaacaccgccctgtgttcctacagaggggcatctaccacgcctacatgcaacataagcacgggcggtcaaccctcaagctgtcatcagattcgtcatcattggctgttcggtcagacgaaggttcatcctctgatacaagtgacgagaagcttttcgctatcgttcagccgatgcttgtgtacactggcttgattgagcagctacagcagttcttcaagaagggaaaatcatccagcatgagcaagatgggtgaggaagatgaatctgctggcagccttgagaaatgggagatccagatgaaagagaagctggacaacatgaaggagatggtggggctgtccaagaacctgctctcctggcttgaagacatgacctcatcagatgatatgcaggaggcctttgatgtcatgggggcattgacggatgtattttcgagtggttatgcgacatgcgaagattttgtccgggctgccatgcatgccggcaggagctgagcgtgagaatggaatggaggttccagggtgtgttgatatgtatacgccttgttagatcaacaggctctattcagcccagatgtttgtagcattttgccataatgtgtcccgacgtaaggagaatatgtccctatgttgtgaattatacaaattctccattcaccagtagaaaagttacaattcc

SEQ ID NO: 12409 - DNA, 1103 bp, Sorghum bicolor
  unsure (1)..(1103): unsure at all n locations
  Clone ID: SORBI-28MAY03-CLUS9406_1
gcacgaggagatcccgcatcgtcgacccatccgattccgtcgtcctcctcccgacggtacgccaagtccaacgcaggcgtagctcccggccacagcagagcccacgccttgacgcgctccgtgtgagactgtgagtggagcgtccggacgccggccggcggccagagaggaagcggatcgaggaggctcggctgactggaggagatggaccgcaaggatgtcgggatcctcgccatggacatctacttcccgccctcctgcgtgcagcaggaagcacttgaggcccatgatggggcgagcaaagggaagtacaccattgggctcgggcaagattgcatggccttttgcagcgaggtggaagatgtcatctcaatgagtttgacggttgtcaattccctgctgaaaaagtacaagattgatcccaagttaatcggtcgcttggaggtcggaagtgaaacagttatagacaaaagtaaatccatcaaaacttggctgatgcagatttttgaggaaagtggtaatactgacattgaaggcgttgactccagcaatgcatgttatggtgggacagcagccctactgaattgtgtgaattgggtcgaaagtaactcctgggatggccgttatggtcttgtcgtttgcacggatagcgcggtttatgcggaagggccagctcgtccaacaggaggtgctgctgctatagcaatgctcattggtcctaatgctccaatttccttcgagagcaaaaatagagcttctcacatggctcatgtttacgatttctacaagcctgatcttgcaagtgaatatccggttgttgatggtaaattatcccaaacatgctacctgatggctctagactcatgctacagacagttctgcaacaagtatgagaagatcgcgggtaaacaattctcaatttctgatgcagaatattttgtgttccattctccatacaacaagctcgtgcagaagagtttcgctcgactttactacaatgacttcatgcgcaactgcagctcttgtgatgatgacgctaaagagaagctncagtctttttcaaatttgactggtgaagagagctaccagagtcgcgacttgga

SEQ ID NO: 12410 - DNA, 977 bp, Sorghum bicolor
  unsure (1)..(977): unsure at all n locations
  Clone ID: SORBI-28MAY03-CLUS9423_1
gcacgaggggcatcagcgccacggaaccaaccaaactgcgtttgtgagggagaggcctggctgctgctgctgctgctgctgcttgtcaccaatatccatctctgcctctccttgttcaaaacctttgttatcttgaccaagatccctccctccatgaattccagcagaagcctcctctcctcgcccctctttgctagctcgtctccaaacttcaggagcagtacctccgtctccgtctcctcctccccgtccccatcccgcaccacaggtatatttccgatgatacatgacaacaccggcagagcatccacggcgtgccactactcgccatcacttgtggctgaggagcagcttcacggttccaaagacaccttgaccttgaagggcgaaaaggctttgcttgagttgctgctaggcatggctctggaccagcacgtcgacggcggcaagctcacggctgaggatactgatttcgagacctatttaaaagaagcaacaagccgagtgctttaccagccagtattcactgaggatgattccacttcggagaactcttcagcatcaacagctaaaacacctgggagtttggatcttggcaagccgacgaaggaggtggaattgccagcacaagaatcaggcacttcagacacccagttggatgtaccactgcctcaccgcgtggacccaaaccattcgtacgagggactgctgagcaatgatcaagtgtttattagatccacccgggtacttgagagaagatccaagaaacgcaacgccaacagggctttgagtaatgacgttccgtgcagtggtgtgaatgtgaaatccaaagagaaaagagaagtcaaagaagtttggcagagttcttgatccagatgagccttttanggttgttctacgggatcgagagacaacagagttcttgacaagcaaagaggagaaaccagatgtcagtcaaatacagaatcttatgaagc

SEQ ID NO: 12411 - DNA, 520 bp, Sorghum bicolor
  Clone ID: SORBI-28MAY03-CLUS9345_2
ctgagctcctcgggatccggtgccaggccctcgccctcacgcggcggtgctccctctcttcgtcccccagcgacgcgcgcagcagcgacgcaggcaggcggcatgaaggggggcggtgccatgaagccgtcgtccatgttctacgtccacgaggcggacgtcgtccagatccaccatttcctcgaggagtgctccctctgcgccaagtcgctctccggcgacatcttcatgtacagaggtgacacgccgttctgcagacgaggagtgcaggcagcagcagatcgaggtggacagggcgaagcaccggcggaagaagcgcgcggcggcgcacgcgctgaccgcacgcagcagggagcaccggcaccaccaccaccaccatcaccaccatcaccatcagcaaccgcagccgcggaaggccggcatggacgccaaccaccacccgtgggtcgacgccgggttcgcgagggcgcccgcgctgcgcgtctgaaacaaaaaggaacccgcgccgtcgtacgcacac

SEQ ID NO: 12412 - DNA, 957 bp, Sorghum bicolor
  Clone ID: SORBI-28MAY03-CLUS9345_1
gcgggcacccccggagagtcccgcaagctagctgagcttctcgggatccggtgccaggccctcgccctcacgcggcggtgctccctctcttcgtcccccagcgacgcgcgcagcagcgacgcaggcaggcgtcatgaaggggggcggtgccatgaagccgtcgtccatgttctacgtccacgaggcggacgtcgtccagatccaccatttcctcgaggagtgctccctctgcgccaagtcgctctccggcgacatcttcataggtgacacgccgttctgcagcgaggagtgcatgcagcagcagatcgaggtggacagggcgaagcacccggcaccaccaccaccaccatcaccaccatcaccatcagcaaccgcagccgcggaaggccggcatggacgccaaccaccacccgtgggtcgacgccgggttcgcgagggcgcccgcgctgcgcgtctgaaacaaaaaggaacccgcgccgccgcacgcacacttcccccgctccgcgcgcaggccgggggacatcctcacatccatcctttctccgcgggtttctgacgcgtgctgcagcaggacgaatcctttgggttttaggggatcggctgcatgcatgcatgcactagtgcgtcctaagtacgcggccgagcgattggctcgggtttttgctactacgatacaatacacgtagtaccatgatccaaggctagaactgtagagccatgctgcaacgactactgacggagagccatggccgactctggccatggaccaatggcgtctctcctccacttcttttgggcctcgtatttcggctgtagttcttgctctcgtggaatgaaagacgtacggattatcctaccagactagtcatgtatttcagactctgaatgtatacctacaggctacctgttatttatcattagattattactgggtgctgcatatattttgcctttagc

SEQ ID NO: 12413 - DNA, 1363 bp, Sorghum bicolor
  Clone ID: SORBI-28MAY03-CLUS9440_1
gcacgagggccgcttctctcgggcgttggaaccgaggattggaggcatcgtgcagaccgcgcccgggacacctggcacgtgggcccgcctcctccatctccctctgcggcgtataaagaaccggcccacggccaccgccacgccctcgccggaatatcatacgaaaaccctcgcggcgaccgctctcccacacacgcgcgccgcagcctccgcagtccgcacctgcctccacgacttgtcgtgctcgtgcgctactctcctcgagtgcggcgcggagcacgggggcatcaaatggcggccgcggcagagatcggtggtttcacagcggcgagagtggcggcggcggcggcgctcaggccggctgcgcacccagccccggcggcggcggcgccaccgcagcccaggagggctgtggcggcgcagtcgctgcggacgaccaccgccgaggtgctgacggcggatctcgccggcacgaccaacggcgcggtgcacgctcagatgaatagtgaggctactagtgaaatcacttcacaggcagttatttctaggaggaagacaaagatagtctgcaccataggtccctcaaccaacactcgtgagatgatttggaagcttgcagagactggaatgaatgtagcacgccttaatatgtcccatggtgaccaccagtcacaccagaaggttattgatttggtcaaggagtacaacacacagaacactgatggcaatgttattgccatcatgctggacactaagggtcctgaagttagaagtggggatgttccagagccaatcatgctcaaggaaggtcaagagttcaacttcacgattaaaagaggggtgagcactgaagacactgtcagtgtgaactatgatgacttcataaatgatgttgaagctggtgacatactgttagtggatggaggaatgatgtcgcttgctgtgaagtctaaaacagccgatacagtcaagtgtgaagtagttgacggtggggaattgaaatcaaggcgccacctaaatgtccgtggaaagagtgctactttgccatctatcactgagaaggattgggaagacataaaatttggtgtcgaaaacggtgttgatttctatgcagttccctttgtgaaggatgccaaagttattcatgaattaaaggactaccttaaaggtgctaatgcggatatacatgtcattccaaaaattgaaagtgcagattcaataccaaatctgcagtccattattgctgcttcagatggggcaatggtagcacgtggagaccttggtgctgaacttcccattgaggacgttcctttgctacaggcagagattggtcaaacatgtcgaagcatggagaaaccagtca

SEQ ID NO: 12414 - DNA, 1220 bp, Sorghum bicolor
  Clone ID: SORBI-28MAY03-CLUS8010_1
gctcgaggccggccgggccgggaaaggaattccagttgctcgctctcctcccccggttccccaatcccgtttccgtcggcggcccgccacagatttttctcgtccccgtgcgtctcctcctcctcctcctcctccccctcccccctgttgcttttgcttgcttgcggttgcaggcagccgctgtgccgcgaccgcgagcgacctgtgtagtagggggagggagggtcggagggagcgaaagaagagaagagaagagaaggtttggtggttgtttggtagaggagaatagttggttggctcagggtcaggggggcgaagatggagcgcaaggtggtggcggtgtgcgcggtggtcggcttcctcggcgtcctctcggcggcgctcggattcgccgcggaggccacccgcgtcaaggtttcggatgttcaaataagcagtactcctggtgaatgcatatacccaagaaccccagccttagcacttggtttaatatctgccgtctcccttatgctcgcccagtctatcataaacacggtcgctggatgcatctgttgtaagaggcatcctgttccctcagacactaactggagtgtagccctgatctcattcatcatatcttggtgcactttcataatcgcattccttctcttgctgaccggagctgccctgaacgaccagagaggcgaggagaacatgtacttcggtagcttctgctacgtcgtgaagccaggggtcttctctgggggagcagtgctagccctcgccagcgtggcgctagcgatagtctactacgtcgccctgtcatcgtcaaagggtcctccgccgacgtttgcaaccccgcagaaccatggcatcgcgatgggccagcctgtgatcccgcagcagagcagcgaaccggtgtttgtccacgaagacacttacaatcggcggcaacaggttccatgaccacacaacctgtggttggttcaacaggtctccctaaccagggtacctcatgcagttgtgcttggtctgtataggttgcaggttagaacaatagcagtcaccgttgctgttagctaggtttggttttcttctttctacttctaccctcttgtttatcgagcatgcctgtttcatcgcgagggatgtttgattctgaaagaatgaactgggtaatgttgtagagagcttgcatcatgttcagagtttgtctggaaacgtggaggttctttatcatt

SEQ ID NO: 12415 - DNA, 1418 bp, Sorghum bicolor
  Clone ID: SORBI-28MAY03-CLUS8654_1
taagaaggccggcgcaggcaggagccggacgcccctcacgcgccgcaccaccaccacctcagcaccgcgccgcgtttccttctcggcttctccctctcccctacacaccgcctctccgccgcgtcctccccgcacattttcttctcctcgcgccgccgccgccagcttcttttcctcctccgagatggccaacgcggcgtccgggatggccgtggacgacgactgcaagcgcaagttcctggagctcaaggccaagcgcacctaccgcttcgtcgtcttcaagatcgaggagaagcagaagcaggtggtcgtggacaagctcggcgagcccaacctcacctacgacgacttcgccgccaccctcccagccgacgagtgcaggtactgcgtctacgacttcgacttcgtcaccgaggaggggtgccagaagagcaagatcttcttcatcgcatggtccccggacacggcaaagattaggagcaagatgctgtatgcaagctccaaggagaggttcaagagggagcttgacggcatccaggtggagttgcaggcaacagatcccactgagatgggcactcgtgccatccgcggccgtgcccattccgtcgccggaccggctgctgccgctgtctccgcgctctccctttggagacccatttggcaacccaaacccaaaatgggtctccaacacaatacaatacctatagcctccaacagagtacccttacagaagacctattttgggttttgggtatcaggagaggcataacccaaatttgggtatcctctctcctcgagacccatttgcagagagtgttgtcttttaggtcttgtcgttggagaagactaaaaataggtatggaaccttttacctgtagcgctatccaaagaacaaatggatgggtcttgtatttggggtgacgattgttggagatagtctcggttggactgacgacatgccacgtacgtatgagtgtatgaccacactcgctctcgtgtcgcgccgacagcctgctagtagggcttgaggcagtcgtagaggcggcgatgctccgacggccaaccaccagcagcagcagcctccgccgcggccggcggcgactgcagcgcggtcgcagttggggatctgacgctggacgacggcgacgcgccggttggcgtcggcgccctcgggctctccagcgcctgccggcacgcgtcggggttgccctccacccgcagcatctgcagctgccgccgccgcctctgctccctcctcacctcgttgcgcttgttcacgtagtcctcgtggatgaacacctccatatcctcttctcgatctcacacctactactatcacacaccgtccactgtgaactactgttaaaactactacacactatcattcatcaatcctatccaagatcctagcctcgtgc

SEQ ID NO: 12416 - DNA, 770 bp, Sorghum bicolor
  Clone ID: SORBI-28MAY03-CLUS8693_1
ctgtgcggcgctcgcggacgcgggggctgcctttcttctcccgtccacccctagtgcgctcgtctctctcggcgacgactgggctaccgccgccgccgccaaacttcgtcgggctcgccggcgacgagctcccaccaggatcagaggaggtggtgatggcgagaggtgacagctgcctggcgcgcgtgggtgccggagttgccatcggtggcgcggtcggcggagccgtcggtgcttgctatggaacttttgaggcattcagatacaagatccctggattgctaaagatcagatacattggacaaaccactgttggcagcgctgcaatttttggtcttttcttgggtgctgggagcttgattcactgtggaaaatcctactagtttgtttccctcctttttctgaacacgactttgtcgatgggcttcagaggaggattcttgattttgagtgctaccctgggtggcttcagtcaaaactattcaatgtctgtacaatttaacagctaatagctcagggttggaaagaacaatcaagttatgccccagtgttggtgtggatggaaatataatccatgttcatctgtacgagaatcgtcaatttcacatatagcgtcttatgttctaatatgattttgtttgaaaaatgtaaggatttcttatggtcatcaataatacttttcttgctagatgggatgtatatcgctctcaacgtaaaggcagcaaaaagcgcccctagggatgccaaaaaaaaaaaaaaaaaaggcccct

SEQ ID NO: 12417 - DNA, 760 bp, Sorghum bicolor
  Clone ID: SORBI-28MAY03-CLUS8560_1
gagctgtaacaagtttgtgggtaaaaaatcattcaaaacgaacaaagacagacaaagccgacaactgctgagcatatggctcagcaagggaattcaagagcagaagagctgatggtacatcatccatagtttcagaattccgggtgcatcactcagacaccaagcacagttgagtactatatagaacataataattaggtgcatacagcgacagtgcatgaaaatcagatagcaacaagggttcgatttatgctactgcacaccatctctcccagaaggctactctggaacaggggtgcctacttatacttaggcgtggtcatgttcattggaagttcgagttgcctccttgaccttggtagcctgggctgccaccagggtagccaggattgccaccaccagggtatggcggtgcattggggttgcctccttggtagggaggtggaggtggtgggttgccaccagggtaaccaggtgggccaccttggtagccagggttaccaccttggtaggccgggcctgggttcccttggtaaccttggttaccaccttgataccccggaggtccaccttggtagccaggagcaccaccttgctggtagtgaggagcaccaccaggctcgtggcccgcctgtgggtgtcgcctgtgcgcctgatagtttggctgaccaccaccagcatgtggtggtggtggcggcatgttaccctgaacatgctgaggtggcatctggttctggccaggtggaggtgggcctcgtgc

SEQ ID NO: 12418 - DNA, 419 bp, Sorghum bicolor
  Clone ID: LIB3476-051-P1-K1-A6
ctagttctagatcgcgagcgtccgccctttttttttttttttttttttttggtacatcatccatagtttcagaattccgggtgcatcactcagacaccaagcacagttgagtactatatagaacataataattaggtgcatacagcgacagtgcatgaaaatcagatagcaacaagggttcgatttatgctactgcacaccatctctcccagaaggctactctggaacaggggtgcctacttatacttaggcgtggtcatgttcattggaagttcgagttgcctccttgaccttggtagcctgggctgccaccagggtagccaggattgccaccaccagggtatggcgggcattggggtgcctcctttgtatagagaagggtagaggtgtggtcaccagggaaccaggtgggccacctt

SEQ ID NO: 12419 - DNA, 745 bp, Sorghum bicolor
  unsure (1)..(745): unsure at all n locations
  Clone ID: SORBI-28MAY03-CLUS8741_1
gccggctgcgagagggacttttcgcatccgcacgctcgtgctctctgcccttctttgctgccagcgaacgccgccgcccgtggctaggttttcgtcgggcccttcgccggcgacgagcatccaccagggggacgactgagctgagctgagcctgcagtaacgagagctcaagaggcactatgttgttcttctcctacttcaaggagctcgtggggaaggaggtgacagtggagctcaagaatgacctggcgatcagcgggacgctccactcggttgatcagtacctcaacatcaagctggagaacacccgggttgttgcgtgagacaagtatccccacatgctgtcagtgcggaactgcttcatcaggggctcggtggggcggtacgagcctgatcggccccgcctcaccagcgctcacatctcaccagctgcttccctgggacccgcgcgtgatctgattttatgatactgacatgcatggtggtgttgtagacacagtgttgagtggccgaacaccccaacttattttatccactagttatagttacctggtaatgtgatacttgtcgtgacagacattccacaggttgggtctgatataagaaaatttttgatatttaacactaaataaaaaaaaatagttccctggtacttgncgtgacagacatttccagttgggtgatgacctgctgctatatatcatcatatcatatgcctatggccccctgcatgttccttgggggt

SEQ ID NO: 12420 - DNA, 1637 bp, Sorghum bicolor
  Clone ID: SORBI-28MAY03-CLUS9885_1
ggaaaaccgccggcttatccctccccacagcaccccacagcgctaccgccgcgcacagccatggcatcctcctctacctacctcatgctcgccagcgcccgtgctcccctcgctcctctcctaaggccaacgctgatggccctcgtcgcgagaaccgccgcagcctccatcactagtggcgccagagctagtgtccctctgttcgtcaaccccgccgccttccggccgggagtgcggcgctgtggctgggcccacatctgcagagactcgtccctccagggccctcccggcaccgattctcctgcccagaagcaagaggatatgaagaagagcgaggcggtgtcagaggctgctattcggattgccggaggcagcggccggaggttcagcgactggagcacgtcggtgctcatcttcgggatttgggggggactcctgtactacgtcttcctgctcgcgcctaaccagacaccgtaccaagacacatacctcttgcagaaacttttaaatctgaagggtaacgatggctttcgaatgaatgatgttcttgtttctctatggtacattatgggcctctggccactagtctacactatgttgctccttcctactggtagaagttccaaaagcaagattcctgtgtggccattcctggttctttcatgcatcggaggagcgtatgcgttgattccttactttgtcttatggaagccgcctccacctccaattgacgaagatgaaattggacagtggccattaaaatttcttgagtcaaagttaactgcaggagtagtgtttgccttgggcattggactgatcatatatgctggcaaagctggtggcgatgattggaaagaatttattcgatacttcaggtcgagcaagtttatccatgccacctgccttgattttactttgctatcagccttctcaccattttgggtctataacgacatgacagcaaggcgatggaaaaatggctcatggcttctaccacttgcactgataccttttgtggggccctacactatatcttgctactgcgcccatcactttcttccttgctggaagcatctgcttcaccatctgatgaatttaaaaaataattcagaactgatggagaatttagttgtgggcacatgacatgggtagagaaatggtgatctgacaactgcatttgtcagcccaaatgctatgacaattgctgatttggagcaaatgcacaattttgcatgccaccttcctgttcaaattgcatggcgatccggacaatgaagatattgccaatattatcgtcatctgggtgcctcacaaattttgtcagtgctatatttatcggttaatctgcaacgtttcaatctccgatggaagctgtgtatgtatgcaacaaactgctaggatatcatacctgtatgcataggtcattcagggtatagaaagttttgctcctattacagtgacagtaagggggtgtttggttgaggtgctaaattttatatgacaattagtgtccaatcatagactcaaaatattggtcttgcaaatattttctagctgtgtttttagttttgtaaatagtatacactagtaaaacatgctcgtgcgttgcaacggaagaaaaaactatcacccgtttt

SEQ ID NO: 12421 - DNA, 1396 bp, Sorghum bicolor
  unsure (1)..(1396): unsure at all n locations
  Clone ID: SORBI-28MAY03-CLUS99691_1
gcacgaggcccgcggcccgacagccactactagcaagtaggaactgccccgaccgagcttgctgctccggccggtgtgcgccgtgcccgtgcgcgataatggagggcgacgagaagtcggcgggcggggccccggcgtactggggcctgggcgcgcggccctgcgacgcgtgcggcgccgaggcggcgcgcctctactgccgcgcggacgcggcgttcctgtgcgccgggtgcgacgcgcgggcgcacggcgccgggtcgcgccacgcgcgggtctggctctgcgaggtctgcgagcacgcgccggcggcggtcacgtgccgcgccgacgccgccgcgctctgcgcctcctgcgacgccgacatccactcggccaacccgctggcgcgacgccacgagcgcctccccgtggcgcccttcttcggcgcgctggccgacgcgcccaagcccttcgcctcgtcggcggcggccgtgccgcccaaagcgacggccggggccgacgacgacgggagcagcgaggccgaggcggcgtcgtggctcctccccgagcccgaccacgggcacaaagaagaaggcgccaccacggaggtgttcttcgcggactccgacccgtacctcgacctcgacttcgcgcgttccatggacgacatcaagaccatcggcgtccagggcgggccaccagagctcgacctcaacggcgccaagctcttctactccgaccactccatgaaccacagcgtcttcgcgcgttccatggacgacatcaagaccatcggcgtccagggcgggccaccagagctcgacctcaacggcgccaagctcttctactccgaccactccatgaaccacagtgtgtcatcgtcggaggcagcggtggtgcccgacgcggcggctggcgcggcgcccgtggtggcagtggtcagcaggggcctggagcgggaggcgcggctgatgcggtaccgggagaagcgcaagagcaggcggttcgagaagacgatccggtacgcgtcccgcaaggcgtacgcggagacgcggccgcgcatcaagggccggttcgccaagcgcacgccgggggctggggaggacccgctggaggagcacgaggagatgtactcctcggccgcggcggccgtggctgcgctcatggcccccggcggagccgacgcggactacggcgtcgacggcgtcgtgcccacatattgatcgatctccgcagcaattgcaacgccgacatgtacactagtttgcctcgagcttttggggctgtaatttttgctgcatgctttgcatgcaaagctctcgtgtatatgagaggacttccaagcgcgcgagcgctctcttttcctccctcttctctaattcctatatagtatattattactatacgaactgctatn

SEQ ID NO: 12422 - DNA, 658 bp, Sorghum bicolor
  Clone ID: SORBI-28MAY03-CLUS99749_1
ccacaccgctctgattatgcgttacttattttatgttgtagcatgtggcaatccgtgtatccttactgttgtcttccaagccatcgtggatgatgtgggttcacgcgacgaggcaccatacccgttgacgagtggcttgatttaactatttgcacatgggccgttgcacattgctgaatgtagcagcccgatatctgtcggagccgttaagttctattttaggcaatacaagtgaagaaacttttccatacatggttttgacatccgtatgaaagtaaaatttgcagacgttgtcgatgtgggaagaaatagtccaggacctgacatgatttttatatgtgaatatgtttccatatgtgttgcgactgaatttacctaggcatgtgataagtgatttttaagagctagaatagtatttgtgcgtttccgtccccaagcacttcatgactgtatgcacttcagtactcctgttccttgcgctcagtgtcgcttgtacgttgccttctccttgtcgcgcactggttccatcttgcccgccccgacacaccaggaatgtgaaaagtccactatatgtagctagatccaagaagcataggaagatgaaagggattgatgaagtcatccaattgagtttgtgagcatgcgacgctatgctctt

SEQ ID NO: 12423 - DNA, 878 bp, Sorghum bicolor
  Clone ID: SORBI-28MAY03-CLUS101331_1
gcacgaggcaggttcggagcctcgcctgacactgacagaccctcctagtagaaatggagataaggccgagggcggcgttgtactagaaatagtcgcccggggccgatccgattagtagtgtcaccggcagcgtgtcgacgtggtcgtgtgtgtgtgttcccggggaggaagcgagctctgctctgcttgcggagcaagaagataccgtgggtgagaaaccgggggatggctacaagaagggccgtggtgagggttactgctctgcctgcgtgggcggccgtggcgaggagcatggaaggcgtaggcggcggcggcgcccgcgtgtcgcgctacttcagcgacaaggcctccggcagggtgctcagcgaggaggagcgcgccgccgagaacgtctacatacagaagatggagcgggagaagctggagaagctgaggaggaaggaggacaaggccaaggccgaggcggccaagagggccgccgccgccaaaggcgacaagaagaagggtgaggaggctcatccgagctgatcgccacacatcagatcgatactcctgtgagctgtgaactttgtgatggtgtggatactactgatgacaagtactacatggaaacagactcctctccatgcactgttgtactcagaaattgagaggaatgtttgatctcttataacttctgctcgtcgtgtgtagcccctgtcactgttgtgaactttgtttgtaggttttgtcttgtcggtgcaaatggaggcgcccttgagcctcttatatgtacacagtttatctatgggggtattgtgtttatacccttcctgagatagctaattgtaattctaccctcgttttccacgatcttgtgtttttaccctcgctctgtt

SEQ ID NO: 12424 - DNA, 1225 bp, Sorghum bicolor
  Clone ID: SORBI-28MAY03-CLUS10200_1
gcccgcggcagatgtcagccccgctgatcaagcacctgcgactgcagctgatcgtgtctactacatttatcagactctatatgactgtgaggaagtgctagctacatatcgtgaaaagggtattgctgtcccagtgccatctgaggagcaaaatctgattgataagcaccattcagaattcttgaaatatatgtcgaatgatcttaaaaccacagatgttctggatcgttgcttcgtggagctgctgaagaccataaacagcagtctgaatgatttgaagaaactgcagcaaaaaatagaacagcaaaagaagaaacagcaacagcagaagaagcagcaacagaagcaacagcagttgcaaaaacagccagaagattatattcaagcactgattgccttggaaacagaacttaaaaataaactgtctatacttggtctgatgccatcatcatctttggcagaggtactgaagcaactgaaggacaaagcattaaagcgagcagggctgactgaagaaaatttgcaagagcagattgagcagagaaatgtcgcaaggaagaataagcagtttgaggtatctgatggaatcaggaaaaaccttgctaccaagggcatcgccctaatggacgaaccttctggtacagtgtggagaccatgcgaaccagagcggtctgaataatcatgattatatgctcattaactcaacgagtgatggtgtaaaatgagatttttgcctcagggcagctatcacattttgaggactaacaaaaatcgccatctctggatgtggtattctgcagtgtagggggtccaggttgactcaccagttgaaatttgcatttctggttgtgtaagaagcgaaggaccccatatatatacttgactctttaggaggtttgagttttggttttggatgagacttgacatttccatttcaatgaacaaatgaaattttacttggtgccaaatcctacccgcctgcggaggaggaaccgagggggcgtgggaggagtacaaagtggatgcatggggaaaactacaaagcggatgcaaggtcgtgcagtgcggatgcaaatgcacccttgcatagctggatacgctagatttaaggggaggaaaaagtctacataactccccaaactatatagggtggactactaaccccccgaactattaaaccggttattctaccctatgaactttcaaaaccggtcaaataaccccc

SEQ ID NO: 12425 - DNA, 883 bp, Sorghum bicolor
  Clone ID: SORBI-28MAY03-CLUS11443_1
gtgatgcttaccacatgactgagccacatcctgaaggaagagggattactctctgcatcgaaaaggcactagctgatgcaggggtagcaagggaagaaatcaactacgtgaatgcccatgcaacgtctacacaagcaggtgacttgaaggagtacgaggctatcgtgcgctgttttcgccagaaccctcaactgagggtgaactcgaccaaatcaatgaccgggcatcttataggagcagctggtggaatagaagcagttgcttctgtacaagctataagaactggttgggtccatccaaatttgaatttagaaaatccagaggatactgtggatgtgggcgtcttggtaggatcacagaaggagagatgtgaagtgaaggtggcgttatccaactcatttggatttggtgggcacaactcatcaattctatttgccccctttaagtgaacatgaccgacgaactgccatcttcctcatcgtccaaatggcttaatatatctgggactccacatagaagacaagtggactctgcaacttcctccgttccacacatactacatggaggtccaaaccgaggttatactatgccatacacttgagcgaacaaaacatcagcccccctacatgtttcatctatatcacaaagttgcaaatatatggtaactatcaaaggacttaccgtacctgggccagtgttttcgccatcaccatacctgcccattgtcagtactatttcgtagatttggagtagtcccgtagctaatcctcttccctgtggaggtgatgggattttatgttgtattgatgttgtcaacaatgttgttagccatgaattgctggttccactgtaaacatcgctggacgtttttgctttggttgct

SEQ ID NO: 12426 - DNA, 1183 bp, Sorghum bicolor
  Clone ID: SORBI-28MAY03-CLUS9122_1
gtagccccacatgcacagactacgtaatttctcttgataaggttgatatgtcaaagggaagcagcacctatattggcaagctaagatcaaacttccttggaacaaagttcactgtctatgatgctcatccaccatatgatggagctgtggtctcaaagagtcgctctgcacgtgtggttggtttgaaccaggtctcccctagagttccggctgggaattatcctgtttcacatatttcttacgagctgaatgttctgggctccagaggtccaagaaggatgaactgtgttatggattccatcccggcatcagctgtcgaggaaggagggaaagctcctacacagactgaatttccacttagcagtcttgactctttcccatcaattccattcttcagatctaaatcagctcggatagacagttcaacatcgcagtcatccagatcggataggttggtgctgaagaacaagtctcctaggtggcatgaacaactgcagatgttggtgcctgaatttccgtggacgggtcactgttgcttctgttaaaaactttcagttggtggcttctgatgacaatggaccagggaaccaagataataacaaggtcattctccaatttggaaagattggaaaagacttgttcaccatggactaccgttatccaatatcagcatttcaagcttttgcaatttgtctgagcagttttgatacaaaaattgcctgcgaatgaggcaagaagctgggcaacaatggcagatagcaggacagcatacattatatagcctgatgctggagcaggagggctggaaactaccataccaccagaagaagtgatacaaaatgattatgagctccggtgtgaatagctgcactacaaagttggtccctgcttgttccgccgcctagtttatttttcctctgaatttcaatatatgcgcattctttgccggtgttggcaagtcaaagtctatagtgtggagaatggcttgtgctttgtgtggccactggccatcggtgagctgatgagtttgtgagaatagaggtttccagtgatagtgtgataacagacgtgattacgctgtacgagtttttgagttttaatgtttagtcagtgcttgggttcatggtgaaaagacatgctaagaggcttgtttcaactgttgaacctgcattgcgaatttgcg

SEQ ID NO: 12427 - DNA, 1166 bp, Sorghum bicolor
  Clone ID: SORBI-28MAY03-CLUS913_1
gcacgaggtgcaattataatggttgtttcagtgacagcatcaacaacaagtgggaagcctctttctgaagacaatttggaaaaaaccactgaagcatgtgacagagcccttacccttgatgcggcaaagaagaaagtgcttgattttgtagagagcagaatggggtaccttgcaccaaacctttctgcaattgttggcagtgctgttgcctccaaactgatgggtactgcaggtggtctgggagcacttgcaaaaatgcctgcttgtaatgttcagttacttggtgcaaagaggaaaaatcttgctggattttctactgcctcttctcagtttcgtgttggctatctggaacaaactgaagtatttcagagcacccctccagctttaaggactcgtgcctgcagacttattgctgcaaaatcaactctggcggcaaggattgattcaattagaggtgatccaactggaaaagctggacgaaacttgttagaagaaattcgtaagaagatcgagaagtggcaagaaccgcctcctgccaagctcccaaagccacttccagttccggactccgagcctaaaaagaagagagggggccgtcgtcttcgaaaaatgaaagaaagatatgcgcagactgatatgatgaagcttgcaaaccgaatgcagtttgggattccagaggaaagctcactaggtgatggcttgggggaaggttatggcatgcttggacaggcagggagtggcaagctacgtgtctcagctggacaaagcaaacttgctgctaaagtggccaaaaaattcaaggagaagagctatggtagcagtggtgcaacttcaggattgacatccagtttggcatttacaccagttcagggaatagagctgtcaaatccacaggcccaaggaaaccttcttggaggcggaactcaaagcacttacttttctgagaccggcacgttttcaaagatcaggaggacgcaatagaagctcttccccattgcaaccatcacatctcatttgcactgcatttgtttatatacttgatgcaccgtataaaatcccaaaagttaaactcttgctatgttccagagaggcagagactttaggatagcaatacacagttattagtgatgcttcaagcacttaatcccaggatgttttgagattcc

SEQ ID NO: 12428 - DNA, 731 bp, Sorghum bicolor
  Clone ID: SORBI-28MAY03-CLUS9166_1
caccagtttttctccacaaggactggataatggagcagtgggagaaaagttactacataacagcaattgctggatcaaccaatgggagttcattggttgtcatgtccaaaggaactccttacactcagcaatcgtacaaggttagcgaatcattcccttacaagtggatcaataaaaagtggaaagaaggatttcatgtaacatctatggccactgccggaaatcgctggggtgtagtcatgtcaaggaactcaggattttctactcaggttgtagagttggatttcctgtaccctagcgaaggcatccatcggcgatgggagagtggttacaggataacttccacagcggccaccaatgaccaagctgctttcatcttgagcatgccaaagcggaagccgatggatgagacacaagaaactctccgcacctctgccttccctagcgcacatgtcaaggagaaatgggccaagaatctctatatagcttcgatctgctatggacgaaccgtgtgctgatcgtgcacatggaagtcgaagcgagggcctcgattcaagagatgtgagatggacgttgaaccaaaatcaattctaatgataggatcagtagatctgaaaatacggtatgggtatcctaccgtgattgtaaagaaatgttgtatcgaatgccggccgtgagacctttcctggcatgaagctaatgcatttgggcagaaattcgttgttttcgct

SEQ ID NO: 12429 - DNA, 1248 bp, Sorghum bicolor
  Clone ID: SORBI-28MAY03-CLUS9222_1
cctactggaccggagacaggcagcaagcctaccttcccttcccctgttccgttcccccagcgtgcgcgctcgatctccctgcggccctccctcccgagatctcctctctccctccctcccttcgtctctctcttcccgacgattacgccaggtgcccaggtccaggtcaggtgttcttgggggccgaggttgctcgctgccgccctacgccaggtgcccaggtctcctccgggctcttcgccggcgacgagcaccaccggccaggctgagctccacagtggttcttggagaggtttgtaacagactacacctacacaaagaagagaaaaagggatcttggagaggtttgtgatagactagtgggggtgcatacacctacgcaaaagaagagaaggagaaagagagaaagttctcaatgaattgaagtccttatgtccaaaacaagagcaaggtgcaattgtacaaggggattgtggaaggagcatatcatatatttgtaggagataactttacacttgactcatgggcgactgggttataggggcgttgataaacatcgtggggagtgttgccataaactttgggaccaaccttctgaagttgggacatgatcagagagaaaagctttcctcaattaacaacagcgaaggaaatgaaaaattcgttccaacgtgcgtcatgcatttccagacttggagaataggtatactcttttttgctgctgggaactgcctcaacttcatgtcatttgcttatgctgcacagtcactacttgcagctcttggatcaatccagtttgtgtccaacattgcttttgcctactttgtgttgaacaagactatttcagtgaaagttatggtagccacaacatttattgtctttggcaacatcttcttagtatccttcggcaaccatcaatcacctgtttacacgccggagcagctgatcgccaaatacagcaatttggtgtttgttctttattgcatgtcattggtctttgttgttgcatttaaccactatctctacaggagtggccttactattatatcccattctccaaaggatgctggccaacattttcctttccagtttaaaaacttttttgcaggagtggagaaactattatttcaaatagttcaaaagatgctggcacacattggagaacaatgttgccattttcttatgctgttgtatctggagctattgggtcttgctcagtcttgtttgcaaagtcattgtaggttatat

SEQ ID NO: 12430 - DNA, 698 bp, Sorghum bicolor
  Clone ID: SORBI-28MAY03-CLUS92980_1
cctactggaagatcgagtgaagcaagcagagatgcatgcatggtaccgggcatccatctttcatcgatccaaagtcgcggcgatagtgaattagtagactactagaagatggcgcgcgtggaggctcttagcggcctctcctccatcccgctcgagtacgtccgccccgccgacgagcgagcgggcctcggggacgccttcgacctggcgcgcacccatgccaacgaccacaccgcgccgaggatccccgtcgtcgacatctcccccttcctggacgccagcagccagcagcagcgggacgcgtgcgtggaggccgtgcgcgccgccgccgtggactggggcgtgatgcacatcgccggccacggcatccccgccgagctcatggaccgcctgcgcgccgcgggagccgccttcttcgccctccccatccaggaaaaggaggcctacgccaacgaccccgccgccggccgcctgcagggctacggtagccgcctcgccaccaacgccagcgggcagcgggagtgggaggactacctcttccacctgctgcaacccgacgggctggccgaccacgcgctctggcccgcgcacccgcccgactacgtcccggccacccgcgacttcggacgccgaacacgggagctgaccactacgctgcttgccatcctctccatggggctcctcggcccagaacgcgg

SEQ ID NO: 12431 - DNA, 781 bp, Sorghum bicolor
  Clone ID: SORBI-28MAY03-CLUS8814_1
ctgatgctattccatttccgctcccgcccccgatacagcctgacccagcaaacgcaccacgccaagttaccaacgcacgcaaagcctttcccttcgcgagttcgcgtccactcttctcttctccgtcgcgtcagccatcaggagagactatagaggaaacaaccacctcttgtttggtcaagaatcgtggaggagaaccgaaaggtgcagcctttttcagcagggcatcatctgctacagccggccggttgaagcaggggagcgagagaagggcagccgagcaggagaggaacgcggtggtgcagttaccttcggtgagcagacgacgactacgacgacgacgacgacgctcagaggtttccccgttcccgacggcacgtccaccgaggcggcgccatcgcgatgggtcctctggcgctgaggtgtaataacccgccgccgccgttctccaagtcgccgggctccctgctgctgctctccaagtcgctcaccctctactgctgagctgagcccccctctctatctctctcggttcatgggcgccgtggcctcgtcggcggccggagggggccggggccggggaggcgatggcacggcgctgggcgacttgccggagaactgtgtcgcggaggtgctgctcaggctggacccgctggagatctgccggatggcgcggctcagccgcacgttccgtggcgccgcgtccggggacggtgtctgggagtccaagctgccgaggaactacgcgcgcctcctcgccatcgccgcggccggagatggg

SEQ ID NO: 12432 - DNA, 1896 bp, Sorghum bicolor
  Clone ID: SORBI-28MAY03-CLUS108_1
ccgcggggcgtacggcagcgcagcggtgccgcgagcctgccacaggtcggccaccaaacagtcaccaccgagcaggcgcaggccaacctgaaaggcggcggcggcggcggcagcaggtcactcctctgtcctctcgtctccagtccaccgcatcgccatggccccgccgcagacgctcccccggctcgtcttattcattggcggggcctggagggagccgtgcctcaagctccgtgtcgaggtagtcaaccctgccacggaggccaccatcggcgacataccggcgggcacggcggaggacgtggagatcccggtcgcagcggttgcggacgcgttctccggggacggcggcagccactggtcgcgtgcctctggggccgtgcgagccaactttctcagagcgatcgccgccaagattaaagataggaaatctgagtcctgggctttgctggagacacttgattctgggaagcctctggatgaagcaagtgcagacatggatgatgtcgctgcatgctttgagtactatgctgatctggcggaagctttagatgggaagcaacgttcaccaatctctctgcctatggaaaacttcaagtcatatgtacttaaagaaccattgggggttgttggactgatcactccttggaactatcctctgttgatggcaacttggaaggtcgcacctgccttggctgctgggtgtacagctgtattaaagccttcagaattggcttctgtgagttgcttagagcttggtgcaatatgtatggaaataggcctaccaccaggtgtcttcaatgtaattactggtctgggcctgaagctggtgctccattatcctcacatcccatgtggcataagattgcttttactcggaagtacagaaactggtaagaggataatgacttcagctgcccaaatggttaagcctgtttcattagagcttggtggcaaaagtcctcttattgtctttgatgacattcgtgacattgacaaagctgttgaatggaccatgtttgggatcttcgcaaatgctggtcaagtctgcagtgctacttctcgtctactgctgcatgagaaaattgcaaagaaattcttggatagattggtgcatggggcaaagaatataaaagtctcagatccactggaggaaggcggcagactgggttcagttgtcagtgaaggacagtacgaaaagataaagaagttcatctcaactgcaagaagtgaaggtgccacaattctgtatggaggtgcccgaccacagcatctcaaaagagggttctttcttgaacctacaattataacagatgttagtacgtcaatgcaaatttggcgagaggaagtctttggacctgtcatctgcgttaaagaattcaggagagagagtgaagctgtggaacttgcaaatgatactcagtatggtttagctggtgccgtgatctccagtgatcaagagaggtgccgagccatttcaaaggctcttcaatctgcaattgataactgctcgcaaccatgcttcgtccaagctccatggggagggaacaagcggatgtttggtcgggagctcggagaatggggccttgataactacatgaccgtgaagcaagtcaccaagtattgctcggatgaaccgtggggatggtaccagcctccatccaagctgtgaaggggcattcattccaggagaatggagcgcatcatcattaactgttcatggacaggagcttatgtatagtacagtcgtcgtcaataaaacgtctctgatgagaagttcgttctacttgcactactacatataggttcaggactgaagagtactatactagtatcatgggttgttagtctgcattcttatcattcgaagttaataaagataattggataatctta

SEQ ID NO: 12433 - DNA, 884 bp, Sorghum bicolor
  Clone ID: SORBI-28MAY03-CLUS11185_1
tgttgagatttaacactagttggacttgccttttcctaaactatgactgtggaaaagaaatggataaaactgtggattcagtggagtgtttccgtttgatcactgtggcacggggggtggctggacccattctcctctctctctcctcttcctcctcctctctccatttgtcccaaacaaaatctctccttttctttagtttccccaacctgctcctgtttatcgaattcctaaatccaatcccctcgtcaagctcgctctttgctgcgggaggccgaggccgaagaggtcgtccgggatgggatcacgaaagaggtggctccccgtggccctcctgctcttggccgcctctgccctctggccgccggtcgcagcagcagccgcagccggcggcggcggcggagaggccgaacacgccgttcagcagcatagcgagcgcatctcagggagtgctggtgatgtgttagaggataatcctgtggggaggttgaaggtcttcatttatgacttaccaaggaagtacaacaagaagatggtcactaaagatccacggtgcctcagtcacatgtttgccgccgaaattttcatgcaccgtttcttgctctcaagtgctgtccggacactaaatcccaaggaagctgattggttctatacaccagtttacactacttgtgatttaactaatgctggtctgcccttgccatttaagtcaccacgggtgatgaggagtgcaatccaatatatttcaaacaaatggcccttctggaataggactgatggagcggatcacttctttgttgttcctcatgattttgcagcatgcttccactatcaggaagaaaaggctattgagcgtggaattcttccattgctgcgacgtgcta

SEQ ID NO: 12434 - DNA, 2815 bp, Sorghum bicolor
  Clone ID: SORBI-28MAY03-CLUS112_1
cgacgccgccgcaatgctgtgcctcgtgtcgccgtcttcctcgccgactccgctcccgccgccgcggcgctctcgttcgcctgctgatcgggcggcgccgccagggatcgcgggtggcagcaatgtgcgcctgagtgtgctgtctgtccagtgcgaggctcgccggtcagggccccggaaggtcaagagcaaattcgccactgcagctattgtgcaagaagataaaactatggcaaccgccaaaggcaacgtcgaccatcttcccatatacgacctggaccccaagttggtgaaattcaaggaccatttcagctaccggatgaaaaaattcctggaccagaaaggctccattgaggaaaatgagggaagtcttgaagaattttctaaaggctatttgaaatttgggatcaatacaagtgaggatggaactgtatatcgcgaatgggcacctgctgcacaggaggcagagcttattggtgacttcaatgagtggaatggtgcaaaccacaagatggagaaggataaatttggtgtttggtcgatcaaaattgaccatgtcaaagggaaacctgctatccctcataattccaaggttaaatttcgctttctacatggtggagtatgggttgatcgtattcctgcatggattcgttatgcgactgctgatgcctctaaatttggagctccctatgatggtgttcattgggatcctcctgcttctgaaaggtacacttttaagcatcctcggccttcaaagcctgctgctccacgtatctatgaagcccatgtgggtatgagtggtgaaaagccagcagtaagcacatatagggaatttgcagacaatgtgttgccacgcatacgagcaaataactacaacaccgttcagttgatggcagttatggaacattcttactatgcttcttttgggtaccatgtgacaaatttctttgcggttagcagcagatcaggcacaccagaggacctaaaatatcttgttgataaggcacacagtttgggtttgcgagttctgatggatgttgttcacagccatgcaagtaataatgtcacagatggtttaaatggttatgatgttggacaaagcacccaagagtcctattttcatatgggagatagaggttatcataaactttgggacagtcggctgttcaactatgctaactgggaggtattgaggtttcttctttctaacctgagatattggctagatgaattcatgtttgatggcttccggtttgatggagttacatcaatgctgtatcatcaccatggtatcaatgtggggtttactggtaattaccaggagtatttcagtttggacacagatgtggatgcagttgtttacatgatgcttgcaaaccatttaatgcacaaactcttgccagaagcaactgttgttgctgaagatgtttcaggcatgccagtcctttgccggtcagttgatgaaggtggagttgggtttgactatcgcctggcaatggctatccctgatagatggattgactacctgaagaataaagatgactctgagtggtcgatgggtgaaatagcgcatactttgactaacaggagatatactgaaaaatgcatcgcatatgctgagagccatgatcagtctatcgttggcgacaaaactatagcatttctcctgatggacaaggaaatgtacactggcatgtcagacttgcagcctgcttcacctacaattgatcgagggattgcactccaaaagatgattcacttcatcacaatggcccttggaggtgatggctacttgaattttatggggaatgagtttggtcacccagaatggattgactttccaagagaagggaacaactggagctatgataaatgcagacgtcagtggagccttgtggacactgatcacttgcggtacaagtacatgaatgcgtttgatcaagcaatgaatgcgctcgatgagagattttccttccttttgtcatccaagcagattgtaagcgacatgaatgatgagaaaaaggttattgtctttgaacgtggagatttggtttttgttttcaattttcatcccaagaaaacttatgacggttacaaagttggatgtgatttgcctgggaaatacagagtagcactggactctgatgctttcgtctttggtggacatggaagagttggccacgacgtggatcacttcacgtcgcctgaagggataccaggggtgcctgaaacaaacttcaacaaccggccaaactcattcaaagtcctttccccaccccgcacttgtgtggcttattatcgtgtagatgaagaggctgaacgtcttcaagcgaaagcagagacaactggttctagaaagacttctccagacatcatcgatgttgatgctacccccgtcaaaacttctacagctactaaagaagacaaggaggcaacatctggtggcaaggaggatgcaagcaagaagggatggaagtttgcacgccagtcatccaataaaaacaccaaatgaagccagaagtccttgatcaggactggactggctgccagcgccctcttaatagtcctgctctactggactagccgctggtgcccttgtaacggtcctttcctgtagctcttagatgactggtgtcatctccgagcaagcactgcttgtatagttttctagatagtagacaagaataatcagggatggattgtgtgtatgtacagaggagccatggcctgggttcacctggattttgactgggtacatggctaaatgtgccctgtccagaattaaaacttgggggttcttggaactttgtacttt

SEQ ID NO: 12435 - DNA, 1370 bp, Sorghum bicolor
  Clone ID: SORBI-28MAY03-CLUS11331_1
gcggggcacgcgggaggcacaacaatggaggctgccactgcaagcaacaagatcgtcaatagagacgaaatcacggacgccttcaccgactctgcgcagatccccgagaagtacatccgaaccgatgaggtccgtgccggcgtcgtcgtcggtgaagacgacgactgctactgcgagctgcctgtcgtcgacatggccaggcttcttgatccggagctatctgcgtcggagacgctcaagcttggctctgcatgtcgaaactggggcttctttcagcttacaaaccatggagttgacgaaggagtgatacagcatatgaaagacaacactgccgacttcttcggcttgccactggacagcaagaacgcagtggcagtccgaggagatggctttgaagggtacggccaccactacagcaggttgtccaagcttgactgggcagagagcgtcatcctcatcacgcagccagtccaagacaggaacatggagctgtggccaactaacccacccacgtttaggcacgcgcttgacaggtactcggcggagacgacgagtctcatacggcggctcctgagctacatggcggcggacctcggcgtcggcgaagcggcgctgctggacgccttcagcgggaagcggcagagcatggcgatccaccactacccggcgtgcaggcacccggacaaggtgatgggcaacacggcgcacacggacgggctcggcctcacggtgctgctgcacgtggacgacacgccgggcctgcagatgctgaggggcggcaggtggttccccgtgcgcccgctgccgggcgccctcgtcgtcaacgtcggcgacatcctccacatcgtcaccaacggcgcatacaagagcgtccagcacagggtgttggtgaacgccgagaggggacgcaccacggccgtcgtattccaggacgcctccgtcggcgggatggtcacgccgctcccggaactcctgctcaaggccggcgaggcgccgcgctacagatcgatcccgaggtttgagtacctcaaggtcaggttcagtgccctcgccaaaagggaaggattcctcgagagcctcaagctgtagcgtctctagctatctacatacccccaacatgtttgggcagccatgttccaactgccaatgtccctggagaaataagatagacacaacacgcgaggaggcatccatgaatgaatacacgcatgtggacgaccagctagcttagttacgaatttgcgttgaaatacttttgccttagatttacaaacttccatcttactatgttaagaccagtggtgtatttcgtagtgctattttcaagattggcatgtcacataaaattaaatgaaacaaccaccttcaag

SEQ ID NO: 12436 - DNA, 1783 bp, Sorghum bicolor
  Clone ID: SORBI-28MAY03-CLUS1143_1
aaaactgcgcgtcacagtcgcatcgcttctactcctagttcgggtctcacctctcgtgcgcaaagcagtagcgggttcgggttcggtcgcctggagaaggaaaaaaaaaaggataagcaagctgcagcgcggagacgactcgactcgagcggcgaaggcgaaaaataaaaaaaagaggataaggcgaggcgcgaccgggcggccaccgcgcgctcccagatccgtcccgctcccgagcggatccagctccccggcgagcccgcgcgtggacgccgttgcctcgctcccggatcccgaccgtggggttgcagctgcttcagatccagcgttaccagatctgtgacccgctggcgcctgggcacatgacaccgacggtcttaatggagtttgggcagcacaggccaataaaacgggggtatgaggaaatggctttcaggggcgtggcggcagccacatcccgtggttacacagagactgttggcgagtcggaagtcgcagctggtagtcctgttcgtgtcgattcggaggactcttcggcaccaaagcgcaagtgcatcagcctgaacagcgatggctttgatgtgaagcgggagatctttgtgccgtctaagatgtcgtcatctgaacggcggtatcttcggaagagattccgggcagagcttgattctgtgcgggatctcctcaagaaaccagagtttgcagcccccgttcctctcagtcgggcacctgccttgtcatcctcagctgcccctcgagccaagaagccacagaagtctcagcgtggtgtggcccgtggtatccgtggtgcaaagggacgtttcttgcctacaaaacctcgacctgaacctactacggtgttatctgaagctgcagctgtttaagcagtgtgaagctattttgaacaagcttatgactcagaaatatagtcatatattcaatgttccagttgatgtagacaagctgcaaattcctgattattttgatattgtcaagaccccaatggatcttggaactgtccagaagaagcttgaatctggctcatacacaagtccatcagattttgctgctgatgtcaggctgacctttaacaatgctatggcttataatcccaaggggcatgctgtgcatgacatggccatccagctgaacaagatgtttgagagtcgatggaggccaattgagaagaagctggcttctgctgccactgagaaacatgttgaggttgacagggctgactcgaagaggaggaagacacctcctgtggaccgcagtgatgtgtcaacggaaggtgtacggcagacagagcctgaaaaaccaaagatgacagctgaagagagagaagcctttgggaactccttggcttctatatctgatgagttacctccccacatctttgaactgctgcaacaatgcatcgacagcaatacagatatgcctggtgatggagagatagagattgacatccaagctgtcagtgatgacatgctatttgagctgaagaaacatgtcgacaagtatttgcaagagagagagcagagccagcaggtgaaatctgagccttctgagaatgaagctgtgaatgtatctggccttagccactcatctacaaatccttgcaaaggtggtgagcctatcgaggaggatgtggatatctgtggcaatgcctcccctatcatgttagacaaagatgcacaaatcaggagtagcaagtgcggtagtccaagtagttccagcagcgactctgaatcatcttctagcgattccgactctggcagtgactttg

SEQ ID NO: 12437 - DNA, 1127 bp, Sorghum bicolor
  unsure (1)..(1127): unsure at all n locations
  Clone ID: SORBI-28MAY03-CLUS9532_1
ctgttttgggcttggggtttctcaagcttgatgctcgtgcacgaaaggatacgcaaaagattgaccacactgtgaaggaaagagcagcgcgccttaaccattttgccagagcatttaaggagcgagctcagtcagacttgaagaaagctgcagacaaacattggagtgacggtgctttggaggcagatctgcgacgagctgacttggttgttaaacgacgtgccatggaagacgctttcatggcattgaagtttgttcaggatattcatgacatgatggtgaacagattatatgagcagcttccaaaggacggttcatcttctcgtacaaattcaacagggtttattacacttgagaagaatgggaagactcttgaactgtttcctggtgaagtttctgctgatcagatttatgctatagaggaagcataccagagtatggcatctgccttttctgaagctgatggtattgactacacagatcctgaggagcttgaattgttagtagcaactctaattgacctggatgccatggatgggaaaaggagcgtttccttgattgctgaatgttcaagctctccagatgttaatactaggaaagccctagctaatgcattggctacagctccatcgatgtggactcttgggaatgctggcatgggtgcattgcagagattggctcaagatcccaattatgctgtagctagggctgcatcaagcgccattgatgaactcaagaagcagtgggaacttgaagaaggtgacagtctgaggtttgtaatgaatcagaatttggcttctgaggatactgatggtgacgacaattcagcagcagatgacgacacatgaggtgtaaacaagttgaaagattccaatttcaatgacaatgggccaatgcataagaaatcatcatggacagcacataaagcattcctgtttaacttttaggactgaagatcagatagatataggtgttccatatatatctagttgaaggaaaaaaaatgtgttgtggaacttggtaaatgggggctaaaaagcagagttccctttggatattgttcatacgtgaagctgtatgttgtatttgaaaagcacgtaaaagtgaacannaattccccttgtggg

SEQ ID NO: 12438 - DNA, 1506 bp, Sorghum bicolor
  Clone ID: SORBI-28MAY03-CLUS9661_1
gccggccgggtccgaaaaaaatccaagaagctaacatgagggatgtcagtgaaaagacgaattctagagtcacgtggttgagcatgctttctcttagtgtttgcattgcagtctctgtttcacagttgtggcatctacaacagtacttccggaacaaggagctcatctaactaatgcccgtaatacagtcctctactctgtaataagcctatctttatgctttgtgtttttgcatactgaggtctgatagtttcgccgttgagtctagcgatttgtaaataaactggtaacaacctgaaatcccaagtcatgacatgagactgctgttttccttgttcaaaaaaaaaaaaaaaaaaaaaatctcgccgcgccatggatttctgccgccacctcctcctcgccgcggtgctcgtgctcgtgctcgagctcctccttgccggctgcgcctctgcggcgagccggggcgctggttccttcgacccctcccgcgtggtccaactctcgtggcgccccagggcgttcctgcacaagggtttcctgtcggatgcggagtgcgaccacctcatcgtgctggccaaggacaaactggagaagtctatggtagcggacaacgagtccggtaagagcgtccagagcgaggtgcgcaccagctccggcatgttcctggagaagaagcaggatgaagtagtaaggggaatagaggagaggatagctgcttggacatttcttccaccagagaatggtgaatccattcagatattacactaccagaatggtgagaaatacgaaccccactatgactacttccatgacaaaaataatcaagccctgggtggccatcgcattgccactgtgctcatgtacttatctaatgttgagaagggtggagagaccatcttccccaatgcagaggggaagctattacaacccaaggacgacacatggtctgattgtgcaagaaatggatatgcagttaaaccggtaaagggtgatgccctgctgttcttcagtctccaccctgatgcaacaacagactctgagagcttgcacggtagctgccccgtcatcgaaggccagaagtggtccgcaactaaatggatccatgtgaggtcgtttgatctccctgtcaagcagccgggttcctctgacggatgcgaggacgacaatgtcctctgtccccagtgggcggccgtgggcgagtgtgccaagaaccctaactacatggttgggaccaaggaagctcctggcttttgccggaagagctgcaaagtatgcgcagagtaaggtattgttaatccactgtctgatgagtatcatggcgtgtcgcatagtttctgttcccattaccagggtttagatacgactgtttatagcatgtataagtgcaacccggaagaaggaatcgtaagaggtacgagaactcatgccttgtccatccaaagttcaaaaatgcggacgggttcccttgttgagttgagcaatctaatcaatggccagggtcgggcc

SEQ ID NO: 12439 - DNA, 733 bp, Sorghum bicolor
  Clone ID: SORBI-28MAY03-CLUS9831_1
tctggaggcattctcgcttagtcctagaccactatatatacagtactcgtccccgctttcttcctcgccaacttctcatcatcagccaagtgtaaagggtgcgaagaaacagcagcaaaaggattccattctcgtgttcttggagtggtccatcgagcttcgtcagggagagctattgagagagagagagagagagagagagagagagagcaagcaatggcgaccgcagggaaagtgatcaagtgcaaagccgccgtggcgtgggaggccagcaagccgctgtcgatcgaggaggtggaggtggcgccgccgcaggccatggaggtgcgcgtcaagatcctctacaccgcgctctgccacaccgacgtctacttctgggaggccaagggccaaactccggtgttccccaggatcttaggacacgaagcgggaggcatcgtggagagcgttggggagggtgtgaccgagctcgcaccaggcgaccatgtcctcccggtgttcaccggcgagtgcaaggagtgtgcccactgcaaatccgaggagagcaacatgtgtgacctcctcaggatcaacgtcgaccgcggcgtgatgatcggcgacgggaagtcccgcttcaccatcaacgggcagcccatcttccacttcgttgggacatccaccttcagcgagtacaccgtcatccatgtcggctgcctcgccaagatcaaccccgaggcgcctctcgacaaagtct

SEQ ID NO: 12440 - DNA, 1119 bp, Sorghum bicolor
  Clone ID: SORBI-28MAY03-CLUS9707_1
ggccagggcgggtggtgcgagtgcgcgggggaatgtgaggacgctctccgatctcggtggtggcaagggaaccgcggggtccgacgagaactccgaagacgacgatgaatgggcaccaccaccggagtacttcactgcccgcgggacgagtggaatggttgttagagatcgatcaaaacgtaaaaacaacacagatgaggtattcaagcaagctaaaaggaagggggctaagcaaggtccgtttgaggctcgccggcgatctagttcgaggaactttactgggactggcagacttctgacaggtgaaactgtagagcgtgatgcaccacagccaccagaagaaattgtccataacatctacttctggaggaatggcttcacagtaaacgatggcccacttagaagtttcgatgatccagcaaatgcgtcctttttgaagagcatcaaggattctgtctgcccaactgagcttgagccggctgatgggaaatctaaggtgaatgtgaatcttgtccggaaggaagaagaatttactgagccagtcaagcatgctgctccttttgaaggggaacgcaggaccctcatggaaccttctgacaataatacttccaatgctgctgcttccagtagtgtacctgctcctcggacaatcacagtggatgattctttgccatcaacctccctccaaatcaggtttgcagatggcagtcgcttggttgcccgtttcaacacaagccacacaattggcgacgtgcggtcatttatcgacgcgacaaggcctgcatccagtgattacacgctgcaggccgggttccccccaaagccgcttgaggacgcgaccaagaccattgaggaagccggcatcgccaactcggtgatcattcagtcggtctagctggggaaaacaggtgctgaccctattccgtcaaacacgctaggcatctgaagctatcaccacctcccttgctttgctgttccttcattttgtttctcatcaaacctggcatttaaccttctatatggcttcgtcgtccagtagctgcttctggtattgggagtgtaaaaacagtgagatctgggtgtcccccatcttacattcatctaaagcatatagtacag

SEQ ID NO: 12441 - DNA, 1551 bp, Sorghum bicolor
  unsure (1)..(1551): unsure at all n locations
  Clone ID: SORBI-28MAY03-CLUS9884_1
gcacgaggaggatgcacatataatagggaggcagaaggttactgccctatagtaagctatagtggggacttgcccaaatgggctcaatattttccccaaggcaataaaggtggtcagtcttcattagcagactactgcacatactatgttgcttattctgatggttcatgcactgatgtaaatagtgcacgggcgcctgacagaatgttaggtgaagtgcgaggaagtaattcgaggtgcatggcctcaactctagtgccacctgggtttgtacggggatctatgacccaaggaaatggctgttatcagcatcgctgtacgaataactcactagaggttgctgttgatgggatctggaagtcatgtccacaatccggtgggcctgttcaatttccaggattcaatggggaattaatttgcccggtgtatcatgagttgtgtactactgtaccagttccagtgactggccaatgtccaaagtcatgcagttttaacggtgactgcattgatggaacttgtcactgctttcctggttttcatggtcatgactgcagcacaggatcttgcccagacaagtgcactaaccatggtatatgcaaagctaatgggatctgtgaatgtcaaagtggatggacagggattgactgctcaacagcggtttgcgatgaacaatgtagtttacatggaggggtttgtgataatggtaaatgtgaattccgttgttcagattatgcgggctacacatgtcagaagggttctgcaatactgcccagtctgtcaatgtgtcatgatgtacttgttagagattcagaggggcagcattgtgcgccaagtgaactcagtatattgcagcagcttgaaactgtagttctggtgccaaattacaatagattgatgccaagtgggcggaccttccttaacttcttcaacaatgccaattgtgcagcagctgcaaagcggctggcctgctggatctcaattcaacgttgtgatgaggatggagacaacaggctccgggtatgctactctgcatgcgaattgtacaacacagcttgtggagcgggtctggattgttcagaccagaccctttttagcaaaagggaagaagaagagaagggtgttccttgcacaggatatggcgagaagaagtctttctggctataacatctctgaagcttcttctcttatggctctggcagaagctcagtgattgtgtaaagtatatttgacagtgttccaccccatattctttttttctcttcttttttttcccatttcatccactacttcccaattgtaggatacgggaagtaagcggtccatttcacctaggcacccgaagatgggctgcctggtgtacaagctatgttggagtgggctctttgttagaaggttagtctgacatgaaaaggggagtggggagctggaggtgaaagttggatggtagatttttggttttcaccgcatcagaattagtgaacgcaatgtaaaggttgatgtgtgttgtactcactctttacagattcattttaatccgagggggggncccgg

SEQ ID NO: 12442 - DNA, 891 bp, Sorghum bicolor
  Clone ID: SORBI-28MAY03-CLUS9692_1
cagaagggtactctggtagtgatctcaagaacctgtgtgttactgctgctcatcgtcctattagggagattcttgaaaaggagaagctggagagagcttcagcagaagcagaaaatagatcgttgcctatgtcacacactagcaatgatgtactttttttaagatttggtaatttcatacatgcacactgctaaggctgtggcagctgaggctgaggctaatttcataaacatgagcatgtccaatataatgatctctatggagggggcgggtcgaggaaaaagacaacgctaagctacttcatgtagcttatgctgtaaatataatagaggtgccctggtacaaagcagcaatggttggaggcagttgggtttgtatttggtgcatagttggaaaagagctatgctcatctgccagccatacatatcaagagaattgatggttcaggtggactggaatggaatagtacacattggttgctgccttcactctgggccatgcatcatgcatctagacaggacggctggtctggcttgcagttgccctactgcagttttgagtgcaacggatcaccatcaaggaaagaaaagaaaagaaaatatatcagttgtgttttccccaatccccaggaagcacggagacgacagcgatccttttgccacaaccactcttttcgcttcttagaaacaattcattccttaggttgtataagatgtagtcagtatagcctgtgcaagtgtacagtatgagcatcagggctattaacgtactgtgatggtctatgcctaatcccagtttattaattagaatcgtttaacatgcaatgattattttgtacctacatgcgtttatatcatgttaccaaggatgtatgcaatgtaaactgttatt

SEQ ID NO: 12443 - DNA, 384 bp, Sorghum bicolor
  Clone ID: LIB3478-013-P1-K1-E5
ggcaactgaggctggtgctaatttcataaacatatcgatgtcaagcatctcttcgaagtggcttggtgaaggagaaaaatttgtgaaagctgtgttttcgctggcaagtaaaattgctccaagtgtaatttttgtggacgaggttgatggcatgctgggaaggcgggagaaccctggagaacatgaagccatgcgtaagatgaaaaatgagtttatggtgaactgggatggtctaagaaccaaggagaaagaacgtgtattagtacttgctgcaactaacaggccatttgatcttgatgaggctgttgttaggcggcttccaaggaggttgatggtgaatttgccagatgcatcaaataggagaaaaattcttagtgtaatact

SEQ ID NO: 12444 - DNA, 1398 bp, Sorghum bicolor
  Clone ID: SORBI-28MAY03-CLUS12169_1
gcacgaggcactgacgtccgcctggccgccatggccgtcgtcgcccgagcccgcggcgggctggagaagctcgccgtccgcggcagccacccgacccgtggcgtcacggaccaaggtctctcggcggtcgcacgcggcagccccaacctcggctcgctcgcgctttgggatgtgcctcttatcaccgatgctgggcttgcggagatcgccgccgggtgcccctcgctggagcgtctggatatctctcgatgccccctcatcacagacaagggcctcgcagctgtcgcgcaggggtgccccaacttggtgtctctgaccatcgaggcatgctccggtgttgctaatgagggcctgagggcgattggccgcagctgcgtgaagctgcaagctgtgaacatcaagaactgccctcttgttggtgaccaaggcatctccagcctggtgtgctctgctaccgcttcgcttgctaagatccggctccagggattgaacataactgatgcttcgcttgctgtgattggatactatgggaaggccgtcactgaccttacactcactcgtctcgctactgttggtgagaggggtttctgggtgatggctaatgctgctggcctgcagaatctcaggtgcatgagtgttacctcttgccctggagtcaccgatcttgcgctcgcttctattgccaagttctgcccaagcttgaagcagctttgcctcaggaagtgtggacatgtgtcggatgctggccttaaggcgttcacagaatcagcaaaggtgtttgagaacttgcagcttgaggaatgcaaccgggttactcttgtcggtattcttgctttcctcctcaactgcagccagaagttcagggctctctctttggtgaaatgcatggggatcaaggatatcggctctgcgcctgcacagcttcctctttgccgatcacttcgtttccttacaatcaaggattgcccaggtttcactgatgcaagcttggctgtggtggggatgatttgccctcagttggagcaggttgacctcagtggtcttggtgaggtcactgacaatgggcttcttccattgatccagtcttctgaagctggtctgatcaaggttgacttgagtggttgcaagaacatcacagatgtggctgtctcctccctggtgaagggacatggaaaatctctgaagaaagtcagccttgagggttgcagcaagataacagatgctagcctattcaccatgtccgagagctgcactgagcttgcggagcttgatctttcaaactgcatggttagtgaccatggtgttgccattctggcatctgcaaggcacctcaagcttcgtgttctctcactgtctggttgctctaaggttactcagaagagtgtgccgttcttgggc

SEQ ID NO: 12445 - DNA, 982 bp, Sorghum bicolor
  Clone ID: SORBI-28MAY03-CLUS11518_1
gcacgaggccccaggacccctgggggggccaggggggttttggtccccccgcccccctccgggtttggtggggggcctggtggtggggggggtttgccggtttcccctgcctccggtgccgaccccgggcccccccccattaggaggtcctgggggggggggggggctcgacggttggaacgattaagtattgggggcagcaagcaggagaaagctttgaggaataggtgctttggtggtagagttgctgcaactacacaatgtattcttacctcagatgcttgtcctgaaactcgtccttgtccaacgctgcccccttctcagagggttgcttactgagagaatgcagcagcgagcattctgtgattggagtctgctcacgtgtcagctatggatgtgaactcaaggactgtgtgatgatgggagcggacatctatgaaactgaagaagaagcttcaaagctactgttagctggggaggtcccagttggaataggaggaaacacaaagataaggaactgcatcattgacataaatgctaggattgggaagaacgtggtgatcacaaacagtaagggcatccaagaggctgatcaccctgaggaagggtactacataaagtctggaattgtggtgatcttgaagaatgcaaccatcaaggatgggtctgtcatataaaccgggtgcctgtgcgcctgcaaaacaagaacctacaatggtatcacatcgatggatcgtgtaaccttggtagggaagagccgcttgccagaaagtccagcgttcgggcgcaagatgcatagcctggcatgctgttccttgaaccttggtacaatgtactaataagctgccctggaagttgcagcaaacaaaccttttatgaacctttgtatttccgttacctggtttggattaactctatctttcatcctgtgctactaaaatttccgtgtttttctaaaaaaaaaaaaaaaaaaaggccccta

SEQ ID NO: 12446 - DNA, 385 bp, Sorghum bicolor
  unsure (1)..(385): unsure at all n locations
  Clone ID: LIB3478-030-P1-K1-D12
agaaaaagttatgctgatgcaaaccatgtatctgctatcattttgggtggaggcactggatctcagctctttcctctgacaagcacaagagctacgcctgctgttcctgttggaggatgttacaggcttatcgatatccctatgagtaactgcttcaacagtggtataaacaagatatttgtgatgactcagttcaattctacttcgcttaaccgccatattcatcgtacataccttggaggcgagatcaactttgctgatggatctgtacaggtattagcggatacacaaatgcccgaagagcctgatggatggttncagggtacagcagactctgtcagaaaatttatctgggtactcgaggattattacaatcacaaatcta

SEQ ID NO: 12447 - DNA, 1393 bp, Sorghum bicolor
  Clone ID: SORBI-28MAY03-CLUS12332_1
aaccgaagggggtatattttttatttgacatcagggcctgagacctcatgttaataagggagctagctgaaagctgaagctaaggagcttcagtaactgacttgacaatttgtaaaaatagtcaagctgtcgatggacgtctatttttgagggccatccagaacggcagctctggttgctgcccaggcatcagcaatgcttgtgaaatggagtggaaagtttatttactgagacactcccctgttgaacttctgcttttggatatgtcggctttagaacaaagcaggggccacttctttcgagcaagaagcgcatgatatgatctatttcatatacatactatgctatatatggtattcagtactcagcgcacacatctcatctacatcctgaatttacccgattccgctgcaacgttacaacaattgcaagacgagaagaaaaacgactggtttctccgcactatactgctcttactcaatctccaatgtatgtacaccatccagtgaccattttccacgttggatcaatcctgtcttcagtttgcttcgcacattccagtagctggatcacagaaaccatctcggtcaagaagcttttgtggcggggcactcaacagaggggatgaagggctcccatatgcatttcgacggctattgccacatcctaggctttttcgggtgctaacccctgttatggagttggtcccacttgcatatttgcataatgcctgtttctgtggtaggtcaataacagcatcactgaagtcagcaccttcaatgatcgctcctccaagatcactacgtgttaggactgaccgtacaagaacagcgtttgtaaggttagcttcatttagaaccatgcggtccattaatgtatcactcaaatcggcaccagtgaaatttgccttataagcaacagccttttcaagataggcaccattgaatgtggaaccactgaaatccgactctctcatatcagcggatgtgaagttggctcgcctgaagttctcgttaacgtggacagccttcttgagatcggccgagccgaactgcgcggcggagccaatgccaaactcgccccgctgctcggcttcaaacttgttcaggtccgcgtaagctggcatcgaggcggcgaccacggccgccgcgagcacggcggataccgcggcgcgccaccccggctgctgctgcggcgcccgcgaggcgttcgatgcattgccgcccccgcggcgttcgggcgccgccaggcaggagacgcgcgggaggcggcgaggggggcagcgagagaaggaagcctcgtgcgtgggtaggacggcggcggcgagagggaaggtggatgcgggagtcatggcggcgacgggttaaggcgaggagcagtggccgcagggagt

SEQ ID NO: 12448 - DNA, 1188 bp, Sorghum bicolor
  Clone ID: SORBI-28MAY03-CLUS1225_1
gcacgaggccaatcccatcctcatgataaataaataaagaataattgccggccggctccttctctctcgatttctcgcgcagcggtccttccccttctctcgccgccgccgccgccgtgttccgtcccgtcgccgatggcttccgccaagttcggtgctgtcgcgcaggtggagaaccgaggcgcgctgtcgaaaaggtcgcgcaacgacgtgtctgtaagggagggggactggaattgtcctcagtgtggtaatgtcaacttcagttttagaaatgtttgcaaccgtggagcctgtggtgcaccccgtccatcaccgagtccaagtcctagaatgatgccagcacctcctcctggtggatatgaccggtcacctctattttacggaggaggtggtggtgccccacctccaattcctcttggatctggtagctatggtgctccatatccgcaccttgggatgcgatatggttatggtccaccagtaggagctcctggttcatatggccttttctcgtcatatggtcaacctgggccaatgagtggtatgggatatggcccaggacctgagctaggccgatatagctatggctttagaggttctccaatgccggtttctagcccatggtctggtggagcattagctgaaaacaatgacaatattgcttcacgaaagcgccgtggaggccctgatggactttctgaggggcactagacctgccccaaatgtgacaacattaacttttccttcagaaccacttgcaacatgaagaaatgtggagccccgaggccaacttctggaggtaacacgagctcatctcgcaaggacaataacaataaggaagcccctgaaggaagctggacctgcccagagtgcaacaacctgaactacccgttccgcaccgtgtgcaacaggaaaggatgctcgtacagcaagccagccccgacgaataactgaacccaaccttgcgcacagcgcaccatattgttgagagccatcgtcgaactattgttgtacccgtagattgtatcctagtcgtgtgtaatctttaaactgcacaaaaatgtttgtgcctggagacgagagattctattcgttatgttatgtttaatttacttgttaatttgttatacattttaaatgctgaaaacaagtaaatagcattgtacttaaaaaaaaaaaaaaaaa

SEQ ID NO: 12449 - DNA, 435 bp, Sorghum bicolor
  unsure (1)..(435): unsure at all n locations
  Clone ID: LIB3476-055-P1-K1-E10
gccgccgccgccgccgtgttccgtcccgtcgccgatggcttccgccaaggtggagaaccgaggcgcgctgtcgaaaaggtcgcgcaacgacgtgtctgtaagggagggggactggaattgtcctcagtgtggtaatgtcaacttcagttttagaaatgtttgcaaccgtggagcctgtggtgcaccccgtccatcaccgagtccaagtcctagaatgatgccagcacctcctcctggtggatatgaccggtcacctctattttacggaggagggtggggcncccacctccaattcctcttggatctggtagctatggtgctccatatccgcaccttgggatgcgatatggatatgtgccaccaagaggagctcctggttcatatggccttttctcgtcatatggtcaacctgggccaatgagcggtatgggatat

SEQ ID NO: 12450 - DNA, 1549 bp, Sorghum bicolor
  Clone ID: SORBI-28MAY03-CLUS12408_1
ccgcgcccgcctgcccgcccgcgccccgccgcggcgtctcgtcccgcgtccgctgggtccggaatagttgtgcgcgctccgcccccccaaccccacacccgcctgctctctctctcccctcctcgtcgtctcgtctcgcgtcgtctgcgctcgtcacaggcctcgactgccgagtgggaggagaggggcggcggccggtccgtcatccgttggttcgggaatggcggcgcaggcggtggtgccggcgatgcagtgccaggtcggagtgaaggcggcggcggcgggcgcccgggcgaggccggcggcggcgggaggcagggtgtggggcgtcaggagtaggaccggccgcggcggcgcctcgccggggttcaaggtcatggccgtcagcacgggcagcaccggggtggtgccacgcctggagcagctgctcaacatggacatcccgccctggcaacaacattttggttatctgtgatacctacacgccacagggtgaaccgcttccagaagcaaatcaacacagggctgcgcaaatttttagtgaccctcggaactagaacaagtgccatggtttggcatagagcaagagtacactttgctccagaaagatgtgaattggcctcttggttggcctgttggaggctaccctggtccccagggtccctactactgtgctgtaggagcagacaaatcatttggccgtgacatatcagatgctcactacaaggcttgcctttatgctggaattaacattagtggaacaaacggggaggtcatgcctggtcagtgggagtaccaagttggacctagtgttggcattgaagcaggagatcacatatggatttcaagatacattctcgagagaatcacagagcaagctggggttgtccttacccttgatccaaaaccaattcagggtgactggaatggagctggctgccacacaaattacagcacaaagaccatgcgtgaagatggaggatttgaagatatcaagagagcaatcctgaatctttctctgcgccatgatttgcatattagtgcatacggagaaggaaatgaaagaagattgacagggaagcatgagaccgctagcatcgagaccttctcatggggtgtggcaaaccgtggctgctctgttcgtgtggggcgagataccgaggcaaaagggaaaggttacctagaagaccgtcgcccggcatcaaacatggacccatacattgtgacggggctactggctgaaacaacaattctctggcaaccaacccttgaagcggaggttcttgccgccaagaagctggcgctgaaggtatgaagcagttgaaggatgcttcaggcacgaataaacaggcccacaacaaaattgattctgctgttcactggccttggtcccgcgactctgctcggcgccactctgtacaaaattaattaccatttctggaccacattgtctttgattcatcggttacggttgttacatttgccggggacaccatcacaccatgtttggacttggcctgtactttttgtagcaatttttgtggcaagg

SEQ ID NO: 12451 - DNA, 1726 bp, Sorghum bicolor
  Clone ID: SORBI-28MAY03-CLUS10317_1
tactggctccccactaccaggaggggtttccggggcaggagaagaatcagcggaaggttctagcaggttccactcgaagtggtgggcgttccctctcgccgtccacggtgatggcgatcctcgagaggtcgtcgtcccccgccgcggcctccgtcgccgtcgcggccctgatcgcgctcgcgtccgtcgccggcgtcgccggcgaggtcttcttccaggagaagtttgacgatggatgggaggatcgatgggtcaagtccgactggaagaaggacgacaacacggcaggcgagtggaaccacacatctggcaaatggaacggagatgccgacgacaaaggaatccagacctctgaagactacaggttctacgccatttcagcgcagtaccctgagttcagcaacaaggataagaccctggtgctgcagttctcggtgaagcatgagcagaagctcgactgtggcggtggctatttgaaattgcttgggtctgatgttgatcagaagaagtttggtggcgacaccccatacagcatcatgtttgggccggatatctgcgggtatgccaccaagaaggtccacgctatccttactaagaacggcaagaaccatttgatcaagaaggagctcccgggcgagacagaccagctgacacatgtttacaccctgatcatccggcctgatgccacatacagcattctcattgataacgatgagaagcaatctggtagcatctatgatgattgggatattcttcctccaaagaagatcaaagaccctgaagccaagaagccagaagactgggatgataaggaatacattcctgatcctgaggacaagaagccagagggttatgatgatattcccaaggaaattcctgaccctgatgcaaagaagccagaggattgggatgatgaggaagatggtgaatggactgccccaaccattcctaacccagagtacaaaggaccatggaagcaaaagaaaatcaagaatccagactacaagggcaagtggaaggcccctttgattgacaacccagatttcaaggacgatccttacatctacgcttttgacagtttgaagcacattggcattgagctgtggcaggttaaatcaggaactttgttcgacaacattttgataactgatgaccctgagtacgccaagaagttagcagtggagacctggggcaagcagaaagatgctgagaaggctgccttcgacgaggctgagaaaaagaggcttgaggagtgtttctctttgacaggaatctgcaagcagtaaggacgacgatgacgacttagatgtagatgaggatgaggatgatgcggacgatgacaaggctgatcatagtgatactgatgaggccgaggacagcgaagaggctaaacatgatgagctctagagcacgccgaggtagaggaataccatctttttcttttcagtttcagtttcaatcggagctgttgatgacagagttatcatcccatcccaacagaagaaggccgcagggcgtgcgccggtctcgacatatagcgagtagttgtccatccctctgtaacactactgagggcaattttcattttcccactgtagtgtcaattccccaaatgcgggccgtagtcagacatcgtgaaaccaagttttcgtcagtgttgcgtagacatattctttggtcgttgcccaagttatattaatttgcattccatgggcggaaaaatgcc

SEQ ID NO: 12452 - DNA, 1702 bp, Sorghum bicolor
  Clone ID: SORBI-28MAY03-CLUS10504_1
ttactgagtaacataaacacatcaaggctaagattcacccatccagaccttcctcagaatatctgcaaggccttgggcatcaaaaagctctctgatgtcattgtggaggaacttgatggaaaagaagaaattaaagttgtcagtagtattcactcagttagtctagacagaataaaagagaagctgcaaagtgaatctttgcaaaatgcattaaggattgtgatgatcagcgtaaccaatcatttcccttcatttgaagcccttgctttggtccagatagaacagatactagaggatatatcacagaaactgcaactggttcagtgcctccatactcgctttctcttacttcccacgcgccaagatgttacaagaaccatccagcatccttctattcatgaatggtcaagcaatggaatgcacagaagcatttgtttcatcaacaaatctacgggttatattctggtcgcagagcccccaagttttttgacaatatatgacgttattgcaattgttgttagtcacaggttaggggcaccaatgatcttgccgattgcctcactgtttgcatgcctagatggttcagagaaagaagtccttcaaattctacacctgggttcagacgttggagtttcaaaacgtgaagggaggtatgatgcttcccttggagcagagttgttatctcaagatgctcggcaggtgcaattccttccattaagaccattctatagtggtgaaattgtggcatggaagacaggaaaagagggggaaaaactcaggtatggtagggtccctgaagatgtaaggccctcagctggccaagcactttacagatttccagtagagacagctcctggcgagactcgcatgctgctttctagtcatgtttactcatttaaaagtgtttcaatggctgatctcctatctgcaccttcccaagtgaatggtggtgtggcattagccaccaacactggcactgaagtcatcaaggatgcggatgctgggcttcaatatggaaaagtatcttccactgagctggtgcaagcagtccatgatatgctttcggctgcaggagtaaggatggatgctgagaaggaaacactttttgaggctactctttccttgcaagatcagcttaaagaatctcaagttgctctcttggtggagcaggagaaggccgaagcagctgtaagagaagctgatgtggccaaagcagcatggtcatgccgtatctgcctgaatgctgaggtcaacatgaccatagtaccatgcggtcatgtcctatgtaaccgatgctcaagttcggtttcacgatgcccattttgccggacgcaggtggctagaatgatgaaaatattcaggccataaaaatagtggaggacatttggtctgactaaccgtaggattcagcttgtgaatgtgttacgatatcggggctcccttttggttgtgcattgcattcccttttggactgttctgacgcatctcattctccatgatgatttgctaacagtgggacagtcgagaggtcgccctttggtagtccggtaggagtgtaaatatagttactttgtacaggaacgatgcattgcagtgtacagattctaaaaccatatcactatacaaaatgatgcattgcagtgtacagattctaaaaccatatcattatacaaacttcaaagcccccccaatgttttctttg

SEQ ID NO: 12453 - DNA, 1224 bp, Sorghum bicolor
  Clone ID: SORBI-28MAY03-CLUS10799_1
gcacggcgcgagagcgagacgcggagccagagccaccgcgttccggagagacacgcggagagcgaaggcagccgccgcgacgatgtggagctcggactccgaccgcgacgagcagcccgtcgacacggcgaccaccaccaccacctcgtcgccggcgcagcagccgtcgacgccgcccgcgccgcctcggcgccggcgccagcgcgcgcgacgccgcgcccagcgcctccgtgccaagaacaccggcgcaggagaggaggaggaggaggccgaggcggaggacgtctggcgtgggctgcagcagcagcagcgggagcgggaacgggaggcgtggccgcggcgggcgtcgaggcccgtggtggttgccgccggcgaggaggggtccccggacgccgcttctgccacctcaggggagagcgtcggcgggatggggagggcgcggagcctgaccgacgacgacctggaggagctcaaggggtgcgtggatctgggcttcggcttcagctaccacgagatccccgagctctgcggcacgctgccggcgctcgagctctgctactccatgagccagcgcttcttggacgaacaccagcagctcagcaaggcggcggaggaggcgccggcgctggctccggcctcgccagcgcagcccgtcgccaccaactggaagatctccagccctggcgacagcccggacgaggtgaaggcgaggctcaagtactgggcgcaggcggtggcgtgcactgtcaggctctgcagctgatcgatcaatggcgccaccatcaattttgccaagaaacttgctacaggacgaggatgaaagaaacacagggcatctgctcaacttgcagcaatcgtggcaccgccggaccaacctgcaacaagagcatcccatgctgcatccaaaccaagatgcttggactctgcatcgcatcggagcgtcacgatgatcattcattcattcatccatcagacagaagcacagagacagagttgtgaattcagatcttgctcgaaattttttgctgagatatgtgcaggaaaggagggatagagaaagggagagggggccaggtcaccaacagccattgtctgatgttgtactctactgacacgaatccttgattctcgccttaatttttgctcatgtaaaacaacaccacacctgtgtaaaatatacccttgaatcctgattggatcagaaataatcgcataattccactc

SEQ ID NO: 12454 - DNA, 1348 bp, Sorghum bicolor
  Clone ID: SORBI-28MAY03-CLUS11078_1
gcacgagggcggaccaggcgagcccggagggagcgccgtggtgttctcgcccggcgtcggtttcgccgaatcgaacaccatggatgacagcagttggtggtatgggagcgtccgcacgccgaacccagtcatgtcgcggacagcacgaggctccgccagcctcgaggcaaccacctcagcgaatcatgctcttgaaagcgagtcagactccgacagcgaatcactctacgaggtagagggagttccatatgagcgaggcaacaaatctgtagaaacaaagcgaataagaaggatggtgtccaacagggagtctgcgcgacggtctaggcggagaaagcaggcacaattgtcagaacttgagtcacaggttgaacgacttaaaggtgaaaatgcaactctgttccagcgactttcagaagccaaccagcagttcagtactgcagtcacagacaacagaatcctcaagtccgatgtagaagcattaagagtcaacggaaagatggcagaggatatggtagcgagaagtgctatatcctgtggcctaggcgatcttggcctggcaccatatctgaactcaagaaagatgtgccaagctttgaatatgctcacaaccacaggtttggatttacttgggagtgatgcgttcagaggtccaaccacagctccacaagtacaaaactcaccagtacaaagcactgcaagcctagagaatctggataatcgaaagtccaacgaggtgaccagttgcgcggcagacatttggccttgagcttcaagccattgatcaggttcaaagcttgcttcacccaaaaaacaacaacagtagttcatcaactcaaataactggtggcttgagcagagcttctggcacaaattcccttgaaccatatttccatagaagctttataggatgcatcactcttttgatgtaactatgtgtgtagtacgtctccagtgggaaagtaccatttactggcagctgccttggcagatagggtaatgtcaaacaaggcacctgtatagtttcaagtagaaaatgaactgtctttgtacagtacaaagctgcaaatgcaaactttagaagtaaaatcaatcgtcctgaataaatgtgtgaagaaggaatgatacttaggtccctttccaggtcaggtgagacagttatgtttacaacaaagggcgatacattttgtttcaaaaccattattaatacataggaatgttcaatccagtacaagtcatgtagtaggtttgcagcactacctctagtagattgaagcatgtattcactatttttttgggactacaactgtacatgtacatcatgatggtaaaatgcataactagtgag

SEQ ID NO: 12455 - DNA, 925 bp, Sorghum bicolor
  Clone ID: SORBI-28MAY03-CLUS11098_1
ctgaatgtggcaaaaccagtaaagggttcgacagtggcgattttcggtcttggtgctgtgggccttgctgctatggaaggtgctagactggctggagcatcaagaatcttcggtgtggacatcaacccagcaaaatacgagcaagctaagaaatttggctgcactgatttcgttaaccctaaggaccacgacaagccagtgcaagaggtactgattgagctgaccaatggtggtgtcgaccgcagcgtggagtgcaccggcaacgtgaacgccatgatatctgccttcgaatgtgttcacgacggatggggtgtcgccgtgctggttggtgtgccacacagggaggatcagttcaagacccaccccatgaacttcctcaacgagaagactctcaaggggaccttcttcggcaactacaagccccgcactgacctgcccaatgtcgtcgagatgtacatgaagaaggagctggagctggagaagttcatcacgcacagcgtgcccttctcggagatcaacacggcgttcgacctgatgctcaagggggagagcctgcgctgcatcatgagaatggaggactagagcttcattgcaagctttgcttctgcatccatgctgcatatataccaacggacatgaaaagttgaagacgcttctcccttgtgcagtacatacagtagcaataaattgttaacgtttgtcctgacagacacacggccatgcccatcctgtattctgtttcacggtttcatctttattgtcagtgtgtgatgtgtgtggtcaggtttaatttcagcccttcttagaaaacccaaaaaaagaagaagaaaaaagaagtttgtggccagcttttagagtccctttatcacctgtatgtaattattaccattttgcataacaataatgaaatattgttgtcagtgtt

SEQ ID NO: 12456 - DNA, 757 bp, Sorghum bicolor
  Clone ID: SORBI-28MAY03-CLUS12772_1
gctgtcgctacgcctaccatatcgcctaatgcaaccactggatatgctgggatggcataccaccatgtcattcaatcgcaccaccacccctcaccacagcctgttgcaaacatgggtggcaactttggatatgagtatgctgatcctacgcgcccacaagtctactactcacaagcagctgcacctccaacattgccacctcagtatcagcccatggtctctcctgatgccggacaggcagaaaaacattaagcagaactgtgcctcagatcgaggattggtgaattcgggtatgttgcaaattctacaggcgtagttatccatctattatcattattgttgctactgcatgtttacatgagagtctgtggcaaagagtggaaggtgttgcaactgtgcattcgggatcaaaacaagtaaaacaagtatgcatccaaggatgggttcaaaataggattttaattggatggttcttgtgttggtgagacagaagggtgaccatgttgggttagattggggggagtgaagtgttggaaccctgttccaattggtctttttttcttcttcttattttgaataaaatatatagtgtccaaaagaacctggcgaaaacgaagaactcatcatttgtgtagccctctgtatatttgatctcatggttgtcattcaggttgaggtgcagataagtgtgttattagcttgcttgtagaaaccttattcgagttaaatatatacatcggtccggtttttgtacttg

SEQ ID NO: 12457 - DNA, 1256 bp, Sorghum bicolor
  Clone ID: SORBI-28MAY03-CLUS12847_1
cgtgagacttgcgccacgaaatagcaccgacaacaaaacaaactagttctagatcgcgagcggccggcgattttttttttcaactaataagaactcaaaaaaaatgtcgtcccttctgaggccaggccgaggcacaaccgcacaaggattctcatgtgcattacattgcacacaacacgaatgctataatataggcagtatactactgctctttgcttctacaaaaactacatctcaagaagtagccaatctgccacgttttgaaaaaaaggcttatacatacacaagaggacgcatagatatgagccagtcgaggcagagcggcgcaggaataagttatcgaacaatccatctcttgtcctgtcggttattctattgctgacatgcatcaccaattccagaccaccaccacattgcaagaccaaggcatcagccaaccttttcctcacttgtactcgaacgatggtatcggactgctgggcgtgtcgaagctctccaagatctccgacttgccaccgcccgcgctgggtttcttctcctcctccttcttgccaaacagtcccccgaaccacccacccgcgccgctggagctcgccgcttccggaggtgccacgaccggcggcgcctgcggcagacccgggaaagggttgccgcccatggccgccgtaaggttgggatcgtcggcgggcaggggcgggttggcgaggacgcgattgagcatgaggccagcgccctcgatgagggccaggaggatcccgcccatgagcgccgaccggcccgcggcccccatgccctggcgcatggagaggaacccgcccgtggcggcgcccgcaacgatggagttccaggggtcctccttctggcgagcgtacaccatggcgcagtcgaaggtggagaagaggccgccccagacggcgaagctgccccccacgcgcggcgcgttcatccgcacggcctgtgcgccaccggacaggcgcatcccgttgggggagttgtaaatgcccttgatgaagtggaaggcggagccgccaacggcgcccatcccgaacgcgccgccgacgtcgtccaggatccggtccgggcacggctcgcgcgacgtctccggcgtgcccatgttccctctcctggcacaactaactcggcttcgcctactcctcctcctctcccgtcgtcgtcggcagcggcggcggcggcgagagaggaaaccctagctcggagcccgggccctgacgtgggaaggaagttgggcctcgtgc

SEQ ID NO: 12458 - DNA, 720 bp, Sorghum bicolor
  Clone ID: SORBI-28MAY03-CLUS12924_1
cgagagtgcgtgccgacgagccacgatctgcggcgctcgagccggccgggccgggacagtctcacccgtacaaagcggtccgtcgcccagaagcgaaccaagaagcagagcaaagtactactgctggtacccacacccaccgcagcctcacctaccactaccaagaagatggccagcggcggcgtggtgaagcacatcctgctggcacgcttcaaggaggacgtgacgcaggagcgcctggacgagctcatccgcggatacgccgcgctcgtcgccgccgtcccctccatgaaggccttccactggggaactgatgtgagcatagaaaacatgcatcaagggttcacgcatgtctttgaatcgacatttgaaagcacggaaggaatcaaggagtacattgagcaccctaaacatgttgaattcgcaaatgtgttcttgcctgtgttggacaaggtcatcgtaatcgactataagccaacttcggtcaactagtggtggaccctgaaccagcaggcggagcttttttgcagttctcattatctatatatctataataatcctctgtactgttcgtgggaggattccatttgactctacactttctgctgaataaataaacttgttagctttgttccttgttaagaatgaactttgagttttctgtaactgcacttgttgtaacttggcatgtttcttattgatatcagaattacgttcctg

SEQ ID NO: 12459 - DNA, 1217 bp, Sorghum bicolor
  Clone ID: SORBI-28MAY03-CLUS1301_1
gcacgaggcaaggaaggaacataggctctcctccaagcatggcttctattgtagcagctacagttgctgcagcatctgcatggtgggcaacacaaggtcttctccctttcttcactccacccatggcttttccatttgtaccagctcctagtgctgcctttcccacagttgatgttccaagaccttcagagaaagacagagattgcccagttgaaaatgcacagaaggaatgccaagaagctcaaaaacagggacaatttgaaggtttaagagttgctgcttcttcagtgtctgatgggagtggaaaaggcgaggtgtctctccacacagagttaaagatacctcctgtccagaatgctgatgcaacacctaccacaggagctgatacaagtgatgcattcaggaataagaaaaagcaggatcgctcttcatgtggttctaacacaccttcaagtagtgatgttgatgcagacaatgttcctgagaaggaggacaatgctaatgagaaggtgaagcaagcctcctgcagcaactcttcagctggtgacactaaccaccgcagatttagaagcagtggaagcactagtgattcatggaaggaggtttctgaagagggtcgtctggctttcgatgcgctgttcagtagagaaaagcttccgcaaagcttttctcccccacaagcagaagactcgaaggaggttgccaaggaggaagaaaatgaagtgactacagtggcagttgacctcaacaagaacgccacaagcattgatcatgacctcgacacaatggatgagccaagggcttcctttcccaatgaattgtcgcacctgaagctgaaatcgcgccgaacaggcttcaagccatacaagagatgttctgtggaagcgaaggagaatagggtgccggctagtgacgaggttggtaccaagaggattcgtcttgagagcgaagcatccacataatcgatctctacatggggactggtcggcctgcctctaccatgaagtttatgtcaaagttatatttacatctaagctactataggacttcaaaccttgcaatgcagtgcttcattaaacttaatctgttgtgtgctgtattttaatgcttgtcaagcagcccgctagactgcttttaaacctttgctcgtagactctgatttaagcattaagcaactattgaactttttggtcaaaaggtatttccttatggtttat

SEQ ID NO: 12460 - DNA, 788 bp, Sorghum bicolor
  Clone ID: SORBI-28MAY03-CLUS13108_1
ataccaaatgatgcagatcccccaacccagaccaaaatgaatgggtcgaccaagaaaacattagtcaacggtcttttggatcaatcaaatggcaactcagggctacaatcttcaggaaatgataatcctagctacactaactcgagcagtgctatgccaccctctagtaccgaactaactgagtctacagcccctgctacagatgttgattctgttaagaatggcccaggtacaaaaccagaacaaccagctaagcgggccttgagatcatccaatgttcaacaaggacggaaaagggtgttgcgaagcacagcaagaggaagagcgacgtagggtcattgctgcactatattgttgtatactagtattaacggcccaaaagggcaacatgatacctaggttaattagatctagtgccgactggtcgtttccacggtacggtgcattgtgcatcaacctgtatccatgttgtattatcttaggccttatgatgaccacgtgtactagttagagttgatcattaggaccagaagctgtttgattttgtttcagtatctagctttggttaagtctctggtagtttgtgcagtcggaaaagagaatttgttggttgtattgcagcagacaactaaagtgttctagtcatcaggtacgtgtactgtgtagtgaatccagcagcagagctgttcctctctgtatggtggacgctggtatttgaggcgatgtaatcattatgtaacctttgttttgtgctattgtgttgtggttgcatgagctgctttttaccc

SEQ ID NO: 12461 - DNA, 1338 bp, Sorghum bicolor
  unsure (1)..(1338): unsure at all n locations
  Clone ID: SORBI-28MAY03-CLUS11448_1
gcacgaggcctcaccaacaggtgccatgcctccgctcgctggcgggcgcttgcgtcctcgcgccaagaagcccggaccccggagcgcccgcccgctccggtcggtccgggagccccgtttcccgcagccgatcggccgtccgcgaagccattaaatgattgatggtactctttgttgcttcaatccgtattcgaaatatctcaattccatcggactaagaacatttgagttctactctcagttttgctttagtagccgaagccttgaatctgtgaatgggtcaacactgttgtcctttgctttgatggtaatgcatgaaattcgaacatcgacatgtcttctgcatcttcaggtttagtgagatctggcctccgcaatagtcaccttcttgaaagcagatgtataaggcttattagagttggagttcgatctttggggacatgaattgattctgttatttgtttgactccaatttgggggcaatcacgggctttaggttgggtgaggaattgtcgtttcaacgaattcaggtactcaggttaagcaaaatcacatccctctgttcatgtgttatggcgggacagcatcatattagcacacatgcctccacgatggatcatgtgaacaggttccagagtgaaccgcagccttttggtccaaagttatttatgcattctagaactgatgcagcaaatggagctctatcatcaggttatgggggcgcaccaataagaccaaatgacattccatcctcaagtcacactgggcaatctcatattcagcatagtgatgctcctggaaccatgcttgcatcgtattctggctatcctcatgctggaagctccagcagcatctatgcaccacataatactcatcatccgccgcctttgagttatccacataggtctgaggataacttcattccgagttcccatatggatgacagaagggttgcactgaagcggagaaatccaattattcatccagtggatggagtcaatattgggagctcttatgctggcagttcatctaatcctcagttctctcgctacatgcctccaaatcatattcctgctcctgaaccctgcccttctcgaataacatcaaatatgggttcgagatactggagtgatcatccctttggtggccatggaggatctcagaggaatgtgagaggccgccatgatcacaatcccatccatttgggacacaatccaggtgtaccttgcgcatcaagcagcactcatgggccaccacaccanactaatgtaattggtcatcctcgaagtacagcagtgccacaagatagagcgcatttttctatacctccaagagtgg

SEQ ID NO: 12462 - DNA, 710 bp, Sorghum bicolor
  Clone ID: SORBI-28MAY03-CLUS11477_1
aaggagccacgattttgagggaatgggaggcatatttgccgctcttctggcaactggtaccgcccagtgaagaagactcgcctgaggcttgtgcagagtttgagagagtactcgccaagcaagcaaagcaagcaaccacccagctgtctgcgaagtgattgaatcagactacacaggaaggtgttctctatttgatactcctcgcagagtgatttcctctgatcgctccaagaaaaccaaaaaccgtaactggcatactgaggcatcgaagtgcccttctgaagaatgaaattttgtggaggctctgcccaggctatcttttggggttgagcgagcagaacgatcgcgggttctcctcgatgctcgtgcaccctaggtaacccctgtaaattggtttgctgacgctaggttgcaaaggccttctttgaactgctgcactgtacatgattcttggctgttgccttgtgtaattatgtttttggttagcttatacgtgtccagtggaggcaatgcaagtcgcatgcgcaatagtacagtaggagtacatgataaactgtactatcatcaagatggatttgaatgtttgcttcgtgaatgaacgaaactgatgcttgtggcgtcatgcccgtggtgtgatcgctctgatttgtgaaggttggcatctaatgcttcttttgcagaggctggaatccccaatggtttctcttggc

SEQ ID NO: 12463 - DNA, 1050 bp, Sorghum bicolor
  unsure (1)..(1050): unsure at all n locations
  Clone ID: SORBI-28MAY03-CLUS11353_1
atgaaaagaagaggtttggtctaacttctacgccgacgaaggaacaaccgaggagcccatgggacgcgagagccttcagtcactctggcagaagcacagagggccacgcagcaagttaaggatgctaaatttcctgatttagaggttattcgcatgttgtgggatgtgctcatggaggctgttcagtggtctgggaagaaccagcaacaaaattctaatgcagcacttcgacaggtgaaagcttgggctgagctcttgaatgctttttgcacgagtggcagacttgaactggaacttatatacaaagttcagacgcagtgctatgaggatgctaagctgatgaagctgtttcctgaaatcataagaacactgtatgaccaagatgtcctagctgaagatactgtcctcctttggttccgtaaaggttcaaacccgaagggcaggcaatctttcgtgaaagctctggagccgtttgtcaaatggctggaggaggctgaggaggaagaataagttctgataaacgggaggaattatagttgctacttgtttgccgagcttgttactgccgagaactttatgtttcatgtttagccacatggctcttggctgcagaatgctataatatgttgctgttgactttgttgtggggatttgttaaaacttccgttatcattactgaaatgatttatgatgggacgtcaattactttggtgttgtacgattactggattattcatatgctgcagagtgctacaaatttgatttcttcctggacatcgctatgtatggccacgtccacggctacgagcggacctgcccagtatacgagaacgcgtgtgtcgccaaggggtctaacctctacaccggcgctttcacggcgacgacgcacgtcgtggtgggcggcggcggcgccagcctcgccgactacacagccgtgcgggcgcggtggagccacgtgcgggaccgcgactntgggttcgcgaagctgacggcgttcaaccacacgacgctgctgtttgagtacaagaagagccgggacgggagcgtgca

SEQ ID NO: 12464 - DNA, 1180 bp, Sorghum bicolor
  Clone ID: SORBI-28MAY03-CLUS11801_1
gaagtgcagtgatgtatgcagctgaggcatcctaacgaacgaacgatttgaacccccaagcaaagtttttcgtcgtccgtcccccatcgccgcgacggggagagctccagaggacgccgccgccagcagcgccacagcctgcctcctccgcccatggatccgaagatgacagaggtgacccagatgttcgcccgcttcaaggcggcctacgcccgcaacgacctcgacgcctgcgtgaccctcctctcgcagctcaaggtccatctcaccaaattccccagcctcccgccctcgtttcagcagacaccgaacgctgtggaggagctcaaacttgcaagggacatttatgaacatgctgttgttttgagtgtgaaacttgaggaccaagatgcatttgaacgcgatttttgccagctcaagccttattacatggatacatgtggcataattcccccctcaccagaggagtacccaattttgggactcaatcttctgaggctgttggttcagaatagaattgccgagttccacactgagctggagcttctacctgtcaaggcacttgagcatccttgcattaagcatgcggtagagcttgagcaatccttcatggagggtgcctacaaccgagtgttaagcgctcggcaggctgtgccacatgagacctatgtttacttcatggaccttctcgccaaaacagttagagatgaaatcgctgggtgcagcgaaaaggggtatgattccctatctgtaagtgatgcaaagcaaatgcttatgtttaattctgaccaagatctgcacgagtacatctcagaggagcacccggaatgggagattaagaacggtgccgtcttcttccagaaggcgaaggagtcgcagccttgcaaggagatcccatccttgcagctcatcaaccagacgctcagctacgcgagggagctggagcgtattgtatgatttaatttcatagtaatccctggtggatgtttattttctgtggtcacttggcatggcctgtactgtcctttacatttgagatcagctctgatcgcccctctgaactgtctgaaacatcatgtgaatctctgaagggctcgatctccccggcattggtttgttaactccatttgtatttcaccacattgactgcattgtttgaaagatgcccggcattccctgc

SEQ ID NO: 12465 - DNA, 972 bp, Sorghum bicolor
  Clone ID: SORBI-28MAY03-CLUS11893_1
tccgggccccccccaaagtaaaacgggccgctcgccccgctactccgccgtccgcctctccgcctcctccggcgccggcgctgcagcggccggcccacggaatccatgggcaacatgacccgctcagactcgcccgtctcccgccgcatcgtcctctccttcctcgacttcctcaactccgtcgagttagctcctggggttgatcctgaagctcttgaagttgctaaggattgcctggagtccatttttagtgttaactcatcagccactcgtgaggcgatacagccaggactgttgcttgagctatttgcttctctggaagcaaatgaaagagaccgggcaagagctgctttgctgtcacaatctgtatcaaacaagccatctcaaaatgcgggtacatctaatgtcgaagaagacccaaacaaatgcacaacatcagatagtgacagtcagatggaggatacatttgacctagatcattcaggggatgaactatttgcaaaattttatgctgcacttgatgaaatcaatttctttaagacatcacctgctggagctgaagatcctggcctactttcaaaagcaacacaatactttaatgatgcattactggcgatgcagaagtcaggaacgaaaaaggcaagcttagtagaccttgcagagtcctttaaatcaagaggtaatgaattcatgaggtcaaaccaacaccttaaagcggtagagctgtacacctgtgccattgcattgaacaaaaaaaatgccatttactattgcaacagggctgctgcatatacccttcttaatatgaacaatgaagctattgaggactgcctgaagtcaattgaaattgaccctagctacagcaaagcatatagccgacttggatctgcttattttgctatggggaattatcatgatgctctgtacaagggatacttgaaagccgctgagcttgatcctagtaatgaaaat

SEQ ID NO: 12466 - DNA, 842 bp, Sorghum bicolor
  Clone ID: SORBI-28MAY03-CLUS13714_1
gcgtggtgtcggacacttgcgtggccatgggcgattgggtggctcacccgcaggcgcacacggcgctggacgacatcctcccctgcatggacgtggcgacggcgaacgagtcgctgtaccggagccaggaggtgacggcgcagctggtggcgctggtgaacaacgtcgtcgtcaacatctcgaatcggaacttcccgttaggtctccgcccgctctacttcaaccagtcgggccccctcatgcccgtgctctgcaacccgttcaaccgggacatgagcccgcgccggtgcgcgcccggcgaggtcgacttcgacagcgcggcgagggagtggaagcggttcgagtgccagaccacggggccgccggggtcggaggtgtgcgccacgccggggcgcgtcacgccggcggcgtaccgccagatgacggcggcgacgagcgtcagcaagggcctgtacgagttcagcccgttcctggtgcagctgcaggactgctccttcgtgcgggagacgttctcgtccatcaccaacaacaactgccccggcctcgagcagtacagccgggacgtctacatcggcctcgtcgtcatctccgccggcgtcatgctgtccgtcgtcttctggatggtgcacacacggcaccggcggcggcgcgccttgtgcaagtagctgtgactgaggagatcttggtggcgtgccggcgccacgatttagattgagctgttctggactgacaaccacggctctgtagatgaagcctcgtgcatccgattcagctatgtacagtatggtattgtgcttctgaaagtgaaaatcgaaatgacgcatgtggtgtggttgttctct

SEQ ID NO: 12467 - DNA, 1405 bp, Sorghum bicolor
  Clone ID: SORBI-28MAY03-CLUS14034_1
cgtccccccggcccccgggaaacactagccgacggagtggagaaggagaacccaggccggccgccggcccgatggagcacgaggatcaagaagcgcagaagcctctcctggtcaccgcgcccgggagaagcggtgatggctgtgcgtccggcgccgcctcgtcctcctcttcgattgcggtggtggtcgccagcaccgccgtcgccgtcgccggatccttcgagttcggcatctcggttccagtctcgataccagagataactccaaagaatcttggaggaggactcgcacctgtaaaccagtttctgttatgttctggggcatcacttgcttctgtgctgggaacttttgtcacctggcggacgttggccatcattggactggcgccttctttgctgcagttggttggccttctcgtgcctcctgagtccccgagacgcctggctaggttcggccacccgcgtgcatttgaggcggcattacagaagctaaggggaaaagcgcctgatatctctgacgaagccacagaaatcaaagattttacagaaaagcttcagcaattaccagagtcgaaaatgttcgacctgtttcggaaggactatattcgtgctgttacagttggagtagggttaatggtccttcaacagtttgggggagtgaatgccatttgcttttatgccagtgaaatatttgtttcagccggtttctcatcaggaaatacaggaatgctcgctatggttgctgttcagattccgatgaccggactaggagtacttctaatggacaaagctggacggaggccacttttgatggtatctgcagctggaacatgcctgggttgcctactagtcggtttgtcattcttagctaaggaacatcactggggaaaggatctgaacttagtgctggctttggcaggcattctgatttttggcggatctttttcactgggtatgggtggaataccatgggttataatgtcagagatctttcctataaacatgaaaggagcagcaggaagccttgtgacactcgtcagctggcttggttcgtggattgtctcatacgccttcaacttcctcttggtgtggaactcctatggcacattcttcatctttgcaagcatctgtgggctcacagttgtgtttgtagagcggctggtgccagaaaccaaaggaagaaccctagaggagatccaagcatccatgaactcatccttaacgcccccctttcacttatgatttgcttgtctagtttacatagccaaatacctggacgggatgcgcatgtaaagcttcagtggttatgtggttattgtttgtacacatacaagtttgtatatcaaaaacatatgcagtgtaatagatatttctctcgctccctaaaccatgaattagaattcatc

SEQ ID NO: 12468 - DNA, 1019 bp, Sorghum bicolor
  Clone ID: SORBI-28MAY03-CLUS14114_1
cgttcgctcaccactgacccgcacccgcccgcgagcagaagaaaagtcctctagaagcagagcgcccccaaatcccaaagacgcccactggcggttgcgccttcactgcttgctttcccaacagcactactacacaggaggcggcgatcgtcatggagatggaggccagcggcgcgctatcatcatcgtccgtgctgtacgcggccatgtccctgccgtgcgcgctcctcgtgctggtggtcggcgaggcgggcctccgcgtggcgtcgctggcgctccgcggcgagatgaaggcctggtggcccacgcgcgccgcgatgctgggctaccgcgtcgcgcgccccggcgtcggcggcgcgtccgtgttccccgacgacgacgacccgccgctgctgctgccggccgagtcctgcgaccgcctcgccgtcgccgtgtaccgccgccgcgggcaagggcaagggcaggaggagcaggcgcaggacccggacccggactgcgccttctgcctctccgcggtccgcgacggcgaggaggtgcgcgagctgcggtgccgccacgtcttccaccgcgcctgcatcgacgcctggctcgtccgcccgcgcgccacctgcccgctctgccgcgaccggctcctccccgccgagagcgaccacgaccacgaccgcctctcctcgtcggcgtcggcctccgcctacgcccacggcggcgcgatctggcacatgacgtgaacgcgttaccactaccttgtttcgattccattttctttttcttttctttctggaggagggttattattgcgttaaccctccgctagccgagccggtgccgtgcgtgcctaggattggatttgattggaccatccgaccgacggcctcaagtgtgtgtgtgtgtgtgtctgtactctgtagtaggagtgacctgtattggtcccggtaaatactactagtgggaccggagtgtttcggtgtcactgccgtctggtcggttcacacttgctctaaaaaaaaaaaacctcgtgc

SEQ ID NO: 12469 - DNA, 705 bp, Sorghum bicolor
  Clone ID: SORBI-28MAY03-CLUS14061_1
gccggccgggtcgcagaccaccgacccgaccccggtctgattagcaaggggaagcaagcaagagggaggcggccgaggaggctggaggcctagggcctaggggtagtcccgtacggtctcctgcggctaaggtccggccggcgactgactgcccttgcgtcgccgtcggcgaatcgatgggctactggtgggatcgcgtcgtgctgccggtgcggcgggcctggctgggcgtcgcgtcccgcttcggggttcgccaaacagggctgtggaggctgcggcaggaggtgagcacgtgcgagtacgaggacgtgcacgtgatgtgggagatgctgagccgcaccacggcgccgccgcccgcgcccaggcggcccagccggttccggccgcagccgcggccgtggggcgacaggttccgcctctgccggggcttctagtagatcaaggccgccgccgcgtcagctccgctgctgttgctgcgggataatagtgcttccgctttcttttcacttttcttcttctttggtttccgctgcttgtatctatgtatcgtcgtcgatccctccgagctctgagatgtacttccattcctcctcgtgtatgcatctcgatccgccgcgcctgcagtctgcagatgatgataccggggtatgtgaatgaacagagatatttcggttgggttaaaaaaaaaaaaaaaaaaggccccta

SEQ ID NO: 12470 - DNA, 339 bp, Sorghum bicolor
  Clone ID: LIB3480-011-P1-K1-G12
gattagcaaggggaagcaagcaagagggaggcggccgaggaggctggaggcctagggggtaggggtagtcccgtacggtctcctgcggctaaggtccggccggcgactgactgcccttgcgtcgccgtcggcgaatcgatgggctactggtgggatcgcgtcgtgctgccggtgcggcgggcctggctgggcgtcgcgtcccgcttcggggttcgccaaacaggtacgtacggcagcgcggggcggctcgacgtcggcggcggcggcgtctctcgtacgacgatctcttgggtctgctggtgtgactgacaccgtcgcttgttgcttgcaaggctgtgg

SEQ ID NO: 12471 - DNA, 1193 bp, Sorghum bicolor
  Clone ID: SORBI-28MAY03-CLUS14122_1
caccttcgcacgacctgcacacgtaaacagacccaagaaaaactctcccggcttcgatcccatcctccccctactcgccgaccaagacacctctacccccctcgtggctcctcgaggaatccctgtgcggcggcgcaagccggcgcgaccacatcccggcggcgcggcgccggctgtcatccgccgccaacttctggcctacgccggccgccgacgccgagggccctcacgcctcgctcacccctgcccctgagagagccccgcgcgcgaagaaggcgaagcgtgtgcgcaatacgtattaccgcggcatccggcagcggccgtggggcaagtgggcggcggagatccgcgaccccgtgcagggcgtccgcgtctggctgggcgcctacccgaccgccgaggccgccgcgcgcgcgtacgaccgcgccgccaggcgcaccaggggcgccaaagccaaggtcaacttccccaacgacatctcctccagcgtcaccgccgtgccgacgacggccgccggagcagcagcagcacaggccccggccgttctcccggcgcccaaggtggaggcgcaggcgcaggtgtccgacgaggtcaaggagctgtcggaggagctgatggcctacgagaactacatgaacttcctcggcatcccctacatggagggcgggaatgcagctgcaggtgccaccaccgccgccgccgccgccaccgtcgccgaagaagcgcaggtgccggcggcgccagccgggctgtggagcttcgaggactactactacccgccgtcactgtcgctcttcactgaataatgaacgcggtttttaccgtgcctgttttgttaactcttttgtaaaaagattttcctgctcgtcctagtcgctgtaaatgtgacagactgagcatcaatcgagctcctcctgtcttgtgttttgttgaactcgatcccattgtttcgtttctgtgactgtaccctgtgtttctgtaactcgcaagttgaggcaggcatgtaatcaagatttgcagtttaactctgatctttgcttctcagcagctcgctgcagaggaatctgtttcattttgtacgtgattgcaacgcgctgttgagtgttggtcgatgcttctgattctcactcgtttgttcctttgtaaataggcctgacattttagctgctcaccattgaaagaaaagtttttac

SEQ ID NO: 12472 - DNA, 1008 bp, Sorghum bicolor
  unsure (1)..(1008): unsure at all n locations
  Clone ID: SORBI-28MAY03-CLUS1393_2
gcacgagggttcgtcgtgctttgtgtcgtgcgcgtccgcgtgcagactactgcagagacgggggagcagggatagtggcggacggtctctgctgttggtggtggaggcttcgattccgggcgcgggcggggtggcttgtggtctcaagaatcccggaaaggccgccggaaaggcagcgggcgggcgcaaagataactaataggcaggccactggacaggcatggggtgcggggcgtcgagccagaaggacgccgggccgccccggagacggctggggagcgtcggcgacgtggtcgtcttcctgccgggcctccgggcgccgaggaccgtcgacttcgcccacgcgctcgccggctgcggcgtggccaggagcgtcggggtcccgctgccggcgcccgcggcgccgctcgtccccaggccgaggccggcggcacggcacgggtccagtacagccaatcttctacaggcccttgaagactacttgccagttcttctaggatcagtaaaagatgccagcatcttgaggcacaaagtgcagttcacctggagtaaccaagaggatagtgccgaggagacggccatttcagatgcctggtacgaggtgctgtccgtgctgcatttgatggccatggtctgcttgctgcaggccaacaccctgcttctccccaggtcatacggcgatggctacgccccaagagtttctgaagagagtagacgggccactgttgatgtcttcttgaaggcagctgggtacctagactgcgcaattcggcatgtacttncgaagatgccgctggaactaaggagacaacttccagtagacctggctgaaggaaatctcaaagctctatgcctgcaagccttgggtcagggggttaacatgcagctcggtttggctattgatagtccaaaggccactttagcagtaaaacggcgcttggcctgtgagatggcaaatattggcacaagttcagagagcatccagagctctgcttgatgatggggaaa

SEQ ID NO: 12473 - DNA, 1070 bp, Sorghum bicolor
  Clone ID: SORBI-28MAY03-CLUS1393_1
gccggccgggccgagagccttgtaggcctcctcttctcctctccctctccaggcttcctcctccggccgcgcaagtccagctcatacggcgatggctacgccccaagagtttctgaagagagtagacgggccactgttgatgtcttcttgaaggcagctgggtacctagactgcgcaattcggcatgtacttccgaagatgccgctggaactaaggagacaacttccagtagacctggctgaaggaaatctcaaagctctatgcctgcaagccttgggtcagggggttgacatgcagctcggtttggctattgatagtccaaaggccactttagcagtaaaacggcgcttggcctgtgagatggtcaaatattggcaacaagttcaagagagcattccagagcttcctgtctctgatggatgggggaaaaagcaccggctgtttgtaaagtggaaatatgtggaagcgaaggctgcagcatactatttccatggtttgattcttgacgagggaaataccgagaaatcccatggaatggcaatagctgcactccaagcttcagaggaatttctgaaagaaagcaaaagggtttcggaagccttccatgcaactcctccaacatcgaggagtcccaatccatttggaacagcaaaatatctgtttgacaagatcccaagagatgcttccagcaaggtccgaatcaaccaggacctgtatactcaagaaaaggtcattggagcaccacccccattaccagattttgcattggcgctaacacctgaagactatgaccttcctccactagatccactttggaacaaagaagacacgcaccattaagtgtatatgcagcagaatggttgcttctggcaagaaattggctctggagagaaaggaaggaccaagatccaccatgtcaaagtcgaacatggtaacaaatgaagtgtacaaaatattttcaaacaaaattacatgtcaacaaaattaagcaaggcctgaagataatctgaagagctttgtacaggcgattcttcttctgacatgggaaatgctatgtcaaagggttcttg

SEQ ID NO: 12474 - DNA, 856 bp, Sorghum bicolor
  Clone ID: SORBI-28MAY03-CLUS12547_1
cggcttttatttatttcttcaaatgtactgatcctgtccccattcaatatatctccggcggcaggcaaggcaccttccataattcttatgttggcaccgatccaattcatcgccagtcaactatgaaaaaaataatctgtaccatactgtcaacaacaggatgaagatgttcttatttcatatcccttcatttcgcatgtacaggggtacataaagacctatagccatagtccaaggacaatggccgcaacaaagttaaatttggggaggaagaaagggaggttggaggagggcaatggcgccattttagtttaaatcttaactctggaacctcaaacagctggtaaacgaactctgactcggtacagttttaattacaccagggggaggggacgacagccggccggccacggctactgaagggggaggaggaaaaacccgactggatttggggccggccaagtcgcgcagacgcacatgccatgggggtgtactatggcggctgtacaatatggcacaactctgatccttctgattagttttatggcacagttgtgatccttcagattttaagctctcaccatcacatgaagtagctcagcgctttcttcttccttgacccgccttcaccatacaggtcattccattgaagaagctcgttcatgtttgctgaatcagacgaaacgctagcacaaacctgctcatgggcagatttgaagtcatctatgctaagaggacggatgtcctcgcttccatacaatgcaggctctggcctaccttctgttttagccaaattcttctccttcttttccttctccagaattctcgaatgggataatgccccggcccggccggc

SEQ ID NO: 12475 - DNA, 796 bp, Sorghum bicolor
  Clone ID: SORBI-28MAY03-CLUS12496_1
gcacgaggcccattccaagtccccgctcccggattcccgacgacgagctcggagctcctcctcccctgcccctgttcggtgctcgaagcaacagctgccgccatgtctgccgccaaccagctcgccgcgctcatccacaacatgttcgccacgggtttgcttgacgaccagttccagcagctccagatgctgcaggaccccagcgctcctaacttcgtcgccgaggtcgtcacgctcttctgccaggacggagagcggatcatcggagagctggccaagctgctggacaagcccgtcgtggattttgacagggtcgacgcctttgtgcatcagctcaaaggcagcagcgctagcgttggtgcactgaaggttaagaacacttgtgttcagttccgcgagttctgtcagcagaggagcaaagatgggtgcctgaagacactggagatggtgaggattaacttctatgagctgcgtggcaagtttcagaccatgcttcagctggagtgtcaggtcaacggcttccctcccaacaactaaaccaaatggcagcgctgagcttcatgtcaggattatgcatgcacctttcaaatctcaagacattctgaatgagctcctcaattggcttgtgggaagcctgtaatagcttagcagcagtagtagtgttaacaccaccgtagtagtatcattgttgtcgctcccaataatttctcttaggaatctgctcatggaacctggtggtgaaacaaactaaaatgctatggctattgtttaattataataggttgctgcgtttggt

SEQ ID NO: 12476 - DNA, 677 bp, Sorghum bicolor
  Clone ID: SORBI-28MAY03-CLUS12611_1
atttgctccccgcaaatttgcttcccttcccccacccccgcagatctgaccgccgacccgaggcaatccccaaatggctcattccaacggcgcggccgccactgccactgccgccggcgacggcgagaccgccccggtgccgcggtccctcgcgccggcgcggaaggtggcgctgatcacgggcatcacggggcaggacgggagctacctgacggagctgctcctgtccaaggggtacgaggtgcacggcctcatccgccgctcctccaacttcaacacgcagcggctggaccacatctaccacgacccgcacgcggtgccgtcgtcgccgcgtcccccgatgcggctccactacgccgacctctccgactcctcgtccctccgccgcgcgctcgacgccatcgcccccgacgaggtctacaacctcgccgcgcagtcacacgtcgccgtctccttcgaggtccccgactacaccgccgacgtcaccgccacgggggcgctccgcctcctcgaggccgtccgcctgtcgcgcaagcccatccgctactaccaggcgggctcctcggagatgttcggctccacgccgccgccgcagagcgaggacacgcccttccacccgcgctccccctacgccgccgccaaggtcgccgcgcactggtacaccgtcaactaccgcg

SEQ ID NO: 12477 - DNA, 807 bp, Sorghum bicolor
  unsure (1)..(807): unsure at all n locations
  Clone ID: SORBI-28MAY03-CLUS12645_1
ctactcggtccctctcccatcccaatcccaatcccattcgctttcgctccgcccctccccggccgccgcaccatggccgcctccgcctccaccccgctcttctcgccgtgcgccctgacctccaagcttggggtagggcacgcgtcctatggctccggacgccgcgccaacgtgcgccggcgcggccgcctctcggtggtggccgtacagacggggccgcagaagccgtccccgtcgtcgtcccaggcggccgcggcggaggatgaggcggacgcgctgcagaagcttctgaagagggagtacaagtacgggttcgtctccgacttcgagtccttctccatccccaaggggctgtcggaggccaccgtccgccgcatctcggagctcaaggcggagccggcgtggatgctggacttccgcctcgccgcctaccggcgcttcctcaccatggtcgagcccacctggagcgacaacgagtacgcgcccgtggacctgcagtctatctgctactactccgcgcccaaaaccaagcccaagctcaatagcctcgacgaggtcgacccggagctgctcaagaccttcgaccgcctcggcatcccgctcaccgagcagaagcgcctcaccaatgtcgccgtcgatgccgtcatcgattccacctccatcgccaccacccaccgcgaggcgctcatggccaagggcgtcatcttctgctccatctccgaggccatccgcgagtacccggaccttgtcaggcgctacctcngcagcgtcgtacccgcgggcgacaactattatgccgncctcaat

SEQ ID NO: 12478 - DNA, 1271 bp, Sorghum bicolor
  Clone ID: SORBI-28MAY03-CLUS1265_1
tactggaacgggctggaccggagccgtccacgccgccacgagcccacgagggtagagcctcgcaccagccagccctagagcccgcaacggctattttctcctaccctgccctccggcggcggctcggcgtactagccgttggccgtggccgtgtggtgcggcgggcgttcccctcttccctcctcctcttcctcctcccgaggatctttcgtggccgatccctaaaccccacaaagcaaagcatcaattctctctccttcgcgcattctcctcgcctccccacgacgatctcaagccgctcgccggggagtcgagacacgcgcacttctcgcctcgttcataagctcgtctctttgttctttccgctgttaatcttcttgtttgattattttctgtgcttgattctaacctgctattattttagttcgcgtttaattccatcgctactgctgttgttatttctctgttgtgcttgccctgttcttttgtttgctctctaaccatggacgcaggatcccactcgatctcctcggagaagagccgcgccgccgccgcgccccggccgccgctgcaggaggcggtctcccgcccctacatgccatcgctgggctcgggatgccgtaacccgtcggccaagtgctacggcgacagattcatcccggacagatcggcgatggacatggacatggcacacttcctgctcactgagcccaggaaggacaaggagaacgcggcggcgtccccgtccaaggaggcgtaccggtggctgctcgcggagaagctgctcaacaaccggacacggatcctcgccttcaggaacaagccgccggagcccgagaacgtatctttcgccgatgcggcttcctccaacctgcaggccaagcctgctaagcagcggcgccacattccccagtctgccgagaggaccctagacgccccagagcttgttgatgactactacctcaacctgcttgactggcgcgtgggcaatgtgctgtccattgctctgggagacacactgtacctgtgggatgcgtcgagtggatccacatccgagcttgtgaccatcgatgaggacagcggtcctattaccagtgttagctgggctcctgatggtcggcacatcgccgtggggctcaactcgtccgacgtccagctttgggacaccagctccacccgactgttgagaacactcagaggtgtgcatgaggcaagggtaggttcactggcatggaacaacagcatcctaaccaccggtggcatggatggca

SEQ ID NO: 12479 - DNA, 1042 bp, Sorghum bicolor
  Clone ID: SORBI-28MAY03-CLUS1556_1
gaattagtcccagatattctcccttagcttccatggccttccctgtgcccttcctcctcctcctccttctcgttgctctgctcgtggtcgccgccacgcggctgtgggatcacgtcttcgtgcgcctcgtatggaggccgtatgccatcaccaaggggttcagagagcaagggatccatggaccttcctacagcttcttcaaaggctgcaacgaggacatcaggagcatgaaggagaagaccgacggtctcgtgctggacgtcggcgaccacaagtacctcccgcggatcgcgccacactatctcaaatggagggctcagtacggagaaccatttctgtactggtacgggccacaggcccgaatttgcatatttgactatgaattggcaaggcaaattctttcaagcaagtctgggcatttcgtgaagaacgatgcacaccctaccttgttggctttggttggtaagggactcgggttcatggaaggcgctgattgggtgcgccatcgcagggtaatcaaccctgttttcaccattgataagcttaagattatgacaaaaacaatgctggatttcgcccaaaacatggccagtgagttggaagctgaagcatcccaaagcgagaacggagaaacaagagtggatataaacaaacaattcagcgatctaacagttgacaacatagcctatgccatctttggaaacagttataagttaggtaaacaagtcttccaggcacagactgagatgttggggatcaccatggctactttccttgacgtgccgataccaggaatccagtatcttccaaccaaagcgaatcgacgaaaacagatacttgaaaggaagctcaagagcttactcacacagatcatacaaccacggttagcgagcggtgaatacggaaatgatctgctgggtgtgatgcttgaatcctgcactgaagccaagcaaggagggaagcaagtggatggtctcagcttgagcatggaggagatcatacatgagtgcaagttgttcttcttcgccggccatgaaaacac

SEQ ID NO: 12480 - DNA, 589 bp, Sorghum bicolor
  unsure (1)..(589): unsure at all n locations
  Clone ID: SORBI-28MAY03-CLUS15725_1
gcaccaccgccgcacacacagcagcacatcatctccatcgcgctctctccaagcagcagcaccgaaaccctgtctctccggcgcggcgagcgatttcaaattaagaacgagatggtcctcggcggcggagctgctgcgtttgcgtcgtcgctcctcgtgggcgccgtcatctcctacttcctttggccagtggcggccccggctgccgccgtcgtgatgatgaaggcgcccggcgccggcgggctgctcatctcccgcgcggcgttcgctgccaacccgcagctgtactacagcctcctccgcacggccggcgctgccgccgccgccgccgcatttgctgtctagccccactgggagggtgatgatcttattgtcggatcggaatgtccaaataaaagatggcgcgacgtcgtttgcatgtcgtgcacgctagctagctgttcacctactgtatcagtgtgttatcgattctatgttcgtgcgtgcatgcttcactgatcgtgtcctagatctatgtttgcttcttattgcagcttgaaagaattttaacacccaaaaaaaaaaaaaaaaaaacgacccggggncccgg

SEQ ID NO: 12481 - DNA, 1789 bp, Sorghum bicolor
  Clone ID: SORBI-28MAY03-CLUS1590_1
gcacgaggcatcagagaggcccaccacaaagactggctttcttggatgttttggttccaaggtggatgctattgactattacaaatcagagatcgagaaaattgggaaagaagaagctgaagagcgtaaaaaggtcatgaaggatccaaaatcagttgtgccagcagcctttgtttcgtttcgctcccgatggggtgcagcagtctgtgctcagacccaacaaaccagcaatccaacagtctggttgacagaatgggctccggaacctcgtgatgtttattggaataatctgtccatcccatttgtgtcccttacagttaggaggttgataattgctgtggcattcttcttccttaacttcttttacatcatcccaataacactagtacagtctcttgcaaaccttgaaggaatagagaaggcacttccatttctaaaacccttgattgaattgccattcattaaatcattcatccaagggtttcttcctggaattgctttgaagatcttccttatagttcttccaactatactgatgtttatgtctaaatttgaaggactgatatcacagtcatctttggagaggcgatctgcatcaaagtattatatattcttgttcttcaatgtatttttgacgagtgtaattgcaggatctgctctggagcagcttaaaacctacctccatacgtcagcaaatgacataccaaggatcattggtgattccatcccaatgaaggcgacttttttcataacatatgtaatggttgatggttggactggaatagctggtgaaatattgagactgaagccgctgatattcttccatctgaagaacttgttcttggtcaaaactgaaaaggacagagaagaggcaatggatcctggcagtatctgctttgactcaaccgaacctagaatacagctatacttccggcttggccttgtttatgctgcggtgacaccgttcctgcttcctttcatattggtgttctttgggttcgcatatgtcgtcttccgccaccagataataaatgtctacaatcagcaatatgagagcgccgctcagttctggcttagtgttcatgggcgtataatcacagcgttgatcgtatcgcaactgctgctcctgggactgatgagcacaaacgactttgagcagtcgacgcctgtgctccttgttcttcctgtgctgaccttttggttttacaagtactgcaagaaccggtttgagccggcgttcgtgaggaacccactgcaggaggcgatgaagaaggacaccctggaacgtgcccgggagcccaacttcgatctgaaggcgtacctggccaactcgtacctgcacccggtgttcaagggggacgaaggcgacgacaggtactcggtggtggatgacgaagggtggatggaggaggaggtgattgtgccgacgaagcggcattcaaggaggacgacgcccgcgcagagcaagcacgaaggatcagactcgctctctgtgcccgagagccagcgatagccactagagtaggtagcctgtacagaatggttgaaaatgagggagatgctgctcctgctctatttctttgttttgggttggttgctcatgacactgctagtggtgcgtacaattgagaatacaagcggtatacatacagacatgttggttgatctgcaaccgatctcatagaacagaattcaagagagctggggtaggactgagggggagagaatgttcactgtagcttgagcaaagaatatgaatacaacagttacattatctgatctgatgaat

SEQ ID NO: 12482 - DNA, 1484 bp, Sorghum bicolor
  Clone ID: SORBI-28MAY03-CLUS15985_1
agaaaacagccaaaaatggtggctttcttgttgccgctgcagctgccagctcctctccacactcgtcctcttccccatcaccgcccgccagtcgccgtcgccatggcctcggcctccacctcggacagcccaaatcccatcgtgctgggctgcggcgccgcgtccgtggactatctggccacggtcgcctccttccccaaccccgacgacaagatccgcagtctcgccctcaaggtgcagggagggggcaacacgggcaacgccctcactgcagctgcacgcctcggcctccgccccaggatcatttccaaggtatctaacgatgctcaaggaagaaacatcctcaaggagctgcaagatgatggcatcgacacatcctacatgcttgttgctgaggatgggaattctcccttcacctacatcattgttgataaccaaacgaaaactcgtacatgtatacacactcctggttatcccccgctgttgccagaggaactcacaaaggaaaacttgtctgccgctttagacggtgcagacatggtctattttgatgtgcggttgcatgagactgctttgatcgttgcagaagagtgcaagtcgaagaaaaatccctattttcatcgatgccgaaaaaaagagggagggattggatgagcttcttaattttgcaacctatgttgtatgttctgcaaagtttcctcaggcctggacaggagcctcatcaactccagttgctttagtttccatgcttttaagattaccgaagatcaaatttgttattgtaactctaggggagaaaggttgcttaatgcttgaaagaagcacaatagatgcttctgaggcagacaaaatagacatagaggcactgttagaatctctagagaagaaagttgatcagagttctacgacaccaaattgcattacttccaaggctaatttgagaataagtgcagatggagtggggtccataaatggcaggttactgttaggaacagcagaagttataccacctgatgagctcattgatacaactggtgcaggagatgcattcattggagcagttctatatggtttgtgcactggcatgccaccagagaggatgctgccttttgcatcacaagtggcaggctgcggttgcagaggtttgggggctcggagcagccttcctcatcgcacagaccaacgtctggtgggctattgatcaacaaagttcagggtggccacagggagagagagactactgcagatcgaggctacctagtgtttgccaagttattatcatcgtaggaagatatgtgtattggtacatttgtggcggagccctgatttgatttataacgcaatgtatgctcacatgcctggtgactgaaaccgttacaatgtgagtaaccttttttttttaatgttgcaagtcctcaatgattattttcacttatgcctgatttgaatgatagatgtgaatatctgcacattgctggcatttc

SEQ ID NO: 12483 - DNA, 945 bp, Sorghum bicolor
  Clone ID: SORBI-28MAY03-CLUS15665_1
gcccgaggccggttcgtaccgtgacgaagcgcgcccacgcactgcttcggggggtccagccgggccggacgggtcagccgtgccggcgccgcggcgggcgcggccgcggggccgctgccgcgcgagcgccccccggcgacgtccctgcaggggccgggccgccgcggccgtcctcgccaccgactccccagcacccgcgctccgccgcgcccgccgggcggcggcggcccggcggaggtggcgccgcgagcgcgtccgcgggaccgcgtgctcccggaggtcggcggccgggagttcgtgctcgtgtgcaggcactcccgcgtggaccgccgccgcaactgccccggcgtcggcgcgatccgcggcgcgtacgagtcgctgccggccgaggcccggcagcggctgcgcgccgtcgacttcgtgcacccggcgctccggtccaggctcttctccccccccctccggcgcctcctcttcagctccggggcgtatgagaagctgcgatacatgagccggctggactatgtgtgggcgcacatagacaagggccagctgcaggtcccggaccgccggcgcgagcacgacgacgagctggagcgccgcccgctgatggactacggcatcgaggcgacggagagccgctgcatgtatgacgccgcgtccatggacagctcggcgtccctgcactcgctccgctgcgtctcctagtcgcctggacactggcatcccgatccccgcccccggaacggcgtgcttctgtggtctggttggtaggaggtcgctgcctggcttcatagagcttcggtaccgtagtttagctgtgtatttaagtatatagtattagtgtaaaaaaggataaagagatccaaatgttctgtggactcacgagatgacttctgcaagtgtgcaagagtaacaggaggaccgtggcatccggaacggcgt

SEQ ID NO: 12484 - DNA, 441 bp, Sorghum bicolor
  Clone ID: LIB3480-044-P1-K1-F3
caacctccaacctgggcccgccccaaatgcgccggcctcgcgccgtcgccgctgcacgccgtcgatgactgccgcccctccgaacgccgcggccggcgacctcttcgctgccaacctcacgggggcgcttcttgcggtcgcctcctccgccttcatcggcgtcagcttcgccaccttcgggcgcttcctcttcagctccgggttgtatgagaagctgcgatacatgagccggctggagtatgtgtgggcgcacatagacaaggggcagctggaggtcccggactgcgtgcgcgagcacgacgacgagctggagcgccgcccgctgatggactacggcatcgaggcgacggagagccgctgcatgtatgacgccgcgtccatggacaactcggcgtccctgcactcgctccgctgcgtctcctagtcgcctggacactggca

SEQ ID NO: 12485 - DNA, 1372 bp, Sorghum bicolor
  Clone ID: SORBI-28MAY03-CLUS16088_1
gcacgaggcgtcacgaggcgcgaggagatcgggaacggctcgtcgccgccgccgggccccgctcctcaccgcaccccacctccggctgcccgcctccctcgccgccgtggtccgcggcccgaagggcagagcggggccacgcgcccaggcgggggtgaacagggccggacggggtcgccggccgggcggtggggtgggcgaatcgattctgcgtgcgcggctgggcaagccgataaaagcgggcgcctttggcctggcgccgtcagcgcggtgaggaagctagacattgaaggcgcagtaaaagaacccaaagaatgggtaagaaaggaaagtggtttagtgcggtgaagaaagtcttcagctcctctggtacagatggaaaggaagcaaaggctgagaaagcagacaagtcaaaatccaagaggagatggccattcggaaaaacgaagaagcactccgagccttcgatctcaacggtggcagggactgctccggtagctccgttgccatcaccaccaccaactcagccccactctctggagattaaagatgtcaatccacttgaaacagacagtgagcagaacaagcatgcctactctgttgcgcttgcatctgctgtcgctgctgaagctgcagcggttgctgcccaggctgctgcggaggttgtccgcctcacagcagttaccacggctgcaccaaaaatgcctgttagttcaatggaagaacttgctgccaccaagattcagactgccttcaggggttatctggcaaggagagcattgcgggcactaagagggctagttagattgaagtcgcttgttgatggaaatgctgtcaaacgccaaaccgctcacaccttgcaatgcacacaaacaatgacaagagttcaaactcaaatctattctagaagggtgaagttggaggaggagaaacaggctcttcaaaggcagctccaattgaaacatcaaagagaacttgagaaaatgaagattgatgaagactgggatcacagccatcaatccaaagagcaaattgaggccaaccttatgatgaaacaggaagctgcaatgagacgagaaagagcccttgcatatgcattttctcaccagtggaggacttctggtcgaactataacccctacttttacggaacctgggaaccctaactggggctggagctggatggaacgctggatgaccgctagaccttgggagagccgattggtggcatcagacaaggatcctaaagaacgtgctctgacaaagaatccaagcaccattactgttcaagccgcatctgtaccccgtgccatctcaatccagagaccagctacaccaaacaagtcaagccggccaccaagccggcagtcacc

SEQ ID NO: 12486 - DNA, 1203 bp, Sorghum bicolor
  Clone ID: SORBI-28MAY03-CLUS13462_1
ggcacgggtcggggccggccttgagctcgggtcctccacgctcgctgcctcagatttctgcgtgtgccgctccggcaatgccgacggccgtgctgcataaagcgagcgacttcccgtgcggtccgcagggcggcgccgactgcacgtccatcctgcagggcggcggctgctacaacacaaacaccgtcgccgcgctcacctccggggccggcgactcctactacatctacaacaaggccaccggcggcacctgcgacttaggcggttccggtgccgtctgccgccacggcccgagtctctacgggtgcactgtcgggatgaagacgacgaaccttagtttgaggatctcgacgtcggtcccggcctccctgagcgctccaacaactaccaccgccacaaacagcttcatggttggttgggggatcggcgcattttactacaccgcaatttgggaggccacgctctgacctaccaggactacctcgcggccctgtgtgtctaccgtgagattgtggataggtcttgacatgagcgacttcgtgatgatcttgttgagcctgcatctgcaccattgattcagcagattcagctagctccacctctccctacttgtgtctcgtcgttttcatcagtaccattactagctctctgtctgaacatgagcctgagccgagctagatagctacttgctccatggaaagggcccggatcgaggaactgtactggagaagaatgggatgatcgaattggttggttccagtttcattccacctgatctgatcacacactccactactaccgccactagtagtggcaatggtggttgggggcggcgtgatcctagctagctagctacactacaggctggtgtatggcttatttggtggttagaatggctgtctctttcctacgaggaccattgtctgattgtctctcttgtactacctctcttctttttcttgtttttatttgcaagaggtccttgtcgctagccctttgttcttaattaaccacctccttgtgtttattatttaatttgcttgtagttaagtctagaacaaacagggaccggtggttttgattcaagattattagctggagcgagcacgcgtgtgtatatgtaatgtcgtctggacgtggacgatcttttatattaggtctctgtctattcaattctattgaaggtgaagctcttttatcctc

SEQ ID NO: 12487 - DNA, 933 bp, Sorghum bicolor
  unsure (1)..(933): unsure at all n locations
  Clone ID: SORBI-28MAY03-CLUS13061_1
atcgcgagcggccgctcgcgatctagaactaggcggcaagatcatccgcgtcgaggcgcaccccatgggggagcaccccaagcccaagagggtgtctgggcgggtgacactggtgggcgacgcggcggngtacgtgaccaagtgctccggcgaggggatctacttcgcggcgaagagcgggcggatgtgcgccgaggccatcgtggcgggctccgccaacgggacgcggatggtggaggagagcgacctgcgcaagtacctggccgagttcgaccgcctctactggcccacgtacaaggtgctggacatcctgcagaaggtgttctaccgctccaacgccgcgcgggaggcgttcgtggagatgtgcgccgacgactacgtgcagaagatgaccttcgacagctacctctacaagcgcgtcgtgccgggaaacccgctcgacgacatcaagctcgccgtcaacaccatcggcagcctcgtcagggccaccgcgctgcgccgggagatggagaaggtcaccttgtgagccgctgcctgcgacgtcgtcgtcgaaatggcattcacttgaggtgttggagtcgcagctgatcggtgtattagtagagatttgcggctgatcgaccgggttaatttaggccaacgtgcgtgggcagtgggcacggagaggaagagaaagaggttgtgcaagtgcagcaagtagatcgaagtgctgcctgtttgtatcgatcgatcctgcaacatatagcatctgatgatgttgagaactcggagcagttcatcgattggattgctgacgacggcaaacttcgacgtgaatgaatgtataatatagattaagacataataatgaagctaaaatttccccgttctagttctgattactgtatccctgtatctttagtttctgaactctgacgagaaagcaaagtatga

SEQ ID NO: 12488 - DNA, 827 bp, Sorghum bicolor
  unsure (1)..(827): unsure at all n locations
  Clone ID: SORBI-28MAY03-CLUS13011_2
tgaccctttccccagatgatcgacagtgaacatactgagcgctataatttctcatttgagaaaaccaagccagaattctgatccttcatttcctcttttcaaaatttatgtctctttgttttttgttctcttaactgagttttgcatacccaagaagatatgatgaccctttccccagatgatcgacagtgaacatactgagcgctataatttctcatttgagaaaaccaagccagaattctgatccttcatttatgtagaaaaaatgattctgaattcatgtagtgatctttttgttgcgtcttatcaaaattatgccactttttgagcttttttggtctcttaacttggccggccggttcgggggatatgatgaccctttccccagatgatcgacagtgaacatactgagcgctataatttctcatttgagaaccaagccagaattctgatcctcagagggggtgatatcgatattggaaggagagggaccagcagcgcaaagatcaggcggccgccatggcggatcagttcgcggattcggcgaacaatgttgtcattgaggaggtgaacaagggcctgaacccaggaatggtggtcctgcttgtagttgcaagcttcctgttgctcttctttgttggaaactatgtgctgtatgtgtatgcacagaagacacttccngccaagaagaagaagccggtctcgaagaagaagctcaagagggaaaagctgaagcagggggtctctgcgccaggagagtaacagccatgctgctgatcctcccgtcctgagctcctatttacatgattattaaagggaaaaaatat

SEQ ID NO: 12489 - DNA, 985 bp, Sorghum bicolor
  Clone ID: SORBI-28MAY03-CLUS13011_1
ccgggagagggggtgatatcgatattggaaggagacggaccagcagcgcaaaggtgagctttttcttcagaatctaccattcgtcctcgtcaactctcgtgctcacctcatccgtccttccgcaaatccatactaaatcttctaatccagagcggggtgttggcacagatcaggcggccgccatggcggatcagttcgcggattcggcgaacaatgttgtcattgaggaggtgaacaagggcctgaacccaggaatggtggtcctgcttgtagttgcaagcttcctgctgctcttctttgttggaaactatgtgctgtatgtgtatgcacagaagacacttccgccaaagaagaagaagccggtctcgaagaagaagctcaagagggaaaagctgaagcagggggtctctgcgccaggagagtaaacagccatgctgctgatcctcccgtcctgagctcctatttacatgattattaaaggaaaaaaatataccagctggagccgcagtgttggaagtgactttgttctgtagatgctttgtgtttaatggtacatttgtattggacaccttgtttcagcaactgatgaatcttagcctaaaccgagctactctgctgttccttattgctgcaagttcttcaaattttggttagtatgaatatgcacagaagacacttccgccaaagaagaagaagccggtctcgaagaagaagctcaagagggaaaagctgaagcagggggtctctgcgccaggagagtaaacagccatgctgctgatcctcccgtcctgagctcctatttacatgattattaaaggaaaaaaatataccagctggagccgcagtgttggaagtgactttgttctgtagatgctttgtgtttaatggtacatttgtattggacaccttgtttcagcaactgatgaatcttagcctaaaccgagctactctgctgttccttattaaaaaaaaaaaaaaaaaaaaa

SEQ ID NO: 12490 - DNA, 1014 bp, Sorghum bicolor
  Clone ID: SORBI-28MAY03-CLUS13533_1
cgggcctcggtgctcgcctccagcagctgcaaggtctccgacgcggcggcggggctgccgcctgcatgtgccgaggtcgcctgcggcaacggtgctcgcggctgcgccgtgggcagcgtgaaggatgagccgcagcagcagcagcagcgccacgacgattaccaccacgagatcgtgcctgagaagatcatacgcgaggactcgccgccgcctgcgccggtcgtttctgaatggaaggagaccgccgccgccgcaaccacggaagacgaggaggtggagacccccaagaaaggagcggcgcctgcaccggaaccggtgccggagcccgtcgtcgtcgtcgtcgccgccgctgcagccgaggacgacgtggtggcggacaagttcgtgacggtggtgaaggaggcgatcaagaagcacgaggcggacgagaagaaggaggcgatgcggaggttccagggcagccgggtgaagacggcgatggaggcgcggccggagtcggagcagccgcgtcgccgggaggtggtgcggagcaacgacgtcattgaggaggcgcgcaccaagctgctggagaagcgccagtgcagcagggtcaaggcgctcgtcggcgccttcgagaccgtcatggacaccaagaaggacgccgccgtcgtcgccgccggcaagccgctgcaccagttccggaagtcggcctaaaaccaccatgcaagctagccaccgcgacggcgacgtccgcatgcatcatatcgatcctccaccacgcttcgtgtcgatcttcgccttaattattaattactattataaaatcctggccagcccgtcgccgcatgcatgcacggcgctaattaatccctatttactactaattaactccggttaattcgtggcaaaccatgtatatagcgtcatggcgttctccatctacacaggaggagggaaaatggggggagaccgatgttgccttctgcagaaattcttcttatataattatataattcatcggttttattcctccct

SEQ ID NO: 12491 - DNA, 788 bp, Sorghum bicolor
  Clone ID: SORBI-28MAY03-CLUS13517_1
cgggaagctgctggactccaatgggcttgatatgtcgaaggcatacatgctcgatacgcaggagacggcagaaaccaagtacaagaaatgggagaaggaacctgctccatatgggtgggatgttttcaatcaaaagaccttgtatgatgcatacaaaaagaggaccaagaatatagaagtcgacatggaggcttacaataaagccaaggaagctgaccctgaattctaccgtgacgcctcaagtctccagtatgggaaggtatccaatgtcccagaagaaaacattgacaaaatggtcaaggaactcaaggagagggaagagaagcggaaatcgttcagcaggaggcgcaagttcaatgaagacaaggatattgactcgatcaacgaccggaatgagcacttcaacaagaagattgagcgtgcctttggcaagtacacgctcgagatcaagaacaacctggaaagaggtactgccttgccagactaaaaccttacacagcagctcgggttcaagaacagcatggaaagaggtactggcttgtcagactaaaaccatacacagcagctatcttatggcattcaagctaactactcgactagaggcgagtgtccctggtggtgttttccttttcacatggttacttcttgtatgcttgtaacttttggccacagttccattgtgacttgtaagaaacctgaaatgggttgtaatgaggcgaggctgaagcaatgtacaaacagtcgtgtttgcatgtgagctgaatggaaataatgatttgtaatgggtt

SEQ ID NO: 12492 - DNA, 858 bp, Sorghum bicolor
  unsure (1)..(858): unsure at all n locations
  Clone ID: SORBI-28MAY03-CLUS17152_1
gcggcggtcggccgggccgggcctcacctgcctcagagagagaaagccgacgacacgcgaagggtgaaccgagattagcggcggcggcgatggcactcccggcgtcgagctccggcctcttccgattcgtctccccgcgcagccgcccccagtccaccgacatcgtggccgccgcctcctggggagtcttcgccggcaccgccggcctctacctcgtccagccatttgactggattaagaaaactttctttgagaaacctgaaccagaggcatgattctccaggcataaaaggctgcaagtctgcaactgcaactttgatacaccacttttgtccgggatgattcctgattgaagagaacttgtataactcagcaaataatatgagaccccctcatgtttccttgtttgattttattcagatgtaggcattcctcttgcatgtaatcctcacgaggggagtgatcatttgacttgtttttcatcacacagaaactgcttggttcaactgtgttaaatgatcttgatggcatatcgaaaaaaaaaaaaaaaaaggcccctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12493 - DNA, 835 bp, Sorghum bicolor
  Clone ID: SORBI-28MAY03-CLUS16857_1
gcacgaggcactaggccgggcaggaggagaacagccttggtcgcctcacaactcgactcgccgccggccgccgccgaagggagcggagcaagatgttcttccacatcgtgctggagcggaacatgcagctgcacccgcggcacttcgggccgcacctccgcgacaagctcgtctccaagctcatcaaggacgtcgagggcacctgcagcgggcggcacgggttcgtggtggcgatcacgggtgtggaggacatcggcaaggggctcatccgagaaggcacgggatacgtcaccttccccgtcaagtaccagtgcgtcgtcttcagacccttcaagggcgagatcctcgaggctgtcgtcaccatggtgaacaagatgggcttctttgcggaggctgggccggtgcagatctttgtgtccaaccacttgattccagacgatatggagttccaatcgggagatgtgccaaactacacaacttctgatggatcggtgaaaattcaaaaagagagtgaggtgcggctgaagattattggtactcgtgttgatgctacagaaattttttgcattggcacaataaaggatgacttcctgggtgttatcagcgatcctggtgcagcagtgtaaatggtctaagaaacgagattgtactccgatgttcacagactacatgtgtaattcgtggttgtacggactacagaacctgttgagaatggtgcgcctaggaccttgtttagcttaactgtagtatataagcaactccagcaatagcccccaaatcagggccaacttttttctggggctgcctgcttttgattgctggttttctagattcg

SEQ ID NO: 12494 - DNA, 707 bp, Sorghum bicolor
  Clone ID: SORBI-28MAY03-CLUS17018_2
gccggccgggccgggccccgccgccatcgcttcgcgtccgccgccaggagaggagaggagaggagggagttttgagaagctcaaatggctcctaaagccgctcctgccaagaaggctgacgccaaggcccaggccttgaaggttgccaaggctgtgaagtctggggcaggcaagaagaagaccaagaagatccgcacttcggtgacatttcaccgccccaagaccctgaagaaggccagggacccgaagtacccaagaatcagcactaccggaagaaacaagcttgatcagtaccaaatcctcaagtacccactcaccacagaatcagcaatgaagaagattgaagataacaacactctggtgttcatcgtcgacctcaaggcagacaagaagaagatcaaggccgctgtcaagaagatgtatgacattcaggcaaagaaggtcaacaccctgatcaggcctgatgggaagaagaaggcttatgtgaagctgacccccgactacgatgctcttgatgtggccaacaaaattggcatcatctaagttacatgcaactggattcggcatctgtgtcgtactagttctatgtgagacgagagtttttgtagctattactttctatggcattcagtggatccattaccatgtcttgatgcacgcttatgagtttgatatcatccaagtgaccgattgagctaatttgagct

SEQ ID NO: 12495 - DNA, 817 bp, Sorghum bicolor
  Clone ID: SORBI-28MAY03-CLUS17018_1
cgctcgaggccggccgggccgggatttgggggccggccgggccgggcagccgtcatcccttcgcgtccgcctcagcccgccgccagcagaggtacaggagagagtttcaagaagctgacatggctcctaaagctgctccggccaagaagggtgatgccaagacccaggccttgaaggttgccaaggctgtgaagtctgggtctgtcaagaagaagaccaagaagatccgcacgtccgtgacatttcaccgccccaagaccctgaagaaggctagggacccgaagtacccaagaatcagcactaccggaaggaacaagctcgatcaataccaaatcctcaagtaccccctcaccacagaatcagcaatgaagaagattgaagataacaacactctggtgttcattgttgacctcaaggcagacaagaagaagatcaaggctgctgtcaagaagatgtatgacattcaggcaaagaaggtcaacaccctgatcaggcccgatgggaagaagaaggcttacgtgaagctgacgcccgactacgatgctcttgatgtggccaacaaaatcggcatcatctaagttactgcattaggcatctgtgtcctagttctttgtgaaaccagagtttttgtagctatggctctcagtggctccattaccatgtcttgatgcagacttatgaatttgatatcatccaagtgaccggttgagctagtttgagctctgcactaagttatacttggatactatctggttttctttatgtcaccagtaatattgtttgttaacaaaaaaaaaaaaaaaggcccctaaggccc

SEQ ID NO: 12496 - DNA, 1178 bp, Sorghum bicolor
  Clone ID: SORBI-28MAY03-CLUS1748_1
cgccaccgtctccgggatcaccctgctgaactccaagttcttccacatgaacgtgttccagtgcaaaggcgtgacgatcaaggacgtgaccgtcaccgcgcccggggacagccccaacaccgacggcatccacattggtgactcctccaaggtcaccatcaccggcaccaccatcggcgtgggtgacgactgcatctccatcggccctggcagcaccgggatcaacgtcaccggcgtcacttgcgggcctggccacggcatcagcgtcggcagcctgggcaggtacaaggatgagaaggatgtgacggacatcaacgtcaaggactgcacgctcaagaagaccagcaatggcgtccggatcaagtcctacgaggacgccgcgtgcgtgatcactgcctccaagctccactacgagaacatagccatggacgacgtggccaaccccatcatcatcgacatgaagtactgccccaacaagatctgcactgccaagggtgactccaaggtcaccgtcaaggacgtcacgttcaagaacatcaccggcacctcatccaccccggaggccgtcagcctgctctgctccgacaaaatcccctgcagcggcgtcaccatggataacatcaaggtcgagtacaagggcaccaacaacaagaccatggccgtatgtcaaaacgccaagggaagcgccacaggctgcctcaaggaactggcctgcttctgagcgatccgttcacatccactcgccgcacagccatgtcttcgatcttctcgctccgaacaaccatcgtcgtctatcttcaccagctatcactaattttggtcttctatctacgcaacaaacataagggttgatcggtgcatcagatcgtcatccttcaatacctttctttatttaggggtcatacaaatattacccggctattgtaatgtaatcctcccatatgcgcggcaccttccgtggacgcaggcaggcatacgggttagtgccgatgcccatgaggaggccggctgaaaattttatgttcttttcacgtttcctacggattttgtgaggcttccatgcatgcatggccaagagatgtgtttaagagcatctctaagagtatttactctgcaacaaatcatcatttggaaaatatttgtgttttcaacaaaaaaaaaaaaaaaaaaggccccta

SEQ ID NO: 12497 - DNA, 1401 bp, Sorghum bicolor
  Clone ID: SORBI-28MAY03-CLUS1794_1
gtcttctccgcgcgcattcacacccacatccgccgttttccgtcgccattccgccgcgccatcgcatcgtccgcgctccctcttctcgttctgccccggtacgattcgtcgacggcggccgtgggcgccggaggtgcggctccgaggtgctgcgcgtggtgcgttgggtgcgctcggttcgggagatctcggagtttgctgctcgcgcggtcggagaggggcgccggaggaggaggaggctgtgcaagctgtgctgagctaagggttcgggatcagtggaggtgctgcggcaggagggagctggagatgtacgagccgccgtcccgaggcggcgggggagccggcgctgccggagagcagcctagggtttaccaagtttggcgaggaagcaacgagtttttcttgcaagggtggttcatatttggacctgatgtgagatccttgtttctcaccatattcctcattcttgcaccagtagtggttttctgtatatttgtggccagacatcttatcaatgactttcctgaccattggggagtttcagttatggtcgtagtgattgtcttcacaatatatgatttgacactgctgcttcttacctctggtagagatcctggtatagtgcctcgtaacacccatcctcctgaacccgaagctattgatatgatcaatgatgctggaaatggtcagacacctcaacaattgcggttgccacggacaaaggatgttatcgtaaatggggtcattgtgaaggtcaagtactgtgacacctgcatgctgtacagaccacctcgatgctcacattgttctatctgtaataactgtgtggagcgcttcgatcaccactgcccttgggttgggcaatgcataggattgcgcaattatcgttttttctatatgttcgtattctcgacaacattactgtgcctctatgtatttggcttttgctgggtgtacattgtgaagattagagacgcagaacaatcgtcgatttggaaagcaatgttgaagacaccagcatcaattgttctgatcatatactgcttcatctgtgtgtggtttgtgggtggtctgtctgtcttccatttctatctcatgagcactaaccagacaacctccctgtccactttttattatagttgtcggcacctgaaagcttacagctaggaattggttgtcatactcataagcatattgctaggaatttgcaatcacttttcctatcctttgcagacaacctatgagaacttcagatatcgctatgatcggcgggccaatccttacaacagagggatcgtgaacaacttcatggagatattctgcaccgcagtccctccttccaagaacaacttccgagctagggtcccagtagagcaaggtttacagcaatcacatgcgcca

SEQ ID NO: 12498 - DNA, 591 bp, Sorghum bicolor
  Clone ID: SORBI-28MAY03-CLUS6125_1
gactagttctagatcgttagcttttaggcaagggcaagaaacgcgtggggggttttggctcctgatcgaaagccgccgccgcctgccggtgcacaagcgaggaagtgggagagaaagagaggagggcaaggaggaaaccgaggccagaggctgagagcagcgcagaagctctgctgtacgggcagccatggcggcgaaggcgagggtctcgctgacggtcttgctcgccgccgcgacgttggcgtgcttatgtgccgtggccgcctccgcctccgccttcgacgtgccgtccgtggccttcgaggagcggttctcgccgctgttcggcgacggcaacgttgtccgctcctccgacgacaggagcgtccgcctcctgctcgaccgccggtcaggttccgggttcatctcttcggactactacctccacggcttcttcagcgcgtccatcaagctgcccaaggactacacggccggcgtcgtcgtcgccttctacctgtctaatggggacgtgtacgagaagacgcacgacgagctggacttcgagttccttggcagccggtggggcgggcagtggcgcgtgcagaccaacgt

SEQ ID NO: 12499 - DNA, 648 bp, Sorghum bicolor
  Clone ID: SORBI-28MAY03-CLUS63072_1
gcacgaggcacgcggcagcagcctcgctcaccacaaacacagtgtgtaagcaaactgattcacactagtggagctagctagtagaggttgttaataatcaccaaacgatacgatgaggccactccttgtttcgcttgctctgattttcgtggttgccggtgtggcgcatggcgccggggagtgcgggagagcctccgctgacagggtggcgctgaggctggcgccatgcgtctcggccgccgacgacccgcagtcgacgccgaccagcagctgctgctccgccgtgcacgccatcgggcagagccccagctgcctgtgcgccgtcatgctgtccggcaccgccagggctgctgggatcaagccggaggtcgccattaccatccccaagcgctgcaacatggccgatcgccccgtcggctacaagtgcggagattacacgctgccctgaccacatcgtcagcaagccggccgtgtgcagtgttatgacgggctgatgaacgagccacgcaaggcgttgtgttggaaaagtcgaatccgctagaataaataagtacgtggacgatgggctcttgctgtgtcactactggactttgcttgtgttgtatgtcaaaaataataataaatatgttccgttccatattgcttgtg

SEQ ID NO: 12500 - DNA, 882 bp, Sorghum bicolor
  Clone ID: SORBI-28MAY03-CLUS6059_2
agcagctaatagcacaacagatagtaaggaaaatatgagttctggcagtgatactaattccaacacttccgttaatgagagtaatgctcaagaaattattacagagaaggtgctaaagaaaagaacatttagggttccattgaaggttgtggaaaaaacgactggtgctggaacaattctttcgaaggagttgtattctgaagcaaaaaataggttagaggcactcgataagaaggatgctgaaaggaggaaaactgctgaacttaagaataacctagagtcatacatatattctatgaaggagaagctggaggaaagcacagatattttgactgtctcaacagaacaggagagggaatcctttgcggagaaacttagtgaggtgcaggattggttatatatggacggtgaagatgctcaagctaatgaattccaagagcgccttgatcaacttaaggccattggtgacccaattcttttcagattgagtgaattaaaggcccgaccagcagcctgtgaaaatgctcgattgtatcttgatgagctgcaaaagattgtcaagaactgggacgcaaacaaaccatggctccccaaaaagagagtagatgaggttgtaagggaagcagagaaactgaaagcttggttggaggagaaggaaaacctgcagaaaaatacccctgtctatagcccaccagttttcacatctgaagaagttgatgagaaagttctggacttgcaagataaggtctcaagtgtcaataggattccgaaaccaaaacccaaggttgagaagaaaacagcaaaggaggaagaacctgctagcaaggagaaaaccacctcttcggaatctgcacccaacgagggtgaatacaccgaaacgtc

SEQ ID NO: 12501 - DNA, 839 bp, Sorghum bicolor
  Clone ID: SORBI-28MAY03-CLUS6059_1
agcagagaaactgaaagcttggttggaggagaaggaaaacctgcagaaaaagtataaccttttgagtcagctttctttttttttattgtcttgtaaagggtggaggagaaggaaaacctgcagaaaaatacccctgtctatagcccaccagttttcacatctgaagaagttgatgagaaagttctggacttgcaagataaggtctcaagtgtcaataggattccgaaaccaaaacccaaggttgagaagaaaacagcaaaggaggaagaacctgctagcaaggagaaaaccacctcttcggaatctgcacccaacgagggtgaatacaccgaaacgtctcaggaatctaaggctcaagaagaggatcagtctgcatcggccaacactagcgattcagaacctgaatctcatgacgagttgtgagtaccagaatccatagatacaggtcggaagacgcgttacgcatatactataagaaggcagtttgaggataaattttggttgctcaaattttcccagtttttatttgacgaccaaaagatgaggctacgtagggtgttggggaacattagatgctgtagagccaaaaagattttatctgtagtttctgattgtggtgtaagttattcgcctcaaaggtgtagttcaggatctagaatatcgcattgttgtactgaactcatttgatttttttaatgaggaatgaatgctatatagattttacgccaatagagcacatttgattttttttttaatgaagaatgctatatagatttacgtcaatacttatgtttaaagttaaacataataataacatttccgtccaacgtgacattttc

SEQ ID NO: 12502 - DNA, 1176 bp, Sorghum bicolor
  Clone ID: SORBI-28MAY03-CLUS6314_1
gcacgaggctcctcttctctctctctctctctctctctcttccccgtctcgctcgcctcctcacggccattaaaccccacccgcgcgcgcggcggccggcggcgagcccccacccacccgagcaagcggaggagtaagagagcgctcggtagtagcaggaggaggcatgggtaccctggggcgcgcgatcttcacggtgggcaagtggatccggggcacggggcaggccatggaccgcctcggatccaccctccagggcggcctccgcgtcgaggagcaggtttcaaggcatcgtacaatcatgaacatttttgagaaagagccaaagatccatagagatgtgtttgttgctcccagtgcagcagtcattggtgatgttgagattgggcatggatcatcaatctggtatggatccatattgagaggtgatgtcaacagcattcatatcggatctggtactaatatacaagataattcccttgtacatgttgcaaaagctaactttagtgggaaggtccttccaaccataattggaagcaacgttacagtcggccatagtgctgtattacatgcatgcactattgaggatgaggcttttgttggtatgggtgccactctgcttgatggagtgttggttgaaaagcacagcatggttggtgcaggatctcttgttaagcagaatacaaggattccttctggagaggtttgggtcggtaatcctgccaagttcctaaggaagcttacagaagaggagattgcgttcattgcccaatcagcaaccaactatatcaacttagcccaggtccatgcagctgagaacgccaagagcttcgacgagattgagctcgagaagatgctgaggaagaagtacgcacacaaagatgaggagtacgactctatgcttggggtggtgcgcgagattccgccggagctcatccttcccgacaacatcctcccacacaatgctcagaaggccgttgcccgctgaacctattgtcaagccatgcttggtgttgttgtctgttgacttggaacattttgacacgagttcattctctgtttttttccagcccaataagattgggtcgagcattgttttaggatcgaccgcacacaccacctctattttgaactgcaatggaaagaagctcaaaggtctcatttacaagcacctgt

SEQ ID NO: 12503 - DNA, 1432 bp, Sorghum bicolor
  Clone ID: SORBI-28MAY03-CLUS650_1
gcgcgatgagtgagcaatgattcccctgccaaatcgcaaaacctcaccaggccaatcctcccctgccccccccccggccccggccccccgcccccggcgccatcacggcccccgctgcgggcccaggggcaagggagagcagagggcggacgccggacggcgatgcagcacgagccgtggcgggctggcgctgagcccgccgggatggccccgaccaccgtcgacgaggcgtccatggagcgcagcaagagcttcgtcaaggcgcttcaggagctcaagaacctgcggccgcagctctactcggcctcggagtactgcgagaagtcctacctccacagcgaacagaagcaaatgcttccgggcaacttgaaggattatgctgtcagggccctggtcaacgctgtcgaccatcttggcacagtggcctacaaattgacagacctatacgagcagcaggcttcagaaatatcaaccctcgagttgaaagtatcatgcttgaaccagcaagtccttacctgccagacatacacggataaagaaggcgttaggcaacagcagatgacaggggctgccagaagacaccataaacattacatcgtaccatatgctggaaataaaagaatgcaggcgttttctgatatgcaagccgatgctgattttgactcaacgccaaggccttactcttcagcaaggacccttcagtggcatttggtttccgagaagaattccaaaaccagtagaccagatcaatctgaaattgcccaaggagacacaaaaactactaagccttcatcaagtggtttccgccttggcaaggaatcatctgcgtctcccttgtcccggaatgtgcagtccaacataaccagcttggatattgttaatgtaggaatgaaggatcagcccacgaccaggcatttgtcatcattcagttctttggacaaccctagagggcgccaaatccagaaggcaccgcttcgcacaaaaagtatgttagccgctttctttgtcaaacacagatcagcaaagatgaaaaacgtctctgttcgttgatcaactgcaagccaagcctgtagtttgctccagccaaaccaatttggaagtgttaaggacatggaagaaactttgtatacatgtttgtatatggtatttgggtcttgtatattagtgctctagagataaaaccttttctgataccctttcaattcgagtcttaatggcatcctgctgatgacctcaatgtaatgatttatattgatatatacaataatagttttgtacttcagagtcatctcactagtcagtgtatacagaatgtaaaaggagtacgttttttcctgccagaaatacgaggtgggtggtccatgtaattaattgattaaagtatgtgtattgctggatttggctcaagtggaaagtggaaaatgtaaggaaa

SEQ ID NO: 12504 - DNA, 986 bp, Sorghum bicolor
  Clone ID: SORBI-28MAY03-CLUS6506_1
ggccgctcgccacccgccgggccaggcgtccccccacgcggctcctcttccacaatccacattccacaccgagaaaagaacaagcagccgccaccggagctcacaatcagaatcatccgccgccgtaccaagagtccatccaccttctacaatctacacacatggcgtcgcaccagcagcagcaggcgggagcggcagcagcggcggcgtccgtggacttcgaggactacctgccggtgatggcggagcgtctaggcgaggacgggctgatgcgggagctggcgagcgggttccgcctgctcatggacccggcgcgggggctcatcacgttcgacagcctccgccgcaacgcgccgctgctggggctgggcggcatgtccgacgccgacctccgcgggatgctcgccgagggcgacttcgacggcgacggcgcgctcagcgagatggagttctgcgtcctcatggtccgcctcagccccgagctcatggacgagcctcgcaggtggctcgacgacgccgtcgaccaggcgtcccgcttcctcttcaccagctgatcgatcgagtcgttcgtcgagtcgagatggataggaaattaattatttgtccacgtccgtccgcgccgtcttcgcttctctctttttttttttttttttgaattcttcttcttcttcctgttgccgttgttcatagatggatcgtcaggcagggatgcgctgctgattggtcgatggatttcccatccatgtgtactcatccgctgttccttccttcccatttcacaatggagtctgaaaaactctgaattaattaacatgctgccgcttctgaccatcaaaaaaaaaaaaaaaaaaaaaaaaaaaaaaaaaaaaaaaaaaaaaaaaaaaaaaaaaaaaaaaccaaaaaaaaaaaaaaaaaaaaaaaaaaacaaaaaaaaaaaaaaccggggaaagaaaaaaaaaaaaaggcccctagggcccgggcccttt

SEQ ID NO: 12505 - DNA, 947 bp, Sorghum bicolor
  Clone ID: SORBI-28MAY03-CLUS1887_1
actgtgggttgtgcatgtaacagattgagagagagctgtactgcatttgttgaagaatatcaagatgaaaagacaagcaggcacgtagatgaaccacgcttcacgttatactaacacaccaacgcacgcacgccgcagatacgcacactccgccgccgtcgtcgccgtcgccggtgcggtgggggtgcacgagcttgttggcagctagtagctcatcagtcggaccgcatgcggttgagctggttgagcgcgggctggaggatgttgaagagcacccagccgatggcgggagcgacgacgatgagcagcaggaggccccggctgtcatcagcgggcgccgcggcggcgagcgcggcgagatcctgcaccgacgcggcggcggaggcctcgggcggggatgccatcccggcggcggtggcggcggcaccgaggccgagccccgcgaccacggcctggctgcgcatgcggttgagctggttcagcgccggctgcaggatgttgtagagcacccagccgatggcgggcgcgaccacgaagagcagcagctggccgcggttgtcgctcccggcgtcggccgccgccgccacgtccgccagcgccgcgtccgacgacgccagcgccgagaagaaggcgcccgccagcgccgcggccgcggccgccgccggcgtggtggttgacgttgacgacacggccaccgccgcggtcgtctgcttcttggcctgcgtcgtcgtcgggacgcgcagcgagacggcgccgctggtggacggcgccgaccgcgccacgatcttggcgggtttcagcagggccatcgtggctatggtcgccatggcagttaggcggggcagagatggcggtggcaccggcggctgctgctggtggtggcggcggatgtgaggtgtggtgtgggtgtggcgtgtgggtgcgcagtgcagtcccgtgcctcgtgc

SEQ ID NO: 12506 - DNA, 1354 bp, Sorghum bicolor
  Clone ID: SORBI-28MAY03-CLUS1907_1
gcacgagggtttctcgtgagattcttcaagaaagtcgaattgttcgtataatgagaaagaggctggtgcggaaagcctttgatatgatacttggcatttcttgcaatgaaaacagagatgattatgaaaggttctgggagaactatggaaaattcttaaagctgggtgccatggaagatagggaaaaccacaagagaattgctcctttgttgcgcttcttctcttctcaaagcaacgatgaattaattagcttggatgaatatgtggaaaacatgaaacctgagcaaaaggacatttacttcattgctgcggacagtctgagcagtgccaaaaatgctcctttcttagagagactaacagaaaaagagtatgaggttctacttttcgtcgaccctatggatgaagtggctatccagaatctggtctcctacaaggataagaaatttgtggacattagcaaggaagatttggacttaggtgataacaatgaggaaagagagaaggagataaagcaggagttcagccaaacctgtgactggataaagaatcgcttgggtgacaaggttgcacgtgttgacatatctaaccgtctcaggtcatcgccatgtgtactcgttgcagcgaagtttggttggtcagccaatatggaaaggctgatgagagcacagtctatgggtgatacatcctctttggatttcatgcgctcaaggaaggtttttgaaataaacccagagcatgagataatcaaggccttgaatgtggcatgcaggaataaccctgatgatcctgaagctctaaaggctctggatgttctcttcgaaactgctatgatttcaagtggcttttcgcctgacaacccggcagagctcagtgggaagatctacgagatgatgacctctgccatcgccggcaaatggtcctcacagtcggaggcgcaacctgccaacccaatcccgcagcactctgcacccgtgatgtcagatgagccgcttgaagctgaagtggttgagtcagagcccgctgctgatgctggtcagcagaagtagggcaatcccttaggcctgctcgtgcaaaacctttgtttagctttgaaccgttgggcacgtggcagagagttttgagttatttgttatgacggcctgtatctttatcatgagctgtgtcactggtaacgttgacgtatcggttagaatttagaagattataggaataattagtggttgaattactagaacctggcactcgttgttcacttgttccgttaccaggagggttgtggttggaactactacttcatcctttctgcacggaggtagtagtaattttgaaggaacgtcattacttcgtttggaat

SEQ ID NO: 12507 - DNA, 1851 bp, Sorghum bicolor
  Clone ID: SORBI-28MAY03-CLUS1936_1
ttagaactagagacatgatagttgcaaacttgggtgccaaaccattggtgattcagttgccgattggttcggaggacaatttccaaggagttattgatctagtcagaatgaaagctattgtatggacaggggaggagctgggtgcaaaatttgaatacaaagacatacctgatgatctccaagagctggctcaagattatcgtgttcagatgctggaaactattattgaattggatgatgaagttatggagaattatcttgaaggaactgaaccagatgaggaaactgttaagaaattaatcagaaagggaacaatctctgccagctttgttccagttttatgtggttcagcattcaaaaacaaaggtgtccaaccattgcttgatgctgttgttgattacttgccatctccacttgatctaccttcaatgaagggtactgacccagaagaccctgaaataatatttgaaaggcaaccaagtgatgatgaaccattttctgggttagctttcaagatcatgactgatccatttgtggggtcattgacatttgttcgcatatactccgggaagctggtagctggttcatatgttctcaatgcaaataaagataagaaagaaagaattggaagactccttggcgtccgcgcaaacagtaaggaagatataccagttgctgtgacaggtgacatagtagcgcttgctggtctgaaagacacaattactggtgaaacactctgtgacccagacaagcctgtagtgcttgaacgtatggaatttcctgatcctgtcattaaggttgctattgaacccaagaccaaagctgatgccgacaaaatggctaatgggttaattaagcttgctcaagaagacccgtcattccacttctctagagacgaggaaactaaccagactgttattgaaggaatgggagaactgcatcttgatatcattgtagacagactaaagagggagttcaaggttgaagcaaacgttggagctccacaagtcaactaccgcgaaagtatttccaaagttgcagaaatacaatatgtccacaaaaagcaatctggtggatctgggcagtttgcagacattattgtgcgttttgaacctttggaagctggaagtgggtatgagttcaagagtgaaatcaagggaggggcagtgcccaaagaatatgtaccaggagtgatgaaaggattggaagaaagcttacccaatggtgtcctcgctggttacccagttgtggacttccgggctgtgctggttgatggctcatatcatgatgtcgattcaagtgtcttagcattccaaattgcagccagaggagccttccgtgagggaatgaggaaagctggtccaaggcttctcgagcctataatgagagttgaagtgataactcctgaagagcatctgggtgatgttattggtgatttgaactctaggagaggacaagttaacagcttcggggataagcctggtggactcaaggtggttgatgcttttgtgccacttgctgagatgttccaatacgtcagcaccctccggggcatgactaaggggcgagcatcctacacgatgcagctcgccaagtttgacgtcgtcccacagcacatccagaaccagctctccaccaaaacggaggaagctactgcttaattttcatttcccgtagataaatccatactgcaacagcagggcaggttgataggaagggcatcaagtgtatgtagctttgtagtgtatttaaccccgtgagggggcattatttgccattgattttggacctgataatggccttgtcgaggttttgcgatgagaggacagtgaaaatatatgtttttggttc

SEQ ID NO: 12508 - DNA, 961 bp, Sorghum bicolor
  Clone ID: SORBI-28MAY03-CLUS1996_1
gcacgccccttgaccccaacgccgccgccgccgcccgccgctcggggatcgcctgcttttctctccggaccacatctacacagcaccaccggtccttccaagtgagctccaatcccctgcgtgtagatggagagggtgctcaaggatgacgccgtccaggagaagggcgagcgcgccaggatggcatcgtttattggggccatggcaatcgcagatttgattaagaccacattgggaccaaaaggaatggacaagatcctgcaatcaactggcagagggcgtaatgttactgttacaaatgatggggctaccattctgaagtcacttcacattgacaatcctgctgcaaaggtccttgttgacatctcgaaagttcaagatgatgaagttggtgatgggacaacttctgtcgttgttctagctggagaacttttgaaggaggctgagaagttagttaacatgaaaattcatccaatgactatcattgcaggttacagaatggctctcgagtgtgccagagatactttgctacaaaagaccatggacaacaaagaaaatacagataagttcagaactgatctcatgaatattgctatgactactcttagttcaaaaattctttcccaagacaaggagtactttgctgaacttgcggttgatgctgtcttgaggcttaagggtagcaccaacttggaatctattcaaattctgaagaaacctggaggatctcttaaggattcctttttggacgaagggttcattcttgacaagaaaattggcattgggcagccaaagcgcattgagaatgccaaaattttggttgcaaacactgctatggacacagataaagttaagatatatggggcacgggttcgggtggattcgatgtctaagggtgcagatattgaagctgctgagaagcagaaaatgagagagaaagtcaaaagatcataggtcacgg

SEQ ID NO: 12509 - DNA, 806 bp, Sorghum bicolor
  Clone ID: SORBI-28MAY03-CLUS19875_1
actactcgacacgaggcagccctcgcatccgcccgcacgcccacaaaaccacgaagaaaagaagaggaggaacgccgcaagttcacgcgacgatggagaacgccgctggcgctcccgctcccgccatcaccaagccgtcgctatccaagaagccctcgccgtcgttccgcctccggaacggcagcctcaacgctctgcgcctgcgccgcgtgttcgacctcttcgaccgcaacggcgacggcgagatcaccctcgacgagatggcctcggcgctcgactcgctcggcctcggcgccgaccgctccggcctggaggccgcggtgggcgggtacatcccggccggcgctgcggggctccgcttcgagaacttcgagtccctccaccgcgcgctcggggacgcgctgttcggccccatcccggaggaggtgcctgaggacgacgacgagggggacatgaaggaggcgttccgggtgttcgacgaggacggtgacggcttcatctcggccgccgagctgcaggccgtgctcaagaagctcggcctgccggaggctcggagcctggcctctgtgcaggagatgatctgcaacgtcgaccgcaactgcgacggccgcgtcgacttcggcgaatttaagaacatgatgcaggggatcaccgtgtggggcgcttagctgcagcactccttcgttgtcaccccctctactgcgtggtttcatgtatgtatctaggcaccgtagaatgcgcttttctacccggagcttcttgttcctcttaatggcgaagtggattctctgctgttcttggcctat

SEQ ID NO: 12510 - DNA, 1217 bp, Sorghum bicolor
  Clone ID: SORBI-28MAY03-CLUS1639_1
acgcgtagcggataggagagcgcatgacactgtacacggacgcgcgagcgaggcgaagctgccgggccaatccagcgtctgcgcgcggagccggaggtgaggggagggccgagggcgccatggcggcggcggcggcggcgaaggacgcggcggtgacgctgagcagcgggtaccggatgccggcggtggggctgggcgtgtggcggatggacaagccggacgtccgcggcctcatccacgccgcgctccgactcggctaccgccacctcgactgcgccgctgactaccaaaatgaagcagaagttggtgatgcactcgcagaggcatttcagactggacttgtcaagagggaggatctgttcatcacaaccaagctttggaactcagatcacggccatgtgcttgaagcctgcaaggatagcttgaagaagctacagctagattatctcgatctctatcttattcacttcccagtagctaccaggcatacaggagttggcacaacttctagcgctctcggtgatgatggcgtactagacattgataccactatctcattggaaacaacatggcatgcaatggaagaacttgtttccatgggactagtgcgcagcatcggaatcagcaactacgacatcttcctcactagagactgcttggcctatgccaagataaagcctgcagtgaaccaaatcgaggtgcacccctacttccagcgcgattctcttgtcaagttctgccagaagcatgggatctgcgtcaccgcgcatacccccttgggtggctccactgccaacaccgagtggttcgggtcggtctcgtgccttgacgaccctgtcatcaagagcttggctgagaagtacggcaagacaccagcacagcttgtcctccggtggggtctgcagcggaacacggtggtgatccccaagacctccaagttggagaggctgcaggagaactttgaggtcttcgatttcgacatctccggcgaggacatggagaagatgaaggccgtcgacaggaagtaccggactaaccagcctgccaaattctggggcatcgacctgtttgcttagcttatttcagctgcatgcatctcagtctcagcctcccatatgtgtggtacggtgtgtggacattattcctgaaccattgctccatctgttgctcccagggcccagatagcatcaataataaggattccgatcctctcttcc

SEQ ID NO: 12511 - DNA, 707 bp, Sorghum bicolor
  Clone ID: SORBI-28MAY03-CLUS16569_1
gatgtgttgtatctacaaccaggtatgttcctgcttattcaactcgggtgaaatttgagaacaatgcatggcacattcttccagcgaattcgtcagatccaatgggtgctgcagatcctgtgtggactgaaagctactggaacactattggcctcagggtctatgccgtgcaagattcagcttacgattggcttattcttcttgccgggctcattatcactgctgcatcttactgcgctgtacagtttggcacaacatacatttcaaaggtggtgaagcatgactgaaacgtcagtgggctgctacactgattctgggtatttagagctggaaatagaactaattgagctggcaatttgtagaacattagcagcacatgagacagggtgattgaactacgagaaagccacaatgaattatgaagccttccggctaagctaaggaggagccaatggatgcagtccgtcatcattatgcggacgtccaggttagaattagaagcccctgtcttgggccgatgcaatatgaaagtgtagtgaccctggcacgtttggtactgaactggtaggtagattatgagacgcctctacctctaggtggatgtttccaggaacgtgtgttttcctttgtttgtggatgctgcgtactcagttttggttgcgtataagcctgttcctctctccaatggatttgctgttgcgcccccc

SEQ ID NO: 12512 - DNA, 1013 bp, Sorghum bicolor
  Clone ID: SORBI-28MAY03-CLUS1662_1
tcgacggcgcggtgggttcggatgaggaggtcacaggaattatttttcattctggaattattccagaagatggtccagcagggtgtacggccaaatgttgtaacattttctgcgatcctgaatgcttgcagtcgctgtaataattttgaagatgcagcccttttactggaacagcttcgcttatttgataactctgtgtacggggttgcatatgggcttttgatgggccatctggaagcttggtctcaagcacggtccctctttaatcagctgggccgcatggattctccaacatcctctgccttttataatgctcttacagatgtgctatggcattttggccagaggcaaggagctcagcaagttgtgcttgaaggggtaaaccgtcgtgtttgggagaacacatggggtgatttctgcttggacctgcaccttatgtcatgtggtgcagcccaagcaatggtacatgcatggctcctgaatgtgcgctctattgtctttgaaggtcgagctatgcctgaatttttaagcattctgacaggttggggaaagcatagcaagatagctggttcaagcactctccgtcgtgtcattgaagcattactcctttcaattggagcgccatttcaggtcgagcgcttcaacatcggaaggttcgtgtcacccagtgctttggtggctgcctggttgagagaatctggcaccgttaacatcctcctcctccgcaatgagcgagtgcaacatgcaaacccgtccaatctggtgccgatgttacaggcgttgcagttgtagccccctagatctcatctcgttgtccgtggtagggttggttctgtcacaagagtttttatattcacctttgttcagaagattgtagtgtatcataggctcagggaataggtcactctattaaatcccagtgttttaggccgttttagcgatgaatgtaatgttgtaaaattgtcagcctgccttacaactcctttcatcaagataaaaagtgcaatttcttc

SEQ ID NO: 12513 - DNA, 1196 bp, Sorghum bicolor
  Clone ID: SORBI-28MAY03-CLUS16581_1
gcacgaggcttttccatcgtctccccaagtccgccggggctccgtcttcgtctacctctcgagtctgaatagatagcaatctccaaatccccaagagcccccggccggtcaaattagggtttcttcctgcttgcttcacagggccgtccagtttgcgggttctgtcggtggcgcttgcgatggagggcttctgggacgcgcaatcgcagcggaggaggacgggcggcggtggcggcttcgaatcgctgaagcgtctgggtcacatctcacccgctgtgcagtcgcacctcaaacacgtttacctcaccctatgctccgcgctggtcttctctgcgctcggcgcctacctccacatcctcctcaacgtcggaggcaccctcacgaccgtcggatgcctggccgccatcgcctacctcatctccctgcccgcctcacgggaccaggagaggaaccgcttcgccctgctcatgtctgccgcgctccttcaaggcgcctccgttggcccgctcgtcgaccttgttattgacttcgatccgaggattctcgcgacggcgtttgtcggaactgcaattgcttttggatgcttctctggcgctgccatcatcgccaaccgcagggagtacctgtaccttggtggtctgctttcatctggcctctccattcttctctggctgcagtttgctacttcaatctttggccacaccagcaccaccttcatgatcgagctctacttcggcctcctggttttcctgggatatatggtgtttgacacccaggagatcattgagagggcgcacggtggggacatggactacatcaagcacgcactgactctcttcaccgactttgttgccgttcttgttcggattcttgtcatcatgatgaagaatgcgcaggagaaatccgaagacgagaagaagaggaagaagcgctagctgctgacccaactatcctatcttgttcctatgagaaaactcttgggactatgttggtggggtcttcccttgcctcctgagtttaccaaactattgaaactatgttgttggggtctccccttccttcctgagtttacctaactatgactattagtactactagtatcatgtgtgtagtttgtactgaagaccagaagaagctttgagcatgcacttgttacctgaatgaatgtaccgatgactgttggcaatgagtattgg

SEQ ID NO: 12514 - DNA, 1999 bp, Sorghum bicolor
  Clone ID: SORBI-28MAY03-CLUS16629_1
gctcctggcccccacgtgcctcctcctccggagcagggccctcttacctactggagcaaccgtgtccatgactgcgcggcgccgcgtgctgctccagctggctctggccctagcaatgtgatcaacaatagcacagccagcattgcccctggcagaaacaacagcttcaagtcggtgagcagcagtccagctgctgctgctgctaccactaccgctggcaatgccgtgaactcaaaggtcgatgactccttccttcaactggaggacctcgatgacacaatcactaacgcactggtggaaagcgggctgttcggtgcaggacaagggtggtagtgccttgccgtggtaacatgtgagcatgtcagcacggtatataaacgtctcactactcttgagttcgtttgccgtaagcgccaaacaatgatgtagcctgattggtgctggcaagtgctttgccacccttgtctttccgctccctcggctttggcacctccgcttcatcatctcctgcacggtgcccactcctgccgcgctggtgcctgtgtgagtgggtctgcgcgggggtctcgcgagggggcccaccccttccgcttcgcgtgtgtctctcctgctccgcaacgggctgatgtgattatcgcacggtccttaaatgaacatgggctttctaaaagatatgtacgctgcctgcagatatcggaggtggtgaatcacatgaaggacttgattgagttcagccacaagaacaatcttggtcctaaagagagcctgaacagttattcgaaaaccatggcgaagtttcagaatatgcctgattcaagacagctcatggctgctgctaaccttgccaataaccagagcaacaccaaactaatgggggtcaaacaagagccaagtacttctgtgaacaatcagactcctggtgttggaaccattggcaataacactctccagaacgccacacctctaaacagctaccagaatatgctcagaacctccagtgcaaatccgattttgctgcagcaggaggcatcaagtgtcttcaaaggtcctgcagcaatgcacaatggcatacagctggaagcggccagatccttccgtggacctaaccaagtgcagttccaacaccccacgtcatttcagcagcctatgttgcagcaaaacaatttccagggttttggtgttagcccacaataccagcaacatgtgcttaatcagcttctgcaggaagttaagaataataacaaccgcacaaaagcacagcaaccacctccagatgcacctaatgcgagcggtagtctcgcatcaggagttgctatccccaacgttgctgctactggggagcagggacaacatatcaataatagcaacagtaaccataacagcgcggtgaagggtgctgctccagctggcactggccctagcaatgtgatcaacaatagcacagccagcattgcccctggcagaaacaacagcttcaagtcggtgagcagcagtccagctgctgctgctgctaccactaccgctggcaatgccgtgaactcaaaggtcgatgactccttccttcaactggaggacctcgatgacacaatcactaacgcactggtggaaagcgggctgttcggtgcaggacaagggtggtaacatgtgagcatgtcagcacggtatataaacgtctcactactcttgagttcgtttgccgtaagcgccaaacaatgatgtagcctgattggtgctggcaagtgctttgccacccttgtctttctggagcttctgtattgacagtttctgatcatatcgtacactgatgtaactccagatgcgtgagtaagatagtgagtgagttggatttggcttgggaatcgggagtggtgcaacccatagctgttagcgtgtgtatgacatgttgctgaatgatgtgatgtgattatcgcaaggtcacaaacattacctctgtcatgtatatcattttcatgctacagggagtgccaattatatctcc

SEQ ID NO: 12515 - DNA, 811 bp, Sorghum bicolor
  Clone ID: SORBI-28MAY03-CLUS16971_1
gccggccgggcctggccggccgggccgggccctccacaataacaaagccacgatccatccgaataaaccgcagagtgccatcccttgccaaatccgagctcgcgttcgcagaggtccatggcgtccaagtccggcgagctgcgcgtgacgcttctgggcgtggccctgctggggttgctgctgctgagccagcacgcggcgcccgtcgacgccgccgagagcgtcgacgccaccgagggcgccgccgccgccggcgtgaaaaagactagcttcagcttcaacggcaacaacaacaacaacaacgccggcggccgcactctcagcagcttcagcatgagcagcttcagcatgaacagcggcagcggcggcgagaagaagcccagcggcaagggcgtctgatcgccgcgcgcaccgcgatgatccacaacccatgcctgcctgccggccacatgcctcgcctctcaccacgcagcgttaccgtactactatatctacatgcgatcgacgacgacgacgaccgtgggacaacgtcggccggagctcgatcggcgtattagttgctgccgcgtggctgtcaaagtcccctgtttctttcttgatctgtgcttgtgttgcattgctggcttcggtgttttttctttcttttgattaatcttgttttcgatcagacgcatgtgacggcaccagctggtcttgtgtgtaagtctattcttggattcattccaatctctacgtactagggtcgtttgggttgtgcgtgtttattgtgtaactcatatactccccttctttcttaaaattttttattaac

SEQ ID NO: 12516 - DNA, 749 bp, Sorghum bicolor
  Clone ID: SORBI-28MAY03-CLUS21823_1
ccggggccccttctcttccccactcgccagtcgccaccgcgcaccttgcatcgatcgtttcgttcgttccaggagtaaaatactaaaatggcgatggcggcggcgaggagagcgctcctggcccacctccgcgtgccggcggtccaccctgcggcggcgggagggactatccccgcggcacggaggctcctgtcgtcgacgacggaggagacgaaggggtcgttcctcgacaagggcgaggtcgccgaccgcgtcctctccgtcgtcaagaacttccagaaggtcgaaccctcaaaggtgacacctactgcccatttccagaaggaccttggactcgatagcttggacactgtcgaggttgtgatggcgtttgaggaagaattttcctttgagatccctgacaatgaagcagagaagattgactccatcaagacagctgttgacttcatcgcctcacatcctcaagcaaaataagaggatttcctttttcttatttcaacgtgcgtttgcatccagaacctgtatgccacatgggaccagttttctgtagcttgcctcagtagataggaagtcatttctttatctttctgaatctgttggaataaaacgtgtaccaaacgattttttgtgttcttgtgcccccatgtgatgcgtgtgaactgtggaacacacggtgcatggaaaccctcattagtaaactaatacagaggtccatttgggatttcttcgaaagggtgaagtacattttc

SEQ ID NO: 12517 - DNA, 696 bp, Sorghum bicolor
  Clone ID: SORBI-28MAY03-CLUS22669_1
cttggagttggtgacattgattttgtgtcttgcagtactacagtttatgaagcaatgctcacagactggatgaggaatttggaagtcggcatcccggctctacttgaggatgggattaacgtgcttatatatgctggagagtatgaccttatatgcaattggctcggaaactcgagatgggtacactccatggaatggtctggccagaaagactttgtatcctcttctgacttatcgtttgtagtagacggtgcagaagctggagttttgaagagccatggaccactcagcttcctcaaggttcacaatgcgggtcacatggttccgatggaccagccaaaagcttccctggagatgctaaggagattcacccaagggaaactgaaggagtcgctccccgaaatgatggttttgaaggcggcgatgtgattggcatgaacatgaagggaattgcttgattactaggtagtctgaggtgtcattccaaggagtgtgtcgatcactgaattgaagcttgttatttcctccctgatactaataacgttggccctgcaatgtaagtaactacccactgatgcatgctgttgatataaagtccaatacaaagggacaatgtcggaaaccttgtctgctgctcttgtaaagcatctcatgtatacaacctttgatccagaaagacaaataatattttttatt

SEQ ID NO: 12518 - DNA, 647 bp, Sorghum bicolor
  Clone ID: SORBI-28MAY03-CLUS22729_1
ccgggagggcaccgtccatccacccacccacagtttgcaatctgaccctagagatcagaacaacagcgctagctcgtcgcaggtttgcagctgtgaattgtgatcgtcgacccaccatgagctaccaagcaggctacccaccaccggcgggccagcagcaggcctacggcggcgcgcctccaccgccggcatacgtcgcgccaccaccggcgtacccgccgacacaggacggcggcgcgtactacggccagcagcagcagcagcagcagcagcagaccaccaccagccgcggcggcgacggtttctggaaaggatgctgcgccgccatctgctgctgctgcgtcctcgacatgtgcttctgagaggaaaccagctatatatgatcgttggccatcgacatcttgtgtatctttgtgttagtgttgctgttaatggtcaattggtcatgcagtcctgtatcatgtgattcgtagtcgatcagctttaatttctggtgcggttgcattgtatctacatatctcttttgttcagcagtcgctgatccattcgtttttctatgactatcattgatgacgtttcctgtacatatgcctattagttctacacgttgttattccacctcaaattaaaaatgaagcttaacaaaa

SEQ ID NO: 12519 - DNA, 1186 bp, Sorghum bicolor
  Clone ID: SORBI-28MAY03-CLUS2273_1
ctggacagctgaacccccttcatttccactccctcaaagctgaaccggcaggctcccatccttcctccgccgccccgcttcggagctgccctcactttcccctttccaccggagagcagagcagagcagcgcgcaccagaacgcagaggcaacaagcaagaagagccagagccggtctcccagtctccgatggcggctcgcgtcctcgctgccctgctcgccgccgccctcgccctcgccctcgccgcccccgcgcgggcgtccaacgacgagggcgacgcgctctacgcgctgcggcagcggctgtccgaccccaacggcgtgctgcagagctgggatcccacgctcgtcaacccctgcacctggttccacgtcacctgcgaccaggccagccgcgtcgtccgcctggatttaggcaactccaacgtctctggctccatcggccctgagctcggccgccttgtcaacctcaaatacctggagctatacaggaacaatcttgacggtgagatcccaaaggaactgggcaacctcaagaacctgatcagcttggatttgtatgccaacaagctcactggaggaatccccaagtcgctttccaagctcaactcactcagattcatgcgcttgaacaacaacaagcttacaggatcaattccaagggagtttgccaagctctccaacctgaaagtcatcgatttgtcgaacaatgatctctgcggaactattcctgttgatggacctttctcaacctttcctctccgaagctttgagaacaacagcaggctcaacggtccagagctacaaggattggttccctacgactttggatgttagatgccgacaccgatgcataacaatcaacaatgtatcccgtccctagttgaaaggaggaaaaacaagatagtagtagaaacctacgtagcttggagaatgccgtgactatataaatgtataatattcagacaagatttgacaagggtgtcatagcaggtcgtgatattctgtgtgcattcagcaacaacataaaaaagaatgtattcagacaagttctgcttggttgatattttgtcccgatggatagctgcttttatgcagccgtgttgatattttgcaaacccaaacaatccattgagaaatgagggtacatattgttcatgaataaatttaagcctccaatacatac

SEQ ID NO: 12520 - DNA, 1000 bp, Sorghum bicolor
  Clone ID: SORBI-28MAY03-CLUS18000_1
cctgccgatctcgcttcgtttgtgggagaagatccagcacctgttggaacacagccacgggagcccggaccgccccccactcccgatcgccggcgatggcgagccttctcctccggtcgctccggcgggcgcgaggcttcagctcctctgccacctcggcggcgaaggaagggggcgacgggaagctcgtggcgacggtgatgttcgagcgcctccccgtcgtcatccccaagatccatcccgccgtctacgccttccaggagttctcgtttcggtggaggcagcagcacagacggcagtacccagacgaagttctcggcaaggccgacgccaggggtaagggtgactatcacattgattatgtgcctgctccaagaatcacagaggctgacagaactcctgctcaaaagtcattcttatgaggcctttgatataaagtctatctggcattttccggcaaaaataaatgaaaatctagtggaaaggctgtttggaatagaccagaaaatctatataaaaatgaagaaactatgcgacccagtgcttaatatgcagtgaagtcttctgttggagtccatggtactacgtcagtagtgaagtatgttcttgggggacttgacaatacgtactttgttggcaatgctccgatggctcatatggatgttgaacaaacagattcaagtgtgtcatcattcaaggtgcttattaatgaaaggtcctaatatggttagaggagggtgaatagcctatttaaaaatctacaaactcactagagagcaagaggttagtaaataacaaagcgaagctttttgctctaaaaaaaaaaaaaaaagaaaaaaaattctgagcaattagcatttatgagcagatttggcagggaacgatcacctcaagcatttcttgaaacagaaactggagatattctattttgcctattttttgagggggcgattctacatctatagcaatgtagcatgtagtaagtagtcctccccaggta

SEQ ID NO: 12521 - DNA, 1268 bp, Sorghum bicolor
  Clone ID: SORBI-28MAY03-CLUS1745_1
gacgcgccaatcgccccccccccccgtggtcatcctcccactcccccccccccttccgaccccgcgccccctccccccgcccatccgcgcggagctccgctccatcgcccccgcccaggagccgccggcggccgcgaccccgtcctcctcatcgccgccgcccagcagacgccggcggccgccacagcgacctcctccgcgagcagcccgtgcatcccccccgccacggatcggcgacgcgcggccacacctggccgtcgaacgcccagtggatgtagcccctccacgccgcgtcgccctcctcgcgggccatcgccgcgcggccgggctcggccgccgccgtccacctcccgccgccggcggcgaccgcggccccgtccgcgagcgccacgtgcagccccccccggcccgcctcccccacgggcgcgccgccgtcggccgccttccccccgtcccggccccgccgcccgccgccggtgccctccgcgagcgcgaacgcctcgcgcacggacccgccgtcctccatctccctcctgcggccggcccccgccacggcgccctgcttgcgggcctcccgtcggccgccgggctcgcgggtgggcgcccgcgggcgatcctctggcgggtgatccagttttgtttctttaattttcttacttagcgaatgatttcatgttaatcggataagcatgagaaacactattataagatgatcaatgcatatttaagatcatgcaaatttggttaatcatgttcctgtgggggccacctgcggcggctgccggcgcctacgtccgcctccgcccccgcctgcctgcggtgcgggctcgcatctcccaaggtcggatactcatggatacttagatagctcatatcactgccgccaatcaagtaatacttcattgacgagatccttggtttgagtcgagctcgagcactccggagttgggattgaacgtccagaaacaaacattcatgccatcaagtccttatgcctcccagacttccagtctctcaattctgattaatcttggtgatcattctgattaatctcagttatctctgctggctcttgggtgacgactgacgaacagttcagtatatggcaataggtgcctagcagccacatgagatttttcaaggagtcagaacgatctcactattttcaggcgaggcgatccctagctggcttgcatgcccgcccggcatcgcccacgcgctcgctcccgttcccgtaccagccccacaccacgcctgagcagccatgg

SEQ ID NO: 12522 - DNA, 458 bp, Sorghum bicolor
  Clone ID: LIB3480-007-P1-K1-H6
cacgcacacgcaaccgtagtggtctacagctatcgtctctcccgtggtcaacttgcggtcagggaccgttcctcccacgcggggtgccctctcccacgccgcatcccctctcgctgtccatccacgcgaagctgcgctccatcgccgcggtccaggagacgtcgtcggcggcgacagcgagctcctcggcgagcatctcgtgcatccggtccacgccgcatcctctctcgctgtccatccgcgcgaagctgtgctccatcgccgcggtccaggagacgtcgtcggcggcgacagcgagctcctcggcgagcagctcgtgcatccggtcccggcacgcctcggcgacgtgcgagcagccgtggccgtcgaacaccccgtagaagtcgcgcctcccgccgtgggagccctccgcgagcgcgaacgcctcgcgcacggacacgacgtcctccatctccctc

SEQ ID NO: 12523 - DNA, 1066 bp, Sorghum bicolor
  Clone ID: SORBI-28MAY03-CLUS18420_1
gcacgaggcaagaatggagctaaagttgttagcctcggactccttaaccaggcacataacctcaatggaaatggagaactttatcttcagaagtatccaaagttgggagtaagactcgtagatggcaccagcttagctgctgctgtggttatgaatagtattcctcaaggcacagatcaagttgttcttgcaggaaatatttcaaaagttgctcgtgctgttgctacagcattatgtaggaagaatatcaaggtagtaatgaccaacaagcaggattatcatttccttaagcccagcatggcagaagatgcagctgagaaccttttattttcaaagacagctactgcaaaggtgtggttaattggggaaggtctagatgcttctgagcagtttaaggcacataaagggacccagtttatcccatattcacagtttccaccaagaatggcacgcaaggacacctgcacctactctataacgcctgcaatggctgtgcctaaaacactacagaatgtgcactcctgtgagaactggctgccaaggagggtcatgagtgcatggcgcattgctggaatggttcatgcgttggagggatggaacgagcatgagtgtggggacatcgtgctagacatggagaaagtgtggtctggtgctcttctgcatggattccgccctgtggctcaagtttgattctccggttgcaattgcaaggcagcgcaataagttattgaaagttatgtcatatgctcatgagaattatgctacagacatagtagtatgttgatgttctattctccatgctctgcctcttatcactttaagaccttcgctatctaaaatttaagatgaactcctttcgtgtaaaagcattctgtggaagcaggataaaaaaattacatgtctataatgataagcagggatgggatgtagcatataagtgttctgatctactgctagctgtttactactttattcacaccgtacactcaaagaccaatgatgaattaattctgcatcagtatttctcaatgcatcaatgcatattttcacaagaaacaagtatggt

SEQ ID NO: 12524 - DNA, 667 bp, Sorghum bicolor
  Clone ID: SORBI-28MAY03-CLUS18692_1
gccggccgggcttcgagccgcccatttgcgccgccgcttgctcgccgcagctcttcgcaccgccgccccttcccgtcgccgccagcggctgctcgatccgatggctcccacgaagaagtcgaagaagagcacagagagcatcaacaacaagctgcagctggtgatgaagagcggcaagtacaccctggggtacaagaccgtcctcaagacgctgcgcaactccaagggaaagctcatcatcatcgcgaacaactgccctccacttaggaagtctgagattgagtactatgctatgctggccaaagttagcgtccaccatttccatggaaacaatgttgatcttggcactgcctgcggcaagtactatagggtgtgctgcctcagtatcattgacccaggtgactcggacatcatcagcaccacccctggcacccagtgagtgaagaagagccaggagcttcgcctgtcactagtttgagatgagatgtagggctcagacttcccgctgcaagctctatgaccatctcttttttatcttttagttatatgtaatttggctatcatgtctgcatctaccatactgataatacctcgtatggctgctatgtgaggagtatccatggttttgtttgatgagatcgttaattttaaaaaaaaaaaaaaaaaa

SEQ ID NO: 12525 - DNA, 1401 bp, Sorghum bicolor
  Clone ID: SORBI-28MAY03-CLUS18861_1
gccggccgcaccagggtgccctttccctcttcctctctctacttgcgacgactgggcgaccgccgccgccgccgccgccctacgacaggtgctcaggtcttcttcggggccttcgccggtgataagcacccaacaaatcattttatccgatacaagcattgaagagagtaatattgcaagcatgtcttcacatatcgtggactcgtctcaggatgaggtgaagaaatgggcaaaattttgcagcgattttactgcgagtgatggaaaacagcatgcattgcttgataatctgaataaggatttgtcccagaagtctgtaatactgggtgatggtttaaaactatcggctgctgataatgatgtgtttgcaactgttcatccttttgtgattcgtgttagtgacagcgagttgcagaaatatacacatgtattgcggtggatggactacattcagaacactgttggttctggtacaactttgcaaaagataaatgtggtcaagtctgtctttgatccaccttctcatccaaagaaagctgataaaggagatgctgaatcaagttcgaagaaagccatttccggacagaagactgctgacaagtcaaatggaagtgctgactcaaagaaacctgcaggggagactaagcctcctgaaaataaggagaatcctactgctgcggggaacaacaaaacctctggagagaaaaagaaagataaagagaagtcagcaggaaaaacagcagagaaagctccagagaaagttgcagacaaggaatcagagtgcaatatcagtatcctgaatatacaggttggccttatccgcaaagcatggaagcacccatctgctgacagccttttggttgaggagatagatttgggagatggtaatgtgcgtcaagttgttagtggtcttgcgaagtactgcagcccagatgatctaactaatcggcatgttgtcttgatcacgaatgtgaagcctgggaagctgcgggatgttatgtctgctggattggtcttgtgtgcttcaactgaagatcatactgctgtggagcctttgattcctcccgaaggagccaagattggagaacgcatttcatttgctgggtttgatgggaagcctgaagatgttctaaatccaaagaaaaagcagctggacaagattactccgcatcttcgtactgatgagaatggaattgcaacattcaaaggtgtaccctttactacatcagctggcccatgtagatcttcgattcgcaacggaaatgttaagtgagcagctcattagacatggttgcatagattgacgtcaaactcatgtagggtgtctgtaccattttgtcatacatcatgtttggtgttgctaaatttgaacagagtcacactatctataagcaattttct

SEQ ID NO: 12526 - DNA, 1363 bp, Sorghum bicolor
  Clone ID: SORBI-28MAY03-CLUS24383_1
gcacgaggctgtctcttgctcttctcttcttggcagtttggcacagcagagcaggcagctaggcatggccatggcgctctccggctacccagcgacgaccccgctgcagctcgtgctcttctcgctgctgctgctcgcgagctcagccgcggccttgccggtgccggagcgcccggccatggaccgcgtccggtggcaggtggacagggtcaaccggcgaggctcttccctcggcctcgtcatgtcgtacgtcgacgaggccaccgcgttgcaggcctccggctacttcacgccttggcatgtcctccccttcgttgacctctatggacggcggtatcacatcggcagcattcggggagtgaacgttatatatgcattgacagggcaacgcaggttgaatgctgctgtcactgtacagactctcatcgatgtcttcagcgtctctggtattgttcactacggcacggcagggagttctaatgactccatgtcttttggtgatgtcagtgttcccaagcttgttgcttacacgggtgcctggacatggaagaagttcaaatcaccgaaagaatcatcagcagaactaagctttggggaatataacatcccaaatggaggagggaatttgctaggatccctgaaatacagaaacgaggagctatactcagttggcaagcctatggaagaagttttctggctacctgtagattcagcatggttcagaattgcagaacaacttaaggtcaaacttgaaaggtgcaatgacactttctgcttaccgacaactccacaagttgtctatgggctaaaaggatcatcagcagacatgtttcttgacaacgcagaatacagaaagttccttttcagagaatttggggtgtcaacagtagatgaggagagcgcagcagtggtgatgacaacaacatcacctggcatacctgtgattgtattccgaggagtatctgatttggctggaggggaaccaacatggtcatcaacaagcttgatgaatctggcatctattaatgcattaaaagtggcagttgagttcatcgctacagttggcaagcagaagtcaagcgtatcagtacaaaggagcaataactaaacaaaagatgacagccatgttcgttcattactgctccaaaataggtttgcagcaataactggaagttatgttcagaatgatatgaaatcttgtggcttcaagtcatacaccctctccaataaacggataaaacgtttgagatacatagacacattgtaaccacacctctagttaatgatttgtttttccaggtatatattttggggtaatgctataacaaaatggtggttaagatatttcattttttagaagaat

SEQ ID NO: 12527 - DNA, 1157 bp, Sorghum bicolor
  Clone ID: SORBI-28MAY03-CLUS2450_1
gcacgagggatctgccgaagttccggtccttatcctcacacttcgagtgcccgaatgtctccgcccaccatcttagccaactacctcctatacggactgcaggatggccaccctccttggccaccccgttcctggagttctcgcgctgctgcattctgcacaccgaagtccccgggtgttagagcacacatgcaaccatctcgccaaagaacgtcaaaccacattctccgagtcgtgtagtgatgcttccgactaggcactggaaggagtaaatacttccctcagtggagtccccagttaccacgttcctgacccctccgacggtgccccaaaaagcaacgaagttctcccacaaagcaacgaacttcctgtaactctcaacccccttcctgtaacgagcaacccgtccggacgggcctggcctttgagagctcctgtaagagatgggcgtgttccatcatggcaggagctagctgcatcagttccccgtggaattccatgtatgagtgatgaagttgcaacagcatggctaaacaatgataacgtcagatctgcgattcatgctgaaccagtcagttcaattggaccctggcaattattcacagaaatagattttgatcatgatgctgggagtatgataatttatcacaagaaccttacaagccagggttatcgtgctttgatttacagcggtgaccatgatatgtgcgtacctcacactgggactgaagcatggactgcatctttaggctacggcatcattgattcatggcgacaatggattgttaatgaacaagtagctgggtacacccaaggatatgaaaacggccttactttcgccacgattaagggttctgggcacacagttcctgagtataaaccacaggaatcattggctttctatagccgttggcttaatggtactaagctgtgatactcatgaaggagctcctgacgatgaggcctatttttgtgcaagttcatgtagtactgaaccaaaaaaagtacaatgtggagaaattggataaagcatacagcaatataaggcagctaaaggatcaaagtacctagcgccaactacaatgttgcaatgattcgtgcaaatattatatcaaagtaccttacatgcattattcattagttcactgggaccaaac

SEQ ID NO: 12528 - DNA, 1365 bp, Sorghum bicolor
  Clone ID: SORBI-28MAY03-CLUS24644_1
acgcggcctagctctagctgcgcccgcgcggacacgccgggagctctctcggaggcgcgcgctagagtctagagcagcgtgccagcgggcatggcggagcagctcgtctccacggccgagcacgacacgctgccggacagctacgtccggccagagacgcagcggccgcgcctgcgcgaggtcgtccccgacgcggagatccccgtggtcgacctcgccgtccccgaccgcgccgccgtcgtcgccagggtcgccgaggcgtgccgcacccacggcttcttccaggtggtcaaccacggtgtggcggaggagctgacggcggcgatgctggcggtggcgtacgagttcttccggctccccgccgaggagaaggcgaagctctactccgacgacccgggcaagaagatgcggctgtccaccagcttcaacgtgcgcaaggagacggtacacaactggcgggactacctccgcctgcactgccatccgctggagcaatacgtccccgactggccggacaatccgccatcattcagggagacggtgagcgcgtactgccgggaggtccgggcgctggggttcaggctgtacggcgccatctccgagggcctggacctggacggcgtgtacatcaaggagacgctgggcgagcaggagcagcacatggcggtgaacttctacccgcggtgcccggcgccggagctcacgtacgggctccccgcgcacacggaccccaacgcgctcaccatcctgctcatggaccagcaggtggccggactccaggtgctcaaggacggccgctggatcgccgtcaacccgcggcccggcgcgctcgtcgtcaacctcggggaccagctgcaggcgctgagcaacggcaggtacaagagcgtgtggcaccgcgccgtcgtcaactccgacaggccaaggatgtcggtggcgtcgttcctctgcccctgcaacgacgtgcgcatcggccccgccgccaagctcgtcaccggcgacacgccggccgtgtacagggactacacctacgccgagtactacgccaagttctggagcaggaacctggaccaggagcactgcctcgagctcttcaggacctagcagcagcacctcctgcgtacggtagtactagcagcagagaagaacaaacagcagagtctagcgttttcgatgcttctctttcgtttagcttttcggttttccatcatcccgttttgttcagtgatgtaccatgtagtatgtatacgcaacagatgtactctggtagtttgttcgttagaagtgaacttgccgactccatcagaaactgtctgtacccttcatcaacttccctccaattcagctttgcttatacaagaactcaaa

SEQ ID NO: 12529 - DNA, 601 bp, Sorghum bicolor
  Clone ID: SORBI-28MAY03-CLUS24699_1
gggtgcaattccagtgcacgtggggacatcgtctccttcctccactgcccacctgttctgcacttctgccgccgccgctcccgctgccgcagggaaccctagaccctgctgaacaaccccctcacgacccgcacggcgtagctttgcagtttgcgcgaaatggaattcggcgtcgcctctcacggcgccgtcctcgccgccgcgccgctcgtcgcacggccgacctggctcctcctctcgccgccgccaccggcgtcgtgtattcagattcagaatcgtctttattcgatctcgtcactcccactaaaggctggacctgtaagggcatgcagagcttctttagcaagcagctacacgcagacaactgaaacagttgatttggactgggagaacctgggttttggaattgtgcaaactgattatatgtatattgcaaagtgcgggacggatgggaacttttctgagggtgaactggtgccttttggacctatagcgctgagtccatcttctggagtcctaaattatggacagggattgtttgagggcctaaaggcgtataggaaaactgatggatccatcctattatttcgcccagaggaaa

SEQ ID NO: 12530 - DNA, 1398 bp, Sorghum bicolor
  Clone ID: SORBI-28MAY03-CLUS24700_1
gcacgaggtgctcattggtgggcttgggcgtcggtcggcggctgccttgctcttcggtcctcagatccgttcctcatcctcctgcttgtgccgtcgctgtcctggtccttcagatccagcggcgtcaggcgcaagcgcaactgtcaggacggcgcacggcgggatttggagggcgaggttccagggggcaggagcggatcctgaagccggcaagagtacgagcgcagcacggcgtcccgacgccggcttccctacgtgcgctccgccccctgtccccggccgcctccccagggcccgcgccggcccggcggggcctgcctctctccctcccccccgcccgcaggtccgcccccggcccgtcggggccatcctcattcccctcccctcttccgcccatgggcgccgggtgcagggccctgcggcagtcccgcgtttttctggtggcgggccgccggtctcgtgggcctagctcttttggctggttgccggcgtcgttcgtccggccgttgatggtgggtccgggcattattctttcaatcaaggatgatgggtctgctgtcatagcagcgaattccacattctttgggctgcgggatatgttgcagggcacttccctgttgctgttcgtaagcgcaaaaaatctgctgttcttgctgcctttgaatctgctgaaggtttctatatatttgatgctaagccaagagaaaatggctatataaaagcagtcaggtttgagactcagtctgttcaagttggtgatcctgttgattcatttgtttttcctagagaagggtatattacaccaaccggttattgcagaggttcagtaacaggtgtttgtagcagagttctatttcatgattgccctatgcatgagtatgcttacttaggatcaccattgttcaatttgtctggtgatctcgtggggataacatatcttgatcagagacactggcaagcatggactgtttggcagctacgagatacttttaaacactggaaaagtacctttgtttcccagggaaatgaagaacctgcaggggcagaagctcaagtggaagaacctgcaggggcagaagctcaagtggaagaacctgcagagggctgactattggtgggagatagcctgagcagcagcatatgcaaggagataacctgagcagcagcatatgcaagatgcatgtcacgcatctcaaaagtctcaggcagctgcaactgtggagttgagttgtagcctagtgtacgcgttgatttaggttttatttttgaactgttatgtgactttttaggaaccatttatcctgctgagctgtttgactgctatgaggtattaatgtgacgcgatctgttgaactcttttcacattcatgaatgttaaacaatttctattggggtttt

SEQ ID NO: 12531 - DNA, 620 bp, Sorghum bicolor
  Clone ID: SORBI-28MAY03-CLUS20171_1
actgtgcgccgctcgagccggccgggccgggacagttcaccgcagagaccagaacagagcaaacaaagagagcagagtgtttccgagcgagtgtggtggtcgtcgtcagcagagaggctagagatcgagagagagagaggatggcggacatcgcgttgctggtgacggagcagttcgagaaggaggtgaagagaggcgccggcgccggcggggacaacggcagcggcagcggcggcgagaggaggaattttggggccgtggccaaggtgtggagctcgtgggtggagtccgccaccaccgccgcgtccggggtgagggtcagcgtcgcggcggtgcacctggagcccaagaccgcgctcgccctggccgccgccgacggcctcttctccgcctagtgctctagtagtgtcgcctgcttccattgtctttcctaatcgagtcctgcaccggcaccatactatactggtgtaatctgtacagtcgtcagtcgctgcgcctgcgccgtaatctgcaacagaattactattcatatttgctccagaaactccatggatctgctgcatatcctcgattgttttcctcaaaaaacttatgcactcgactgttttcttgtcgtggag

SEQ ID NO: 12532 - DNA, 1021 bp, Sorghum bicolor
  Clone ID: SORBI-28MAY03-CLUS20451_1
gccggccggggctctctttccagtgcccgccgccgtgcgctcgttcgcccctctccctttgtttgcgacgactggttaggctaccgacgagccgccgccctacgccaggtgacgagtccttcggcgataactttgccggcgaagagcgcccaccagatcaatccctgctgaaaacgcactcgatggcctccgcgacggggggttcctcctcggagatggcggtggaccacccgacggggccgggcgccgtggagaagccgcaattcgatgctctgatgccgagtgagatgagcggcgggaggccccagttccgaaaagtgaccgtgccgcagcaccggttcgcgccgctcaagcgatgctggatggaaatctacacgcccgtgtacgagcacatgaagatcgacatacgcatgaacctcaaggcaaggagggtggagctaaagacaagacaagatacaccagatgtgagcaaccttcagaagtgtgctgactttgtgcatgcttttatgcttgggtttgacattgctgatgccgtcgccttgctgcgtcttgatgacctctatgtggattcctttgagatcaaggacgtgaagaccctgcgaggggagcatctgtcgcgtgctattggccgcctatcagggaaaggaggcaagaccaagtatgccattgagaactctaccaggacccgcatcgttatcgctgatacaaagatccatatacttggatcctttgttaacatcaaggttgcgcgggattcgctttgcagtctcatcttgggttctcctgctggcaaagtgtattcgaagctaagggctgtatcagctaggttggcggaaaggtattaaattaaatgggttttgctcgcaccatgtaatggttgcaattttgatcacacaatatgtggttatagtagctgatttgtgtgctcgggggagtgggacagtttattgtatccttataaagagcgtactttgatgctgggatatttaaattggtatctatgccgtgtgtgctctttgct

SEQ ID NO: 12533 - DNA, 787 bp, Sorghum bicolor
  Clone ID: SORBI-28MAY03-CLUS20537_1
gccggccgtggccccaaactccccaagcaatttccatttccaccaccaccactctcttcctcgcagcgcgcaccaacccgccgccgtctactgcagctccgcttcctcatggcctcccctacggcgggtgatgcccccctcgcggctccggctccggcggctgacgcgacggacgcggccctcgccgccgcggccgcggtgccggatccagacgcagagttcgggttccagcgcccggagctcgggaaggagaagctggtcgggacggtggggttccacgagcgccatgtgttcctctgctacaagggcccggacgtgtggccgtctcacctcgaggccgctgagtctgatcgcctccctcgcctcctcgccgccgccatcaaggcccgcaagcccaatctgaagaagaccatcaaattgaccatctgtgaaggagaagatggcactgaatcatcaaatggagatgtgttgatctttccagatatgatcagatacaaagggctgacccattttgatgttgacaactttgttgaagaagtgcttgtgaaggatattgactggcttcctggatctcctgagcctatgagtggttcgtatgtttttgtttgctcccatggaagcagggacaaaaggtgtggtgtttgtggacctgagttgattaaaaggttcaaggaagagataaatggactgggacttgatggtaaggtgtctgtcagtgcatgctcacacgtggggaggtcataagtatgcaggaaatgtcatcattttcagctctgttgccaaggag

SEQ ID NO: 12534 - DNA, 851 bp, Sorghum bicolor
  Clone ID: SORBI-28MAY03-CLUS21007_1
gcacgaggccccatcccgcctctcccgttcacgcggtcctaactcccaactctctccctcgcgcgcccgcgcgctctctctagccggcgacgactgggcgagcggcgccaccctacgccaggtcttcgtggagatcatcgccggcgatgagtttcaaccagtctactgtcaaggggcagaccaggagggagaggcctagggctcgccctcatggcctgacgcagcagaagaggcaggaaataaaggaagcctttgatctgtttgatacagataactctggaaccattgatgcaaaagagctcaatgttgccatgagagccttgggatttgagatgactgaagagcaaattaggcaaatgattgctgatgttgacaaagatggcagtggagcaatcgactatgaggagtttgagcacatgatgactgccaaaatcggagaaagggatagtaaagaggagcttacaaaagcattccgcattattgaccaagatggaaatggaaagatttctaacattgatatccagaggattgccaaagagttgggtgtaaatctcaccctcgatgagatccaagacatggtgcaagaggcagatagaaatggtgacggtgagatagactttgatgagttcatcaggatgatgaggaggactagctatggctactaggtgtatcttatgtgagtcctgacaccgtcagttggtttatgaccacaaggggtgtgactggtgtaattactatgaaacaataatgttgtgttctgcttatgtttatccttttttttaattcttgctgtgcctacttaagtatggtaactagagtaatatatatgcaccagatttctgttatagttc

SEQ ID NO: 12535 - DNA, 373 bp, Sorghum bicolor
  Clone ID: LIB5052-012-A1-XP1-B2
gccggccgggctttcgggatgcttaaaaaggaaacagttgccaaagagttgggtgtaaatctcaccctcgatgagatccaagacatggtgcaagaggcagatagaaatggtgacggtgagatagactttgatgagttcatcaggatgatgaggaggactagctatggctactaggtgtatcttatgtgagtcctgacaccgtcagttggtttatgaccacaaggggtgtgactggtgtaattactatgaacaataatgttgtgatctgcttatgtttatccttttttttaaaaaaaaaaaaaaaaaaaaaaaaaaaaaaaaaaaaaaaaaaaaaaaaaaaaaaaattaaaaaaaaaaaaaaaaagggccccta

SEQ ID NO: 12536 - DNA, 1376 bp, Sorghum bicolor
  Clone ID: SORBI-28MAY03-CLUS2209_1
gcacgagggcaatcctctgtttctcactcatcgtcttcctctgctccagtttttgttgtcgattcaggcaatggataccagagcagtggagcacacagcaatcctctgttcctcactcatcgtcttcctctgctccagtttttgttgtcgattcaggcaatggccgacgaagttcagcagctcaccagggccttctcaggccttggcgggctcggcgtggatgagccgacgatggtgtcggcgctggcgcggtggcggaagcagcccgagaagcggtcggggttccgcaagggcttcccgggcttcttcaagagccacggcgagatcgaccggtgcgaggacgagtacatgctgcacctggccgccgagttcgcgcggttcaagaacctgatggtgctgtgggcgatgcacccgtgggagcgcgacgcccggctggcgcaccacgtcctccaccagcagcacccgcccgccatcgtcgtggaggtcgcctgcacgcggtccgccgacgagctcctgggcacgcgccgcgcgtaccaggcgctcttccaccactccctcgaggaggacgtcgcgtaccgcgccagggacaagccctactgcagcctgctggtggggctggtgagcgcgtaccggtacgagggcccgcgggtgaacgaggaggtggcgaaggcggaggccaaggcgctgggcgccgccgtgaagagcgcggctgctgccggcggcggcgggaagaagctggtggagaacgaggaggtggtccggatcctgaccaccaggagcaagccgcacctggtggagacgttcaagtactacaaggagatgcacggccggcacgtggaggaggacctgagccagagcagcggggaggaggagacgacgaccctgctggagaccgtgctgtgcctcgccgcgccggccaagtacttcagccaggtgatggagggcgcgctgagggacggcgcggaccaccacgggaaggaggcactgacgagggtggccgtgacgcggtcggaccacgacatggacgacatcagagccgcctaccaccagcagttcggggccaagctggaggacgccattgcggccaaggcgcacgggcactacagggacgcgctgctctccttggtcggcgccggcaagtgatcaatgtgctgagcgctcgctgcctgctgctgctgctgagctcgatggagtgtttttttcccccctccctcccttcccgtgtgtttttgtttcgttttcgtcttcgtggtgtcgtctgtgtattgcaaactttgttctgttgtcgatcgagcgggactgtaacatttgcagctgatgagtcatcagatccaataagatgtgcaagagttctttatttcaacaacaaaaaaaaa

SEQ ID NO: 12537 - DNA, 781 bp, Sorghum bicolor
  Clone ID: SORBI-28MAY03-CLUS21144_1
ggccgatgctaacaactttgccaatgccaatgcaaatgcgaatccatggttcatgggcacaggagtccctttggcaaatgcgcggtgggggaattatgcattctcagctgctttcgggggactattccctatgcttagcttccaagttcatgggtttccagatgctgctgcttatgcacagcctgctgggttccactatgggtatggccatgggcatggattccatggcggtcatatgggacatacccatggtgtccaccgacaagcgccattgggccaacagcagcaggcagatatctacctgaaggccctgctcttcatgattggaattctagtgattgcaagcctcctcgcattttaaacttgttggcaacaactaccaggaagcctgctcgtcatggttggaacttggaattctgggaatgtaatcctcctggcatttcaaagtcgttggtagtttgacattgtgatggcatattggcctatgaattgccagaatttcagtgttgggtctgtactatagcctggtgctgaatgttgcataacttattattgtatttgcatgaagtgtccatagaatatgtatttacgtctagataagtatctgcgttttacaacaccttatagagtgtaaggaggaacatggtgcaattgttgctgtttagttttgatggtttttaactctttggatgtgaacgtgatgtacaatttgggtcctgtttagacgtaaggcaaaaaaaaaaaaaaaaaaaaataaaaaaaaaaaaaaaaaaggccccta

SEQ ID NO: 12538 - DNA, 949 bp, Sorghum bicolor
  Clone ID: SORBI-28MAY03-CLUS26515_1
aattcggtttgcgttggctgcattaccttttaattcattttaatttgagcaaaagcttgtaacaattcgattcctacatcatcagctcaagcttctgcacactttacaacatatccaagacgccatcgaaacctctctacacaaccggagataacattatgcatccatccataatgactgaacctctcctaccctgagctatggcacaacaaaggcgactgttaaacatctgaccctgagtgagcattgcaaggtgtgtggtaggccattgcattgtacacgcagaagctcagtcatcagtcatcatgacttggtcttgaagggaacatagtgtttgagcgattcggtgactccctcaatggacgcgaccgccgaggcgagcgacaccaggaagcacaggaagctgagcagctgcagcgccacccacctggtggtgtacttctgtatccgccgctgccggatgtacatctccactgggtagtacacggtgagcggccagaacccgatggcgccgaggaagcccaggatgtcgttgaagaagggcatcacgatggcgagcaccgtgctcaccaccacgaacgccgtcctccacgtcagcctgagcatgttgacgttgaacctgccggccacgagggggtgctcgcgcgtgacgaacttggcgttcggccagcgcttggcggcggccgtctccaaggccgcaaagatgggctgcgagaagacctggtacgcgcccaccaggtgcaccacgatgcagacgttggcaaagtcgatcagccagtaaggttcgtagaagccgaacccggtcaggatgttccctggcgccgcgttcccgaacgccgagtacccaaggcagccagcaagcatgtagaacgccgtggtggtcgtcacgcccatcagggtcgccttcttcatcgtcttgttctcggcgggaggagacttcaccgtgtcc

SEQ ID NO: 12539 - DNA, 1020 bp, Sorghum bicolor
  Clone ID: SORBI-28MAY03-CLUS26710_1
gcacgaggcaagaatgacctcaagaatcataacattccagtggttctccataacaaatatgtgggtaaagggatggctgacaatcccatgaactccatattcataccaacaagaagccctcctcggcagtctctcattgaaactgttggaataactgaagaaggtgtgttcattgagaccagcagcgggtttggtcagtcatcagagagtgtccactgccaccatggaatcatgtctgctgagattggacagctttctaccattcctccgaagcaaagaaccctggaagcagcccagaaatacgctcataacaaacttaatctacccaaagaggtattccacggtggttttatacttgagaagattgatggtccgctgtccacaggccatctggtcctcacagacactgatgtccggaacaatccagcagttaccttcaactacttcagtcatccacaggatctcaatcattgtgtctatggtatcaagaccattgaaaggatactcaagacaaaccgtttctctgaactctctgctgatggtgctgggttatcaatggaaagggtgctcaatatgagtgtgcaggctaatgtgaacctgatacccaagcatacaaatgacacagaatccctggagcagttttgcaaggacactgtgatcaccatctggcattatcatggtgggtgccatgtagggaaggtggttgaccagcattacagggtgcttggagtttcaggtctccgggtggtcgatggctcaatattttctagatcaccagggaccaaccctcaagctacagtcatgatgatgggcagatatatgggagtgaagatcctaagggaaaggctgggacgagcagctggagtgtagtcgattcctggacattagctttttattatgtgtggcctaggaaagaaattactaattttttgtgggatccagaatgattcgctgaagaaaaacaagctatgtgtttcatctgtacccagtaatgatttgtctaatatgatattgcagact

SEQ ID NO: 12540 - DNA, 873 bp, Sorghum bicolor
  Clone ID: SORBI-28MAY03-CLUS26711_1
tgcacgaggccaaatgaaaagaagcaatttattccctttgcatctccacctccagtttttgctccttcagtggaaaaaaccaagacagttccctcaccttctctctctccagtgaagccaacagagccagaaccagaaaccttcacaaagaaaattgatgaagtgaccacacctccagtacctcccacggattatatgttcacaaaacagccagaacaagtgcggacaatctctccttctgagagtggggcaaatattgacttggacgacgttttatctgctgctcagacagctgcagaatcagcagagcgagctgcatcagcagcccgtgctgctgcgaaccttgcacaactgcgcattgcagatctaaagaagaattcccaggtctataacaagtacagcgatagtgccttaagggaaagccatcatcagactgaggggacacagaaaccagtatttgatcaccaggactccttcaccaacgatacacaggactatgtgccatctcatgtgccgcagaggtcgccatctttggaggacgatccatatttctcctatcccaacttgttctcagcgccaaaaccctgaaggcggaaaactagtggtctgcatgtagttgttcagaatagtttgaagattgagatatcactttttcagctctgtccagtcctcttatgtttggcttttgctgttgcctccaaacttctgtgtattgctgagttggtacatacaggacgagaggagactactgggttattacttggctataaaacctgtctagttgagtatctgtaaattgtacatgtgcggtgtttgtatcagttttctgaaacatttctgcagtcctacaggtaataacagaaattgaatctc

SEQ ID NO: 12541 - DNA, 1100 bp, Sorghum bicolor
  Clone ID: SORBI-28MAY03-CLUS26716_1
gcacgagggagaagtcgtcgtcgtcgcggtcctcgtcctcgtcggggatgacgtccgtggactcgtcgccgccgccgccgcagcaccacctcccgacgctgctgccgctcatgcccgtgacggcggtggaggataagggccccgctgctggtgctgcgacagaggagcttccggcgcctgtgccgtctcaggtggccgcggcagccacggggtcggcacggccgtttgctccgcgggcgttgcgcccaggctccgcggcttgggcggcttcgttggtgacggtggaggaggtgaccgcgacgtggcgcgacggcgaggcgccgccgtcctccgcggcgtgcgtcgccgacgacgccccggcgttcgtgtcggaccagtggggccgcgtcacgtggaggaacgccgcgttcgtccgggctgtacccgcggacgacggcggcgacgaggtggagacgcagacgcccgtggcgctcagcggcgcgctcccggcgtggggcacctgctcgggattcacgtgccgcgtccgctggcactcgagcccccggcgcgtgggttccacttcctccgtggtggcgccctgcgatgtgtggcggctggacgccggcggcagctacctttggcggctggacctgcaggccgctctcactctcggcggccgcctgtgactgtgaaaacccgcctgtgactgtcaagttctgaaccccagcaacgaatatgctgtagtactcctacgtgcggattagtagtgttttattctgagattggaaaccatatgcgttcttactgacgtacggtatggtttaatcggcgtattgctatcctggtcgggcttaattaaggatgtttgaagccagattgggtattactaattatggattagtttagatcccttggaatgggagtgagtgacttgccaggacttaagaagaaaccaaagcatgtgacgaatgcttctggatgtgcagagttcagtcttccttcttcagcagcacagaatcttgctcttctcatttgttttccttttcttctcttgagggcacccttaacgtaaactatagtttttattatgaatatttattataatgttacttaagtgtttt

SEQ ID NO: 12542 - DNA, 1078 bp, Sorghum bicolor
  Clone ID: SORBI-28MAY03-CLUS27195_1
gcacgaggcctcgtgccgcattagttttatacattctttaattccagatatcaggcgagtccttttcctgaaaatacctgaagcacgcaaacagctgttaatgtctgagctggatagagtagctcaggactacaaggtccatcgagatgaaattcacagcaaactcgtccagataatgagagagaggttgcttgcaaatcttagaaaattaccccaaattgtggaaggctggaatggcccagaagataatgatgtgcagccaagtccatttgctaaagctgttacaaaggaagttacatatttgcatcgcatcctttctcaaacattgcttgaggttgacgtgcaaataatattcaggcaagtggttcaaatattccattcacatattacagaagcattttcaaaattggaagttagtactcctcaggcaaagaatagattatgccgagatgttcagcatattcttgcatgcatccggaagttaccagctgagaacttcagttcagaaactattccaaattatggtcttcttgatgaattcttggctgagaacttcgggacaaaagttggtgaatgattgactgtacattaggaactgactcatgtctacaaatgttcaatggtggaaaatatgttaaatgggaagcgctccaagatggtgccgttttcggcgtgaattctgtgcaggtattgctgtgcagggtagtgaaaacaatcagctcctctgatgtcaacaaagtaacatgctgatccttgcacttcccaatatgaaattttggctccacagctttgccatttcaggccatattttttgttttgttttgttttgtttcaatagtaattttattcccgtttgggaagctgatatcggttagatgctggtatagaggaaacctgagttttggcagcacgacctattctttgcatggtgcttcatgctgttaggtccattgtatcgaatatgctgtccagatggcagcccatgtattttatccctgtaatatttgtaattattcttcctggtgcgaaaataatcagttgttaaatgctagtataggcagaacttcaagctacgtct

SEQ ID NO: 12543 - DNA, 2775 bp, Sorghum bicolor
  Clone ID: SORBI-28MAY03-CLUS2705_1
ggcctactatttttcagcttgatagcccctgtgttcatgttatagtagtatattatgccagtttttatatcttgttttatttacagtggtttccttttgcatctgtactcatcctcctaattgtggtgatatgcgttgcagaaacaccctggtagcacaggaatcaatgagaagcaaagtggaaaaccaccattaccaattaatgcagtagcagagcttcgaaaaggttcttactatgcttcgttggaacttgttcaggctttatgtgatacatcttatggcctggtagatatatttcctattgaggatcgtaagattgccctccgggagtctcttacagagatcaatagtcagattgcttctgccgaaaaaaatggaggagtatgctttccgatgggaaagggcatatatcgagtggttcatatacctgaagatgagtccgcgcggctgaattctagggagaaagctccttaccttatatgtgttgaagttttaaaagcagaagctcctagccactctaaaggatcatccgatgggcacaaattatcaaaaggtgggataccattggctaatggagatgtgcaactaccaaaaccaccaccatgggcttatcctttgtggagcaggcacgacacacaaaactatgaaacagacagaatgctgaagtctacttctcaggttattgaccaagcaatggctcaactctgggagacaaaagtaaaatttgtaaatgttagtttctctattgagaaacttggtcgctcaaggagcattgcactttctgaaacggggcgtaggctgcgacatgatgctatagattctcatgagccacctggagattcgcaaacagttgctgatcagcctattgaatgggtgaaggttacattgtctgcagttccaggagttaacatggaagatgtagatgataatgaaccaacacgaaagaagggcccgcgccgcattcctagtacaattgccattgaggaagtaaaggctgcagcattaaaaggagaagctccacctggtcttcctctaaaaggagttgggcagagcacccaaaatttagatcctaaggctactgatggtggggatccaaaaccaaccgatgctttggctggtgagctttgggctgtcaaacgagagagaattcgacggtcttcggttcatggaaaatcacctggctgggacttgcgctctattattgtcaagagtggtgatgactgccgtcaagaacacttggccgtacagcttgttgcacatttctatgacatatatcaagaagctggtttaccactatggctgcggccttatgaagtgattgttacttctgcttatacagcactaattgagactatccctgatacggcatcaatccattccgtcaaaagtaggtttcccaatatttcaagtctcccacgcggctatgtagccaagtatgaagagaattctccaaatttcaaacttgcacagagaaactttgttgaaagtatggctggatattcaattctgtgctacctacttcaggtgaaagatcgccacaatgggaatcttctaatagatgaggaaggacatattattcatattgattttggtttcatactatctaactctcctggaggggtaaacttcgagagtgcaccatttaaactaacaagggaactccttgaagtgatggattctgatgcagagggaactcccagcgagttctttgattacttcaaggtcctatgcattcaaggtttcctgacttgtcggaagcatgcagagcgtattatacttcttgtggaaatgttgcaggattctggctttccatgtttcaaaggtggccctcgccgtccgcagaacttgaggaagaggttccacttgagtctaactgaagagcaatgcgtatccctggtgctctcactgatcagtagcagcatggatgcttggcgcactcggcaatatgattactaccagagagtattgaatggaattttatgattttccccacaagagtcacggattcattcagaaaccaaacttcttgtatccttggagcaaaccatgggattgcataggtcagtttggggctgatctatactgggtaattgagcactgtgttttcatgtggcattgcacatttttggtcaactagggaaacagattggtgcctgcattctactttcatgtgatcccccctctgacagagttaagtgtacagtcatcggcagttatctagttagtgctttgtgctaggaggttgcgactagtggagctctatttggcatattggaatttggaacccgagctgcattgttgtacagacctttggttgacgtagcttggacaggatgtaggagaggactgggccatactttgaagcaaacaagtgtaaattataggcatatgggagctggggataatccgaggacaagaacagatatgccgttcgaagtgtcactgtactgatgtcctgtggtatccctatagcgccaaagtagatggagatgtgctttgctgcatttgtaaattaccaatactgtacagggaccatactataggagctttccgttttttagttgttaagatattaattccttttgttgtggctgtctggcctacgaagatctaggtgatagcttgttcactagcagtatgatcagtgtttggtattttttgctattttttcctgtggccctagcaaattgcaatgtggatacaaaaaatacatttccttgtgtcatgaagaaaaacactgcaatatttttagtacattttgctgtaccatgagag

SEQ ID NO: 12544 - DNA, 912 bp, Sorghum bicolor
  Clone ID: SORBI-28MAY03-CLUS23041_1
ccggaaaaatccatccctagccggcagggcgttcgagccgccgccgccgcctcgcacgaaacgcggcggagcctcctgccgcagccccatccttcatcggcgaatagcaaaccgtgggtcgtgatcgccggagctgtcgtggcctcgaaccgggaggaaggtttgaaccttctttagaaatatacaataaacaatatggccgcggttgatacagctaccaaggagatggaggcactgcatgtgggacaaaatgaagaaaccaaagcagatctgattaatgaaggcaaaactgcaaacagcaatggtgtggttcctgcagctcagtcttcacaaccagaggatgatgatgaagcacaagctgatgatccatctcaagatggagcacaagaagctgcaaagaagaagaagaagaaaaacaaatccaaaaagaagaagggtcctcttcagcagacagatcctccatcaatacctgtggacgagctttttccttcaggagaatttcctgagggtgatattcagcaatataaggatgataatttatggagaacaaccagcgaggaaaagagggagctcgaacgactgcaaaagccaatctacaactctgttcgccgagcagcagaagttcatagacaggtgcggaaatacatgaggagcattattaagcctggaatgttaatgattgatctatgtgaaacactggaaaacatggtcaggaaacttatcaaggagaatggactgcaagctggcattgcctttccaactggatgctccttgaattgggtcgcagctcactggactccaaatgctggtgacaagactgtgctacagtatgatgatgtgatgaagctggattttggaacacatatagatgggtacattgttgattgtgcatttactgttgcattcaatcct

SEQ ID NO: 12545 - DNA, 392 bp, Sorghum bicolor
  unsure (1)..(392): unsure at all n locations
  Clone ID: SORBI-28MAY03-CLUS227_2
cgtccgcgaatttctcagtncntgactgggagaaggaactgcatgctccagtgccaggtggtatgacggctgcatggcatcccacacaagttggtaatcaagctattttttgtggtatacagacaaaaaataaaggttgccagcctgacgtccgggcttatacggcagttttgtgatgattaaatcagcagattagtctgttgtagtattttgggccgccgataaggcgtgcactgtttccacagcaatctcagctgttactgatatatttgtaggtcatatataggtactgtacatgattcaacaaattcctgggcaattatgaattgaatattttagagaagaaaaaaaaaaaaaaaaaaaaaaaaaaaaaaaagggaggacgatataaa

SEQ ID NO: 12546 - DNA, 1185 bp, Sorghum bicolor
  Clone ID: SORBI-28MAY03-CLUS227_1
cgtgagctcgaaaggaatttggctatgaaagtagaagatggggaaactgctgatacatttcttgttagtggcagaggcacactgcatctcacaatattgatagagaatatgcggagagaaggatatgaatttatgataggacctccaaaggtcataaacaagacaggggatggaaaactactagagccttatgagatagctgctgttgaggtcccagaagagtccatgggatcagttgttgaacttttgggaaaaaggcgtggacaaatggttgacatggaagctgatgggccggagggaacaacattgctaaaatacaagattcctaccagaggcctcattggacttcggaatgcagttcttacagcttctcgtggcagagctatactgaacacaatctttgacagctatggcccatgggctggggatcttagctcacgtgatcagggatccttggttgcttttgaagatggaagcactacttcttacgcacttcttaatgcacaagaaagaggtgtgttgtttgtccaaccagggcaggatgtttacaaaggtcaaattgttggtatccatcagagacctggtgatttagcaattaatgtgtgcaagaaaaaggctgctacaaatgttcgttccaacaaggaaactacagtggttcttgatgaagctttgctacagtttggatgacgagttagtaataatttattttctctcagcacttgacagtttggtggtttccatttttgttgctaccagacctgcaaccttttaattcttatatatgacgaatttgtgtactgtgaccgtgagttctcttctgaaaagcttttcaatttagctactgcaaaataaatgttaaaattttggaacaagaaagagtagagattttggaatatagtcatgtattgcaggcaatgtagcttgttcctcctgagaagcaggaagtgctgaaatgagcaatatatacatggaaatgctttaatgctttaccaatatttgtatctattgggaggaaaaaatatcaatatttgtatctattgagaggaaaaaatatatttgtatctattgactcttaggtttttatccaagtgttgaattctgcgtgtttcatatttgcagtggttcttgatgaagctttaagctacagtttggatgactgcatagagtttatccaagaagatgagc

SEQ ID NO: 12547 - DNA, 1051 bp, Sorghum bicolor
  Clone ID: SORBI-28MAY03-CLUS2367_1
gccggcaaaaaccgcaccgcacccgataccctacctcacttcgccgccccgcttcgacggcgcgcgcttccgacccggctcgtgttccgcccggccggatccgacggtcgctcgctgctgcagcgggcgcttgctgtgcgtcgcgtcggttcggccggagggagggagggaggcggagcctagccttccctgggtctcggagatggcggcgccgccggcgagggcccgggccgactacgactacctcatcaagctgctcctcatcggcgatagcggtgttggtaaaagttgtctccttttacggttctcagatggctccttcaccactagctttatcaccaccattgggattgacttcaaaataagaacagttgagcttgatggtaagcgcataaagttacagatatgggatactgctggtcaagaacgttttcgaactattacaaccgcctactacaggggtgcaatgggaattttgcttgtctatgatgttactgatgagtcatctttcaataatataagaaactggattaggaacattgagcaacatgcttccgacaatgtgaataaaattttggtaggcaacaaagctgacatggatgaaagcaaacgggctgtaccgacttcaaaagggcaggctcttgctgatgagtacggcatcaagttttttgaaacgagtgccaagaccaacctgaacgtggagcaggttttcttctccatagcaagagatatcaagcaaagacttgctgaatctgattcaaagccagaggaccgcacgatcagtattaacagacctgagggtggtgaggcttcggcgtcacaaaaatcagcttgctgcggatcgtgagggggttaaattgtcacagggaaaaggaagataaatagtgtgataccatgcttgtaatttacccttctaccttttatttggctgtcatcgttctcttctaacttttaattgcaattgcttggattcagatttctctgtgttgtaatgtgaacaattttagttgtacccctggtagaaatgcaagtgctcataagtcaatgcacc

SEQ ID NO: 12548 - DNA, 575 bp, Sorghum bicolor
  Clone ID: LIB3481-007-Q6-K1-H6
cgtccgatcaaacagctacctgaacccgcagaggcggccggcgcgcgcacgcagatttttagtttagttttagtttcttctccagctctcctccgacccggctcgtgttccgcccggccggatccgacggtcgctcgctgctgcagcgggcgcttgctgtgcgtcgcgtcggttcggccggagggagggagggaggcggagcctagccttccctgggtctcggagatggcggcgccgccggcgagggcccgggccgactacgactacctcatcaagctgctcctcatcggcgatagcggtgttggtaaaagttgtctccttttacggttctcagatggctccttcaccactagctttatcaccaccattgggattgacttcaaaataagaacagttgagcttgatggtaagcgcataaagttacagatatgggatactgctggtcaagaacgttttcgaactattacaaccgcctactacaggggtgcaatgggaattttgcttgtctatgatgttactgatgagtcatctttcaataatataagaaactggattaggaacattgagcaacatgc

SEQ ID NO: 12549 - DNA, 969 bp, Sorghum bicolor
  Clone ID: SORBI-28MAY03-CLUS24079_1
gcacgaggccgcacacgcctgcctcttcgagagctcgcggccgccgccgctggcagccggccgccctccgtaccccgaccgcctgctgcccgccggccgcccctgcgggtttgccccactcgcggcgtggtcctccggcatctgaccggccgcgcggccgcaccaccgccagccggggcgccgaccttccctgctcgcccgccgcgggaggccgcggccctccccggcccgccggccgccgttggccgaggtgattggaggagatccagaacgccatctccgaaggtgaggaacgccgagatctagaactccatctccgaaggtgagaaaccgagcgctcgccgaccctgccccaccccagaggcgagttctgcaggcctacgactgtgctgcaaccctgactggggctgagcttgtccgtccaagccatcctgtcgcctccaggtgcacacatcttcagctcctccagaacaccactgctcccattcgaagcccgaccgccgtgccttgcgtaaagcttgagatgtagatactagctgacgtgcttgatcaaaaacaagacaagatgctcacagaaacttggaattttaataattagctagcatatgctacttatataaaatccttttcttgcaggtgaaaaggatcaaactgcttctgttcagctagattaggtaaaagatggacggtgggcaagccagtgggtgaggacagtgcgctcggcagcgaagcatcaatcggggacatcgtcaaaccatgtcagagggtcgaaggcatcgcacgccgggccacccccagctggaccgttgccgggatcgcacattggggcgtcccaaccctcgccggcatcgcacagtggactgtcgccgtgagccgtcttcggagtcgtttttatgtattgaacttgtcttggaataatgtgtacttttgaacatgcggtttgtaatataatgtggattttgtacaaat

SEQ ID NO: 12550 - DNA, 978 bp, Sorghum bicolor
  Clone ID: SORBI-28MAY03-CLUS23885_1
gcacgaggccaaaacgcaccacctcgccggggacggccgttcctggccatccacagagctatggagtagtgggatggccacccataagaactttcaggatgaacagcctatttaaccaggccaaagaaaatgcctctgaggctggcaccaagaagcccaccgttgaatctgacatgcaggaagacaaggaggagagcaagaaaggacgggtcgtcggttgggtgaaggtgaacatggaaggagatatcattggaaggaaggtggatctcaacgcccatcgatcttacaagacccttgcctcagcacttgagctcatgttcatgaagccgtccatcagtctttgcacttctagtagttctaagtctctaaagctattggacaactcatcggagtatcagctcacctatgaggacagggatggggactggatgctagttggagatgtaccctgggagatgtttgtaggttcagtgaagaggctcaagatcatgaggacctcagatgccaacggtctcggtccgcgattccaagggcctcacaaacctacagcagcttgcacaagaggcaggatatgaaaaccaccgatgggcgttaatttggtgctagagagctataccgctggtgaagcttgaactgtgtttgataccacgtaacagcagcccatatctttggcatagttgtgagattacttgtgtctagtggaaatagtagaagttttttttccttcttcttcttcttcttcttcttcttccctttggtgcactcgttgagctttttctcatgggctatgactaggagcatagcccccatctcttctgtccacactgtttttacctgtgaggcattgtcgcccaaagtatctgttctgctgtttcatatttgtgttcatatctgaattcccagttgccgcacagtgtctgtgctaattgctgcggtctgcaatgcaacgccaaccacccgagtgtttgggggggacag

SEQ ID NO: 12551 - DNA, 852 bp, Sorghum bicolor
  Clone ID: SORBI-28MAY03-CLUS24117_1
gcacgtgcgcgccgccgccgctccccagcccgctgctaccaacgcgccacacctgcacttgctccccgtcaaggagcaccagatcgtggagcagctcgtcccggggctcaaggatgaggtgatgaacaccacgcccgtgcagcgcacccggttcaaggcgttcgtcgtcgtcggcgaggcgatggacacgtcgggctcggcgtcaagtgcgccaaggaggtcgctacggccatccgtggcgccatcatcctcgccaagctctcggtcgtgcctctcagggtgcccgtcaggagggggtactgggggaacaaatcggacagccccacaccgtgccctgcaaggtcaccgtcaagtgcggctccgtcaccgtgcgcatggtgccggtgcccagggggggtctgggatcgtcgccgcctatgtcccgaagaaggtcctccagttcgctggaattgaggacgtcttcacctcgtcccgtcgcttcaccaagacattgggtaacttagtcaaggtgaggaatctggagcacaagattaaaggggaaggtacatgctcaggaacctagtatgttactaagtttagctcctaggatattagctccaagtggcatcagtataggatattagctcaaagcccttcatgcatatctctattgtacagatataatggtactaaatttttattgatctgaatatattattgtatattgtataatgaaatcatttgatagttttcatttatggttgtttttgtgcagcctaagatattgagcccagccagcttctgatgaaatcagtcctccgcttgtgttagggtggtcttcaatatgatatgaatgctacaacgcttgcactc

SEQ ID NO: 12552 - DNA, 1307 bp, Sorghum bicolor
  Clone ID: SORBI-28MAY03-CLUS27911_1
gccccagcgccgctcaggctcggtccctcaacgcagatctccttccccactcgcgctcaggctcggtcgcagggattggatcttccgcgcgtcggcggctccccctcggcggcgtccagcgacggaggggcagtcctaggctcggcggcgccgtcggcggctccccctcccgcctctcgccagtcgcctcgcgccctcgcctccgtcctccgcgcaccggccggcgaccctgcctctgtaggttttttgtactatactttctagtggttctggccgtcttgacacaatggtgaagctgacaatgatagcccgtgtcactgatggccttccactggcagaagggttggatgatgggcgagatttgaaggatgctgatttctacaagcagcaagctaaacttcttttcaagaacttgtcaaaagggcatcacgaagcttcacggatgtcaattgagacagggccctactatttccactacatcattgagggccgagtatgttatctgactatgtgtgaccgctcttatccgaagaaactcgcattccagtacctagaagatttgaaaaatgaatttgagagggtcaatggcaaccaaattgaaactgctgcaaggccgtatgcttttatcaagtttgatacattcatccagaagactaagaaactgtatttggatacaagaactcaaagaaacctcgcaaaactgaatgatgaactctatgaggtgcatcaaattatgactcgcaatgttcaagaggttctgggtgttggtgaaaagctagaccaggtcagtgaaatgtcaagtaggttgacttctgatacaagaatatatgcagataaggcaaaggacctcaaccggcaggcgttgattcggaagtatgctcccgtcgccattgtcattggggtagtattgatgctgttttggctcaagaacaagatatggtgattgtacaatatgaaggaaactgggccctgttacaacaccggagaagaacagatggagaaaaaaaccagttcgattctggaaaaaaaagatgctttggtgacttgtatcccgtatctgcccattcaagcgagtacttgagctgccctttgctcctccctataagctagtatattaaagtgaattcgttgtagtgcagaccttataagaaactcagattttgtgcatccgtggaactcgtaaatacaagagctctgtagagttgactttacgacagcggggttgtaatttttctggctgaactcaatgtaaggattcagactgatctgatgagttgacttcacttgggcgcgcttatcttgcccaa

SEQ ID NO: 12553 - DNA, 715 bp, Sorghum bicolor
  Clone ID: SORBI-28MAY03-CLUS2794_1
aaaaaaaaaaactcctccgcgcccgatcgggcgcactgcacatgtggtgtgtgtcacgcgcctcgtcactcacccgcaaccctcatctccccactctcccccgtcgacggcgggcgctcctggcagcaaaggaacaagatgtccaatagggccacacattggtgttatgcctgtcggcgaccaattcgtctccgtgggcaggatatcatatgcccaaactgcaatgatggttttatccaaaaaatcagtgagatgggtggccgattgaacacttacgggctaattgaaccggactttgaagagcgtcgagctagaagatttggaatgatggatgccatgtcttcccttatgcggcaacggatggaagaaatggtagaagatagtttgtttgatattcatggtagacaaggggcaggtactgaatatagaaggaggccaactgctgttcctacactggtatttggcggcatcccttctcctggagttggtagcagtgatgttaatgttgtcctcaggggaggccgcagagttggcactgcccatccaaatttcagtagtttagttgttggtcccagtctggaagctctatttgagcagctattcatccagaacaaccgtcaaggcccagcacctgctccacagtcagctattgattccatgcctgtggtgaaaataaatcgcaggcatcttgacgatgatccacagtgcgcagttt

SEQ ID NO: 12554 - DNA, 1364 bp, Sorghum bicolor
  Clone ID: SORBI-28MAY03-CLUS28264_1
gcaatcaggtgaatggtgtctgccttggctggccgccgaacatgatcgagctgtgcaaagaagtgagaaagctaaaagaaaactttcattcctttgagatcatccatgttcgacgggagtggaatgctgaggcagatcgccaggcgaacatcggtatcacgcttgcaagtggcgccgtgtctgaggagcgtggtgacatctgatacatcagttaccgacttatgtagttaactaagtagctggacctttgccttccacctttgtcgagctgctagcctgatcttcagcaggagctgaggtgatggcttgccgtctagtaggcactatatcgaaagcactagttggatctattgcaccgtgaagctgctacggaagtctgatttcctgtatcctgctgaaggtggtgcatgttgagggatgggttcgtcgttgatattgagtgcttggttgtactggtcccactttgtcgaacccagtaacttttggtgtaagtttccgtcctactcgcctggctctttttggcccgtctcaatgcatagtttcatggcacagttaccaagactataaactaggtaaccgagccacatgagtttcatggggatgaaactcctctctcatctgatgaaactccttcatttaatgaccctgccaagtcagcaattttgcttatgtggcaccctatttaatgtgcatgacactctccatgaaacaatgcattgagactggccttaggtttccccccggggcctctgtctgtggtaaataagcatagcaattcattagtgtcattagcttcttgaataagcaaagataaaacaattatgttgaaacgagcagtctttggacatggggctgcttcactacagcgccatgagcaactcctgtatatgctgctatgcacaccctattgcatcacaaaatatcacaagctaattcacccgctggctgactaaggaaattttcctggttccatatactcaaagggatcatcagctttaggagacctggtgatagacatgctgtaatcacgtccgaatgcaaattgagcgccttgtgaagctttgttgtctagttgaagtcgtctgcgttgattagacatccacttatcactgcagtagttggtgactccaaaaatcatttcccttaacatttttgcattcaaaacaaagaacttggcaaagtcgacgtcaggcctcatgccatgataattattgatgacaacttttttgagatgaagctcaagacattcgattggattcagtggatcatagctctgtgcatttttcatattcttttgtgtgtgagacgtgacatatagcttctccacacaagggaaacacttgagaaaatgaacaactgagtcc

SEQ ID NO: 12555 - DNA, 999 bp, Sorghum bicolor
  Clone ID: SORBI-28MAY03-CLUS28684_1
ggaagaggaaaagcttggccagtctagctcatttaaaatacgtgatctcaacctggttggtagtccagaggttgctgacatgcgaggtgaccctcgtttaggccaaaactccactgctggatgttcagtgggcctacaagataatcaacaagttgactttggaacagcttttggtaacaatccaagtaatactgacacatgtgctccatttctgttgggaaataaggcagttcaagttattgatatcgaagatgactcaccaaatgaagctggtgcttgtgacacttcaaaatcaaaaggtgagatggtttattctagcatggagggcatgatgaatcctccggcgaacaccgatgctctacatggtatccaagatggttatggtcttgcaatttcagattaccttggtgctgatatgtcatgctaccaatcaatgcaaacagaacttcaagatgggatggacctaaatggttcagagggcataactgtgatggatgatccaatttacagttctcttggtgacataggttttatggaggtttgggaccagcaacctcaagactatgaaaagttcttctgagtcaccgacccatgtcgctaaaactgttctggagttcgactgataaataccagttacacttgcataggcagaaataaagcaccagatcgtgcctaacaaatagaatcccgtatgctcgtgcgacagcagcacctcatacacttgtatctaccaggctatatatattggggcttttgtaataccagggtctgcggcggcagctcaaagagcgagatatgttcaaactccgtgtccctgccttgcccaacagtggtgtaaaaagttgtagtatagctgtcatgtaattcaagggaattgacgcaagcacgatagagtattcatccgaaatcattcttaacagttctattttccaaaataaaattgtttatttgttatatctgtgttcttgttgcactcctagttgggtggtttgtggcttt

SEQ ID NO: 12556 - DNA, 813 bp, Sorghum bicolor
  Clone ID: SORBI-28MAY03-CLUS25320_1
ggaagacggttgacagtgctgtaaaggttgtggagacagcacttgccttgcaggaggctggatgcttctcggttgtgttggagtgtgtgcctgctccagtggcagccgctgcaacatcagcattgaaaatcccgaccattggcattggggctggaccattctgtagtggacaggtcttggtataccatgacttgttagggatgctacgacacccacaccatgccaaggtcacaccaaagttttgtaaacaatttggtaacgtgggcgatgtcatcaacaaggcgttatcagagtataagcaagaagtggaaactcattctttccctggtccaagccacacaccgtataagataactcccacagatgttgatggctttgcaaatgcactgcagaagatgggtttgagtgacgccgcagatgctgcggctgctgctgctgaaaacagggagaatggtggagaaccaaaaggaaaatagttgatctaatgcctgttgctttcaacggctacaccagattttagactagagaataaaggctagagaatatattgcctagcataacggtgtcctgcactagtgcaatcttgtaagactgcaggtgtagactgaaactgagaaccctttcgatgtcgttaactggacaaaagggatccttaataaacatgagctagatcaagatgttccgagtagaagagctacgttactatcacttttgagttttgacacatgatggtgtatcatcttttgctactcaagatactagctttgaatgtttgtcatatatcaaacgagcaaaataataaaatgcagtttt

SEQ ID NO: 12557 - DNA, 663 bp, Sorghum bicolor
  Clone ID: SORBI-28MAY03-CLUS25483_1
cctactggaccagcacctagctcaggtagcctttgatttctcacttcaatttgacgaactgcacagatctctctcagctcgatctctccaatcctgttaggctagccaccaggcaacagactcgatcgaaggctgcgcggcggtagcggagcagagatgcagggggcaacgacggccaagcaggcgcgcaacggtgaccgcggcgcggcgaagacgacggaggggaagggcgacgccgccaccggcgccaaggtcggcaccgacgtggcgaagagcgacgccgccagggctgtggacgtagggaagggcgacgccaccggcaacaaggctggcggggccaatatgcatcatcacggcatgtcggccgtggaggcgaaggactcccagaccatcgtcgcactgcaggcgccggtgaccgccatgcgccccgtccgcggcgacctcgaggagcacctccccaagccatatctggcgcgagctctggcggcgccggacatctaccaccccgacggcaccgcggacgacgagcacatgcaccaccacatgagcgtgctgcagcagcacgtcgccttcttcgaccgcgacgacaacggcatcatctacccttgggagacttactccggatgccgtgcgcttgggttcaacatgatcatgtcgttcttc

SEQ ID NO: 12558 - DNA, 726 bp, Sorghum bicolor
  Clone ID: SORBI-28MAY03-CLUS25977_1
aggttgatgatgctgaatttgaagaaaatgaagtctacgcaatcgatattgtcaccagtactggggaggggaagcccaagttattggatgagaagcagaccactatctacaaaagggctgtagacaagaattatcacttgaagatgaaagcatcaaggttcattttcagtgagatcagccagaaattcccaatcatgcctttcactgctagggcattagaagagaagcgtgcacgcttaggcttggtggaatgcatgaaccatgagctattgcagccgtaccctgtacttcatgagaagccaggtgatcttgttgcacacataaagttcactgtgcttctgatgcccaatggatcagataagattacatcacatccgctacaggagttaaagcccacaaaatccattgaagacaatgctgagataaaggcatggcttgctttggggacaaaatcaaagaagaagggtggtggaaagaagaagaaaggcaagaaaggagatgcagcagaagcagatcccatggaggcgacaaacggtgcaagccaagaataattctgatttttggaattactgcctccagccttttttcttgtttcttcactgcatctgatggtgttatattacattcagttgtggaaaaaattgagtactttttctagtgtcttaagaaatgaagcatcctgctgcacattatcgcatctaatggcacaaagtgaattatctacga

SEQ ID NO: 12559 - DNA, 1246 bp, Sorghum bicolor
  Clone ID: SORBI-28MAY03-CLUS26014_1
agcacaacagaaagccgtttaactactgtagcactgtaatccgctaagcaagcgaatcgagctcagagccctaacgagcgtcaatggcgcccgagcccgagcccaggatcctagagctctccaacggcaagatcactgcgaggatctccaactggggcgccaccatcacctccctcctcgtccccgacgcccaagggagtatcgcggatgtggtgctcggattcgatgacctggacccgtacgtgaaaggcatgtcaccttattttggctgcatagttggccgagttgcaaataggatcaaggatggaaagtttagactcaacgaagttgagtattcattgcctgtcaacaatggacctaacagccttcatggtgggttgaggggatttgataaggttgtgtgggatgtcgtagaccacaaggatggtgaatgcccatcaataacttttcagtatcacagcaaggatggtgaagaaggctatccaggggatgtaaccattagggcaacatactcacttcctgaagctgctactctaagacttgacatggaagctacaccagaaaacaaagcaactcctataagcttggcgcagcacacctattggaaccttgcaggccatgcttccggtgacatcttaaatcattcaatacagatatgggggaagcacatcactccagttgatgaaaacacaattcccactggtgagataatgcccgtcaatggcacttcttttgatttcacaacagagcacaagattggagagcgcatcaatgatgttcctggagggtatgatcataactacatgctggactgtggcgatgagaagaatggcctgaagcatgcggccaagctgagagatccatcaagcttgcggaccctagagctctggactgatgcacctggcatgcagttctacaccgccaactatgtgaatgacatcagtggcaaagggggtgctgtctatgagaagcatgctggagtatgcttggaaacccaggggttccctaatgccatcaaccaacctaattttccctctgtagttgttcggcctggtgagaagtataagcacactatgctgtttgagttctcaaactgaatagtgattggacaacacaaatagctctaaaacatgttgaatgaataaacaagcagaagaataatatgtgataatgactgtaaatcttgtttgtcatggaaccagagaatgatcgaggtaaatttataaattttttaatgagagtggct

SEQ ID NO: 12560 - DNA, 997 bp, Sorghum bicolor
  Clone ID: SORBI-28MAY03-CLUS26006_1
ccgccacctcccccatggtcgcccccgtccccgccctcctccggcgaggcaggatggatcggcacatcgagatgtcctactgccgtttccgggcgctcaaggtgctcgccaaaaactacctggacgtcgaggagcacgagctgttcggccagatagggcagctgcttgaggagacagacatgtcaccggcagatgtggcagagaacctgatgcccatgtccaagaagaagaagaagagggacgccaacgtgtgcctggagaatcttgtggaggctctgaaacaggccaaggaggatgcggccaaggccaaggagaaagcagaggcggcaaagaagaaggctcaagaggaagacgaggcaaagaaaggcaaaggacaagacgaaggcgataaaacgtcagaatccaagatgagcaacggacacatcaaatgagatgacaaatgacaagtcctcagtatgtcaaacaattaatgaagtacaaatataagactgctaagatatgctatcagagcaattgggggtacattatttatattggaattggaacaactaggacgcacgatctgaacaatacacacactcgtgtctgtaaaattagtggataacatgttggcggctctctagcaggccaaggcggcggcggccgctaaggcgctggctgaggcggccaaggcaaaggaggaagcagaggcgaaggcaaaggcggaagcggaggcgaaggaggctaaagagaaagacaaggcagaggcggaagcaacagaaaacaacagaggagaagacaaaggaaaggacagcaagatgaacaatggagaaatcaaggaaggtgacaagtgacaggtacagaatgagattgtttactagtgaaatgatggaggaagatagctgaataatgcagtgtcctatatgcactaggagacgagtaatgtatcagagaagcacatgtaatgtatcactctctccaaatcaagcaatccagtagctttcccgtgttttgggcc

SEQ ID NO: 12561 - DNA, 902 bp, Sorghum bicolor
  Clone ID: SORBI-28MAY03-CLUS29919_1
gcacgaggaccagcagtatcaagctccgccagctccacagcctcaggctcctcctgcatctcagcagtatcaagcttcgccagttccacagcctcggccccctccggcgccgcggctgctctgaatcatatggttacagtggatctccttcccaccgtggcaattctggaatgaagccgtcttcaccttttgctcaatcctcggggggaagtggcagctatggcagtggcaggctccccacggctcagatactaccgcaagcagtgccgatcagctcctccagcaccagcggttcttcaggtaatagagtgccacttgatgatgtagtggagaaggttgccacaatgggattctcaagagagcaggtgagagcacccgtgcggaggctgactgaaaatgggcagaacgtggacctgaatgtggtgctcgacaagctgatgaacggcagataagtttgaggagtattgtcatttcacagagccacacagtgtgtacagtatggaaacttggaaagtgtcagctgaaccgattttctgtgtgcaaccttgtaaacctgattgtgcctggagaactctgatggccgaacagccgtgcatcgtgattggcggtcacggttgctccatctgaaatggaaacagctcagtgtgcctgtcagtgatatagtattacaatctgaatacgttgttcatttatgtatatgtggtgctgatgatattctaaaacatataccgttgttgcttgtgataggttaatcgattttctgtgtgcaaccttgtaaacctgattgtgcctggagaactctgatggccgaacagccgtgcatcgtgattggcggtcacggttgctccatctgaaatggaaacagctcagtgtgcctgtcagtgatatagtattacatctgg

SEQ ID NO: 12562 - DNA, 1388 bp, Sorghum bicolor
  Clone ID: SORBI-28MAY03-CLUS30039_1
gcacgaggatcaagaacaagaaagatcagagattaaacgaccagagaatgttccctcgtgccatagtcagacaaccaagtgcaacaaatggtttcctgtcaggtaatattgacaatgaagtaggccgcacacaagcttcatcgtcgttcacatcaaacagcattctcagatcattgatgggagcactagaagaaatagagctacatgctcatagtgagactgtgagatcaggccactcacagatgtatctgtgcttactgagagaacaacaattgcatgaactaattccattttcaaggatgactgatgaaattgatcaggatgaaggaactgcatgtacacttttgaagcatatggtattgaatttatatgaacatgttggggtcaggatgcatcgtctttctgtgtgccactgggaagtcaagctctggttggtttgtgatgggcaagctagtggtgcttggagagttgttgttaccaatgttactggtcacacctgcaccattgatatttaccgagaagtggaagaccccagcacacatcagcttctctaccactctgccacagccacggctggtcctttgcatggtgttgcattgaatgaaccatacaagcctttggacgctattgacctcaaacgttatgctgctaggaaaaatgaaaccacatactgctacgatttccccttggcatttgaaacagcgctgaagagattatggaaatcaagtagctatggtgttagtgaagctaatgagcgcaatcaactctatgctgaagtgaaagagcttatatttgttgattcggatggagcatggggcactccattggtttcatttgaacgccctccaggcatcaatgatattggcattgttgcttggaacatgaagctgtccacgccagaattcccaagtggccgggagattatagttgttgccaatgatgtgacatttaaagctgggtcctttggtccaagagaagatgcattttttgatgctgttaccaatcttgcctgtgagaggaaacttcctcttatctatctggcagcaactgctggtgccaggcttggtgtagctgaggaaataaagtcatgcttccatgtcggctggtctgatgatgagagccctgaacgtggttttcagtacatttacctcactacacaagattactcacgtctaagctcttcagtaatagctcacgagctgcaactagaaaatggagaaaccagatgggtggttgataccattgttggtaaagaggatggacttggttgtgagaatctccatggaagtggtgcgattgccagtgcatattccaaggcatacaaagagacctttactctgacatttgtgactggaagagctgttggcattggggcttatctggctcgt

SEQ ID NO: 12563 - DNA, 700 bp, Sorghum bicolor
  Clone ID: SORBI-28MAY03-CLUS30066_1
gacgacgaccagcccccattcctcccccaacttttcaggctcccctcctccctcgccgcggaacacgcgcccccgtcctcgcccgcctgcctgcccgtgttcatctctccattccttggtgcggtcgtagccgagcgctccggccatggcgttcttccggggcctcaccgcggtctcgagactgcgatcccgcatggcgcaggaggccaccacgctgggtggtgtgagatggctgcagatgcagagcacgtccgatctcgatcttaagtcccagttgcaggaattgattccggaacaacaggatcgcttaaagaagcttaagtcagagcatggaaaggtccagcttggaaacataactgtggatatggtccttggtggaatgagagggatgactggaatgctttgggaaacatccctgcttgacccagaggagggtattcgttttaggggcctctcaattccagagtgccagaaagtgctgccaacagcagttaagggtggtgaacctttgcctgagggtctcctttggcttcttttgacggggaaggtcccaaccaaagagcaagttgatgctctatcaaaggaattgcttgcgcgctcaactgtcccagctcatgtctataaggcaatagatgctctcccagtaactgcacatcctatgacacagtttaccacgggggtaatggctcttcaggttgag

SEQ ID NO: 12564 - DNA, 1197 bp, Sorghum bicolor
  Clone ID: SORBI-28MAY03-CLUS30330_1
gcacggcgccgccgcctaggcttatgttagagtcccgccggcgaggcctcttgctcgtccggcagcccacctcccgagtcctcgccagaccgtatctccaccctgcccgcctcttcctccagcacttcgccgccgacgcgatgggtgagggttcctctgctggtaaggacgcgaagggaaaggggaaggggaaggccaaggcccccgccgcggattcgctcctggtcgctcgcgacgactcctacctagaggcggtcacacagaagaggattcgcttgttcgaggagatccaggctaggcaggccgtcgagcggctgaatatcggcggcgaagttatcaaggtaactctgcctgatggagctatcaaggaagggaagaaatggataacaacaccaatggatattgctaaggagatatcaagtggattcgcatctagttgtttgatagctcaagtggacgaaacactctgggatatggggaggccactcgaaagtgattgtaaattgcaaatgttcaagtttgataccaatgaaggccgtgacaccttctggcactcaagtgctcatattcttggagaatctattgagagagcatatggctgcaagctgtgtattgggccttgcaccacaagaggggagggtttctactatgatgcttactacaaagatcaaacattgaacgaggagcactttggtatcattgaaagccaagctaaaaaggctgttgcggaaaagcaaccatttgaacgcatcgaggtcagcagggcagaagctcttgaaatgtttgctgaaaatgaattcaaggttgaaatcattaatgagttgcccgaggacaagaccattacagtatacaggtgcggtcctttagttgacctatgccgtgggccacacatcccaaatacttccttcgtcaaagcttttgcttgtctgaaggcttcatcatcatattggagaggaaaagtggaccgcgaaagcctgcagagagtatatggaatttctttccctgattctcgacgactcacggaatataaacattttctagaggaagctaagaaacgtgatcataggatactagggaaagcacaggaactcttctttttccatgaacttagtcctggaagctgcttcttccttccacatggtgctaggatatataacaaactgatggacttcatgcggcaacagtacagagctagag

SEQ ID NO: 12565 - DNA, 1528 bp, Sorghum bicolor
  Clone ID: SORBI-28MAY03-CLUS30809_1
gcacgaggctcctctccgcctcccgatttaggatttatataccccaccccagccccgccgatcccctgcctcgcctcttccggcccgtcctgccgccgtccgtcgccaagatcccgccgtcctcgcctcctgacctgacctgacctgacctgacctcacccaccgcgccgtcaccgtgacatgccggtgcaggtcggagggagcaaggtggcggaccccaggccggccagggtgctggacctctcgcccgccgccgtcgtcggcgacaaggcccgcgcctccgccaagaagaaccaccgccgccgccacaagaaggcctcctcctcccccgccgacgccgccgcatcttccatctcgcccatgcagaggctcttcgacaccagcagggaggtctttgccaactcctacccgggcttcgtcccgccgccggacgccgtcgcgcgcctctcgggcatcctcaatgagctgaaaccacgtggcgcgcgggttgccccaagtatgtccgtcttcaaacatgctgaccctaaaagcccccctccagttacttatttgcatttctatgattcctctgagttctcgtttggtatcttctgtttaccgaaatcagcagttattccccttcacaaccatcctgggatgacagtgtttagcaagatactatttggttcaatgcacctcaagtcatatgattgggctaaaagtctgccggatagtaacgataatgcacttcagaactctgatggagctcgtctggccagggtaaacacagatgctgtttttgacgcttcatctgagacggtagttctgtaccctgaaaatggagggaatttgcactgttttacggcattgaccccttgtgccgtgctggatgtgatggggcccccctacaaccgtgatgagggaagggattgcgcgtattacggtgaatcaccgtactcaggttcatgtggtggagatgaacaattttcttggctgaaagaggttcatagcacatttgagatgcaaggcataaagatggagcagcacttcatcatctaaggcatgatgactggcatggcattgtggcgacatcagaagacaaattggacgtactagcgggcagtttgatgtagatatctttagctgcaaggacaaacagcaggggttacaagtggaagactgcgctgggccgggatgttcagactaggaaacttgacatttgtttggcttatttcatatgggttgaaacagcttcttgtgatctgggattgactctgcttcccttattttactggagtatctgatagcacaattcgaatctgggtttttgggtcatggtcactttttatgtttccctgtagacagaaatgtaggcaggtgtactttttgaagtgatcatggaccgaatcctgtgggtcgtttggttggttttgttgagcagggcagtgagtcgtgaactttttgcctgctttcatgtttcaatttcagtttcaggggcatatcttttgtttccttgttgaacaaagaactatctctagtagcagtttgc

SEQ ID NO: 12566 - DNA, 770 bp, Sorghum bicolor
  Clone ID: SORBI-28MAY03-CLUS27455_1
cccaggaactaccagattcttggctcctagcccaatcaattcggtgattgttgaagaaattttggcaacgacacttggtgtgaatgagcgaatcttttcaatcggcactctggagagaagaggtaggttgtagtcattgcccccaatttctccaacgatgaagagggattgacttatcatgtctgagcaaccggagcggccgctgcggcagaggagctcaagcagatcgtgaaaccacttcatctgcaagcctaggtgcacccgtccgtcgccgatgtcgaaacccctggagcggaagaagtccgggccgagcgccgtggccccgccgacggcgaagttggcaccgcacgcgaagtcctccgcgcgccgaccgctcagatacggccgcacgaacgggagccccatcgtgtccgcgatgaagtcgaggacgaggcggccgttggagaagcgccccgtggcgcggcggaagaaggtctcgccgtagggtggccggagcgcgggctcgccggagttgttgccgtagtagaatctgaagtttccggtatcggtcagcgaatccccgaagctgaacacgcgcgggtagcacgccgccgccggctccgccccaactattaccatcagcgccacagccgccgccggtaggatcagctgccttcctcctctgccgggggcagaggacgccatggcctctttccccggctatcacgtcggcaacggcacgagctgctcgaggcggccgtagaagaaactgaggaattcaaccctcgtgc

SEQ ID NO: 12567 - DNA, 928 bp, Sorghum bicolor
  Clone ID: SORBI-28MAY03-CLUS2782_1
gctcgggcccgccgcgctgcaatccggtgtcgcggaccgcaggaaccctggcccccaccccacgcctccggtcgccgtcctccccccttgcgtggagggctgtgcgcgctctgggcgccggcccccaatcgaaaagccaatcgggcgagttcccagttccgctgctccaattccactcggcatggctccgcaggcgtgggtcgtggcggagaacggcgaggacctccaacgacccagggaattcgtgcctctttctgagctcgaagatgttggcgtgttgtattggcatttggaccctaagaaatctgaaagcgaggaggagctagcgaaaatccgcaaagacagaggatacagttacatggatcttattgagatatgtcccgacaaactggaaaactatgaggagaaggtgaagaacttcttccgtgagcacatgcatcctgacgaggagatccgctattgcttggagggcagtgggtactttgatgtccgtgacaaagatgacaagtggattcggatctggataaaggaaggagacatgatcatcctaccagctggaatttatcatcgattcacccttgacagtgccaaatacacgaagctcatgaggcttttcattggggtacctgtttggacagcatttaaccggcctcaggaggaccatccggcgaggcaggagtatgtcaagaatgtgagtgcgggcactggatttgctcttgcagcacactgaatctgtttctgcctttccggtttatacaaatatatgatcacttggattcatgtacatcatagtatcaacatatggttatgacaaaagcgtgttgtataatcaggagtcatgaaaccttgatgcatgttcaggagtcgtgaaaccttgatgcatgtatgcgtataaaactgcaaattatgggaacgcacagtagtggtc

SEQ ID NO: 12568 - DNA, 1195 bp, Sorghum bicolor
  Clone ID: SORBI-28MAY03-CLUS27832_1
cgacgacgaacccgatgccgccccaccgtgccggaggggccgcaggcggcggtgacacgagcgcgttcttcgcggcgacgctagtgctctgggctgtgtctgtggggttcgagatcggcgtgcgggggcgacgcgagcttgcgcccgtggccgccggcttcgccttcttccaggccgccaacgccgcggtccgcggctcggtctcccgcgacccgctcttcgtcaacaccgccgtatcgctcctccactcctccctcacctccgtctccgttatctttgttcttgtccatcaatggcgtaataagggctttgagaccatgtttgagcatgaagaactatttggtggcagttggattggagcatattctgctctgtgcttttcttgtggctactttgcgtatgaccaactggacatgctccgttaccggctgtacagtggatggattcctggaattctcatgcatcacttgatcctactcatttgctttacactagctctgtataggaatgtcacaatcaactacctaattctctcccttgtatgcgagctgcactccatatttttgcatgtaaggaaagtgaggcgaatggttggatttcgggatttccacagaacaatggtgaagctggaatgggtactcaactggactacctttgtgacagcaagggtgatatgccatatcttgataacttacaagctcatagctgatgcccacaaatttgggaagggcattgagcttccgctagctcttcttggtatggcaggaatgaatctgctcaacatatttctagggcttgatctactgaaagcattcacacgagaaagaaatcagcaaaaccatcaggactgaatgcacctttcttgactgtggtgtactctaaattttgagaaggccgtagttccgttcctgtagggatagagaggtatgtttaaagtcttaattagcaactacactagaggctatttatgtatgcattctttatgtataccaacacatgctaatgctaagatctctaccagaaagggttgttgccagcatgtgcatccatgtagataacattactgttcattaggagaatgcaggcgggtacctggatgcaggattttacatacattccttccctttggtcccaactcgcaaacctcatctaaagtaaaccccgaagcaactttggattggccctgtaggctaca

SEQ ID NO: 12569 - DNA, 1369 bp, Sorghum bicolor
  Clone ID: SORBI-28MAY03-CLUS27883_1
gcaccacgcgctcacactcttgtcttgtctccattgtgctgtggaggagcccaccgggcaccggctatgtcgtcgtcgcccacgccggcggcaggcacggcggcggcaccacacgtcgtcgaggactgcctcggcttcgtgcagctgctcagcgacggcacggtgaggcgctccacggactactccatgctccgtcccactggccgcgtgccgtcggactcggaccttcccgtgcagtggaaggacgtggtgtacgacgacgcgcacggcctccgcctccgcatgtaccggcccaccaacgccggagccacgaagaagaagctgccggtgctcgtctacttccacggcggcggcttctgcctcctcagcttcgagatgaccagcttccacgccgccgcgctccggctcgccgccgagctcccggcgctcgtgctctccgcggactaccgcctggcgccggagcaccgcctccccgcggcgctggacgacgccgagtccgtcttctcctggctccgcgcccaggccatggcggacccgtggctcgccgggtcggccgacttcgcccgggtgttcgtcaccggccactcggccggcggcaacatctcgcaccacgtcgccgtgcgcctcgccgggtgcgtgatgctgtggccctacttcggcggcgaggagccgacgccgtcggaggcggcgtgcccggcggaccaggtcatgggcccggcgctgttcgaccagatgtggcgcctggcgctgccggcgggcgcgaccaaggaccacccgttcgcgaacccgttcgcgccggggagcgtccagctcggcgacctcggcgcggcgttcccgccggtgctcgtcgtggaccccgaccaggacccgctgcacgaccgcgtggtggactacgtcgccaggctgaaggcggccgggaaggacgtcgagctcgtcgtgttcgcggggcaggggcaggggcatgggttcttcgccacggagccgtgcggtgaggccgccgacgagctgatccaggtcattaggcgattcgtgcacggccgcttatcagactgtcagagtcgtgttgacggaagtaattaagatgtgtcatgtgaaacagtacgatttgtcacttctcagaagaaacaaatcaaacgcaaacaattaataatcgatatctcagtgcgtcgctttagatgagatgatgatggaatggaggttgctgttgcagttggcggcgaatgctgagttttcagctcaggttcggaaaatgactgaacgatgcctggcgtgcaggtgatattggctggagtcttgctacttgtttcccggacagtattggtagggttcgccgcccaacaaagtttgtaaatttttagtaccgggttct

SEQ ID NO: 12570 - DNA, 1354 bp, Sorghum bicolor
  Clone ID: SORBI-28MAY03-CLUS27820_1
actcttggtcctgatttcaggtccagggttccagggccaggcaccggctccaggccctaacccatccggagcacaggaaattttggaggctgaagcggaaggggagaagacgatgacgacgagggagccgcacgaggcgtcccggcgcgacgggcgcgacccgcacgggagacgcccccactcctcgtccaggtcgcggagggacgatcccagcccaaggagaagaagagatgacaggaggcgtgaatcggacaggtctcactacagaagtcgagatgaagagtctgcggaggtggctgaccatgatcagaagagggacagagatactgcacagggcgatgatcctccgaatgctgagtccaagtcagcgagtgatgtgaagaatggcccctccaccaggcatgagagatcacctaggggaaccaaacgattttctgagtcgagagaggcatcgaggcctcggtctttctttcagcacaatgagcgtggaagtgctgggcaaggtggtcggcactatgaccgccaggctagtgactatggaaggcaaagggaccatctctctgatagagagaaacagaagaccgagggacacagtttgcaaggaaaggttgagctggaccagcaaaagaaggatggtgattcaacatggaagcatgatggatttttccaattggaggaagaagcaccccttgccaagaagaggccaccatttcaggagatgaagatacaagaatctgctgccactgtaacagaaccagattctagatcaaggaaacttgatcagcctgggctaacttctgcagtgagagaagaaaggagaaattatcatgcacgaggattcggaaatcatcgacccttcctaaggccagacgatcgaggcttcagaagggggtttcctgaccacaggagtgatggccagagaaatgggtatgattcaaggggaagatttcctggtaggggaggaatggacagagacaggtttaacaatccatatggtgggagaagcaacgtagagcaggcttctggtgatcaagaagaaaaatggaagcatgacctctatgatcagacaaacaggagcccacctccaaagactgaggaagagcagatagcaaaagttgaagcgctgttggcactgtagctatcttctctacgtctggagttatttttgtgtgatgatagattatcatgtacttggtttcagttgtgttgaatgctgtcttttttattatatatattttacatatctatggggattaagacaccttatgaagtaattccatttggactaataatattgtactagactatcatgagtttcataacgtgaaccatcaaggaaaagtacaagacaatc

SEQ ID NO: 12571 - DNA, 726 bp, Sorghum bicolor
  Clone ID: SORBI-28MAY03-CLUS332_1
ttttggtcagcgtgctccacaccgtgcatccacaagggattcttccccagtccgaagaacattaccttccaaacaggacaaggaaagaagttatgatggcgaccgtgcaaaatcgccaccaaggaaacgccgaagtcggagttctgagcgtgatcatgactctgagagggaccgttcagatcgtgatcgtggcaggtataaggatagggagcatgatcgttatgctcgtgatcacagagaccgtgatcatcatcggtcgagttattcagatagggatgatgaaagacggggccgtgaaaagagggacagggattctgaccgaaatagacattcaagctcccgcaggagcaggagcaggagtccagtccgtggcagaactgacggtgacaaacatcgctccagtccatttggtagggcaccagaatcatccaacctggcaaagctgaaggatctgtatggtgatgcaacaaacacaaagaatgatgctggtgatgatagagctcacagggattctggaacagaagaggtaatccgactgggaggggcaaggtggaggtgaatctcatgttatggcaggtccatgaatccaaacatcattagtgtcagaaattacccaagaaatgatgggctgtatgtcttaacttgaacttgtaatttcaaatatttactctgaagttcccccattattatgctgtcaatcttttttatgttgaagttctgttgctt

SEQ ID NO: 12572 - DNA, 880 bp, Sorghum bicolor
  Clone ID: SORBI-28MAY03-CLUS33209_1
gcatcacactaggaccaggggactagcaatagatagatccccgatccgttaggtctccacccccatcgctgtaattatcccacaatcaacaccaggaacaatttctgcgtacaaataacaaatcaaaccacagatccggatcatccaatccgtcacggacccccaatttgaccctgatttccccccgttttttaatcgggctagggctagggctagtgtgcaccgcgctgttttaggttgtgctcggtggcggtgaggtgttgaagctaaggttaggaacttaggattgacgagaggcggagggatggacaagaagaaggtggcggtgccgacggtgtgccatgggcactcgcgcccggtggtggacctcttctacagccccgtcacgcccgacggctacttcctcatcagcgccagcaaagactcaaatccaatgcttcgcaatggtgaaactggagattggattgggacatttcaaggccacaaaggcgctgtatggagcgcttgccttgacaccaatgctctgcgtgctgcgtctggttctgctgacttttcagcaaaaatatgggatgcactaacaggcgatgtgctccactcctttgaacacaagcatattgtccgtgcatgtgctttttctgaggatacccacatgttgcttacaggaggtttcgagaagattttgcgcatatatgatttgaatcgcccagatgcaactccaagagaaattgacaaatcacctggttctgtcagaactgtcacttggcttcatagtgatcaaactatattaagttcctgcgcggatttaggtggtgtgaggttatgggatgtaaggagtgggaaaattgtccaaacacttgaaaccaaatcacctgtcaccagc

SEQ ID NO: 12573 - DNA, 1790 bp, Sorghum bicolor
  unsure (1)..(1790): unsure at all n locations
  Clone ID: SORBI-28MAY03-CLUS33298_1
gcacgcacgagggtttcttctcgtccggtcgccatggtgcacgagacgagatcgcgggtgcacgcagttgcccaggaagaaggcaaggtcgcctcaaaaaagcagaaatcagagaatgaagaccaggaaaggggccagcatgtgccctccaagaacaaaaagcctgtggacaataaagggcaagacggggaatcagaggcaccaacgaagagcaagaagctcaaagctgatgaatctgagcccaatgggagggaagctgccgcaagagactttgcagagttttgcaaggccctaggagaacacctctccctggacgacatgcgcaatatccttgaagccaatgagcaagatgcttctggatcggaggatgcagtcgttctaagatgtgaggatatgatgttctatgggcctctcgagaagtgcccagtatgtggtggtcagcttgaatttaaggggtggaaatacaggtgcactgggaactacagcgagtgggcacgctgtactttcagtagtaacgacccttcaaggaggagtggtcctatagaagttcctgatgacataaaagatgattttatccgcaagtggctgaaacaacatgaacgaggggagttccctaaacgtgatgttgatgaagaggcccatatcttctccggcatgatgattgccttgtctggacggatgtcacgctcacatggttacttcaaggagcagattatgaaacatggagggaaggtcaataattccgtgcttggggttacctgtgtagtggcttctccagctgagagagataaaggtggctctggaggattcgctgaagcactggagcgtggaactcctattgttagtgagaattggataattgatagtattgagaagaaggaagttcagcctttagctgcctatgatattgtttctgatgttgttccggaaggccgaggactcccactgggccaacttgatccaagtgaggaggccattgagaccttagctgcagaggttaaacttgctggcaagagatctgtccacaaggactctaaactcnagaaagatggtggatgtgtctttgagaaggatggcagcacctgcaactgtgcttttgctgtatgcgatctaggatgccagatgaatgagttatgcatcatgcagctgattatggtccctgaaaatcgtttgcacctattctacaagaaaggtccaattggtcatgaccagatggcacgggggcgagtggaggattttggtagccgtatcaatgatgctattaaagaatttgttcggctatttgaggaggttactggaaatgagtttgagccttgggaaaggcagaagaagtttgagaagaagagtatgaagatgtatcccttggacatggatgttggtgtagatgtgcgtcatggaggtgcagcacttcgtcagttgggttctgcagcagcacattgcaagcttgatccttctgtttctttccttgtgaaacagttatgtggccaagagatttataggtatgctttgatggagatggcccaggacctgcctgaccttcccatagggatgcttactgatctccatctgaagagaggggaggatatgctgcttcagataagaggagatgcagagtcagtggcagagtctggcccagaagcagatgcattctggactgaagtcagcagcaaatggttcactctgttccccacaactcgaccgtacacgatgagggggtttgagcagattgctgacaatcatcaggttttgagacagtacgtgatataaacgacgcatctcatctcattggg

SEQ ID NO: 12574 - DNA, 1095 bp, Sorghum bicolor
  Clone ID: SORBI-28MAY03-CLUS34192_1
gcacgagggtggttgcagttaaaaagctcgtagttggaccttgggccgggtcggcccgtccgcctcccgccgagaaccccccgactcgacccttctgccggcggcgcgctcctggccctaattcgccgagccgagccgccgccgccgttaccccgaagttcttcccacagcagccagcttcctgctcccttggcaggcctgcagcctcctgcctctgccagtggtgatgtgacatcaaattactctctcaggtgtccacctcctacatccgcgccttcaccgtcgcttcttgggctcttgcacaattcaatgccctctagacaagatcatcccatcagcagcactaatggtggtccatatgatggaggcaagcctgctattccgaagctgaacgctacatgctcactacagtcaaatcctccccttggcccaatagtgtttgggctgttgcatcaatgctgccatgaaagggtaccattagccttagcaatgcatcccggctggtacatgtaagtctgtaactgtcagtttagctgtttagctatctccgtgggtggggctcccgcgccatgagtgggttcggtcatgggatgagaacagcaatggcaaacaatccgatggcaatgggtgctaggatgggaatgaatcacggtgcacatgccctatcgcaactgggtcagttaccccagcaacagcagcagcagcatgacataggaaaccagctgttgggcggatttagatcagcaaacggcttcaataacattcaatatgactggaaaccctcacaatagagagcacccagaaagccatagagttcagtgtgatgatgcatctgcccttgctggcaatgcgtgtggagcatccacatttatggtgccaaatcctccccttggcccaatagtgtttgggcttttgcattaatgctgccatgaaagggtcccataagcgatagcaaagcatcccggctggtacatgtaagtctgtaactgtcagtttagctgtttagctatctccttgtgtgttactccctcagttttacaacatttgtccattttactgggagttgcaattccccatgtgtcacattgtttgtcc

SEQ ID NO: 12575 - DNA, 1444 bp, Sorghum bicolor
  Clone ID: SORBI-28MAY03-CLUS3450_1
gcacgaggcaccagtccaccacccaccacacccgaccgatcccgatctcaccgaacccccccgccacctgcctgccgtgccggggctcgccgctcgccacgatgaggggcctcctcgcgtgcgccagtaccctcgcccgccgcgccaccgcgcccgcgcgcgtccgccacctggcgggcgcggcggaggcggcggaggccgagctcaagaagacggcgctgtacgacttccacgtcgcgcacggcggcaagatggtgccgttcgccggctggagcatgcccatccagtacagggactccatcatggactccaccgtcaactgccgcgccaacggcgggctcttcggcgcggcccacatgtgcggcctcagcctcaggggccgcgacgccatcccgttcctcgagtccctcgtcatcgccgacgtcgccgcgctcagggacggcaccggcacgctcaccgtcttcaccaacgacaagggcggcgccatcgacgactccgtcgtcaccaaggtcaccgaccaccacatctacctcgtcgtcaacgccgggtgcagggacaaggacctcgcccacatcgaggagcacatggaggcgttcaataagaagggcggagacgtcaagtggcacatccacgacgagcggtcgctgctcgcattgcagggtcctcttgctgcaccaactctccagttgctgacgaaagaagatttgagcaaaatgtacttcagtgacttcaagctgattgacatcaatggatattcatgcttcctcacgagaactggttacaccggcgaagatggttttgaaatctctgttccatcagagaatgcagttgatcttgcaaaggccatcctagagaaatccgaaggcaaggtgcggttgactggcttgggtgcccgtgacagtctccgcctagaggcaggcctctgcctgtacggcaacgacatggagcagcacatcacgccagttgaagccggcctctcatgggcaattggaaagaggaggaaatcggaaggcggtttcctgggtgcagatgtgatcctaaagcagcttcaggaaggcccaaagatcaggcgtgtcggcatgatcacgcaagggccgcctgcacggagccacagcgagcttgtgagcagctccggggagagcatcggcgaggtgaccagcggagggttcagcccgtgcctgaagaagaacatcgctatgggctacgtgaaatcaggaatgcacaaggctgggacagaattcaaggtggttgttcgtgggaaatcctacgacgctgtggtcaccaagatgccgttcgtgcccaccaagtactacaggccctcgtagattgtacaaatgggacgctttgcatttctcttgttgcggcttgtccttgacaggttgtttaagcctgcaactgtaacttgacattttatctatgcctgcctaataatgccttgtttccc

SEQ ID NO: 12576 - DNA, 773 bp, Sorghum bicolor
  Clone ID: SORBI-28MAY03-CLUS29477_1
cagaagcgtgctatcagaatagcatcccaaatacactgtggggtagcagcaatcaatgattttgcttcaagttacatgtgtcagtctttgccattcggtggtgttaaagacagtggatttgggagatttgctggtgtagaaggcttgcgagcttgctgccttgtgaagtctgttgtagaagatagattatggccatatattaaaacagtgatcccgaaacctatccagtatcctgtctcagagcatggatttgagttccagcagttgcttgtggagactctgtatggctatagcatgtgggacaggttgcggtcccttgtgaatcttataaagatggttaccgagcagaactctgcctcagtttcaaatgcgacgacgaagaaaaggcgatgaggcgaatactgaggggttcagttgaatctcgtgtcaagtatcagttttctcttattatggtaattcctcccatcagtaatccgatctttagactttagatgctgtatcctccccaagcttcttcttggggaggtaggttcagtggtttggcggcactgtctgcgtgtaatcggccttgagaaactagaatttagaagtaggcctcctttgatgacgagagaaaattgaaatcgacaattgagacctccaatttcgagtttgctctctgaaacaatcttgagcctgggagcttgtgagcgctttgggtttcagaacttttttttctgcttattaacactcgatgcctgggcaatgaaatgaaattccactgtgaattgcct

SEQ ID NO: 12577 - DNA, 962 bp, Sorghum bicolor
  Clone ID: SORBI-28MAY03-CLUS29023_1
tgactgttgtgtgaacatattaattgaactttgtatcattttttattttgctcgatttgtactgccaaatatcactgtagcattagcatgggaaatattaagatgtgtcacttagcttaaagaattttgagataattgccttgaagcattcatgatttgtattttttgttttatagtaaatttctctttgaaatatctttaaatatggtcacattaactttaagatgctattttaatatttccccgcaagtcttaggctaagtctctgcagcaaattggggaacttgaaagtaagaatcaaggataacaatgttgtaggcaattagtatagttgcatgaatgattttattagaaacatatagtgtcttattagtcttggccttagaatttaagaaattcacccatttgtgctcgatcgatcttatcttgtcaaaaatcaaataaatgggctgaagtcctattgttgttaactactaacatgtggtctggtatccatctgctgtggtgattgaaggtttggcagccgggacgggtctgacaatggtggtgcgaattaaggaagatcaagtcgtctgcgggcagccgtcagggtagaggattaatcgagtgtatcttgaattgctgcgtgaaagcatgccaggagaggatgatatgatctttactgatgatacgatggatcacttgatgtttctttatctgtttgttagatagacgatgagcagagttttgtgcaaaggaacgcacgcacgtttgggtttagttttcttgatatgagacaatgtacgtcgtgctgatagatgatgcatgatgcatggtgcagttcctgattgatgatgcatgttggttttgtacaccatattggatgtttcatcgtgttggcgtgtgttggacgtgttgttgtatgatggacttgttggactcctttgttatggtttatgtgtgttatatatgtggatttggtg

SEQ ID NO: 12578 - DNA, 1109 bp, Sorghum bicolor
  Clone ID: SORBI-28MAY03-CLUS29612_1
gcacgaggactgtgaggaggcagaggaggagtcgaaccgtaatctgttggagcaagctagactcttggaggaagaggatgaggatctctgtgacacggaggaggccaagattgctttccgtgctgtcaaggtcaagtttgctgctttataccgcagcctggctggcactaagcctgtgttcatatatgacccacccagcgacacaattgaggagcacttgacggctaaggagatggagaggcaagcagatatttctggatggccagtttgctctcaggcacaacactttgccactcttgctttggagtggtacaactctaccaagaaaacgcataagtttgagattgcaaaggtgttgttctctaagtgcttcaccgacgtagatcacaacacatatgcccacgtgaacttcactgcgacccccacctcagactcacacttgcctaagaggttgttcttcgctgagctcatgctggttccaaatcttcaggcgtgtaaggatactgatcctatacgtgtcctcagtgtatctgccatcgatgactcttgtttcggtgggtgtcatgagatggtgagggacattaaggttgcaataaggaaggatatggattatgagcgctgtcatgcatgcagcgagcgtatcaaacatccaagaggcgatcagtttgttgctggccataaccgcacgaggatgccttatgtcagcacgtttccgtggacacctgagtcagagtagtttggtgctgccatgcatgcagtgagtgtaataaaaatccaagaggcgatgagcttgtagctagccacaaccgtacgatatgtcaacatgtttctgtggacatacttgagatagatcctctaaatgtgctctgccttgatatttaatattgtactatgttctggacctaagatcagtatgtgttattgaatttcatacataaaatagaccttctaaatgtgttatgccaatttatttaatatattttgctatatttgggacctaggattgaatttcttggaacagagccatcccaactgggatgtctgatctctggaatgttgatatcctagctcactcatgggttatgaatgagcccatttgttgtcttttc

SEQ ID NO: 12579 - DNA, 677 bp, Sorghum bicolor
  Clone ID: SORBI-28MAY03-CLUS29688_1
cgtcgatgcgggggcggtgcgggtgctggcccggggacgcctcgcccgcccccgggcccgccgggcacgtccactcgtacgagcgcagcccccgcgtgtccaacgtcgcctacgacatcgtcaacggggaggcgacgccggtgagggacgccggcgcgcccgtgtacgtgaccatcggcgacggcggcaacatcgagggcgtcgcggataacttcacgcggccgcagccgagctactcggcgttcagggaggcgagcttcgggcacgcgacgctggagatcaagaaccggacgcacgcctactactcgtggcaccggaaccacgacggcgccaaggtcgtcgccgatggcgtctggctcactaacaggtactggatgcctaccaccgacgacgacaccaactgatctgaggagtgatgatcgatcagcgtcccattcgatcctgcagggcacagagttatgcagttttctttctcgatcgaacaaaaacatcatcgatggcgatagatcatcagccttgataagataggtgctagctatagcccctgaatgttggttctccaaaattgttggtacagtgggacatgaaaaacatgcaaatgctgcaatgcagtgagttttattagtgatgatatgatgatcaatatataagaaagaaatatatatgcttgcggctct

SEQ ID NO: 12580 - DNA, 1062 bp, Sorghum bicolor
  Clone ID: SORBI-28MAY03-CLUS29819_1
gcacgaggctcccctgtttctggaaaagccatcttttctgcctcctgcaaaagattgccttttacctttatagttttggttatgtgatttgcttcctacatgtctaataactaatgaataatgctgcattaccttggatcccttttttaagaaaaaagggtattgactggttggtttgaaaacatgcagtaactgctatgctaagttttgtagtcctgaaaacctgaatcactgattcactgtacacttgcacaacactgcctgttgcatggttctatgttactgtgaattcactgcttaatttgatatcacatgaaaggaaccagattagaatatatttggatgatttatgctcacatcagtgccaccgctactgtgccctccgcttccgcctttccctcacccctcggcaatgcaaggttcacagagtcagatgatgccccaaatgccacagcacatgatgggcctaaatcagatgcatcctggttctgtgcctcctggtactgtacccccaatgggtgggttcccaagtgggatgggaaacatccaaggagcatcaggttcgtctggcatacaaaattttcctatgggtggcatgtataatcgacctcagggacaaatggctccacaaggacaaatgacatccattcccggtctaagctcttaccagggaatgggcaatgttggcctcacaccgcccccgccgccaccacagcatccgccgcctcgaggaggctcggcacaccagtgacctggagcaaaacaaagattatacggaacctagagttttccgtgacactgaatttgtaacatgtaatccatctggagcaatatcagcatgtcgagactctcccgcaaattcgaagggatttctgcccgatttttgctcaggcagctaggatttcgctatctcgtgctgtgatttagaactgggaggtcttctgttcagtgccttatttatactgtaattcgaattgtgtatttacttgtcggctgcttgaatgtggaacagagaattctttggcgcagtaatgagaaacatgaactttgtgcagttatcgt

SEQ ID NO: 12581 - DNA, 1077 bp, Sorghum bicolor
  Clone ID: SORBI-28MAY03-CLUS2982_1
gcgcgaggggggctgtgcgtggatggaatcctttgtggagggcgacccgcccacgggtggcagcgtcccgacccgcgccggctgctcgatccggcagccggccaaactgtccgccttcaccaggtcaccacggtcccggctgccgcggggtgggtctgccctccggggcacggtccgcgaggccaccgtggaccccatcatggagcccccgcagccgaccgtggacagcctcgcgaggcgcccccgcgtccccagcgtcctgccggcgatgctgagcccccgggccagggagccccgcgccctccgcgtccgcgtccgcgccggccaccccgtcacgtaccaggtactgtaattaattatcatggtgtaataccaggtaagtaacattacattacatcgcatccactgccactgatggatggtctgcgtgcgtgcaggaggtcaccgaggaccccaacattgagccccctgaggtgagcgtggacaggctgatgatgcggcagcaggtgcgcagcttcctggcggggatgctgagcccccgggagaaggagatcatcgagcaccgcttcggcatccacgacgggcagcccaagacccttcatgtcatcggcgacatgtacgggctgtccaaggagaggatccgtcaggtgcagaacaaggccctggacaagctgaaaaacaccatctcggcacagggcttccacgtctactttgatttgctaacttgagcagagcacacaattaagctgatgctgagtctcttcagcagatgcattgtcttgtccatatatatatgtacaaattgattgaaaactgaacaaaaccagctcttagcatctagatttgtatacatcacacattcccttcccaaatcccaaagggcagaagcagctaatggaattgccgtgtatatcatatatagatagaggacaaatgcaagcagtatacacttcacaaaggcagatccattgccgcctgttcttcatgtaataagtatattttcctaggcaaaatcaacagcaaaaaaactgttgctacatactgatactgaacttcctttgggctagagtaccaagg

SEQ ID NO: 12582 - DNA, 1207 bp, Sorghum bicolor
  Clone ID: SORBI-28MAY03-CLUS36006_1
catacgataaattggatatatctgatgaaggtacagagcaggttgagttagtgcatgtacagctcaaaagagccaaagaacgggttgacatgcctgatgatgagttctaccatgaattactttcactgtataacaagagccatgacccaagtgctgaattggatacccttggaagattgtcagaaaagttgcacctgacaaccatcactgatctcacacaagaatcgcttgccttgcatgagatggtggcatctggtggaggtaacgatcctggagaacacattgaaaaaatgtcaatgctatggaacaagatcaaggactttgtgcaaactcagaaccctggcacgaggccgccggtgactaccaaggtaatggattccaacggggagccaagacctataaacattcctgatgagttccggtgtccaatttctcttgagctgatgaaagaccctgttattgttgctactggccagacatatgagcgggcattcatcgagaaatggatagcttctgggcatcatacttgtccaaatactcaacagaggatgccaaacacgacactgacaccaaactatgttcttagaagccttattgcgcagtggtgcgaagccaacgggattgatccaccgaagcgcccaacggaggctgacaaacccacatcttcatgctctccaagtgaacgtgctatcatcgatgctctcctctccaagttatgctctgcagatcctgaggaacagagatcagctgctgcagagctccggctcctagcaaagcggaatgcaaataatcggatctgcattgccgaggctggtgccattcccttactattgagtctcctgtcgtcatctgacctgcagactcaggaacatgctgtgactgcacttctaaacctctctatacatgaggataacaagtctagcatcatattatctggtgctgtcccaggcatagtccatgttctgaagaatggaagcatgcaggcacgagagaatgctgcagccacccttttcagcctatcggtggttgatgaatacaaagtaacaattgggggaacaggagctatccctgcccttgtagttttgctaagtgagggcagcccacgtgggatgaaggatgcagcagctgctctattcaacttgtgtatttaccaagggaacaagggccgtgctatacgagctggccttgtgccactcatcatggggct

SEQ ID NO: 12583 - DNA, 1861 bp, Sorghum bicolor
  Clone ID: SORBI-28MAY03-CLUS36080_1
gcacgagggcgggaaatctctggtcgctgggttgagttgaatcgatctggatccgtttatcgctagtttgggcgtccttgatctgaaaggtggaagctttggttgggttttctcctccagagcatttgcgtttctgaggggctaagatgctctatttgaagcagccgacgaggagctgagtctttctttttttaatcacaatttctctcgtcgtttgttgatctgatccgatggaggctatgacgggtggcaaattccttgaaaagtttcggctctacgaaaccagatcgaaattttatcttattggaagagacaagagcagaatacactggagggtgctaaaaattgatcggttggagtccactgagctgggtgtcgaggaggatccaactatttacacggaggatgaatgccaagaactgctttgccggattcatgtggggaacatgttgactggtggactgaaatttgtcacaaaatgttacggaatagttggttttgtaaagtttcttggtccttattacatggttataataaccaggagaaggaaaattggcacaatatgtggccatgaaatttactccgttggcaagagcgaaatgatcgcaattccaagtgttatagtctggcccaacgtggcttattctagggatgagaacaggtataagcgcctgctttgttcagttgatctttcgaaggatttcttcttcagctactcttacaacatcatgcgcagccttcagaagaacatatccgagaagaatactgggcaggttgtttatgaaacaatgtgtgtatggaatgaatttctgacgagagcaattcggaatcatctcaagaatacctgttggactgttgccttagtccatggattttttaaacagtcgaagctctctgtatctggcaaggatttttggttgacccttatagctaggcgctcgcgacattttgctggaaccagattcttgaaacgtggagttaatgaaaagggcagggtagccaatgatgttgagactgaacagattgtttttgaagacacatctgatggaatcccaactcagatagcttctgttgtacaacatagaggatcgatacctcttgtctggtttcaggagacttcaaggcttaatattagaccagatattatattaaaacctgatgtggactacaaggcgactcgccttcattttgagaaccttgcacttagatatgggaatccaataatcatcttgaacttaataaagacccgcgagaagaagccccgtgaatctctgctccgtgcagaatttgcaaaggctatccattacattaacaagagcctacctgatgacaagcgtctaaaatttttacacatggatctgagtaagctttctcgaaggaaaggaaccaatgtgcttgcactgttgaacaaggtggcatcagatgtgttggatctaactgaattcctccactgcgaaataagtacatcaacaaaacctgatgacacctcaagtggagaagaaactgttggcagaccacttgatgacagaagtagcagagatcaaactgaatgtgcagctaagttggcacctcttttattacagaagggtgtcctcaggacaaattgcatagactgcttggatcgcacaaatgttgcacaatttgcatatggtttagttgctttagggcgtcaacttcatgtattggggcttattgaagcacagaaaattgaattgcatgatcctctggctgatgatctgatggatttctatgaacggatgggtgatacattagctattcagtatggtggttctgctgctcacaacaagatcttctgtgagcaaaggggccaatggaaggcagcaacccaatctcaggagtt

SEQ ID NO: 12584 - DNA, 1141 bp, Sorghum bicolor
  Clone ID: SORBI-28MAY03-CLUS3619_1
tactggacttccccttccccagcagagcagagcagaccaaccgcttgtcgcgagccgcccgaagcttcgggccctgacgcgtgggccccgaccgcgcccgcccccgcccccgcgtcgccgggcatggcggggcagccgccgccgcccgggggctccgaggacgacttcctcgagcacttcttcgccttcccctccgcggcctccgccgccgccgggggacacgcgggcgccggtgccggcggggaccaccccttccccctcgccctcagcctcgacgccgccgccgagcccaagccggaccgtgaccccgtgcagctcgccggcctcttcccgccggtgttcgctggcgccggcggcgtgcagcaaccgcacctccgcggcccaccgcctccgcagatgttccaggcgcagccgaagccgggcgagggaggcatggcgccgcagccgccagccccacggcccaaggtgcgcgcgcggcgggggcaggccaccgatccccacagtatcgcggagaggctaaggagagagagaattgcagaaaggatgagggcattgcaggaattggtccccaacacaaacaagacagatagggcagctatgctagatgagatccttgattacgtgaagtttcttaggcttcaagtaaaggttttgagtatgagcagacttggtggtgctggtgcagttgcacagctggttgctgatattccactctcagttaagggtgaggcaagcgacagtgggagcacacagcacatatgggaaaagtggtcaactgatggcacagaaaagcaggtagcgaagctgatggaagaagacatcggggcagcgatgcagttccttcaatccaaagcgctatgcatgatgccgatctcgcttgcaatggcaatctacgacacccaacattcccaggatggccactcactgatgaagcctgagcccaacacatcctcgtagtatagtaacatcaaccctagcgtgcatttcaaccccctaatactattaggcaccgatatatccaaaaaaaaaaagtgtatgatatacggagcgttccaatgtgctaaccgtgagataggaaaggaccttaaattggtatatgatgtagcctcccctttccctattttatttcaaatcagagcag

SEQ ID NO: 12585 - DNA, 777 bp, Sorghum bicolor
  Clone ID: SORBI-28MAY03-CLUS36347_1
aggctctgaagaagggagaagatgcagggcttgctttggcgaagaaagtatatgcctatattcacagaaatgggtacaaaacaaagttgatggttgctgccatacggaacaagcaggacgtatttagccttctggggattgattacatcatcgcaccactgaagatattgcagtctctggaagaatctgtcaccgatcctgatgtgaagtacggttatgtcccaaagttgacccctgctattggcaagacgtacaacttcactgaagaggagcttgtgaagtgggaccagttgagcctatcagctgcgatggggccagctgctgaagaactgcttgcttcaggactagagggatatgtgaaccaagcacgccgcgttgaggagctcttcgggaagatctggccacctcccaatgtttaataacgccttgccgcgccacagttttcagttccaacagagagcaataacaaccggcaagggaacaacacttcgcttgcttgccactggttctccaatgtgatttgcctggcagtcccacaatgctgtgcaaaagacgttttgcttcttcttttggatcctacaaggggcgcttcagtgttttcgtgaacttgcattgtgtattgtgtttttgtgattcaaacgatgtactaaactgatgagaacctgtctcctgatattccctgcatcttcaaatgtcctggtactgctaccaaacagcttcttggttcaggtggcaatgtgccaatgtgccaatgttgttccatgagaatcctccatc

SEQ ID NO: 12586 - DNA, 931 bp, Sorghum bicolor
  Clone ID: SORBI-28MAY03-CLUS67702_1
aggatggcgatgttaacacgggaggaactggtggttctaagaacaagcttttcttggatatgcaagcattaaaagccaaaatatcaggtctggcctctaatctctctgctgaggctggggggaaaggtgcagacaagaaaaaccttactgaccaaagagacttgtttcaaaggatcttagatttcgtcaagtatggtgactgccctgaagaatcgatcaagattgctggaaaacgtgatgttttaagggtgtcgtcatggtctgaattaatccagttgaatttcttaaagcggtttctggggaagggctttctgaagcatgttcaggagaatggacttcttcaggatatctttgacattaaggttgacaaagctgaaaccctgtcgtccactgataagaaaatctttaggtctgaagaggaaaaagaaagagctctgaaattaaacaaggaacgtcgtctagcccaggtaaggaagaatgccgtcatgttggacgactaacatggtcacttgggtgggaagacaaccattctgcgtctcctttcaaactactccgtattattactggcacatttcactggaggttgtgccatcatgattgtgtactttgagatactggagttatactattatagtgcacctaaacaaattgctatttcgtgcatatggaacgtcagatagcacgatttatgttgaagttcagcatgatttggcgggaatagtcaagaattacttcgaagttcactaggcagttttgttctgaggcccacctcattcgaagacgttctgttgttgcgtgacagttgcatcaactgtacccagcccgtcgtcgacaaattggcacggcctaggaccgtcccttccatggttcaaggcacacaccaaactgttactactgtagtaaccagtattggatttagaagttgttttac

SEQ ID NO: 12587 - DNA, 1024 bp, Sorghum bicolor
  Clone ID: SORBI-28MAY03-CLUS1846_1
gccggccgggcctacagcacacacaactctagtgagaggcaagggacgtaagaagtcgtctaattctttgatcgaattaggcgccttcttcgtcccacactcctctctttatttgtaatttagcacgctaacttctaatctacaggatctaaagcaacacttgattcaattatggacggattggtaggcctcttgaaagtccgggtggtccgagggatcaaccttgcctaccgcgacgcaagaggcagtgatccttatgttgtcttacgacttggcaagaagaagctgaagacaagcgtgaagaagagatctgtcaaccccatctggcatgaggagctaactctgaccgtcacagatcccagccaaccactcaagcttgaggtgtttgacaaggacacattcagcagagatgacccgatgggagacgcggagatcgacgtcgcaccattgatagaggcggtgaacatgaacccagaggagatcaggaacggcgccatcatcaggtccgtgaggccgagcaccaagaactgcctcgccgacgagagccacgtgtgctggaggaatggcaagttcgtgcaggacatgatcctccggctcaagaacgtcgagagcggggagatacagttgcagctgcaatgggtaaacatttctcctgttgcagccaggtgaatcatcatccgattgtatatagctgctgttcctgtcattgcctgacaggcacaacgacaggaatttatttccaaatcggtgggcacgggacggatgcctgcccctctgttcatccgcgaaatgaagcgtcccgtttcaatcgcattatcacaaattgtgaatgtcggattaaatgtaacttaaaaaacaatggggtcagggtagttgatgttgcttcgtagtggggagaaaaaacaagaaaaaaaatagaggaaaataatgtcggatggcgctgccaaaatgtaaatatccggggacaggacacgcacacagctttgctttgtaaagcctggacaacataataattaagtcaagg

SEQ ID NO: 12588 - DNA, 1079 bp, Sorghum bicolor
  Clone ID: SORBI-28MAY03-CLUS18303_1
gccggccggaactactgaactcttcctccagcttagtgccaacctgaactactgaaggtgaaatggcaagcctgcagaatctgatttgctccgtatccaaacaattggttgtgccaaattgtgcggtgactgccaaaccgaatggggctcctccctcggttgtggcggcaagctcgaaagaaggatctttgaatgacagcaaggtcacgaaaaggcgattagctttgtttggtgctggagcgttagccactggcctactgaagacaggctctgcatttgctgaagaagtaccgaagaattataaatcttatgtggatgcgaaagatggatactcatatctttatccagctgaatggagggatttcgacttcttggggcatgattcggcattcaaagataaaaattttgcccttcagtgtgttcgggtgggatttattcctactgagaaaacagatgtccgcgacctaggaccaatggatgaggccatcttcaatctggtaaacaatgtttatgctgccccgaatcaaataccgtctgtctatgacatgcaagagcgtactgttgacggcaagaactactggacgtttgaatacgatctggaggctccgggctacggtgtttctgcgtttgcaacggtcgccattggaaacggtcgatactacacgttgatcgtgaccgcgaacgaacgccggtggagcagactgcgaaacaagctcaaagtcgtcgcggactctttcaagatctcggatctgacagcgtgatcgcttgcttctattagggcagctccaatgatgatttttgagctaccttaaagcatattatttcatactttaataaaagctagctctcgatgaagagctaagatcatacacacattccaagattacgtgagagtgttatgtgaggacacgcacgctatgagcaacgtgctaaacttagcactattgaaaaagttacttagagatagtaactagctttatattcttgagggcgcctttaattgtgatgtaatgcacggcctcatgagccttgggcatatgtatgcagtatgcttggtgaagagaaatgtctaaaaaaaa

SEQ ID NO: 12589 - DNA, 794 bp, Sorghum bicolor
  Clone ID: SORBI-28MAY03-CLUS18668_1
gccgggctggggaggtgcgcctgtccttcatcgtgaacgcacgcggccggcccgacatcccgctcctcgagggattctacgggaacgccttcgcctactccgtcgcggcggccaccgccggggagctctgcggcggggacctcggtttcgcgctggagctcgtgaagaaggccaagtcggcggtgacctacgactacctggtgtcggtggcggacctgatggtgctgacggggcggccgctgttcgaggtgtcgagaacgtacatcgtgtcggacatcagccacgccgggttcaagagcatcgacttcggctggggtgaggccgtctacggcgggccggcgaaaggcggcgaagggccgctccccggcgtcaccaactacttctcaagggccaagaacggcaagggggaggaaggcaccgtcgtgcccatctgcctgcccaaggacgccatggagaagttccagctcgaggtggaaggcctcaccgccgagctctaggcgatccaccgccgcgcaccggccggccggccggggtacatgcatatatacatgtcagggtgtgcgcatgcataacaatagcctaccaaggaaggcatgagcgcaactttacactactgtagatagaacgtcgtcatcaagtacgtacaccataaatgcgtcctgttcgtctcgtcgatatggcggtatatatacgcgtgttttgttttcttactatatacacagctgtacgtacgcaccgaaatatatacggtggtgtgttctccaccgaaatatcacttgcagatttgcaatgcc

SEQ ID NO: 12590 - DNA, 1255 bp, Sorghum bicolor
  Clone ID: SORBI-28MAY03-CLUS1820_1
gccggccgggccgggaagagacgactctatacaagcaattttggattttgacactgtatcacggggcagtaacccgactctctgttccgagcctttcctcccgcccccgcccccgcccccgatccagatccagctaccttctgccgcggctgaggagcgactctccctctctcctcttcctctcgttccctcttgccggtaaggagtggagatccgcgcccatcttctgttgattaggatacggggtggaatagggaacggcgatacaccatggcggatttctccaaggaatcttgcccttctgtgaagaacattttgcttctggattctgaaggaaagcgtgttgctgtaaagtatttctcagatgattggcccactaatgcatcaaagttagcctatgaaaaatctgtttttactaaaactctgaagaccaatgcacgggcagaagctgagataacattgtttgatggttatattgtcgtctacaagtttgtacatgatcttcactttttttgtcaccgctggagatgatgagaatgaactaatcttagcaagtgtactacatggtttttctgattctgttggtcttctactaaggggtgatgttgagaagcggactgcgcttgagaacttggatttaatacttctctgcattgatgaaatcgtagatgggggaatcatcctggaaacagatgcaaataccattgctgggaaggtcgcaaccaatgctgttgatggttctgtgcccttttctgagcagacgatatctcaggcgctagccacagctagggagcaccttgcaagatctctactgaaatgaacaatcagcaatacttgatgacgtattatatgacctatatgtgtgttaaaggttgggctactgaatgttgagggcctgtgtagtcgttattcatagtgtaaagtgctgccttgacagtagcctagttgtaccgagagttggtcgcatgcaatgctctatgatttaatttttttgaaccagtgattttgtagctgtcatatttcagataaaacataaataaagagttgtaattgggtgtgacctatatgtgtgttaaaggttgggctactgaatgttgagggtctgtgtagtcgttattcatcgtaaaagtgctgccttgacagtagcctagttgtaccgagagttgtcgcatgcaatgctctgtgattttttttgatccagtgattttgtagctgtcatatttcagataaaacataaataaagagctgtaattgg

SEQ ID NO: 12591 - DNA, 343 bp, Sorghum bicolor
  unsure (1)..(343): unsure at all n locations
  Clone ID: LIB3480-026-P1-K1-A5
catctgactgacttgtctacatggctctcaataatatctggaacaatgcaataccatngctggaaggtcgcaaccaatgctgttgatggttctgtgcccttttctgagcagacgatatctcaggcgctagccacagctagggagcaccttgcaagatctctactgaaatgaacaaccagcaatactttataacgtattatatgacctatatgtgtgttaaaggttgggctactgaatgttgagggtctgtgtagtcgttattcatcgtaaaagtgctgccttgacaagagcctagttgtaccgagagttggcgcatgcaatgctcttgtgatttttttgatcc

SEQ ID NO: 12592 - DNA, 323 bp, Sorghum bicolor
  unsure (1)..(323): unsure at all n locations
  Clone ID: LIB3476-003-Q6-K2-B5
tctccctctctcctcttcctctcggggcctgtggccgggtggaatagggaacggcgatacaccatggcggatttctccaaggaatcttgcccttctgtgaagaacattttgcttctggattctgaaggaaagcgtgttgctgtaaagtatttctcagatgattggccgactaatgcggggggggtagcctatgaaaaatctgtttttactaaaactctgaaaaccaatgcacggncagaagctgagataacattgtttgatggttatattggcgtctacaaggttggacatgatctttactttttttgnnaccgntggagatg

SEQ ID NO: 12593 - DNA, 1079 bp, Sorghum bicolor
  Clone ID: SORBI-28MAY03-CLUS188_1
tatagaccttatttgggtgttggtctaggacctttatcgtttttgaccaagttgcggataccacaccctggaagagttggtggcagattcttcatcaaatatggaatgcctgcgatgctgagctgggtgcttggtggcaacagctcaaagctagagggaaggcctttaagctgccgactttctgacaaggcaaatgaccagctttatcgatggtttgaggatgatgacgcgctggaacaagctatgggtggagaatggtacctcttcccaacaagtgaaggaaacagcaatagcttccagcccattcgtttaattagggacgagcagaggtcactctctgttggaagccagtcagatcctaatgacacagattcttccctatcattgccgtttccacagatatcagaaaggcatgctacaatcacatgcaagaataaggctttctatctgactgatcatgggagtgaacatggtacctggattaccgacaatgaaggtagacgttaccgtgtgccaccaaacttcccagttcgtttccatccctccgatgtcattgagtttggttctgataagaaggctatgttccgggtgaaggtgctgaacacgctcccatatgaatccgcaagaagtgggaagcagcaggggcagcagcaacagcaagtccttcaggcggcatgaatggagacaccggccaccactcctatcatcagcccacactgtactattgtacagcatccggtaaagacgtgactctgcaccacagaaaggatatagaagatacgtcaaagcagatgtgatttttgcatccatcgatgccaaacaggattttgaatactagcacctaacggattgaaaatgatgagattgcagttctacgagaggaactgatgagttgtacaatagggataggcaattcagctattgtcggactgtgtacattattgtatcatcaccaaaaaatgctgtacacctgatcatgtaatatagtgtatagttatttaactctgagtcagataagatatgatttgttcttccccccaaaaaaaaaaaaaaaaaaaaaagggcggccctcgcgatct

SEQ ID NO: 12594 - DNA, 964 bp, Sorghum bicolor
  Clone ID: SORBI-28MAY03-CLUS18834_1
gccggccgggccgtccggctcgtaaagaaccggcagcggttcggggccacccagcagccacgtccaaggcgttctcctcctccccgtctcgctcgccgtcggcggtccgccgatctcactctctctccgtgcctctcgcccgccacccaagcaagcaagcaagcagccatggcggccgcgctgctccgccgcgcgctccacctccgccgcgtgctcccctcgcccgccgtcaccgccgcctccgcacagcgcctcgcccccaccttctcgaccaccaccccgaccccgacgacctcccagcagagcgccgccaccaccacggtcgacctctcctccgacgagagccgccgccgcctcctcaacaggttggtgtaccggagcaagcagcgggggttcctggagctggacctggtgctggggacctgggtcgagcagcacgtgcacggcatggacgaggccaacatccgcgctctcctgcaagtgctcgacctcgaaaacccagatttgtggaaatggttgactagtcaggagcagccaccagaggatctgaattctaatcctgtgtttgctgccatcaaatcaaaggttacagataacctgacaaagcatgcttctcccgagacccgatcaacaccaggtcaaccatgggttagaggatgggacgacataaagaaaggcaaagatggacccaagtatggaaatcagtgataagctgcttgaaatggggatgacagctttacatcctaaataatagctgtccgtttcccccatctgcttgttttgtgcttgtgtagaataaagtgaaatgtgatcagcatgtgtgaagtttgttaaaatatattggtgaatcagaatcagcttgtaactatggatggcacttttgatgtgtccctagcagttccaggtatcgtctactactggaaagatgttatgcattgcagcctgttaatgatggcaatcattg

SEQ ID NO: 12595 - DNA, 1313 bp, Sorghum bicolor
  Clone ID: SORBI-28MAY03-CLUS37650_1
agttcccaagcgccgagccgaggaaaaagccagcccaatttccaggggattccatataaaagatttcctactactagtaaagattttactcctacagtctaccagcggctgacagatcggttcctccggctggttgctggcagatcgcttcatcgctttgtcacgacgctggcagcagagccttcaaatcctgtgtgtgcatgtgcagctgctcctgccgcctccgccgcgcgccttcgctggaaagggaaccctggtcgcccgcttccttcttctacaactattctattgccagcgcccagcggcaggcaggcagcggcacgggtagattgggagagcggctcttggcttgcagtcgagacgcccttcgtcgtctctgatctggaccggagggagcagctccttccgtcagttgttcttgggtgcgtgccttcgtgctgcttcgtcttcgtcttcttgagaggagctgctgttgcgtgcctttgttggaggacgagatgtcgggggctgttcttgtcgccatcgccgcctccatcggcaatctgttgcaggggtgggacaatgccaccatcgcaggtgctgttctgtacataaagaaggaattccaattacaaaatgagcccactgtggaggggctgattgtggccatgtcacttattggtgccaccatcatcactacattctctgggccagtatcagactggatcggccgccgccctatgctcatcctctcgtcaattctgtactttctcagcagcctcatcatgctatggtcccctaatgtctatgtcctgctgctggcacgcctcgtagacggattcggtattggcttggctgtcacgcttgtgcctttgtacatttcagaaacagcccctccagagattagaggtttgctgaatacactgccacagttcagtggatcaggagggatgttcttgtcatactgcatggtgtttgggatgtcactgttgccatcacctgattggagaattatgcttggggtgctcgcgataccttcattgttcttctttggattgacaatattttaccttcctgaatccccaagatggcttgttagcaaaggtcggatggcagaggcaaagaaggtgttgcaaaaattacgcagcaaagaagatgtctcaggtgaattgtcccttcttgttgaagggttggaggttggaggagacacttcgattgaagagtacatcattggccctgccactgacgcagccgatgatcatgttactgatggtgataaggaacaaatcacactttatgggcctgaagaaggccagtcatggattgctcgacct

SEQ ID NO: 12596 - DNA, 1452 bp, Sorghum bicolor
  Clone ID: SORBI-28MAY03-CLUS3787_1
gcacgagggcaagatggtgttcagctcatggacatatcatcacagattttgttcaatagggtcatggcccagttggggctgtgtgctttcagggctggtttgataaatgaagcccatggatgcttgaccgagctctactctactgggagggtgaaagaattgcttgcacaaggtgtgcaacaaagccgataccatgaaaaaactcctgaacaggaaagacttgagaggagaaggcaaatgccttaccatatgcatataaacctggaacttttggaagccacacacttgatttgtgcgatgctgattgaagtccccaatatggctgccagcacttatgacaagcggaggcctatgagcaaaacattccgacggcttcttgaagtgagtgaaaggcagacgtttgttgggccaccagagaacgtgagggaccatgtaatggctgccacaagagccctcaacaagggtgatcaccaaaaggctttcagtgtcattaattcactggagatctggaagcttttgaggaacagagatcatgttcttgagatgctgaagcttaagatcaaggaggaagctcttagaacctatctcttctcatattcgtcttgctacgagtccttgagccttaaccagctcaccaccatgtttgatctcagcgagcagcatgctcacagcattgttagcaagatgatgatgcatgaagagcttcatgctagttggggcccgccgacaaaatgcattgtattccacagtgtggatcaaactaggcttcaggggctactattccagatggcagataagctctcggtccttgtggagagcaatgagagggcatacgaggcaagaactggtggtactcttgagggagtgccgcccaggcgcagaggtgatggtcaggactcatccaatatggggaagtggcaggagaactttgtctcatcacaggggcggcagggtggtggcaatcggtttggatactctggtagaggtggaggatctggtcaaagtggtggccaccagagggacaggggcaaccagggttcccgtgggggttacggtggcggttcacggtttcaggatggaaggggtcgcaaccagtctggttcatcagccagaggtggtgatggtggtgctcgcatggtgaacctaaacagggttggtagagtttaggtgtgataattctcagctgaaggaagcccgaagttctactaaaggccaagttttgaagcactgctttttccataattacaaacttctgttctaaactcagtcgttcacctatttgctctatttcgttgtagcctttaattcaagggtctaggaaattgaactaagggtttgggtactctggtttgtgtcgtgggagtgagacgatgcattcgctcctatatttgatatctacttgttactcttgctataatgctatacttttcgtatttgtgtttaaaaaaaaaa

SEQ ID NO: 12597 - DNA, 947 bp, Sorghum bicolor
  Clone ID: SORBI-28MAY03-CLUS38224_1
agcacggcacgaccccccagcaccattcctgccaaacccagcgcgacctcgcgattcatccgccacgcccctcgcgaggaacgcccggcggtgggagctgcgccgccgcggctatggctgccgccggctccagccgggattcggccctcggcccgcggatcccccgccgcgcgcgctacttcggcctcgagaacttcggcaacacctgctactgcaacagcgtgctgcaggcactttatttttgtgttcctttccgtgatcaattgctggagtactatgcaaacaacaaaaacaccggagatgttgaagagaacatggtaacctgggttgccgagctgttccctccgatgagtaggtaggagaagaagaccggggttggtgctcccaagcgttttatgcaccgatggaagatccaagatgagatcttccgcagctatatgcatcacgatgctgacgagttcctgaatttcttgctctacgaccgcgtcgacaatctagagaaggaatgtaatgctgccagagaacctctgcaaaattactcttgcaaaaagaatacagatgacactattgaagaccatcccaatagcagtcacacagatttagctgcaaaaagggttcatacatgcttccagggccttttgacgcagataagccaagcaaagaaaaagactggcgttattgctccaaaacgttttgttcagagagtgaagaaacagaatgagttgtttcgcagctacatgcaccaggatgcacacgagttcttaaatttccttttgaatgaacttgttgatattctggaaaaagagtcaagtgctgccaaggattcaccccaattgtcatctcctgaaaaagctccaaatggcccagttcaacctttagccaatggagttaaaaaagaacctccagttactctggtccataaaaatttccagggcatattgaccaac

SEQ ID NO: 12598 - DNA, 1041 bp, Sorghum bicolor
  Clone ID: SORBI-28MAY03-CLUS38561_1
gcacgagggggatatcgaccttactaattctctttggacgtatcagattggtttgaaaggtgagttttcaaggatctattctcctgagaagcaaggatctgctgggtggagtagcatgcaaaatgatgacacactttcacccttcacatggttcaagactacgtttgatgctccagaaggtaatggccctgttgccattgatcttgggagcatgggaaagggccaggcttgggtgaatgggcatctcattgggcgctattggtcactagttgcaccagagtctgggtgtccgtcctcatgcaactatgcaggaaattacggtgatagcaagtgccgatcaaactgtggaattgctacacaaagctggtaccacataccacgcgaatggttgcaagagtcagacaatctattggtactcttcgaggaaacagggggagacccttctcagatatcgctggaggttcattacaccaaaacaatctgctcaaaaatatctgagacttactatcctcccctttctgcctggtctcgtgctgccaacggtcgtccctcagtaaatacagtagcaccagaacttcgcttgcagtgcgatgaggggcatgtgatctcgaagattacatttgcgagttatgggacccctacaggagattgccagaacttctctgtagggaattgtcatgcatcgactactctagacttggtggcagaggcctgcgaaggcaagaacagatgtgcgatcagtgttaccaatgatgtattcggcgacccatgccgaaaagtcgtcaaggatttggcagttgtggccgagtgctccccgccgtcagctaacaaagaacctcgagatgatatgtgatcacggtactgtaatgtggtgctcaggtcctggaagagccatggacgttgccgcagctctgtacctctggctatgcacccatatttatatgcaatgtaaagacagtgtcctactcctataaagaaaaagaggagaatagaaaagaaaggagaaggaaaaaaaagaataaaagttgcttccttacagtt

SEQ ID NO: 12599 - DNA, 633 bp, Sorghum bicolor
  Clone ID: SORBI-28MAY03-CLUS34554_1
cccaggcaagaaggacggcggcggcgacaagaaggacaagggcgcaggagacgggggagacaagaagaaggacggtgggggcgaggagaagaaggacaaggccgcggccgcggccgcgtcggtggcgccgttacccctggccgacgccgccatgtaccagatgcccccgcactacgggtacggcgcgtatccgccggctcccggcggctactacggcgccgccccgcggccgccacccaaccacgccggtggcttctaccaccccaacgccggtgtccattacccgcccgcgccggcctacgggtacggcggcccctcccacctccacgcgccccagatgttcagcgacgagaaccccaacgcctgctccgtcatgtgagctcgctcgatccgccggtttgccgtcgatcggcgcccccttcctccgtctccgtgtcagaccaagaaccatggcttgggttttagcggtcggtttagttaaattatcaggtagtagtagctagtttaatcagtgctccgagatcagtaccagcagacctgtgtaaatgagatcagtacccccgccccggtgtaagtgtaatgcagcgtcatgtttgtaatctagccggacctgataaagttttgctctttttc

SEQ ID NO: 12600 - DNA, 1435 bp, Sorghum bicolor
  unsure (1)..(1435): unsure at all n locations
  Clone ID: SORBI-28MAY03-CLUS35037_1
cagccaaacttcgtccttggggacattcactgtgttatcttacctgattcttgctgatgcatatnngctacaagtgatgcatatnagttacctgcccaacatgnggcanncttacctggacttatangaagacaaaattnntgttgcgtgaaattanttggttatnncatgctgatatcatctgtcttcaggaggtacaagtaaaccactntcgaagattttttttcacctgagcttgataaacatggatatcaggcgctttacaagaaaaggacaactgaggtgtattctggaaatcctatggccatagatggctgtgctacttttttccgcagagacaagttttcacatgttaaaaaatacgaggttgagttcaataaggctgcacagtctttaacagatgcaattattcctgctgctcagacaagagtggctttaagtcgattgattaaagacaacattgcactaattgcggtgttagaagccaaatttggtaatcatggagctgaaaatcctggtaaaagacagctcctttgtgtggcaaatacacatataaatgtccatcaagacctaaaagatgtgaagctatgggaggttcataccctcctaaaaggattggagaagatagctgtcagtgcagacattcctatgttggtctgtggagatttcaactcgacccctgggagttctccacatgcgcttcttgcaatgggcaaagttgatcagcatcatccagatctggcaatagacccccttggaattttacgccctccaagcaagttgaatcatcagcttcctctggtcagtgcatactctgcgtttgcaagaatggtaggtgttggctatgatctggagcaccagcggagaaggacggatcctgcaacaaatgaaccactcttcacaaattgcacgagagattttacaggaacttttgattacatattttacacagcggactcattgaccgtggattcattattggaacttttggatgaggaaagcttaagaaaagacacagctcttccatcccctgaatggtcatcagatcacatagcgctcttagcagagttccgttgcaagcctagaatcagacggtgacgcattaggtcttgtagaaaaggttattctcatcatccttggtggtggaacactgttccatgtgggaacttgagtcagggcggggacgagggctctcggggaagcaaagcagccttaggaagcagcctcaggaaggggaagaggcttgtaacattgattttaccctcttacattttgagctcagtgatattaagctgcccctgtgtaccattactttctatagaagaaaaaacttgagagaaatatttaaagggttataaaccctttctttttctttcgtccactgtggtcgcgttcgatttacctcttggctgtanccatgctcgctgcctacaag

SEQ ID NO: 12601 - DNA, 821 bp, Sorghum bicolor
  Clone ID: SORBI-28MAY03-CLUS3536_1
ttggaaagctgctgacattgagatcttgaatactttccagctactttcagctaagccagttgtatatttggtgaatatgagtgagaaggacttccagagaaaaaagaacaagtttctacccaagatacatgcctgggtgcaggaacatggtggtgaaaccatacttcctttcagctgtgcttttgaacagaaactagtggatatgccagaagatgaagctgccaaatattgtgccgaaaaccagataacaagcatgatcccaaaaatcatcaagactggttttgcagcaattcatctgatatactttttcactgctggtcctgatgaggtaaagtgttggcagatcagacgtcagactaaagctcctcaagctgctggtgcaattcacactgatttcgaaaggggctttatatgtgctgaggtaatgaagtttgaagatctgaaagaactgggcagtgaatctgctgttaaggctgctggaaaatacaagcaggaggggaaaacctatgtggttcaggacggggacatcatctttttcaaattcaacgtgtctggtggcgggaagaagtaaaaaaaatgtatgaagatgatactagcatcaacagtgtattacatcttaccccgaatttctcgttcaacagtgtgttacatcttgcccccaatttctacatttttgaggtcgctagccagtagccaagttccggtgatgcaagcttgtacaacgaggctccagactgttgaaggattgtattgaaataacatgcacggttgtatatcttatgcttgagctctcgctgttaccaaagcttataatcgtctca

SEQ ID NO: 12602 - DNA, 1123 bp, Sorghum bicolor
  Clone ID: SORBI-28MAY03-CLUS35604_1
taaaaacaaaagtcttgatgccctgcagatttttaagcatcatgatggtgtcgttgaagatgttgcttggcacttgaggcatgagtatttatttgggtcagttggtgatgatcatcatcttttgatttgggacctgcggtctcccgcacctactaagcctgttcagtcagtggtggcacaccagggcgaggtgaactgcctggctttcaacccgttcaacgaatgggttgttgcaactggttctactgacaagactgtcaaattatttgatcttaggaagattgatacttctctgcacacctttcacaatcacaaagaggaagtttttcaagttggatggagtccaaagaatgaaactatacttgcatcctgttgtctgggcagaagactcatgatctgggacctaagcaggattgaccaagaacaaacaccagaggatgcagaagatggccctccagagctcatgttcatccatggaggccataccagcaagatctctgatttctcatggaacccctgcgaggactgggtgattgctagcgtcgctgaagacaacatcctccagatatggcagatggctgagaacatctaccatgacgaagatgatttgccaataagcgatgagccggcaaagacatcttaagccccacaatgcaaaaggaatcttaactccatcaactgttggtgctcctagatctgaaccctgctggccagtgttggccaagaatcttaactgagtgcgttggccaagaatcttaactgagtgcgttggctgtaggttgcttccgtggtcgtaactttatgcttgacgggttggctgtgtttcttcgactgtcggtatgttattagtcgaaccttttgagcgttatacatatgccgattgattagatctgttcgtcgcagttgtgttttgtagtcctgttatttcttataagccggcctgctaatttttggtgtgccgagggttaggaatgtcgacgtctagtgtcaagttggttgagatgatgcgagatgtttttgtgggcatggcgtgccaagtagtagaggcctgttgatcactgcttgcaagtatctaaggtcgctcgcttgccatttgcatcgatgatactggggtcatgtgatc

SEQ ID NO: 12603 - DNA, 1270 bp, Sorghum bicolor
  Clone ID: SORBI-28MAY03-CLUS3373_1
atcgatcgatccagatccaggcatccggccgctcgaggccggccgggccgtattccaccgcgtccgcgaggtcgtcatcgtcttcctcgttccccattcccgtccccgttcccctctctttgagtcgctgtgaagcgggatctcggtccagccttcgattgatttcttcggttcgttgctggggttctgaaccccattccgcgaggcacgtccgatcagatcgactattttatgagttcacaggccacccagcatgaagtttttagaatacacccccttcgacagtataaatttgttcctcgagcagctcaaccttggagattgtacaatcagaggaaaccttgaggccttctcatgcaagcacactgcaacagaccgtcggctttcaataagcctagaacacgagattcttgattaccttggcaagtctgctgatagtgatccttcttcaccagtggagcacttatcctccagatcaagccggaaaacattgatatatctagttctcactcttggccacatatatccagattatgatttcagtgctgttcgggcacacttgttcttccaagaagaggagttggaaagtttcaagcagatggttgacacctacttatctgatgcttctaggcaatgggcagccacaaatgagggcagttctcttctggacagtatgactaaagcaattgatgaggttatcaaaatcagagagtgtgacatctacagctataacccagactctgatgcagatccagttctagagaaaggggccatatggtcgttcaactacttcttctacaataggaagctaaaacgagttgtgagctttcgatgttactgcactagcaaattatcaggagatgacttcttaactggtgttgcatctgatggtgaagaggaagatgccttgattgacatggacatatgactgacggagttctgcgagctacctgatgtgcgtgtaatatagagcacgtatgcacattcctgttaggaaacttttaatatgacttccttctatcgtagcctgtaaaaaccatggcccctgtttacctttgtttgtatatgcggatttgagatttggcagcgggaaacttccaaaccctgaggcttgaactgccatgtcaatttggtactcagttgtttgctagtaccggagtctgttctgcctagttaaacatgaagatatttctgaatattgtgtgaactgaattgtcaaatttgctcagttgttaattcagggggagatagtatggaactgccccatcct

SEQ ID NO: 12604 - DNA, 1365 bp, Sorghum bicolor
  Clone ID: SORBI-28MAY03-CLUS3596_1
gcacgaggccgtcacatatatggacaagcaatcaaggtgaactgggcatatgcaagtacgcagagggaggatacatcagggcatttccatatttttgttggtgatttaagttccgaagtgaatgatgcaactctttatgcctgtttctcagcatatccttcttgttccgatgctcgagtcatgtgggacaacaaaactggacgctccaggggttatggttttgtctccttccgtaatcaacaggaagctgaaactgctataacagaaatgactggaaaatggcttggaagcagacaaataaggtgcaactgggcaacaaagaacaattcagaagagaaaccagaaactgacaatcataatgcagttgtactaacaaatggtagctccagcaattcagcaacggatgcaagccaggatggaggaagtaaagagaacccagagaacaatcctgattgcactactgtatatgttggcaacctcggacatgaggttaaccgggatgagcttcaccgccacttctatagcttgggggtcggggcaatcgaggaaatccgtgttcaacaggataaagggtttgggtttgtgagatatagcacccatggggaagcagcattagctattcagatgggcaatggattggtagtccgtgggaaaccaattaagtgctcatggggtaacaaaccaactccacctgggacaagttccaagcccctacctcctccagttgctccataccagcctgctgtagcaatgccaggtgtcccgcaaggtttcacagcagcagaacttcttgcttatcagaggcagcttgccttaagccaggctgcagccgggcagattgctggccagcatggtctcgcgggtcaggtttctgcaggtcttcttgctgctgctggttcccaggccctctacgatggctacccaaaccagtcatcagcccagcagcttatgtactacaactagagttgaagaggaaggcgttagtgttcagcttgttctgtgcaagcctggccatcctcgcccggttttttattttgtggttcatgtactatttgtgtgagagttcttgttctcttctcgccgcgggattgtgtcgctatcttcttattgtaccatcgaccattttccttgtctaattctgttgagtagtcactttaacagagtaagagatgtattctatgtgacgttgcgattgattaatgtaatgctcccctggggatcggctttggtcgctgggctggttcatgatctggtgttctggtccgattggacattgaaaggattactgtttctcatttgtagtttggtgttatggtttactgatgttctggtccgattggacattgaaaggtttactgtttattc

SEQ ID NO: 12605 - DNA, 1158 bp, Sorghum bicolor
  Clone ID: SORBI-28MAY03-CLUS3599_1
cgtccgagcagatgaggttatcactgcatttggaaggttggggactatgtttggatgtgattattataacatcaagccagatctagtttcattggccaaggctctttcaaatgcctatgtacccatcggggcaactcttgttagccaagagatatcagatgtgattcattcccagagcaataagcttggttcatttgctcatgggtttacatactctggtcatccagttgcctgtgctgtggccatagaagctctgaaactttatcgcgaaagggatattcctggtcatgtcaagcaaatcgctccaaagttccaggacggaattagggcgcgcgcagacagtccaattattggggagatacgcggcttagggatgataatgggaaccgaattcactaacaacaaatcaccgaccgatctattccctgccgaatggggggttggtgcgatctttggagaggagtgccagaagcgcggcatgttggtcagggttgccggcgacgcaatcatgatgtcgccgacgctgatcatgacacccgctgaagtcgacgagctggtgagcatctatggggaagccctcaaggccacggaggagagggtggcagccctgaaatccaagaagaactagcaaaagggcgaggacgacgacgataacaccgggcggagctgatgtacaggtgaaataaaagttggtggctgcgagatggcaataacgcaccggaacggtcgtcgctgttcttgaagtgcaaggtcgcagctgctcggtcactaagcaatggtgactgaccttttaaacaggacatagatgtttttttccccctaagcaatggcaatatctcaaatgtttgctgccctgtacttcctgaagataatttgtttcaagtatacccttactggtagaatattcagatacataactttgtaaggcaaaacaatagtaaatggtcccaaataaagtgaaggaattacagggcaaaaaaaaaaaaaaaaaaaaaaaaaactcgagaccgaaaacattggtgagaatccaatgccccgaaaacccaaggtttcctccgcaaggttcgtccacggagggtgagtcagggcctaagatcaggccgaaaggcgtagtcgatggacaacaggtcaatattcctgtactaccccttgttggta

SEQ ID NO: 12606 - DNA, 1334 bp, Sorghum bicolor
  Clone ID: SORBI-28MAY03-CLUS42127_1
ctggccgcatcatcaattctcacctgttgagagtatcgacaaaccaaatggaggcgctcgttgttcggcggctgggcgacccgacgctggcccccggcggcgaagcctccccgttcgccgcggtctctggggatcatcctgtgccggaaatctcgtcgccaacggcagttagagtgcgagtcgcggcgaccagcctcaacttcgccacgttcctccaggtgcagggcaagtaccaggagcggcccccgctgccgttcgtgcctggatccgactactctggcgtggtcgacgcagtcgggcccggcgtgcgtgggctccggcccggcgatcgcgtctgctcctttaccggcctcgggtccttcgctgacttcatcgtcgccgaggagaagcagctatttttagtgcctgatggatgcgacctggtcacagctggggctttacctgttgcatttggtacatcacatctggcccttgttcaccgagcccaattgaaggctggccaggtgctacttgttcttggtgctgctggtggtgtcggggtatctgctgtgcaaataggaaaagtttgtggtgctgttgttattgcagttgctaggggggctgagaaatcggaatatctcaagtccataggagctgatcatgtagttgactcaagcaaggataatgttgtcgaaagtgccaagtccttcttaaaggctagaggcttgaaaggcgttgatgttttatatgacccagtcggggggaaactaactcaggatagcctgaaacttctcagttggggtgcacacattcttgtcatcggatttgccagtggtgatgttccagttattcgagcaaatattgctcttgttaagaactggacagttcatggtttgtactggggaagctacttaattcatcggccacgagtgctcattgattccctcaatgaactcttgtcgtggctttcaaagggtctgataaaagttcaaatttcacactgctacagacttgttgaggcccatcttgcgttctctgccctgagagataggaaggcggttggcaaagtgatgattgtaatgggcccctcagcagtatcaaggctctgatatcattcagaaatctacgagatcatgaggcttctactgtgtatctcttgtatccattgtaggacaaagattatccgagactgaagtagtttccttgtgaataatgttgtatatgatatctacaaaaacaatcagagtaataagcagtttgtctcgacacaatgccaagcagcgtatacagctgatgcgaaacagctctacgatgccaatgcagtgagcagtggcaagtaaaatgaacacaatctg

SEQ ID NO: 12607 - DNA, 1052 bp, Sorghum bicolor
  Clone ID: SORBI-28MAY03-CLUS4214_1
tctctccctccactcatcgcgtcgccgttggtcgttagcagcagcagcagaagcagcgcggggggcaaacagggggacaaggcaaccgggccgacgagacgaacaggaaaaggaagaaagcgtcgcggagcgatggcgcttggcggccttggcgtgcgagcggcgcccttcacgtacgcggcgcacgcgctggccgtcgcggcggcggccatggttctggtctgggccatccagttccgcggcgggctcgccatcgaggccaccaacaagaacctcatcttcaacgttcaccctgttcttatgcttatcggttatattattatcggcggtgaagctataatggtatacagggtacttccaacaacgaaccatgacacaactaagctgatccatctaattctccacgggattgcacttgtccttggtgccgttggaatatattttgctttcaaaaatcacaatgagagtgggattgccaatctttacagtctgcactcttggattgggatcggaacaattactttatatggtattcagtggataattggatttgttacattcttcttccctggtgctgcgccaaacgtgaagaagggcgttcttccttggcacatactctttgggctctttgtctacatcttagcactggctaatgcagaactcggctttcttgagaagctcactttcctcgagagctcaggtctcgacaaatatggcacagaggcattcttggtgaacttcacagcattggttgtcgtgttatttggtgcctctgttgtagtggctgctatagctccagttcgccttgaagaaccacagggttatgctccaattccagaaaactagtacaaatgaaatgtacagcatatgtagttgccaggattggctgttaccatatggagataagatattcatctctgtttattaaaggagaagaagatggtggaattatcacaataagaagatagtgcatcttcattgtgtgtatatacattctgtgatacttcaaaatttcagtatatgtataaaactgaaaaaaaaaaaaaaaaaaa

SEQ ID NO: 12608 - DNA, 1176 bp, Sorghum bicolor
  Clone ID: SORBI-28MAY03-CLUS4246_1
cccacgcgtccgcggacgcgtgggtgagatttggaatgcgatgtccactttgacaaagtccatgtgctggaagatggtcaacaagactaaggataagttaaatcaagttggtatggtcatatttcagaaaccaatggacaacatttgctatgagaaaagatccgaaaacaacccaccattgtgcaaggaatctgatgatgcagatgcagcttggaatgtacctttggaagcatgcatgcacaaactgcctgttggctcgaaagttcgagggtcaaaatggccagagttttggccacaaaggcttgagaagactcctttctggactgatggttccaaggttggggtctatggaaagcctgcaaatgaagatttcgaggcagataatgctcactggaaaagggttgtaagtaaatcgtatgtgaatggcatgggaattgactggtccaaagtgagaaatgtaatggacatgagagctgtgtatggaggttttgctgcagctctgagggaccaaaaggtctgggtcatgaatattgtgccgattgattcaccagacacactgcccatcatttacgagcgtggtttgtttggtatgtaccatgactggtgcgagtctttgagcacttacccaagaacttatgaccttctgcacgcggaccatctattctcaaagctcacaaagagatgcaaattgatggcagtttttgccgaggttgatcgtgtactgaggccccaaggcaaactgattgtgagggacactgcggacacaataaacgaactggaaagcatggccaagtccctgcagtgggaggtgcgaatgacctacaccaagggcaacgagggcttgctttgcgtcgagaagtcgatgtggcggcccaaggaactcgatgcaagcacgtgaaatatatgtgttgaagagaactgttaccaagtagggtaaaattagaggaatttttgtcactagatatgcatatgattcttgttgatgctgaaaggacaaactctttggtgtaactgtagaataatacacatctgttttcccccatttgttgtttcattctcaacgctgctgtaagatagtgtgctggaaatcactggtacattctgttcaattgggcagcttcttcagtttgtcggatagcagtcgaacaatcttgtgcataattgcatatgctatat

SEQ ID NO: 12609 - DNA, 671 bp, Sorghum bicolor
  Clone ID: SORBI-28MAY03-CLUS42465_1
caataaatctcccgaggcaattttggcgtgctttacttacctgcttcctatttttccttttccgcgacaaaatcctttttgttaattgcgaaaacgaaagagcccgtgtgaactggagaggtgaggaaaagaggaaaaaagagagataaattggaggccattagcaagaaaccatgagttctaggttcgcaatccctagtcctgacctcacttgagcgctcgtgagctctctccagtggctaaagattgcagatttgagttctagtccaagaaaagggtggtggtccgccatggaggtgaggtccgagcaagggctgatggcagggagggatctattcggcatgccgaagagcccgccggcgccggtgcctgggccgccggcgtccgcggccatgcagagcgtgcgcatggcgtacactgcggacggcaccgctgtgtacgctccggtgagctcctcggccgcgacgccgtcttaccagccgcagggcccagcccacggcactagcatgtctgcggcgacggtcgttggtggcaatggcgcgtcagctgtgcctggcatgggggagccggtggccaagaagaagcgcgggcgaccaagaaagtacgggcccgacgggtccatggcgctggcattggtgcctgcgtcggcggctacgggatcaccggctaca

SEQ ID NO: 12610 - DNA, 852 bp, Sorghum bicolor
  Clone ID: SORBI-28MAY03-CLUS4265_1
ataagcacccggcccagatccagtcaccactgcccgtccacaagccacaccaacccgcctcaccccattcatcgacgggacgacctcgccggcgagagagagagagagagagtgacagatggaggcggcggcagcggcggccggcgtggagctcggctcctcgaagccccagatcgcgacgcaggcggagatggcggaggcccgggtgcccctcgcctaccgcgaccagtgcgcgcacctcctcatcccgctcaacaagtgccgcgtcgccgagttctacctcccctggaagtgcgaacccgagcgccacgcctacgagaagtgccagtacgagctcgtcatggagcggatgctccagatgcagaagatccgcgaggcgcaggagaccaaggtcaagggcggcgcctccattggcctcatcccggccaccgccaagctctcctgatccggccccggcccgatccgcttgatttaggtctgccggctatcgtgcagaggcattgtgctgtgcaaggatcctgaatgtttgttgtgtgaacaaacatgtgtttgaatttggcataaagttaactgttgtcttcttcccttccccctctctccctgatgggcatcttcaagtttcaatttgatgatggaataaggaaacattcttgtcctataaccgaagactgaatagcgccttcaagttttgaatacaatccttggtgtagactgactcacctctgtttggttgtttggttgggttactgcgtagtaaaaccactactgtggcatggtaattgcagcagtttgtgcctggcatgccgtcgttgtgcggtactggtgtgttagtgcatcgatatgcatgcgtct

SEQ ID NO: 12611 - DNA, 944 bp, Sorghum bicolor
  Clone ID: SORBI-28MAY03-CLUS3629_1
cccacgcgtccggcaacgacggacaaccgaccatgaagccatgactaatatgaagacagagttcatgtccctctgggatggattcaccactgaccagaatgctcgtgtaatggtcctggctgctacaaataggccttctgagttagatgaggcgatcttaaggcgctttactcagatatttgagattggaattcctgttcagagtgaaaggagcaagatacttcaggttgtgttgaagggagaaaatgtcgagaaggatattgattacgatcacattgcaagattgtgggatcagcctactggttcagaagacctcgagatctcgaagcaggctacattggaccctatgagggcattattgggctatgggaaaaatgggaggcaattagataaacctagacctttgagacaatcatacttggagagagccctatcaacgtctagaaagggcaagaaggtctggaagttcaggactgcagtcacccttggtgtttaagttgacagattcagaagaatatccgtatgggaacgcgatctttgactcatcagttgtgtggccaacaattggtcctgactgtctggtattttattttcagtttaactaatctagggtatcgaattacgccgtattaatgcagaaagggccccttaagtctcgcaagcattacgaagatacctttaggtttgcttatgcagattgcaatttacctaaatatgtattatttctttttgcgtggcgatgctgcacctggttttttgaagctaactgcagctggcaaagtggcaagtgtgccatggtgtttaagttgatcattcaaagttcacgcccctatgggcagcaaactcagaactccatagttgtctggccaacaattggtcctggttgccttgtattttattttcagtttaactaatctagggtatcgaattacgccgtactaagc

SEQ ID NO: 12612 - DNA, 763 bp, Sorghum bicolor
  Clone ID: SORBI-28MAY03-CLUS36790_1
tgctcaggagctttttgaaaagcctttcttccagtcggtggccagagctttgcgtcctggtggagttgtatgcacccaggcagagagcatatggttacatatgcacattatcgaagatattgttgtcaattgtcgccaagttttcaaaggctcggttaactatgcttggacaacagtacctacataccctagcggagttattgggttcatgctttgctccactgaagggccagctgttgatttccagcaccctgttttcaacattgaggaggatgaacattctacaaaagcaaagggaccccttaagttctacaactcggagatccacacagcatcattctgtttgccctcttttgcaaagagggtaattgagtcaaaggcgaactgaacgtgaagatatttcaccaagtctggtcgattgggctaagtaccttaggtgcaacacagaatttgttgtagtgtgaaaaggggatgccaaccttttcttcccctttgatgaataagcacaggagatgagatgcaacagttatcagagctgtcggtctatacgattctgttagttgtatgtcttggctgcctggtgcagctgtgaaaacgttttgcaatagctgttttcggcagtcctcagatcaggttgagttttgggcatcaatgtttctgttcctgcttccataccagggatggaatatataagaaataaaactgtgtaatgattgttgccatcacatctttttaaaactggtcaacccccctgctcaaaaaa

SEQ ID NO: 12613 - DNA, 791 bp, Sorghum bicolor
  Clone ID: SORBI-28MAY03-CLUS37260_1
aaacagtttatcagttgtgcaagcaggctgtttcacaggctcgtgctggtgctgatgttgtcagccctagtgacatgatggatggccgtattggagcacttcgctctgctctggatgctgagggtttccatgatgtctccattatgtcctacactgcaaagtatgccagttccttttatggcccattccgagaagctttagattcaaatccaagatttggagataaaaagacctatcagatgaacccagccaactacagagaagccctcatagaaaccgcagcggatgaggcagaaggagctgacattctgcttgtgaaaccaggattaccttacttggatatcatccgacttcttcgggataattcagccctaccgattgctgcttaccaggtctccggcgagtactcgatgatcaaagctgccggtgcgctgggcatggtcgacgagcagaaggtgatgatggagtcgctcatgtgcctccggcgagccggcgccgacgtcatcctgacctacttcgcgcgtcacgccgccgcggtgctgtgcggcatagggcccaagtagtcaagtagagggcagaggcccgccatccctgcgctgcactgcatgccattgtgtagctgagttgactagcaagcaagtatagcttttttatcgtgcgagggtgtgtttgggcccgggccttggaattggattgtaggaggcctgggattcgaataatttgcgccgggagattagctgtgcaaaactgttttttgagttctcatggtggtttcatttcccggtactaat

SEQ ID NO: 12614 - DNA, 711 bp, Sorghum bicolor
  Clone ID: SORBI-28MAY03-CLUS37335_1
tgtccaatgtgattgacctgggtacagtggcccatgctgcgctctccacagtcagtgtcatcatctacttctgctgctttgtcatgggatttggtcccatccccaacattctatgtgcagagatctttccaaccagggttcgcggtctctgcattgccatctgtgccttgacgttttggattggagacatcattgtcacctacagccttcctgtaatgctgaatgctattggactagcaggtgtttttggcatatatgcagtcgtatgcttgattgcctttgtgtttgtcttccttaaggttcctgagacaaagggaatgccccttgaagtcatcactgagttctttgcagttggtgcgaagcaagcggctgcaaaagcctaattccttccgtacctttgcctgcaactttttgcactgtgaattataaacttgaagggatctcaccaagaagctctgggaactttcgatttgtataaatggtgagggaacagatatctgctcatgctccgcaagcgacagcaagactccctcgatggcaaagagcagttgttaagttgtcaatgttatttaccatatgttgttacctattagtactgtattagtcaagctattcagcactggttgttagtagagatgtttagaacaaagatactgatctgatccggtggtataatattcaaatctcaaataaagaaaataccgttttcat

SEQ ID NO: 12615 - DNA, 780 bp, Sorghum bicolor
  Clone ID: SORBI-28MAY03-CLUS37576_1
tactggaaaccgaggccacaggatgagcagcttctccgaactccccctctcgtgctgctgcgtctcctcctcctcgtcctctccagtgtccagctaggccatggcgtccaccgtttccttctcccccgccaacgttcagatgctcccggctaggagtggccgaggccatgctgcctttgggagctgctctgccgtaccaagagctgggccaaggctgcgctccacggccgtcagggtcagcagcgagcaggaggcggcggcggccgtcagggcgccgtccgggaggaccatcgaggagtgcgaggccgacgccgtcgctgggaaattccctgcccccccgccgttggttaggccaaaggcccctgaaggaacaccggagatcaggccccttgacatggcaaagcgcccccgtcgcaacaggaaatcaccagctcttagggctgcattccaggagacgagcatctcgcctgccaatttcgtgctcccattgtttatccatgaaggagaagaagatgctcctattggagctatgccagggtgctataggcttgggtggaggcatgggctgcttgacgaggtttacaaggcccgtgatgttggtgttaacagttttgtgctctttcctaaagttcctgatgcattgaagtctccaacaggagatgaagcttacaacgaccatggtctggttccacgtacaatccgcttgctcaaagacaagttccctgatattgttatctacacggatgttgcgttagacccttattcatctgatggtcatga

SEQ ID NO: 12616 - DNA, 1183 bp, Sorghum bicolor
  unsure (1)..(1183): unsure at all n locations
  Clone ID: SORBI-28MAY03-CLUS3651_1
cgtgcggactagttctagatggaagtccagaagcgtcttcatgaacagcttgagattcagagaaaattgcagttgcggattgaagagcaaggaaagtatctgcagatgatgtttgaaaagcagagtcaatcaagcacggataaagtccaggatccatcctcaagggatacagtggcaaaacctactcgaccccgggaccgcagactccagactcgagagagagatagaggtgcgcctccccgtgagccgggggcaactggtgggcggcgtcctcctctttgcgcagcaggttctcgcgtccccctcccggcagcctctctcccccaccgccatcggcgccaagaggcgatcgtcccacccagctttttcccccctcccccgcacccatcatctaccctgagccaatcttcaaacaaggatagtggtgcaaccatgggccccctgccggccgcggcccgcccctccccggcaagtcggggagtgcttttatcgaggtgatgaaaggaaccaaaagtgactaatgggaaagaaacaaagcttgttcactgttctaaacaaggaggtttaatctgatgcagtctcaaaagagcagagttttgggagcaatgtcatcctctttgcctattctgccaaatcctttgaaagggagcttcccaaagccttgtaacccccagcatattcctatgtcgaggcagctgcctgatgactctatgcccttgcgtaatgacatacatcagtctgctagtttaagcacccaaggggtggtggtaaaggagcacctcctagccgacttgtttataacactagcaataatagctatacccgaagtggggtcaatggttgcaccctatatttctcagtcatccagttttgagtctttccagtctctatctgatactaccccaggaacacacactgaggcagcctggttcacatcttctatggatgtttcaccactctacacagataatattgctgctcctgatgataatcaaatccagagtatacgtcctgctatgacatctgatgagactgctaaactgggagaacgatctggatcgcagatataatgaatgatgattgnaaaagtattctagacgncacagctactgattcacactcaaaagccatgatttcaacttccactcagctacatcattacctgcagtanaacagtcagctt

SEQ ID NO: 12617 - DNA, 931 bp, Sorghum bicolor
  unsure (1)..(931): unsure at all n locations
  Clone ID: SORBI-28MAY03-CLUS48121_1
gcgcgaggcacggaccccccctcccctgagcatcagcgtcgtcgccatcgccggcgacggtgacgactccgaccgccgccgccccctgctcgccccgaacgaagagatccacccatacactgaccccccgtcccctgagcatccgcctctagatgctgcggcggcgcagcccgacgagcagcggatgccggagagagtggcctcgctggacgtgttccgcggcttcactgttgccatgatgatactcgcggacgacgccggcggggcgtggccgggcatcaaccactcgccgtggttcggggttacggtggcggacttcgtcatgcccgccttcctcttcatcatcggcgtctccgccgcactcgtcttcaagaaaatgccaaacaagacagatgcaactaagaaggctgcaatccgggcttcaaaacttttcatattgggtgtgattttgcaaggaggatacattcatggacgacacaaactaacttatggtgtcgatttggatcatattcgatggcttggtgtgctgcagaggatagctattggatactttgtagcagcaatgtcagagatttggcttgtcaacaataatttggtggattcacctgtatcatttgtgaagaaatacttcatggagtggttcatggccatagctattacagtgctttatgttgccttggtatttggcctttatgtttcaaactgggaatttcaaattcaaactagcaattcaaccctttcaatcccaagcaattcaattgaatcaaagatggtccaatgtggagtcagaggtagtcttggaccaccttgcaatgcagttggcttggtagatcgagttttgcttggtgaanatcacctgtacaagaacccagtctacaaaaggacaaaggaatgcagtattaattctcctgattatggaccacttcctccg

SEQ ID NO: 12618 - DNA, 1178 bp, Sorghum bicolor
  Clone ID: SORBI-28MAY03-CLUS47665_1
tactggaacctccccttcctggaggcacgcacctccgtcacacacaaaaggatccgaggaagacagcagagatcttgaaaccaagaaaaaaaaaacaggctagatcgagcatctatcctgcatccaatccacagcagctgtatctactagtaggtgctagtcttactctgctctgggccgcttctggctggctccatggccgggctgagcgttctcctggagccccacagcaagagccacccctgcgggaaggggaaggcagcggcggcggcgcagatcatcagcaaggccaccctcgtgatccacggccccagccacaaccacaagcagcagccgccgcagcgggttccgcctgtctctccgacggccgcgggctccttcctgcagcgctgctgcctgtgccacgcagagctcgccgagggcatggacatcaacatgtacagaggcgaccgggcgttctgcagcgtggagtgccggtgcaggcagatcttcatggacgaggacgccctcagcaacggcgagggtgccggtgccggtaccgccaccgtgcggggcagccggcgagccgccggcggcggccgtgtcgcctactgagcgcggcctgaacaaaccaaggttttctccgtgtagatgtagccgtgtagggtggggccagatcttcatggatggccatgggagcagaacgagcgagaaatcatccaagagacagagagcataggtcatcacgctccggcagtgtgctagtatctgacagctcgtccccgtgggacccatcgctggcgcaacaaaaggaggagtagtacgtgcgtggcgtctggctggacccactggataagatggccatgactgacttggagccgctcttgggccccaccccaccacctcatgaagtggatcaggatcaaccgagcagttagcgggccggctctgccttttgttattacgtctctcaatgcagattggctaaccgcgttcgtcaacggtggatatcactgaccggagttgattctgtgtccactgttcaagtttggcggtacctgcggtgcaccttgagggaaatttcttcttattattattagttccttcctcttctttgtattctaatttgtataatttctatcttgtgcaataataatactgtgtcggtgtgacatatatatttatctatcatactgtgc

SEQ ID NO: 12619 - DNA, 970 bp, Sorghum bicolor
  Clone ID: SORBI-28MAY03-CLUS4831_1
agtctatgaggaaacatacaagagcttgaaatcaagaggagtgcggtttcctggacgtgacaatgagagcttggctcccatatttactccaccacggtcagttgctgaagctgatgttgactcaagcttgccccagcaagcattcgaagacatccatgttcatacatatactgctgaagaaacaaaagaagcatttgatgtagctcgtaacagcatagaacttctttcaactgttctttcgtcttcccctgaacaggatgctttgcaggatgacttgacagccactcttgtgcaacaatgctaccaatctcagcacactatccagaggattattgagaccgttggagacaacgaagctgtgctctttgaggccttgagcgtgaacgatgagatccagaaagtgttatcgaagtacgaggagatgaagcagcccagggcctcagagcatgcagaacagagaccagttgtcataccgattgccacagaacatgaagattcgactgctatcggcaatgaagacgcccttgtcagaaaaccagctgccgcgagagcaaggtcaggtggagatgatgatatccttgatgatctcgacgagatgatatttggcaagaagggaggtagcagctcccaggatgggccgaaaaagccagatccgaagaaggatgacctgatcagcttttaagtacctttccataattgcagccagtgcttgctattttctggtgctgtacccactcggtagattgaagattcgataggatttgaatcgattgtttattcgcacatacgattcatacctgcccctttcggtttgttcagttaagtcgctgcactttctcaatcttgtttcatgaatgagtcccagtgaccatgaatgtattggatggtggattatgccttgacggggggaaaatgtccagtgtcactgaatctctgttcttcactacagtaaaccattgttaagctcaaa

SEQ ID NO: 12620 - DNA, 1443 bp, Sorghum bicolor
  Clone ID: SORBI-28MAY03-CLUS49034_1
gcacgaggctctcacggtctctccttcggtccttcccatgtcgactccacgtgggtggcccccgttcttctctcccaggcaaatccccgacgacgcggccgtgcccttctcctcccgccacatctctgccatgcgaacccccctccttcttcccccacccggctccccccgccggggccctgccctggcccccccgcctcatccttgccacccagatccccgccgtccccgccgccccctcctacccgcgccccgcccgcgccgcgggccccgcccccaccccggccgccccccccttgacgactggcccccgacctcctgctaccccgcctactccccgtttgcccccgatgcagtgctaccctaactactcctcgttgcgctgctctgcggcgacgccgacgcatccgggccttcccctaggtttcctcgccatgcacctcggtccccaggtactggccgcccggcctcctacaactccccatcccagagggagcacctcctccggccccccccccactttctctgcccacgcatactccgatgcagagcctcccatccccctgctacccaattttttacctctgactttgctactgtcagaacctctcagccggatctcgtcaactcaagtgcgtgggttcatggatgttctgcctgttgcggccctcacagcacagggatgtgatgtccttctgggatattgtgctggtctccctactggttggggcccagcccattcctgggcctgttgttccatgtggctgttgtggacatgctagttcttgctggattgcttgtgtcgttgtttgacgagtggctgcttggacaatactttgataaataaacaaaggtatgtgctataatttattatttggcacatctaatcgatatagtatacaatcttcatatctattatttgtatataggtaaacatagtccaatgcagaaactatcatgacactccaaaacaattctgtcccatgattttgcttcaagtaaggttgaaattaattcttatagcattatatgatgtgattatcttgctgtgtggaactctgaaactatgcattggtgccaaaagtgttggttgtttacttgttatctgttttcagaattttggactagcatatgtattgaatttgttaactagtttcaaagcttcctaataaatagatgacatttctttttagaatctttgctagcaaatctgacttatatttgttttgattttcaggtagcacatcttatggacagcaagtgaattgaagtgctcgtgaatactaatgtttagttgtttagactccctagatatcaaatcttttagttcaaacttagatattgtgatagtcactctaatggttgtgagctaggccaatctgtggcttgatgttcaatgtggctgttgtggacatgctagtacatgaatgaattatggttggg

SEQ ID NO: 12621 - DNA, 747 bp, Sorghum bicolor
  Clone ID: SORBI-28MAY03-CLUS38742_1
atcaaagaaagcatgttggagggaagtagaacccgtaaaggactatcttatgctgagagccatgaaaccaagattcatgattctgcatgttctcaagaaagaaatccaaaagatgaaagtgatgggcacaaagatttggaccaacagaagaataacaccaccaagaaagacaaacctgctgctgaaccaatagttgttccaattgtactgaggatgtctgattttgatcacaaagcattgttagaggaatggatagccactagagctttcagagataattgcattcctcaggatcaccggaaacttataaataaccttaagcttattcaggactacctttgttcttttgagtcacagggattgaccattgttgacatctcagcaaattcgtttcctcaaacattagattggcttcacagctatcttcttcagtgcatcgagcgaggtcttttggctgcgtgttcagaaagctgcaatcaagggggaaattaatcgacatgacactatgggattgtcctagagagagataggttattgttatggatgaggcattttgttcaatgtaacctggttgatataatctgttgtactttaatctgttgtactggcaaagtcgcagtgagtgatattacatacgatccacagtgctgactattattcatgcaaacagaagcattctgcctggctgctaagcctgtttgcttgaactttgctgccgaatcaccatttaaagtatttttctctccc

SEQ ID NO: 12622 - DNA, 708 bp, Sorghum bicolor
  Clone ID: SORBI-28MAY03-CLUS38904_1
aaaggtgcttcttgtggcttgggggtttccgttcgtctgagcttctaaagctccttgtgaatcagcttgagcctctaactgagcagcaattgatggggttatccaatctccagcaatcctcccagcaggctgaggatgcattgtcacaaggaatggaagcattgcagcagtccttggcagaaacgctggctgggtcccttggtccatcaggatcttctggaaacgtggcaaactatatgggtcaaatggctatggccatgggaaaacttggcacactcgagaatttccttcgtcaggctgacaatctacgacagcagaccttgcatcagatgcaacgcatcctgacaatccgacaagccgctcgtgcgcttcttgcaatccatgactacttttcacgtttgcgtgccctgagttctctttggcttgctaggccacgagagtaacatcacccacgttggggtcacgccatggactgatgatctgtgaatgtgggactgctggctgcaaactcgcaaggcatttgcagatgactgaagagtcagccctctctgtacaagttgtattaacatcttctggtctcatattgtgcttcagtgttgtacaagttagggtaaagcttggattaacttgtaagttatcatgaatttatgattgacatattgtataattgtattggcaataaaaatagaagtacataagtgcgggggg

SEQ ID NO: 12623 - DNA, 979 bp, Sorghum bicolor
  Clone ID: SORBI-28MAY03-CLUS39441_1
acagagagagagcgcgggagtctcctgacgacaccgggcgggcgggcacacgagcgcgagcgggcacgcacgagttcgcgactcgcgagtccctcccctcctcctccaccccccgcgtgctgcgcgtcgttggaaccaaggattggattagcctcgccgaggcggaggagggaggagctggtggtggttggcgaggggcttgcagggatggggatctcgagacccctcgcggcgctggtgctggcgctgctgatcgccgtcgctggcgcgaccgccgaggagccggtggtggaggcggactcgttggccggcgcggtggaggcggcggcggcgctcaggacggaggaggctgcggaggccgcggcgctcagggccgagctggggcaactccaggcgaagatctccgccttagagtcagacatagcagagcgatcacaggtactgaagaataaggacgatgccatcgcgaacctggagaaagccattgagacgaagtcaaaaactattgcttctttacagggcgagattgcttccctccaggcaaaggggtctgtagctgctgaggaggaggctagtaaggccaatgcccgggctattgagcttgagaagcagatcgacaagctcaaaaaggatattgaagcacaaaatagccagaaagcagcactagaatctagggccaacaatgcagagaagaaggtggaagagttgaatgaaaagcttaatgcaatccaaaaggaaagtgatgagcgaaaacgcaaaatcaagaagaccgaacgtgctcttaaagtcgccgaggaggaattaatgaggttgcagttagaagcaactgctaaggcaaaacagctgacagaggttcatggagcatggttgccaccttggttagcggcacagtatgctcactatgtggaggttgtctcaggctactggaatcaacatgggagacctgctgtgcataatgttttgcataaggcatcagaaa

SEQ ID NO: 12624 - DNA, 364 bp, Sorghum bicolor
  Clone ID: SORBI-28MAY03-CLUS3882_2
cgccggccccgtcgcggccaccgagtggtcctccggcctctgcgcctgcttcgacgactgcggcctctgctgcctgacgtgctggtgcccgtgcatcacgttcggtcggatcgcggagatcgtggaccgcggcgcgacgtcgtgcggcgccgcgggcgccatctacacggtgctggcctgcttcacggggtgccagtggatctactcctgcacgtaccgctccaagatgcgcgcgcagctcggcctccccgacgtcggctgctgcgactgctgcgtccacttctgctgcgagccctgcgcgctctgccagcagtacagggagctcaaggcccgcggcttccaccccgacctcggctgggacgtc

SEQ ID NO: 12625 - DNA, 1067 bp, Sorghum bicolor
  Clone ID: SORBI-28MAY03-CLUS3882_1
ccggggttcccggcaaggcgagagaacgcgtacgtacgatcgacaccaagaaacccaaggcacgtaccacaacgacagcctgctctgctcctctgtgccattcgccggccggctccgctcctccccgccgccgtcagaatgtatccggccaagcccaccgccgccgcagccagcgcgcctgtggtcgggacgccggcgtccccatcccccggccccgtcgcggccaccgagtggtcctccggcctctgcgcctgcttcgacgactgcggcctctgtaaagcattctgtcttctctgatcctccatcccaccccgcgagttgccgtttgcatgcatgcaatgcaacactgcctgacgtgctggtgcccgtgcatcacgttcggtcggatcgcggagatcgcggaccgcggcgcgacgtcgtgcggcgccgcgggcgccatctacacggtgctggcctgcttcacggggtgccagtggatctactcctgcacgtaccgctccaagatgcgcgcgcagctcggcctccccgacgtcggctgctgcgactgctgcgtccacttctgctgcgagccctgcgcgctctgccagcagtacagggagctcaaggccgcggcttccaccccgacctcggctgggacgtcaacgcccagaaggcggcggccaacgccgctgccggcatgtacccgccggcagcgcaggggatgggccgctaaaagccagccagctgcctcatcgcgcgacgatccgcgcccggcccagctccatcggtaaaaaaaaaaactctgtcgtacgtctcagtcaatatcatcgcgtacgtacgtgtattgtatgatatgatgacgtgtattcatgactggtacacaaagaatgcctatgtgtgtttcaagatttgtacgggctgggctgtacgtttatttttttttggtccactcaatatatccggcgaaaatatttttccttgaatctgtttttctttttctttttccctttcttcttactcggtacttcttagcaccgagtaccatgcatggaagttcataagctaaatatatgtgtgtttggtttact

SEQ ID NO: 12626 - DNA, 1396 bp, Sorghum bicolor
  Clone ID: SORBI-28MAY03-CLUS3961_1
ctcgtccccagcggcggtcggcaaaccctagaaccttagactcatcggccatactgcggttactgggcgcgggttagggcccggcctccgtctccgctcgcggcgatgccgctgttcatctccgacgaggagctccggctcctcggcggcgacacggccgccgttgccgagcgggccgacgccgccatccgtgagctccggcgccaggtggataccgtacgcgccgaggcggacgccgctgcgatcgctgccgagcagacctgcgccctcctcgagcaacggtacgcctccctctccgccgagttcgatcgctcccaggccgaggccgccgagctcaccgcggctgctgagcgccgcgctgccgagcttgcctcctctcaggcggagatacatcagcttcggcacgaggcaaaggccaggatgctgatgttaatattgacacaaatgcaattaccatagaagatgagcatgtggtggcaaagtcagaggcagtaattgaatcatttgacgatgaccagaaaacagaagattcaaaggaagatgctcagcttactactgcaactgatgttgacgatgacatggaggagggagagttgccagaggaacctgaagaaaagagtgatgttgatatgtcagagattgagggtgaaactacagctgagcgtgctgcagtggaaccagaccaaagtcctataacacaatctggtgtagctgatgcctcaccaagcagaaatgcagatgcatctcctgcacgtgaaccttcccctaatccagtccaagctggtgcaacttctcgaccccagaatactagcactacaacagaggcacgtgaaccttcaactaatccagcccaagcaggagcttctgaacagcggaacaccagaacaatcaactttgagcgcgccgggcaaaataggcaagccaggtttcaacgtccacagcaacctgctgctggtgcacaacaacctgtcgctgctcggggtcgtgggcaatctgttacactcaggaaagatgccgcgggtcgaggatcaaggggccgtgggggacgtggtcagtcctagggaagtagattgtcttttctcgtgcagggataaatttgcccagggggatatagagacccccttgtgtttttagacctacgaattttgtgtcccattggctcttacgaaatgtgccctgagcccctgacctgtattccttgtgggttctgcgccagctacttgtagtccaaactgtagtatttgtaaaggatcttaccacagcctgtatggctgtaacttggggcactgggcggggcatgtgatgctgatttgagaactgttttattcagggtgtaagaaacatagaccctagcaagttattttggaggttgattaacaatataactactagtatt

SEQ ID NO: 12627 - DNA, 1411 bp, Sorghum bicolor
  Clone ID: SORBI-28MAY03-CLUS40874_1
tctctactcctcttcccccgcacgaggcaattcattcgcacccaaaaaaatcgagccgatcgaaaaaaccctaaccgctgcgatcgaatcgaatcatccaggggccgcagcagagcccgacgaggccatgtctccggcaaccgccgccatcccctcccaagatcgcttcccctggtgatacgtacgactcgtgccgctcatttctttgccttgggatatagtatatgagggccgctgcgaccgatccgccggcgaggtcgatgctgaagcggctgttcgatcgccagctcctgcggatctcgccagcggatcgtctaccgtcggcggatgccggggagaaggatgacgcggagccgagctccgtgtgcctggacggcatggtgcgcagcttcatggaggacggcgtcggcggcggcgacaaggccgggcacggcggccggtactgcaactgcttccacggaggcgataattcggatgacgaggaggacgacgaagcggcggcggcctcggacgtcgccgagacgatcaagggcctcgtccactgcgctacgcttcgggagcgcaacctcctcgccgacgtgtgcgcgcacctggagcggccccccgccgcgggggcgcgccggcgcgacctgctccgcctggtggcctcgtcgctccgcgccgcggggcacgacgccgccgtctgcgtctcccgctgggacaagtccccgtcgcacccggcgggtgagcacgcgtacatcgacgtgctcctcccggcggcgtccgaccgcggcgcgtgcgagcgcgtcctggtggacgcggacttccggtcggcgttcgaggtggcgcgccccaccaaggcgtaccgcgccctgctgcagcgcctgccgcccgtgttcgtgggcaaggacgacaggctccgcctcctcgtcgccgcggccgccgccgccgcccgcgccagcctcaggaagcgcggactccacctcccgccctggcgtaagcccgagtacatgcgcgccaagtggctctccccctacgaacgcgaggctccgccggccgacgccgccgcgggcgaggagaaggacgacggggagggacccggaaccggaaccggaaccgccgcgtgacgacagggctctcttgccatttttgtcttggaggagggtctagctgcaaaagctagaaatctcgtcaaaatttaacttttaattttggtggggtggtacgtaatttggactgccatgtgatgagtgaggttattagtgcagcgcgaaatgaaggcgagaggtatgtagtgtagtgctagttttttttaggaagagaagtagtaaaagaaaatatcggattagcgtccacttttggtaatgatgtttgtttgtgtagtgataaaacttgcgaagatgtgatttgattattattattattattatta

SEQ ID NO: 12628 - DNA, 1277 bp, Sorghum bicolor
  Clone ID: SORBI-28MAY03-CLUS5070_1
gcacctccggcgagcgaagtgcaggtgaggccatggcggacaagccgagccgcgcgctggtcctctacgccgccggccacgccacggtgctcactcccccggcgggctccgcagccgcggggagccacctcgacgcgttcgcctcccgcgcctcctgcggccttctcaccctccgctccccgccggcttcccatcccacgaccggcgcggaggataatagcagcacgattctggagctggcgcagttgctcgacgtttatgatcatctctaccccggaaagaatgcggatagtggtcaagaagttgcccaagtggatccacaggagctagtggttcccaagctgtctgagaggtttatgggcctgagagctgccttggtcaccagttgtccccgcgtcagctcctttgcggcgaatcttggtttccaagtttttcagaccaatgatttcgcccctcaatctggctcatccggcgttactaaagaggttggattaatcaaccgagcatttgatctgcttggattctcggatggaaatgtgcaggaaacatctgagttcgatctagttttcatgcatgttgccatggagaacacaagcagcaagttaggaaaattaggaatgaagacagatctcaatcggctggagaaattagttggtgcagtcatggaatctgcgcctgttggttcagctattgcttcacgtattcatgtatctgtcattttgagctatgggtctgcttctggaaataaggatgagttttccctattaacctcttcgaccgaagcagattcagacttgaatctactgcgcccacgccagagctacacaatgaaagcaggacatacattagatgatgtcagacttcatcatccaattctactggcacagtggcaggaaggagttacacgtgttgatttggctaaagggttttcttttgaggagtttataaagcatggtggaaaccttgctatgcttgctgagcgctttctacatgaggtggcatttaagctctggaaagcacccaaatatggggcttgagggtgtccagcattggctaggcgtcggataaataaacatccagatgcgtttccattttggaaatgaaaatgacgaataatgcaagacatgtgagttttcatatgaagtgtaccatggaccggcccctaattcgataaactgttggagattgttactgatccaaccaatggaaatctgtagcgaaacaatatgaggttttcttatgaatagagtttcccagggtctttgtgcagtgatccc

SEQ ID NO: 12629 - DNA, 716 bp, Sorghum bicolor
  Clone ID: SORBI-28MAY03-CLUS51257_1
atcgttggggggggggctgtttcccgtcgggggtttgagtgtcaaaaagatcaaattagccaataggcgaaccccgggtgttggacgtcgatgcgggcttccttccggctggcccctccgctcgggttggtccaaatatgaacccagatgaggaactccggaagctcaaggaccgctttgcgacatggaaaaaggactacaaatctcggttgaaggagacgaaggtaaaccttaataaggttggcacccatgacgagaaatctcggaaaagatggtggggaaagaagagctcgaagtgaaacgtgtaagaaaatcaccattacatttttccaccactgggtcaaggaaagtgaccaagaatgccagggcaggcgcaaagaaccagcctcggttctctcatcgcagaagcccggcccggcgagatgatgacctccatcgttggtggcggtgctgttacccgtcgggtgtttgagtgtcaaaaagatcaaattagccaataggtgaagccagagttctgtacatgtatattaaattagatccgagttgtcacttgacagtgtatgtatgtcatcatgtatgtagagtgataaatctgacgtgtggaagggtaactaaatacagattatccaccatgagcgcatagagatgcgaaagcagagtattgtaagatgtgtacagttagaaaattgttgaaatgtgcaaggcattttactctg

SEQ ID NO: 12630 - DNA, 1901 bp, Sorghum bicolor
  Clone ID: SORBI-28MAY03-CLUS50803_1
tatcatattttggtttcgttagtgatggtaaatattcaacacgtcagacttcttacctgtcttggttctctaaaattagcctttgagctagccttaggtcacacgagggcattatggcacaactgtatcatattttggtttcgttagtgatgttcttgagctctcagagaaatttcagaagcattttggtcctttacgatactttgtagctggttttctcaaattcctgtgtttgccaaagtacagttttgaattggaatatcttccagtgtcagatgtcaatgacgctgagcatacaattttggtaggacaagaaaaggtcgatgcatctgatctatatgatgatgttgttcggagatcaagagcagaatgtttaccacgcgcctcaagtttatctagcattgattcaataatgtctacaggcatgtctggggcagagctggaggtttgtagtcctcgtgcaaataatgaaccttctgaggttgttcgtgcacttgacccgaaatcaaagcgcttatcattagggagagcgagtacatttaaagaaccagaagaagtgcttcatccccactcccatggtacatctactcccaactggcgtagatctaagtcaaaatcaaggactgaaaaggcaaggccaggcttgtctgctacaaatgatgcaaaatcctctaaggttaacacagacaaagaggacacgtcgtccacaatttctgatcctggacctgtggctgtatgggattcaggaccaaagtgggacgatgaacctaaatgggacaatcaacctaactgggaacctgagacttcaattgagctccatagtcctcgtgaggacattgagcttggtctgactaaggagctggtacctagcttagatgaaagatggacagttaggaaagggcgctatcttggtgtactggtgtgcaaccattcatgcaagactgtgcagagtctgagctctcaggttgttgctcccaaggctgaatatgatgacaattgtttggacctgctgttagttggtggaagtggaagactgagattactgagatttttggtgcttttgcagtttggagcgcgcggatctcttccaaatttagaatatgtaaaggtgaagtctgtgaggctcaaggcaggcccaaatacacatgatggatgtggtattgatggcgaactactccatgtcaaggggcaagttcgctgtagtttgttgcctcaacaatgccaattgatgggcaggccagtgaaaaaccttgtacaatagctgtaaatacactactctgcggactgtctgcagctctgaggtcagcccataatcttgcacctgtacaagcggcgaaccatggaattttgtccgcatccacatataagtaaatatattcagaagtcagaacagcttagctgacactcaaactccagagatgtacatttgtggttaatgagcagaaggtgctgggtgggtgctatttatccagatgtaaagccaaagcctgtcacagactgcagcttgttgcgcacctcttgcttttgcctttttctcgtctgatagtatacgtctactatacaaccatccagagtgtacttgctccagaacatagtgtccacctccacccccgggtgtgtttggaggtccctgatgccggccacttgataatactcattacccctattatagggacaacataccagtgccgtgtccttgatctgtttgttgtgtttgcaaagtgtgaataagactatagaactgttgcattcccggtacagcgtagggtttcagcagaaagggttggacgatattttgtggcgatgctgcctcttttttcacgagtgtaattcttgttctttgtgatttgtgaattgtgatgatgtatgagctgtgtactaatttgtaaaccttgcctgcc

SEQ ID NO: 12631 - DNA, 1378 bp, Sorghum bicolor
  Clone ID: SORBI-28MAY03-CLUS52737_1
tatgcgcccccctctaggggttgccggtccccggttcgatccggaccacttatttattgctgccgcaggctctcctggagctgtcgccactctgtcagcgcctgcgcctgctatgccgccatccacgtttggggcccttcttccctccgatgacctcgtgcctgaccagactagccgcttaatgcttgagtgagctgagcaaagtgaataattggcaagtagttgaggatgcaaacgacaagcaatgccatttttgaagtgcgacatcgtcgtgccagccttgctttgaagactcaaagaaaaagtcagtccggcggttcgacagctcactatagctaatagcaagtcaatccggcggtccaaagcgtcaaatgatcgaaaccgaagatagaaggtatatttttaagcacttgttctgccagccagcagctctcataataaatcagtgtacagtacttccagtcatggtttttcggcacaagcgaacagacttacatgttgttctagcttgcttgatccgactttcatccgctttgctttggcccaggggacgcgccgccgtcttggtgatcgtgaagcgggatcggcgtatggcctccggggagatgggaatctgcatttgaacattgtatcaagcaaatatgacgacattactcttggacgaattgaaccatttgtctataaatggacttcagcacaaagaggaagcatcagtgcagagcatggtttggggctaatgaaagctgagaagattcactacagtaaatcacctgaagcagtgcaactaatggcctcgatcaagaagttgctggaccccaattcgatcctgaacccctacaaggttctgccgcagtctgtactgtagctgaaggtactctgttatcggcagtatgtaatataccgtaaaggttagggacccctttaactcactgatgagcttgtgcctgaccagactagccgcttgatgcttgagtgagctgagcaaagtgaataattggcaagtagttgaggatgcaaacgacaagcaatgccatttttgaagtgcgacatggtcgtgccagccttgctttcaagactcaaagaaaaagtcaatccggcggttcgacagctgactatagctaatagcaagtcaatccggcggtccaaaacgtcaaatgattgaaaccgaagatagaaggtctatttttaagcacttgttctgccagccagcagtgtacaatactttcagccatggtttttcagataagtgaacagactttgttgtttcagcttgcttgagacgactttcatcagtttttctttgtcccagtggacaactggcgaaatggattaacataaattaaacagctagcaacaataccctttttttttggagcaa

SEQ ID NO: 12632 - DNA, 660 bp, Sorghum bicolor
  Clone ID: SORBI-28MAY03-CLUS5669_1
ggctatactcactccactccccagctagctccgatccctcgacatggcggccaccactactaccatccttctcctcctggtcgccgccaccgccgcctcggcggccgacctctccgtgtaccacaacgtgcacccgccgtccccgtccccgctcgagtccatcatcgcgctcgcccgcgccgacgacgcgcggctcctcttcctctcatccaaggcggcgtcgtcgtccggcggcgtcacctccgctcccgtcgcctccgggcagaccccgccctcgtacgtcgtccgcgcggggctgggcaccccggtgcagcagctcctcctggcgctcgacaccagcgccgacgccacctggtcgcactgcgccccgtgcgacacgtgccccgccggcagccgcttcatccctgccagctcctcctcgtacgcctccctcccgtgcgcctccgactggtgcccgctcttcgacggccagccgtgcccggcgagccaggacgcgtcggcgccgctgccgacgtgcgccttctccaagccgttcgcggacaccgcgttccaggcgtcgctgggcagcgacacgctgcggctgggcaaggacgccatcgccagctacgcgttcgggtgcgtgggcgcggtgaccgggccgacgacgaacctgccgaagca

SEQ ID NO: 12633 - DNA, 678 bp, Sorghum bicolor
  Clone ID: SORBI-28MAY03-CLUS4290_1
tcgattcctcgccgctctctctctctcccctccgctcttatccccgctgcgcctcctgactttcctcttcgtcgtctcctactcttctcccacccgcaaccgccgcagagagagagagaaaggggaagaagctttccccagcgcagcagcagccgccgccgccgccgccgccgccgcagcggatcgggacctctgctctgcggaatccatccatggcggaggaatcaggccgccccttgccaaagtttggtgaatgggatgtcaatgatccagcttctgcagacggatttactgtcatattcaacaaagcaagagatgagaagaagggtgggaatggacaagacactgattcaccttccaaggacaccaggactgagagggtggaatcttatgctgcaaaaccaagcacgaagaaatggttttgttgtgtgacagccagccctacgcaatcctgaggaagacaagtgcatgcgctttggaaatactgtccctttaattttctatacatactatccataagacaatgtagaggtacccatgcctctcgggctccaggatgggtatctcgtaaactctggcgtgcgtgtatgtatggtgtgagagttgtcggcatacatttgaaaagtggactttctggttgtaattctagtcctgtctcttttttcaaaaaaaaaaaaa

SEQ ID NO: 12634 - DNA, 1420 bp, Sorghum bicolor
  Clone ID: SORBI-28MAY03-CLUS45167_1
ccctctctatctccccctctctctttctttcccagctctctctctctccctctccacccggccgccaccatgtcaggcctgtacagccagggcttctcccctgcaagaaccctctccccccagattaggagcaaccccgacgctgacagccagtacttggccgagcttctcgcggagcatcagaagctggggcccttcatgcaggtgctgcccatatgcagccggttgctcaaccaagaaatcatgcgggtatcaagcatggttcatgaccatggatttagtgatcttgacaggcgccggtttagaagccctagtcctatgtcttcaccaattgttcggcctaatctacatggcaatggatttggtccttggaatgggatgcaccaagagagattgggccttcctcctcctggaacaagtatggattggcaaggagcaccaccaagtcctggctcttatattgtcaagaagatcgtacgcttggaagttcctgtcgactcttaccctaatttcaactttgtggggcgcattctaggcccaaggggtaattctctaaagcgagtcgaagcatcaactggctgccgtgtttttattagaggaaagggttccatcaaagacacagaaaaggaggagaagcttaaaggaaaacctggctatgaacatctgaatgagccactgcatatattgatcgaggctgagttaccagcaaatgtcattgatacaagactgagacaggcacaagaagttatggaagaattgctaaagccggtggaagagtcacaagatttctacaagaggcaacagctgagggaattggctatgctaaactcaactctgagagaagatagccctcatcctggaagtgtctcccctttcagtaacggtggcatgaaacgcgcgaaaccaagccagtagagaagcttttggctctctgctcttcagtcgttcatggtgcagcaccagcaaggtgcccttgaacttgcgctgtccgtgtcgtgggtgcttgtgtaagaaaaggtatgcatttgctgctggacaggtagtctggtgccaagtgtgtcgtctccttgagatgaggagaaatcgatggctgttgaactgtctcgatctttggtggatccagccatgctgttgtaacttgtaaggtgatgaacattcgttttattcgttattgactgttaaccctaagtagatcatgatgctgaggataggtggtttcaggggagactagttatgcctgatagtgtgagctggttcgtttaggtgtttaattagcttgtattattcacattacattgtggagttgcaacatcacagatgatgacgcactctgctctctatgatagtttgatgacaactttgaatgaaccatgtgaattcagaatgttagtacttagtgaatcgatggggtgtttatata

SEQ ID NO: 12635 - DNA, 1279 bp, Sorghum bicolor
  Clone ID: SORBI-28MAY03-CLUS43733_1
gcacgaggctccattattccacgcttgaaagcattctcggattggattcttaaagcaatggctttaggtaatcttgaagacatctttcctgccgcaagccgtgaatatgcaccacttgttgaagaactgtggaaagatcctgctattcaagctacatatagaagaagaactgaactgccattccttccacctgctgccaattattttcttgacaaggctgttgatatatctcgaccggaatatgagctctcagatatagatatactgtatgctgacgggattacatcctcagatgggttagcatcaactgaattctctttccctcagctgtctttgggtggactgggtgttgatgagcctgatgcacaagacaccttgctaaggtaccagttgatcaggataaacagtagaggtctgcatgagaactgtaaatggttgcaaatgttcgatgatgtaaggcttgttatcttctgtgttgccgctagcgactatgatgaatactacgaagatgcaaatggtaccattgtcaacaagatggtagagagcaggcggctgtttgagagcattgtccttcatccaacattcgagcaaatggatttccttctactcctcaccaagtttgatctcctggatcagaagatcaacaattccccactgacctcatgtgactggttcgatgacttcactcctctgatcagccgcaaccttctcagcggcggcagcagcaagcccacgcgcagcagcaccggcgcgacgctgtcccagatggccgcacactacatggcgacgaagttcaagaggctgttccagtcgctgacggaccggaagctctacgtgtcctatgtgaacgccctggatcaggagtcagtccggtcagcgatccgctacgggagggagatcgtcaagtgggaggaagagaagcctgtgttcggtgccagcgagacggtctacagcgaggagccaagctccttcactcactgacttgacaccccgcctttgtcttgtgcagaagagatgtaaatatttttgtgcatttcctccccagcaccttttcttagagttgtgctaccccccattccttttgttcgtagctgatcatcggcttgtatggctgtttagttattcgcaagtagaatgttgaggcgctagaagacctgggccgttctgattcgtgtaaattgtattatgagttgattgcatttgatgcattaggctggtgcaaaagtcccagatcatcggcttgtatggttgttacttgtggtaaattgtctggttcgtt

SEQ ID NO: 12636 - DNA, 1485 bp, Sorghum bicolor
  Clone ID: SORBI-28MAY03-CLUS46704_1
gcacgaggctcacaagctacccagctagctagctgcgcgccggccggcggtgctctcatctctatccatcatattcatagggtagccggtacagtggtaggctagcagggacgacgatgagcgccggcaccagagctgatgaggtcgtcgtccaagtacggcagctcgtcgtcgtagtggctgtcgccgtgatggcgacatcatgcttctcctcctcggaggcgcagctccagggcgcgtgctacaacgccacctgccccgccgccgagagcctcatcgagaccatcgtccacgccgccgtccgtaaggacgccggcaacggccccggcctcatccgcctcttcttccacgactgcttcgtcaggggatgcgacgcgtcggtgctgctagacgacccgacgggcacgccagggaacaggacggtggagaagacgtcgcaaccaaacttccccagcctccgtgggttcagcgtcatcaaccgggcgaaacgcgtggtggagcggcggtgcccggggacagtctcgtgcgccgacatcgtcgccttcgcggcgcgcgacgccgcccggatcatgggcgggatccgcttcgccatgccttccggccgcctcgacgggcgcgtctccaacgcgtccgaggcgacggccaaccttccgccggcgtcgttcaacctgacgcagctcctggcccggttcgcgtccaagaacctcaccgccgacgacctcgtcacgctgtcgggcgcccactccatcggccgctcccactgctcctccttcgccaacacgcggctgtacccgcagctggacgccacgctgaacgtcacgctggcggcgaggctcagggccaagtgccccgccgctcccggcgggaaagaccgcgtcgtcgacctcgatttcaggacgccgctgcagctggacaaccagtactacagcaacgtggcgacgcatgaggtggtgttcgggtcggaccaggcgctcggcgaccggaacgacacggcggcgctcgtcgcgctgtatgctgccaaccgtaagatatggtcgcagaagttcgcggcggccatggtgaagatgggtagcatcgaggtgctcaccggcccccccggcgaggtcaggctcaagtgcaacaaggtcaactgatcagaccgaccggattcaggttcagtttcagcaagcatgcagagggaatcgagcgtcgcgtcagaggactctcgatcgatcaggaattgtgatgaattttcaagacagctcaagtcatcagtcagaggcgccatccatccagtccatccagtctgcattattattcattcattcatgtgtgtacttaactgtacatgacatacatgatcatcactccctgcacttcgccttgtacttatttttagtagttatcagtttatcactgtacttaccaattgcatgcgcgcatgactgtaaactgtaacataagaggaaaaaaaagagatggtacagttacattattgggcatagt

SEQ ID NO: 12637 - DNA, 644 bp, Sorghum bicolor
  Clone ID: SORBI-28MAY03-CLUS45912_1
gcacgaggccctcgcaggcgccacccgcattcctctccacgctgccagcgcctccgagtgagtccgtagagggaggaggaggccgccagttgccactgccgcgccgctcccgcctccctctctctctctctctctccctccatccgccgaactcgacgccaccatgatctccgcgcgcaccgccgcgtccccggcctcccccgcctccgcgtggaagcggggaggaggacgaagcgaggtcggcggcggcagcagctgcgacggatgccggacctacaggaacaccttgcggaggagcgccgcggcggcgaaggtgcgcgccgtgccgccgaggcgggtggaggcggtcgcgatgggctccgccgcggagacggagaaggagaaggaggagcagcaggaggtggtggccggggccggcggcctcgtcgaggaccactacgacgaggacagtgccgccgaggaggtgccaatcatgccctgggccttctccgtcgcgagcggttacactctcttgagggatccccatcacaacaagggtcttgctttcacggagaaggagagggatgcacaccacttgcgtgggctgcttcctcctgcagttgtgcctcagcaactccaagttaagaagatcatgcacaacctgc

SEQ ID NO: 12638 - DNA, 1868 bp, Sorghum bicolor
  Clone ID: SORBI-28MAY03-CLUS4710_1
gcacgagggtggagctgctgtatctgccgcaaaggcagttggttactacaatgctggaacagtggagtttattgtggatactctttctggagagttttatttcatggagatgaatactcgactccaggttgaacacccagtgacagagatgattgttggtcaagatcttgtggagtggcaaatacgtgttgcaaatggagaacgactgccattatctcaggagcagattccattaaatggacatgcatttgaagcacggatatatgctgaaaatgttccaagagggtttctccctgcaacaggaaccttacatcactaccgaccagtcccttctgatccaacagtaagagttgaaactggagtcgaagaaggagatacagtcagcatgcatgctcgtccaatgatagccaaacttgtagtatggggtgaaagtcgcactgctgcactagtcaagctaaagaactgtttatcaaactttcagattgcaggtttgccaaccaatattggtttcctccaagaactcgcaagccatagtgcctttgaaaaaggcctagttgacactcacttcattgaacgttataaagatgatcttttgagtatttctacgaagtcctcagaagaatctcatggtgtagctgtgcttggtgcaattttggctgctgcatgcatttgcaagaaggatcacattacatttaaagaatcacaacgagccaacaacacactatctgtatggtacaataatccacctttcaggatgcatcactttgctaggcatcccctggatcttgagttggaagagaatgatggattcagtgagaaacttcttaaactgtgcacgacgcataaatctgatggaagctacttcatcgagacagaagatggcacttctggtttagatgtcaaagttgatcacaagggtgaccatgattttcgtgtcgatgtttctggtctgcaaactgatgtgactctagcatcttattcgaagggcaacagcaaacatatacatgtctggcatgggaagcatcatcaccattacagacagactgtaagagctgagcatgcagttgatgatccctcccaaccttgtcatgcttctgaagggaagtcacatccaaaagggagtgttctggcaccaatggctggcttggttgtgaaagttttgcttgaagatggggcacaggtggaggcagggcagcctgtcatggttatggaagcaatgaagatggagcatgttgtcaaagcacctcgtgccggatatgtagatggcctgaaggttactgctggccaacaagtttttgactccagtgtccttttcacaatcaaggacaatattgcaaactgagatggagcgatcacatccgaagtaactgcactgcaactgtattcaaacactcaacggatgcttcaggggttggccaacgacgctgctgctgtccagatagagaaccgaaggaaataaacagctgggttcgtctgcgggcaatccggcaatgcaagcagacggctcatggtgttcccagcttgatgcgaattcatccatcattcgccacaacgattccattgcatagtgtacacgaacatgaaactgtaccacgttgagcaaagaaataagcagatggaatcagatttgtcatttgtgtacctttgctgaataagtgatgggaagctgggaaccttcactgtgaaggatcagtcacctgaacgaggcgctggtttgccatttgacgcaacaccaggtcgtcacacagcccctgcggcagccgtacaaacgtggccaaagaatatgatatgcgtgtatgtttgcacaccgtctgaacgctatacgatggtaaaccgtttgcgtttaatgggttattctgtctgttaaa

SEQ ID NO: 12639 - DNA, 1259 bp, Sorghum bicolor
  Clone ID: SORBI-28MAY03-CLUS5593_1
gaagaacctggaatcaggacgaacactacaattcttcttggcaatattgcaagctatatgaatgatgggaccaggaagagagtactgatcaatgcattcacagttcgtgcattacgggataccttccctccggccagagcagctggaatcatggcactgagtgtcactagttcatactatgaagtgacagagattgcaactcgcatccttcctaacattgttgtcctcacatttgacccagacagtgatgtccgaaccaaggcttttcaggctaccgatcagttcttgcaaatagcaaagcaacaccatgaaaagcttactacaggagacaacagggtggctgaaagtacgggtgttaagttaaagcctggaaatgcaggtttacttgggtgggccatgagttctgttacacaaaagggtaaaccttctgaccacgcccgaatatctactgcaaatgccagtaattctcaagcatcaacaacttcgactgccgctccagacactcaggcttccacactagcgtatgcaccatccacatccaactcccttgatcaagctgcaccagcatcagcaaggtcttcagtagatgggtggggtgagcttgatgatggtaatatccatgaggagaatagtagtgataaagatggatgggatgatgtagacccgtttgaggacaagccatccccatctcttctatccaacatacaggctgctcagaaacgtccagtggtacaaccaaagcaagccgttgcaaactcatctaaatccaacccactaaaggcgccaaaatcagaagacgatcctctatggggtcctatagctgctgcaccacccaaaagtgcagtaaaatctgcagacatcaagccatcaacatcacataatgatgaggatgacctctggggttcaatagcggcacctcctccaaaatcatctgggaagcctttgaagccagctgcagcgaatagtgacgacctatggggtgccattgcagcacctccaccagcaaccaaagccagacccttagcctcatcaggtaggggccgaggaacaaagccagcgcagccaaaacttggtgctcaaagaataggaagaacatcctcaactggaatgtgagggcttacgataccaagtgttgtacaagaatgcaaagttttcctttttgcccccctgagtctgtccgggaggtcattctttgtaaactagcaaaatgatttatatatatggacacggttttgccccaagtgtattagtattatttt

SEQ ID NO: 12640 - DNA, 720 bp, Sorghum bicolor
  Clone ID: SORBI-28MAY03-CLUS5588_1
accctctgcagttttcttgtgcaaacgcagaacatctcacgatttctactgttatcgtcgaacgccaaaaccctagttcccaatctccatctccggcacctccaacccctccctcaggctacccgtcccagcggcgccggcagacgccatggacagctccctcgcgagcgccgcggcgatcgccgaccagcgccagaagatcgagcagtaccgccacatcctcgcctccgtcctctcgtcttccccacctgacatctcccaggccaagcgattcctcgaccacatggtgtcggacgaagttccgctcgtggtgtcgcggcagttgctgcagacgttcgcgcaggacctggggaagctggagtccgacgcgcagaaggaggtcgcccactacgcgctcacgcagatccagccacgtgtggtctccttcgaggagcaggtggtagtgattagagagaagcttgcagagctatatgagtctgaacaacaatggtcaaaagcagcacaaatgcttagtgggattgacttggactcaggaatcaggatgcttgatgacaccaacaaattatccaagtgtgtccagattgcacgactctatttagaggatgacgatgcagtaaatgccgaggcttttatcaacaaggcttcatttttggtaaccaacagccaccaggaagttctaaacttacagtacaaggtctgttatgcaaggattttggatct

SEQ ID NO: 12641 - DNA, 1190 bp, Sorghum bicolor
  Clone ID: SORBI-28MAY03-CLUS56157_1
gcacgagggccagatgcagggctgcgccttcacgctcggcctcggcgagcccaacctcgccggcaagcccgtgctccagtacgaccgcgtcgtgcgcccgcacgagctgcacgcgctcaagcccaagccggcgccggagcccaagtctgggtaccgcaaccgggagcacgagacgctgttcaccatgtaccagatactcgagtcatggctgcgcgccgcgtcgcagctcctcacccgcctcaacgaacggatcgaagccaagagctgggaggcggcggccagcgactgctggatcctggagcgcgtgtggaagctgctcgccgacgtcgaggacctccacctgctcatggacccggacgacttcctgcggctcaagagccagctcgctgtacgggcggctccggggtctgacgcgtccttctgcttccggtccagggcgcttctgcacgtcgctaacaccactagggacctcaagaagcgtgtgccctgggtgcttggtgtcgaggtcgatcccaacggcggcccacgggtgcaggaggcggccatgaagctgtaccacagccgtaggcgcggcgagggtgaggatgcaggcaaggtggggctgctccaggccttccaggcagtggaggtggccgtgagaggattcttcttcgcgtaccggcagctggtggcggcggtgatgggcacggcggaggcgtcgggcaaccgggcgctgttcgtgccggcggaggggatggatccgctcgcccagatgttcctcgagccgccctactaccccagcctggacgccgccaagacgttcttggcggattactgggttcagcagatggcgggggcctctgctccgtcaagacaaagctagctgagacggcgaaatggcgcggctggatagcgaccaaatcgcgcagttttgggggcctgaagatacaatatatatgcatgcatcgtaatttcgttgtggccttgtggtgatagagtgattcatttctatagcgatcatgtaagcactagattctcttactatcactgcgcgctgcgttgtgttgtgttctacatatggagagattgattcagttagatgccatttgtaactataggcaagcatttcaattgggcaacgtgtatatatggaacttctgtaaatacgtgtagatggtttcatgtattcaactgactgtactttgtgatcg

SEQ ID NO: 12642 - DNA, 1050 bp, Sorghum bicolor
  Clone ID: SORBI-28MAY03-CLUS56339_1
gcacgtggcaccgtcgtcatccgccccggcccgagcctcaactgctccaggcagccaacccgccggtcctccctcctccctctctcgcctcgcgacgtgacaacgcgcgcgcgcatacgtccaagacgcgcacgccgcagggccaccacacaaccaatcgcatcgaccgaccgtctggtctggtgcgggcagggaagaatgggcctcctcgaccagctctgggacgagacggtggccggcccgcggccggactccggcctcggcaggctccgcaagtactcctccttctccccctcctcctcctcctcctcctcgtcgtccttcccgccggcccccgctcccgccgcggccacgtccgacgcgccggcgccggcggtgacgcgcagcatcaccatcgcccgcccgccgtcgctctccgtcgacgcctcgccgcgcgccgagtcctacagctcctccgtcccgtcctccccggccaccacgcccgactcgccgttcgccacagctaccacgcccaagacggacggctggaggaggttccgccggaaaaccaaggtctccgatgggccggagcccgccgtcggacctaggagccccaccgtgtacgactgggtggtgatcagttcgttggaccgctgagctagaacaaatccaatccaatccagcgccaataagcaaccgatagcagagggcatgcggtgcagaggaatctagatagcggtttctttctcgggtctatgaggcagcgtcgtgtgttctgtatacagtatgtttgtgttcttctgtattaggatggtgatgatgatgatcagttcgtggggggttagaagtgggcgccgatgtatcctagtttggcctagccgacaggcgtgttcttcattagttcttggatctggggaagaactctcgacatggcatgctcgcacggctgcctgctttgttttctacgtaccctcctcttcagtgtaattaccccaagtagtactatttttactgtagactactcctactactagtgtttgtgtgtgtgtgccatgcaaagcatgtggctct

SEQ ID NO: 12643 - DNA, 827 bp, Sorghum bicolor
  Clone ID: SORBI-28MAY03-CLUS4934_1
ctagctgagttgcttcttggtcagccactgtttccgggagagagcgccgttgatcagctggtagagattatcaaggttcttggtactccaacccgggaggagataagatgcatgaatcccaactatactgagttcaggtttcctcagataaaggctcacccgtggcacaagattttccacaagagaatgcctcctgaagccatagaccttgcttcccgtctccttcagtattcaccaagtcttcgctgctctgctcttgatgcatgtgctcatcccttctttgatgagctgcgggcgccgaatgcgcgcctaccaaatggccgtccattccctctgctctttaacttcaaacatgaactagcaaatgcatctccggacctcatcaacaggcttgtaccggagcacattagacggcagaacggtgtcaacttcgggcatgttgggagctaggagggcaggcgttgcgatggtcgagtttttggtcttggttccccatgtgcagggccgatgcaagcgaaggtgatattgcaccatctggagaggagagaggggctcagcagtaccagagagaagtgagtatgtaaattatctgaccgttaaggagtaccgccagtgttaagccagtaactggcacatgttggtccagtagttaagggtaagaatgtaggtggagactggttaatgcttagggttgtttttggttattaccattttgtaatgttcgttggtacttccccagcagtagtgtagctgctcctgttttgttcgtccgccatgatgtaaatgatcatcacccaactgcaatgtctgttctctctgatctttct

SEQ ID NO: 12644 - DNA, 1743 bp, Sorghum bicolor
  Clone ID: SORBI-28MAY03-CLUS4976_1
aacccccgtctggcgcctgctcttcactctccatattcccctgcttggctcccctccacactcgaggcatgcactgcaagctagctaggacactgtcctgaagcttctctccatccatctcagcttcgactcgtcctccatggatttccgcggcatcagatggaggaaggctctgccgatgtgcctagctcttgtggctctgcaagcatgcctccctgctcgcgcggcggctcccaagacttacatcgttcagatggccgcgtctgagatgccgagctcgttcgatttccaccacgaatggtacgcatccactgtgaaaaccgtgagctctgtgcagctggaaggaggtgcggacgacccttacgcgaggatcgtctacaactacgagacggcgttccacggcttcgcggcgaagctggacgaggacgaggccgagcggatggccgaggcggacggcgtggtgaccgtgctcccagagacggtcttgcggctgcacaccaccaggagcccggacttcctgggcatcagcccggagatcagcaacagcatatggtccgccgggctggccgaccacgacgtcgtcgtcggcgtgctcgacaccggcatctggcccgagagccccagctttagcgacaagggcctcggcccagtgccggccaagtggaagggcctgtgccagaccggccgcggcttcaccatagccaactgcaaccgcaagataatcggcgcgcgcatcttctacaacggctacgaggcctcgtcgggccccatcaacgagacggccgagctcaagtctccgcgggaccaggacggccacggcacgcacaccgcggccaccgccgcgggcgcgcccgtgccggacgccagcctcttcggctacgccagcggcgtcgcccgtggcatggcgccccgcgcccgcgtcgcggcgtacaaggtgtgctgggcggggggctgcttcagctccgacatcctggcggccgtcgaccgcgccgtggcggacggcgtcgacgtgctctccatctccctaggcggcggctcgtccccctacttccgcgacagcctggccatcgcgtcgttcggtgccatgcagatgggtgtgttcgtcgcctgctcaggcggcaacgccggcccggaccccattagcctcaccaaccagtcgccgtggataaccaccgtgggcgcgagcaccatggaccgggacttcccggccacggtgacgctcggcaacggcgcaaacatcaccggcgtttcactctacaaaggccggcgaaatctttcgtccaaggagcagtatccgttagtgtacatgggcggcaactcgagcatccctgaccccaggtccctgtgcctggaggggacactccagccccacgaggtcgctggaaagattgtgatttgcgaccgcggcattagtcctcgggtgcagaagggtcaggttgtcaagaacgccggtggcgtgggcatgatactcgccaacacaccggcaaacggcgaggagcttgtcgccgacagccacctcctgcctgcggtggccgtcggggagtctgaagccattgccgccaagaagtacagcaaaaccgccccgaaaccaaccgcgacgctcagcttcgacgggacgaagctcgggatccgcccatcgccagtcgtcgccgcgttctcgtcccggggaaccaacttcctgaccctggagatcctcaagccggacgtcatcgcgcccggcgtgaacatcttggcggcatggag

SEQ ID NO: 12645 - DNA, 1706 bp, Sorghum bicolor
  unsure (1)..(1706): unsure at all n locations
  Clone ID: SORBI-28MAY03-CLUS4964_1
gcccgtcgccgtccccgccagtcgcccccgctcccgcgtcccccacagccaccacccccacgcctcccccaccccatccccgtgtagatttcaaatccgcgtcaggccaggccaggccagggcagagctcaggtctcggtctcccccttcgccgccagttgccgcagctcccacaatccctcgagatccgccgccggggagaccgctgaccatggaggccatggaggagctgtcggagctcgccgagtcgatgcgccaggcggcgtcgctcctcgccgacgacgacccctccgacgacgccgcgccgcgccgccccaccaccttcctcaacgccgtcgccctcggcaacgtcggcgctggcaagtcggccgtgctgaacagcctcatcggccacccggtcctgccgacgggggagaacggggcgacgcgggcgccgatagtggttgaccttcagagggagccggggctcagcagcaaggccatcgtgctgcagatcgacagcaagtcgcagcaggtctccgcaagtgccctccggcattcactgcaggacaggctcagtaagggggcgtctggtggatcagggaggggccgtgctgatgagatttacctcaagctgcggacgagtacagctccctcattaaagctgattgatttacctgngatagatcagcgcggactcgtgggttccatgatcaaggagtatgctgggcacaatgatgcaatactgctcgttgtcatacccgcaatgcaagctgctgatgtcgcatcgtctcgagctctgaggttggccaaggatatcgattcagatgggacaagaactgttggtgttataagcaaagttgatcaagcggggggagatgcaaaaactatagcttgtgttcaggccctactgtcgaacaagggtccaaaaaaccttcctgacatcgagtgggttgctctaattggacaatctgttgcgcttgcgtcagcacaatcacctgggtctgaaaactcgctagaaacagcttgtcgagctgaagctgaaagcctgaaaaacatcttaactggagctccccagaataagcttggtagaactgctttggttgatacaattgctaagcaaatccgtaaaagaatgaaagtgcgggttcctaacctattgagtggccttcagggtaagtctcaaatggtgcaagatgaactggcaaggctgggtgaatctatggtacagagtcctgaaggaacccgggcagttgctttggagctgtgccgagaatttgaggacaagtttcttgctcacataacatctggtgagggatctggttggaaaattgttgcaagttttgaaggcaagtttccagacagaattaaacagctaccattggaccgacatttcgatctcaacaatgtcaaaaggattgtcttggaagccgatggttatcaaccatatttgatatctccagagaaagggttgagatccttaataaaaatagtactggaaatggcaaaggaaccatcacgactatgtgttgaagaggttcatcgtgtattgttggacatagtcaatgcttccgcaaatgccacaccaggacttggaaggtatcctccattcaagcgtgaggttgttgcaatagcatcaaatgcattggagaccttcaaaaatgatgcaaaaaagatggtcgtcgcacttgttgatatggaacgtgcctttgttcctccccacactt

SEQ ID NO: 12646 - DNA, 673 bp, Sorghum bicolor
  Clone ID: SORBI-28MAY03-CLUS5000_1
atcgagtcggccttgctggccggctccaagggaaagcgaaagagagcagagcttggcaatggagcttccatggggaatgctgctgctgctggtcctctccgtctcctcctcgtcctcctcctcggctgccgccacgctcgccgtcagtgctccgcccccagtgcctgcgcctcgtcatgctcaagacgctgaagggctgctcatcaacggcaactttgagacggcgccgaggaagctgaacaagacccttatcgtgggccgtcactcgctgcccggatggacggtgcagggtcacgtggagtacgtctcgggcgggccgcagccagggggcatgttcttcgcggtgccgcacggcgtgcacgcgctccgcctcggcagccgcgcgtccgcgtcgcagaacgtgacggtgcgtccgggcgcactatacgcgctgacgttcgcggcgacgcggacgtgcgcgcaggacgagtccctgcgcgtggccgtgtcgccgtcgctctcggcgcccgccgacgtcgccgtgcgcacgctctacagcggcgcgtccgccgacacctgggcctggggtttccgcgcctcctcccccgtcgcgcaggtcacgttcgccaatcccggcgtgcaggaggacgccgcgtgcggcccgctgctggacgccgtcgccatcaaggagctg

SEQ ID NO: 12647 - DNA, 789 bp, Sorghum bicolor
  Clone ID: SORBI-28MAY03-CLUS50232_1
gcacgaggattaacaggtccctctggcaaaataatgcttctaccggaggaggatccaaacgcaacccatatcatgattgctactggcaccggtgttgcccccttccgtgggtacctgcgtcgcatgttcatggaagatgttccaaactacagatttggtggcttggcctggctcttccttggtgttgccaattcagacagccttctgtatgacgaagaattcaccagctatcttaagcagtatccagacaatttcaggtacgacaaagccctcagtagggagcagaagaacaggagtggtggcaaaatgtacgtccaggacaagatcgaggagtacagcgatgagattttcaagcttctggatggcggagcgcacatctacttctgcggtttgaagggaatgatgcctggaattcaggacacccttaagaaggtggcagagcagagaggcgagagctgggaccagaagctctcccagctcaagaagaacaagcaatggcacgttgaggtctactagggctcgaattggttgtaattgcgacccttaatgctgcgggtcatcgtcaggaggaaacaaacacatgattgaaattgaatcgtcgaatgattcttggggcggtgtaaaatcacaaaaagttctcttggcgagaatcagaaaatcgcctttgtaattcataaagcttccgcgtcatggttatccgtggaacggaccatgtaactttcagccgtttacatttgcagtgcagtgcttttgacagtattcccaattagaggtctctgtccagttggt

SEQ ID NO: 12648 - DNA, 703 bp, Sorghum bicolor
  Clone ID: SORBI-28MAY03-CLUS50427_1
aactatatggcgcctgagcggattagtggtagttcttatgactacaaaagtgacatatggagtttgggcttagttatacttgagtgtgccattggccggttcccttatataccttcagaaggtgaaggttggttaagcttttatgaactactggaggctattgtcgatcagccaccaccttctgcacctgcagatcagttctctccagaattctgctcatttatctcctcttgcatacaaaaagatccggctcagcggatgtctgcttcagaactcttgaaccacccttttttgaagaagtttgaggataaggatctagacctgcggattctcgtcgaggacctggaacctccaatgaatatacccgaatagcctgccttgttgggtgatgaagcctttgttgtgccttcagggtttgacatcgatgcatctagcagcagggcatctgctcctgaactgcagcctccaattccctacatgaacatgccataacatcgatcattgtatgatccaagacccttgtggctagctgagcataagagcagaggaagtcatgctgcgttccgtatggtcaccttattgtagctattgttgcgttggccttgtgattgcgagtcttgttttaacttttgcagtcttattattggcagacgattcaaaagggacgaactgaatattcaaaacatgcttgccaacatgattc

SEQ ID NO: 12649 - DNA, 1596 bp, Sorghum bicolor
  unsure (1)..(1596): unsure at all n locations
  Clone ID: SORBI-28MAY03-CLUS5064_1
gtggtgcttgtttaagaagtcaaggggttcggggacgagactagagagtttgggttatctcccacagtcagatatggttcagaagttctggaaactatgtgaacaacagctcaatatatcagatgaaactgaagatgaagatgcaaatgaagaatatattgaagacacaaacaggggtgcggggatgattgcagctgcaaagctagtgctcgctgatacagtatcaaaggattatcttggtccagagattgtttctcactatgtatctcacggagcaagtacaacagagataatcaaacatctaattacttctctaaagaaaaacacaaactttgacatgggagctctcttttttgaggctctgaaaagggcatatgaacgttacatggcccatgttcatgagggagaaaaccaaatcctgactggcaagtcttattcggaatgtcaagatcttgctagtcatcttgcagggtcctatgttggggccgctcgcattaaaaacaagtcagatatcctgaagattatccaagatggtgtttcttttgcttttgtcgatcttccaaatcaattgtcgttccttgaggctgctcttctgccatttgtttctaaacttcagtcgtcagatattccagatattctggcagatgtagagaagaggactcaagataccaatatggttggagatcaaggtgcttggcgcccatattttacattcgtagaacacctacgtgataaacatgcgaagaatgaggttttgcatgaggaagaggaaaaacctgtgaggcgacggggccgtccgagaaaggttagagatgtgccagatgtaccagatctacgtagtggtcgggatgtacgtgggaagaaactttttagagatgacgggcacaattctagtggcgaggagtctatcagtgcatctgaccatcagggtcacggtgaagatgacgacagcgacggcgatgcagatcagcccttaatcaacacgattaggtcttccgctgccaagctacgatccttgaagattgctcaacagggaacaagcagccacaaaggggtctctggcccatcaggaagcaatagctgagagaatgcatgcagtatcgcacatcgctggtgatgatttccagactttgaacgaccagttcaagcagcacagtggaccggcactaacatcagtttgacgaggacatcagtccacgcggagctgcatctaattgcttaggcgctgtacatgatttgcacttaggtgctgactctctttgtacacgttaggtgtcccgctaggtctttcttttaccccctcttctatcctcatgtgtaatatatagaaacaggttaatggactcatggtacgggctgttttttacttggtgtgtatagtgctatcttgatctggcagagggtttcttccaggttantttcatttcaagcattgagttgtcgttctagccctggtggtatgctgattccatatgctgttgatttacatagttttctgtttccatttcctcttacttgtttgctgattcctgtagaccaaaaaccatgtctacttttggcttcaaaaaaatataaagtcatctcgttggtatcaca

SEQ ID NO: 12650 - DNA, 1305 bp, Sorghum bicolor
  Clone ID: SORBI-28MAY03-CLUS5761_1
ttttcctttccttgccgctcgggccgcaacgccagccacgccgagaggagagagaccaaccgccgccaccggaatggctgggtgaggaagcccgcgccggacacgacagaggaaccgccgctacccccgccgccgcgacccacaggacaggacaccgggtagaggaagagatccagccagccagcgagccatggggagcgacgtgcccatgagccccgagctcgagcaggtggacggcgagatccaggacatcttccgcgcgctccagaatgggttccagaagatggacaagatcaaggactccagcaggcagtccaagcagctggaggatctcaccgccaagatgagagagtgcaagcgtttgatcaaagaatttgaccgtatactcaaggatgaggagaaaaagaacactcctgatgtcaacaagcagctcaatgacaagaagcagttcatgatcaaagaactcaactcctatgtaaccttgaggaaaacgtaccagagcagcctcggtaataagaggatcgaactattcgatactggtaatgaccaagtggctgacgaaactccagttcaaatggcatcagaaatgtcaaatcaagaactcattagcgctggaaggaaacaaatggaccaaactgaccaagccattgagcgctcaaaaatggttgttgcacaaactgttgaagttggagctcagactgctgcaactctgtcacagcaaacagatcaaatgaagagaataggcaatgagctagattctgtccacttttcactgaagaaggctagccaaatggtgaaagagattggccgccaggttgctactgacaaatgcattatggcgttcctgtttcttattgtctgtggtgttattgcaataattgtcgtcaagattgtcaacccacataacaagaacatcagagacattccggggctggcacctcccgccatgaacaggaagctgctgtccgtcgatgctttcggagggctccgagcgctgtgaatggctgccccctgcagtacatcagagttctcctgtgagccacacgatacatgattttgcgattattttgtgcttgtatattgtctcatgttgtttacgcctgcccattctttccctattgcgttggtgagtagtaggttcaggtttctagcggcactcttgttgtttattgcttgcgagcactggctttctggttgtctgtgtatacgcggtagtgatgtgaatgtgagaattgaaattcttcatggttcattcttgtgagttgtgactcaggtttgtgagcttgggtgaaggttctcattctc

SEQ ID NO: 12651 - DNA, 1097 bp, Sorghum bicolor
  Clone ID: SORBI-28MAY03-CLUS6046_1
tggataccacacccctcgccctcccgtcgccgcgtcactgtgcggtgcctcgttcgcttgcttggtggttgcgggtttgatatattttgggtgtgcagatgagcgcgggcgcgggcgccgcggtggagaagatccgcgccgccgggctgctcaggacgcaggggctcatcgccgggaagtgggtggacgcctacgacgggaagaccatcgaggtgcaaaatccagcaactggtgaggtccttgcaaacgtgccctgtatgggcagcagagaaacatctgatgctattgcttctgctcacagtacattctattcttggagtaaactcactgcaggtgagaggagcaaggcactaagaaaatggtacgatctaattatttcacacaaggaagagcttgcacttctcatgacactggagcaggggaaacctatgaaagaagccctgggtgaggtcaattatggtgcaagtttcatagaatattttgcagaggaagcaaagcgtatatatggtgatatcattcccccaactttatctgatcgcagattgttggttctgaagcagcctgttggggtagttggagctattacaccatggaattttccattagcaatgataacccgaaaggttggaccagctttggcgtgtggctgcactgttgttgtcaagccatcagagttcacccctctgacagcattagctgcagcagatcttgctcttcaagctggaataccagcgggtgcactaaatgttgtgatgggtaatgctcctgagataggtgatgcattactgcagagtacacaggtcagaaagattacgttcactggatcaacagctgttggcaaaaaactgatggctggatctgcaaatactgtgaaaaaggtctccttggaacttggtgggaatgcaccttgcattgttttcgatgatgcagacattgatgttgctgttaaaggcagtcttgctgccaagttccgtaacagtggacagacatgtgtttgtgcaaacaggatattggtgcaagaaggtatctacgaaaagtttgcaactgcattcatcaaggctgttcagagtttgaaggttgggaatgggctagaagag

SEQ ID NO: 12652 - DNA, 820 bp, Sorghum bicolor
  Clone ID: SORBI-28MAY03-CLUS6065_1
ctcaagaaagtcctccttcgcaaggacaagtatcttgattggcgcaaacggataatgcttgcaatggatgcagccattgggatggagtacttgcactccaaggacattgtccactttgatttgaaatgtgataacttgctagtgaatgttaaggatccatctcgtcccatttgcaaggttgctgattttggcttatcgaagatgaaacaagccacccttgtttctggtggaatgagaggaacacttccatggatggccccggagttgctgacaatgagtggcactaaagtatctgaaaagattgatgtctattcttttggcattgtaatgtgggaaattctcacgggcgaggatccatatgatggcatgcactatggaggagtgatagggggtattttgagcaacacactacgaccaccagtgccaacttcatgtgacccagaatggaggaaactgatggagcaatgctggtcaactgaacctgagagaaggcctaccttcaccgaagttgcatctcgtctccgtgccatcctagaagcaagccagagagaatctccacgttaataatctgcatggacaacactctgcatctgtacatattacctcccagagcaagacacagtcatggacatttgttctagaactggtaccaagtctcagcatgaaaatgtaaaccccagtttccccaaagttaactatgggcagtgtacattgatttggcatccccatgtactgaatttgaaatgatgctgcgttgttacttttcgtttttcatttttgaaattctgcaaagcaacttgatgtcccacaggacacagcc

SEQ ID NO: 12653 - DNA, 1602 bp, Sorghum bicolor
  Clone ID: SORBI-28MAY03-CLUS61076_1
gcacgagggtgaagtccctcctgaaaaattataacattgacccaaagtgcattggacgtttggagctcggcggtgaaacagtaatagacaagagcaagtctataaagacatggcacgaggagatatttgaggaatctggcaatactgatattgaaggagttgactcctcaaatgcatgctatggtgggacagctgcattgtttaattgtgttaactgggttgaaagcaactcatgggatgggcgttatggacttgttgtttgcacagacagtgcggtttacgctgaaggtccggctcgtcctactggtggtgcggctgctattgcaatgctgattggaccaaatgctcctatttcttttgaaagtaaatataggggatcccatatggcccatgtatacgacttttacaagcccgatctcgcgagtgaatatccggtggttgatgggaagctatcacagacatgctaccttatggcattggactcctgctacaatgtattttgcaaaaagtatgaaaagaatgagggaaagcagttttcaatttttgatgcagattatgttgtgttccattctccatacaacaagcttgtacagaaaagctttgctcgtttgtactacaatgatttcctgagaaactgcagcacggttgatgaagagtcaagggaaaaattggcaccctatgcaggcttgtcatctgaagaaagctaccagagtcgcgaccttgaaaaggcatctcagcaagttgcaaagaacctgtacgactccaaggttcagccaacaacattgatcccaaaacaagttgggaatatgtatacagcatcactctatgccgctcttgcatcgattattcataatagacatgaaactctggcagggcagaggattgttatgttttcatatggcagtgggttgacatcaacaatgttctctttcaagattaatgaaggccagcaccctttcagtctgctaaacattgcaaacataatggatgtttccaagaaattgaaggcaagacatgtggttcccccaaagaaatttgtcgagacactgaaactgatggagcaccgctatggggcgaaagattttgtgaccagtcaagatacaagtttgctatctgcaggtacatattatctcacgcacgttgactccatgtaccgaaggttctatgacgtgaaaggtgacagtgtcaccactgcaatctccaacggccactgatctgtcttctgctcgaagctgcaacaagttaaataacagaggcaggtgtcctaagtattctgagtgttcttagattatctattattaggagggtaagctggagcttagattaatctctgcccagttgtaaggttgtaaagttagttagagctgcgccattgttgtaatgcttgcttagtaaaaactctggtgctcttccgttctttattggtgtgaattgcagtgcttgcaaaattcaaatcaagcacactgctgagttattagaattctgaataatttgcagaatcactggttacatccaagttatgctgttgaatgcatctggattcagttgtactgttggagcagtcgtgtcatgtcttgtactttttttaattagtttctaaca

SEQ ID NO: 12654 - DNA, 1288 bp, Sorghum bicolor
  Clone ID: SORBI-28MAY03-CLUS534_1
gcacgaggctccaactctctcctccgccccagcccgccgtaatgatggccgccgcggccgccgtctccgcggtcccgatgccttcccgactcaccctccgtgcccacccctgctcctccgccgctccgctccctatgcgcgcgctccccttcctccgcagccgcctccgctccttgaccacggcctacgctgtcaagcaggacgcggccctctggacccctgcgcccgtctccgccgtcagcgccgccaccgccgacggctccatctcctacgtcgtcgtcgacctctccgacgccgctgacctcgtggactcgtacacgaccccggggcagtacctcaagatccgcgtaccctctgccggggacgagctcaagccggcgttcatggccatcgcatcgccgcccggcgcggggccccggttcgagttcgtcgtcaaaaccgtgccggggaccaccgccgagaagctctgcaccctccgagacggggatgttgtggagctcggcgccgtcacgggggacggcttcgccctcgacaagataaatccgcccgacgtcgcgcaggccgtgctcatgttcgccacggggacggggatcagtacgattcgttcacttatcgagtttggttttgctgccaatgaaagagctgatgtgaggctttattatggtgctagaaatctgcaatcgatggcataccaggagagattcaagaactgggagtcaactggagttaaaataataccagtcttatcacgaccagatgacagttggaatggtgaacgagggcacgttcaggatgctttcttcaaaaacaagaacatagtaaatccatcttctacgggagccgtactttgtggacagaatgaaatgcaggaggaaatcacctcagcccttgtagcagatggtgtctcacgagacaaaatcttaacgaactactgaaagcaatctccggtctccccctgatgtattctacgaccagttattcctagacctggctgtaatgttccagtgttatttatatcgatatctaataataaagaggcaaaatttatgccactaataatttttcgtccaacttactccgaaagtgtctcggcttcgaccatcagttctggaaagtttcccgcgtccgaattctctgtcaaatagaaccggcattttccgtggaagacgttccattttctcccttctccttgttgggttctgtacatgactttgtttttccttttttatctctctttgtcacgtaaaaaaaatatatcatatatcgtattatgtcctttcttctcttt

SEQ ID NO: 12655 - DNA, 1474 bp, Sorghum bicolor
  Clone ID: SORBI-28MAY03-CLUS5372_1
cgttcgtcggctcgggggcatacgccgcgcactggaccggcgacaacaagggcacttgggaaaatctccgctattccatctcaacgatgctcaactttggcatcttcggcatgccaatggttggctctgacatctgtggcttctacccggcgccgactgaggagctctgcaacaggtggattgagctcggggccttctacccgttctccagggaccatgccaacttcgcgtcaccgaggcaggagctctacgtctgggagtcagtggcgacgtcggcacggaacgcgctcggcatgcggtacaagctgctcccctacctgtacacgctcagctaccaggcgcacctgaccggggcacccgtggcgcgcccggtgttcttctccttccccgacttcacgccgtgctacgggctgagcacacagttcctgctcggcgccagcgtcatggtgtccccagtcctcgagcagggcgccacttcggtgagcgccatgttcccaccgggcacctggtacaacctgttcgacatgaggaaggtggtggtgtccaagagcagcgcccccgtgacgctggaggcgccgctgaacgagatcaacgtgcacgtgttccagaacacgatcctgccgatgcagcgcggcgggttcgtctccaaggacgcccgggcgacgccgttcacgctcgtggtcgcgttcccgttcggggcgacgcaggcggacgcggagggcgcggtgtacgtggacgacgacgagcggccggagatggtgctcgcggaagggcaggcgacgtacgcgcgcttccacgcgagcgtgcgcggcaaggccgtgacggtgcggtcggaggtgctgatgggaagctacagcctgcacaaggggctggtcatcgagaagctgtcggtgctgggtctggagggcaccggcaaggacctcgccatccaggtggacggcacggacgccaccaccgccgtcgcgacgtcgagcccttacttcgcggcaggtggcaacgcgaagctgcatggggaagaaggcgtcgaggatagcaacaagagcgtcatggtggaggtcggcgggctggcattgccgctggggaagagcttcaccatgacctggaacatgcggatcgaagcataggtcaagtggtgatgtgcttccatctccatgaattcgcttaagacgtgttctatttgtgtcatccgggagtgctctgtgcaaggagcagagtacacagagaatcttcctaagcattgttgcaataaaagattgagtctttagcgttggagttgggcctttttaggtggactaaactaaaatttagttcatgttttggatgccaattagagggtttaaacatgaactcattatggtctaatagaaactaatactccctccatcccaaattgtaagtcattctaagaatcttggaaagtcaaacttttctaagtttgaccaaatttataggataaaataataattattattag

SEQ ID NO: 12656 - DNA, 1011 bp, Sorghum bicolor
  Clone ID: SORBI-28MAY03-CLUS5265_1
gcacgaggccctcccgcaagcacccgcacctcccccacgccgtcgcccccccccccgcccagcccgctccccacccctcccccgagcttaaccggcggcgatccaccatgccggcgacggcggggcgcgttcgcatgcccgcgaacaaccgcgtgcacagcagcgcggcgttgcagacgcacggcatctggcagagcgccatcggatacgacccgtacgcgcccgagaacaacaagcaacagccgggccgcccctcctcctccgtctccgccaacgccgccgccgcagccgccaacgacgccacagcttccggatccgcaccaagagaaaatcaaagcacacaaggagtaggaggagtgatgatagtgaggatgaagaggaggaaggcagaagaggcagggacaggaagaagtccagcagatcgaagaagcatgaaagatcagatgaggatagcagcgatgatagtgactcagataggcagaggcacaggaagagcaggaaggacaggaagaggaggaggagccaccgcaggagcgacgactcattggatgagaaggatgtgtctggagatgaagaaaggaggcatcgacgtcaccgcaagcggagccatcaccggagggatgcatctgactgtgacaatggtggcagtgattctgcagataacaagaagcgatccagcaggaggaggaggcaccgccggtcaggaagcagtgggttggatgatgatgagcgacatgatcaccggggagcaaagcgatctggggagaagagcagggaccgcaagaggagctaaagaggagcattgaattggtaattcctatatgatgatgttattgacttcctctatttatcagctggtctgttgccttgccttgtcataagtttgaaacatttggagcatgatgcttgatatgtgtaacaatataacaagttggtgtattactgtatgtacttcgagtctattatgtgttcatgattcgataattgataatattattgtcaaggattttt

SEQ ID NO: 12657 - DNA, 579 bp, Sorghum bicolor
  Clone ID: LIB3476-004-Q6-K1-G9
ccgagcttaaccggcggcgatccaagatgccggcgacggcggggcgcgttcgcatgcccgcgaacaaccgcgtgcacagcagcgcggcgttgcagacgcacggcatctggcagagcgccatcggatacgacccctacgcgcccgagaacaacaagcaacagccgggccgcccctcctggtgcgtctccgccaacgccgccgccgcagccgccaacgacgccagcgcagccgccagcgccgcagcagcttccggatccggctcgggcgatggcaacgcctacaccaagagaaaatcaaagcacacaaggagtagaaggagtgatgatagtgaggatgaagaggaggaaggcagaagaggcagggacaggaagaagaggtccaacagatcgaagaagcatggaagatcagatgaggatagcagcgacaatagtgactccgataggcagaggcacaggaagaggaggaggagccatcgcaggagcgaggactcattggatgagaaggatgtgtctggaggtgaagaaaggaggcatcggcgtcactgcaagcggagccatcaccggagggatgcatctgact

SEQ ID NO: 12658 - DNA, 706 bp, Sorghum bicolor
  unsure (1)..(706): unsure at all n locations
  Clone ID: SORBI-28MAY03-CLUS54866_1
ctactggagcagcacgcagagatcaatcacacttctctgctactctgccttcgtcgtcgccatggctctgctctctgatctcatcaacctcgacctctcggactgcaccgagaagatcatcgccgagtacatctgggttggcggttctgggatggatgtgaggagcaaagccaggacgctgtccggacctgttgatgaccctagcaagcttccaaaatggaatttcgacggctccagcaccggccaagctcctggtgacgacagtgaagtcatcctttgccctcgggccatcttcagagacccgttcaggaaggggaagaacatactggtcatgtgcgactgctacgagccaaatggaaagccgattccgagcaacaagcggcacggggcggcgacgatctttagccaccctgatgtcaaggctgaggaaccatggtttgggattgagcaggagtacacccttcttcagaaggacaccaactggcctcttggttggccgctgggcggctaccctggccctcagggaccatactactgcgccgccggagcggacaaatcctacgggcgggagatcgtggacgcgcactacaaggcctgcctctacgccggcatcgacatcagcggcatcaacggggaggtcatgccagggcagtgggagttccaggttggcccctgccgtcggcgtctcggccggcgaccagtntgg

SEQ ID NO: 12659 - DNA, 1201 bp, Sorghum bicolor
  unsure (1)..(1201): unsure at all n locations
  Clone ID: SORBI-28MAY03-CLUS55548_1
gcacgagggaaaaacggaaacggaagcatccccatcccgtgccgtgctcgcgcacgaggctcgcatggactccaccgcggctgctgctgctgctgctaccgcggccgcgccggtgctgctggtgacgaacgacgacgggatcgacgcgccggggctccgcttcctcgtcgaccagctcgtcgccgcggggcggtaccgcgtactcgtctgcgcgcccgacacagacaaatcgggtgtgagccacagcatcacatggcgtgctgcactccgctgtaaacgtgttgatataacgggtgctacagcatttggagtttcaggaagtcctgctgactgtgcctctttaggcatctctggaaaactctttgatggtttggttcctgatctggtacttagtggaatcaacattggaaacaattgtgggtaccatgtcatttattctggaacagttgctggtgctagggaggcattcttatatgggattcctgcgatatctatgtcatatgattgggttgcgggtcggagcagtgttaatgagctcaaggtgtctgcagaggtctgcatgcctctgataaatgctatcgtgactgagatcaagaatgggacttatcctcaaggatcattcttgaatgtagacgtaccaacagatgctgcacaccacaagggctacaaaattacaaaacaaggaacatatatggccagaattagttgggagcaaacggtttacaagaagcctgcggtagaaagttaccagacagcaaacatggatgttgatggcgaaaaggatagcgaactagttacttcagaaaatgacctactgtttaagagagtgattgtagggagaagtgccgatggagtggaaggagacgaaatggactacaagtccctagttgatggatacatcactgttactcctttgggtgctctttcccactcagaaccagatgccataccctatttcaaagcttgcgtatcacgtctgtgaccaggatggcaggatgcttaccagacaggccagacaggacctcctgatgtcatcgcttggccacagagtagcgaataatctacataaatatcaagcatattatttgaattaccgccacactatatagtaacgataattcatattatttgtggcatgcattcatgaaataattcaggtttatggtaattatgcttcatcaantaattcaaaggtttttgt

SEQ ID NO: 12660 - DNA, 1339 bp, Sorghum bicolor
  Clone ID: SORBI-28MAY03-CLUS55628_1
gcacgcgcgggggggagagagaggaggctagagagagaaacaaaggtggtggtacggtagtagatgtgagccaccctctttgtatccctcgccaacttcttctcctaccaacttcttttcgtcccctcccaccccttccttaccgtctcgcgcccgctcccgcagcctcgctccacccgccgccgccggccggccggcaccgccggtggcatttcaagtatggttagcttgaggcgacgtcgactattgggtctttgttctgggaaagactcattgccagttgatcttcctaagcccattgaaaatgaaaaaactgtggaagttgtgcactccaatgtgaagccattcagtgtgcatcctctgcccttggcaaagacttctgatgtgctcacaaaatcctcaaatggttctgatgattcaaaggaagagaaaacccagtactatccaggcaaggaaatcaagcgcagaaaacgacatagaagaaagcagtacgtggatcaagagccctgcattatgaggggggtttatttcaaaaatatgaaatggcaggctgccataaaagttgacaagaaacagattcacttgggtactgttgggacacaggacgaagcagcccggctttatgatagggctgcttttatgtgtggaagggagccaaactttgagctttctgaggaagagaagcaggaactacggaagtacacctgggagggcttcttagcagtgactcgcaacacgataaccagcaaaaaacaaaggaaagttgggttgccaaggcgtagcaaggcagacctgttcatgggacagagtgatggcgatactgagatggccaatggaggcggttcatcgaattctgataatggagacgcagagacgtcggcatcttaggttgctcccaggggtttttgccgttgtggcaactcaagtggagtcctccagcatattcattccgagcatgatatgagctccgtttaggattttgttctctcatcaataattaattttcatgtgcataaggcccccgttggtctaatcaaaggttagggaaatcatgccatctcaaacaagaattggaggtggtccattgtagaaacaattcatgtataccggttccgaaattgtgtatatctaccgataggttcaccttaccttttacccaatgtagttagtttaccttatcatttacccaaaagaaatatttttccctttccggtaataccatccatacgtcatttatgtaccagtggaaatcatcctgtatatgtcttgatgagtttactgccgacatgcttgaaactttgacattcttctaagtttataagtttggaattgatgctgt

SEQ ID NO: 12661 - DNA, 1435 bp, Sorghum bicolor
  Clone ID: SORBI-28MAY03-CLUS6508_1
gcacgagggagagaggaaaaaaggctcgcgaaccctagccaagatcacatcggatcgggtacgttccccatccttccttgggcggcggcgtgttcatggcctcaggcggcggcggcggcgtgtctgtggcgccgggcggcagcggcttggggtacgacgtcggagaggtctggggggacttggaacctttcttcttcgacgaggcggaggcggtggccgatcatgagaggcgaatgcggagagaacaggaggaggcgcagaaggcggcgcagcgcctccaggacgcgatcgccaggaagagcgccaacaaggccgcgctggctaagatctcagactacgatccgaagcaggatggcaaatacttcaaccgatttcacttcgccgacttctccaaattcgacctcgacgaggagtcgccccttggaccaatgagatacaccaatataatctacaataagggtgatgagcactggaagagcgctgcagtgaacattctgtccgtgaagatagcatcattggatgtcggttttcccattgatgtgtatggcactgtaattttcagagacagcattgattacaagtgtgtttacctctttcatcgcgagaaagataattgtcaacccatccactcaagcgatgaatcgttgatcttgactggcccaaaacgaggactctttttactagatgatgtatatgttgagattgatttgaagatcaaggattgtcaagtgcaggaggagaaagaacttagtaaaggattctttaatatcgcacgaggaccaagtcgatatttggacaaatgcgaggttgaaagcaaaaaacttgctaccaggctcagtaccatggaggtgacgtatgcagttgtgaacaatgccgtggaggctaccattgcagttgaggtcctgaggggagaattttatggaaaaatcattgcttgcaccaccaaggtccctaatcatcttgtgcttcatgatagcaaactggctggtgtgatgagcaaggacaacagcaacagtacaggtgttatccaacttttgagatccattgtgtccgtccctctggaggagatgctattagtgactatagtggcccagactggtgatgctgaatgtgaaagaaccatcgagtttaccccacatatcagcggtggagacagagatgtgattactgttggtgtaacaaagttgtcggtgacggttgcttggtcactgattagtcagtagtttgtagctttgggctgtactggttaacttagtaatttatttataatgacttatgtttgggcacaagtagtagtgcgtgtatcgactagtactgtgaatttgtgatgtgctttgttatgttgaactagtgtggtagtgtgtaaggttatcttagcctgttcaatggaagctggcgcctcatcctaggcgcggctgcaaattaaacccttttt

SEQ ID NO: 12662 - DNA, 913 bp, Sorghum bicolor
  Clone ID: SORBI-28MAY03-CLUS65401_1
atcttctgcccctcatcctccgcctgtcacaccacacagccgccggcactctatcgctcgcccccgctaggccatgccctcttccgagaaccgacgaggggcttcactggcagcacccctccttctcctagattagttgccgtcttttcgacgccctcggggtctctgtctggtccgtagcctgccgtgcccggttcagcattgttgctccggcatcgatgccgggcagcggacttgtgcgcggccgaagtgctgcggtctggccacggactatatctatgtggtgccagcttcgccgaggtggagggcgagccttgggcgaaggcgcatcagcatgagctgccgatgtgggttagggcagggtaccgtggccgcagatgacaagggagcaggtgaccgggttatgtttcacattaattggagttgtgggttactttaacgatgggtcagtagctctgaggcatttttttttcgaggttcatagcatcatgatttcatccgccacttagctagacattattcttttcattaagggcttcttttactgcagtggtgtgtgtggttgatattatgcgcggatctctcatctgtctgtcttatttcttctcgcgctctaactgttaggtcccggtagttcgcgtcctcatgtaggcctaaatccgtctcttccttgactgcatgtgcatagattttgttgatccgtgactcgatacttaaagacttgaaacgtcggagaggggaacctgtatcaccttgacttgagcaattggcctcttgctatgcactagagcgccattatgccaatttgcgacttgagaccctacatgtgtaatgaattggtggattgatgtaatgatattgtatttactgtggagatgttaattcatttggatctgagtgttttatgttattc

SEQ ID NO: 12663 - DNA, 1840 bp, Sorghum bicolor
  unsure (1)..(1840): unsure at all n locations
  Clone ID: SORBI-28MAY03-CLUS6592_1
ctcggaggaaacttccaatccacaacaccactcctcctcccatcttcttcctcctccggtgctccctataaaacccctcgcctccccaccctcccacaggcccccaccacaccaccaagaaaataaattcagagaaaggaggagcagacaagtatagctagctagctgtctcctcccctgctcccagactctgcctgtcctgccccccatggctccgaggtgggccccgcccgctggcctcgtcgtgcttgtggcgctgctcgcgctgctgctggcgccggcggcggtggtgcgcggggacaagcccgtgaggggtggggcgtccagctccgtcgccggcgtggagaccgaggcgtcctccgccgtcttcccgctctacggcgacgtctacccgcacggcttgtactatgtggccatgaacatcggcaacccgcccaagccatacttcctggacgtcgacaccggcagcgatctcacctggctgcagtgcgacgcgccctgcaggagctgcaacaaggtgccacacccactctaccggccaacaaagaacaagctggtgccatgcgtggatcaactgtgtgcttccctccacaacgggctaaacaggaagcacaaatgtgattcaccatatgagcaatgcgactatgtgattaagtatgcagatcaggggtcatccaccggtgtgcttgtcaatgacagcttcgcgctccgactcgcaaatggctctgttgtccgccccagtctggcgttcgggtgtggttatgatcaacaggtcagcagcggtgagatgtcgcctactgacggtgtgcttgggcttgggactggatcagttagcttactttcancagttcaaacagcatggagtcaccaagaacgtggttggccactgcctcagcctaagaggtggcgggttcctcttctttggtgatgatcttgtgccttatcaacgtgtgacatggactcctatggttcgcagtcctctccggaattactattcccctggctcagcaagtctgtactttggtgaccagtcactgcgtgtgaaactgacggaagtagtctttgacagtggaagctcattcacctactttgctgcacagccatatcaagcacttgtcaccgctcttaagggtgacctaagcaggacgctgaaagaggtatctgatccctctcttcctctgtgctggaaagggaagaaaccattcaaatctgtgcttgatgtgaaaaaggaattcaaatctttggtgctgaactttggcaatggcaacaaggcgttcatggagatccctcctcaaaactacctcattgttacaaaatacggtaatgcctgtttgggcatcctcaatggatccgaagtcggtctcaaggatctgagcattcttggagacattacgatgcaggatcagatggtgatttatgacaatgagaaagggcaaattggatggattcgtgcaccttgtgatagaatccccaagtttggatcctccgctcttctgtgatcatttcacacccctgtacagtgaacatacacccacttaattcatttctatttatccgaacagcgacaataccattgatggatttgatgaacgttattgttggcctcaattcccggggatcatgggtcttccgaatgaagattgcccagcctattaccgttcaaacaaagagtgatttgcccaaggggaggccgctagagtgacagaaagaacagaaggatgatcaccatggggaggctggacacagtgttaggatcgtgtattctttaggaaagagagaacctagtcacatgtaaacatcataatgttcatatatgaaatataatgatcaccctgttacg

SEQ ID NO: 12664 - DNA, 693 bp, Sorghum bicolor
  Clone ID: SORBI-28MAY03-CLUS66797_1
tgctgccgctgctcgccgagctgggcaagtccatcggcgtgcacccgccgacgccaccaccacgctggtgctgccgctgctcgccgagctgggcaagtccatcggcgtgcacccactgctgctcatggtccccggcaccgtcggcgcgcagctgtcgtacctgctgcccaccgcaacgccagggaacgtcgtcgggttcggcaccggctacatcaccatcaaggacatggtggtcactggaatgccaataaaactcgtcggcatcgcagctctcacgatactactgccaacgttaggttctctggtttttggcatggattcgaaaatgtaggaacttggacggccaacatttatcaggctcattatgatacgtgggatttatttctaatcctgcaggaattgagctggttcctatcatcctatgaatggaactcttgcagattttagttcatgtgttcgtttggaacatttcactatgtagactgtaggctgtccctttttagataaagagactgtaggcagtctagacgttagtctggtacttgtaaagtgttcaggctgtacagttcatcagtttcattgcctcaggaagaaaatgaggttgtattgtcttgattgtgtattccttgcttcagttccgagttagagatttgtacgcaaatgatttcatatgtacagatgagatttactata

SEQ ID NO: 12665 - DNA, 664 bp, Sorghum bicolor
  Clone ID: SORBI-28MAY03-CLUS56707_1
tggaaactcgcacgctccttcccccctacccggccaatcaatctcctccctccctctccggccacgcgcaccacgagtacgccatgagcgccgcccatcagccagaacccacggctcccgccgccgccgcctcctgcggcggcggcggcgacagcacgatcaagaacgcgcggcaccggacgagcaccctgaagcagtgctaccacctcgccatctccaacgcgctgtacctcctcctcgccccagccgtcgcctacgcctcccaccgcttctcccaccacaccgcatccgacgtcaccgccgccgccgcgttcgcgtccaacccgccgttcgccgtctccctcctggtgctctccgcggtgctcgccacggcgtacctgatgcgccgcccgcgcgccgtctacctgctcgacttcgcgtgctacaagcccggcgccggccacgtggtgacgcgggagacgttcatgcggcagtcggaggcgggcgggggtgttcacccccgacaacctggcgttccagcggaagatcctggagcggtcggggctcgggcaggggaccttcttccccgccgccgtcctcaactcgccgcccaacccgtgcatggcggaggcgcgcgccgaggccgaggccgtcatgttcggcgccatcgaccaggtgctggcaa

SEQ ID NO: 12666 - DNA, 1559 bp, Sorghum bicolor
  Clone ID: SORBI-28MAY03-CLUS56893_1
cccctcgatgctgctggactggaggcgaaccgcacaacagtggggttcctcctggcagcgcgcgcgcacgcaaacagtcaagaccgacgacttacccataggcgcgcggcgcgcggcgggcgggcggcggtgaccacgcacacgcacgcatggcggagcagctcctctcgacggccgtgcacgacaccctgccggggagctacgtccggccggagtcgcagcgccctcggctcgccgaggtcgtcaccggcgcgcgcatccccgtcgtcgacctagggagccccgaccgcgccgcggttgtcgccgccatcggcgacgcctgccgctcccacggcttcttccaggtcctcaaccacggggtacatgccgacttggtcgcggcggtgatggccgtggggcgcgccttcttccggctgtcgcccgaggagaaggccaagctctactccgacgaccccgccaggaagatacggctgtccacgagcttcaacgtgcgcaaggagacggtgcacaactggcgcgactacctccggctgcactgccatcccctcgacgagttcgtgcccgactggccgtccaacccgcccggttgcctggactccatgagcacgtcctgcaacgctgtccggccgcccgcgtgcacgcggtacgcggccctctcggggtgcctgggtctataggcgagctacatgaacgagacgctgggggagcaggagcagcacatggcggtcaacttctacccgccgtgcccggagccggagctcacctacggcctcccggcgcacaccgatcccaacgcgctcaccatcctgctcatggaccaggacgtcgccggcctgcaggtgctccacggcggcaagtgggtcgccgtcaacccgcagcccggcgcgctcatcatcaacatcggcgaccagctgcaggcgctgagcaacgggcagtaccggagtgtgtggcaccgggcggtggtgaactcggatcgggagcggatgtccgtggcgtcgttcctgtgcccgtgcaaccacgtcgtgctcggccccgcgaagaagctcgtcaccgaggacaccccggccgtgtacaggagctacacgtacgacgagtactacaagaagttctggagcaggaacctggaccaagagcactgcctggagctgttcagaacctagcagggcgctgcggcggccgtgcaaatggattcgccctggtcctgtttcactgtgtttctccatgagattagaagaagacgttttacaacgtttgtccgttgaagatgatattccaagactctagtgcttttctattctcttaatgaaatacgggtgaatggcccgatcccgaaaaaaaattcttccactctatatacataattaaatgctcttttgaaagaaaatggaagcagacgtattatgttattagattttttttggaataaggagaggttgtccgtactggttatatatattataaatatcactcctattttttaggtgtctgaattttaagatggtttcaagcaactcttttgtaccaccaactagtacaagtaaattgttactttttgattt

SEQ ID NO: 12667 - DNA, 2002 bp, Sorghum bicolor
  unsure (1)..(2002): unsure at all n locations
  Clone ID: SORBI-28MAY03-CLUS57456_1
gcacgaggcgggcacgctccgggaattctgacacttcaagcaagagagttgaacaaatcaatcacaaatggcagtttcatctatctctggacgaagatggcacagataactctagcttgttcaaggagaagcttacacaagctcttcggtacttcaaggagtccacagatcaacatctgttggtccaagtctgggcaccagtaaagaatggagaccgctatgtgcttactacttcaggacaaccttttgtgcttgaccaccagagcattggcctacttcagtacagagctgtatccatgatgtacatgttttcagttgatggggaaaatgttggagagctgggcctacctgggcgtgtctacaagcaaaaggtgcccgagtggacaccaaatgtgcagtactatagcagtggtgagtaccaacgacttaaccatgcgatcagttacaatgtccatggtacagttgccctgcctgtttttgatcctgccgctcagtcgtgtattgctgttgtcgaacttataatgacatcaaagaagataaactatgcctgtgaggtcgataaagtctgcaaagcacttgaggccgtaaatcttaaaagcactgaaatattggaccatccaaatgtccagatatgtaatgaaggccgtcaagctgctctggtcgaaatactggagatcttgactgtagtctgtgaagagcacaagcttcctttggcacagacctgggttccttgcaagtatagaagtgtattggcacatggtggtggtttaaagaagagttgcttaagtttccacgggggttgcatgggggaagtctgcatgtcaactagtgatgtggcgtttcatgtgattgatgctcatatgtggggatttagagatgcatgtgtggagcatcacctacagaggggacaaggagtttcaggaaaggcatttatctcacacaaaccttgcttttcaaaagatatccagaagttctgtaagttgacatatccacttgtacactatgctcgcatgtttgggttggctggctgctttgcaatatgcttgcaaagttcttataccgggaatgacgactacgtattagagtttttcttgccgcccgattgtattgacgaagatgaccaaaatgccttactggagtctatattaactctgatgaagcggtgtcttcgtagcctaaaggtagttggtgacagatattcgagtggggcttctcttcaacttagtaatgtgctaaaacttgagaatgaagaattcaaaacagatgcacagtttgataactctgatggttcccttcatgaatcacctggtggtgatagacatggaggagcgcacaagtttgataacgggaacaagaaagttttggatttgacagagggacaattgttgactgatgactactctcaagacaatggtacttctgctggcaggccaaatggtagcggtgcttctgattcttcattgcttcacaaaaccaacaaaccccctgaaaggagacgtgggaaagctgaaaagactatcagtttagaggttcttcagcaatatttttctgggagcttgaaaaacgcagctaaaagccttggtgtttgtcctacaaccatgaagcgcatctgccggcagcatggaatttctcgttggccatctcgaaaaattaataaggtcaaccggtctctctcaaaattaaagcaggtaattgagtctgttcaaggctccgatgcggcatttaatctcacgtctatcacaggtcctcttcctatacctgttggcccttcatcagagtctctcaatgtagagagattaactcaaagtaaagtggcagaactttcgaatcttgctgttgatggtgacagagattctttgcaaaaatcacttgaaaatgatgaccattttggtatagtcatggcccaccaaggatttatagacnataacaatgactctcagcttgaagctgacaaagcttctcactcgagaagttcatctggagaaggcagcataaattcacg

SEQ ID NO: 12668 - DNA, 1683 bp, Sorghum bicolor
  Clone ID: SORBI-28MAY03-CLUS57848_1
gcacgaggaggatgatgatgatgacaatggtgatcctgaaccactgcgtaatgaatccgacgggaaaataatcaccaacgacgatgtgttaggggacgaagtgccatatgaccagcaagaagctttgcgtgtcctatgttatcggttgcttgaaatgccccttgtaagggggcattcacaatttcctggatcacatccagtttctcttaacagtgaaaatctacaactacttaggcagcgatactactttgctacatggaaagctgatggaacacgatatatgatgcttataatgagagatggttgtttcttgattgatcggaatttttgcttcagaagggttcagatgcgctttccccataagagccttgaaggtctgcatgatatgaccttgattgatggagagatgattatagacacggtaccagattcaggcttgaagagaaggtacttggcatatgatcttatggcacttggtgcagtgtccaaaactaagttgccattttctgaaaggtggaaaatgctggaagatgaaataatacggccacgttatcatgagaaaaagcaatttgagagtggtgctaagagcaatccgttgtacaaatatgacatggaattattttcggttaggagaaaggatttttggctgctctcaacagtaaaaaaggttcttaaggagttcattccatcgctttgccatgatgctgatggccttatatttcagggctgggatgatccatatgtaactcgtactcatgaaggtcttctgaagtggaagtaccctgagatgaattctgtggacttcctttttgagcttacaaatgataatcgtcaattggttttcctttatgagagaggaaaaaagaaacttatggatggtgctcggatagcatttactgacgatgtagatccatcctctgtcgctgggaggattgttgagtgctcctggaataaggaagaacagtgttgggcctgtatgcgtattagatctgataaatcgactccaaatgacatcaacacataccggaaggtgatgaggagtattacagataacattaccgaggaaaagcttctcgaagagattgatgagataaggcgcctcccaatgtatgccgataggatgcatgctcatacgaagatggcacaacagcggcgaagattgccaccatagtgctagtctcgttgctatagtgctggggcgctctcctaccgcctctagccagcggctggcttctgtagctgtgtaattagtagaggtttcagtagccctcctatgatgattgctggctgggtctggccagccaactaattctttgcacctcatttgtgtcttctccctgccctcccaaccacccacctgtataggcgtcgccgcagagtagtttccctgtaaattgtgtattctatgttctcccatattctcccctatggttttatttttcatgggtgtagaatagcgtttaacaagaggctggtgttgtaggtacattagtgtatttgtttaccatctctcggtgttgccttgtgctagaataaatgtagggtgcactgggttcccatctgttgccgatggtcgtgtggttcctctggccatatggctgcaaaatatgggttatttacatcttttgttttgtgcgcacctgatctgatcttttgcttaacgaagaaatctttttttttggt

SEQ ID NO: 12669 - DNA, 928 bp, Sorghum bicolor
  Clone ID: SORBI-28MAY03-CLUS60226_1
aaaggtcccaccacgccgcagtccatccgggacggcggggcccgggcctgcgttgcacttgcaccctccttctccttcgtctccgatcctcaccttcacccccactcccttactctctcggcccttctttcctagctagcggcgacgacagggtgagcagtgaggaatcaccaccgcacgtgccaggtcggccagaactagtgggtggacggcaagcatcgtagcgaccatggaggtggtctcttgcagccactcctgctcggcattacatcaaacaccagcgagtgcatggaggcttcggggcggcactgctcttggtcttggtcttgggcatgccaagccttcccggcccagaagatacacggttatgtgtgtcggaaccacaagaggatcagcttcgagtccgggtggttccggcaaggtccatgcagcccagggattccatgtgagcgacgtggatgcagctctgcagggcattccttccatgaaggtgggggaggttaagaaggtgatgattcaaggcctcccggaaggccctgatggctcaccgatcagtactgggttctgggagtggaagccgaagctgactgtgtactatgagaggtccggggtggagaacagcaaggcgccggcggtgctcttcctgccagggttcggagtcgggacgttccatttcgagaagcagctgagggatcttggtcgtgatcatagggtgtggacgatggattttctcgggcaggggatgtcgctgccgggtgaagaccctgctcctagtagcatctcgagtgaagaggtgttttgggggtttggacaagattcgcagccttgggcagaggagctggtgtattctgtagatttgtggcaaaaccaagttcagcgtttcatcgaggaggttatccgtgaaccagtttatatcgtggggaactct

SEQ ID NO: 12670 - DNA, 1873 bp, Sorghum bicolor
  Clone ID: SORBI-28MAY03-CLUS604_1
gcacgaggcctccgcgaaggcgccgcggccgcgatgacgaccacgatccgcacgcggccgggagcggtggagacaccggggcgctgctggcgtcggtcaggaggcttctgctctccgaggcgccgacggcggcggcggcggcggaggaggaggaggaggagccccgacggttccccaagcgttgggccatcgtcttcctctgcttctctgcattcctgctctgcaacatggaccgcgtaaatatgagcattgctattctgcctatgtccgcagagtatggttggaacccacagactgttggtctcatccagtcatctttcttctggggctacctcctaactcagatagctggaggaatatgggcagatactgttggaggaaagactgtccttggttttggtgtggtttggtggtccatagctacggctcttactcctgttgcagcaaagcttggcttgccatttcttcttgttgtgcgggctttcatgggaatcggtgagggggttgccatgcctgcaatgaacaatattctttcgaaatgggttcctgtatcagagagggggagatcattggctcttgtgtatagtggaatgtaccttgggtcagttacaggacttgcattttcccccttgctgatacataagttcggatggccatcagtcttctattcattcgggtccctaggggctgtttgggtcacgacatgggcaaccaaggcatatagttccccacttgaagatcctggaatcagcgctgcagaaaagaagcttattgctagtcagagcacagcaggcgagcctgttaaaacaattccatggagattgatattatcaaaaccgcctgtttgggcacttatagtttctcatttctgccataactggggaactttcattttgctcacatggatgcccacatactacaaccaggttctgaaattcaacctcatggaatcgggccttgtctgtgttcttccctggttcacgatggcagtttctgcaaatgttggtggttggattgcagacacacttgtcagtagaggagtatctgtgacaactgttcggaagatcatgcaatcaatcggattcttggggccagcattttttctaactcaactaagccatgtcgactcgcctgccatggcagttttatgcatggcttgtagccagggaactgatgcattctcgcagtctggtctgtactcaaaccatcaagatataggccctcgatatgcaggtgtattgcttggtctttccaacacgggtggggtcttagctggtgtatttggcacagcagcaacaggatacatcttgcagcatggttcttgggataacgtattcgagttatcagtggtgctttacctggtagggactttggtatggaatgtattctcaactggcgagaagattcttgattgaagagtgtacatagtgtgcttacagttcagaagtgaaattcatttcggagcaacaacttaacccctggacacaatacacttcaagataacaaatgtgtcatcgtccagctcagctcttggatgaggcaacatgattctaatgtcaatacatgcaatgccaagcacgagaagtatcaagtcttcacatcccagcacgagaccaggtgaagcatagatgagttgagcgatgcaccccttccggacatgcactgtatattgtgttagcataggtatcatgtacagcatagtagaaagtttcatcatacacagtagtcttttctgacttgtacaattttttcctcttgaatagctttgttcctgtaacagcccgacgcagatcaaaataaggaaatctggggaaggggctactactaatgcaaacatttgatgaatatttatctatttgcagtctcagttttt

SEQ ID NO: 12671 - DNA, 791 bp, Sorghum bicolor
  Clone ID: SORBI-28MAY03-CLUS7005_1
gcacgagggcggagcgcaccaatcccatcccccacccaatcgaaggagcggcggcggcggcggcggcgaccggagaagatggtgcgcaaggcgaaggttgagttcgacgagcagccgccggataacttcgacccgaagaacccgtatggggacccggtggcgatgctggagtaccgggagcacctggtgcgggagaagtggatccagatcgagaccgccaagatcatccgggagcgcctccgctggtgctaccgcatcgagggcatcaaccaccaccagaagtgccgccacctcgtcgaccagtacctagagtctacccgcggcgtgggttggggcaaggatgctcgcccgcccgagttccacgagcccaagaagaccgtcgaggcggagtagcggcgctgctgcacggcttctcgtgctgctgttcctggatcggagaggtgatctgatccttccattgaatcgaaagaagtaacttggaactgttgcaatttgtcttttacatctgaagctgctgatagacttcaaataaaatgttgtccaagaaaacattcttatgcccgtacctgttgttcttgtcgagctgtgtaattgagcgaattgtggcttgaaccttggtgcctaccttgttcttaaaatcctaatgttcgagtttatccagacggtgtttttttgtgtgttttttcactgtaaactgcatctttgatctgcaaggatacgaaaggccccattgatagatgttgactgtttggtttagtggatctactagtacgtaataatcagacctttct

SEQ ID NO: 12672 - DNA, 931 bp, Sorghum bicolor
  Clone ID: SORBI-28MAY03-CLUS70115_1
ctacttgctgaatatggaaaatgtatttctggatcaacttttgtgattcaagggtttggcaatgttggctcatgggctgcacgacttatccatgagaaaggtggtaagattattgcaattggagatgtgacgggttcaatcaaaaacatgtcgggtatagacatacctgctttgatgaagcataagaatgaaggtcatgccatgaaagactttcatggtgcagaagtcatggattcgactgagttgctagtgcacgaatgtgatgttcttgtcccttgtgccttaggtggagttcttaacaaggataatgcaccaagcgtgaaggccaaatttatagttgaagctgctaaccatccaactgatccagaggcagacgagattctcgccaagaagggagtggtcgtattacctgatatctatgctaattcaggtggtgtgatcgttagctactttgagtgggttcagaacattcaaggtttcatgtgggatgaagagaaagtgaacaatgaactagagaagtacatgagcagtgcttttcaacacatcaaggccatgtgcaagagtctggattgcaaccttaggatgggggcattcaccttaggagttaacagggttgcccgtgccaccctcttgagaggctgggaggcatgagaccattgactgcagattacagactcatcaggtgtattcaataattcatttccaacaatgttggaggatcagtgtttgatacggtaaaattcatcagaaaaaggctggcttggaaggaatccagttgaaataacattctgggtgtcgtgcttgttgatccagttcttagtgatgattattgaaaactgtacttaatcattatataatgttttagaaagcttatttggtctcaacagagttcatgtatctttccattcgtattaatggaattctggtaggg

SEQ ID NO: 12673 - DNA, 812 bp, Sorghum bicolor
  Clone ID: SORBI-28MAY03-CLUS7013_1
gccgggcacgaggcgcaggttcgttgttcctcttatccgcggaggaagaaccttggcccgacaccatgctcccaatggccgtgcaccccacgaccacgccggccttgtccccgcgcacccgcgtctccccgcccaggccttccacctccctggccgccacctcgtccaccccctgctctcgcactgtcagtttgaagagcagcaggctgcgacttcgctcgctccgaagcgtcgtcgccgccgccgccgccgatgccgtcggggcagaggaagaagaggtgcaactaagtggaggtgtggatgcggtcgacgaggaggaagcggagaataaggtggtggtgcctgagagacaggacccgatgctggtactcaaattcatctggatggagaagaacatcggcatagcacttgaccaattggttcctggctatggcagcatcccgctaagcccatactacttttggccgcggaaagacgcgtgggaggagcttagagcgaagttggaagagaaagagtggatctcgcagaagcagatgatcatccttctcaaccaggccaccgatatcatcaacctctggcagcagggtggtgggagcctgtcgacatgagttgcaagcttgcattttgttggtttcattacatgccctctctgttgttgatgttaaagtcatggtacgtggccttgtagatcggttcaatctgttctcacgtatgtttttttcccatggaaacgatcttgtgatttatcatagttattatgtgtatcagtcgtttttcgttgggaaaatcaagaaacagacaccctttccggt

SEQ ID NO: 12674 - DNA, 897 bp, Sorghum bicolor
  Clone ID: SORBI-28MAY03-CLUS72562_1
acgctggaggatacggcgctcactacggcggtgccggcggtggcgccgtgcagcagtacggctaccagcagaaagatgcgtacggcggagccaccgccggtggcaaagtgaagaagaccggctaccagtaccaggaggcgtacggtggaactggcgctggcgcaggagggtacggcgctcactacggtggtggcgccgccgccgttcagaagcaccacggctacatgcaggacgtgtacgagagcgagactgagagcgagagcgacgagagtgactgcgacgaggcgttcccgccgcgcggcggcgtgcagcacagctacggggcgtacaagcaggagaagcatcacggggctggcaacctcggcggcgtgcgccgctacgagtcgtacgagacccgcgaggagctcggcggcggtcgccgctatgagtcgtaccagagcagcgtccagtacacgggcggcagcggcggcggcggcggcggcggctacgccacgtgctccccgatcaagaaccgccacctccttcgctatggcgcgtaggcatacgctctgctctgatccagctgcgcgtacgtgcacctacgtatattcgtatgccgtgtcgtatatatagacaggcctatatatgccgctacttggtggatcttgtggttgctgatgcacaaaaaaaaaaaaaagaagctaaacaatcgaaatatctgaaaataagatgtactaaatatgccaccttgggataataatgcatgatgatgaaagaccgatagctgatttgttgtgggcatgcttggttgtactattatcctatttaggccctctttgatagagattcaggcagctccgcctcccattgtaactttcactatgtgctactgttcactagagctaataggagtaagta

SEQ ID NO: 12675 - DNA, 920 bp, Sorghum bicolor
  Clone ID: SORBI-28MAY03-CLUS7230_1
atcttttgatgacaaaagagcagctttttgatatgacatgcatgacattaggtggccgagctgcagaggaggttttgattggcaaaatctcaactggtgctcagaatgacttggagaaagttaccaaaatgacatatgcacaggtcgctgtgtatggttttagtgaaaaggttgggcttctatccttccctcagaaggatgatggttttgaaatgaccaagccttacagtaatcagacggcatccatcatcgatgatgaggtccgggactgggttggcaaggcctataagaaaacagttgaattgataacagagcataaggagcaagttgcgcaaatcgcagaattactgcttgagaaggaagtcttacaccaggacgatctaaccagggtactaggagaacgtccattcaaggcactggagccaaccaactacgacctctttaagcaaggtttccaggatgatgatgacaagagccaagcaacatcagagaacgctgagttgcctgatgattcatctcccccacttggtgaggttgtacccacgtagtttgtttccccctcaaagttagagctgtacattgagtgctcattctcgatagattcttgtttgttgtggcaccataagaaaactgtataaattagcgccctcgctgattatgccaatgtggaaatgcatttggattttcacaaatgcatttggatgccttgggctcttcatggcatcagcaaatgttctgaatcttgtatccgaatgttttgaaaaattctgtctgactggggagttggcgcaaaaaagtgtgcttgtcctgtctgaaggcttggctgtctgttgctggtaacgtcagtggctaagaggagtgcctgcctgcctggaacagtggaacctttgaattttcatcagtagccggtgtgcttattt

SEQ ID NO: 12676 - DNA, 875 bp, Sorghum bicolor
  Clone ID: SORBI-28MAY03-CLUS47301_1
acactaatctctcttcctcctcctccgcccctccccctccccctccccctccttcacacgaaacaacactttcctttcctttttcctccacacaagcaagacgctcaacctgccggcagccgcccgggcaaaaccctagccccgcgatgtccgtccccggcgccccctcgggccgcggctccggcggcggcggcggatcccgcagcttcgacttcggcgccgacgacgtgctctgctcctacgatgacttcgccgccccatccgagcccaagcgccccgatccggccgacaaggattttcatgacagcagattggggaggccatttgtgaaaccttatgaacaagaaagttatggcaaagaggatgtgctttctgctgttgagaaatgcatgaaaaagtatgctgataatttgctacgatctcttgagggaatcactagtcggctttcacaactggagatttattgctataagcttgagagatccataggtgaacttcgaagcgacgtgcttcgtgatgagactgaccatagattgaagtctcttgagaaacatttacatgaagtacacaggtctatccaaattcttagggacaaacaggagttagctgaagctcagaaggaattggccaaatttcaacttacacaggatacatctaaaaagaaggaagatgtaccaacaccatctattcctgagcaaaagaagcttgaagaaaaccctgatacatcgaaccagcaattggctcttgttttaccgcatcaggtgaacctgccatcacttgcacctagagcttctgaatcagtccaacagtacaaggatcaacctgtgcaacaatcagcccctacccctcctgtgccacagcaggaccgctatgtt

SEQ ID NO: 12677 - DNA, 953 bp, Sorghum bicolor
  Clone ID: SORBI-28MAY03-CLUS4787_1
gcgttctttgattctctcctgattcatcagcctatttgtgaaagcacttggaggttcagtggcaggctcagacaagaaaatactgttcctctgtggggactacatggaagattatgaggttatggtcccattccagtctcttcaagctcttggctgccatgtcgatgctgtttgccctgacaagggagccggggagaagtgcccgacagccattcatgatttcgaaggtgatcagacttacagtgagaagcctggccacgattttactttaacagcatcatttgaaagtgtggatgcttcaagctatgatgcacttgtgattcctggtgggcgggctccggagtatctggctctgaatgataaagtcatcagcttggtgaaggccttcgcggataacggaaagccaattgcatcgatctgccatggccaacagatattgtcagctgctggagtccttaaggggaagaaatgcactgcgtacccagccgtaaagctcaacgttgtacttgggggcggaacctggctggagcctgacccgatccaccgctgcttcaccgacggcaatctcgtcactggcgcagcctggcccgggcaccctgagttcgtgtcccagctcatggcgttgctcggcatcaaggtttccttctgaagtccgaactgagagtttgaaagtgctcccgtgggacctggggggcgtgataggatagctttggatatccagacagaagagaacacactcgtatgacacgtatagcgaccgctccatctcatccatgatctatgcgcagcaagtttcaggcttacacttttcttttgtcagcgttgtgtaactgtaacgtggatgttgtttcttcttggttcatttttttttggtgtcgtccttttgggattcaaacaataaataaacgcttgtatactgctatgtgttatacttcgagctgctggttttcgtc

SEQ ID NO: 12678 - DNA, 1484 bp, Sorghum bicolor
  Clone ID: SORBI-28MAY03-CLUS4827_1
cgtgaaggctctgaaggagaagctcaggctgcctgttggttcatgtgagcttgctgttcctctcaacgcaaaagcacgactctacacagtagacagacgcagagaagcatatgctacaatactgcattcagcaagtgaatatgtttgcggtgcaatcacagcagctcaaagcattcgtcaagcaggatcaacaagagaccttgttattcttgttgatgacaccataagtgaccaccaccgcaaggggctggaatctgcggggtggaaggtcaggataatagagaggatccggaatcccaaagctgaacgtgatgcctacaatgaatggaactacagcaaattcaggctatggcagcttacagattatgacaaggttatttttattgatgctgatctcctcatactgaggaacattgacttcttgtttgcaatgcctgaaatcactgcaactgggaacaatgcgacactcttcaactccggagtgatggtcattgagccttcaaactgcacattccagttactgatggagcacatcaatgagataacatcttacaatggtggtgaccaaggatacctcaatgagatattcacatggtggcatcggattccaaaacacatgaatttcttgaagcatttctgggagggtgatgaagaggaggtgaaagccaagaagactcgtttgtttggtgctaacccaccgatcctctatgtccttcactacttgggccgaaagccgtggttgtgttttcgggactatgattgtaactggaatgttgaaatcctgcgggagtttgcgagtgatgtagcgcatgctcgctggtggaaggtgcacaacaagatgcccaagaagcttcagagctattgccttctgaggtcaaggttgaaggctgggttggagtgggagcggcggcaggctgagaaagcaaacttcactgatgggcattggaaacggaacataactgatccgaggctgaaaacttgctttgagaagttctgcttctgggagagcatgctatggcattggggtgagaacaagaacaactcgacgcagaacagtgcagtgccggcaacacctactgcgagcctgtcgagctcatgagatttgttgtagatagcttcgttgagagtagtataccggatacaaaacttcccaagctccatacatacatagcaacagctctgtaaaggtagctatgtaggcctttcccccgaatgactatacttttgttcgccgtcacagctgcgccctcccgctgctttctgatggttaacaattcttttggtttttgccaataattcgtcagtataggctgttttttttccctctctggcttgagtcctgtccgggtctgttgcttcaagtcccatgggctattgctttgcagtacgcctggtttgttgtatggtggttgaacagtttcagtgataaatctggagtgatgcaatatcagattgctgaccagcgaacagtgcatcatgttggc

SEQ ID NO: 12679 - DNA, 1036 bp, Sorghum bicolor
  Clone ID: SORBI-28MAY03-CLUS49158_1
gcctcactcatgcagactgtcgcgtccccctccctccttgccctgccctcctcggactacagcctccccccgcccccgcggccaccgcgcaccgccccaccacctgcttcttccagcacaggctgacgcttcattctcccgtcctctcctctcctctcctctcatcaacctctgacctccccgaccccgaggccgccgttcgttcggtgccgcaagcctgtccctgtgcgcagcagcggcggcggctggaggctggtccgtcggcgcgcaacgatggccgcgcgcttgccgctcgcgctcgcggcggcggccgcggtcctgacgcctctcctgggcctggccatggtatccgcatcgggagcctgggacagaaccggaccacggacatggtggagaacgtgagggtcgacacctgcttgctcaccaacacgaccaacggcgtacggatcaagagctggcagggaggcatggggttcgcgcgtgacctgcggttcgagaacatcctgatgaagaacgtctcgaaccccatcatcgtcgaccagtactactgcgaccagcccacgccctgcgccaaccagacgcaggcggtggaggtgcgcaaggtggagttcgccaacatccggggcacgtcggcgacggcgcaggcgatcagcatcgcgtgcagcgacaccgtgccgtgccgggagctggagctggcgaacgtcaacctgacgctggcggagggcggcggccgggccaccgcgctctgctaccgggcgtccgggaagagcgttggcaccgtggtcccgccgtcctgcctcgccaagtcctgagagtcatcagctagtgaatacacacatatgattgttgatttggagctgttgtcataccccaaacgagcttgtcgattgtacacgctgtttttgacgacaaggaaacacagagaagatatattggagtttacgtgcaaaatgctgtgtgctagaaagggggagctcgctctctttctatgtaaaagaactgcagtgaattgaaggcaataaaatataaatatagg

SEQ ID NO: 12680 - DNA, 870 bp, Sorghum bicolor
  Clone ID: SORBI-28MAY03-CLUS49228_1
gcagggcagtgacaaaaccccacagccacagccttcgccccccaactttcttgccccgtccgtttccctctctgacgccgccgcccgccgccgcgcccctgcctgtcccgtcccggcatggcgatgctctcccgcgcggcctcctccgcggcccggcgcccggcactgctgccgccgaggctgctggcggcgagggcgatggcgtcgtcgctcttcggccacgtcgagccggcgcccaaggacccaatcctcggcgtcaccgaggctttcctcgccgacccctcgcccgacaaagtcaacgtcggcgtcggcgcctaccgggacgacaacggccagcccgtcgtgctcagctgcgtgcgcgaggccgagcgccggatcgcgggcaacctcaacatggagtaccttccgatgggaggcagtatcaagatgattgaagagtcactgaagctggcgtacggtgaggattctggcttcatcaaagataagaggatagcagcggtgcaggctctttcaggcactggtgcctgccggctctttgctgatttccagaagcgttttttgccggattcgcagatctacataccaacaccaacgtggtccaaccatcacaatatctggagggatgctcacgtgccacagaagacattcacatactaccatccagagtcaagagggcttgatttttcaggattgatgaatgacatcaagaatgctccagacggttcattctttttgcttcatgcatgtgcccataatcctactggtgtagatcctacagaggaacaatggagagaaatatcccatcagttcaaggtgaaaaaacatttcccattctttgacatggcataccaagggtttgccagtggtgat

SEQ ID NO: 12681 - DNA, 1144 bp, Sorghum bicolor
  Clone ID: SORBI-28MAY03-CLUS50212_1
gctcctggctgctcctggcctcctcccagaggtggggtgtccgttctgtcgggctacagccccgggccggggcccggttcgcgcctaccttggcgtttgccggatatcggttctcctctccggccggtgctatctgtagcggcctcggtgctcgtgctgtaccttcggcgtcgttggggtcacgccacgatcccctcctgagtgctaacttcacccatgatccctcatagagatgttgagtcagttctgacaggatacaagaaagaaccagagtctgaatcacaactagaaaagcttttgccatatatcatttcttctttcagtcctgataaatcagtagctgaatctgtggaagagctaaagaaatgtagtcgaagtggtgatgctgcagtggcagaatgggccaatgaagctttagcaggaattgagaaaggtgctccattttctctttgtttaacacagaagcatttctctcaagtggcatcagcgtacaggactagtgaacactatttatctaagctcgctggtgttatgaaattggaataccgcattgccttgaggtcgtcggttagaaatgattttgttgaaggcgtacgtgctgttttagttgacaaggaccagaatccgaagtggaatccagccactctggaagaagtaaacatgggcgaggttgaatctgtttttgagccattaggtgctgaggctgagttgagtgtgtgaactttccatggcctgccactatctgaacatcagttttcttattggtggtgcaataataatctacaaaacagaaatgtgatgcccacagaacgaacaattactgtttctaaataaactaactgaagtggttccattttcttgaaagggcacatgaaaatctaggtctgttgcctgctcttttgtctccaatatggttcccctgtttccgctgggatattccagccatggtaccaggagtgactcgactaaatgctctagaagtgtgtgtgtcacgggtagagctttgtgttacatgtagtttgatgtgagtagtgtaataataactgggtacgaaaaccatggtttcgccagcaaaaaggcgtgtttagaacaagtgtacaacagacgtgctcaggtatcatatgaatatattgcaaatgctaca

SEQ ID NO: 12682 - DNA, 1152 bp, Sorghum bicolor
  Clone ID: SORBI-28MAY03-CLUS7985_1
gccggccgggttccggcttctctaggcagtgccagtggtgaggtgagaggcatgtgaccctcttcactcgcttgaccctcttcatcactcgcttctccaagaagacacgcaccaaacaccaccctagagaaggcgagaacgcactccgtccctcccctccaggaccgtctcctcgcccgctcctctcttccgtttctccccttctctgggctcggagaatcggagagaggcacgcgcggccatggcgtccagcgcctctcggttcatcaagtgcgtcacggtcggcgacggcgccgtgggcaagacctgtatgcttatctgctacaccagcaacaagttccccactgactacatacctacggtgttcgacaatttcagtgcaaatgtagttgtggatggcaccacggtgaatttgggcctttgggataccgctgggcaggaagattacaaccggctgaggcctctaagctaccgaggtgccgatgttttcgtgcttgcattctcacttgtgagccgagctagctatgagaatatcatgaagaagtggataccggagcttcagcattatgcacctggtgtgcctgttgtgttggtaggcacaaaattggatcttcgtgaagacaagcactacttgatggaccatcctgggttggtgcctgttaccacagcacagggtgaggaacttcgtagacaaattggtgctatgtattacgtcgaatgcagttcaaagacacagcagaatgtcaaagctgtgttcgatgctgccatcaaggtagtaatccagcctccaactaaactaagagaaaagaagaaaaagaaatcacgcaagggatgttcaatggtgaacctcttctgtggaagaaaaatgctatgcttcaagtcctgaatgatctaagagggtcgtacatgaactaataccatgagtgtggccccaagtttgtgaaacttgaaatctcgatgtgcttgttgcgcatgtgtatatttgcacctttggttattaatcactagaggtagatgattgaaactagtctgcttaagcgatgtgcactgctggtgtggttagctctactgtatgagttaggcagtcagttcgacagaggccaaagagacaatgagattttgttctttcatggcaatgtcacagcttttgtg

SEQ ID NO: 12683 - DNA, 954 bp, Sorghum bicolor
  Clone ID: SORBI-28MAY03-CLUS80199_1
gcctggagtccagtgtccgggacccggcgcgacgtgggtgcgccccccccagcacgacacggctgctcgcggccgcattgggtcggggtcgggggaaggaggcgcacgaggagcgatggcctgcctgcacgatcacagctgcgaggatcacaactgcgccgccgactggtcgctctacaaccacgtcgacgtccccaaggtggtggctctgaacgaatctgtgcccgggagcgtcaagtccgtcttcaagccctgggagcagcgccttgacacttcggggggttttctggagagtaatgacggtgaccctgagcttcttattttcagcccgttcacatcagatgttaagatcaagagcatttctgttgttggtggtgctgatggaacatccccgtcaagaatgagcgcgtttataaatagagaaggcattgacttttccgatgctcaaaacatgcagcctgtgcaggaatgggaattagcagagaacctgcaaggagctcttgagtaccaaacaagatattcaaggttccaaggtgtggctaacctaactctgcatttccctgacaactttggtggtgatacaactaagatttattacattggactacgtggtgaagccactcagaacaaaagggatgtagttgcgacaattgtatatgaagtcatgcccaatccttcagatcacaaaacaaaatctgagactggaggaggtttctcgcatgtcgagtagacatcatacaagagcgtgagaagcagaagctgggtactgcgttgcctgaaggaaaatttgaacctcgcttcccatcaatcaagaataagataaatagataataccagctggtagacttttagcttgacttttgagcacttaactctgtacccgtggacgctgtagccggtttgctaatgctatcatcagagtgggtctcgtgtgttgttactttatttttggta

SEQ ID NO: 12684 - DNA, 821 bp, Sorghum bicolor
  Clone ID: SORBI-28MAY03-CLUS80237_1
gcacgagggaacgtgcgtccggacctcgtcaagggcggcggcggcggcggccggctgccgtcggagttcgcggccgcgacggagggccggagcatgctgtcgacgtggtgcccgcaggcggcggtgctggagcacgatgccgtgggggtgttcttgacgcactccgggtggaactccacgctggagagcatctgcggcggcgtgcccatggtgtgctggcccttcttcgccgagcagcagaccaactgccggtacaagcgcaccgagtggggcatcgggatggagatcggcagcgacgtccggcggggcgaggtggaggcgctcatacgggaggccatggagggggagaaagggcgggagatgcgccggcgagtgacggagctcaaggagagcgccgtggccgcggcgaggcccgacggacgatccatgcgcaacgtggacaggctcatcgacgaggtgctcctagcctgagcctgagcattcagcatcctccctgtggctctctttgttctccgtggacaggaactgtgctcctagctagcttgagcattcaacatcctccgatcatacggtatcatatccttgtttttattgtgaaagtggcaacgatgtcgttgcacatgggagtatatctctctcgatgttggaggtgattaacaaatcactaaagctaaatttggcaagagatctatagtagctaaatttggtaagagatctgtagtatgtaaggtcttattataaaattaagaacatggtgctcttgtccaatttattagggcttgtttatatacaatgatgactaactgatccagctagctaaa

SEQ ID NO: 12685 - DNA, 1635 bp, Sorghum bicolor
  Clone ID: SORBI-28MAY03-CLUS8098_1
gcacgtgggcaaatccccccaccctattcctatgttcctacctcctccgagccagtaacatcgctacctttgctggccggacgcatcgcctctcctctcccgcagtatgtttccatggcatctgctctgcttcgcgggtggccacgagggcttgcgggacgagttttcccactcttggcagctcccaatccactagtccgttgtgtttcccgattttttcatagaccccggaacgtggccaccatcagtcgagtaaaaggggatgagtctagaaaaccatacacgcgccatcacaactcttctgtcaacttcattattttttcccaagacaacatgtattctgggatcacccatggcattaaaaacattgagacaagcggcacaatcgcgcaggtagccgaaggtgagagaggtgacaaagatgcttcgcaggtagctggagatgagagaggggacaaagatgcttataggactactaagcacacaggatgtttggaagacctagaggatcaacgggggaaacatcttgtcagtgacgatgaagaaataagtgaggacaatggttatactttgagtaatatacttgaaaaaagcagacactgtgatggttctatatacaggagtatggatatatggtggaaaaaacagtatcgcattgcggaacgtaatgagactcgggtggaggcaatgatgttttcagatcccacaaatgttatcatccgcaatggaattcgcatgcaccatggccgtgcttgcatgctgcaaattttatcattagagttggctgaaatttctgtggatggtggcttagtagagttgtatggatacatagcagtgcgggatgaactggatccattgcttaattatatcatcaatttcagcagggatgatcccatcgttgtggagcagggttctctcatcaacatggctggccctaagcgagcgatagatttttttgaccaagctctaatcgaatatgacatgaggatcaagacaggtgaacaagaaaaagatgacctacagctgattgatggcgcatcaatcataggcccttcagtcatgtgggatcgcccattcacatgtcgcttcgctggtgattgtggtacagttaagttaactgccgcacgtctttatgatgcagttgaggctactgtagaggtcctaatattggaagtacagaaaaaatttaatttgtctgttggttgtataaccagtgatttggatgaggaaatccgactctttaacggtgctatcatggagtcacgtgcgttaaagaggtcggtggttgctgtaacgatgtattattcgttagatttgaagttcaatgtaggtgcattgtcatccagtttggagcagcatttttgttccttcaaggccaaaacccatggccatgatgttcaagaaataaagactggttttggattaatctcagtaaaggtgacttggtcaactatgctgagggggtactacggtgatgcctgatagctttcctgtgcctgtaatgagtgagccaagagactaaaaacttgggcagttgagtggtggacttgtagctgtgcaaacttgattttaactttgtttaataaggagcattgtaactctggtaatatgtggtaaaactttatcatacatatt

SEQ ID NO: 12686 - DNA, 1906 bp, Sorghum bicolor
  Clone ID: SORBI-28MAY03-CLUS6767_1
gaggctacagtcaaaagttaccctccatttattgaagctatgaagagaagaggtgtggatgacatggatcttgttatggtggatgcttggtgtgctggctactacagcgaagctgatgctccaagtcgcagacttggcaagcctctcatattttgcagaactgagagtgatagccccatggagaatggttatgctcgtcctgtggaaggaatccatgttgttgttgatatgcagaataatgctgtgatagagtttgaagataggaagttggttcctcttccccctccagatcatttgagaaactatactcctggggaaacaagaggtggtgttgatcgaagtgatgtaaaaccacttatcatcaatcagcctgagggtccaagtttccgcattaatggctattttgtggaatggcagaagtggaacttccgtattggcttcacccccaaagagggtttggttatctattctgttgcttatgttgatggtagccgtggacgtagacctatagcacataggctgagctttgttgagatggtcgttccttatggagatccaagcgaaccacattatcgtaagaatgcatttgatgctggagaagacggacttggaaaaaatgctcattctcttaagaagggatgtgattgcttggggtacataaaatattttgatgcacatttcacaaacttcactggtggtgtggagacaattgagaactgtgtttgtttgcatgaggaggatcatgggatcctttggaaacaccaagactggagaactggtttagcagaagtaaggcggtcaaggaggcttaccgtttcatttatctgtacagttgcaaactacgagtatggtttttactggcacttctatcaggatggaaaaatagaagcagaagtaaagcttactggaattctcagcttaggggccctgatgcctggggaatcaaggaaatatggcacaactattgcccctggtctgtatgcaccagttcaccagcatttctttgttgcccgtatggacatggctgttgattgcaaacctaacgaggctcataaccacgtggttgaggttaatgttaaagtggaaagtgcaggcacacataatgtgcataataatgctttctatgctgaagagaaattgttgaagtctgagttgcaagcaatgcgtgattgcgacccttcatctgcacgccactggattgtacgtaacacacggactgtaaatcggactgggcagccaactggttacaggctcgtgcctggttcgaactgcctgccattggctctgcctgaggcgaaatttctgaggagggctgggttcttgaagcacaatctctgggtgactcaatacaagcgcgacgagatgttccctggaggggagtttcccaaccagaatcctcgcatccacgagggtctgccaacatgggtcaagaaggataggcctctggaggaaactgatattgttctctggtacgtgttcggtctcacccatatccccaggctggaagattggccagtcatgccggtggagcatataggcttcatgctcatgccacatggattcttcaactgctcacctgcggtcgacgtgcctcccagctcgtccgatgcggatgtcaaggaagccgagtcgcccaaggccatccaaaatggcctcgtttcgaagctgtgagctttccaagggagaaatcagcgcgcggctgctctgcctatattttatcgtatttctcgaataaaaggaaaactgcacgagatccgtttgtttgctgtttggtaataacgttctgttagctacacttgtttctctttttttctaaaattggatttctatgcttgtcaatcagcgggctgtgaagctttacattgctcgcgtactaataaaatactgtttggacttgcttaatagc

SEQ ID NO: 12687 - DNA, 732 bp, Sorghum bicolor
  Clone ID: SORBI-28MAY03-CLUS6801_1
gcacgaggggtagccctgtccctgacctgaccctgacccgtgcgttgcgcctcctcgcagacggcgccaggagccgcctcctcgccttctcgccatcggccggcggcgacggtggctgcttccccgagcccgcaggtagaccacctttagttggttcctcgagtcttcacctggtgcttcagtttgcagcttcatttttaagatgtcacaagccagggaagtgaggtacactgcacggtctattacacctcctgctgatagaaatggcacctcaagctcgcctcctccaaagagacgcagcccttcaaggtcacctccaccaaagagtgcttcacggtccccacgtccaaggagtccaaagagacgcagcacttcaaggtctcctcctaggagacgtggtagatcaaggtcaagggatagaagtcggtccaggagcccagatgatagaaatccagggactaacctttatgtgactgggttgtctactcgtgtaactgaagaagatcttcagaagttctttagtaaagaaggaaaggttaaaaactgtcatgttgttcttgatcctaggacaaaagaatcccgtggttttgccttcgtgactatggatactcttgaagatgcaagacgctgcatcaagtatctgcaccgcactgtacttgaaggtcgcctggtcactgtagagaagtttacatggtgctgggctgcctctacgtcaacctggttggtccaggc

SEQ ID NO: 12688 - DNA, 1381 bp, Sorghum bicolor
  Clone ID: SORBI-28MAY03-CLUS6757_1
gcacgggccgcgccccccgcttctcgcgcgtcgccgcgcgtcgcgcacccaagcagaaccacgccacgcgcggtgcacagtgcacgcagctcccacttccgccagtgccagccgctcttgttgtcccagtccaggagtggccgccagccgctgcactgcacacacgccctcgcactcgcattcctcatcactctctccctccccatcgaccatcgtctccgaatctctctatcttcttctctctctaccggcaaggcccgctgtctccgtccggagctctctcgcgtgctcgcagtcgcaggcgcgtcctgggaggagaccttcgcttcgtccgtggcagagggtagtagaccatgaaggcgctggtggtgacagtgcttctcctgctctcctccaccctcgccgtgtcacagtggtgcgtgtgcaggcaggacgcgacgcaggcggcgctgcagaagaccatagactacgcctgcggctccggggcggactgcaactccatccatgagaacggggcgtgctacaaccccaacaccgtcccggcgcactgctcctgggcggccaacagctactaccagaacaacaaggccaagggcgccacctgcgacttcaccggcaccgccaccctcaccaccagcgacccaagttcttctggctgctcttaccctaccagtgcaagcgccgctggaacgatgaccccgaccactggaggcacaatgggaggaaccccagggaccttcacgcccgggacaggcacaggcacaactggcactggcatggggacaggcactgccaccggaaccaccgggttcggcggcctaggaccaggcacaaacgctggcatggacacagcggcagcagcgggcttgctcctcccaacggctgggctggccactgccctcgctgcgctcctcttctcagccatcgtgctcgcatgatcgctttgatatgacctcagaaacaagaccctacctgctagtagaaagcacaacaacccttttggtaaggggcatttcaggagtactctaatgatctatggagaaagggagaaccgaaacctaatgcatcctatctgaaaacccactagcgcctgcttcttgttcggtgcagcctgggggagctcatgggtggggtgccctttcgtttgggctcctctgtgaccgcctcaagttctgtgtattactctgtaatctggtaggatgtctgtctctgtcatgcaaggccaattgtctgtcttttttattctctgtggttaatcatgtaaatgtagggaaggtcctgctaggttaattagttcttcaaggctggctggctggaatgagaatgctgctatttggccaaacaatgccgtgctttttttcatcaacttgcagtcatcaaa

SEQ ID NO: 12689 - DNA, 410 bp, Sorghum bicolor
  unsure (1)..(410): unsure at all n locations
  Clone ID: LIB3476-024-P1-K1-B7
actgaagttctccccaaaaacaactttcctttttcaaaatccctttctgtgcttttgcttaactgaaatgcagcacacagcttacacaaaaggctcagatttccgttggagcacatgcctagtgaaaagtgctgttctctcttcctttgcgtgtgcaacgtctgcttgctgtgctcacgctgtcccctgaccatcgcatttggtgacatccacataccacatccaacaagaaactgatgcgggagaaccggcgcgtcccctggaacgcccaggccaggcgttcccttcagtctctctagcagttcgctaaccaaaaatctttggtgcaaagtggtgcgtgtgcaggcaggacgcgacgcangcggcgctgcagaagaccatagactacgcctgcggctccggggcggact

SEQ ID NO: 12690 - DNA, 1461 bp, Sorghum bicolor
  Clone ID: SORBI-28MAY03-CLUS691_1
gcacgcgtgtcgtcgtctcttttttctttgccagtgaggacagctgccatggcgctgggggatgaagtacttctgggacaccttgctggaggctgaccttgagagtgatgcactaggctggcagtacatttctgggtctctccctgatggccgtgagcttgaccgcatcgacaaccctcagtttgaagggtacaagtttgatccgcacggggagtacgtacggcgatggctaccggagttggcgaggctgccaacagaatggatacaccacccctgggatgcaccatcctttgtgcttcaggctgcaggagttgagctaggctccaactatccacgccccattgttgagttagatgctgccaattccaggttgcaggatgccctgtctgtgagttgggagcttggggcagcctctcgtgctgcgatggagtatggaatggaagacggacttggcgattccacaagtgaaccgcagatagtcttccctctacaattacggatggaagtggactgactgccggctcaacctgctatccacacaccggcagtggctggtatgcagcttcctggatgcaatgtgcctagcatgacgccagttgtcattaaccttgtggtatagctcactgggtgtcctggagatatgtgttattcgtcagataagagttttctagcatcaggttcattgcgggctcgggccgggtgggaagcataagtcagtggtggctctggcaatactgtcaggatgaatggcaaccatcagcagcagaatcttcagaacaacatgcaccgtgtgctaggtattgctccatcagtttcagaggcatcgagcagctggacgggcagggaaggtggagtggtaccggtctggtcacctccggcagcttcgggacattctgatccttatgctgccgatgaggctgacatttccagtaggagttatttggacaggcatccacaatcacatacgatgatgaactggagtcaactctctcagtcattgacaacagggtgggaagtggataattagtgctgtgagtccggattttaattggttaggagttcagcagagagaattatttatatacatatgtaaactatcgcattttgtttgtctatagcctttccttggtgtgcatgcaagtcatcaatcatgcagcttcctggatgcaataatggttatgtgaagctagttgtatagaaccttgtggtatagattgctaggtgtccacgagatatgtattattcgtcagataagagttttctagcatcaggttcatttggtatttgtatctggttgttgtcatattgcagtttttggtgatgggatagtcaacatagaggtgtgttctcagtttggtagacatagaacttacctgctatctgtgaggactcaaagggaacatcttggcagtgagattgtgtgccattcttgcctgctgctactttgcctcaataaagaag

SEQ ID NO: 12691 - DNA, 1053 bp, Sorghum bicolor
  Clone ID: SORBI-28MAY03-CLUS6931_1
gcacgaggccgcggcaaaagtgaggcgcgggcgggcgagctgggggagagggagacgaacccatcataattccatcggtgctcctgcgtatataagcgcggcaatcgggacgccgggcgaggaggtgttcattcctcatccatcccacgccacgcgcgcgcaggccaaggccggatcgggctctcagtcagatctcgcccggcggccacgacccgagagagagagagagagaaagaggggggttggccggcgatcgggagaagatgtttagcgggacgcagcagaagtgcaaggtgtgcaccaagacggtgtacccgatggaccagctctccaccgacggcgtcgccttccaccgctcctgcttcaagtgccagcactgcaagtccaccctctccctgagcaactattcctcgttcgaaggagtgccgtactgcaaggcccatttcgagcagctgttcaaggagaccgggagttacaacaagagcttccaatcacaatcacccgcaaagattactccggaaaagttggcccctgagctgaccagatcaccaagcaaagctgcaaggatgttttcaggaacacaagacaagtgtgcgacttgcggtaaaaccgcatatcctcttgagaaggtaacagttgaagaaaaggcataccataagtcatgcttcaaatgctcccacgggggctgtgcgattacaccttccaactatgcagccttggagggcatcctctactgcaaacaccatttctctcaacttttcaaggagaagggaagctacaaccacttgatcaagtgtgcttcggtcaagcgcgctgctgaagcacagccagaacaaccagcctccgattcctcctgatcgtgccatttcaacagtgggggtttgaaggcgagagttgggaagcctcctgtttttacttaaaaacgcatgctgtatgtcattcatctatgccctgaggataccggactatctattttggtatcctttgctgtgctagctggatcacatcggtgaaccatggaactgatgtcatttccaagtgatgtggttgtgc

SEQ ID NO: 12692 - DNA, 669 bp, Sorghum bicolor
  Clone ID: SORBI-28MAY03-CLUS6955_1
gcgctacgcccgtggctgtctgcttgtcttgcccccctctcgctctccgacgactggtgcgccgcgccgccgccgccctaagccaggtgctgaggctttatttcgtctcttcgccggcgaacgagcacccacgaggcgtagagagagatggcgagtctaaccggcctcgccgcgaaccctaatccgaacaagtcattcgagatactgccgaacccgggtgactccgtctccagcctcagctttagtcccaagagtaatctgcttgtggcaacctcctgggataaccaggtgaggtgttgggagattgttggtggcaacagtcagccaaaggcatccatatcacatgaccagccggtcctctgctccgcttggaaagatgatggaactactgtcttctctggaggctgtgacaagcaggtcaaaatgtggcctctgctgtcaggtgggcagcctcagacagttgcgatgcatgacgcgcctgtcaaggaggtcgcctggattcctcagatgaatcttcttgtctctggaagctgggataagactttaaggtactgggatacaagacaagcaaatcctgtgcatatccagcaacttcctgagcgttgctatgctcttactgtgaattatccccttatgattgtggggactgctgatcgtcatcttgttgtc

SEQ ID NO: 12693 - DNA, 1080 bp, Sorghum bicolor
  Clone ID: SORBI-28MAY03-CLUS8837_1
cgcacgaggctgacccgatcaaagacgtagctgcccccaaatttcccctcgcggagccacgcggatcgagtccccgtcgaattcgcctctgccacctgctcgatccggtggccgcgaactcgccgctgtcggatcgtttccgccggggtgattaagctacgggatttgtagagatctaggcgagccgcgggcagcagccatgagcgaggtgttcgagggatacgagaggcagtactgcgaggcctccgcctcgctctcccgcaagtgcaccgctgcctccgccctcgatggagagaagaagaagcagaagctgtccgagatccaatccggcatcgaggaagctgaatcgctgattcggaagatggacctggaggcaaggagcctacagcctagcataaaggctggtttgcttgcaaagctgagggagtataaatctgaccttaacaacgtcaagagtgagcttaagaggatatcagcgcccaatgccaggcaggctacccgggaggagctcctggagtctggaatggctgatactcttgcggtgtctactgatcagaggggaagattgatgatgacaactgaaagactgaatcagtccactgacagaattaaagagagccgaagaactatgttggagacagaagaacttggtgtctccattcttcaggaccttcaccaacagcgacagtcactactacatgctcatactactttgcacggagttgatgataacattggcaagagcaagaagatcttggctgcaatgtcaaagaggatggataggaacaagtggatcattgggggaattatcacggctctcgttctggccatccttctcatactctacttcaagctcgctcattaagcctgcctgcaggtaggttatccccacatatctgtgttcagtaattgtgtgataagagttgtctgaatgatgtgtattgagcaacacgtgtctctcggagcatcatttgttcccccccaaacctgtaaacttccgtggctcatgttgtgtacagtcaagatacttccaactatgtaaactgtctaaagagtgaaaaaaaattactggtgtggagt

SEQ ID NO: 12694 - DNA, 861 bp, Sorghum bicolor
  Clone ID: SORBI-28MAY03-CLUS895_1
atccacaatcactgcagtacacagcacatttgcaaagttgtagttcatcaaacgtagcggctaggtgtagcgctatatatagctccatctgctgcgacgacatggcgggcaccaccaggaggagcaggaagtcctcgtcgtcgagctcatcggcgcagcagcagctggctgccggcgcgctgcttgtggccgttgtcgtgttggtggcggcgtcgtcgtcgggcgtgctggtggcggtggaggcggtgtgcgacatgagcaacgagcagttcatgtcgtgccagccggcggcggcgaagacgacggacccgccggcggcgccgtcgcaggcgtgctgcgaggcgctggcgggcgcggacctcaagtgcctgtgcggctacaaggactcgccgtggatgagcgtgtacaacatcgaccccaagcgcgccatggagctccccgccaagtgcggcctcgccacgccacccaactgctagccatgctaataataagctaagcaagggcgctggcctggctagcattgccctacgttgtactacgtgtgttgttgcattatatatatttattattactgtgtgtacatctgcagcaggagggggcccggccgtacgtacgtgccacatcgatcttgtcacgtactaacatgcatatgttcttgtcgtgtgtgctccgtgctggcgtgtgtgtgtgtgtgtgtgtgtcgtcgttggtacatcttgtcacgtactaacatgcccgtggttggtttgttggactgtttgtgcgtacgcgcgcatgtgtgtgatgtgtacttcggtagtgtgggtgactgcctggcaaaagttgcatcttgtgccctctcgctcgctcgatctctctgta

SEQ ID NO: 12695 - DNA, 1484 bp, Sorghum bicolor
  Clone ID: SORBI-28MAY03-CLUS903_1
gaatgcatctgcaaagggaattcaaatggaggaaccttttgatgtgtttgaagagagcccctctatgaggcgtgcacccgtgtcgagaagagtggatgatatgtttgggcagataaaatcaaaacttcctggagctcctaggttcctcatgtgccttctccctgagaggaaaaattgcgaagtctatggtccttggaagagaaagtgcctggccgagtttggtattgtcacacagcgtctagctccaacaagagtcaatgatccgtacctgcttaatttgctgatgaagattaatgcaaagcttggtggtctgaattcgttgctgcaagttgaagcatctccatcaataccccatgtgtcggaagtacccaccatcatcttgggtatggatgtgtctcatggccatccaggacaagataggccttcagttgcagccgtggttagttctcgtcaatggcctcttatctctaaatatagagcatcagtgcacacccaatccgccagactagaaatgatgtccttcttgtttaagccacggggtactgatgatgatggcctcattagggaatcactgattgacttctacactagctctggcaagcgaaaaccagaccacattatcattttcagggatggagtcagcgaaagtcagtttacccaggtcatcaacattgaactggatcagataattgaggcatgtaagtttcttgatgagaagtggtcacccaagttcactgtgattgttgctcaaaagaaccaccacaccaagttttttcagaccggatcaccagacaatgttcttcccggaactgtcgtggacaataaagtttgccatcctaagaactttgacttctacatgtgtgcacatgctgggatgattggaacaacaaggccgacccattatcatgttctgcacgatgagataggtttctctgctgacgaaatgcaggagtttgttcattcgctctcttatgtgtatcaaaggagcacaacagccatctcagtagttgctccaatctgctatgcccaccttgctgcagcccaggtgggcacgttcctgaaattcgaggagatgtcagacacgtcctccagccagggagggcatacctcggcgggcagtgctcccgtgccggagctgcctcgcctgcatgagaaagtgaggagttccatgttcttctgctgatgtgatggtccatcaggatctgggagcgtttgaactgattttggttagcggtagtgatgtgtatgtgtgtgtgtgtatggcatgcaaccagcttggaaccttgaaggctcgcttgttgtgccaacctgacttagctgctggatgcctgaatgtagaggcttttgtaggagaaccagtcagcagtccttgtgtatgcggtgttactgtcagcagctaacatcctagtaaagtttgtctgtggtgtaatgaaccttcacttgataaccttcacttgatgctagctaagctcccctatgggttg

SEQ ID NO: 12696 - DNA, 758 bp, Sorghum bicolor
  Clone ID: SORBI-28MAY03-CLUS9072_1
cgctgatgcttttctctctcctcctgcctccggctccacgccacacacaggatagcgagagcggcagggacggcggcgccgagctagggttttgatccggcctcgccggccagaggctacgccgccccgccgccgaagccatggagagggagctgctggagacgttcgatgcggccaagaaggcggccgacgctacggcagcggacggcgactcgccggaggctgaccgctgcctcgacgcgctgcgccggctgcgcgacatacgcgtcaacaccgacatcctcgtctccacgcaggttggcaaacgtctccgaccccttactaagcaccctcactcaggcatccaggcggtcgctgcagacctttttgggtactggaaaaaggttgtccttgaagagtcaggaaagaaaaatggtggctcagagaatgaaagatcaagtgactcttctggaaaggttgagaaggtgagacccatgaaggttgaaaagaattctgcatcagcaagcatgaaggttgagaaaagagatgtggatgttaggggtcagaagcctggcagtgtcaaagttgagaagaccgctagcaatggttccagaactcaatctgtgaaggtcgaaagggtatccaaagaagtcagtagaactccagatgcaaagaagccagcatccacccccagcggtgccccaaagcttacatctcttgtcaaatgcaatgatcctactcgagataaaatccgggaactacttgctgaagcttttgca

SEQ ID NO: 12697 - DNA, 1185 bp, Sorghum bicolor
  Clone ID: SORBI-28MAY03-CLUS8925_1
gcacgaggcgagagagagagagagagagagagagagagagaggggagagagagaagtaagcagcagccgagtccgagcatctctctatttccctcgcccagctctcagatccgaagcccggaaggaaatcgcgccaacaggccctagccccagatgcgcgccgccgcttgctacaggcgctgctgctactgcttctagggggtcctgcggagatgctgggcgtcgagcccgagggcagacgcggcgcgtccgcctccgccgccgcggcggggtggggcgcgcggcgccttcccttctcccggccgccgcctctggcggggtgccagctcgggggctgcgggggtgccggcggcagtgccgcctacggcgctgctgtcgggggggaagcaatctggcggttccggctgtccgctggtcgcggcggggttccttatgttggtgattactaccatcaagctggtatggcaaaaagaggcgccacgtctaagcaaagcaccagtttctccccaacatcaatgaaagatataccatccaagtctcgatccagcagtgatcagcacacatatcttcaggttgatgctcttggaagagtatctttctcttccatacgtaggcctcggtctcttcttgaggttgaccatccttcatctgctgatggctcccatgatcagaagtctactgtgaggcccctggagaaagaaccaatgcttgcagcaagagtcactgttgaagatgccctttgccttcttcttgaggttgatgacactgaccgtctgttgcagtctagccagtcacaggacaacattttccaactgaagcggagacggcaagtcctcctggaaggtctagcagcatcactgcagtttgttgatcctctcggacccagcatatctggtcattcatctgggttagccctgaaggacgatgttgtttttcttcgcattgtttctctgcccaaaggacgtaagtttttagcacgttaccttcggcttcttgtccctggcagcgagttgacccggatagtatgcatggcaatttttcgccatttgaggttcttgtttgggggtttgccatcagactctagtgcagcagaaactacagttgctcttgcaaagactctttcatcttgtgtgcatcacatggaacttggtgctcttagtgcctgccttgctgctgttgtctgtt

SEQ ID NO: 12698 - DNA, 545 bp, Sorghum bicolor
  Clone ID: LIB3476-055-P1-K1-F7
ccgaagcattagtggaacccggaatcctggtgttattggggacaggagatccatttcacgaggaagttctttaactgttgactgggctgaggatgtggagttttcaaactggggagatcaagacgtatttgaaaatgaggaattccacgaaagtaaaagatggtggtcatccaattcttcagttcagcaaggggattctaactccagaccactaagtcgaacatcttcctaccctcagcagccactgcagcaccggtcaagtgaacctatcgttttaccaaagacatcttcatttacctcattcccaccacctgttgctgctgctggtggtagatccccttaccctgctcaaggccttacacgtcatgggagcattccatcaattggtgctgggctccaaatgggttctccaggcatgtcactttctgcttctccataccatatggtcggaccatctcatgggctgccatacacaggaggaatgccttatggtgctcttaacctgcctgtaaacaaatctgtgcaaaatgattggtcgaaccatg

SEQ ID NO: 12699 - DNA, 979 bp, Sorghum bicolor
  Clone ID: SORBI-28MAY03-CLUS7404_1
gcacgaggatcaggaggcagcacaaatccacgcaccgccgcgtaaccctagtctttacccgcccgcggcagcgccgagcagattctcctccttcgcggcgctcaggctcgggccctcggcgacggaggggcagtaccaggctcggcggcgacgtcagcggctccccctcccgcctctcgccagtcgcctcgcgccctcgcctccgtcctccgcgcaccggccggcgatcctgcgcaggagacactttctattgtatgagaggatcaatgtccaattattatgatgactacgatgacattgatgagatggaggatgaatatgatttggatgatcctgctgatgacatggtagatgagcagcgagggattagggattctgatgcggaggataatgattatggacaaccaaatgataagatcccagatacttcatcagtggacgcaagaaaaggaagggacattcaaggaataccctgggagcagataaacataacccgtaaaaaatacagacagtccagattagaacagtacaaaaattatgagaatgtacctaactctggagaagaagctatgaaggattgcaaaccaacagagaaaggtggaatgtactatgagttcagacgaaatactagatcggttaaatcaactattctacattttcagcttcgaaatttggtatgggctacgtccaagcatgacatctacctagtatcgcattactcaattcgtcactggtcagcattgagtggtgtggatactgaacttatcaacgtccaaggacatgtggcaccaagggagaagcatgcaggaagtttattagagggtttttctcagactcaagttagtaccttggcagtcaaggacaatttactggtagctggtgggtttcaaggagagctaatctgtaaacaccttgatcgggaaggtattagtttttgctgtcgaacaacttatgatgataatgctattacaaatgcggt

SEQ ID NO: 12700 - DNA, 502 bp, Sorghum bicolor
  Clone ID: SORBI-28MAY03-CLUS7224_2
cggacgcgtgggttctctcgttcgctctctctccgcgacgactcggctaccgctctacgccaggttcccacgtcttcatcaggcccttctccaagcacccaccagttaattgcagttttcgctaagcgtctttgggatatcaagtttgttgttgtccaagaagaagaaatatgcaggcttctagggctaggcttttcaaagagtataaggaggtacagagagagaaatcagctgatcctgatatccagttgatttgtgatgattcaaacatattcaaatggactgctctcatcaagggaccctcagagactccttatgaaggtggtgtcttccagcttgcctttgctatcccggagcaatatcctctactacctccccaagttcgatttctgaccaaaattttccacccaaacgtgcatttcaagactggtgaaatttgcttggatatcttgaagaatgcatggagccctgcatggaccctccaatctgtttgtagggctat

SEQ ID NO: 12701 - DNA, 928 bp, Sorghum bicolor
  Clone ID: SORBI-28MAY03-CLUS7224_1
cttcccccgattaccttctccgacggcacgaggccaccgccgctgcagcagcagctcctccctgctctccggtgactttccccacgccggagtcgagcccccggtgccataagcccaagcatttagtgacgcctttgcctatatcagccctgtggtcataactctctagcagagaaaggagaagatgcaggcatctagggcaagacttttcaaggagtacaaggaggtacagcgagagaagtcagctgaccctgatatccaattaatatgtgatgattctaacatattcaagtggactgctcttatcaagggcccttctgaaacaccttacgaaggtggtgtgtttcaacttgcgtttgcaattccagagcagtatcctctgttgcctcctcaagttcgatttttgaccaaaattttccacccaaatgtgcatttcaagacaggtgagatttgtttggatatattgaagaatgcatggagccctgcatggacccttcagtctgtttgtagagcgataattgctctgatggcccatcctgaaccagacagcccacttaactgtgattcaggcaatctcctgcggtcgggtgatatcagaggctatcaatcaatggcccgcatgtatacaaagctggcggccatgccaaagaaaggttatgctgtagaacatatgccaggccaagagcatatggcagtccatgcatcgctacatgttgtcaggtctgccttgtgctgtctatgaactttgtggttcttgtttcctaaatcctaaccattcatatgcgtgcgtgcgtgcgtgtgtgtgtgtgttttcttgggtagatgggacaaaacctggattcctgatgcttggtctgtgatgtaataataagtcctggaattcaacagttgctacaactgatctattgtagtgctctgtatttctgtc

SEQ ID NO: 12702 - DNA, 1513 bp, Sorghum bicolor
  Clone ID: SORBI-28MAY03-CLUS77950_1
acctttgtccgttgcctcaacgcaagtctactacccccgccggtctcctaccccccagatctgcccatccgccatggcgcctccaccgcaccgccacctgctgctgctgctgctcctcctccccctcgtcctcctcgcggccacacctgccggcgctgatgaccttgtctcggagctccagtccctccgcgcgcggtccccgtccggcgtgatccacctcaccggcacgagggtcacccgtttcctcaccgccccctcctcgcgccgcccctactccgtgctcgtcttcttcgacgccgcttcgctccactccaagcccgacctccacctgccccagctccgcaccgagttcgcgctcctctccgcctccttcctcgcccacaaccccgattccggcgacctcttcttcgccgacatcgagttcgccgagtcgcagcactccttccaccagttcggcgtcaactcgctgccccatgtccgccttatccgccccgagcacgccaccctgtcgaaatccgagcagatggaccagtcccacttctcgcgcctcgccgactccatggccgagtttatcgagtcccgcacgggcctcgaggttgggcccatcgtacgcccgccgctcctctcacgcaaccagatcatcctgctcggcatcctcttcctcatctccatccctttcatgatcaagaggatcatcgatggggagaccctgctgcatgaccgccgggtctggatggctggggcgctctttgtctacttcttcagcgtctctgggggcatgtacgggatcatcaggcacacgcccatgttcctcaccgaccgcgcggatcccaacaagctcgtgttcttctaccaggggtcagggatgcagctgggggctgaggggtttgctgtcgggttcttgtacacactcgtgggtctcatgatcgctggggtgacacacttgttggtgaaggtggagagcctgcagacgcagcgatttgcgatgctcgctgtcatggcgattgggtggtgggctgttaggaaggtgatctacttggataactggaagactggttatagcattcataccttcttcccgagcagctggaggtgaaattcttgccgagtgggatggatgctttcctttactttcagagggtatgaagtcgtccaaattgacatgccaaaagtttaaggttgcagtttctcagctgctctagtatgaaatagagagagaactcaagttattttagctgaattttcaattctgttactcaaaaagaaaagtcccaattttgaactcctatatatgatgtggtacttttacttggtttaacaagacaagggtaaacttagttgatcatgccctgcttacagcctttggatgatcactgcattgaatgatctggtctggaagtttggtatggacttgtggtatctggattgtatccagggaaattttgtccatattgtgatatctggattgcgaggctgtcgtacagatatttaaagacattatctgccgttcttg

SEQ ID NO: 12703 - DNA, 654 bp, Sorghum bicolor
  Clone ID: SORBI-28MAY03-CLUS750_1
tgtgcggcgctcgaccgggaagagaagcaatcgaggttgacccgaccggcagccgaggaccgaagtgcccagcaccaccccctccgcccttccgccgcgaacccgccgctgtgtcggccccctccccagcaagatggccgagattgagataaaaacagcacctgctgacttccgcttccctacaacaaaccaaacaaggcattgttttactcgctacgtcgagtaccacaggtgtgtgaacgccaaaggggacgatgctggtgattgtgaaaaatttgccaagtattacaggtccctttgccctggagaatgggttgagaaatggaacgagcagagggagagtgggacgtttccaggacctctctgaatctactgcccgaggcctccccttggaccagtcaacaagttggccagtcctactgttccattctgcattcctactttcagaatcgtcaatgccttttgtcccttgctcttcaaccagtcaccgcaaaactgttagtgatgctctctttttgcagttctaataattggctacagttgcctcacatgcagccttgttttgtgtgtggacctcattttattcacgtataaacgtctgtgaatgaacttgcatttctttcgtgccaaaaaaaaaaaaaaaaaaggccccta

SEQ ID NO: 12704 - DNA, 1769 bp, Sorghum bicolor
  Clone ID: SORBI-28MAY03-CLUS7075_1
acgataggctcacggaggacaagcatcaagcccacgaagaaccggcctcaccaagctgcccacaaagccctgtaggcggccaacgcggcggagcaggaagcccagcacgatgatatgtggggtggcgttgctgctcgcctccctgtgttgggctagcctccacgagggatcagttcgtcgaaataaggtggcctcatttgtgatggaagggccacaaggatcacgcaatgtgacaaaacacaataaaagaaagtctcctgtgcagagatggaggccggcttcaacagaagcagttccccagaaagatgacattacagagacatcaaattctgaaagcaagaaaattatagaggtttgcatagcttctagtgagagtttggcatcagatggaacaaccaatgttgttgttgaagttaccaccaacgatgcttcatcgtcaaaatataacttaagtttggaatacagttcaactaaagtagttatagaagacaatgtggaggtatctggcttcaataaggatctagttgtatccaatgtctccgggacgtattcctcctctattgaggtagatgctcctttgatacgctttgtgaaaggaaagggtgggtctacgcagaagcagattgaagagggtgctggagttaaaattatcttcccatcatcaagggtggggacttctgttgtccttgaaggtaaaagtgctgaaggtattagaaaagcatcacagatgattgcagatgttcttgaagaggctgttaaaagtcgacagctcgactactctcatttcatatcacttccattggctctccgcccatatcttgtcgagaaacggaaccacttccagagttgaatccttggggaagaagacagtgacaaagatgagagccgaagaacatgtttgaaacttggtctctagcttgattgtggcattgacaagtcaatatttatcaaaccgaaaacatttcacctagaaagttttatgtgtgattaggatttcaaatatcacctatgttctatgacgtactaaaatctatctgtatctgtcttgttccctgcaggctttgagaagtttattacttgcatatagattacggttctgacatgcatgaaaggttctccagctaaggctcgggtggtatatgctccagtgctggaagttggtggcgaagggcgcctagcacgtgcttgtagactcatctccaatccccttggagggctagctttcatgtacggtgcccacgcaagggcactcctgttgcatgctcccgtgatggaagttgggcatggagggcgccaataccgggcccgggccatagccgattattctgtccatgacgtcctactttttcagagggccgcactagaccgcactttatacgaagccgtaacccatgccctgcacaggtccaggcgcagtctggaacgcggctccgggcaacttcagtagaaataaacggaacccatggaaggacttgtttgatgcctgggatatattcaggaaatacgggaacgaggactggggcgaatatcccatccatgaggtccacctttctcagaggttcaagtttgacaaaagtggatactactattgctgcccttgcctgcagagatgcacacagagtgagatttgtagctgtgatcatgttttagggttgttgcataataataataataataataataataaaactgctgttcatgaggcgtttaactttgttatcagcggtatgccttaggtcaggtgttactgtgttcaattgttttgaatc

SEQ ID NO: 12705 - DNA, 601 bp, Sorghum bicolor
  unsure (1)..(601): unsure at all n locations
  Clone ID: LIB3476-029-P1-K1-A4
cagccgcgtgtccgccgggctgtcggtcaccgagctcgccaaatctttccacggctcgaggccgcccatgttcgtctgcaggtcactcctcgcaagggatcagtttgtcgaaataaggtggcctcatttgtgatggaagggccacaaggatcaagcaatgtgacaaaacacaataaaagaaagtctcctgtgcagagatggaggccggtttcaacagaagcagttccccagaaagatgacattaccgagacatcaaattctggaagcaagaaaattatagaggattgcatagcttctagtgagagtttggcatcagatggaacaaccaatgttgttgaagttaccaccaacgatgcttcatcgtcaaaatataacttaagtttggaatacagttcaactaaagtagttatagaagacaatgntggaggtatttggcttaataaggatctagttgtatccaatgtctccgggacgtattcctcctctattgaggtagatactcctttgatccgctntgtgaaaggaagggtgggtctacgcagaagcagattgaagaggatactggagttaaaattatcttcccatcatcaagagaggggac

SEQ ID NO: 12706 - DNA, 311 bp, Sorghum bicolor
  Clone ID: LIB3480-021-P1-K1-E8
cacctgtagattttggcattgacaagtcaatatttatcaaaccgaaaacatttcacctgacggttcttatgttgaagttgtggaacaaggatcgtatagctaaggccgcggatgtgctccagtcagtatctaccaaagtaaatgaagctttggaaaatcgacctatctccatacagcttagaggtctgacatgcatgaaaggttctccagctaaagctcgggtggtatatgctccagtgctggaagatggtggctaatggcgcctaccacgtgcttgtaaagtcataactgattgcctttgtcaagtcagg

SEQ ID NO: 12707 - DNA, 1626 bp, Sorghum bicolor
  Clone ID: SORBI-28MAY03-CLUS7909_1
tgaataatgttgccagcctgtggttcatgtcactctttatttgcatttttgctacaagcatcctagaaatgagatggagtggtgttggaattgatgattggtggaggaatgagcagttctgggtcattggaggtgtgtcctcgcacctctttgctgtgttccagggacttctcaaggtcatagctggtgttgatacaagcttcactgtgacatcaaagggtggagatgatgaggagttctcagagctgtatacattcaaatggactaccttattgatacctcctaccactttgctcctattgaacttcattggtgtggttgctggtgtttccaacgcaatcaataacggatatgagtcatggggtcccctctttgggaagctcttctttgcattttgggtgattgtccatctgtatcccttcctcaaaggtttggttggaaggcaaaacaggacaccaacaattgtcatcgtgtggtccattctgctggcttcaatcttctcactcctttgggttcggattgatcctttccttgcaaaggatgatggtccacttcttgaggagtgtggtttggattgcaactaggatgtcagcacatcagctcccccaatcagcatatgcttgaagaagtatttttgccggtgtttgtccccatatttacaatgtcccctctgtagataagagaccgaaatgtcttgtgtttcttttgatccatggtggaacctcaacctaatatctgagatatactggggagaatggaggctgcggcaatgcttgtgcagttgggccgtggaatacagcatatggtgtttgattgtgcagcattctttattacttgggcacaaaattgatcgggtgagccgaacagtaaggtgttttgattctgcactgctcccgtgtacaaacttggttctcaataaggcaggcaggaatgtgcatctgccagtggaacagagcaacctgcacagtatttatgtagcgaattatgtatgcctgctcattggagggcttgttcattacatgttcgtctatactagaaagacagtattagtattaatctatataattttatgtaaaggcgtctgttttttgtcgtgtactgtaatcgttggagttggttttgggaaattttcatagaaaggttgaatgtgatagatacagaaaatgtaatgccgtgctatatggttatagaacgatatatcttttatggttctatgctagtgtattgaataactccagagatcggggagctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattttaaaaaaaaaaaaaaaagggcccctagggcccgggccccttaaaaaaaaggggaccccccggggtggggaaattcaaaataaagtttttcaaaccccccccccccaggggggggcccggaccccatttccccctaaagggggcctatttaccccccctcctgggccccctttttaaaacgccgggatgggaaaaacccgggggtaccccaattaaatccctttgaagcaattccccttttccccagttggggaaaaaacaaaaaggccccc

SEQ ID NO: 12708 - DNA, 2047 bp, Sorghum bicolor
  Clone ID: SORBI-28MAY03-CLUS10508_1
aaaaacaccgttggaatcgggtccctcatggcagcatcacgcacctcccacggggccgcagctcgccgcagttggccccgccataaccgcgccgcgcttccgcaccacccttccctgctgcacccggccaaggagtaggaggctcacctcttggcgccgcgccgcgctccccaaggatgaggattattacttgatcgacgcggaggagtccattggggatggcttctcgttcagtggagggaagtacggggagggaccaagtaagtcagacgaatggtttgctcaagggaaaatggtaaatgcttaccaaatatacggggacaaagggaaggcaaaagatccattctttggcctgacgatgggatcagaatctcaatcttcagatgacgttttcagatggttctgtgtggaggctgggagctcttctaatcctaaagtgcttttaattcacggcttgccatcgcaggcatactcttaccgcaatgtgatgcctgtactgtcagacaaatatcatgccattgcttttgattggctcgggtttggattttctgataagcctcaaccaaaatatggttttgactatactcttgatgagtatgcctcatccttggaatctctagtcaatgctgttgctcctgataagctctctattgttgttcagggctactttgctccggttgcagtcaaatatgctagtgaacatcaagacaaattgaatcatcttgtactagtgaatccaccgataactgataaacatgtaaaccttccatccaccttggcttcattcagcaacttcttgttgggcgagatattttctcaggatcctctcagagcaagtgataaggtattgactagttgtggtccatacttgatgaagggaagaagatgctatggtgtatagaaggccataccttgtctctggttcctctgggtttgcacttaatgcaataagcaaagctatgaaaaaggaccttaaggcttacattgaatccatgagaaacattttaagaagtaattcgtggaaaacaaagacaacagtatgctggggcatgagagatcgttggctgagctatgatggggttgaagatttttttggaggcctaaaccagaagattgtagagctgcctatggcggggcaccatgtgcaggaggaccgtggtgaagaattaggcaatatgatcaaaagtatactgagatgaccgcaaattttgtggggtcaggctctagaacatgccaaaaacagatgctttacgaggtatgacgcccatgctgcattttatttgaacaaagctctgtttgctttgtgtacactttttaaaatttgagacggatttcaatgatgttctctcttatcaagtttgtcacgaaaacactaccctaaaagcaacgacggacattttcagacaacagcagtaccggtctgtgtgttccatgttcctggtgctggttccttgcgcggttttctgtttcccccctgttcctgcaggacacgctgccagggatgcgcttgctccggatgcccgcgacttaacttcattggcggtcattgctagtattctctgggttgcgcgcttgcccgagccttgcggggcatgtgtgtcatggcctcgctggtcagtctgactttttaagctatctcgtgcaggttcatgtttgtggccgtgcaagcagccaatactggtcgtaataaagctcaaagtggttacagttagtggtgccgtgctgtcctggtgctggcatatatggactcaagtctctcgtagtgaattcgtgtgtggttttcacatagagatcctccatttgttcccattgtctctcccatgacactctcccgctcaatgtatgcttatatatgatgcaacctttatgctctgtttggatccatagggctcccgtacgtggatccaaacgggtcagctaattattagctgaatatccaactaacaattattttattagttaagtcaaactagctaatagcaattaatagttggccatatctaatattagccatgagctattagctagcttggaaacggaacttttt

SEQ ID NO: 12709 - DNA, 879 bp, Sorghum bicolor
  Clone ID: SORBI-28MAY03-CLUS107500_1
cgcgagcgagcccgcgcatccaccacgcccccgtcctccgcgttgccacgcaggaagactccgccgcctacgccctcgccatcatgaagcatccggatccgattggggaggggctggccatggaggcgttcgcggaagccgccggcccggacggcatcgtgcccggacaccacgcgcccctcggcccccccgggcgcgccgccgcgcccaccgccgcggggcaggggatccggcccgtcccgcgcatccaccacgcccccgtcctccgcgttgccacgcaggaagactccgccgcctacgccctcgccatcatgaagcatccggatccgattggggaggggctggccatggaggcgttcgcggaagccgccgggccggagtgcatcgtgcccggacagcaagcgcctctaaggctcatgggactcaaggtttggccccttgatatagatatgaagttcctagagccatttggacgggaattacaatcaatgaaaaaattcatggacaaatcgtgcagtgttatggactcatctatggcaaacaagtaggcacatggcacatcagtccaatacagctgttgttgtatccacctgcttgctgaagttacaagacccgaaaaataggaatttggaagaagagccatggagaaagccacattcttttgcatatcttgcccaccgtcacccgacggaacaagatatggcatcgggagtgcagtaacaattagcgagtagtcctgtgtggagcctgggcgcagcctctgccagtataagtgctctacgtgttatacattttttatgttcatgaaacgttggtccactgagaaaataatcttcaggtgccaagggatcggtttgggaaaaaaaaaaatctttcggc

SEQ ID NO: 12710 - DNA, 1947 bp, Sorghum bicolor
  Clone ID: SORBI-28MAY03-CLUS10848_1
gcacgaggccttggtttatcctgcacttgtattggcttatatgggacaagcagcttttatttcacaacatcacaacattgagagcagttatcatattggcttttatgtgtcagtaccagaaacactcagatggcctgttctggtgattgcgatactagcagctgtagttgggagtcaggcaattattactggaaccttttcaatcatcaagcagtgctcttcattaagttgtttccctggagtgaagattgtgcacacatcctcgacagtgcatggtcagatatacataccagaaatcaattggatgctgatgatactctgcctggctgttactattggcttcagagacacaaagcacttggcaaatgcacaagggttggcagtaataactgtcatgcttgttaccacttgcttaatgtcactcgttattgtgctttgctggaacaagagtatcttccttgcccttggtttcctgcttttctttggcacgatcgaagtaatctacttctcagctgcccttgtcaagtttcacgaaggtgcttgggttcctattactctctccttcatatttatggtggtcacgtgtgtctggcactatggcacaataaagaagtacgagttcgatgtgcaaaacaaggtttcagtaaactggctcttaaaccttggtccttcactgggcattgttcgtgttcgaggcattgggctaatacatacagaactaatgtctggaattccagctatcttctcccacttcgtcaccaatctgcctgcgtttcaccaggtactggtattcctctgtgtcaaatcagttcctgtgccgcatgtggaacctgaggaacgatttctggtgggtcgcattggtccaaaagagtataggttatacagggtcattgtcagatatggttatcgcgatgtgcagaaggatgatctagagttcgagaaggagctagtcagcaacattgcagagttcatccgcagcagtggggagtatgacaagaatggcttcgtcgaggacacagataagccctccgagaagctgtccaccatcagtactggaattaatatgtgggaagaggatggagaacttgatgcatctggaacccctcataaggagatagacccacacaatgcagtacccaagcaaaagaaagcaaggttcatgataccgaagagtgctcaggtggacagtgaggtgcgccgtgagctgcaggagctcatggacgctagggaggcaggcatgtccttcatcctggggcactcgtacatgaaggcaaagagcgggtcaagtttcataaagcgaattgtgataaacttcttctacgagttcttgaggaagaacagccgtggccctgcatacgctgcgaacataccacatgcctccactctggaggtaggaatggtctaccaggtctgataacagttagcagctgtgtaaaggtagagatgagacgaagcctcttggccccacctgtatatatccacttgttgctgccgataccgttaacacaattacacgataacacgagtagagacccttgagcacagcattggctgagaaagcagctgaagatcatctgtggagagcccaaccagaagtatgcttttttgtttgtagagccttttgttgtgcgggtagttgtttagtttcgtgatatgttttctgctgttgttgactcgctgagtctcagtacttgtgagctgtaattgtctgtaagagtactggcaaaatagcttttttggcgtttagcgacctctgtagttgtcacttgtctgtagttgaagactgtataggtagcaactaaacattcataggggtttgtgtcgttgggtccacctgtattatagactgggccgtaaagcagctcttccttttgggcttttggcccaagaacgtctaaaaattaccagacaaacgaaaattctcttgtaccttttgattatcgtggt

SEQ ID NO: 12711 - DNA, 791 bp, Sorghum bicolor
  Clone ID: SORBI-28MAY03-CLUS8186_1
ctcccacagagaaataatccgacggcctgctcttcccggagctccgacggaagccacccccaggaatacccaccggcgacgggaggcggcggccggcgattagaagcgatggcgttcacgatgcgagcggtgaaagtgcctccgaactcggcctcgctggaggaggcgcggcaccgcgtcttcgatttcttcaagcaggcatgccgctccatccccaccgtcatggagatctacaacctcgacgacgtcgtcacgccctcgcagctccgctccaccatcgctaaggagatccgcaagaaccagaacgtcaccaaccccaaggttattgatatgcttctgttcaacgggatggaggagctgaacaacatagttgaacatgcaaagcagcgccatcatgtcattgggcagtatgtgatcggccaagagggcctggtgcatgaccttgggtcaaaggatcaagggaactccgacttcctgaagaaattctacacaagcaattacttttgatctgagttgcagatttccaccatctggaatactcagggtggtgctctgaataagacactgaggacctgccagcatcagttgtttcacaatcctctgttcaatataatattgctgttagctatttgctttgttgcacttaccaaattgatgtttatgagtcgatttgattctacaaagattgaacattcttgagtcctttcttctgtgagcactgagctgcatgacagggttcgaaacttcgaatggacaaaaaagaatgtgttgtggttctaccttcctcgtgt

SEQ ID NO: 12712 - DNA, 1473 bp, Sorghum bicolor
  unsure (1)..(1473): unsure at all n locations
  Clone ID: SORBI-28MAY03-CLUS8210_1
cctactgaggagcttcagcgctagctcgatcggcagccactggcctaccagagagcacccgaagcttaagctagctagcaatggctgcggcggcgactcctcctggtggtcgtcctagcagcagcagcatttcacggcgcgccgccgccgtggtgccggccttgctgctgctggcggcggcgatggccgcctccgccgccgacgcgcagccttccccggggtactacccgagctccaggttcaggccggtgccgttcaaccgcgcctacaccaacaagtggggcccgcagcaccagacgctctccggcgaccattccgccctcaccatctggctcgacaggacctgcggtagtggtttcaagtcgaagcacgcgtacaggaacggctacttctccactcgcatcaagctccccgccggctacaccgccggcaccaacaccgccttctacctgtccaacaacgaggcgcaccccggtttccacgacgagatcgacatggagttcctgggcacgatcccaggcgagccctacacgctgcagacgaacgtgtacgtgcgcggcagcggcgacggccgcatcgtgggtcgcgagatgcggttccacctctggttcgaccccaccgcggcctaccacacgtacgccatcctgtggaaccccgacgccatcactttcttcgtcgacgacgtccccgtccgccgctacgagcgccgcaccgagctcaccttcccggacagacccatgtgggtgtacggctccatctgngacgcctccgactgggccaccgacgacggccgccaccgcgccgactaccgctaccagcccttcgtcgcgcgcctcgaccgcttcgtcgtcgccgggtgctctgtctccgcgcccccggcgtgcaggcccgtgccggcgtcgccggcgggggctgggctcacggcgcagcagtacgcggcgatgcggtgggcgcagcgggaccacatggtttactactactgcaacgatttccgcagggaccattcgctcacgcccgagtgctagccgcccgggttgctgttgctgcgcggcgtgccgcccgcttgattaattggtgctttgtgttttgttgtttatttgttagtactactgctacagtgctagtactactattatggtgcaggggggggtgtgtgcagtggctgccctaccaccgccgcggggcgctctgtttgtgatgaggcgccggcggaggccggtggttgtggcgtgggtcgttggcgtatcgccaacaaagtggtgtgtcgccgtgtgcgtctacgtacgtacgtacttttcttgccattgttgctttgcatttggtctcgtcgcgtgcatgcatcacatgcgaggcgccccaaaggggcaagcgtccatgattcatggcatcatatgcatgcccactgtaatacggatatactactatgtatacttcatatattatatatatatatatatatttatttcagtttca

SEQ ID NO: 12713 - DNA, 1259 bp, Sorghum bicolor
  Clone ID: SORBI-28MAY03-CLUS8150_1
gcacgaggggctggtgcccctccatcagacatcagctccctcgtctctgcagctgcgggcttgtgcgtgagtcccagccgcccagtccgcactcttgccatcttccactccaccgaggcagctccaagccatggccatggagaaggccgcctccttcctctcctccctcctaggcggcggcggcggtggtgtcgggcagccggcggcgacagtcaagtctattttcatataccccatcaagtcctgcaggggtctcgccgtgccacaggcgcccatcgcctccactgggttccggtgggatcggcagtgggtggtggtgaacgccaaagggagagcatacacccagcgggtggagcccaagctcgcccttgtccaggtggagctgccgccggaggccttcgacgaggactggcagcccacgcccgacgaccacatggttatcagagcacctggaatggacacattgaagatacctctagcagcggaacacgccacaatcgatgacgtctctgtgtgggagtggtctggctctgcctatgatgaaggcgctgaagcagccgaatggttctccacttactttgggaagccaagtcgactagtgcgcttcaaagaagcatcggaaactagaccaaccgatccagatttcgcccaaggttacaagattgcattcaacgattgcttcccatttctgatagcctctcagggttcactggatgcactaaatgagattcttaaggaacctgtaccaatgaaccgcttcagaccaaatattttagtggatggatgccacccatactcagaggacctgtggaaaaccataaagataaacaacctaacattcctaggtgtgaagttatgcaaccgttgcaaggtgccaaccattaatcaagagaatggaatacctggcactgaaccaactgaaactctactgacattccggtctgaccaagtgcttcgtccaagccacaaaaataaacgacaggtgtactttgggcagaatttagtctgcaaggaatctctatcaggaaagggcaaaggaaagatcatcaaggttggcgatccagtttatgttctgcaagcgttcgcttcttctgatgaagccccagcctgatttagggttaaaaatagtgacgatgtgttcaaaataagtgagtgtgttatactccctggataaataaaaatcagtaggctgttaagactgtttgatgagagaataaaacacttgccctggacactcgttatgaattagcttaacttct

SEQ ID NO: 12714 - DNA, 386 bp, Sorghum bicolor
  Clone ID: LIB3476-044-P1-K1-F2
gcggctcatctcttctgaactgcatttgtctgtggcactcagctgcgcctgccgcccagcacaatggagagggccgcctcgttcctctcctcgctcctcggcgtcgccggcggcgattccggggcaccggcggcaacggtgaagtccgtcctcgtgtaccccatcaagtcctgcagggggatctccgtggcccaagccccaatcaccgccacggggttcaggtgggatcgccagtggatgctcgtcaactccaaagggagagcgtacacgcagagggtggagcccaagcttgctctggttgaggtccagatgccgccggaggcctttgccgaggactggcagcccacgccggacgaccacatggttatcagagcacctggaatgga

SEQ ID NO: 12715 - DNA, 521 bp, Sorghum bicolor
  Clone ID: SORBI-28MAY03-CLUS8261_2
ctgtgcggcgctcagccggccgggtcggaaccaaatcactctcacggtctcaccgtctccccagcaaccagcacacatttccctttggcggatcgaaaggaggaggagaagatgggtggcggcatggaggtgcacaaaaaccggtggatcgaagagtggaacgccggccgcgagaacctcgagttcaacttccgctggacccgccgcagcctcgccgtcatcggcctcttcggcctcgctgtccccatcctcgtctacaagggcatcgtccgcgaattccatatgcaggacgaggatgccgggcggccgtacaggaagttcctctgagcgtcgtcccgggctgctggagacgtcgatcccttgaccggggctgcgaggaggggagtttccattcggtttgtgccggtattgttttagtctgaatctgatggagcattttggaatgctgaactgttgtgtcggatccaaatgaataaggtgtaatgactcgtctttttaattactgaaatttgacatgtttg

SEQ ID NO: 12716 - DNA, 567 bp, Sorghum bicolor
  Clone ID: SORBI-28MAY03-CLUS8261_1
gcacgaccgcgcccgcccccccactcggacactcgcaccaccagattcgccgccgctgcatacgcctacccacccgtcgccgacgagcagcgcgatccggggggagaaagggaggagacggagaagatgggtggcgggatggaggtgcacaagaacaagtggatcgaggagtggaacgccggccgggagaacctcgagttcaatttccgctggacgcgccgcagcctcgccgtcgtcggcctcttcggcctcgccgtccccatcctcgtctacaagggcatcgtccgcgatttccacatgcaagatgaggatgcaggaagaccaccgaggaagttcttgtaacctgcaggttcatactcgtttgtttcaagaaataagcaatactgccagatgtggtaatgtcaacctgacaaacataatgctactcggttctttgtaagcactttaagttgctatgtatgctatgttccagatgttcgttcctttgaggaatctatgtaacgtcttttatatgaataactataactatgttttattgactaaaaaaaaaaaaaaaaaggcccctaa

SEQ ID NO: 12717 - DNA, 1330 bp, Sorghum bicolor
  Clone ID: SORBI-28MAY03-CLUS8305_1
ctggaaaaggccccccttcacagcttccctccccaaagctactttcccacaaacccaaaccaaaacagcttgcgtcttccatttcttttcttgttggcggccttcttcttgccttgctcgttgcttcttgaggtcgaaccccctctgcgccttgcccaagtctctgtgtgttttataggcttgggagcttggaataggtggggtggaggaagcggaagaggaggttggattgtcttcgggaggagtcatgttccatggcggcaggcctttgtccctccgggggtctctcaaggcccttgaagctgatatccaccatgccaacgccctggcgcacgctatacacagggcgtatgggggtgcctgcgtgcagatgaggctctcctacagctccatggctccaatcattctcaaccttatccaatggatggattgcagctgctccttgtcatacacgctccctagttaccttggactgcttgaggttcttgtctacaaggtttatgttgatgaagatgcctctatatccaccatagaaaggagagcaagcctgaaggagttctatgctatcatataccctttcttgcaacaacttgagggcaacttgatggataaggactgcaaggacaaaggatggtgtaaggagtctgcagccggcggcggtcggaagcttgttgccgatgatgacagggaggatgagtgtggcatttgcttggagacctgcaccaagatggtccttccaaattgcaaccatgccatgtgcatcaactgttaccgagactggtatacaagatcccagtcctgtccgttctgccgcgggagcctgaaaagggtccgatccagagacctctgggtgcttaccggcgacgacgatgtgatcgacacggtgaccctggagaaggaaaacgtgaagcacttcctcagcttcatcgacagcctgcctctgatcgtccctgacaacatgttgctggtctactacgactacctagtctagcaaagctcccccctcccatctgaagctcaggcagaggagaagggatctgggaagaagatgaagcggtgtactacaagcgatgaagcaagcaaagggttccggcagccgaccatcctctatggatcgagttggcaaagcgaagccgttgctgacaaacaaaactcttgtggtctgccatgccattgcacgggcgcctttgcatgatgacgttgctcgctgtaataagtgtaaagaagaaaaatgtctcgggttttactagcttgacattccttgtctggcaaattgccggattattcagaaaaaaaatgaaggaaacaggggccttggcgctttccattt

SEQ ID NO: 12718 - DNA, 1454 bp, Sorghum bicolor
  Clone ID: SORBI-28MAY03-CLUS8750_1
ctttctcctctcccttcctctccgctttctgccgctgagcgtccggccgcccccgtttcccagctcgcgctcggtctcgttccccaggacccgctcggccgcgctgcggcggaccccccccggcggcgcagcagcgcaggaggggtctcggccctggaggcgacgttggcggcttcccccccagctctcctacgtcgccccctcccctcgcccgcgtgcgcccccgacccgccgcctggcctgcgcccgctctcccgtccagtccggccccccacctaagcgcggccctattccggtcttcagccgcttggtagccacacatgttccctggcccaaccggccgatagcaaccagccatccgtctctcccgtctcctctcacgcgcggcccccgctgagcataggtccaccgtcgatttctatgtgacatagcttcccgcaaacctcatctgacgcaccatcccacagtcatccgcagatacaatgcatttgcggtttgctattccaacaaggctctctttgctctcctatacttcttcagctttgtccttgatggtgtggatggttggttcgcacggaagttcaatcaagcatcaacatttggagctttgctggacttggttacatgtatggtttgcactgcttgtttgttggcccttctctcccagttctacataccaggtttattcttcttgatattgcttgggttggatattacgagccactggtttcaaatgtacagttctttcttgtcaggtaagactagccacaaggatgtaaaacacacaggcaattggcttctgaaattatattatggatacaggccattcatggccttctgctgtgtttcttgcgaggttttatatattatcctctttctctttgctgatgagaagtcaacaagcttgcttagtgtatgcaaaggtgtcctgaaccaaaatcctgttgttgtcttggtgtttatttccactctagttggctgggcagtgaaacaagtcaccaacgtcatccagatgaaaactgctgcggatgcatgtgttgtgtatgatctgaagcgcagcaaatgaagcttcaaagcatgaaggcacccacatttacagtttaattcagttttgtatctacacacccaaagggaaaactccgcgaggcttgtacaccaggagctacgtcttactgtgccttgacatctttctggtgatgctataagtgggacctgaggatgacatgccgtgggaagaacatgtttatattcataaagaaaaccaaagcagacggttgtttttgtgaaagcagcggcagttaagtagttgttgtcagtgtgtaactgtgtattaatctttcatacagcgatgatgcgatcgtgatctttgttatctagagtagccctttgtgttaacctgaacgaccatgttccaaactccaggaatatagaaggtttgaatagcaaaaattaca

SEQ ID NO: 12719 - DNA, 928 bp, Sorghum bicolor
  Clone ID: SORBI-28MAY03-CLUS12387_1
tacgggattaagacctccgctgctgcgaacgcgccgcaaatatccacttgccctcctcgcactctcagcctccccgcccactcgcacgcgcaccatggcggcgctctgctccgcctccccagccatctccgcggcggcgtccctcgggtcgcctgcgcgccgggtcgcgtccctcctccgcctgcgcctccgcaccgcctcgtgctcctactccctcgcttcgtcaccgcgggcggcggcggcgggggtgccgtcgtggcgagcgcgccggcggttcgtggcgtccgcggcttccaccacggatgcggaggagtgctctggggtggagacgctcatcccgcccgacaatcgcatccccgccacaatcatcaccggcttcctcggttccggcaagacaactttactgaatcacatcttgactgctcaccatggaaagcgaattgctgttattgaaaatgagtttggagaagtagacattgatggttcattagtcgctgcacaaactgctggagctgaggacataatgatgctaaataacggctgcctttgctgcacggtgcgtggcgatttagtccgtatgattggtgaattggtgaacaagaaggagtggaagtttgatcatattgttattgaaaccaaaggtctagcaaatccagcacccattatacagacattctatgcagaggatgtagtttttaatgatgtcaagctggatggtgttgtcactttagttgatgcaaagcatgctagacttcatttggatgaagtaaagcccaagggtatagtcaacgaagcagttcagcaaattgcctatgctgacagaattatagttaacaaggttgatctgggcaatgaacctgaagttcgtatctggttgagcgtaataagggtatcaatcgcatggctaattgaagcgagctgatatggt

SEQ ID NO: 12720 - DNA, 2152 bp, Sorghum bicolor
  Clone ID: SORBI-28MAY03-CLUS12526_1
gcacgagggtgcgcctcgccgtctcgggccaacccggacgccgaaccccaaggctcgcgaccgcgacactcgtgtgcccctcctcctcctcctcagatctcgccgccggcggcatgctcccctcctccggcggcggccggtgccgcggccgccacctcctgctcggcttcggcctcgccgtcgctgccctgctcgcgctcgcctccgcctccgagtccgaccacaagtacaaaactgaagagccagttaagctttgggtgaataaagttggtccttacaataatcctcaagaaacttacaactattacagccttccattttgccaaccatctgagaaccctacacacaaatggggtggtcttggagaggtcctgggtggaaatgagctgattgatagtcagcttgaaattaagttcttaaaaaacgtggagaagggctccatttgtacacttgagctagatgctaaaaaggtccagcagtttgctgatgccattgaaagctcatattggttcgaattttttatagatgatctgcctctttggggttttgttggggagactgacaagaacagtgaaaacaaacattatctttacacacacaagaacatccttgtcaatacaatgataacaggataattcatgtaaatctcacccaagagtctcctaagcttcttgaagatggtaagaaattggaaatgacatattcagtgaaatgggtagcaacagatgtgtcatttgcacgccgttttgaagtgtacctggactatcctttctttgaacaccagattcactggttctccattttcaactctttcatgatggttattttcctaactggtttggtttcgatgatattgatgcggactttgcgcgaggattatgccaaatatgctcgtgaagatgatgatctagagtccctggagagagatgttaatgaggaatcaggatggaagcttgtccatggtgatgtatttcggcctccccgaagtggcagtgtttctttctgcacttgttggtatcggcacccaattggcagctctgagccgacttgtgattgttttggccatcgttggaatgctatacattgggcgaggggctatcatcacaacctttattgtgtgctatgctcttacatcgtttatttctggatatgttagtggtggtctttactcaaggaatggtggcaaaaactggattaaagcgatggttcttacagcatccctctttccgttcttatgtttttcaattggctttgcactgaatacaattgctatcttctaccgctcattagcagcaattccatttggcacaatggttgtcatgtttgtactttgggctttcatctcctttcccttggtgcttttgggaactgttgttggtaggaactggagtggtgctcctaacaacccctgccgagtaaagacaattccacggcctatccctgaggcgaagtggtaccttacaccttctgtcatctcattgatgggtggcctgcttccatttggtagcatctttattgagatgtacttcgtgttcacatcattctggaactataaggtgtattatgtctatggtttcatgttgctggtcttcgtcatccttctaatagtcaccatctgcgtcactattgtgggtacttatttcttgctgaacgcggagaactatcactggcaatggacgtcattttcctctgcagcatcaaccgctttgtatgtgtatctgtactccatctactactaccatgtgaaaacaaagatgtcaggcttcttccagacaagtttctactttggctacacattgatgttctgtcttggtctaggcatactttgtggtgctattgggtatctagggtcaaccctttttgtaaggagaatctacagaaatatcaaatgtgattaaatccctgctacttgctagcagcagaaagatcatatgtattgtcagtggaagcaaggcctcaaaaaatggattttaatggtagaccctgaataggtttttgaaactgccgaggacttgctccatttgttcgctgttatacgcatttttgtttgcctgcttattcctgtgaaatcgtccacataatgtatacctgtggtagttgaggattagtctgaagcacctgttttcaaaaaaaaaaaaaaaaaaggccccta

SEQ ID NO: 12721 - DNA, 1045 bp, Sorghum bicolor
  Clone ID: SORBI-28MAY03-CLUS1243_1
caggacgtgcagcgcaaggtgcacgacgagctggaccgggtggtcgggccgggcgaggccgtgacggagtcggacaccgcctcactggtgtacctgcaggcggtcatcaaggaagtgctgcgcctgcacccgccgggcccactgctgtcctgggcgcggctggccacgtcggacgtgaacgtcggcgggcacctggtccccgcgggcaccaccgccatggtgaacatgtgggccataacccacgacgccagcgtgtggcctgagccgacggagttcaggcccgagaggttcgtcgccgccgccggcggcgaggacgtcgtcccgataatgggttcggacctccggctcgcgccgttcgggtccggcaggcggagctgccccgggaagtcgctcgcggtggccaccgtcgggttctgggtcgccaccctgctgcacgagttcgaatggttgccgtgcggcggcggcggcggcggcggcgtggacctgtccgaagtgctgaggctgtcgtgtgagatggctgcgccgctggaggcgagggtggtgccacgtcgtcacgcggtgtgatgatgacgaggcagctgagacacacgtggacgtggctggggagaggacggagttgctagcttctactactactactaccttaccaccttctagcagaacgtaacgtggccccggacgacgatcgatgagcgagatgggtaaaaaaaaaaatgcccaagtgccatgctttagagctgatgctggtgtggacttcgtgtatgatggtaggtgctggtggagggactacgtagtaaccaccagccggtttgatgcttaattatgtgtgtgtgtgtgtgtgtgtaatgtaacttactagctgctgctgctgctgctgcagcatcatgtaatatctgcctgctgttagtcgactactaggtagtgtagtgtaccagatgatgagtgtgtgacagttatcttttccttttcagtaatgcgtagctagctagagctagatgtgtattattgtgtaataatcctatgtgtatatattctctctagtttc

SEQ ID NO: 12722 - DNA, 241 bp, Sorghum bicolor
  Clone ID: LIB3476-030-P1-K1-C12
acgtagtaaccaccagccggtttgatgcttaattgtgtgtgtgtgtgtgtgtgtgtgtgtgtgtgtaatgtaacttactagctgctgctgctgcatgtaatatctgcctgctgttagtcgactactaggtagtgtagtgtaccagatgatgagtgtgacagttatcttttccttttcagtaatgcgtagctagctagagctagatgtgtattattgtgtaataataatcctatgtgtgtat

SEQ ID NO: 12723 - DNA, 1077 bp, Sorghum bicolor
  Clone ID: SORBI-28MAY03-CLUS1293_1
tctggattttctctttcccctccaccgattcggccggcgagagtctccgcaggctcgccgggatcgcgagtccacgatggccgccaacttctggacgtcgtcgcactgcaagcagctactggaccccgatgatgtggacctggtgccggcggcggaccgggagcggggcatcacgccagaggagttccgcctcatcaagatccatatgtcgttccatatctggaggctggcacaacaggttaaagttaggcaaagagttatagctacagcagtcacttacttcaggcgtgtgtatacaaggaagagcatgtcagactatgatcctcgtttggttgcacctacttgtttgtatttggcatctaaggtggaggagagcacagtgcaagctcggcttcttgtcttttacataaaaaagatgtgtggttccgatgacaagtatcggtttgaaattaaggatattcttgaaatggaaatgaagctcctcgaagctcttgactattatttggttgttttccatccataccgtcctctcttacagttattgcaagatgctggcataacagatctgacacaatttgcctggggccttgttaacgatacatacaagatggaccttatcctcatataccctccctacatgattgcactggcctgcatatacatagcaagtgttctaaaagataaggacaccacagcatggtttgaagagctccgtgttgacatgaacatagttaagaatatctctatggaaatattagacttctatgacacctacaagattgatcctcaaaggggcattcctgaggataagataagctccgtgatgaacaagttgccggcgaaggcttgactcagatttggcgtctattcaaactttcttagaatgtaaactagtagtaagctacatcgcacttccaacatgtgtgtgtactcagtctgcactgtcgcttgtgacgtgttgatgaactacttgttgacaactccgatggaatttgttatgtatgctgctgttgtgaattccaagttagtagtatctgcatattttaactattttattacaaaaatgtgttccagggt

SEQ ID NO: 12724 - DNA, 709 bp, Sorghum bicolor
  Clone ID: SORBI-28MAY03-CLUS12715_1
ttgcaatgcagggacgtgtggtgcttttgatctgtctaaagatgatgggacacaaactagcaaaatacttactactgatgatgcattaatggggttagattatgatcctgggaatggattaggagctactaatggagaaaatgactatgaatcgggtctgctggaatttgatcctgttaatcatcacaatagttactgcccatgggtgaacagaaatgttgtagtggcttgctgtaacaacattggctccagctcaagtagttcagcgccctctggttggcagttaacaatagatgcagttgacacgtaccaatcacttggtcaagctcaaaatcaaataatgcaatctgattctgcagcttcattatatatggatgatcaaataactcgtaaccacaaggtagggagacggccttctgtgagcagaagctttgggaagtgctgatcggaactcctgtaccttaagtgttccttagacagaagtaacattccagaagttccagattggtgtaacaggagaaacgaaataatactcagatagtctcaatagatcattgtcaccccttgggtgtgaccttatagttgtttatgttgttgtgtattgatatatcgtatcatatatatgtatttatattccgaaagggttgattcaactgtcttcatttgacaggaacatgttcaagtgaactagatactatatggggaactt

SEQ ID NO: 12725 - DNA, 1179 bp, Sorghum bicolor
  Clone ID: SORBI-28MAY03-CLUS9229_1
gaaagaaaaaactgaagctgcgtccagtaacatatctaagtggttctcagggttctggcaatgacattcctcatggatacatttggagtcctcatctagtcccgaaaccaaaagactggggcccaaagatcgatgttgttggattttgcttccttgatcttgcttccaattacgtacctcctgaaccacttgtgaaatggcttgaagctggtgacaagcccatatatgttggttttggtagccttccagttcaagacccacaaaagatgactgaaattattgtcaaagcactggaaattactggacagagaggtatcattaacaaaggctggggtggccttggaaccttggcagaaccaaaagattttgtatatctactagacaactgccctcatgactggctttttctgcagtgcaaagcagtggtgcatcatggtggtgctggaacgacagctgcaggtcttaaagcagcgtgtcctacgactattgtacctttctttggtgaccaacctttctggggggatcgggtgcatgcaagagggctagggcctccgcctattccagttgatcagtttggtttgcagaagttggtcgatgctataaaattcatggtgaagccagaggtgaaagacaaggctgtagagctgtcgaaagccatggaatctgaagacggggtgacaggtgctgttagggcattcctcagacacctgccttcaaaaaccgaggaacagagtctgccgcagtcgtcgggcttcctggaattcttaggcccactaagtaaatgtttgggatgctcttagtgcgcaacacatcgatgatcacggatttgattccttgaacgaagccccgccaagggtcatgatcaaatcaacccatggaaagtagctccgggccacgagtgtgtttctcttctcttctcttttctttgtatcctttttcttccctgcgggtatttatttatagtgtgtatgtaaagagtgcttgtctggtgtggatggcatgctccctgcggtgcgtgtaattttgatgtgcatgtttgccgtgcatcacagacgacgacgatttcacgtctgcatggccaaccctgtttgtgtatatgaaagaagctgaagaggttcttcgtttcccctgcctccatatggttacaaataaataccaggatagtggcttagtagttgg

SEQ ID NO: 12726 - DNA, 990 bp, Sorghum bicolor
  Clone ID: SORBI-28MAY03-CLUS9452_1
gtgcatcgccttcaggcttcagctccatccatcatcatcaatcccagatcaggaccacccggcgaagaaaagagaaaaatatctcctctcttcccctctctctctctgtctccaccggatcggttcgcttcgttgtgggaggagaggagagattgagagaccgtggtgcgcggaggggacgagattttgccggtttggagccagataggggtatgagctgcttcgcgcaccgccgctgctccgacgtcgcccgccgccaggacggcctcctcgtcttcgtcttcttcctctcgattcccatacctagtagtaattctaatttaagtagtagtaatctcttgtaaactgcgctcgcctttgcgtttgcgtgtacggggacggagggaccttctgtggttgcttcttcctctttcccacccttttcttctccttccacggcggcggcggcggcggcggcggcggcgggtatggaccccaatggcctcaaaactggaggccttttgctcccgaccattgagaggcggtgcacgtctcctccatccgtcattgtcatcggtggtggcatctctggcgttgcagctgcccgtgccctctccaattcttcatttaaggtgactgttttggagtcgagagatcgtattggcgggcgtgttcatactgattactcatttggatgcccaattgatatgggagcctcatggctgcatggcgtgtgtaatgagaattcattggcgccattgattggctatcttgggctgaggttatatcgcacaagcgatgacaactcagttctgtatgatcatgatttagaaagctatgctctctttgataaggatggtaatcaggtcccaaaggagacagtcgataaagttggagaaacttttgagagaattcttgaagagacggtgaaagtgcgtgatgagcaggaacatgacatgccacttctacaggcgatttctattgtgtttgagaggcacccccatctaaagc

SEQ ID NO: 12727 - DNA, 1169 bp, Sorghum bicolor
  Clone ID: SORBI-28MAY03-CLUS9579_1
cagagcctgtgagcaagccgtcgccattttctacgtcggaaatctggtcatggactgctatattcgtcgcatcatttggtgttgcatatttcaatcccacggcacttggtaccaccgcaaaaacatgccttcctttcctgcttgctgctaacgtgctgggatacatggttggttctgggttaccagctggtgtcaagaaagtgttgcatccagtcatctcctgcgcactttctgcagatttggcggcagcagcgtatgggtacctctccgggtctggatttgatgctgtgctaggtgattacctcacaaaggcggcctctaatcctggagccggtgacatactgatgggtttccttgggtctgtgatcatatcatttgcattctccatattcaaacagagaaagcttgtaaagaggcacgcagcagagattttcacatcagttgccattggagctacattctctctgtactcaactgctatcatagggcgcctggttgggctagagccatcgttgaccatatccatgctgccaaggtgtattactctggcgctggctttgagcatagtatctttctttgaaggagtaaactcttcagtaactgctgtcgtggttgtccttaccgggctcctcggtgccaattttgtgctagcagcaatggagaaacttcgtctgaacgaccccatctccagaggaatagcgacagctgccagtgctcaaggactgggaacagcagcactgtcagccaaggaacccgaagcactccctttctgcgccatctcttatagtttcacgggaatctttggctcgctgatttgctcgattccagcagtcaggcaaagcttgatattcatagctggttaatagcaggtcatgatgatctgaattttaggatttgatgctgtagataaaagaagccgctttctccgtgtaaaagaagtcatgttcagaagatgaagaagcaacgccccacatgttgggtcaggatctattatgtgtaggggcttgaaaaaaggtgaatagttccgtaatcaggatgtaactaaaatactacattttttgtgacaaaatactactactagagcaagatggattcattatttgtttgatagtttgtgatgtcatctctctcccttcctagaaacaagagactataaagtagtatgtttg

SEQ ID NO: 12728 - DNA, 737 bp, Sorghum bicolor
  Clone ID: SORBI-28MAY03-CLUS9651_1
tacctcccctgaaggttttagctactactacaatagcattactcgttccctgaagtgggagaagcctgaagagtatgtgctgtatgagcagcagcagcagcagcagcagcagcagcagcagcagcagcagcagaaactgcttttgcttcaacagcaccaacaaaagattgctgtgcagcaactgcagtcaccgccacagggtcaatcacttatatccatgcaaccgattcaacagcttccccaggcacaaggacaaacacaaatgcatatgaaacagcaggaattaaattattcccaatttcaggcagctggttccattgatcccaacaggattcaacagggcattcaagctgggcaagaacgtgcttggaaaagttaaagctgcaggtcgcaataataaagcactagtcaagactcaagaagtgaacaaagcctttgtgctgtccaattgtaggagcagcttgtctagtgcctccacagcctgtccctcatgccgatcagtgtcactccggattagattagactgatatgtagatggtagaatcctgtatctgtacattattgcaacctaggccatgtattccatgtacctgattcaccatgttctccaggcggggctgccttgctggtgtccgtacgaaggagttgatgtcatcacatgtgttttccctgtgttgggggcatgatttgtgatgttcggcgcgatgtttgggcattacatttgacgatctggttaa

SEQ ID NO: 12729 - DNA, 1180 bp, Sorghum bicolor
  Clone ID: SORBI-28MAY03-CLUS1034_1
gccggccggtttgggaactatttcccctccttcaccccacggagaagcgaaactgacctttccccctccctgcatcccacctcgcggagatctagtcctagggtttcgccagcggcgaggcctaagtcatcggcggcgagccaaactccacgagcggggaaagagggggaagcagagacgaaggtagacatggggcagcagtcgctgatctacgcgttcgtggcccgtggcacggtcatactggccgagtacacggagttcaccggcaacttcaccaccatcgcctcccagtgcctcatgaagctccccgcaagcaacaacaagttcacctacaactgcgatggccacaccttcaattacctcgtggaagacggattcacatactgtgttgttgctgttgaatcagtggggcaacaaattcccattgctttcatggatagggttaaggaggatttcacaaaaaggtatggtggtgggaaagctgctactgctgcagctaacagcctcaaccgagagttcggatcaaaacttaaagagcacatgcagtattgtgtggatcaccctgaagaggttagcaagctggccaaagtgaaggcacaggtttcagaagtcaagggtgttatgatggagaacattgaaaaggttctagatcgtggagagaagattgagctgcttgttgacaagaccgagaatttgcgctcacaggcacaagatttcaggcagcaaggaacaaatgtgaggagaaagatgtggttacagaacatgaaaatcaagcttatcgtcctgggaataataattgcacttattctgatcattatcctctctgtctgtcacggtttcaagtgccattaagcgcagaccagaatactgatacattcaactgcacctattatactgctgcttggagcaagaaaaagtatgatcttttgttctttcgctagtgtgctctggcccggtcattgtgcacaggtgttctacattgtctttgataaatgttggatggtgactgggttagctgtgtcaactgtcaaaactgtcgtgtatttttggacgctatgtatgtatagcctggatatgagtagacttactaaacttctccagttgtgactcaggagtctgctcctctggacaataatgtgcatcttgcattgacctcgtttagtgcaaaactgcaatttgg

SEQ ID NO: 12730 - DNA, 1855 bp, Sorghum bicolor
  Clone ID: SORBI-28MAY03-CLUS1047_1
gcacgaggcgaggggaacccccgacccgacccgacccggaacagcagcaggaggagaggaggagcgcgagggagagagagagagagacacagaggggcgctgcgaggaggaggccggcggcggcgcgcgctcgcggcgccggcggcccggcgatgggggaggtggccgcgctgcgccagctcgtcggccaggtccaggagctctgggacctctacggcgccaacgcccaccccatccccaggtggtatttacttgacttcgaacatggttcaatcaaggatgattattgtgggggaaggcctggatacaactcagaattactgaagatcatggaaactaaccaatctccccctcgcaaacgaccgcggagagatcgaaaccgtgaaaaggcaccctcaaacaaaactgaagtaatgcaacaagagatctggagagatttccccgaagatctttttgaaactgtcattgcaaggcttccagttgctgcaatctttcgattccgcaccgtctgccgaaagtggtcttctcttttggggctcagacagtttttctcatcagtactctgaagctccacgtggactgccatggttctatacaatcacccatgagaatgcaaacaacaatgttgcaatgtatgatccttcgctgaagaaatggcaccacccatccgttcctctcactccctcgaagatagttattccagcggcatccgtgggtggtcttgtatgtttattggatctgagccacaggaatttctacatttgcaaccctcttatgcaatcactcaaggagatcccaccaagatcagttcagggatggtcaagagtcgctgtaggggatggtgttgaacggaagaagttctagtgatggctacaaagtaatgtggttaggaaatgatgggacttatgaagtctatgactctacaaagaacatgtggtcttgccctggatcttttcctccgggcatcaaacttccacttgctctaaatttcaggtcacagcctgtggcggttggcagcacggtatacttcatgtgcgcagaaccagatggtgttttgtcatatgatgtaagcaccgggatttggaggcaatttgccatcccactgccactgcatctgactgaccacacacttgccgagttccagggaagggttatgctagtgggtctgctgtgcaaaaatgcagcgacctgcgtctgcatatgggagttgcagaagatgactctcctctggaaggaggtggacagaatgccaaatatctggtgcttagagttctacggtaagcacatgaagatgacatgcctgggcaacagtggtttgctcatgctctccttgaaggcgaagcgtatgaaccgccttgttacttacaaccttttcaaaagggagtggcagaaggttcctgattgcatgctaccatgcagccgcaaaaagcaatggatagcatgtggcacagcgtttgatccggtcccctgtgccttggcctgacatggagtgtaccttctttggccgagcatgctaatattttagtcatttcatataattggtctattatctttagatatttctatgttgttgtgacaagttctgcaaaaccgcatcactgtggtttgttttgtatcacgctgaagcaatcaaactgtttccttctattacctgctgctacttgggtcagtgctacatcaattgggcaagccgacctgaatatgtttcatggaagtcaaaaatggaacgccaggtatctgtatggtcttggttttggtatgttttgtctgtgtcccgtttaagcttgtaatctttctgaacttgcagttacctgcccagaactgagtttattatacaataaaaagaacggcatgt

SEQ ID NO: 12731 - DNA, 907 bp, Sorghum bicolor
  unsure (1)..(907): unsure at all n locations
  Clone ID: SORBI-28MAY03-CLUS979_1
agtccggccgaatccggtcgcccaccgtcgcgaccgtggtctgagagtgannnnnnnttgaagtgaagtgggataaggagagggggtgctcgtctgctcgtccgcagcaacaacgccaccaacgccagcacatccaccgcgtcgccgccgccgttcccggggccgcagccgatggccgtgtacagctccatctggaacgcggacgactgggcgacgcagggcgggcgcgtgaagacggactggtcgcacgcgccgttcgaggccacgttccgggaggtgcgcgtggacggctgcgcctgggcggccaacgccaccgacggcgacgccggggaggtccggcggtgcagcgagacgtcgtggggaaaagaaggccggtactggtggaaggagaaggagatgtcggagctgtctgtgcaccagagccaccagctcgtgtgggcgcgcgcgcaccacctcgtctacgactactgcgtcgacaccgaccgcttccccgttcagccgcctgagtgcgccggccgctgatcatcctcaccaacgccggcggcgttgctcttgctccatcggtggtggtagcttactgctagctagctagtctttggacacccgtcgatgcggcgcatgcatcgattggtatggaatggttggaactgctggtttccctgggggttggttcgtgttcgtgcgtcgtttgcagcaatggtgcctgtctgtcagactgtagtttcgtttcggctttgcgaggtcgcattgttggcgaccttgtgtggtgaactggtaatcttgtggaggttgtcttttgtaaaaaaaaaagtgaaatgggatgatgaatgaacgacgctacgctccgttccagggatttggcactcccttccttctgaaaaaaaaaaaaaaagggcgccgctcgcga

SEQ ID NO: 12732 - DNA, 496 bp, Sorghum bicolor
  unsure (1)..(496): unsure at all n locations
  Clone ID: LIB3476-009-P1-K1-B8
gcgtgtggaaccccagccaggtggtgttcatggtcgacgacacccccatccgcgtctacgagaaccgccagaacgccacggtgcacggcgcgcaccaccgcagcaacaacgccaccaacgccagcacatccaccgcgtcgccgccgccgttcccggggccgcagccgatggccgtgtacagctccatctggaacgcggacgactgggcgacgcatggcgggcgcgtgaagacggactggtcgcacgcgccgttcgaggccacgttccgggaggtgcgcgtggactgctgcgcctgggcggccaacgccaccgacggcgacgcccgggaggtcccgcgggcagcgagacgtcgtggggaaaagaaggccgtactggtggaaggagaaggagtgtnngagctgttgtcaccagagcaccaactcggtggcgccgccaccactgttacacttctggtgcaccgacgttcccttagcgctgatgcccgccgtgtatctac

SEQ ID NO: 12733 - DNA, 790 bp, Sorghum bicolor
  unsure (1)..(790): unsure at all n locations
  Clone ID: SORBI-28MAY03-CLUS14565_1
ttccgnnagttatacataaagaaatcaagggctacactcctcaccagtttccgctctggaccgttcactctccagctcccctcgctccgttcccttccgcccaaccaccgcctactccatccagatcggcggggcgggcaccggccggccggcgatgacatccaccgtcaccaccaccgtcgggtgcggggggctccccgtccgcccgtcgtcgtcgtcgacggcgcgtagaggacgtccccgcagatgcgccgtccgagctcaagccgcaggagcggatgcctccaacgacaagtcagtggaggtcatgcgtaagttctccgagcagtacgcccgccgctccaacaccttcttctgcgccgacaagacagtcactgccgtcgtcatcaagggacttgcggatcacagagacactctcggagctcctctatgcccttgtaggcattatgatgacaaagctgcggaggtagcacaaggattttggaactgtccatgcgtcccgatgcgtgagaggaaggaatgccactgtatgctttttcttactccggataatgactttgctgggaaggaccaggttatctccttggaggagatcaaagaggcgacatcgaagttctaaccccttgtatttttcacgaaatgtttacttgacagctagtagttttttttatatgtatatgtacttaagtagcatctataagatatccgtcaggaaatctttcataaaatgtgcagtaaacagcacttgcaaggctgtcgatgatatgaactgcttttacccttttattgt

SEQ ID NO: 12734 - DNA, 1100 bp, Sorghum bicolor
  Clone ID: SORBI-28MAY03-CLUS14515_1
tgtgcggcgctcgagccggccgggtctgggacacagtggtcaggagtcgggagggaaagggatggccacagcgcatctgctccgccgcgcctcctccgccttcctcttcagcaccaccaacccgttgcgctcgtgcttccctctcgtccgcctccagcacccccgcgccgccatggccaccgactcctcggtagccccgttccagaagatccagatccagcgcgaggacaccacttttgatgcctatgttgttggcaaagaaaatgctcctggaattgtggttttgcaagaatggtggggagttgactatgagataaagaaccatgcgatccacatttcccaacttggtggaggatacagagcactcattccagatttataccgtggaaaagttgctctggatgttgctgaggcacagcatctgatggagggtctcgactggcagggtgcagtcaaggatattcaggcttcagttaaatggctgaagtcaaatggatcacccaaggttggtgtgactggctattgcatgggaggtgctttatcaattgcaagtggagttttagttccattggttgatgctgttgttgctttctatgggacaccatcttctgagcttgctgatccttccaaggctaaggctcctatacaggctcatttcggggagcatgacagttttgttggtttttcagatgtcactgcagccaagtccctggaggagaagctcaaatcttctgggataccatatgaagttcacatataccctggatgttcacatgccttcatgaacacttcgcctgaggccctcaagaggaagaaggggatgggtctgactgatgagaaccaggaagccgtcgacctggcctggtctcgcttctcttcttggatgggccgtttcctcggatctgcttgaaccattccccacttcatgtgctgtgtgattatgtgtggagtcaggtcccatgaataaaatgttcagattcaggatgctctatccaaaccatacaaatggactgggttgtacggtgctctggatcgtcctgtttatggataaatataccgcagtgtcgtttccttaaaaaaaaaaaaaaaaaaggccccta

SEQ ID NO: 12735 - DNA, 843 bp, Sorghum bicolor
  Clone ID: SORBI-28MAY03-CLUS14649_1
ccttgactccccaggtccgaaatcttcagtcccattagctgttcctcccgtaagtcaggctccggcagctcagcctgcaacacttgcaactacaactgcagcagcaataatgccttgagggcattccaccagctccaaggggcatgccccagattgaggttacctttgacattgatgccaatggcattgtgaaggtgtcagctagggacaaagccacaggcaaagaacaagaaatcaccatcaagtcttctgggggtttgtcagagggtgaaattgagaagatggtgaaggaggctgaactgcatgctcagaaggatcaggaaaggaagtctctcattgatcttaagaactctgcagataccacgatttacaccattgagaagagtgtcagcgagtacaaggacaaggtacctgctgaagtcaccaaggagattgagtctgctgtctctgatctgagggcagctatggctgaggacgatctggagaagatcaagcagaagctggaagcagcaaacaaggctgtgtcaaagattggggagcacatgcaacaaggtggtggtggtggcagcgctggcagcagtagtggcggagaccagactccagaagccgagtaccaggacgccaaggaagccaagatgtaggttgaacctgcatcaagtctctacttttgcatgtacccatttaggaagtaatcttacctacctccggcttcttagttttctgtgaggggttaagagaattgtaatttttgttgtcaatttttgggtcacggataaattgtgaggggaacaaactcataagttaattgagccatttacatatactccagacgtcctttcaact

SEQ ID NO: 12736 - DNA, 633 bp, Sorghum bicolor
  Clone ID: SORBI-28MAY03-CLUS15443_1
cggcccctcgcagcacggcgatcaccacctcctctccttcccagtctcgcggtcgcggccacacacgcacggcaccactcgtagaaaaaacaccacatcgatctctttcttagtctgcgccggcggcggcggcatggcgactacgaacgggagcagcaaggtgttcgaggtgcccaaggtggaggtcaggttcaccaagctcttcatcgacggcaagttcgtcgacgccgtctccggcaagacgttcgagacccgggaccctcgcaccggcgaggtgatcgccaccgtcgccgagggagacaaggccgacgtcgacctcgccgtcaaggccgcccgggaggccttcgacaacgggccctggcccaggatgacgggctacgagcgtgggcggatcctgcacaagttcgcggacttgatcgacgagcacgtggaggagctggcgatgctggacacggtggacgccggcaagctcttcctcgtcggcaaggtccgtgacatccccggcgcggcgcacctgctgcggtactacgcgggcgccgccgacaagatcgcgccgccgacaagatccacggcgagacgctgaagatggcgcagcggatgcacgggtacacgctcaaggagcccgtgggcgtc

SEQ ID NO: 12737 - DNA, 667 bp, Sorghum bicolor
  Clone ID: SORBI-28MAY03-CLUS11153_1
ccaactacttcccctagtcttgttgcatctgcacagggtctacagaatgaggagttttccccaagccagctaagtaaaatgtttggatctcatgcaacgatgatggcaaacacccttcgcacaccaatcattgtatttacacagaccggctccatggctgtcctcctgagccactatcggccctcgtctacactatttgcatttacaaacgaggaacgagtgaagcaacggctggcactctaccagggggtcatccctattcacatgcagttctctgacgacgcagaagaaactttctccagagcaattagcagcttgctgaaagcacaatatgtgaagaagggagactacgtcactcttgttcagagcggagtgacttccatctggagagaggaatctactcaccacatccaagtgaggaaagttcaggtctgatgtgccggtgggaattggtcgtcggagaaattttgatggcgccgctagaagtgttatcatcatcaaatgcgagtaattttaatgttttaccaggagattgccacgtcgagttatatgttgtgtcgaattcacgtgtagactctgaatctttaactctgtattcgttcattttcacttgttgtttcacactggagttttacaagttcacctttactgctcttgctttcttgtg

SEQ ID NO: 12738 - DNA, 1176 bp, Sorghum bicolor
  Clone ID: SORBI-28MAY03-CLUS11221_1
cggcaatatcgagggaagcttgagaggaaagctgtcctcaaagctatttgtgctggttttgaggaaactactgaaccaaatgtttgcctgagtgatgatatggagactaatgagtgtctgaatgacaatgggggttgctggcaagacaaatccgctaatgtaacagcatgtagggacaccttccgtggcagagtgtgtgaatgccccactttcaatggcgtacagttcaaaggcgatggctacagcaactgtgaacctgctggaccaggaaaatgtttgataaaccatgggggatgttggcacgaaactcgtaatggaaaaacattctctgcttgccaggaatctggagatgggaaatgccggtgcccagctggtttccgaggggatggtgttaaacagtgtgaagacattgatgagtgcaaggagagaaaagcttgtcagtgttctgaatgcaactgcagagatacatggggtggctatgactgcacttgcagtggtgaccttttgtacatcagagagcatgacacctgcataagcaagacaacagttcaggctaaagcggcatgggctgcagtgtggggtatcttgatagttgttgctgttgtggcagtgggaagttatgttgtatacaaatacagactaaggtcatacatggactctgagattagagctatcatggcacagtatatgccactagacaatcaaggagacgtcccaaatcatacacatgacgaagatcgttcataagtgtgcagatcattacatggtaggcccatatggcctaaactgacaccaaggccgatcgacatgaggtatacaaattgatactacaggtcaataatagcttgttttagtgcacacacggatctgttatttgcctgctagtttatctggagcagtttcattttacaatcactgtaagatccatttgtgaggatgtatatcttaggatttttgttgaccagtattcatacgtttttagcctatcagtgtgttgttggctcgttgctggtcattgtaatagaagcgcaccagttttctgcgcacagtaagacctaacctggcaacatttttgtagtacattttatggacgacctgtgtcttgtgaccacagaattgagaatacatgccatcagtttaccatatgagtattctacatctgatttcgtagggttt

SEQ ID NO: 12739 - DNA, 625 bp, Sorghum bicolor
  unsure (1)..(625): unsure at all n locations
  Clone ID: SORBI-28MAY03-CLUS11272_1
gcacgaggcggcgtctcctccctgcctgaggccccgaatccatctcccgcaccaagccggagcattccatcctcggaggccggacccggcgagaagcgagcgactgcagccagctcacgtcccctctcgatccaccatgctcagggtcgcgggcaggcgcctctcgtccgctctctcctggcgccccgccaccgccgccgccggcacccggggccctctcgccggcacgctacccggccgcgacgacgacgacacgcgcgaccgcagggcgcgtttcgccatcgactctcccttcttcgccgccgccagagggttttcagcggaaactcttgttccaaggaaccaggatgtgggcttagctgagctcccaccaactgtggccgctgtgaagaatcctagtggaaaaatcgtgtatgatgagtctaaccatgagcgctacccgcctggggaccccagcaagcgtgcatttgcctactttgtgctgagtggtgggaggttcatttacgcatctttgctgcgacttctcatcttgaaattcgtcctgagcatgtcagcaagtaaggatgttctcgcacttgcctcacttgaagttgacctctcaagcattgagcctggcaccacggtn

SEQ ID NO: 12740 - DNA, 1482 bp, Sorghum bicolor
  Clone ID: SORBI-28MAY03-CLUS1141_1
gcccacccaatcgctctcgcccacccacccacacacgccgacgcacacgcatctccccagctcggactggaggaggttgtcagcacccgctccccgcgactccctcgcccgagatcccgctcgcgccgtggcggttgactttccccgtccgtccctggtccccgctatcgctgcccccaggcaatcgcgaatccctagccccattctagcgccccaccaccctccactcctcgccgccgaacgcccggcctgcccggtcgacagcctggtgaagattgccgccactattcgggtgaggaggacaaggagcattaggctaaggctaaatatgagcagatgcaggaggaggaatcagctcaggtgtaaccagaagcagtacgctacctttcctcgcctccagtacgatgcattagggagcagccgcagcgttgttggggacgccggctttgtattagattgggtcctcagtgttgtttccaaacatatgctgatgtaggtgtgccattatatacctaactggaaaccaacgtggccattgttcgctatctcgaggcccgcagggatccttaggtggctgtgaggcaagattggactataggtgaaaagctttataagggtataagaggacacctttactggcctgatggcacagtcaagaggcgtacaatgtcatgaaaaaactgagaaatctgaaatgcgtcaacttgttcaagctttagttgacaagtataatgaggaccataatcttttcgaggatcttgcacacgaactcaaagacgttttacactaccagtcaattattgagaacctgaatttgtactatcatttcaatttcaaaacaaagattaaaggggctggtccaaatgaattgagcatggacaatcttttctttgtggaagtgaaatttatcggaaaaggaaagcttatagaactgcaggctaactgtttctgcgcagttaatccggatgacaatggtccctgctttggttgcaccaaacatggagatgttggtatgaagcaccctagcagttctgttggatacactgctggtcacttgaatgtgggtttgccatttggattcattgcaaagtggaagagggactatgaggatgaggaggatgatgataaatatgtgaaagctaaggaagctgagctaaggcagatgttcaagggccttgataacccagatgtcatgaagaaactatgcacgccccctccgtgggcaactaaaagaaaagcgcaggagtggaacatcacagtccattgcacttgtgtctgaatgtatattttgcaagcaatagcccttttaataattatgttatctagacaggaactcagcttgttagttcatgttgtaaggcactgaagaagaaagcatatttgagtggcactgagaaaccatttgagtcgaggtggttgagctctttgtaacatgctactcttaataaataagtatcttcagaatgccctcaggagaccttt

SEQ ID NO: 12741 - DNA, 1882 bp, Sorghum bicolor
  Clone ID: SORBI-28MAY03-CLUS11894_1
ccccgagggggtcgcgttgcgctcccgccggccgcctcccgccgccgcggccgccgcccccggggcctggcgctcgcggacctgctgcgccgcggcgccgccgccggccgggcggaggcgggccgggaccgcgccccgcgcgggcccgccgccgcgcgacgccccggcgcgccggcccccgccggctccccccgccccccgggcgcggggcccggcgccggcgcccccgcgcgcggcgccgcgggcctcccccgcggcgacgggcgcggccgccgccccgcccatccccgccggcgtgcgtcgccccccccccccccccgccccctcctcccccgcaccagggttcgatgggcacaacggcagcgccgccgcggtgtacgccaaggagcacctcctcggcaacgtgctcagctgcgtccccaccgatctgagcagggatgagtggctcgccgcgctccccagggcgctcgtcgcggggttcgtcaagaccgacaaggatttccaaacgagagctcattcctcggggacaaccgtgacgcttgccataattgatggctccgttgtaactgttgcgtccgttggtgattcacgctgtgtccttgaagctgagggatccatctactatttgtcggctgaccatcgctttgacgctaatgaagaggaggttggacgtgtcaccgaatgcggaggtgaagttggaaggctaaatgtcgtcggtggtgctgagattggcccccttagatgttggccaggtggtctatgcctctcaagatcgattggtgatcaggacgtaggtgaatttatcattccggttccttatgtgaagcaaattaagctgtctaatgctggaggccgtcttattatttcaagtgacggtgtttgggatgctttgaccgcggaagtggcttttagatgtgcacgagggcttcctcctgaggctgcagctgagcaaattgtcaaagaagcagttgaatcaaaaggattgagagatgatacaacttgcattgtcattgacataataccaccagaaaaaccaaaatgcactatagaatctccaaaaacgccaggaaaaggccttgtacttctaaaaaaattctttttaaggaaaactgcatccgactcgttatccctagctgataaagataattatcctgagccagatttagtggaggaggtctttgaggacggatgcccatccctttcgaggaggcttaattctgaatatcctgttcgagatatgttcaaaatttttgcatgtgcaatttgtcaaattgaattggaatctggtcaaggcatatccatacacgagggtttgtcaaagccaggaaagctgtgtccctgggatggccctttcctttgtcacagttgccaggaaaagaaagaggcgatggaggggaagcgtcactcacgagattcctcgtcaagaaatagcgggtcaagtgaatagtgactgaatccaagagtcatcttgaggcaaccacctagcggtgtgacgagctaattcttgttgcagttgtcattcttgcagcacttcctctattacatggactaccattggatagagacagatgttggaaggtgacatgcctgcatatgttggagttatatggcacggaaccgctgggcttgtggcagtagctcgtgcaggtaatgatgacaagagattgttagtgaagaatgtccacagtggccaatagtcatgtaaattacccatggtatagaggtgcaagtgacaaatagccacggttttgtaattctcgactaggattaggtattgagaccctgtaattcgtctgggcagacctcaaactaaaggtcaacaacgtagcctggcttattgtagaatgtatcttgccctacaatgatcatgattcaacgctgt

SEQ ID NO: 12742 - DNA, 1617 bp, Sorghum bicolor
  Clone ID: SORBI-28MAY03-CLUS12285_1
cccgcgccgccctctcccccccgactgagatcactgcgcgtgccgtcggcgccatggccgcgccaccgccgccgtcgccagccaaaacccactagcagcgcgtcgcgggtgcacctgctgccgatctaggaagcagggatttcttcgcgccctgcgctgtagaaacgggcctggatttgctcgagagcgagaggagggggtaatagagtgaaaggaggcgcggggagaagatggctgcggaaatggtgaaggcagcgacgagcgacaagctcaaggagatggattgggcaaagaacatcgaaatctgcgagctcgtggcgcaggatcctgggaaagcgaaggatgtgatcaagtccataaaaaagtctatagggagcaggagcaagagcactcaactctttgctgttatgctattggagatgcttttgaataattgcggagagcctatccataggcaggtcatcgataatggccttcttccaatacttgtgaagatagtgaagaaaaagacggatttaccagttcgagaaaaaatatttcttctgttagatgctacacaaacatcccttggtggagctaaagcaaagtttcctcagtactatgaggcatactatgagttggtgtctgctggtgtgcaattttcaaatcgcccaaatgttgttgtcacaagagcagaagtgccagtcccagaaccaagaacagaaccaaataatgaaagtttagcaacccgattgaatgaagcccaacaggagctccacgctcagcctgctcctgatgcaagtatagtccagaaagcctctagtgtcatggaagtattgagggatgtgcttaattctatggatcctaggcaccctgagggagcaacggatgaatttgtgttggaccttgtcgagcaatgtacgtttcagaagcaaagaataatgcaccttgttatgacatcaagagatgaaatggtggtatcacaagctatagagctaaatgaagagctacataaggtccttgtccggcatgatgcgttgctttctgttcatccgacaacaacagtaccttctaatataaaggaggaagaggaggaagaggatgctgaaagtctctatcggagactgcggaaggggaaagctctgtcgcaggactacacagatgactcggtgccgtcattccgatccatgcccgaggacaagctgcggcggccgctgaccatccaatcgcctcaccccgacaagcgactgggtgcgctgaacatccgctcaccagaccgtgaagagccaaggcctgatcctgctccgctgatcccgccaccgccctcaaagcacgccgagagggagaggttcttccgggagaagagcatcgatggcgtggccagcctgccaggccacctgaggggcctgtcacagcacagccgggacggtagcagctcgtgtagcggcagcactgattacggtgactgaggggggagcggcagcagcagcagtacatatagggtttcccttcttggggttgttggtctcccacttggctaggcaggcgatacattggtgttgcgccggagtttggctcggccctcggcatctctttctccttcatgctgacctgtgtacacttggcttggtagcattt

SEQ ID NO: 12743 - DNA, 1057 bp, Sorghum bicolor
  Clone ID: SORBI-28MAY03-CLUS1696_1
ccgacaggcgccctcccaactccgcccgaagcggccccgcgccttcccctcccgcctccctccgtcccatgctccgccgctgacacgttggcccgactcaaccttccgatggccgccgccgcctccgccaccgccatctccggcgtcgtgcttccccacgccttcctatcccaccggtcgccgccgccgcaggtcctagccgtggcctcctcattccgccggctctccctgtgcgcttcccctcgccggaccacccacataatcgcccgcgctgacgccagtgccgaagccggagaaccggagactgaggagcctgtcacttcctcagctgaatccgaagaagaggtggccgagggggctgtcgctgtggcggaggccgaggaagaggaggcagaggaaccgccgccgccgagcaagccgaaggttaagttcggcgaaataattgggattctgaataagcagtttattgaggaggctgagaaggtgaagacagtaccagatctgaggcctggcgatatcattgagcttaggatgcaacggcccaacaagaggagattgtcactctttaagggtataatcatcgcaaagcacaaagctggtgttcacaccacaatccgtgtcagaaggatcattgctggtgtaggagttgagattaccttcccagtgtactcacccaggatcaaggagatcacggtaatcaggcacaggaaagtgaggagagcaaagttgtactacctgaaagacaagcttccccgcttttcaaccttcaagtgacatcagatctgctgacagaacatcttcttccaccaccatttcgatttctcttagaaaacctttttttcacttccctgtccaaatcagcgcatttcactgtaattctcagatatcagatgtgtaatgtctactacagctttataacatatactacttggcttgcaatgcaatgcttctttgtcgtcttgtacaaaattcgtacaaaggccttgttattatgaatttaattgcatccttttatgaggatcgacaagaatggcgaagcgacctgcacgcaatacat

SEQ ID NO: 12744 - DNA, 297 bp, Sorghum bicolor
  Clone ID: LIB3480-035-P1-K1-G11
cccacgcgtccggcaaagttgtactacctgaaagataagcttccccgcttttcaaccttcaagtgaaataagatatgatgacagaacagcttcttccaccaccatttcgatttctcgtagcgaaccttttttcacttccgctgtagggttgtatgtcgaattgtagtagggatgtatcttgaacttgcattagggatggatgttggactctgtgatgttgaacttctaatagtaaacctatgatgttgaactttgatggatttttgttggatttatgaaatctgtgtgtgcttgtga

SEQ ID NO: 12745 - DNA, 819 bp, Sorghum bicolor
  Clone ID: SORBI-28MAY03-CLUS16157_1
gcacgagggttccttcaaaacaaaactcgccaatggcgggcggtcacgggtcgggcgtttctacctctcccttctctgttggcataccggtttgctttgtctggaggtgcttgaccccggaacatggaagctgttaggtggtggccatgaggccgtctatgctgctgtcaagcttccacttttctcttctgagactgctgccatatgagatatccctcattctattttatagctggagggttcttcaatcagtgcaacgctttcacaagtcggcgcaaggatcttagttacctgatacatcgtgtggagtttccctgagacacagtctcctgtcctaggtgcatccttggtcctaagctggtccatcactgaggtcatcagatattctttctttggtttgaaggaggcatttgggatcacacctttctggctcctatggctcaggtactccacgttcactttactctaccctattgggctcatcagtgaggtgggcttaatctttgttgccatgcctcacatgaagggaagatccttctacatctgcgcggcattgaccagtctctacatcccaggattcccatacttgtaccgttacatgctcgcccagaggaagaaggtcctgtccaaggcgaaaaccgcgtaatgctccatacgagccctcactgtcacagagtaattaatcagtgtggttgtagactcgtactgtaccatggctcttatcaggtggagataacagtgtggttgtactgtagttacaggccacactgattatatagctctccgctcttatcaggtggcaaaatcatatataagtgg

SEQ ID NO: 12746 - DNA, 729 bp, Sorghum bicolor
  Clone ID: LIB5049-002-R1-XP1-G4
gccggccgggccgggaactcttcaatggagggtgttccttcaaaaaaaaactcttcaatggcggctctacctctctgtgtacaactgggttagcttcttcggatggttgctggtgctataccatgcaatcttggcgctgttaggcggtggccatgaggccgtctatgatgctgtcaagcttccactcctgttttcacaaactgctgcattagcagagattcttcattctattacagggtttgtgagttctccaatcagtgcaactcttccacaagttggtataaggacatcagttctctggttcatcgtgtggagatttcctgagacacagtctcatgtctgtcttacttccttggtcctaagctggtccattactgaggtcatcagatatcctttctttggtttgagggaggcatttggaatcacacctttttggctcctatggctcaggtacagcacgttcattgtactctatcctatcgggcttatcagtgaggtcggcttaatcttcactgctatgcctcacatgaagggaagatccttctatatctgcgctgcattgaccactatctacattccaggattcccacgcatgtaccgttacatgctcgcccagaggaagaagaacctgtcccagtccaaagccgaaagccgcatgacgctccagacgagcctcactgtaccagacagagaaaccagtgtctctgcctctctggaggacgcgcttcc

SEQ ID NO: 12747 - DNA, 730 bp, Sorghum bicolor
  unsure (1)..(730): unsure at all n locations
  Clone ID: LIB5048-004-R1-XP1-D10
ccggggcaactcttcaatggagggtgttccttcaaaaaaaaactcttcaatggcgggcgacaacgggtcggtggttcggcggctctacctctctgtgtacaactgggttagcttcttcggatggttgctggtgctataccatgcaatcttggcgctgttaggcggtggccatgaggccgtctatgatgctgtcaagcttccactcctgttttcacaaactgctgcattagcagagattcttcattctattacagggtttgtgagttctccaatcagtgcaactcttccacaagttggtataaggacatcagttctctggttcatcgtgtggagatttcctgagacacagtctcatgtctgtcttacttccttggtcctaagctggtccattactgaggtcatcagatatcctttctttggtttgagggaggcatttggaatcacacctttttggctcctatggcccaggtacagcacgttcattgtactctatcctatcgggcttatcagtgaggtcggcttaatcttcactgctatgcctcacatgaagggaagatccttctatatctgcgctgcattgaccactatctacattccaggattcccacgcatgtaccgttacatgctcgcccagaggaagaaagacctgtccaagtccanaggcgaagccgcatgacgctccagacgagcctcactgtaccagacagagtaaccagtgcctctgcctctc

SEQ ID NO: 12748 - DNA, 1001 bp, Sorghum bicolor
  unsure (1)..(1001): unsure at all n locations
  Clone ID: SORBI-28MAY03-CLUS17600_1
gatacatttcaacggcccggctctcgccgggccgggggttccgccgcccccacacgtctcgtctctcctccgttcccctccggcctctgacccgtgcaactgaaccagcgatggcgcgccgcctcctcgccttcctgctcgcggcgtcgctgctgctcccgctggcccgcccggaggactcctccacctcctccacctccaacttgtccccggccgccaacaccaccgcgtacgacgagctcggcctccgggggttcccgcggggcctgctcccggccaacgtgcgggcctacacgctcgacgccggctccggggacttcgccgtccacctccgctccagctgccgcatcgtgctgcccgcggggagctacctcgccgccttcagcgaccgcctcacgggccgcctcgacgaccgccgcatctcgggcctcgacggcatccgcgtcagggccttcttccgctggtggtccatcaccgggatccgcgccgacggggaccagctcgtcttcgaggtcggatccgtctccgccaagttccccgcccgggacttcaacgccagccttgagtgccccgaccaggccgcggcctaagtcaacgaggtatcctgtctgcatgttccatgctagtatgtgacatcctaaaagggcagctggacgccaagcacatcagcgtatttaatttcaactgtctttattgtaatgtattgtataaatttaggacagactggatcgataaaggcgcctttacaggccaaaaatccgggatgacgatagtggttctttgcatttcattaggaatgccctacgtcatggtttgaaaagctgttcttgtatctatcgtccttattaagaacagccgtataagactacttggtatatataagaagaaaattgaggtgcaagagcaagacccctaggtgctgaatacaaatgcctttgtgaaatagtataattatctttgttattgcaaaaaaaaaaaaaaaaatccgagggggggncccg

SEQ ID NO: 12749 - DNA, 1001 bp, Sorghum bicolor
  Clone ID: SORBI-28MAY03-CLUS17955_1
gcggcgctcgacacggccgggccgggaggagagagaaatgcgatgtgtgcctaagaacacccggcgagggacgggttcgaactcctcccaccggcagccatggccaccgccaccgccaccacctccccgctcttctccctctcctccctctgcgcctccctcccttcccccacccggatccccacgtctctctcgctccgtgccctctccccacgtgcccgtctctctgcctcccttcctttcgcctccccactcggcgggtacgggacctgggcggcgacttcaacgtcgtccgcgggaaggttgagacggcgggggctggaggtggtgtgcgaggccacgacagggcggcagccggactcggtcaagaagagggagcgccagaacgacaagcaccgcatccgcaatcacgcgcgcaaggccgagatgcgcaccaggatgaaaaaggtcttaagagctcttgaaaagcttaggaagaaacctgatgcccaacctgaagaaataatcgaaatagagaaattgatctctgaggcatacaaagccatcgacaagacagtgaaggttggtgccatgcataggaacaccgggaaccatcgtaagtctcgactggcgaggaggaagaaggccatcgagatactccgtggttggtatgttccaaatgctgagcctgtcgccgccacctaggattcttgagaaatcactatcatggattcgtggcagcttttcatcaaatttcaccaattttgggcaacatatgctattcaaggatctcgacagcttgccaagttctctattgaaatggtctgttcataccttttctgctatcttctatgtctatgcgcttgctctgtattagcagttaaactactgactagagtggccacctcttctccccccgtttctgttgttgttcacttcattgttgtaaaactaaagtcagaaaaatttaaatatagctgttctctggtgtgtccagatttcttcagctggaaaaagtataa

SEQ ID NO: 12750 - DNA, 923 bp, Sorghum bicolor
  Clone ID: SORBI-28MAY03-CLUS13582_1
gccggccgggccgggatcctctcccgtgccgccgccgcgacgcgccgccggccactccaccgttcagtctccaatggcgtcgactcatgcaatcagcaagaagcggaagttcgtggcggatggcgtgttcttcgcggagctgaatgagatgctcacccgcgagctcgcggaggatggctactccggcgtcgaggtccgcgtcacccccatgcgcaccgagatcatcatccgtgccactcgcacccagaacgtcctcggcgagaagggccggagaatcagggagctgacttctgtggttcagaagcgctttaacttcccggagggtggcgttgaactctacgcagagaaggtgaacaaccgtgggctctgcgccatcgcccaggccgagtcgcttcgctacaagcttctgggtggactagccgtgagaagggcatgttatggtgttctcaggtttgtcatggagagtggcgctaagggctgtgaggttattgtaagtggcaagctcagagcccagcgtgctaagtctatgaagttcaaggatgggtacatgatttcttctggtcatcctgtgaacctatatattgattcagctgtgagacatgttctcttgagacagggtgtgcttggtatcaaggttaagattatgcttgactgggatccaaagggcaagcaagggccaaccatgcctttacctgatctggttacaatccacgagcctaaggaagaggatgagtttttgaggcctcttgcagccgaaatcccagttgcctgaagtaaaaaagttggaagtggggcctatggttgtggtctgccttttttgtgttcgtgtaatgtttattattaacatgttgaaagtaaagagagctttactttctatagttgcaaacaatgacaatcaatatattctttctgcttctcgcttt

SEQ ID NO: 12751 - DNA, 958 bp, Sorghum bicolor
  Clone ID: SORBI-28MAY03-CLUS14149_1
caggcacgagggtgaaactccttccatggtcaaatgggatgtgcttggcagagtatcttcctgctttagaagatagtcttaacggtctgcttgtagaggcatcagcttcaattggttccagaagacgttttattgaggcactagctcctacctttgggagaccattagaggctgatccgattttttgcaggagggctacaattctttccatttctggaattttcacatttctggttcactttgccatcccccttcaattcccaaagcaacaacctgttctcacattgcagagttctcagcactgtaatgccgatgggacgcctattatgtcgccccccataaatgactatccctggagtcctagatgggatcaggcagaaatggttgaacgtatctacgacttcctgactgacgagtgtcaaaatttcaagaagttctgcagcgatgctatcactcagcagaagtagctgttcatcattctgcagcggaagctcccgtgctgattttctcaggaacaagctgctttcttattctaagcaagcggtacacctgtgcctacttgtgcgctgcaaccggtgattgactggtgggcataagctgttttctttctcgtgtgagcggcagtgagggtcaatgaggcaacctcaggcgttaggatgggcataaccaagccggacaacaagacggcttggttgcactgtttcgtaccccctatataagctgccgacatggtgactgtttgggatggtatagatgaatgcaatccagttctttggaccttgtaaatatatggatgatgacaccccctacctccaatgcattctcagtcctctgtaaagtactatatgctgtcaatgtcagtgtcagtgggaaagtttgcgatatcggccattgttcgtttggctgataagccatggtaaaagtactgttgactgattttgttgtaagagaaaaacac

SEQ ID NO: 12752 - DNA, 808 bp, Sorghum bicolor
  unsure (1)..(808): unsure at all n locations
  Clone ID: SORBI-28MAY03-CLUS14113_1
ccccccgccccnncccccgcgccccctgtgcggcgctcgacccgggcgggccgggatcgttaaaaccgagaagaagagaagaggccgaaggaaaacaaatcctgaaaccaagccatgggtctgcaggaggaatttgaggagtacgctgaaaaggcaaagaccttgcctgagagcacgagcaatgagaacaagctgatcctctacggactgtacaagcaagccactgttggaaatgtgaataccgaccgtcctggcatattctaccagaaggacagggccaaatgggatgcatggaaggctgttgaaggtaaaccgaaggaagaggcaatgaatgattacatcaccaaggtgaagcagctccaggaggaggctgcggctgccacttcttaaagtctcttaatagttgccaaacagctattgtcagctgagctttatgccatttgttcgtgagaaatagatcatttgatccactggggatctgtgaactatgtacctgcttatgtaactggttaccaatgttatccatctatctacatgtgaagacttaatatgtctgtgtattaaggctgtgtttggttcagtttctaggaagtgcgcttctgctggccaaacgggtagaacacgaagctgtttttccaaaataggctgttttcatgtagtataattatcccacaccttggaccctgctttgcctttcagctttcagttttccaaatgggtgaataaaataaagagatgttttcatttgcttcgagaagatacgaggggtagttttatagttgctacaaaaaaaaaaaaaaaagcccct

SEQ ID NO: 12753 - DNA, 1211 bp, Sorghum bicolor
  Clone ID: SORBI-28MAY03-CLUS13921_1
ccgggaggcaggcacccctagagtcttagccggccggccggcagccccgcccaagaatggcgcgcctcgccgccgtggccgtggccttggccgccatcgccgcggtggccggcgcccaggagacgtactacgcgtccgtggagaaccaccttcctgcgctgggcatgaagctggcgtgccatgcgatgggcgggttcctgacggagctcagcgtggtgccgcgcgggcgcgtgccccacggcagggccgggcggcgcgtcgccgagatgctggtggagcgcgggaagcacgggtgggtgcgctgcaactgggcgtacgcgggtaactacgtcgccgggatcacggtgctggactcgcggtgccccgaggcaaaggcggtgccaggaccccggcggccagggcctgttgccgcgtcgtcttcgagaacgacagccgtggtcctcaagacgcccatcaggggcgtgcgcgtcatcggtcaaccggaagcagtacaaggtgacggtccatgggtacgtggagccgcacaaggtggtgaagcgggtgcaggccacggggaagaaggccgagatctggccctacgtgccctacagcctcgtcgcgcacccctacgccgcgccggcctacgacaagaaggcgccgccggggtacgtgcgcagggtcgacgccgtcatgcccgtctccagctacggcggaccaacggcggccggcccgcaggaggagcggctcgtcaccatgttcagcgtcgacaaccccaacgcatgctccatcatgtaaattactactactgtcaaatagctagctagctacagatcgaccgtgcagccgcagtggtgggtgcacgcagctctctctcttcgatcacacaacaaaatcgtggatgtgacaaatgtgaagaaatatatacagtagatatatatctatacatatatatgtgttcggctcgtcccgttcggtatatgttcatgtccatggcacatgtgtacgtagctatatgtttgtatgctttgtagagtgacacaaccaaaagagagcatccgtgtggcagagatactgtcgcatctgatctcattcattccagtgctctctctgcctcgcttgtatgatagatgaggggtgccaaccatttggggagtccaattttgtacattatattttacagagggcttccattaatatatacaatgcagattgctcacagcacattccccttt

SEQ ID NO: 12754 - DNA, 313 bp, Sorghum bicolor
  unsure (1)..(313): unsure at all n locations
  Clone ID: LIB3480-022-P1-K1-H3
ccggaagcagtacaaggtgacggtgcaggggtacgtggagccgcacaaggtggtgaagcgggtgcaggccacggggaagaaggccgagatctggccctacgtgccctacagcctcgtcgctacccctacgccggccggcgactcgggagcgccttcgagtacttcgccgtctgatctcattcattccagtgctctctcggcctcgcttgtatgatagatgaggggtgccaaccatttggggagtccaattttgtagattttattttacaaagggcttccaataatatatacaatgcagattgcaaacananna

SEQ ID NO: 12755 - DNA, 877 bp, Sorghum bicolor
  Clone ID: SORBI-28MAY03-CLUS14254_1
cgtgtggcgcgcgcgcaccaaggcgctcgggctggcacccgagcagcgcaccaagctgctgttcgccgtggacgggcggcgccggttctcgccgccgctcccgcggggctacttcgggaacggcatcgtgctgaccaacgccctggccaccgccggcgagctgctgtccgcgcccgtgtcgcgcgcggccgggctggtgcaggaggccgtgcggatggtgaccgacgactacatgcggtcggcggtggactacttcgaggcgacgcgggcccggccgtcgctggcgtccacgctgctcatcaccacgtggtctcggctcgagttccacggcgccgacttcgggtggggcgagccggtcatgtcgggcccagtcacgctgccggagaaggaggtcatcctcttcctcgcgcacggaaaggagaggaagagcatcaacgtgctgctcggcctgtccaatctggaccagaacatcgcggtgatcgtgcagaacgagatatgctacacgccctcggcgccgtcgcccagcgccgatggcggcgaggacgtcgacgtggcggccgcgctccgcgacgcgctggcgcgcgtgccggtgcacttccacccgctggcggggcggctggggatcagcccggagatgaagctgaccgtggagctcaccggcgagggcgtcgtgttcgtggaggccgacgccgcctgcgacctcgccgtcgttggcgacctcaccaagcccgaccccgccgcgctcggccagctcgtctactccgtccccggcgccaagcacatcctcgagatgccccccatgaccgcgcaggtgacgaggttcaagtgtgggggtttcgcgcttggtctggccatgaaccactgcatgttcgatggc

SEQ ID NO: 12756 - DNA, 2107 bp, Sorghum bicolor
  Clone ID: SORBI-28MAY03-CLUS13747_1
cggacgcgtgggcacagccccacgcacccacaccacagcacctcgccctccaaaccccatcatcacccacctgcccttttccatttgctttgctagcttcttcctcctctcgtcacctcgccattgcatcccatcttgtgctcccagttcttgctgctgctagctcgatctttcgcatgcgtctaactccattctcccaatcctagcaagccctgagagagactgttcttgtgagagagctggacaccatctccccacccattacgccttagccaaaccttgagaaaaacctgtggagcatgtaactccagtccctatcaaaaatccaaacccaacccccaaaaaaacacaaaaaaaaaagaaatcaagatctccaaaagcatcggtgttgcgaagcgaggcgtaagttttggtaggctggatacttccccactaattccttagcacaaactcaacaaaagcctccggatcatgtaagtttcgccatcatctttgctcgccacccaactgacaaaaaaaccaaaaaaaaaaaatagcaagaccatccagcatcatgcatcgctagttgtagccatacatcagtcgtagtctctgctagtgatcggcctgctggagcccatcatccggccattatcatagcatcacctcagcaaaaaccatcaaatcatgtaattagtacacttcagtgacctatttctgctgcactgccggcagtccaaaaaaccaaaaaaaaaagagattgtcttcgagagtgagagcgagagaaaagaaaggggagtcttcgagagtgagcgagagagcaagactgcaagagagagaggaagcaaggtgctaccaatggcggagccggggtcgacaacgcccccgaacgggtctgcgccggcgacgcccggtacgccggcgccgctgttctccggcgggccgcgggtggactcgctgtcgtacgagcgcaagtcgatgccgcggtgcaagtgcctgccggcggtggaggggtggggcattgcgacgcacacctgcgtcgtcgagatccccgcgccggacgtctcgctcacccgcaagctcggcgcggagttcgtgggcacgttcatcctcatcttcttcgcgacggcggcgccgatcgtgaaccagaagtacggcggcgcgatcagcccgttcgggaacgcggcgtgcgcggggctggcggtgaccatcatcatcctgtcgacgggccacatctccggggcgcacctgaacccgtcgctcaccatcgcgttcgcggcgctgcgccacttcccctggctgcaggtgcccgcgtacgtgtccgtccaggtgctgggctccatctgcgccagcttcgcgctcaagggcgtcttccaccctttcctctccggcggcgtcaccgtccccgacgtcaccatctccaccgcccaggccttcttcaccgagttcatcatctccttcaacctcctcttcgtcgtcaccgccgtcgccaccgacacacgcgccgtgggtgaactcgccgggatcgcggtgggagcggccgtgacgctgaacatcctcgtcgccgggccgacgacgggcgggtccatgaacccggtgaggacgctggggccggcggtggcggcggggaactacaggcagctgtggatctacctgctggccccgacgctgggcgcgttggcgggggcaggcgtgtacacggcggtgaagctcagggacgagaacggcgagacgccgcgcacgcagcgcagtttccgccgctgatcatgacgacgcgcaagacattgcgggagacattgccgtgcacgtcacccgtctcgcgcgtcctcccccgcgtaacgcacggccacgccgcgggcgcgtccgtggtgtccgtacgtctccgtgtcaagtgtatcgtgtcggtgtcgagtcggtacgtactgtgtccgtgtctgtgttgcaataagccccgttctgcttcgtccagaacggccggcggcgtccagtgctatgtgtggtctgtgttgtgacttgtgagtcggattattctgggtcgtcattcgtcaaagagtcgtgtgttttgaacgagtctctcggtgtcgggtttgatgcgatccatcatcgtgtgtcttgaataaaagccacg

SEQ ID NO: 12757 - DNA, 463 bp, Sorghum bicolor
  Clone ID: LIB3480-006-P1-K1-C7
cgcgccctcgacaaccaccacccctagcagacagatcgaccgaccaccacgggcgccaccatctccaccgcccaggccttcttcaccgagttcatcatctccttcaacctcctcttcgtcgtcaccgccgtcgccaccgacacacgcgccgtacgtatatatatacatacatggtgggtgaactcgccgggatcgcggtgggagcggccgtgacgctgaacatcctcgtcgccgggccgacgacgggcgggtccatgaacccggtgaggacgctggggccggcggtggcggcggggaactacaggcagctgtggatctacctgctggccccgacgctgggcgcgttggcgggggcaggcgtgtacacggcggtgaagctcagggacgagaatggcgagacgccgcgcacgcagcgcagctttcgccgctgatcatgacgacgcgcacgggcgcgcgcgagaca

SEQ ID NO: 12758 - DNA, 1313 bp, Sorghum bicolor
  Clone ID: SORBI-28MAY03-CLUS19165_1
gccggccgggtccgaacccttccgcgtggtgtgctccgttcctctttacgccgtttcctctcccgactctctcctcgccgtgcgccggcgtccgacgcgtaggagtaggaggaacaaaggccgaggcggcgggcgcggctgcggctgcagaggcgatgggtgatcatgaggcgcgcggtgacgacttcgagaagaaggcggagaagaagctctcgggctggggcctcttcagctccaagtacgaggacgccgccgacctcttcgacaaggctgcgaactccttcaagctcgccaagaactggagcagagctgcatcagtgtacatcaagattgctaactgtcatttgaagggagatagcaagcatgaggctgcctcagcgtacgtcgaggcagcaaattgctacaaaaagttctcacctcaggaagctgctcaagcgctaaaccagtctgttaatcttttcttggaaattggtaggttgaacatggctgcaagatacagcaaggacattggtgagatatatcagcaagaacaagatttagagaaggctacagattacctggaaagggcagctgacctttttgacagtgagggacagtcatctcaatcaaacaccatcaaacagaaagtagcagaaattgctgctcagttggaacagtacccaaaagcaactgagatatttgaagcgattgctcgtcagtcaatcaacaataatcttcttaagtatagtgtcaggggaattctccttaatgctggcatctgccaactatgtagaggtgatcctgttgccatcacaaattctctggagcgataccaggaaattgatccaactttctctgggacacgtgaatacaagcttttagctgatcttgctgcgtctatggatgaaggcgatgttgccaaatttactgatgccataaaagaatttgatagcatgacacgtctggatccttggaaaaccaccctgctgctcagggcgaagaatgagctgaagaaaagggaggacgatgaggacgaccttacataagtattgttgtaaaaaatggcacgatatgttttcgtttgtggctccattgcattggaggcatcgtgttccttacaaacgagcatgatgataaaattaatcgctggtctgtggttgtacagaacgtcaatttgggttgtcctgttgatgtgactgccagtttcattgacttcatgatttgctgtcattgaaaattagtaccgaatgctttttctgcggttcctgctcttttccatttgctattgtagttctataccttattaataatctaagcggtttccgctggattgt

SEQ ID NO: 12759 - DNA, 811 bp, Sorghum bicolor
  Clone ID: SORBI-28MAY03-CLUS19256_1
gccggccgggctctctgggttccactccccgcgtcccaccaacccagtccattcccccagcggcccgcccaccccactccactccactccacaccgcagctcctcccattcactcactcgagccatcatggccctcgcctcccgcgccgccgccatggcgtgcgtcctcctggcgctcgccgcctccgccgcgggggcgggctcccactcccctgccccggcgcccgcggtggactgcgtcacccaggccaccaccctcatcgactgcctcgactacgtccagccggggagcaccgcaaagcggccgtccgctgcctgctgtgcggaggtcaagaccgccgtggccagccccgccatcgtgggctgcctctgctccctcgccggcaacaaggacctgggcattcccatcgacatgaagcgcgtcctggcgctccccggcgcgtgcggcgcgtccaacgccgccttcagcaagtgcaacatttccgcgctttccccagcaggagcacctgcaccatcatccaccgctgggggatcgtcgagtggcggggcggccgcatcaccacccaaagccgcggcagccagttctccaatgacggcgaccgctctggtggctgccgtggcggctcccctgctcgcctacttctacctcttctgaggatctctgttgcctgcctcgcatgctatgccgccgtccaggctgtggctgagtgactatgtattatgacgattaatttacctttgtggagctgctagttaccctgttaatgagattgttggtgattgaggtggtggtgttctatatttagcagac

SEQ ID NO: 12760 - DNA, 730 bp, Sorghum bicolor
  Clone ID: SORBI-28MAY03-CLUS19328_1
cttacttcgttggttgactacccttccaccccacggttcactgatagctttgtgttggttgctcttacctttaaatttagcgctccgggccgccccagccgccgcttcgcccctgcgacaaagacgacgcaagccctcgcctctcccaactcctccaaaccctcgccgactcagatccagctgccccgcgccgccgtcgccatgcctttcactccgggcccctactccggcgtcagcaccctcgcccttgtggccagggcgtctgccttcagcgtcggtgtcgtctacgggagcatcaagctctcaatcctcaaggcaacaaaacctaaaaaggaggaagcacatgctcatcactaagcatggcagggctgctacatgttaattcctatggaaggatgttataaattggcattgcacccttttctccatacgtgcaacttggtttatgatttgtggatctcttgtctgtaacacctgcgagttaccttaggtttgtgtcataataaattcttatccaatgacttgaaatcaggaaggaaggggaaaaaaattaaagaacccaacttttgttttgtgaggttgcaaagttaggacatggcctcttgaatttcggtcatgaggatcggccttgccgattctgttttgttgcgacgatgtgcaatggatggtttgtgcggaatgatggcacttattgttttcacaaataaaaaaaaaaaaaaaaaggccccta

SEQ ID NO: 12761 - DNA, 1173 bp, Sorghum bicolor
  Clone ID: SORBI-28MAY03-CLUS1940_1
gcacgagggacgccgccggttggtcggatccctctccgccctcctctactcactccactcacctgcctgccgcgcaccagtcacctctgcctctgctccgcttgctgcggccggcggcgtccgcaaagcttcctccgattcgaccccgatcgggacacgcgttctccatggcggagcagctcagctcatcccaggatgcccccaatcgccctgcgccggcacagagggtactggtgacgaacacgcatggtgagactctcgtcggcctgctgcaccacatggggtccgacaagggacgatagcctcattactgatcttgcggctgcactgacaaagcaagggtccagcgtgtttcgttttgattttagtggaaatggagaaagtgaaggtgaattccagtatggcaactacaagaaggaggctgctgacttgcactctgttgtcttgtatcttcgccaggaaaagtacaatgtagcagcaattgttggtcacagtaaaggtggagatgtgatggttctatatgcctctatctacaacgatgtccccatggtggttaacctttctggtcgatttaatttggagaaaggcattgaagagcgcctaggcaaagagtttatggatagaataaacaaagaaggctacattgatgtcacaaacaaatcaggaaaggttttgtacagagtgaccaaagagaccttgatggaacgactgagtattgatatgcacgcatcaagcctttccatcagcaaagagtgcaggttctttacaattcatggttcagctgacgagatcatacccgtggaagatgcatacgagtttgcaaagcttataccaaaccacaaactgcgtgtcattgagggagcaaatcactgctacactgctcaccgtagagaactttctgatgctgtagtagaagccatcacatccagtgaggcaggggagaccaaaccctagagcagatgcataacggcgtcctcctccagcctgctcttccaagcctgccatctcatcaccccagtcaccttaccttattataaaggcttagattagacatagacagaccctggttttgctcctccatctgtcgctttctgagaaattaaatattttcaactttgatgaagtatatacaagaaattattaatatttatgatatataataagtatcgttag

SEQ ID NO: 12762 - DNA, 709 bp, Sorghum bicolor
  Clone ID: SORBI-28MAY03-CLUS19814_1
aaccacaacaacatggccggacggatcggcacacagtctcggctctcgttccattgggcgaacgacactgtacacaaacctagctatactagcttagacaacgacccaaaccaaccagcaaccatggctggtggtgctcatcaacaggtggtggttgtgctcgctatggtggcgctcatggtgacggcggccgagggtttcatctccaagaagacatggagcgccatccggcgagcggaccgcgacggcccctttgtggggctggtggtgcccaacacctacgagatggaccccgtcctaagctcccctgacttcaagcctagcaacaacatccccattctagatgtccaagggcgacgattccgcttcggaactattggaagccaaaacgttgtcatggtcatgactgggctgagcatgctgaatgcagggctcaccacccagctgctgctgagcctgttcagggtgaaaggcatcgtccactggggcatcgccggcaacgccaacgaggaccttcagatcggcgacgtgaccatccccgagtcctgggcgcacctgtccctgtggaactggcagaggcacggcgatggtgcggagaacgagctgccgctggagagcgccggcgactacacgagggagtacggcttcctcaacttctccgactacactgtcggccaggccaacccggagctgtcggcgaacactctga

SEQ ID NO: 12763 - DNA, 945 bp, Sorghum bicolor
  Clone ID: SORBI-28MAY03-CLUS15437_1
ccgaaaccgcgcgtgcccgcatgcggccgagcagaagcggtccccaaatccccaatccccccgaaccctaacgaccactgagtcaccaccgttgccccgtgccgccgcgcggcagagcctcgacgccccgacgcgaaccatagcgactgccgagtcgctgccccgcgcggccgagctccgacgccccaacgccgacgacgcgagaggcccgacacaggatttgagacaacatgcctaagataaagacaagccgtgtgaaatatcctgaaggttgggagcttattgagccaactcttcgggatctggaggccaaaatgagggaagctgaaaatgatccacatgatgggaagaggaaatgtgaagctctttggccaatcttccgtatttctcatcaaaagagtcgctacatatatgatctttactatcgaaggaaggaaatatcaaaagagttatatgagttttgcttagaccaaggttatgcagatcgcaatctgattgcaaagtggaaaaagccaggttatgagcgcctctgctgccttcgctgcatacagacacgagaccacaacttcgcaaccacttgcgtctgcagagtgcccaagcacctcagggaggaaaaggtgatagaatgtgtccactgcggatgcaggggctgtgccagcggtgattaaagttgctatcctgtggttgtgggataacctcaaaactgttcgaaatgtgccattgtatttgagccggtatgctgtgaacaagcaccgtataatcaggtggcgagcggtgattacagtttcccatctcgtggctgcaaaataatgtcggactaattgctcgaggtggctcgttgtattgatgatgatatctgttggggacagcactgtataatcagttgatttcaacctgtgtgtgcaatgtattgcaaaatgccaaaatcaaagttaaattcaagtg

SEQ ID NO: 12764 - DNA, 853 bp, Sorghum bicolor
  Clone ID: SORBI-28MAY03-CLUS15664_1
gctggatacaactgatctcccttcccttaatcttccctccatactgcatgacccattaattcaccttccactccccacttcaccacttataacactacatggttcacaggttccaacattcacgccattgatgtctgatcccattgtgcatatcccagtcattgatgtgtgttcggcagggcaggcatatctagtgagttgtgggccttctatcacttcagcagttcccctgctcccgagcttgaagcctctgctgccagaagcagaatcgttagtcgagagaagtgcaagggaaacactgatgaggctcatagcttcgacaccacctgcaagcaatcctcagctggccaacgtgctacctgtggtcattcctgatatgcctgaaagtatataccgggccaataatgtgaacaagcatgttgatgtgggccccaatgacaaagcatttggtacgtcttgtgttgctgctgtgtttggaagtgggattgcacaagctgaggatgaagttccaagcggagatgattcacaagagcaatttgccgaatatgatggtaccagcaatgaatgtgatgtacagcattgccagaaaatatagaccgtgacacagttggcataagaaggcgtgctgcatgtctctatggggatgttgttttagtttgattggcagttgcatcatcatggtaaatagggttttaaggattcggtgatttgatgctctgtatgcagccttttgtttctgtgcccagccagcaggcctatctctatctggttggcaaatgtaattagtagcttgtactgtgttttgttttggcaaacttgctgcgagcctcatgcttagtttggttcatttgtt

SEQ ID NO: 12765 - DNA, 1057 bp, Sorghum bicolor
  Clone ID: SORBI-28MAY03-CLUS16126_1
tcagatttggggattatcggaaggatgatccctcttcatttagcctgcattcaaatttctcattgttccctcagtttatgtttaatctgcggcgttcacaatttgttcaggttttcaataacagtccagatgagacagcttatttcaggatgctactcaatcgcgagagtatcactaactcggttgccatgatccagccttccttgatatcattttcttttgattcacctccatccccagtatttctagatgtggcatcaatagcagcagatcgtatactgctacttgatgcgtactttagtgttgttattttccatggtatgacaattgctcagtggagaaacatgggttatcagaaccaacctgagcatgagcaatttgcacaactattacaagcaccacatgaggatgcacagatgataataaaaggtcgatttccagttccaagactagttgtctgcgatcaacatggctcgcaggcaaggtttttgttggctaagctgaatccatcagccacatataattcagctcatgatgttgctccaggttctgacatcattttcacggatgatgttagcttccaggtcttctgtgagcacctacaaaggctggctgttcagtcttaaggaaatttatgcaaaagttgtacaccttatatttgatagttgctgataattcactgggttcttaggttggagttgtgagaaatttcctctatctgtttctttggccacaattttctgagatcagacatttttttcccgggaaataatcctaaaggaatgtgtaagttgcccccagaggtctattatctacatatagtctatacttgtttatgttgacattacccagcttctgtagggtggttgcatgaattgaggtttgtgtcaagttcagttcacagaaatgtaagatggtatttgcaaggcattatagtacagtgtgcatacaattgagcagcttaggcacttgtcccttgaagcacatgagtttgtaaatgtgacatctggacacttgacatgctctctaagatttgattttacagccaacttataca

SEQ ID NO: 12766 - DNA, 938 bp, Sorghum bicolor
  Clone ID: SORBI-28MAY03-CLUS15710_1
cggggagggaaagcacgacacgagtcgccaacgtgacgcaacggggatacacccaagccgagccgaccagggaatcttaggcaccgtcgcgtctcgcgtcgtcgcccccaccctggcccgtttctctctcgctcaaaagttgctggagccgtcgtcgtctctctctctctctccgaccaccagccatggatgaggcgcaagttgtggagtcaaaggatggaaccatctcagttgcttctgcatttgctggtcatcaggaagctgtgcaagacagggatcacaaattcttgacaaaagcagtggaagaggcatatcaaggagtcgataatggcgatggaggtccatttggagcagttgtagtccgtaatgatgaagtagtagttagctgccataacatggttctgaagcacactgaccctactgcgcacgctgaagtaactgcaattagggaggcttgcaaaaagcttgggaaaattgagctctctgactgcgaaatttacgcgtcctgtgagccatgcccaatgtgcttcggtgcagttcatctctccagaatcaagaggctggtttatggagccaaggcagaggctgccatcgccattggattcgacgacttcatcgcagatgctctgagaggcactgggttctaccagaaggccaacatggagatcaagaaggccgacggcaacggtgcgctgatcgctgagcaggtctttgaaaagactaaggagaagttccggatgtactgatgcttagcagaagaggagatttcagatttgtacaatgctcacccagaaggacaatgaataatacagttgccaaaatgtccattctttcggaaaaaatatctcgattccattgtttaacattctgatgatgatgcatggatttgttgtaaacagtaaacagacacaagatgttctttgctgtaacttaatgtg

SEQ ID NO: 12767 - DNA, 805 bp, Sorghum bicolor
  Clone ID: SORBI-28MAY03-CLUS17120_1
gccggcagggccgggaaagaacccttcccgtgctcactggggttgttggcctcccgacccgacgacccgacccgtcccctatctcatctgcttcctgctgagctcaggaaatcccctcccgtccccattccacccgccgccgccggtcgacgcgcctgtccaagatgaatgtggacaagctcaagaagatggcgggcgctgtgcgcaccggaggaaagggcagcatgcgcaggaagaagaaggcagttcacaagaccacaaccaccgatgacaagcggcttcagagcacattgaaaagaatcggagtgaacactattcctggtattgaagaggtcaacattttcaaggatgatgttgttatccaatttcagaaccctaaagtgcaagcatctattcctgcaaatacatgggtagtcagtggagtaccccagacaaaaagtctgcaagatcttctgccatcaattatcaaccaactgggccctgataacctggacaaccttaagaggcttgctgagcatttccagaagcaggtaccaggtgctgaagctggtgcagctgcacaggatgatgacgatgtccctgagcttgtcccaggagagacatttgaggaggctgcagaagagaagaaggtgcctgaaccggaaccggaagagaagaaagaatcgtaattttgctgtgtctcatatccgttgttgtgaagggtcacttggtttaagtgtttccgttagccatgcgagagacctgctcatctatgaactctgacatgcctcattcgtttacatgtgctccagttctcactggagtg

SEQ ID NO: 12768 - DNA, 1248 bp, Sorghum bicolor
  Clone ID: SORBI-28MAY03-CLUS17378_1
gccggccgggccgggcctcgtccccgggcttctccctctcctcctcctcctcctccctgcctatccatcctcgtcctcggtcctccccagcaatcgaagacaagggcagagctgaaccgagccaggtcaaatctggccgcaccgcgtagcttctctctcatcctggcctcgattcgtggttgttttgggaaggagaggtatcggatcaggtcccttgatcactcatggtgcccagggacagggcgcatagcgccacaactgccaccgcggccccggcggagaacctcgttcaagggcctatcctgaacaacaagtgcgaaaagaaggctccaaagaaagtacataaatctgagagggagaagcgtaagcgcgacaagcagaatgatctctttggcgagctgggaaacatgctagaacctgataggcagaacaatgggaaggcatgcatattaagtgacactacacggatacttaaagatctactttcacaagtagaatctcttcgaaaggagaacaatacgctgaagaatgaatctcattatgttgccttggagagaaatgaactactggatgaaaccaatgtgatccgtggtgaaatctcagaacttcaaaatgagctgaggatgcggctagaaggcaaccctatctggagtcatgacacttctagatcaaatattacagcacctcatcctgcgaccacagtatttacattgcaacattcagcacatccacaagtcattgcaacaatggcacttcctctgcaacagccagcagtcgttgagcaatcttatgctgccccacggcgggagctacagctattccctgaagctgcacctactgaagatactgagccaccacaaaaccaggggatctctaataatgtgatgcggccccaggcaagatacccaccagtagtgacaactttgcctgtacatgtatatccagtccttccaagaatggaagatgagcaatgcagcagcggcactactagtagcagagaggaaggcggggtcggcaaccgctaacagctcaattagaaaacgagatctggttcacagcttgaaaagttttcgtagtttcaagtttaatgtttccgttatagctgatgtgctaaagaaaccttaaaacctatgcggctatgtgcctccatgtgtaaatatcattccaccctgtattacctttacctgaacttaaatcttcaacagttcgatgggagcaatctatctttgttcgttcactttgaagttt

SEQ ID NO: 12769 - DNA, 1325 bp, Sorghum bicolor
  Clone ID: SORBI-28MAY03-CLUS24654_1
gcacgaggacctcgcttgcgttgcgttgcgttgcgtgcgccgggaaggcacgagggggtgactggtccgttctcgcgagaggtggctgctgctgctgctgctgctggtgttcctcctcctcagctcccccggttgatgagcatgggccattgctccgagcagcggacggggttcgaggtcaccaaggactggaacggcgccgaccaggtcgcgatccggtccccgcggggggcttccgtccgggtctgcctgcacggcgggcaggtcgtctcgtggaggaaccaccgcggcgaggagctcctcttcagcagtagcaaggcaatcttcaagccgcccaaagcgacgcgtggtggcattccaatatgcttcccccagtttggaaactgtggaacactggagcaacatggatttgcaaggaacaagatatggacaatagatgatgaggctccaccactaaattctggtgataacaacaacaacaaagcttctgttgaccttctgctaaagccatctgaagatgacctgaagtgctggccacactgtttcgagttacgtctcagagtttctctttcaatggatggagacctttcactgatatcacgggttaggaatgttaacgggaagccattcagttttgcatttgcttatcatacacacctttctgtttctgacatcagtgaagtgaggatagaaggtctggagacccttgattatcttgacaaccttagccagcgggaacgttttactgaacagggagatgctataacatttgaatcagaggttgatcgagtctatgttggctgcccaggcgtaatagctgttcttgaccatgaaaagaaacgcacattcatcatccgaaaagaaggccttcctgatattgttgtgtggaacccctgggaaaagaagtccaagacgatgacagacttcggcgacgacgagtacaagcagatgctgtgcgtggatgcggccgcggtcgagaggaccatcacgctgaagcccggcgaggagtggacggggaagctggagctctccgccgtggcgtcgaccaactgcagcgaccacctggatcacccgggcaggctgtagagcactgggtgggttcgtcgcccctgacgaaaggcatgtactactttttttcatgtatgtacatgggggcgctaggtctgcaggctgcagtatgatctgcctgccaggcgtgtcatgtgtgagtttaaactaaatatgtcagatgcaagtatttctgtgatctacatgttcgatgttgttcgaagtctcaagcgtttatatatctgcatctttcgaagtctaaaaaaaaaaaaaaaaaa

SEQ ID NO: 12770 - DNA, 1353 bp, Sorghum bicolor
  Clone ID: SORBI-28MAY03-CLUS2169_1
tactgccccttttccctcttttcccctcgtgcccaccgcacgcgccgccggaaccctagcctccgccgccacaggcagccgggatggagaaaggagccccggaggcgtcgcccccctgcgctcgctgcggcaagcccgctcagcttcaatgccccaagtgtgctgaacttaagctaccgcgtgagaacgcagctttctgcacacaggattgttttagggcagcatggagctctcacaaatctgttcatccaaagcctggtgcactggcatcccagcagtctccagaaggttggaaatattgtgtgagaaaagggcggggacgtgcattggaacttcctcgttttgattggacaggtccattgagaccatatccaatatcaaagatgcgtgtggtgccagatgaaattgagaagcctgattgggcgcttgatggaattcccaagatagaaccagatagtgatttgcagaaaagagtagagattaagacccctgaactaatagaaaggatgagagaaacatgccgaattgcaagagaggttttagatgcagctgctcgtgtaattaaaccaggaattaccacagatgaaattgatagagtcgtccatgaagcgacaattgctagaggtggatacccatctccattgaattaccatttcttccccaagtcatgttgcacgtctgtcaacgaagtcataaacaggcatgcttcgatgtcaggtttatctgtggtgaaatcttattgtggccatggcattggagaactgtttcactgcgccccaaatattcctcattattcaagaaacaaggctgttggtatcatgaaagctgggcagacatttacaattgaaccaatgatcaatgcaggagtttggaatgatcgtctgtggcctgatgattggactgcagtgacagcagatggtaaacggagtgctcaatttgaacatacacttctggttacagagacaggatgtgaagttttgacggcacggttaccctcatcaccggacgtttttccatggttgaagaagccgtgatggggccattccatcaacagcaacaagaaagagatactgatacactgggtcagcaaaaatttttgttactctttatcagtcggtcaaagctgaaattttcaatttttccagaccagaaagtgataagcatgctactgctgaatagtctcaacaattgtctatcctgcggaattgttcctgagagtgtgtattgttaagtcggttttctccgagttacacgagacgtatggcttcttgagttgtgtcaccaatatgattatgccattaaagtttacttttgacttcagaaaacatgatttccatcaattttagtaggtta

SEQ ID NO: 12771 - DNA, 302 bp, Sorghum bicolor
  Clone ID: LIB3481-004-Q6-K1-E7
cgtccgctgtatactataaaggtgttcatggtgatttgaatgagacatattttgttggaaatgtcgatgaagcttccaaacagcttgtactttgtacctacgagtgcttggagaaagctattgcaatagttaaacctggagttcggttccgtgaggttggagaagtcataaacaggcatgctggggggtgaggtttatctgtggtgaaatcttattgtggccatggcattggagaactgtttcactgcgccccaaatattccttattattcaagaaacaaggctgttggtatcatgaaagct

SEQ ID NO: 12772 - DNA, 880 bp, Sorghum bicolor
  unsure (1)..(880): unsure at all n locations
  Clone ID: SORBI-28MAY03-CLUS250_1
gcgtccgctggnaacctttaccaaactggntaccagctcaatggaagcgcctatgtcatctcaaagcacataagcaatacatggctatgggatcgtgttcgagttagcggtggtgcatatggaggattttgtgattttgacaaccattcaggagtgttctcatatttatcatatcgtgatccaaacttacttaaaacacttgaggtctatgacgagacagcaagattcctcagagagctagaaatggatgatgatgcactcacaaaagcaattattggaaccataggcgatgttgacgcctaccagctaccagatgctaaaggttacagcagcctaatgagatatttgctgggcatcacggatgaggagcgccagcagagacgtgaagagatactatcaacaagtctgaaggatttcaaggagttcgctgatgctgttgaaaccatcaaggacaacggggtcgtggttgccgttgcatcaccagatgatgttgaggctgcaaataaggaaaacccggtattccccgaagtaaagaagtgcctgtgaggtccaccgctccttaataagggttttagtcggaggtgttttttcgacaggccttcactagacagcagtaaatggcaagtctgacaatgtaacatattgtgagagcaccatctctacgaccatgatcatagctgaatcttggcttctcttttcccatgcaatttttggagtcaataattagtgcagaggtaggaccaaagcacatagatgtagcgtcttcccatgttgactaaaaattcggatgtacacaatgattcagacaatacagaaacagatgatgagattttcacaaattgttggggtttccatatattaatacacccagttcaatgat

SEQ ID NO: 12773 - DNA, 716 bp, Sorghum bicolor
  Clone ID: SORBI-28MAY03-CLUS25405_1
gcacggcgccaggcgctgaaggcctgaagcgcctctgctactgtgctgcgctgacgcggtgacgccggtggggtgtgtgtgtgagcgaactgcgagctgccactgccgcggtcgacagccgggccgccggcagccgtgcgtgcgcgcggagccgagatggacgctcggtgggcggtgctgctcgcgctgctggtcgccagcggcggcggcggcggtgtccgtgtctgcgccgcgggggcgaagggcgccaactggctgggcgggctgagccgcgcgtcgttccccaaggggttcgtgttcgggacggcgacgtcggcgtaccaggtcgagggcgccgcgtccaccaacggccggggaccctccatctgggattcattcgcgcacgtcccaggaaatattgcggggaatcaaaatggagacgttgcagtggatcaataccatcgctacaaggaagatgttgatctcatgaagagtttgaattttgatgcctaccggttttcaatctcgtggtccaggatcttcccagatggcgaggggaaagtcaatccagaaggtgtagcatattacaataatctgataaactatctgcttcagaaaggcatgactccttacatcaacctttaccactatgatcttcctcttgcgcttgagaagaaatatggagggtggttaagcgctaagatggcggacctgtttacagactatgctgacttctg

SEQ ID NO: 12774 - DNA, 947 bp, Sorghum bicolor
  Clone ID: SORBI-28MAY03-CLUS5358_1
agatcagacatgtatgttttctgttgctcatacacgcacaatgttgcgcccagagggaagttcattgcatttgtgtctgcagaagcagagactgatagtccccagtctgagctaaagcctggaattgatctacttggttctgtagatgagatattctatgatatttatgacagatatgaaccagtgaatgaaccatctcttgacaattgctttgtctcgacgagctatgatgccaccacacattttgaaacaactgtaacagatgttctgaacatgtatacaatgatcactggaaagactgtggatcttagtgtggatctgagtgctgctagtgctgctgaagaatattgatttcagtcatcatgtttatcaaagatcacatcgtcagggacagcacatggaaacttcaatgaatggctggtatggtttattccggtccagattatatcatgccccttctactgttctgcgaaatgtctactgggtacttgttgctggcagaactatgcacaatattgactagttgatggacggtgatggttctatcttatttactagtgttgatcgaatggtgtaaaatgttataccgtgaccatcatggttgtgtgatgtatcataactgttcagtaaatttgggttctttactgtcgagttctgcttgatgctattgagcgctgcccgatctgcttgttctactgttccttgggtacttgttgctggcagaccaatattgtgcagtgaatttgtctcaagttgatggacggtggttctacaatttactagttgatcgaatggtgtaaaacgttatacagtgaccatcatggtcgtgtgatgtatcataactcttcagtgaatttgggggtctttactattgagttctgcttgatgctgtcgaacgaagtttgtcacccatcaagttcttcaaagattttttagggacgaatgct

SEQ ID NO: 12775 - DNA, 1076 bp, Sorghum bicolor
  Clone ID: SORBI-28MAY03-CLUS14771_1
gactagttctagatcgcgagcggcggcccttttttttttttttttcttttttttttttttttttttttcttaatttcactataataattgtgaaattaacaatgaacatttgtataggtacacgtcctgtggacctcacttgcccaacaatttgcctaaaaaccgcaaacttttggatagatcaacagtgaggtcctcatatgtacaccattttacaaagtgaaaagtagccaaacaacaatgggataggcttcaacaaaactgccaggaagtcctgcacatgattaggcacacccttctgttgggtgctgaagcaggttattgccattctggagttccactgacttgtgattgctctgaccaagggatttgcatggcttagatgaattatcaggactccatgtgtctggaacagacaggaagtacttcgccatgaacttcctaaacctttttttgtattccttgggggaaattacagttggtgaaacattcttgggtactaccagagaagtcttcacccatgtctccagttgtttgtcccaagtatattgcctcagatagtcaatgatgccaaacacaagttcatgcttctctttgtccactcccacaagtagagaatagtccatgacattcgcagaagtgaggaaagctgtgtcattccagattgcacgctgcaaaagatgttttgttcttccaccaatatagattggggaaaaacccatgtcctcaacataattttggtccaggtaaacagtatcatgatcatttgagtcagtgacacgccgcgaaaaagtagcacctttgaggtcataaattcgtgaaatattgtggccaaagagaagattttccatcaccatcaagtcaatctttacctctttgccatgcctaatttgcttaacctgatagattcctaatatcttggcaaggcaagtttggcttccagtgtccagagaatggtaaacatgcttaaagtaatcaggggcaaatttaataaatgactcgaactctgttttcttgatttgctttatgatgaacctgtcatccatcgtctttgcaaaataggccttgctctttcc

SEQ ID NO: 12776 - DNA, 986 bp, Sorghum bicolor
  Clone ID: SORBI-28MAY03-CLUS14482_1
gcacgaggtaaacacagacgttgaggcaacggccatggccggaggggacgagctgaagctgctgggcatgtgggcgagcccgttcgtcctgcgggtgaagctcgcgctcagcatcaagggcctgagctacgagtatgtagaggaggacatctgcggcggcaagagcgagctgctcctcaagtccaaccctgtgaacaacaacgtacccgtgctcatccacaacgcgaagcccgtctgtgaatcgctgatcatcctgcaatacatcgacgaggcctttgccggcaccgccccgaccctccttcctgctgacccctacgaacgcgccgtcgctcggttctgggccgccgacatcgatgacaaggtgctggccgcttggatgcaggcgaccaggggcaagacgggggaggacaagggtgaggggagaaggcagtggagcgtcgcggttgagacgctagagggagcgctgagggactgcggcaaagggaagcccttcttcggcggcgacagcggtcgggttcgtggacgtcgtgctcggcggactacttgggtgggtgcaggcaaacgaggaggcgttcggcatcgagtccttggatccgcaacggactccgctcctggtcggcgtggtcggagcgcttcggcgcactggataccggcgagcctgcgaggcccgaggtgagcaggctgggcgggttgggcaggatggtgctggcccgtgcccctggagcggcggctctcgccgctggtgcaagcaactgaaagttattgttctatcgaactagatttcccatgtgtttcagcctttcaggcgttcagctagtgttgaagaagaaaataatgcaacacacacagctatgccacgtgttgccattagtcagtttgtgcggaggcacgttgcacgtcgccttctggccggtcctctgtctgccggtgtttccgtgtggttcttttttttgtttttaagaacaggaggggtgcatgggggcgtc

SEQ ID NO: 12777 - DNA, 401 bp, Sorghum bicolor
  unsure (1)..(401): unsure at all n locations
  Clone ID: LIB3480-019-P1-K1-F9
aggacatcttcggcggcaagagcgagctgctcctcaagtccaaccctgtgcacaacaaggtacccgtgctcatccacaacgggaagcccgtctgtgaatcgctgatcatcctgcaatacatcgacgaggcctttgccggcaccggcccgaccctcctccctgctgacccctacgaacgcgccgttgctcgcttctgggccgcctacatcgatgacaaggtacgaaaagaaaaccccgtcttccaatcgatcgcatcaattggctgcgacatggccggtttcgttcatagatggggcaggcatgcgtgatgtggtcgtgcaggtgctggccgcttggatgcaggcgtncaggggcaagacggaggaggacaaggctgangggagaaagcagtggttcgtcgc

SEQ ID NO: 12778 - DNA, 1631 bp, Sorghum bicolor
  Clone ID: SORBI-28MAY03-CLUS14933_1
acaaccccctaccccgccccccctaagtcccacaccaccaccacccgaaaaaatccgcttgcctagtccgtgaaccgacgataaccgctcgtcccgaaaccctaaggtagccccgaatcgttccccaaaccctacccctaaacggctcgatgctgtgagaccagcaacagtgcccatggctctggagggtccggcggagcgacgggacgaggtacaggtggcgatggggaacggaaacggcgttgcgccgtctcaaccgtcgcggccagccggtcggccaccggcggctgcggcgccatacgcggaccggcggctgcggcttaacccaaatgcggagcacaagccgcaggactacagcgacgtgcgtggcgagtacgcgccggccgtgtacagcgcactcgagcggcatctcccacccagcctcctcgatgccgaccgcgatgtcaagctacacttcatgcgggacattctcgcgcgctactggccccagggcgagcgtaacaaggtgcaaaggcacagagaatacaggcagaggatactccacctttacaagcctcttcatgaagaattgtacaatatgcatccttcagtgttcttcttaccaacattccttgaagcagttaggagcaatacagaagaaagctttagaagtattatgactgagccaattcctggtgtttattcgtttgctatgttgcaacctactttctgtgagatgttattggaggaggtagagaactttgaaaaatgggtccatgctatgaaatttaagataatgaggccaaatacaatgaacaagtatggtgctgtccttgatgattttggcctggaagctatgctgaaccagttcatgcaacagttcatagctccaatttctaaagttttttatcctgaggttggtggaggaacattggactctcatcatgcttttattgttgaatatgggaaagacagggatcttgaactaggttttcatgtggatgattcagaagttacattaaatgtttgccttggaaaacaattttctggtggtgaattatacttccgaggtattcggtgtgagaatcatgtgaattcagagacacaacatgaggaaatgtatgactacacacatattcctggtcgggctgtactccaccgtggtcgacacaggcatggtgctcgagctacatcatctggtctcagaatcaatctgcttttgtggtgccggagctctgtgttcagggagatgaagaaataccagaaggattttccgagctggtgtggtgaatgccagcgcgaaaagagggaaaggcagagtcagtgcgttaaagcaaccaagatggcttttctcaggggttctggaggcgcaacgatttagtttgtacgtagggcatttatgtcagtttggcggcatactgaactttgttcatcattcgggatttagagaggtgaccattgtaatcaacagccagctttctgctagagcgctcattgatgtgatcgcaggtgtatgtaaatgtaaatcttatcaaatccagccgaaagaaatgtaataaagggttataatctggtagcttcagacctgcaatttttgtggtgtcaatgtgctcccattatactgctatgaatttgaatacttttgttgcctg

SEQ ID NO: 12779 - DNA, 762 bp, Sorghum bicolor
  Clone ID: SORBI-28MAY03-CLUS15244_1
gggggccggccgcggggccgaatattccccccgctccgtgtggtgcttgtttgtagccggcactcagctcacacacggaaccgaaccgaaccatgtcgtcggcggcgggaggagacggggagacggtgcgggcgtcgcacatcctcatcaagcaccagggttcccgccgcaaggcctcctggaaggaccccgacggccgcatcatctccgccaccacgcgcgccgacgccgccgcgcgcctcctcgacctccgcaaccagatcctctccggccaggccaacttcgccgacctcgccgcgcgccactccgactgctcctccgcgcgacgcggcggggacctaggtacctttgggaggaagcagatgcagaaaccatttgaggacgctacatatgccctcaaggttggtgagctcagcgagatcgtggacacagacagtggggttcacgtcatcctgcggactgcctgaggagagaaccatgctgtcagctgagtctcaggctttcagttagcgcttatggctttctattaggacctgtatttttattcctgctgggtgcttgagtttacattccggcagagataaagtcatgtgtgacaacacgtttccaacagcatttgtgcttaacctgtattgatgatgatgccttgagctcctgactgcctagttttttcctggcgacagtctatttgtctgcttctgattataattcttggactcgatgattgttccttagaaaaaaaaaaaaaaaaaaggcccctaa

SEQ ID NO: 12780 - DNA, 1362 bp, Sorghum bicolor
  Clone ID: SORBI-28MAY03-CLUS1533_1
cctcctggccctctccctccccgcccgaccgtcgtcgtcgcggcgtgagcgagcgggcgtgcgcgcgcgggcgacccagagcccgagcgcccacccccccgcccccccgccccccgcccccgccccgccggccgcctggcgggggacgtggcggtggccgtcgtcgtcgccggcctccccggcggcccccccgacgaggccctccgcgacgccctccgcgacgccggcgccttcgtcgccgccatcgtctccgtcgagctgtctgtcgatcgctcgggctatggcttgggttctggctctctcccctgcgctcccccccgagctgctgcgcgcgcggttgccggcatggtcggcaagcgttttggccatcgtattgttcgaggaactgaagtgcgtacaagaggtccccgagattttggtcgagatggtttcagacgagatccaagaaggtatggtagagatccatactgggacagaagggatagggaacggagctatgatcgtgaaagggatccctaccatgacagggatagtgatagatcccgtgagcatgatagagaaagagattatgagcatggtggctttaatcgagaaattgactatcccatggatcgagatcatgaagtagacgagagacgtcctagagaacatgatcgtgcagctgaaatgcataatatggattcagataatgacaaagatagggagcatggaacaagaaaaagccgcccgaaaggtcgtgatagcagagatttatcgagttccagtgatgatcttcaaaatgatggaaagcaccagttggataaaactattcagatgcgtgaggaccttgaaaatgaggttaaccagattaaggataaaatatctggaaaagaacagcacattgcagatttgcagaagaaagctcagaaattagaggatgaactggttgccgcgcggaaagtctcttcagaacgacaattagctgttacagacctgtacaaacattttcttcaacttcaagactacaacgatagggtcaaaacggctgaacagaggctgcagtctcttgttgatgctgccatggtcgagcttgacatagccgaagatgctactaccagagatggctcaatgtatgagaatggggtggtctgaacacccaaaagggctgccagctgtcatgggttgtgaggctactaatttgttagacttgtagtttggatttgccatgtaatgagaactgtactgtaactagaaacagaaaatgttatgtaaggggccagaaaatgagtggctgcacatttttctatttctttccaagttgaatttattagccgtcctgactattgctatacggtgtgatgtgacccgggtatgtcagctgtt

SEQ ID NO: 12781 - DNA, 1763 bp, Sorghum bicolor
  Clone ID: SORBI-28MAY03-CLUS15544_1
gcacgaggccgccgtccaagaagtcggccggccccacggtcgagcgcccgtccagggagagcacgaccgtcgagaggtacgcggagctcgcgccgcgcgccacgcccgctaagaagtcccccgctattgtccagggctctggaacgaagctcaaggacatacccaatgtttcattcaaactatcaaagagaaaggttgatgagaatctccagagccttcatactgtattgtatgggagaaaatcaaataaccatttcttgaagagaaacatatctcaattttctgggtttgtttggacagacaatcaagaaaagcagaggaacaaaataaaggaaaagcttgagaaatttaacaaggagaagttgctagatttttgtgaagtactggacattaatgtaaaagtaactacaaagaaggaagaagtttctgccaagctcttagagtttttggagtctccttgtgttaccagggatgttgttctcactgataaaaagaaggggaagaaacgtggaaggaaatctaaggcaacttctgaaggtgcttctgcagagaagaaaaggaaaagagtccagaaacaagcagctgaagatggtaaagagaatgatgatgcggatgatgctgatcctgctggttctgaggatgcatcaacaggagaggaagctgatggggattctgaggcaaatgatcatgctgtgagtgatgatgaacttgatgagcctccagcaaagaagaagtctacagatgctaaacaggttaagaaagaaacaggttctgatgcaaagcacgaggatacaccaggaaaaaagggttctacgaaacctgcaaaaggtgcatcaaaggcttctcaaaacagtaaaaatgagcctgatgcagaggtaaaaaaggtgggcaagagagcaaagagttcaaaagaaagtgttgtgtcaccagattctaataagtcaaacaagaaggtttctaaatccaaaaaggacgatggaaaagaatcccaaaacaataaagctgccaggtcatccaataagaataaaggaaaaggcaagggtggtgcagctgctgggactgccccaaccactgaacagcttcatgctgttgttagcagcattttgaaggaagttgacttcaacacagcaactttggctgatattctcagacaattagggacccattttgaaatggacctcatggaccgaaaagcagaagtgaagcgcatcatagaagaggtaataaatagtatgtctgatgatgaaggtgaggaagattcagaagatgaagcagaagataatggtaaggtggagaagtcaaagagtgatcccgatggaggtgaagagaagtgattctgtggaccggatgtgccatgttgagatcagtctcttgttaatctgtggtttagattgaacttggactattttcatgccagttctcctgtttggaggtttggctctgtacaattggggcaccgcaagacagccggtgacctgggtactggttacaagattgttaaccatttcacagccatacacacctagttgtgcttgacttggtagtgaatgtagtctagtcgctggtcatgtacgatagctttgcgattaatagtttggttgcttaggtagctagcctgactgtaatatgcagaataattcttggcttgtttcatccatttatcatgtaaaactctgtatctgagtcctgaatcgttcccgctcattgtatttcttatttaccttgccatagcaatgtaagcagtgtgtttctaaaaaaaaaaa

SEQ ID NO: 12782 - DNA, 1207 bp, Sorghum bicolor
  Clone ID: SORBI-28MAY03-CLUS2825_1
gtgtcagtctgtgtgatccttctagagctcaccagcacgaggcccatgctccctctactcatgcttgttcttctcatatccaaaaccatagcagataactttaacaagggagtttatgatcagatagtggtgatgaaaggcttgccattcatggaggctcatgctgaaccatacatgaggcacttggttgctggtgatgtggtgtctggcccactaataaccttttctggtgttgagaaagtggggaacattgttcatgcattgaggttaactggccacaatggttttcctgtggttgatgagccacccataacggaagccccggaactggttgggcttgtgactaggtctcatctattagttttgctgaacagcaagaatttcatgaaggaacggttcaaaactagtggtagctttgttctgcgaagatttggtgcatttgactttgccaaaccaggttcaggcaaaggtttgaaaattgaggatctggatttcactgatgaggagatggacatgtatgtggatctccacccgatcacaaatacatcaccttacacagtggttgagacaatgtcactagcaaaagcggcaatccttttccgggaactcgggttgaggcaccttttggttgtgccaaagacaccagacaggcctcccatagtcggcattctcacaaggcatgatttcatgcctgagcacattcacagtctgttcccgaacttgaatcctcacaagtaccattcagcatcaatggcaggttgataatgaggcttttttttctgcttcccatctatgtacattatttggatgcggatgctggctgtatgtaaattgcaaaggtgtatctggtgttcaattggatagagctcatcttctctacatggtttggcttgtgtggatttttagcatatgctctttttgcaataaaaagatgtggcagttattttgttggtgactgcctattatgagcctgcggcaagaaatgagtaaacattcaaagctccagaatatggagagaaagtgtgtattgcatatttgcattgttcctgtaaagcatgtttagagaactgaaactcttaagatttatatcttatctttaaatagtacggagtatatatctaaggcagaaacatgggcgattgggactgcgaagtgcaggtttcttcttgtgattgtaagatctatttggattgagattggtaacatt

SEQ ID NO: 12783 - DNA, 1288 bp, Sorghum bicolor
  Clone ID: SORBI-28MAY03-CLUS2786_1
ctggcttgttggttgctttgccgtttccgttgccttggccggcctgccgtaacacccaagtagtcgtctcctactactactagtatagtctctctcctcccgttattccaatccattccagttagcgccgctaatccgctccctaatcaccatccatccgatcggcttccccacccatggcggcgacggcggcggaggttcccgtggaggcgccggtgaggacagtgaaggtcaccaatgtctctcttagtgcaactgtgcaagacattaaggagttcttttccttttcaggagatattgaacatgtggagatgcagagtggtgatgagtggtctcaagttgcatatgtcacattcaaagatgcacaaggcgcagaaactgcacttcttctatcgggtgccacaatagttgatctttctgtcattattgcgcctgctccagagtatcagccaccccctacgtactctgcgccaccaatgagtggaaccagagttgcagttggtggagacaacaccgttgtccacaaggctgaggatgttgtcagctctatgcttgccaagggtttcgtgctaggcaaagacgctgttggcaaggccaaagcgttcgatgagaagcacggcttcacttccacggccggtgctaaggtagcctccattgacaagaagattgggctgagtgataagatcaccacgggcacatccttggtcactgggaaggtgaaggagatggaccagaagttccaggtctctgacaagaccaagtcagcattcgccgccgccgagcagaaggtgagcagcgccgggtctgccatcatgaagaacagatacgtcttcaccggcgcgtcgtgggtcactggcgcattcaacaaggtcgccaaggctgccacggacgtcgggacgatgaccaaggagaagatggcagctgaggagcagcagaagggctctggcccttcctctgggggccactcgtacacgcccatccgatgattcattagcttggtgttatgcgccctccctcaaaacagtgttgtattacatattggtggatgtaaaacatagatatatagaacagatcatcaggcccctctcaccacatgttcatcgttccatattctgttaaatttcgtactgtggggatttttttcagtaggacaaggaagtatggtggtgataccaatgtgttggtttatacgaatccatgttcagacttcagattggttgtggtttgaatgaacattttgtagaagtggtgggaagttacccaaataatatgatgtgctgaatcaaca

SEQ ID NO: 12784 - DNA, 816 bp, Sorghum bicolor
  Clone ID: SORBI-28MAY03-CLUS28469_1
ccttcctggtggcacgcggcgtttgtgcttttggtggcctgctcctcctagctggtctgggcatgctctgctggattgaccaagatgatgggaggcactcctttggccattccggaggattcatctgtccattcgttcccttgctgccggtaatgtgtatcctcataaatacatacttgttaatcaatcttggtggcggcacatggatgcgagtgggggtgtggctggtgatgggggtgttcgtctacattttctatggccgcacccacagctcattgacagatgtcgtgtatgtccctgtggctgaggcgaatgagatatatgggtcaccctcttcatcagggtttgtggcgtaaagagagatggagatgtttgttgaagcctatcttgagctagtcagggtacttttcacagaacctcaaggatcctgactttagcagattcctgcttgagctatcatacgcattgcagggatggatttgaagaattcaatttgtacgtcaatttttaaaatgtgtaattgtaatgcacaactaaacttgtgtgcctctgttcaaggaatgtaaatattacatagtagaacaatatattatagatggtgccagtatagaggtatttgaaaggggggttcagtctaggaatttgtacgttgaagtacaaatttgttgtaaattcccaggattgaaattatagtccccaattcaaacaggtctgtgtgaggcgtattatgtggtcaaagcctcaaacacattttatttcacggtggtgaacatatgagaaaaactgctcatggaaaaataatattttcaactgagg

SEQ ID NO: 12785 - DNA, 1647 bp, Sorghum bicolor
  Clone ID: SORBI-28MAY03-CLUS19950_1
gagagttcgactagtcgtcgagaccacaccaaccaaacaccacaacacaacacgactcgagcgagggacggaggagcaatggcggagccgagccagcagctgctgcggtcgttcgtggaggtgccggcgggctcgcacttccccatccagaacctgcccttcggggtcttccgccgccaggggtcggctcaggcgcaggcgcaggcgccgcgccccgccgtggccatcggggacttcgcgctcgacctcgccgccgtcgccgacgcggggctcttcgacgggcccgtgctctccggctccccgtgctttcaccaggagacgctcaacatgttcttggggatgggccgcccggcgtggagggaggctcgcgccacgctacagaaaattctctcagctgacgagccagtcttgcgtgacaacgaggccctgaggaacaagtgtctggtaccaatgagtgatatcgagatggttctaccaatcacggttggaggttacacagacttcttttgttctgtgcaccatgcaaggaactgcggattcatcttccgagggccgcagactccagtcatgccaaattggttttatcttccaataggatacaatggacgagcatcatctatagttgtgtctggaaccgatgtcattagacccagaggacaaggacatccaacaggaaactcttctgctccttattttggcccctctcagaagcttgattttgaacttgagatggctgccattgttggtccggggaatgaattaggcaaacctattgatattaatgacgctgaagaacatatttttggcctaactttgatgaatgattggagtgccagagatatccaggcttgggagactatacctcttggacctttccttgggaaaagcttcagtaccaccatatcaccatggattgttactctagatgctttgaagcctttcatgtgtgatgctcctaagcaggaacccgagcctttaccgtacctagctgaaaagaaccacataaactatgacattcctcttgaagtctgggttaagcccaaaggtcaaaatgatgcatcagttgtcacaaaaactaatttcaagcatctgtattggacggtgacgcagcagctaacacaccacactatcaatggatgcaacatgagtccgggggatatatttgcaactggcacactcagtggacctgaaccagagtccctcggatgtctgctggagctaacatggaacgggcagaatgagataccggtggggaattcaacccgcaagtatctagaagacggggatgaggtcatcttgacaggatgctgcaagggtgaaggctacaacgttggttttggaacctgcaccgggaaggttctgccggcacttccctgagccaacaccgtcttcgcatcagttctccagagtctcaacaatcaaaaagagttccttccgatatctagcaagctgctatgtaactgaacaatacgggttgttttcctgcactgttgaagatgaggagactgatactctgttgtgcaataaaattggttcatcattttacaaaaaaaaaaaaaaaaaaggcccctacgtgttattaaacttgtactacattacattgcaatgtcctctgacaagaaatttagaaatgtcacgcggattggt

SEQ ID NO: 12786 - DNA, 1106 bp, Sorghum bicolor
  Clone ID: SORBI-28MAY03-CLUS203_1
gcacgaggcacacagagggggtgtagccgagtagcagagcagcgagcgccatgtccctgtccgtcgccggcgcgcggacctccacctctcccctcccctcttcgttcgccgcctcttcatcccgcccgcgcctcctcgcgcttcctctccaccgccgctcgcacggctccctcgcctcgccgccggccgcgggcaggcggcggctgcggcggctgctcagggtgcgcatggcccggacggagtccacccgcgtaggtatcggctgccgcgcgccggaggtcgagctccctgagccactgaccgggaagctctggacgttggatgactttgatcttcactctgcactgatatgcaatcactgcccatttgtgaaacatctgaaaaaggacattgccaagctcacctctttctatgtggagaaaggacttggtgctgttgccatatcgtccaactcagttaggacgcatccccaggatggcccagaacacatggctgaagaagcaaagttgttcaaatatcctttcccatatctttatgatgagtcacaagaagtagctaaggcttttggagcagtctgcacacctgagttttacttattcaaaaaagatgggcgaaggccttttgaacttttctaccatggacagttcgacgattcaagacccagtaacaatgtgccagtaactggaagggatctaagccgtgcaattgactgtgcgctcagtggccaagaactgccctttgtacaaaagccaagcgtcggctgcaacatcaaatggcacccatgaggtgctcgtaactcatagtgtcgcgctgtggcgagaaacaaagccatgtttcacttctcggtacaatacaaagatggaacacctgattgaggtgcactgagggctgaatttgaagtcagtgttgactgcctttgggaacagagttgtgggggcagaaacctgggagcttttcttgtgtaacaggggcaatagtgtagtgtagcgctagcgcagcaaccagcaaaaggcccgtgtaaagaattgtttacacagaagtgctttacttaccttttctgaggtcgcacaagatgtccgtttacacgtggtaatcccaaaaagcag

SEQ ID NO: 12787 - DNA, 831 bp, Sorghum bicolor
  Clone ID: SORBI-28MAY03-CLUS21141_1
tgcgccccctcgtgctactacagacgacgctgcaatgctgtcctttccctgttgctgtgtggccagccctcacaggctttctaccttgtcccccgcccgttgctgcaaccaggcagcaatgatatagtccttttcgagcaatttggtggtgacccaagcaagatatcctttgtgataaggcagacaggaagtgtgtgcgcacaagtatcagaggaacatccagcccaaattgatagttggaattcttctcaacagacaatgcaaagatatggacctgaacttcgcctggaatgcccaaaagatggccaggtcatcagcagcatcaagtttgcaagctttgggacaccgagcggcacgtgtggaagctacagccacggcgaatgcagcagcactcaggctctctcagttgttcaggaggcttgcattggagtgagcagctgcagcgtgccagtgtcgtcgaattactttggaaatccatgcacaggggtcacaaaaagccttgcggttgaagctgcatgttcgtgacaagtctgattaacattggttcataggaagcaaaatcagtggggagaaggtgaaaccttctctgtgtaggcaagcaggcaaaaaggaataagtgttcccatcctggtcaaaaggaataaaaatattcccaatattgctatatccaagctattagatggtatgattagaaagcattgttcttgttaagatgtaaattcatccatcatgacaaagaaggtgatccttttgtaatccttcttgaaaaaatagaatggattgaatttcaatcaattttaattataaaaaaaaaaaaaaaaaaggccccta

SEQ ID NO: 12788 - DNA, 1128 bp, Sorghum bicolor
  Clone ID: SORBI-28MAY03-CLUS212_1
ggaatgcaatgcaagactattatctactacatgttagtagctctttacaaaaattagttcataacaaacatacaattctctcagcaagcatatattactcgaaactatttaaatccgtactcgacccaatttcgctccatatccgtaccacagtttcgacacccataaaacctgcatctgcattcgaatattttccactccaatccgaatccgacggaaaaacagattagaataagagagaggcattatccattcgactccgatccgatccattttcatctctatccagggaacaccatgctcggaagaaacccttgagaagttttgagatagaaagagcgagcttcctagcttgctgtatcttcaactgctgctgcagctacctctgtcttggtctcttgttgagctccctcgtcctcagtactggccacctcaactctcatcttccttacacggaacatcgccaagtggatgtcaccgaagatgagaaagctgccggggtcgatggcgatggggaagccagggttgagccggcgctcgttgatgtaggtgccgttggtgctgtccaggtccgttaccagcaggctgccacccttcttctccagccgagcatgcgtgcctgaaactgtggcaatggggaggacgatgtcggccttgtcagcaactcggccaacggttaccgcatcatctgagattatctcgatcgcgccaggccgtgcaactttgtagccaatgtgacgccaatcaccgtcacctgcagggtcaagaatccatttttctgtcgtgacagcggttgatgagccgccagtggcacttgaaaagcacctccagctaatgctcctgctactccccttgctgcctagcctcggcgcaacgagatgctgctgctgccgccttgcagtagtggaggttgtgatggagcagcaaatattcttgcagggaggccgaagcaacgagggggaaggcaaggttgtcggcgatgatcgactccgggggccggagaccagtagcagggagcaggtggctgccactgctgcgtccatggtcagggcaggcacaggcaagggaatgtaccggagccggagaagaagggctagctggggccttgttttcctcccgccctcgtgc

SEQ ID NO: 12789 - DNA, 1625 bp, Sorghum bicolor
  Clone ID: SORBI-28MAY03-CLUS2131_1
gcaacagcctcacgcctctgcctcttcttaaagtcagtccccgagccttcttctccctccacttcgccgcgacggcccccgccactagaccaacagcaacggtactaaccagtgccagccccgcatgcctctcgcggcggctgccgcggccgttgccgcctgtccttccccgatcggcctcacccgccctttgtgccgtatcgaggcgcatccgcggcgccggcggaggttccggtcggaggcaagctcatcggcgtccgctcccgcgccggccgcggtggatgagggaggcggagcggggccgtgccccgtggtcaggttcgacatggctgatttcaccgtcgccgaccgcgtcaacgtcgggctccatggacggtcggatgagatgatcttcgaggccacggtgtgcgatccgagcagcgagctgtatgggtcaacggtggtgctgcggcagctgaagagtttgcaggcgaagcgcagggggcgtcgcgctctcgaggtgctgaagaagctggctcgtcgccaaatgatgtaccactcctacgcacttcaggtccatggttacattgctccgtgcaatgccgtgccggcggccgtcgtcccgtttgttttggttctgcggtatcatgggagtcattccctgcgtcactggttgcaactctcagattggctcccaaccttagaagcaacattagcattggacgaagaacaagtcaggagggtaggagatgactctgttggaggaccagctgtaacccggcagctgcgtctaatcaggatattgatgagagaccttttgattggtgtaaattatctacatagccatgggctggcacatactgagcttagattagagaacgttcacgtgagcccaatagacaagcatgttaaagtcggtattcttggaaatgctgctgattttcatgacaatgatcctagcagtagtacaacagcaattaacaatgacaggcggaaaatgatgatagcctttgatatgagatgtgttggcttcatcatggcaaagatggttttgagagagctaatggattcttcaactttctttaaattcaaatcattcctgacaaagggaaatgacccatcctgtttgcgtgagttcctattaccaactctctgccaaaattctacatctgggaatattggtttacagatgctagataggcagtggggtgctggttggaatcttttagccttattgctggcaacaaaaccggaggaaaggataagttgtgttgatccgttgcggcacccattcctttgtgggccaaaatggcgtataaatccatcagcaaatctcatacgttggagcttgggatcaactgctgtccgcatggctgaagattatatctatggacatcatcagcgtagacgcttagcatattttgttgaattgatggaggttctaaaccctaacttaagaacacagaattggattcacctcctacctggtcgttggcgtctcttgtactgcactggaagacacattggcctaacacttcgccagccttcccctagagtcctcatcagtgatgtgtaccttacagttagttcagagtcagtcgatccagtcttctctctgacctctgatactggtttcagagttatgc

SEQ ID NO: 12790 - DNA, 1208 bp, Sorghum bicolor
  Clone ID: SORBI-28MAY03-CLUS2185_1
acgcgccacccaacccaaccttccagggaaaaggggaaggagagcacgaggcccccccaaatcggaatccgcacccatccatggccgccgccgccctgctccgccgctcgtcggcggcgcgcacgctcctctctccggccctctcgtcccgcctcgtcgcgtccaagccccactcctcctcccccgcgccgcctccgcctccgccggcggcgaaggcagcggccaacacgaagacgttctcgatctaccggtgggacccggactcgccgtcgacgaagccgcacctcaaggactaccaggtggacctgtccgactgcgggccgatggtgctggacgcgctgctcaagatcaagaacgagcaggacccgtcgctcactttccgccgcagctgccgggagggcatctgcgggagctgcgccatgaacatcgacggcgacaacggcctcgcctgcctcaccaagatctcctccgcgtcatctgcgtccacggtctcgccgctgccccacatgttcgtcatcaaggacctggtggtggacatgaccaacttctacagccagtacaagagcgtcgagccgtggctcaagcgcaaggacccgccgccgcagcagggcaaggagatcccgcagaccaaggccgatcgtgccaagctcgatggcatgtacgagtgcatcctctgcgcctgctgctccacatcctgcccatcctactggtggaaccccgaggagtacctcggccctgccgcgctgctccacgccaacaggtggatacaggacagccgtgaccagttcaccaaggagcgcctggactccatcaacgacgagttcaagctctaccgctgccacaccatcaagaactgcacgcatgcttgtcccaagggcctgaacccggcaaagcagatcgacacgatcaagaagctccagttggaagcctgagagcggatcgtgtcttccattcaaaatgatcatggaacaaacctgtgaaaatttgtgataaacttgcctctcttttttttcgtctttgcgtcgtggtttctacttgacaaataattcctcgattggggcctcttctctgatgctcgtatttgtgtcaggtggaggtagtgtagggagtgaataactgctaccttatttcatttttaagctgtatctaatttggtcctctgcaatgcattgtatggattactgtcattcgttgatgattttcattgc

SEQ ID NO: 12791 - DNA, 2118 bp, Sorghum bicolor
  Clone ID: SORBI-28MAY03-CLUS2240_1
gcacgaggtcggcatcgtacgagaatcaacaggacattcaactcatgaggtttgctgattactttggccgggcatttgtagctgtaagtgcatcccaattcccatgggcaaagatgttcaaggaatcaacagtgtccaagatggttgacattccattgtgccatattcctgaggctgtcatcaagactgcgagtgattggatcagtcaaagatcttctgatgccctgggagactttgttttgtggtgtatagacagcatcatgtctgaattgtcaggcccatcagcaggacctaagggttcaaagaaggttgctcaacaatctccaagggctcaggctccaggctttgttgttcttgccatggctttaagaagaaagcctgatgttctggtaaatgttatgccaaagataatgggaaacaataaatatcttggacaggaaaagctgcccatcattgtctgggttattgctcaggcatctcaaggtgacctagtgactggcatgttttgctgggctcattctctatttcccacattatgtgcaaagtcaagtgggaatccccttgcaagagatttggttttgcagttgcttgaaagaattttgtctgtcaccaaagctcgttctatcttattgaatggtgctgttagaaggggggcgtccgtagttccccctgtttcatttgacttgttcatgagagccacatttcctgtttctaatgctcgggtgaaggctacggaaaggtttgaagcagcctacccaacaatcaaggagttggctcttgctggtcctcctggctctaaaactgtgaaacaagcatcacaacagctgttacctttgtgtgcaaaagcaatgcaagaaaacaatgcagagctcaccagggaggctactgatgtattcatttggtgcttgactcaaaatgcagagtcctacaagcagtgggaaagaatttatcctgaaaatattgaagccagtgttgctgtcctgagcaaaattgtgattgattggaaggatgtgtctcctaagctcagttctgaagctctcaaggcaacagtgaagaacttcaaggctaagaatgaggcagcgctggagtcagcaacagatgctggaaagcaggcatctatcaaagaagcagacaagcattgcaaggtgatccttggaaagctgactcgtggtgccacctgcctgaagagcagcctggtggtcattgggctcgctgttgctgctggtttcgtgctatatcctgacatggacctcccagtcgagtgggagaaggtccaggcgatggtctcatcccacctgtccttctaaacatacctgtccagaatctccagatgtggatctaagttatacaagccatccaaaggggatggcttactcagcagtgaagagagctcagggggtgagaataagaggggaataggtggtagaactgaaggggtatagtttcgtgagttgccgtttttttccagcatctccaggagcagcagtgcctgggaggagatgcagtcgactttgcagagagttgggttaatcggtagactgatgggtgcaaacaaggttaagtcaaatggctgaaccagaggattaacacctttgcttttccgttctgcatctgagatgatgatagcaaacatttttggttttaaaaaatctagaatcttgaatcgtattccgtgctgtgcgtattggtaaatgtatctgttgcgtcgatcaggataacctgcgtgtgatgttgtgcccatgcctgtgtgcttttgtgatctcccttttagcaggtgtgatgtctgatgttggagcgtgaagccattttgtaatttgtttcattttcggatggttttggactgagggagatgctcgttaatttttgggtttttttatttatttgaagatttgaggaatcggtctgaatctcaagggcctgtatttgcatgtgtgatgtctgatattggagcatgaagacttttttttttggaaatctgttgcattttcagattgtttttggaggagggagattcaggtttttttatttgaggaatcgatctgaaatcttaagggcctgtatgtaatctattgtatgtaatatactgtttcttcgaggtgtagatgagaaggttttccc

SEQ ID NO: 12792 - DNA, 1070 bp, Sorghum bicolor
  Clone ID: SORBI-28MAY03-CLUS300_1
atgactatgactattattcttattcttggggagttttaacaccccaaatgatgaacaaattgttacatcaacacactttttcagtcagttcacatccttgcaatacaggttgtacagcaatcagaactgagatgaaagccctactcgactattccccgctttgccccatccaccgtgttcttcagcagcatagcaaccgtcattgggccaacgcctcctggaaccggagtcaggtaaccagcaaccttgctcactgctgcaaaatctacatcgccaacaagtcggtacccagacttccgggtagggtcatcaacagagtttgtcccaacatcgatgaccgcagcacctggcttgatccaatcccctttgatcatcatagcctgcccagctgctgcaatgactatgtcagcttcgcgtacaatgctttctggatcaggggtccgtgagtgcacaatagatacagtcgcatcttccttcagaagaagcagggatacaggtaacccgacaatgttgctgcgtccaaccacaactgcccgtttacctttaacagtgactccactccttgacaagagctccatgcatccctttggtgtacatggttggaacagtggctctctgcctttcattgcaagcttgccaatattgagaggatgaaacccatcaacatctttttcaatgctgatctcgttcagtatcttttcttcattgatgtgcttaggaagtggaagctggacaaggatcccgtgcacggcggggtcggcgttgaggcgatgaacctcggcgacgagcgcgggctcggagatgtcctcggggaggtcgacgtcgatggagcagatgccgacctcggcgcacgccttgcgcttcatgttcacgtacgtctgcgagtccttcctgctccccacgatgaccacggccagccccggcacgagtccgtgggccgaggagagcgcggccacatcggcggcgacctcgcggcggatgtcggcggcgatggccttgccgtcgatgatctgcgccatcgcggtggcggggcgagggagtggtggtggcgacgactccggatccagtag

SEQ ID NO: 12793 - DNA, 700 bp, Sorghum bicolor
  Clone ID: SORBI-28MAY03-CLUS30043_1
ttatatcctgagcccacccaaatccccgcgcccccctgttcatttcatttcctctcctctctccccccacctcctccctcctcctccttcctcgccgctcgccgttgaagagggaggccctcgggccggcgggaatggaggcggcgacgatggcgtggacggcggcggtggtcggggtggggctggtgtactggttcgtctgggtcatgggcgcggcggaggtgaagggcaagcgggcggtggatctcaagatgggatccatcacgcgggacaaggtgcaggacaagtacacgcagtactggtccttcttccgccgccccaaggagacggccaccaccgcggcgtcggcggagaaggtgccggccttcgtcgacaccttctacaacctcgtcaccgacatctacgagtggggctggggccagtccttccacttctccccgtcgctcccaggccgctcccaccgcgacgccacgcgcgtccacgaggagcgcgtcgccgacctcctcggcgccaggccaggccaccgcctcctcgacgtcggctgcggcgtcggcgggcccatgcgcgccatcgccgcgcactcgggatccaacgtcgtcggcatcaccatcaacgagtaccaggtgaaccgcgcccgcgcgcacaaccgcaaggccggcctcgactccccgcgctgcgaggtcgtctgcggcaacttcct

SEQ ID NO: 12794 - DNA, 806 bp, Sorghum bicolor
  Clone ID: SORBI-28MAY03-CLUS30389_1
gcaccccgctccactccgccgccctccgcaccccgtgggctccgaccccgagcgccagagcgatctcgcctcctgcccggtccgcggcacggggcgacgagagaggtcgaggcgccgctgcctgctaggaccgggcgtcaggaggtccccaacgccctccgccccgcgccgccgcggggattgattgttatccgatctagccggtagcggtcatcagctgagggtggaccgaagatgagcgtggtgggattcgacctcggcaatgagagctgcatcgtggcagtcgcgcggcagcgcggcatcgacgtggtcctcaacgaggagtccaagcgcgagacacccgccatcgtctgcttcggggacaagcagcggttcatcggcacggcgggcgccgcgtcctccaccatgaaccccaagaactccatctctcagatcaagcgcctgctcggccgcaagttctccgaccccgagctgcagagcgatctcgcctccttcccgttccgtgtcaccgaggggcccgatgggttccccctggtccatgtgcggttcctgggcgaggagcggacgttcacccccactcagctgctggccatggtcctgtccattctgaaggcctttgccgaggggaacctgaacaccgccgttgttgagggccgcttcggcctccccgcggccttctgtgatttgcagcgcagggctgttcttgatgctgctactattgcgggcctccggccgttgcggctattccatgaaacaactgccacggcattggcttatggcatttataagactgacctcccagagca

SEQ ID NO: 12795 - DNA, 722 bp, Sorghum bicolor
  Clone ID: SORBI-28MAY03-CLUS2479_1
gccggccgggctgcgggatcaccaatcaccgtccgccgctccgcgcctggagagaagtcgatttgttcccccaaatctccgccctccgctccaccggccgccgcgccccgatccagatcaggagctgtgagatggacgcgaacaggcgcgccagtgggattcagcagctgctggctgcggagcaggaggctcagcaaatcgtgaacgcggctagagctgctaagtcagcaaggcttaagcaagcgaaagaggaggctgagcgggagatagccgaataccgtgcccagatggaggctgagttccagaggaaggttgcagagagcagtggtgactctggtgcgaacgtcaagcgcctcgaggaagagacagcggcgaaaatcgaacagctcagccagcaggctgcaagcatctccccagacgtcattcagatgcttctgaggcatgtcaccaccgtgaagaactgaggaacgatgtctccaagttatgcttgcaaacttgtatcatcgaatctatttatttttgttggagtggtggtgatgaataatatgtcgcttgtatccatgattccttttcttgactacggaataagccggcacagctttagcggcaaccttgacttggtactatcagaccttgccattatttggtacatttggtaaataatattgttttataaattggttttttgaacaaactaaaaaaaaaaaaaaaaaaggccccta

SEQ ID NO: 12796 - DNA, 737 bp, Sorghum bicolor
  Clone ID: SORBI-28MAY03-CLUS25533_1
ctactggatcgcccggcacatgcctctgcctttcctctgcttctcttccactgcaccaatggtgaccagcgttctgctgatactgcgggaaacctctccgtgggcgctggtcggcgcggcggcgtccgtggcgctgctgtggctggtcgcctggacactggagtgggcgtggtggacgccacggcggctagaccgagccctacgggcccagggcctcaagggcaccaagtaccgcctcctcaccggcgacgtgagggagaacgcccggctcaaccgagaagcccgcacgaagccgctggcgcttgggagtcacgacatcatcccccgcgtgctacccatgctccacaacgttgtaaaggaatatgggacaaattcattcacttggttcggcccggttccgagggtgataattccagatccggagttagtgagagaggttttgtctaacaagtttggccacttcggcaaaccacggtttagccgtcttggcaagttactagccaacgggctcgcaaatcatgaaggagagaaatgggcaaaacacaggagaattctcaatcctgcattccaccatgagaaaataaagcggatgctgcctgtatttgctacctgttgcactgatatgattaacagatgggaaaattcaatgtcttccgagggatcttctgagatagacgtctggcctgagttccaaaatcttaccggagatgttatctcaagaaccgcatttggtagca

SEQ ID NO: 12797 - DNA, 900 bp, Sorghum bicolor
  Clone ID: SORBI-28MAY03-CLUS25605_1
cgaccacgccccgccccgctactccacaagccgtgcccgccaccggccgcgacaacttggaaatttctgggattggtggaggaaagcaaataacataacatgcccaaaaaatctcttggtgctgttgtgcagggcatcagcaaaggcgtggtcgtggaaggcctcctgtcgtccatggtcaaaacggggaagccgccggacttcgtgctgtgcatcggcgacgaccggtcggccgaggacaggttcgaccgccgagcccgccgttgtgacggcagcccggcgctccggcgcggctgaccgccaggccctcgcccgaggcgcgggcggccgagcccgcccgtcgtccatggtcaaaacggggaagccgccggacttcgtgctgtgcatcggcgacgaccggtcggacgaggacatgttcgagagcatcgtgtgcccatccaacagcagcctgaagctcccggccagcagcgaggtgttcgcgtgcacggtgggcaagaagccgagcatggccaaatactacctggacgacaccgtggatgtgatcaagatgctcgacggcctggccagcgcgccgtcgcagcggcccaggccggcggtgcagctcagggtgtcgttcgaaggttcgctctgaggaacacacacagcgctagcagtgaacatcgaggaagaataaccaatgatgatgatgaacatgattcagacagtgtggtgtaggattagctgcagttacaggatcgacagggtttcttttttctttcttctacattgctacccgcaaatcgttcgtgcctgtatatgcccgtatgataatatgcaaagaatgtttcgacccacctttgtatatgtagttgacgatgacgatgaaatcagaaaaagagaaggaaaaaaattggttctttc

SEQ ID NO: 12798 - DNA, 1213 bp, Sorghum bicolor
  Clone ID: SORBI-28MAY03-CLUS26040_1
gcacgaggcaagaatgttagaccataaggaagctatcatatctcatttaagttgggctagcctcttcctaggattccataccttgggcctttatgttcataacgacgttatgcttgcttttggtactccagaaaagcaaatcttgatcgaacctatatttgcccaatggatacaatctgctcatggtaagacgacatatgggttcgatatactcttatcttcaacgaatggccccgcgctcgaggcaggtcgaaacatatggttaccgggatggttgaatgctgttaatgagaatagtaattcgcttttcttaacaataggacctggggatttcttggttcatcatgctattgctctaggtttgcatacaactacattgattttagtaaagggtgctttagatgcacgcggttccaaattaatgccggataaaaaggatttcgggtatagttttccttgcgatggcccagggcgcggcggtacttgtgatatttctgcttgggacgcgttttatttggctgttttctggatgttagctcccggcggatgggttactttttattggcattggaaacacattacattatggcagggcaacgtttcacaatttaatgaatcctccacttatttgatgggatggttaagagattacctatggttaaactcttcacaacttattaatggatataatccttttgggatgaatagtttatcagtatgggcttggatgttcttatttggacatcttgtttgggctacaggatttatgttcttaatttcctggcgtggatattggcaggaattaattgagactttagcatgggctcatgaacgcacacctttggctaatttaattcgctggagagataagcccgtggctctttccattgtgcaagcaagattggtcggattagcccacttttccgtgggttatatattcacttatgcagctttcttgattgcctcaacatcaggcaagtttggttaatttagttatttttttttgtactgtatcagaacccagttcattactcttgatggagagggaggatccgcctttttagattttttctatttatttttctatctaggattagaaccatatacttggtaataataggaacggcacattatggcaaaaaaaaagtttgattcagagggagaagaagcggcataaattagaacaaaaatatcatttgattcgtcgtccctt

SEQ ID NO: 12799 - DNA, 883 bp, Sorghum bicolor
  Clone ID: SORBI-28MAY03-CLUS26584_1
gggccggcccaccatcccaccggccgttacccggcgcacccccctcggcacgagggtccgtacgccgccgccgccgccgccgccgccgcctgacttgcaccgccgacagtgcatcagtccagatcgagcctccctcttcccagatcgggtcctaggctacagccgccgccgccgccgccgcatccggcgccttcacgccgcgtgtgcgctccctccccccctgtctgcggcgactaggggggctgccgccgccgccgccccacgcaaggtgccgggaccttccccggtcgcttctcctgcgaagaaagccggccaggccgacacggcaagagcggttcacaccggccctggccgtggcggccgaagcgggacggaacccaccgcaatcgtccggcaggccatcgacgcttccttcccacgcagctatgagccggccgttccttcaggaactgcccatcctggatgtgtagtggctcgagcggagcctgttcctgctggagcaggcgcactggttctacgaggacaactccgtcgagcacaatcccaacctcaagtccctctcctttaaggacttcacctccctcatgttcaagagctgcgccgctctcacgcccgatttcgctcacctggatgatttccccaaggacttctggatctccatgttccgtgtccccgtgtctggcgccgtcatcctagatgtctccgtgctgagggcctggctcggctcggcccggtgggccggggccggctggggccctcctccccggctgtggtcttctgccgcggcagatcacacttctcccattagagaagttctagaggaaactgggtgtgatgtttctacatttttaaatttggatgattgcattgaagtttcaattgg

SEQ ID NO: 12800 - DNA, 1805 bp, Sorghum bicolor
  Clone ID: SORBI-28MAY03-CLUS26818_1
gcacgaggagccaccgcatcaccatgctgtgctgcggcgtcctcctccttccttccctttttataggccgcctctgcctccgcctccgcttcctcgtccttcacctgcgacgcagaggacctgcccctgcgcctgcaattcttcgacgacgacgacgacgacggccaagaccatcacagcgacagggtgcccctcctcctgcccatcaagattatggacgccgccgacgagaagggagagacgccccaaatctccgaggataccgcccaccagattggcgttgatccttggtatcaagttggcttcgtcctcacaaccggggtcaacagtgcatatgttctaggatactctggatcgattatggtccctttaggctggatcggcggcacatgcggcctcctcctagctgccgccgtttccatgtatgctaatgctcttcttgcacggcttcatgaagtcggtggcaagcgccatatcagatacagagatcttgctggacacatatatggacgaaaaatttatgggcttacatgggctctgcagtacattaaccttttcatgatcaacactggttttatcatcttagctggacaagctctcaaggcaacatatggactctttagtgtgccgggcgctcgcaacctcccgtcccgcttggcaatatcaggattcgtttgtgctctttttgcctttggaatcccttatttatctgccctcaggatttggttgggattctccacgcttttcagcctcatctatattgtgatagcatttgtgctgtcattgagagatggcacgacctcgcctgcgagggattatagtattcccaaatcatcaggttcaactcatgtcttcactacgataggtgccgtagcagaccttgtgtttgcttacaacactggtatgctgccagaaattcaggcaaccataaggcctcctgtggtcaagaacatggagaaagctctatggttccagttcaccgttggctccttgcctctctatgctgtaatatttatgggttactgggcttatggttcctcaacatcaagttatctgctaaacagtgtcacaggcccagtttgggtaaaagccgttgcaaatctgtcggcattttttcagacagtcatagcgctgcacatatttgctagcccaatgtatgaatacctggacacaaaatatggaagtgggcgtggtggtccttttgaaatccaaaacctagcgttcagggtagtagtaagaggaggctacttgacggtgaacacgctggtggcggcggtgctcccattcctcggtgacttcatgagcctgacgggcgccctgagcaccttcccactgacgtttgtgctcgcaaatcacatgtacctgatggtgaaggggcctaagctgtctgccatccagaaattatggcactggctgaatgttgttgggttcactgcgttggctgttgcggcggcggtctcggcaataaggctcatcatgcgtgattccagcacctaccacttcttcgctgatgtttgagcttgaggccacgtacgatcagtgaaatattcaattctagcttgtttcctttatgtttttggaaagggagggcagatagcagggtgggtagctaccagcagcagtagttgatttgtgatggaaacggtaaattgtatccgagcaataaaatcaaggccaaatgtgctgagccagagctagtattatttatacacatctagatctcttctctttggttgtcttgtatcttcaaattcatcagtatgattgtatatgctgagccagagctagtataatttcagagaatt

SEQ ID NO: 12801 - DNA, 823 bp, Sorghum bicolor
  Clone ID: SORBI-28MAY03-CLUS27255_1
gtgcgagtcggtagcattttccagggctatggcggcggcgacggcggcggcaggcggtcgatgctggtgcaggacgacgtcgcccacccgggattcttggcgaagcagaggctgaacctgccggtggagtgcagggacaacgggtaccggctgtcctacatctgggcggacgacccggaggtgagggaggcgctgggcatccacgagggctccatcggctcgtggagtcgatgcaccatgctgacgcacttcaggcacgacctcgccaccgtcatcccttaccatgtcaaccttaccaaggcaggctacagggcgctcgtctacaacggcgatcatgacatggacatgacctacgtgggcacccaagagtggatcagaaccatgggctaccccatcgtcagcgactggagaccatggtacgccaaccgacaggtcgcagggttcacaaggacttacgcccacaacctcacttttgccactgtgaagggaggagggcacacagctccggagtacaggcccaaagagtgccaggccatgttggatcgatggacatcagcagcaggccaactctgatgaatttggtggccacgaaattctgtcttattgtcgaattaatcatatgtactaagaataagacaagctttaattcatagggagaggcagcttgtacttggctaggaggagcctaggacaaatgccagcttcgtatatagtatagtactagcacacatgcctgtatgttccaatggaacatacaacttgttgcttggttacatagacaatatgtggcattggcattttttccaccgatcagtccctactc

SEQ ID NO: 12802 - DNA, 1077 bp, Sorghum bicolor
  Clone ID: SORBI-28MAY03-CLUS33773_1
tgggaacctcccaattgggtgtgtcccaaaatatctgttgatattcaagagtgacgacaaagaagattatgagccagagacaggttgcctcaggtggatgaacgaattttcagagtaccacaacaagcttctcttggaggagctggagaagctgcgcaagcttaatcctggtgtgactattatctatgctgactattatggagctgcaatggaaattttccattcccctgaacgatttggtatcgaggaacctttggtggcttgctgcggtggagaaggaccctatggtgtgtccctttctacagcctgtggatatggagactacaaggtgtgtgataatccagacaagtatggctcgtgggatggtttccatccatcggaagctgcatacaaaggcattgcaatgggccttttgcgagggacatacacacaaccatctattgcttccaccaccagttcctgtccacagctcactgagctcggctcttctgttgaatacaaggtcctctacgatttatagttttgcagctacatttagttgttagtgttaattttataaaaacacacgtggttagagattaatctatttttttttggatgcgtacagtatggttaaagatgtaatgatttggacatttttgcctgattacagagccgcggtactgtactgcacttctcggcagtggcccacgtgattggttgggttttgttttaccttctctttttcagttacaggttttattcgtcattatttacggtttctctgtagtttcaatgctctattattcctttagtcgtatatgcaggtttagtttctaacttctgagcatcctattaaaaaggggtgcttttaccatccatagaaggtataccaagaggaactacagaattatacttgggggtccccaaactcttggtacctcccaatgacttcaaaatggccgattaaaaggagaggataccaaatctttgatcatcttggctggtacagcggagatgctatctactccatttccatttcttgtaaatgcaaccatcagttcttccgattaacgtgatgccgagctgaacttctgc

SEQ ID NO: 12803 - DNA, 776 bp, Sorghum bicolor
  Clone ID: SORBI-28MAY03-CLUS33955_1
gatcttgtgggcattccgcctgccccaagaggcttgcctcagattgaggttacattcgacatcgacgccaatgggattgtgaccgtctcagccaaagataaggctaccgggaaggagcagaacatcaccatccgatcctcgggtgggctgtccgaggctgacatccagaagatggtgcaagaagctgagctgcatgcccagaaggatcaggaacggaaagcactcattgacatccggaacaatgctgacaccactatctacagcatcgagaagagtctgggagagtacagggacaagatcccttctgaggttgcatctgagatcgaggcggctatcgctgacctccgccaggagatggcctcagatgatatcgagaagatcaaggccaagcttgaggctgccaacaaggctgtctcgaagattggacagcacatgtctggtggtggctctggtggctcgcagtcaggatctggacctcagggtggcggcgaccaggcgccggaggcagagtatgaggaggttaagaagtgaggctgcggaaggtgaagggagattgtagcggcgtgtttagaagtagctactcttttttgggaacacagatagtcagatgagatgtagcctgtgttgtaataatctttggatttgccccgtcttgttttctcctgcagtgatggaggtcacacgacattgtcatggcttttgttgcatatgaagccttcttctggcctcgatgcacgcgcacagcgaaaaccattggcgagttctgctaatgcata

SEQ ID NO: 12804 - DNA, 2463 bp, Sorghum bicolor
  Clone ID: SORBI-28MAY03-CLUS34399_1
gcacgaggcgatcgatcgcgtgcccgccgactgatgggaggctagattccggcaatcaacctttgcggctgatttttggtgaagcgacctcgatctgaaaaatggggctgttccgggcggcgtccggcctggcccgtgtggcgctgcggcggaacctctcgcgcgccgcggcgagccccttcgccggcggcggtggcgccgtccctcgtgccgcgccggcgcgctacttccactccacccgcccgcgctggttcgctgcgcctgagccccgtgcggtgccgctctcgcgtctcaccgacagcttcctcgatgggaccagcagcgtctaccttgaggagctgcagcgggcctgggaggccgaccccaactccgtcgacgagtcctgggacaacttcttccgcgaacttcgtcggcgcaggctgcggccacctcaccgggcctctccggccagaccatccatgagagcatgatgctgctgctgctcgtcagggcgtatcaagtgagcggccacctgaaggccaagcttgacccgctcgggctggaggagcgcccggtcccggacgtgctggacccagcgttttatgggttctctgaggcggacttggaccgcgagttcttccttggggtgtggaggatggctgggttccttgaggagaaccggccagtgcacacgctgcgttccgtgctggagcggctcgagcaggcctactgcggcaccattgggtacgagtacatgcacatacctgacagggagaagtgcaactggctcagggataggatcgagacagttaacccaagggagtactcttatgatcgtcgtcaggtcatgctggataggcttatctggagcacacagtttgagaatttcttggcgaccaagtggacgactgcaaaacggttcggtcttgaaggcgctgagactctgatccctggcatgaaggagatgtttgacagggcagctgatcttggtgtagagagtattgtcattgggatgccacatagaggcaggttaaatgtcttgggaaacgttgtgaggaagcccttgcgacagatattcagcgagtttagtggtggtaccacgccggtcaatgaaggggaggggttgtatacagggactggtgatgtcaagtaccatcttggaacttcatatgataggcctaccagaggtgggaaacaaatccatctgtcactggttgcaaacccgagtcatttggaagcagttgatccagttgcacaggggaagacaagagcgaagcagtactattctaatgaccgcgacaggaccaagaatttgggagtgttgctgcatggtgatggtagtttctcagggcagggagttgtgtatgagacactgcatctcagtgcccttgaaaattacaccactggtgggacaatacatattgtggtcaataatcaggttgctttcactactgatccagagtcagggagatcctcgcagtattgcacagacgtagcaaaagcattggatgctcctattttccatgttaacggtgatgatttggaggccgttgttcatgtctgtgagctcgctgcagaatggcgacagacatttcattcagatgtagtggtggacattgtatgctaccggcgatttggccataatgaaattgatgagccgtccttcacccaacctaagatgtacaaggtgattaggaaccatccaagtgcgcttgagatttatcaaagaaagttgttggagtctgggaagatctcaaaggaagatattgataagttaaacaagaaggtcagcactatacttaacgaggaattccagaatagcaaagactatgttcccaacaagagggactggctttcagcttactggactgggttcaagtcaccagagcagatttcgcgtatccgaaacaccggtgtcaagccagagattctaaaacgtgttggagaagccatgactactctgccagaaaattttaagcctcacagggctgtgaagaagatttttgatctgcggcgtcagatgattgagactggagaaggcattgattgggcagttggtgaagcactcgcttttgctactcttataattgaggggaaccatgtcaggttaagtggacaggatgttgagaggggtacattcagccaccgtcattctgtcatccatgaccaagaaactggagagcagtactgccctctggatcatcttgttatgaatcaagatgaggagctttttactgtgagcaacagttccctgtcagaatttgctgttttgggctttgaattgggttactccatggagaacccgaactcattggtcatatgggaagctcagtttggtgattttgcaaatggagctcaagtgatatttgatcagttcctgagtagtggggagtcaaaatggctccgccagactggccttgtcgtttgccttcctcatggatatgatggtcaggggcctgaacattctagtgcaagattggagcg

SEQ ID NO: 12805 - DNA, 1156 bp, Sorghum bicolor
  Clone ID: SORBI-28MAY03-CLUS29192_1
gcacgaggggcgcgcccacgcacgagggacgtgtcgccttgggttgttcgagctcgtagtagtgttgccctacgtgatggagggcgatctccccactcctgcgaacgccagggtcgccgtggtcaccggcggcaacaaagggatcgggctggaggtgtgccggcagctggccggcaacggggtcaccgtcgtcttaacagccagggacgaggcgaggggcgctgcggccgtggagaagctcagagacctggggctctccgatgtccttttccaccaactggacattatcgatgctccgagcatcgctcgaattgctgagttcctcaagacccgtttcgggaagctagatatcctggtaaataatgccgcgattggtgggattgagtatgttcatgaccaagatcgtgactcggtaacgagcgaggaaaaggcaaagctcagtggcatggatatggatcagaggcttggatggctgtggcaaaattgccgggagacttacgatgatgcaaagacaggcctgcgcacaaactactacggcacaaagcaactaatccaagttttactccctctgctgcaggcctcctccgatgggaggatcgttaacgtctcctcccacttcgggcagctcaggcttttccgaaacgaggagctgaagcgggagctgaacgacattgataacctcaccccggagaggctggatggcctgctggacatgttcctgaaagacttcgaggccggcgcggtggaatccaacggctggccgatgtatttctcggcgtacaaggtggccaaggcggccatgaacgcgtactcgaggatcctggcgaggcggcaccccgagctgcgcgtcaactgtgcgcatcctggctacgtgaagaccgacatgaccatacactcggggctgttgacgccggaggaaggcggcagcagggtggccatggtggcgctgctgccggaaggcgggccgaccggcgcgttctttgaagactttgcagagtcctcgttcgtgtgatgttgaacatgcagctgcacctcatctattctctatagatattcatctgaaagatgctacaatttttttcccatttgcgtctaaactcagcgctcaacctttaactcttaaacttcaataataaagctaggcacactactgcca

SEQ ID NO: 12806 - DNA, 924 bp, Sorghum bicolor
  Clone ID: SORBI-28MAY03-CLUS29228_1
cacaaacctgtcagcatacgcctatcaccggaagtcagacaactcagacagagagctccaacaggagctggaaaaggaccgtatgcagtaccagccagcacagcggttcatggatgccaaggtagtatcacagatgtcccctgacttgaggtcttcctactatataccaaaaggtgtcccgaaagctgatggcgcagatagagctgctttgcattctagcatgattcatggaatcgccccttttagtggcattgctgctgtaggaggtggaggtggctacaacaaggtcaatgcagttcaatatggagtttctaggatgtactagttctagttgcattggccatctccaaaatcctcagttgagttgaagtaataacatggcgaagggtggaaagatttaggtaccaaagagctgccatattggctctgagccaaagatacaaagctggagtatgatctcggatcaaggacgacgtgtgacatcagattgaaaacgctattgggcaacagtcatggttctgtccattggatctagcttttcggaaagcaatgccttcaccccgcggaaacggtaaaataaaaggagaaaaagggcagtgccgtcagttgattgctgcttataagaagcaaagggggcagagacgatttttacatggaaaattatgtactttgcaagaaaggaaacatgtgggaataaaaatagtgagcctacgtttagctctgtatataaagtcacttgattttatatgtattattacggctggtgaaacccgcttctttaattcaaagctgtagaattttggcctatgtttagctctgtaataccataggcagttcagattgattcagccgttggtttattttgccctctttacctctttgtccgtattacttttacattagaaaatgaaatttagcttggac

SEQ ID NO: 12807 - DNA, 828 bp, Sorghum bicolor
  Clone ID: SORBI-28MAY03-CLUS29633_1
ctgcttaatgaatggaatcaggagctggatgagatgactgagctggagaagcgtacagcaaagggaaagtcgatggttgcaacattcaagcagtgcgcgcggtatctcagccccctgtttgagttctgcaggaagaaggttcttcctgatgacatccgtcaagcattgcttgttattgttgagtgttgcatgaagcgtgattatttagcagcaatggaccaatacatcaagctggcaattgggaatgcaccatggcccattggagtcactatggttggtatccacgagcgttctgctcgagaaaagatctacacaaacagtgttgcccacatcatgaatgatgagaccactcgcaagtaccttcaatcaatcaagaggctcatgacactttgccagcgacgttaccctgcactgccctcaaaatcagtagagttcaacagcctggcaaatgggagtgacctgcaggcgcttttatcggaagagaatggttcgggtaaagcttctgaagaaaggctccggttgatgccagcatcaaaagagtgatgccttcatagactagattgaattacactctacaaatagagcttgagatgtttgtgtaatatcaacaatcagaactgccttttttttctgttttgtgctgaagagaaaaacaacagaattgtgtatgctaatcaaatcgctttaccacttgatctggttgggcaagttttactaatatatcagctacacccagagaatcatttttgacttgttgttctcaagctgcagtgacagtgatgactgtattaatcaggtttggtattatcctagttctgtcagtactgc

SEQ ID NO: 12808 - DNA, 784 bp, Sorghum bicolor
  Clone ID: SORBI-28MAY03-CLUS29525_1
gaggcgcattcaagcatgtctcccagaaggacatcaggaacctccacatgctccaggaaatgtacaatgagtggccatttttcagggtcactattgatctggtggagatggtgttcgccaagggtaaccctggcattgctgcactttatgacaaactccttgtttcagaggaactgcgtccattgggtgagaagctgagggccaactatgaagaaacccaaaagcttctacttcaggttgccgggcacagggatctcctggaaggtgacccttacctgaagcagcggctccgcctccgtgacgcgtacatcaccaccctgaacgtctgccaggcctacaccctgaagcggatccgtgacccggactaccatgtcgcgctgcgcccccacctctccaaggagatcatggaccccaccaaggcggcttcagagctggtgaagctgaaccctggcagcgagtatgcaccggggctggaggacaccctcattctgaccatgaagggcatagcagccggtctccagaacaccggttaaaacacaaagaggggatctttttttttaatcctgatcattgtctctaggtcctttgtatttacgcagattttagctgcatcttcggccgtctctctacaccgtgaggaaataatggcgattttcgccaaagtggcggtaaataaaagggagatgaggatcatacatgtttttcttattagtagaccgttgtgttgcaactttactatgcgataatggaacatggctgtagcctaattgaagtgccgtatctc

SEQ ID NO: 12809 - DNA, 877 bp, Sorghum bicolor
  Clone ID: SORBI-28MAY03-CLUS29650_1
agataaaatccgggaactacttgctgaagcttttgcaagcgcgtccagagagaactagtaatgatgaccgagatgaagtgagaaacatcttggatgaagttgatgcatgtgacccatacagagttgctgtgaaagtagagtctgcactatttgagaggcttggacgttccactggggctcacaagacaaagtacaggtcaatcatgttcaacctgagggctgaaaacaacactgatttccggagaagggttcttattggtgaagtgacgccagaggggcttccagacatatctcctgatgagatggctagtgatgcaaggaagcaagagaatatgcagattaaggagaaggctctgtttgagtgtgagcgggcaggagctccaaaggcaacgacggatcagttcaagtgtggcagatgtggtcagcggaagacaacttactatcagctgcagactcggagtgccgatgaaccaatgacgacattcgtcacgtgtgtgaactgcaacaatcattggaagttctgctgagtggcagcctgctaaaatgtttgcttagttgtgctgagcaccattctgttgtgtgctctgttagttagctctgtgactcagttcgacagggcaggctgaacttagttttttctaagctaggaaccgttatcctcttcctctgttagtcgctctttgcgatcctgattcgttcagattgtactagttgaacgcataaatgttgttgacttgatcatatcatcaacagctgtacccttaaagttttggatggctatgtggttcattgtaaatgtgatcgtgtggttttacagttgtagtcatgtactcgtggatgttggatattgtagtatttttgacagctctttcttcgg

SEQ ID NO: 12810 - DNA, 633 bp, Sorghum bicolor
  Clone ID: SORBI-28MAY03-CLUS29725_1
gcgcctcaagatgggccgcgtcgcctactggcgcaactccctcgtcgtccgcgtgctcaccatgctccggatcgcgcccaagggtgtctccgaggtgcacgagatgctgtacgagaccgcgcagcacctcacccgcggcggcgagaccggcatcttcacgcccatgcacatggtgctcctccgcaagcctgtctccaccgaggaggcgaaatagtgtaagattacacatcaccacccatcaattactactactcacccaccgcaagagggagagggaggaaggaagaagatgcaggagaaataatttatctggcagaagcagcagaggtaagaagaagaagaagagcaggctactcggcgacttgaagaagtaaaatttgatctgttagagaagaagatactactaggaaccatgcttctctggtttactcttttttcttgttattactagtagctttcaattttaattttagttttttggtggaaggattattcaggggggcgaggttggggtttaaatttaaatttgttttcgcttgcttagatcggtggagatccatctatcatctatcatcatcttcatcaaccatgttttgtctgcaacaatacattggaattgaattccctaatgtc

SEQ ID NO: 12811 - DNA, 1459 bp, Sorghum bicolor
  Clone ID: SORBI-28MAY03-CLUS29791_1
attttttccgacagagcggtgggtcgcgccgacggagatgggtggcgccgccgtggccgttcttgccgccgcaaccgcacgccggaaatctggtccgttcgtatccttgctcgccggggcggcgcgcaggctccacgatgctgcagagactgcagcggcggaggaggataaggcagggacgcagagtcggcggcggcggaggagcagcagcagcctccttcttggaccggacttcctcgacacctgggaccctatatcgcgtgacacgacgccgcaggctcctccgcggtgtgcacaagctgattatgatcgcactgcaaccattattgatggcaagtccattgcggaggacataaggtttcatattgctgaagaagtctgtcaaatgaaacgttcagttggacatgtgcctggtctagctgttgttttggttggtgatagaagagattctgaatcatatgtgcgatacaaagtaaaaggctgtgaggaagttggaattaaatctttgttggcgaagttgcctggaaactgttcagaagatgaagtgatggattcagtgtcaagatttaatgaggatccatctgttcatggcatcctagtgcagttacctctaccagagtttatggatgaggaaaggattctgagcaccatcagtctggagaaggacgttgatggtttccatcccttaaatgtgggtaatcttgcactcagaagccgaaatcctttgtttgtgccctgtgctgcaaaggcttgcattgagttattgcttcaatctgggattgaactgatgggcaagcatgtagctgtcattgggagaagcaaagttgttggattgcccacttccttacttttacagcggcatcacgccactgtcagtgttatccatgccttcacaacaaatccagaggctattacccgtgaatctgatattgtgatatcagctgctggagtggccaatcttgtaaggggaagctggttaaagcaaggtgcagtggtgattgatgttgggacaaatccaatcgaggatccaaccagtgattacggttatcgcctaactggagatgtctgcttcgaagaagcagtgaatgtggcctctgctataactccagttcctggcggagttggaccagtaacgattgcgatgcttcttggcaacacacttgattcagcaaaacgcgtttatggccaaagtgactgaaccccctgaactgtaattttgtcatgcttgtttctgtaaattagttttcttttcttttgctcctcccgttgctctctattttagctgtatgagtgctgggatgtaccatattctcgctcaataaatattctgcttagctgtttttttggtgaccatattagcctattacctagaatcaacacacaacagcaggaaacatgtaagacacgatttctttgcattttttttataagagaaataggcctgacggagaacgttgtg

SEQ ID NO: 12812 - DNA, 842 bp, Sorghum bicolor
  Clone ID: SORBI-28MAY03-CLUS36733_1
gcacgccggcgccccccgttcctcttccccctccgcctctccggcgcttcctcctcctctcaccccggccccgtgctctcgcttcgctccctttaatttattttatcatcaagtcctaatttatttcatttcttattgtactccatactagtatttcgctcgccctcccttcccgagtgttcccgtgcctcagacaggttcggattgcttgctctcgcttgttagaaattcagccgtgcaagtttggattcaccaaatccacccattctctcgtgccccgaggtcgcgcgcggcggaatttcggcctgggcgccgccgattcgggcctctcagtccggaaaggcggcccccggtgtggttcgcccccaaatctcagctgccttcgtggcggaactcgtcgtggtgcgctttggtttcctgtccttcagccttccaggggatggggcgccgcgcgtcgctgacgcccgccccgccgccgggccgcctggctgcctgccccgcggccgttcttacgatcgggcgccgcccgtcgccgaccgccgcccttccgccgcgcgccctggcccttgtggagtatgctgctgcaatctatactgctgatttgacagaattgtttacttggacatgtgccagatgcggtgacttgatcaaggctgctgcagggttcgagatgatagagatcattgtagatgtcgagaactgcttgcaggcatatgttggttttgccagtgatataaatgctgtcgtcgttgtttttagcgggacccgcttgcaggcatatgttggttgggccagtgatataaatgctgtcatcgttgtttttagaggaactcaagagaaca

SEQ ID NO: 12813 - DNA, 896 bp, Sorghum bicolor
  Clone ID: SORBI-28MAY03-CLUS37206_1
gcacgaggccggagcgtcaggataagaaaagagcgcggcggcaggcagctcctcctgcggctgcgagcgcccgtccatggcgtccctctccccttccctccacctcccctgcaattcaagaactggtttccttggaaagacacatgggattcgtcctcgtgttctccctgctggaagagtcggatttgtcagaacagtagtggaatgcaaggaatctagaattggaaagcaacccatcgaagtcccatcaaatgttactctcacattagaggagcaatttgtcaaagctaagggtccgcttggggagttatctctaagctttccaggtgatgtgaagattgtgaaagaagaatctggtatgctgagagtttataagactgcagagaccaagagggcaaaccagatgcatggacttttcagaacactgacagacaacatcatcgttggtgtgtccaaaggattcgataagaagcttcagttagtgggtgtcgggtatcgtgcagcggtggagggcaacgatctcgtgatgaacctgggattctcccaccctgttcggatggccattcctgaaggcctggcggtcaaggtggaagagaacacgaggatccccgtgagtggctacgacaagagcgcgatcggtcagtttgctgccactatcaagaagtggaggccccctgagccatacaagggaaagggtatcagatatatggatgaggttgtcagaaggaaggaaggaaaagctgggaagaagaaatagaaagtgtttgttatttttggcccgtttcatacttcatttcatttttcccactgtaatgatcttcgtctgctaaggctgaacctaagaaaaatcttgttctgtgctgatcatggcttatagatgtcccctttgagccaaa

SEQ ID NO: 12814 - DNA, 1121 bp, Sorghum bicolor
  Clone ID: SORBI-28MAY03-CLUS37906_1
gcacgagggcggcgccgaggtggcgaactactgccgggagaggctccaggtgctcttgcggcaggagctgaggctactcggcaaggatttgggggagacaagcgaggtggagatgaaggagcactgggacgacctgttcaccaggtgtttccagaggctggacgacgaggtgtcagggcaggcgagcaggctcgtcggtggcgttcaggagtcacggccggtggccgccgagaacgtgggctcgactgcggttgtcgccgtcgtgtgctcgtcccatgtggtggtcgccaactgcggggattcgcgtgttgtcctctgccgtggaaaggagcccgtagagctgtcgattgatcacaagcctgacaggaaggatgagcgggcgaggattgaggccctgggaggcaaggtcatccaatggaacggttaccgggtctccggtatacttgctatgtcaagatcgattggggaccggtatttaaaaccattcgtcattccaaaaccagaagttacagtctttcctagggcgaaagatgatgactgcctcattcttgcaagtgatggactgtgggatgtcataccgaatgaagaggcatgcaaagttgcacggcgtcaaatccaactgtggcacaagaacaatggtgtcgcatcatcattgtgtgatgagggtgatgaatccactgatcctgctgcacaagctgcagctgattatcttatgaggctcgcactgaagaagggtactgaggacaatatcactgtcattgtggttgatttgaaacctcgaaagaagctcaagagcaactcataacattgagctggatccatcagagttagagctgaccatgatatgtccaaagacttctattgctagttggtcgtccggatgagacttgacccacattttttttttcgttgggcctcaagaattgtacatgtatatgctagatgcattttccgtagagggttatgcttaaccccactctatttctagtggctaaaatattctccaatcggcttctaccttgagccctggcacttggtatatccccaatgctgtatgatagtcgaacttgtaaagagccaagcggctgagacggtcactaaaattaacatattgttacctt

SEQ ID NO: 12815 - DNA, 673 bp, Sorghum bicolor
  Clone ID: SORBI-28MAY03-CLUS38015_1
gcccccgcaccagcgctagcttcaccactgcggactgctccgcttctcttgctggcctcctgggacattgctgcgtcgaaggcgagggccggcggactccgctcgcacgccatattcgtatcgccgcacggcgtctagtctgctgcctgcactgcagcgtgctccatcttgccgggtctagcagccaccctcttctcctctccgctcgctcccaaacgccgctgcctccacttcaccatggcgcttcacgccccggtcctcgtgctgaaggactcgctgaagcgggagtctggcgcgaaggttcaccaagccaacatccaggcggccaaggctgttgctgacatcatacgcactacattgggtcccagatccatgctgaaaatgcttctggatgctggtggaggtattgtggttactaatgatgggaatgctattttgagggaaatagacatcgcacaccctgctgccaagtctatgattgaactaagtcgtacacaggatgaagaagttggtgatggcactacatctgtcattgttctagctggagagatgctacacgttgcacaggcattcattgacaagaactaccatccaactgttatttgccgagcatacaccaaagcgcttgatgatgctattgctgtacttgacaaaattgcaatgcctgttgatg

SEQ ID NO: 12816 - DNA, 1793 bp, Sorghum bicolor
  Clone ID: SORBI-28MAY03-CLUS30735_1
tcccctcccggcctcctctctctctgctctctctctctcatacggacaaattcggctcgccgctttgtttacagcggcgacgcaagccacgcagcgagccgcggttgggttggcgttgcgtctcccctccgacaccgaagcttcctccggggacatctcccttcctccctccgaccgcccgccgcaacccaaatcgccgatctccaccggcgacgttgcccggctgggcctcggcttccgattccgtgtggcgacggaccggatcggcccgaagcgagattattaagggctggcgcacctgacttcttgttttatggctcggaataaccagggtcatctccagctgccagagatggatcatattcaacccaagaacatcccacacaatgaatcactgcctctaggccagaagcttctactgcatcatggaagtggtgccccccctcggcctgctcactctgcgcagccgaatccggctcctcgtgctgagcccctgcctcctccaagccccgtaagcattgaccaaagtggttgggatggccaacacttaattcatcaagaaggattccagaggaatgtgagagcacgccacagtcataatatttcattagaacccagatcagcttcaacctacccactaaacagtgctcacatgtcgtcatttggttcaactgcaagtgcttcctcaagtacatcagtcgaaaggaaccaagcacctgtttctctgccaacaagaactgttccatcaggtgcaccaggtatcactagcagggccctgacagggagggcctactatcctgtggttggaagcagcagcccaagtgttggtgctgtcccaactatccatggatcatctggcactgcaatatttgctaatggtggctatgctcctagtactgctcatactggaactgttcctatctaccctaatggagctcctgctacttcatctggctctagagccatgccccatcagatggtcattcagaatcatccacatgctacctctgcagcaacctctacatccatgcgtgacagaattgctgcggcttctagacatgcaagacatgtatcagtagggcatgctaacaatggaaggtacagaagggctaggagctcttactacagtcttcatccattgatggtagaggcagagcggttcatgatggaccagttagtcttttacgaatcaagagcagcagctgctgacccccacagggacatgagactggacattgacaacatgagttatgaggacctgttggctttgggagaatctatgggtaacgtcagcacaggcttggctgatgaaaaaatttcgaagtgtgtgaaagaagtggtctgttgcagttctggccagatgcaaattgatgaagatgaccaagatgatggaagctgcatcatttgcctggagggttacaaagacaaggatatgctggggatactgaaatgcaggcatgacttccatgccgactgcatcaagaagtggttgcagacgaagaattcatgcccggtgtgcaaagcagccgctgcttaggacaacaccagaggagcaaagcaactattgtgctcctcgatccattcattttaggctcagattaaattatgccatttcattcttttcgtcctggcagccatgtaaataaatgctctatggtgattaattagttatctcttgggttacattagcctgaattcttttgttgtattgtaacagtctagttgtgaaagcaactaatcatcaatcaagtggttaaaagctcatgtcctggttttcggattctccgacactg

SEQ ID NO: 12817 - DNA, 1217 bp, Sorghum bicolor
  Clone ID: SORBI-28MAY03-CLUS30588_1
gatcttgcgcatggacctattggtcacaagtgtttcatagactagactacagttcacaggagaaagcatgaatgcgtcatgtatgcaaccatgcctgttcctgcataaacaaccctgcaggaacgtaactagtggactaaaatcctatgacttttcagtggcatagaaataccatgatcacattattcttcacagcatgttagtactgatgtaggctgaggatgaatcatcaagcacgcaagatgataggagtgtgtttcgttgaatgccattatttcctatcatttatctattatgccgtatcaattgttattgatatcctagagctccactgacctgcatcacttcgttttctttacacattcacacatcactgtcatgcagagctggtctggagaaggcaaagaaagaactggccgagagtatccagaagggtgtctctttcatcaacaagtgaggcgcgccagccctacttagaaagagatgtggcgggctttggctggagcaggatcagcaactctttcaatggcatatgcagctgccaaatttgcagatgcttgcctgagaggattgcgtggtgatgctgggatagtagagtgctcttatgtagcttctcaggtcacagagctgcctttctttgcatccaaagtgcggttagggcgatgtggcattgaggagatcctaccacttgggccattaaatgagtttgagagagctggtctggagaaggcaaagaaagaactggccgagagtatccagaagggtgtctctttcatcaacaagtgaggcgggccagcccaacatagaaatagatgtggcgtgttttggcttcctgagaactcttatctcttgttatctcattgtaaaactgtgtacatggcacgaataatctacataggcggctgtacactaaaaaaatataaatatgtggccgctaaaaaaggaaatagaaaaatctggtaataaaagttgcttctgaacaaatggggttctgaagtctgaattgccccagtgtacgggatcagatgtactgtatggtattagataatacatttgcagtctcgatgcagagcaaggttgcattgcagctgagatgccaatggaactgtgtagaaatcaccactgagattgtgtccttcattatgttgtttagtcacataaatccatgacgggatttgtgcatgatgagttaacttgtacggtcttcagttatatgt

SEQ ID NO: 12818 - DNA, 1390 bp, Sorghum bicolor
  Clone ID: SORBI-28MAY03-CLUS30768_1
gcacgaggccagcacgggcgacacgcccagcaaaacaagccggccaaatccacagacccgccccccgccccgcgcccgccgcctcgcccccgcccccccccccggccccccccccgccgcgcccccccgcccttgccgcctcgccccccgccccccgccggccgcccccgtcctccggcttccctcgtcggcgtcccggctccgtgcggtgcacgcccgtgctgcaggccagtcagtatcttccctcgtcggcgccatggattgggctgctccggcattgacgagcttcgtcgccgactcgtcctaccgccacctctgctgctacggcgccggaatcgcagggaacgtcttcgccttcgtgctcttcatctccccacttcccacattcaagaggatcgtccgcaacgggtccacggagcagttctcggccatgccgtacatctactcgctgctcaactgcctcatctgcatgtggtacggcctccccttcgtctcctacggcgtcgtcctcgtcgccaccgtcaactccatcggcgccgtcttccagctcgcatacaccgccgtcttcatcgccttcgccgacgccaagcagaggctcaaggtctctgctctcctggctgccgtctttgtggtgttcggactgattgtgtttgttagtttggccttgttggatcccccaacccggcagatgttcgtcggatatctcagcgtcgcatccctcatattcatgttcgcgtcccccttgtcaatcatcaatctggtcatcaggacgaagagcgtggaatatatgcccttctacttgtcattatctatgtttctgatgagtgcatccttcttcggatacggagtgctgctgaatgatttcttcatatatattccaaatggtattggaaccatactgggtatcatacagttggtgctgtatgcctatttcagaaaaggatcaagcgaggaagccaagctgccattactagtcacacatacatgagcacgccaaaagaaccaaggttcgctgatggactttggcgaaatcctttttgggtgcgtattctgctgtatgctaggaaaaaacttgacttatcactgtcagtgatcaatggcgacctatcccattcacaaagtccttgtccgaattgttttgctcctgtgaaaaacatgctgttctttcgttttatttacacgcaacggggatcatagtttcgctgtatattccatggtagatgctgcaaattgttgatggagtcattcgtttattatgagtgagtgagtgagtgaagttttgtattttgtatattatagtatagtagtgttgttgcgtggacttcatcaacggatggggccgcctgtatacacatagaaaagcaataaaaggatattattattatttatc

SEQ ID NO: 12819 - DNA, 1334 bp, Sorghum bicolor
  Clone ID: SORBI-28MAY03-CLUS31920_1
gcacgagggccggcccgacccgtggcggggcccgatgccgccggatccggtcccgccgctctgctctgctccgctcggctccgcctccccaattccccccctccgccccgccggccagaccatagtctctgctcggggcagtgccgaccccgaggagcattccgttccatggcctcgccttcctaacggatcgcgggattagcagcccgcgccgcgctgcgttccgtggcttgccggcgctgcgtctccaggttctggcaggaatccaagatgggtgtaatcagcactgttcttggtttctctggatttggctttgggttctcggctggcattgttattgggtacttcctcttcatctatgtccagccagctgatgtcaaggatgtcaaagttcgcccgcttgtggaatatgattcaaaatctttggagggcatccttcctgaaattccactgtgggtcaagaatcccgactatgatagaattgattggctgaacaggtttttggaattgatgtggccttatcttgacaaggctatctgcagaactgcacaggatatcgcaaagccaattattgctgagaatactgcaaagtataagatagactctgttgagtttgaaacacttactttgggtagtctaccacccacctttcaagggatgaaagtctatgtcacagaggagcaagagttgataatggaaccatgtcttaaatgggctgcaaatccaaatgtcacagttgttataaaggcttatggtttgaaagctactgtccagattgttgatctacaagtctttgcattacctcgtattactctgaagccattagtgcctacatttccttgctttgcaaaaatccttgtctcgctcatggagaagccacatgttgactttggactaaaacttctgggagcagatgtaatggctattcctggtctttacagatttgttcaggagaccatcaagaaacaagtggcaagcatgtatttatggccaaagacgctagaagtacctataatggatccctcaaaagcatcaaaaaggcctgttggaattctacttgtaaaggttgtaagagcccaaaatctgcggaagaaggatctgctgggtaaatctgacccatacgtgaaacttaagatgtcagatgataaacttccatccaagaagacaactgtaaagcgcagcaatctcaatccagagtggaatgaagacttcaaatttgttgtgacagatccagaaaaccaggctcttgaagttgatgtcttcgactgggaacaggttgggaaacatgaaaagatgggaatgaacatgatcccacttagagaactcccaccaga

SEQ ID NO: 12820 - DNA, 854 bp, Sorghum bicolor
  Clone ID: SORBI-28MAY03-CLUS32221_1
aacgtagtaaatggtatgactgatgaagaccctaatggcttagtagtcatgcaaattgtgtctgagagcaagaaggatccattacaaaggcgacatgaactgttggtgaaaactgagctggctgaggctctcatccaatcatgccttgaaaatgttggagaattacttcgaacaaattttggcaaagaaatattatatgagattgttgttggtggtaaagacaatattttggagggcctcactgataggatccacatgttgcatgatgcaatagtgtctgatgcagcccaaccgaagactgaagatattgaacatgcatttgagaatttcttttccagtcgtgtaatcagaagaatgataattgactgtccagcatttgcagtcactctctggagaaaggttcttgaaggaaagtgcaagatatgggctgaaggatacagctcgaaggtggttgcaggtttcctggaatcgccaagtaaggaggtcaaggatcttgcaaaacctgagctgcagccactggttgatgctggcatccttaaagtgccagaccctaaggttgttcagaaataactcgtgcgtgcggacatttttgcgtcaatgaaggatccaagggccatccattcttgtgtaagggacatggatagatttttgtcgcttgagcacgttctgcccataaattgttagtcactgagtgtacgctagtccgctataaccttataataggatatatagtaaaccagatccagtatttcgttttgaactctgaatgctcctttttatctgtaattttgttgggagattggtgttcttgtcctgctttgaaggccaataatgattttattgttgtttttttt

SEQ ID NO: 12821 - DNA, 713 bp, Sorghum bicolor
  Clone ID: SORBI-28MAY03-CLUS32515_1
gctcgacgcacgaggctccttcctcccacccgctcggcgctcggcgctcgctcctccagaaatctcgccgctgctggtagaagaggctcgtactatttgtcatgtcaggaggatcgacaccatcatcaaggcgaaacagctttaattctttgtctagagacctagaccttccttcagagcaaggttgtctctccattgttgtacttggggcttctggtgaccttgctaagaagaaaactttcccagccctctaccacctctttgatcagggatttatacaatctggtgaagtccatatatttggttatgctagatcaaatctttctgatgatgggttaagagaacgcattcgtgggtatctcaaaggagacccagaagatctttcagaatttttgcaattaataaaatatgtcagtggttcctatgacactggagaaggatttcagaaactgaacaagacaatatcacagtatgaggcgtcaaacaaatcaggaagctatcgcaggctcttttatttggcattgcctccatctgtctacccttcagtgtgcaaaatgatcagaacatattgcatgaatccatcttctcaccctggatggaccagagtcattgttgagaagccctttggaaaggacttggattccgctgaagaattaagtgcccaacttggggagctattcgaggaacaccaactatacagaatagaccattac

SEQ ID NO: 12822 - DNA, 1010 bp, Sorghum bicolor
  Clone ID: SORBI-28MAY03-CLUS33402_1
gcgctgcacccagcagaggcttttgcacgagccccgtgcagccttcttccacctcctactcctactcctactcccagctacccgtcttcgctgatttctgccgctccaattccatctctttcctgcttagaacttcttcctctgcttctccccttcatagcttttggtgccttgtcatcggcgacctaaccgccggcggccggataaactaagctagccccttggctccaaaagtcgtctctcgtagagagcacttgctcacctgctcctcacgcccctctgctggaactggacttgcgcggggtggagatccatccggacctggttcgatttcttcatttcggaggtgtcattagggaaggtgtcgccaccatgattctcagttaaccacagctaaatgccttttcttaatctttccgggtcgggaacatgcagttaaatctgaccagtagctgttgttggtaaaggttgcttctgtgtccagcgggtggatcactggactgtgggttgtgttaactgcaggctggcttatcagcctacccataaggaaagcgaaaaagagacagcaaagcaatttgttgtctcattcttaggagctggcgagtactccgcgtgccaggtccgactccgcggccggtctcctcgtcggtggtagacatggatgataagaatcaaaggttagaaaatggacagggtggagctatggtcctgccttctaattcatctgatcgatctgacagatctgacaaacctatggaccaaaaggttttgcgacggcttgctcaaaatcgtgaggcagcacgaaaaagtcggctgagaaaaaaggcatatgtgcaacagctagagagcagtaagctaaaacttgcaagcctggagcaagaactccagaaagctcgacaacagggaatcttcatatccagttccggagatcaaactcatgctatgagtggaaatggagctatgaccttcgatttagaatattctcgatggcaagaggatcaaaataagca

SEQ ID NO: 12823 - DNA, 773 bp, Sorghum bicolor
  Clone ID: SORBI-28MAY03-CLUS32051_1
ccttcttggggccacaaatgttgcgcagtccttaaaggtggatgagtcatgtaagaaaggtgttactgaagagaaggctgatgaggaggatgtttgtcctatctgccttgaagaatatgatgaagaaaatcctcgctctgtaactaaatgcgagcatcatttccatctttgctgcattcttgaatggatggagcgaaaagatacttgcccagtttgtgaccagataactttggtggatgagatgtttgaataggcttggtaaccctggtggatcatctcttggagctgttttttgctgaggaagtgcaggcagcaactactttactcttgatattggtccattctgggtggctctcatggtaatgaattgagggggcaaaaattggaaagatgaatgacatgaaatgtatttatgccacgtccttggttgtgcgctctgtgttatgctttcgctgttcatagcaacaggtggattaggaaactgcttggttgaatatatatatgtcggcttgctggttcattctgttcgaagtccaacactctacccttttgcttttatgaatccatagtttcagacatctgctggttcttccatgatcaagtcagctgtgtatatatcatacatttggtgcgtgataggtcaaaatggtctagatggagatgggggttgctttgtacaatccatgctattcaagctttctgtatataatctttctgttttcttcgttttgtctagtcagacaagtttcagggatataattttcagttctaaa

SEQ ID NO: 12824 - DNA, 1195 bp, Sorghum bicolor
  Clone ID: SORBI-28MAY03-CLUS4181_1
gcacgaggaccacacacccatcggattcaccgccgaggcaggcaggcaggcagaggagaacacacccacggccatttccgcccccgcagctcggacatagccaaggcccaaggcacagccggctgctagcacctaggaggagctcggggcgcgtcggggtccccttgccccccggccgcctggtgcgggggccggacccgcgccccgcccggcaccagcggcaggcgctcggggcgctcgccgctctccacgctccccgctcccgccccctgctccgggggcacgcggggctcgcggcggtcgggcggcgggctcccggcgcccgccgacgtcgtggccaagctgcgcaaggtcggcgccgccgccatcgtctcggtcggcccggccaaggaggagaagaaggacggcgacaagaaagacggcgacaagaaggatggcgacaagaaggacggcgacaagaagacgccgccgccggtcatactgtacccgcaccaccagtggtacccgtacgccgccgcgcagtaccacccccacccgtacccgccgcagtacgtcgtccacagcgccgaggaggaccccaactcctgcgtcatctgctgatgatgccgcttcggcttaggcgcagccgcgcgcgcaggctccgtcttctttttgtaaatctctgtgtagttggcctacctcaggccaggcaccatggaccgccacttcgtcggtgatcgccgggaccgggacaggttctggtggttggctgctctgctcgtctctatcatggcgaggggttggtcgctggcccgtccgcaggtcgttatactacgatggctggaggaattatacaggcgatccaggtttccaagagtggttgtttgggggtttcagcaggctgatcgatcagcttgattgtgtactgtgcatagaatatatgtgatttttgtccttgctatttgggtgtttgagggatgaaaaagctatatgcatagagatactccgtatctttaaagattaaccttgtaatgtaaaatataagtctgacgtatggtacgtgtcgagtttattaaagggacgcaaatgtactgacgatgatgccgattgcctcgaactatctggaagtaggatcgatgcactggacaaggggtgatattgtaatcataaaatggttggcatctgaaccatataaatatatgcggaatttgccggt

SEQ ID NO: 12825 - DNA, 567 bp, Sorghum bicolor
  Clone ID: SORBI-28MAY03-CLUS42567_1
cctactggattgccaggtcgatcgggaagccacaagcatatagtacaaccacactgggcgatctagctagcttctagcaaccaaagcactactagctagcaccacctgccacaccgaccggccggcggcgagagatcccatcgtcccatccatggcgcccagcggcgacaccatcgcgcaggtccacaccggcctcgacagcagcaacaagacgctgctcaagagcgaggccctctacaagtacgtcctggacacgtcggtgctgccacacgagcccgactgcatgcgtgagctccgcctcgtcaccgacaagcaccagtgggggttcatgcagtcgtcccccgacgaggcgcagctcctccggatgctgctcaagctcaccggcgcacgcaacacgctcgaggtcggcgtgttcacgggctactcccttctcgccacggcgctcgccctccccgacgacggcaaggtggtggcgttcgacgtgagcagggagtactacgacatcggccgccctttcatcgagagcgccggcgtcgcgcacaaggtcgacttccgggaaggcccggc

SEQ ID NO: 12826 - DNA, 980 bp, Sorghum bicolor
  Clone ID: SORBI-28MAY03-CLUS42601_1
gtggcacgacgcaacaaagaagatcacggtcgacgacgactacggccggcgagagcaagcaaaaatgagcggcagcgccgccgtaaaggtgatcggcttcttcgacagcccgttcagccaccgcgcggaggcggcgctctgcctcaagggagttccctacgagctcatccaggagaaggacctgcgcaacaagagcgagctgctgctgcaccacaaccccgtgcacaagaaggtgcccgtgctcctccacggcgaccgccgcgccgtctgcgagtcgctcgtcatcgtcgagtacgtcgacgaggcgttccacggcccgccgctcctccccgccgaccccgccgaccgcgccgccgcccgcttctgggcccgcttcatcgaagacaagtgctcgacgtcgttctggctggcgatgtggacggagggcgaggtgcagcaggggttcatgagggagatcaaggagaacctcaagctgctggaggggcaggtgaaggggaagcggttcttcggcggcgacgacgtgggctacctcgacgtcgccgccagcgggttcgcgcactggctcccggtctgcgaggaggtcgctggcgtcagcgtggtcaccgccgaggagtacccggacctgtgccggtgggcgagggagtacacctcccacgacgccgtgaagcagtgcctgcccgacagggaggagctgctcgcccgtttcagcgccaggaaggactcgtttgtggccacggcgaggtcaatggcgccggcgccggagaagaagtagtaatcctgcctgcgtgcatgccacagtaggaattaattgtttgtgtcgaggtcaatatgggttgttgaaaatgggtgcatggataacataaaagaattgtaacaagtggtcaggactgctgtcacgtatgatggctcccgggtgtttggttcccaactttgtttgactgcttgaataaaaaagaaagtaccggctgtgttccttaatt

SEQ ID NO: 12827 - DNA, 1090 bp, Sorghum bicolor
  Clone ID: SORBI-28MAY03-CLUS42667_1
ccggcggtggcagcatcccgaatgtccacagcaacaccgacagcagcaacaagacgctgctcaagagccaagccctgtacaagtacatcctggacacgacggtgctgccgaacgagccggagtgcatgcgcgagctgcgcctcctcacggacaagcacgagcggaggaacatggcgacgccgccggacgaggcgcagctgctgcggatgctgatcaagctgagcggcgcgaggaacgccatcgaggtgggcgtcttcaccggctgctcgctcctggccacggcgctggcgctgcccgacgacgggaaggtggtcgccgtcgacgtgagccgcgagtactacgacctcggccgccccatcatcgacaaggccggtgtggcgcacaaggtggacttccgggagggccctgcgctggagcacctggacgcgctgctcgccgacgaggccaaccacggcgcgttcgacttcgccttcgtcgacgccgacaagcccaactacgtgcggtaccacgagcagctgctccgtctggtgagggtgggcgggagcatcgtgtatgacaacacgctgtgggccgggaccgtggcgttgccgccggagacgcccatgaatgacctggaccggaggttctcggcggcgatcaaggacctcaatgtcaggctgtctaaggatgagcgcgtcgaggtctgccagctcgccatcgccgacggcatcaccatctgccgccgcctcgtctgatgaacgactctgactctgatccgttggtcggtcgtcggtccatccgatcatgtcgcggtcggttctccgggttccggccggccggatggaggatcgtcgtcggaactcatcactcagatcccatccggcctttttttttttttggtttgctgctgcatactgtactactgcatgctgtttgttcgagcgtcgtcgtctcggcgctctcaataagattttctgttcttgtttttttttttttcctttcctttcgttttctttttctttgcaatccaagcgatcgagttcgacagatcctgtataagtgtactgtgcttgtacgtacttgtgaaaattactaattgacagtgagtgtc

SEQ ID NO: 12828 - DNA, 1171 bp, Sorghum bicolor
  Clone ID: SORBI-28MAY03-CLUS34665_1
gcacgaggagcagatgtccccatattcagtgggccacatggtgagactggagggagtatattacatgatgacatgatgagcattttctcaaatgatggtctaggacgctttcgagattctatcagcagtgaaacaaggaggagtcacagaaggattctatgggatgcattttccaggcgcggctcaagaggttatccagaatctgatgctgatgaccttggattttacagtacatggctagaccttggtgatgacatttttgaagagttgggggaatcaagatattttcatcgcaggcgacatggttcaattagagtaagccagtattcaagatcccggattagggagcatcgccgtgctgtttttgatagtggtaatgaacaaagcactgcggcatgtcctctggggattcatccaattgggcgatgcacctgtgattctttcttgattgctgaagaatctagtgcccgtgcaagtatatcaagaattgtcatgttaactgaggcgttatttgaggtgttggatgaaattcaccgtcaacctgcatcactttcactttccatggtctctgttcaggctcctgaatctgtggttaattcgttgccatgtaagagctacaaaaagcttgagacaccccaatgcagtgatgatatggaacagtgccatatctgcctaactgaatatgaggatggagaccagataagaactcttccttgcaagcacgagttccacctgcaatgtgttgacaaatggctgaaagaaatacacagggtgtgccctctgtgccgtggagatgtctgcgaagtcggctcatgaagaccttggtgctgccatccctccttgcggcactggcggatagaacatcatcccccgctgcttcctggttgaagctggttgggtcaggcaacggcgatcctgtcaatttggacagttgacaccgcaagagcatgtcagctttgactgtctccctgccgaagagaatggccaaatcctgcgaccgatgcgtcgttgttcctgtcatcaacttttaagatacagactttgtatatagcttttgtagcctccccccgtgtatgacaacctgtacatatttgtaaattctagattccaaaattctattctcctagtcctaccctgatgccgaagcgtagctatttggtgcaggtaaatg

SEQ ID NO: 12829 - DNA, 673 bp, Sorghum bicolor
  Clone ID: SORBI-28MAY03-CLUS350_1
gcacgagggcggcttgtcctcttttaaagctggactgctcgattctgcctaccctcctcggctgccatctgtgtttgttagggtttcgtccgtgcggagctccgaaatccctccgccgctctcgcgttcgaggctaggtagccgccgccatgagccgctcgggacagcctccggatctcaagaagtacatggacaagaagcttcagattaagctgaatgcaaaccgtgttgttattggcacacttcggggattcgaccagttcatgaatctggtggtggacaacactgtggaggtcaatggaaatgacaagacagatattggaatggtggttatcaggggaaacagtgttgtcatgatcgaggcactggagccagttgccaagtcccagcagtgaatcattgttcttccgctgatatagcactagcagcgtgaaaactgatgtaaatgatatcagtgaaccctgttgtactttgactaatgcttttgcacagcaacataacttcggagcaatgtctatccctttttctatgtggtgcttgtggctatgtaatcatctgcccttattgctcgatctaactcaagcccgtctgctcatctacatggtttttctgaagtacaccacatatcaccttcacaacaggcctggctaccagtggtggcacctggctcaac

SEQ ID NO: 12830 - DNA, 1009 bp, Sorghum bicolor
  Clone ID: SORBI-28MAY03-CLUS35526_1
tctggacgcgcgcgcctcgctctccttcccccccgttccgcctctcgcgctcgcctctcgaggaccctcgccatcccgtcctcccccaaggcgcaccaccaaacccccagcggcggcgctagggtttccctctccgcgcgtcggcaccgccacctccgcccgcggcgatggcggggcaggagcgtaggacaatcgatctggaggagggatgggccttcatgcagaagggcatcaccaagctgaagaacatcctcgagggcaagcccgagccgcagttcagctccgaggactacatgatgctctacacgacgatatacaacatgtgcacgcagaagccgccacacgactactcgcagcagctttacgacaagtatagggagtcgttcgaggagtacatcacatccatggtactaccttcgttaagggagaaacatgacgagtttatgctgagggagctagtgcaaaggtggtcaaaccataaagtcatggttcgctggctctcacgtttctttcattaccttgaccggtacttcatatcaaggaggtcacttaccccacttaaagaagttggccttacttgcttccgagaattgatctatcaagagattaaagggcaagttaaagatgcagtgattgctctgatagacaaagaacgtgagggtgaacagattgaccgggctctgttgaagaatgtcttggatatttttgttgaaatcggtttgggtcaaatggagtgttatgagaatgacttcgaagatttcttgctcaaggatactacagagtactactctgtcaaggctcaaagctggattcttgaggactcatgcccagattacatgattaaggctgaggagtgtttgaagcgggagaaggagcgagttggtcactatttgcatattagcagcgaacaaaagttgttggagaaagtgcaaaatgaattgcttgctcagtatgcaaccccgctgttggagaaggagcattctggatgttctgctttgcttcgtgatga

SEQ ID NO: 12831 - DNA, 1568 bp, Sorghum bicolor
  Clone ID: SORBI-28MAY03-CLUS3572_1
gcacgcgcgtgggggtcgcccaggggtggcacggcctctctggaggccgccgggacgcttccctgtgcccacggctcccggcacgtcattactatcaggggcttgtcacttggaattgcattgacagtgtatggcagggaagaagaagctgacaccttgattgaacaaatgactagagatcaagatcccatacttcgttatggtggtatgtatgcattggctctagcatacagagggactgcaaataacaaagctatccaccagcttctgcattttgctgtgtcggacgtgagtgacgatgtgcggaggactgcagtgttggctcttggctttgtcctgtacaacgagcctgaacagacacccagaattgtgtccctactatcagaatcatacaatccacatgtccgttatggtgcagcactagctgttggaatctcctgtgccggaacaggattaagtgaagccatctccttactggagcctctgacatcagacgtcgtcgactttgtacgccagggtgctctcattgcgatggcaatggtgatgatccagaccaatgaatcttacgattcacgtgtcggagcattcaggcgccagttggaaaagataatccttgacaagcatgaggataccatgagcaaaatgggtgccattctggcttctggcattctcgatgccggtggcaggaatgtcaccatcaagctcaagtcgaggtcaaagcatgacaggctcactgctgttgtcggactagctgttttcacccagttctggtactggtacccgctcacctacttcataagccttgccttctctccaacggccctcattggcctcaactctgacctgaaagtgccaaagtttgagttcttgtcgaacgccaagccatcactgtttgattaccccaagccagtgactcagcagactgcgaccgcctcagtcaaggtaccggcagccatcttgtcgacgtatgccaagtctaagtctagggcaaagaaggaagcagagagcaaggccaaggagaaagcagaggactcttccaatgcttctacttcaatgcaggtggacggcgctgctgctgcagagaagaaggcccctgaaccggagcctacgttccagattctgacgaacccagcccgggtcgttccagcccaggagaagttcataaaattcctggaagacagcaggtacaagccggtgaaggctgccccctcaggattcgtcctcctccaggacctcaagcccacggaggctgaggagctcgccctaactgacgcgccgtcaaccgctgccacgaccaatgccccggcatccagtgccagcgagccagccgccatggctgtcgacgatgagccccagccgcccccggctttcgagtacaccgaatagaggtgatgatgatcctcggatcaggatgtatgggttgggttggcttgtctgtagtaacttcgtattgtcggatgactgaactcgggcgtatcactaattcatcatttatttaacttgcatatacttttgctcaagcatttatcgtgtgtgatgaagaaatatattgctgtctgagttttctg

SEQ ID NO: 12832 - DNA, 2102 bp, Sorghum bicolor
  unsure (1)..(2102): unsure at all n locations
  Clone ID: SORBI-28MAY03-CLUS3630_1
tctggagccgggccgtgctcgggaaaataaggacaccagcagcacgaaaggggaaaaaaaaaaaaggagagcagaaatcccccaatcgcccccacttcgatccattcgagccctaaccccgaatctccccggagcatcagactgaatccattcgattccctcatgtcaggctccgtcgtctcctgctgattcccgagatcgtctccaccggcgcggcttcgcccacagctgccgccacagccatggagccgcgcatcggcaacaggttccgcgtcggccgcaagctggggaggggctcctttggggagatctacctcggcaccaacgtgcagaccaacgaggaggtcgcaattaaactggaaaatgttaagacaaagcatcctcaattgctttatgaatcgaaattgtacagaatacttcaaggaggaactggaattccaaatgttaagtggtttggtgttgagggtgattacaatgttttggttatggacttactgggaccgcgcctggaagatctttttagcttttgtaacaggaagctgtccctcaaaactgttttgatgcttgctgatcaaatgatcaatcgagttgagtttgttcattccaagtcattcttgcatagagatattaagccggacaattttctcatgggtcttgggaaaagggcaaaccaggtttatgttatcgattttggacttgcaaagaagtacagagatacatcaacacaccagcacattccatacagagagaacaagaacttgactggaacagcaagatatgcaagtgtaaatacccaccttggaattgaacaaagccggagggatgacatggaatctcttggatatgtactgatgtacttcttgagaggaagccttccatggcagggcctgaaagctgggaacaagaaacaaaagtatgaaaagatcagcgaaaggaaaattgctacttcaactgaggctctctgtcgtggatatcctactgaatttgcttcttacttccattactgtcgctcactacgttttgaagatgcaccggactatcagtacctgaagagattgttcagagaccttttcattcgggaaggctttcagtttgattatgtttttgactggaccattctaaagtaccaacaggcacagatgaccactgctccaacacgtgcaattgctccaccagtaggacaaagcgctcggggggctcctgtggcaaacaacaatagacattcaggcactgaagagggaaggagaagtgggtggtcagacatggacccaacgcgacgccaggctccaccaccagttataaatgccggcagcctagcgaagcagaagtcccctgttcggcctgagacatcgacatccaaaggtccggtgttctccagttcgacttttttgggacgttcaagcggatcttcaaggcggcctgctgtctctagtagccgagagccaagcactgaagcagagcaaacacgtagccgcacgactgacgcaagcccaggggcattccagaggtctggagccccacggtggagcccgcagatgcctgactcctcggacggcaggcgctcgtcttccggcaggcgccactcatctaacccgaagaactacgagtctaccattaggggcatgcagggcctaaacttcgacggcgacgacagggttcactattagcatctcatctgttgtttgggacctgacatggtgcatcgtcggtgcgctgcccccccataggatgctccaatgtgtcaaggcctaaccgagatggaagtaccgagggcggctggataataagaggtttgggtgagtgagcctgagcgcagtccggctcttagaaactgtgttaatggctatgcttagcctccgcttgtacaggttgtcatttctttgattgcgcgtaagtgaagggtgcggtgtccccgtgaatgatgggtttattttgagagggatttcttgtggttcacatttgatgtgttgtgcgtgctgctttggtagacatttgggagaggtttatcgtgcctgctctctcatgtaactccagatctcctcnaactgctatatactatgtttttgactcaaaaaaaaaaaaaaaaactcgagggggggccc

SEQ ID NO: 12833 - DNA, 1133 bp, Sorghum bicolor
  Clone ID: SORBI-28MAY03-CLUS36482_1
gcgcgactctctcgcttccttctcctgccgcagccctagaaaatttttcccctccccgtagcgaaaccctagccgccacgccaaaaaccaaatcccgccgcgcccgaaaatttccggtgggttccttgccgcgaatcgatcgatttcgagcgattcgcggttgattaggccggctttgccgccaatccttgtgatccctcggcggggtagagcgcggtcgaccgtcgaccatgtcgaggtgcttcccctacccgccgccggggtacgtgcgaaacccagtggccgtggccgtggccgaggcggagtcgaccgctaaggtttgttgaaccatcggatttacacacgcacgtgccggatcgtttgttcttcctgttggttttgctcggatctgtgtgttgtgcgtgtgtgatgtgggtatcgcacgtgccgggaaagctaacccttgcggcggagggaagtacctgaatcctgtgtagctttgccagaaggtctttcagatcgattgaaaatttaagttgggatggccgctagtcgagattggttgggtccgatttgcgaatattggttgcatggttatcgaaagaatgctagaacaacaaattcgattcaacactgttggatttacacatttaatcgccaaaagtgatcgtggcccccagccgccttcctgcccgatcgtccggtctaaatcagaactgacgattgctctggtggctgaagctccagaaagaaagggaaaaggccgaaaagaagaaagagaaaaggagtgacaagaaagctccccagaagggtgagacgtctaaacattcaaagcacagccataagaagagaaagcttgaagatgtcatcaaagttgggcaggatcccaaaagggaatccaaagaatcagttgagcagttggagaagagtggactctcagaagagcatggagctccttgttttgtacagacgatccgcgactctcctgagagttcacaggacagcagcaagaggcgaaaggttgtcctgcccagtcctagccaagctaagaatgggaacatccttcgcatcaagattaaaagtaatcaagattcccaatcagctctttcggagaaaccaatggttcctgagcagccattggtccgacaaatggg

SEQ ID NO: 12834 - DNA, 1007 bp, Sorghum bicolor
  unsure (1)..(1007): unsure at all n locations
  Clone ID: SORBI-28MAY03-CLUS4618_1
gctttcttaggctttagtttatagagctcatgcggtggggggggggggggntacatggattcatcatagaggggacgagggagctccaaagcaactgagcttgattcaaagagtaggcatagctgtcaacatagctgatgcattggattatttacatcacgactgcggaaggcccactgtccactgtgacttgaagcccagcaatatccttctaaatgatgatatgaatgctctcctgggagatttcggcattgcacgtctctatgctgatcctcagtcaatgtgggcaggttcgattagttcaatcggtgtgaagggtacaattggctatatccctccagagtacgggggaggtggccatgtgtcaacgtctggtgatgcttacagttttggtgtagtgttattggagattttgactgccaaaaggccaacagatcctatgttcacggatggactagacatcatcagcttcgtggagaacagttttccggatcaaatatctcacgttatcgatgcccatcttgcggaagaatgcaagaatttaactcaagaaaagaaagtgacagaaaatgagatttacgagtgcttggtggctgtgctgcaagtagcactgtcttgcacgcgctcattaccatctgaacggttgaacatgaaacaggtagcaagcaaattgcatgcaatcaatacgtcatatcttgggtcgaaatacaaatagctaggatgaggctactccgcctcgatcagaagtgtgaactgtacaacgtaactagaacaagtattctagcgttccctgttggttttgatcgactacaatagaataaaactagccgtcatgtgctttgtaacatttttctataagggaccatttggatctcttcttttggaggaattgaaatctacataatggattaccctatattgagatttggcttctaagattcacatattgtgtatatctggttttgtccttaaaatcgggtattacatgtggagaatatatggctttg

SEQ ID NO: 12835 - DNA, 1141 bp, Sorghum bicolor
  Clone ID: SORBI-28MAY03-CLUS46220_1
gcacgaggcactccccgcgcgctcaaagccccctcctcactccggttacacgctctccgcccctgcttcccttccgcgcttgccttccgcccgccccgccccgtctccacgcgttccccgcgcggtcggctccctttccgggccccggacgctcttcctccgctgctaggacccgggggcgaccggcacgtaccccggctcaaccatcttcgcagaccaaaaggacgtgagggtgccgggtagggttctgtgcggattgcccagtctggtgtgtcgcgtttttctccccctcatcccctgcgacatggaaacttgacaatcaaaagcttaggctttggctgactatgaaacagaggccattgccctgtaactccttggttaaactccgtgcctcagccaaagcatcctcaacatatgaggtctagtgatactcctttgccacagcatacagcaacgaatggcaggagtactgggtatggtatctcaccaaatcattcatatgacgcacactctcaagcaccatcaagtgggttaccgaatagaggactaagcaacggtacgtatgaatatagtagacgtgtatttggttctgtcctgaatgatgttagccgtcaagctaccagggaagctattccatatccgtcctactagcatgttgggctcccgtcctactagcatgttgggctctggtgactgtgactcaatatgctgacagaaaaggtctttgaagatgttgtctgttgtctcagccacctgtaaggttatctctgtactcaccatttcatgcctgtaaatatgggttatggtggtaggacatatgggttgttctgttctttgcattgtagtgagacttttcgctgatggttaggtccctctcattccctagtgtgaaggccatgcctccactattggctgcactaggaattaccatgcctagttacatgaatgggtggcaatatgctcgcaattgtgttttaacattaagtgccattagctgttttaatgttatagcagggtgtgtttgtgtttgagatattagtatttggtggattgtgcctttcgtcctgatctgggacatctgaaggagaaacatcgttttaaaagaaaattgtgaaatcagtcccacaatttatgatgtttg

SEQ ID NO: 12836 - DNA, 1210 bp, Sorghum bicolor
  Clone ID: SORBI-28MAY03-CLUS46705_1
acccctgaccgtgagaggggggcgacgcgggtatttaaccgggacggcgggccgaggattgcgaggctctcgcggcagcagcaactgcagtgggcggcgcctacccccgcgcgcctccgtttccgtctcccgctcctcccccgcgccccgcgctccgccaggtcattgtagagctgcttcttcctccaggcttgtgcggttctcgtacagtgccaccaccatgggagatgagacctcgacctccattgctccccaggagcaggaatccaccgtgcgggctgggagtgtcaagcaacagctctccaggcttgtcctttcatccctccgggctaccgtgcctgatgtggaggtagaacccatggttgaagtttcagccaagtttgctgactaccagtgcaacaatgctatgggattatggtcaaaggttaaaggatctggaactagtttcaaaaaccctaatgccattgggcaggccattgctaagaacttgccttcttctgatattattgaatccacatctgttgctggacctggttttgtgaacattaccttatcaaaccgctgggttgcacagagaatacaagacatgcttgttaatggtatcaagacttgggcaccaactctgccggtaaacagggcgggcattgtcctttctgcacctaatattgcagaggaaacgctcggggccctctgatggtctacaatgcttccaggcacatgtgcgcccatgttccagagtttaaagcaagggctcaacaaggagttgttcggctacagggaggggaggaaaaatatcgagaagcatggaaaaagatttgtgacattagcaggagcgaatttgacttggtctacaagcgcctaaatgtggtgcttgaagaaaagggggagagtttctataatccttatattcctcaagtgctggaggaattgaataacaaaggcttgatcaaggagagtgagggtgcccgagttatatttattcaaggtcatcaaatccctttgatagtggttaagagtgatggtggcttcaactatgcctcaacagacttaactgctctttggtatcggctcaatgttgagaaggcagaatggatcatatatgtgacagatgttggtcagcagcagcactttgacatgtttttcagtgctgcaaagatggccggttggctcccagatccaagtgaaaagaagtttccaaaaacaagccatg

SEQ ID NO: 12837 - DNA, 1164 bp, Sorghum bicolor
  Clone ID: SORBI-28MAY03-CLUS46723_1
gcacgcacgagcggcagctgggagagcttgggagaccactgcccggcagccgcgaggaactcactcctgcaagatagcttcatatacagccatagccggagtacgtatatgtagctacgcaacctcagttcaggcgagctagctagccacaacgccgaccaggcgagaacgaagagaagcatcgatcgattgggtcacaagctcccagcaacttttaatccaaatccatggacaaccagccgctgccctactccaccggccagccccctgcccccggaggaaccccagtagtgccgggcgtgcccggcgcagccggccctccgccggtgccgcaccaccacctgctccagcagcagcaggcccagctgcaggcgttctgggcgtaccagcgccaggaggcggagcgcgcgtcggcgtcggacttcaagaaccaccagctgccgctggcccggatcaagaagatcatgaaggccgacgaggacgtgcgcatgatctccgccgaggcgcccgtgctgttcgccaaggcctgcgagctcttcatcctcgagctcaccatccggtcctggctgcacgccgaggagaacaagcgccgcaccctgcagcggaacgacgtcgccgcggccatcgcgcgcaccgacgtcttcgacttcctcgtcgacatcgtgccccgcgaggaggccaaggaggagcccggcagcgccctcggcttcgcggcgtccgggaccggcgtcgtcgggggtggcgccccgggcggggcgccggccgccgggatgccgtactactatccgccgatggggcagccggcgccgatgatgccggcctggcatgttccggcctgggacccggcctggcagcaaggggcagccgatgtcgatcacagcggcagcttcagcgaggaaggacaagcagggtttgctgcaggccatggcggccccgctagcttccctcctgcgcctccgagctccgagtgatcgccatgatgtgtacgtcacgcactcacgctgtgtgtatacactctactatagcaaacatggtaatggagctgcatacagaacgaataaggcgtgacgcgtgtcagacagtgagagtacgtagtaatttgtacatgcacgtgatgtgccaattaatcaaagattaacatgcagttaattaattaattaaatt

SEQ ID NO: 12838 - DNA, 1563 bp, Sorghum bicolor
  Clone ID: SORBI-28MAY03-CLUS38650_1
aactttaatttccactcctattcttccccggcgccggggaccaccgccagcgccacccgctcgtcctccagcgtcaccccggcacccgctcgtcctccggcggcggcggagatggcgaggcacgaggcgtcggcgtccgcggccgcggctgtgccgggcgtggacttccaccttccggacgagatcctggccgtgatccccaccgacccgtacgagcagctggacgtggccccgaggatcacctccatggccatcgcgtcccgcgtctcccgcctcgaggctgacgccacgcgcctccgccgtgacctcgccgaccgcgaccgcgccgaggccgagctccgcgcccgcctcgccgactccgacgcgcgcctggctgccgctctcgacgagaacgcgaagctggccaaggaaagggactcgctcgccgcgacgaccaaaaagctagccagaaatttggcaaagttgcacgcggttaagaaacaattgatgaaatcgttgagtgaagataatctattgcaactgtctgaaaccagtcaagatcacaacggagaagataatttgacagctcgagtcccgtcttggaaagatgaagtttcaagcagtaacacttcttcagatacctccagcagatccacaatgactgaatccgtccatggtggaggatacaagttctcaatcacatcatatatgcctccaaaattaactcctggttcaacacctatgatttcgtcctctagtggttctccccgagcttattcaactggcccaccctctcccaagttcttatctggtcctacttctcctacaaaaactcgatccgagagccaattgacattttcatcatggcaaggatcatcaagtcatcagtattcagcacctacctctcctcctcaacgccattcgttcacagggcggccacgtatagatgggaaggaattcttccgacaagcacggacaagactttcttacgaacaatttggagcatttttggccaatatcaaggagttcaatgctcagaaacaatcacgagaggacaccctgtcaaaagcagaagagatttttggagcagaacacaaagacttgtacatttctttccagaatatgcttaatcgcaaccaatcatgagaatttgtcagaagcagtattttttgttatctctaaatgaagcagggaagaatctgttggaataaacgatgccctttcataggttctcaagatcacattgtagagatctgtatagtccaccttaatttgaggtgttcattcccaataatttggagcagtgacttaaaaggaaaaatctcataactaccggaaatttggccaaactcattccctgacattcaagtcttcctacttctgttgtaaaaaaaaaagggtctccctgcttgtgttctgctgtaaattcgaatgcaaatgtcttgagcgttgaggtgccttccccagttccttttgtagaaagctgtataaaactgttctttgcagttctaactgccaagtgtatgcggaatggatatgataacggaaaaattgttctgtaattctgtactgagatattcgatg

SEQ ID NO: 12839 - DNA, 1152 bp, Sorghum bicolor
  Clone ID: SORBI-28MAY03-CLUS3839_1
gcacgaggacgagctacatctttggtggttgacagtggtggtgggtctactgtggtttctgctgtgcatgatggttttgttttgcaaaagtctgtggctacttctccagttggcggtgaatttttaactgactgtatgatgaaaagcttggagagcaagggcatcgttattaggcccagatattcatttaagaagaaggaaaccagtcccggagaatataagattgtagatcttgatcttccaaacacaactgagagttacaggttgtactgcatgagagctattgctagtgacgtcaaggagtctgtttgcagagttccagacactgcttttgatgaagtggcatatgcaaatgttcctacgacttcatatgagcttcctgatggacaaactattgaagttggcgctgatagattcaaggttcctgatattctatttaatccatctctatcccagactattcctggaattgatggatttgcagattcaacaccagtccgtggccttcaacgaatggtcattgacagcataaataagtgtgacgttgacatacgaaaggagctatttagcaatatcttgctttctggtggttcatcatcaattctgcagttaaaggagcgcctagagaaagaagtattagaggagtctccgcaagctgctcgtgttaaagtcatggcaagtggaaactcagtagagagacgattcagtgtttggattggagggagcattcttgcatcccttgggtcgttccagcaaatgtggttctccaaagcagagtatgaagagcatggggtttcctatattcaaaggaagtgtccttgaagcaggggaatatgtacaaccaataatatgctttaggagcctttgttgccaaagggttctttgtgtacaacagcttgatgccttgccatgttggccaatgaagactcgagactctttttaagtgacattaattgttgtcatgactagttagttttaggtgatgtaagggttactaagaactgggccagctaaatatttatcattaatggtagattcatacgctgaatcttattctccctgctgtacaatgagatgagacccttgttctgtaccggggctaactgttccctattgccagcacttaagagccaagatgattgtggtaacttg

SEQ ID NO: 12840 - DNA, 537 bp, Sorghum bicolor
  unsure (1)..(537): unsure at all n locations
  Clone ID: LIB3476-024-P1-K1-H12
cccatcttttccactgctcttgtataatcttctgttccttttttctttggcatgttctgtttatgggattcttaactatctgatatttgagcagaactattgaagttggcgctgatagattcaaggttcctgatattctatttaatccatctctatcccaggtgagtagcgaggaaaggggtctgtagtacttactggtttgaattaggttgtaatcacctaacttgttctagtgctgtgttttttactgcactggtttttgtaatggatccatgttattgtgcagaaaaaaccctagtgcattgctttcttgtttagtgtatgttaacagtggtttagataattgtttgaactcagcagacttgctttctttcaccttatatcccggccttcattctcacanaatttctgaccaacagactattcctggaattgatggatttgcagattcaacaccagtccgtggccttcaacgaatggtcattgacagcataaaatagtgtgacgttgacatacgaaaggagctatntagcaata

SEQ ID NO: 12841 - DNA, 1234 bp, Sorghum bicolor
  Clone ID: SORBI-28MAY03-CLUS3809_1
gcacgaggaagccttctgctccaggcaggagcggtgtaatgagtgacacattggatctgaattattgcatccggcctcggtgaagcagatgaggacgtccttcttatgatgctaactgatgtgcactgtgcttaggggggtgttctaggagcaataaacgtagagaccgctttgctgacacatctcccgcacttgcttccgatccgcctcccctgcgagttcggcccgggggtgtcgggatgggtccctgccgcgtggcggatttgcacgggtccgagctctccgcgctcaggccggctgccctcggtggaggccctcgtcccgttcctgtctctttggtcaagctcaaaaccagaacaggcagtcagactctgcagcttcattatataaggatgatcacgtcccacctagccggaagctgttgaaaagggcaaaccacagcaagagctgatctttggagcttcacgccaagagcaagattcttctatgctcatagaaaagttgtctttcacctggccctggcctgagcaggggccgtgagttgcgcgctcgtcctcccccctcctgccccgcaagagttgggtctggcagggtggctgcacctgtggatgtgtctggctttatgctaactaatgatgactatgatccaggaaatggtctagttcttccggtctgtgatcctgtacgacatcaccacagatactgcctttgggtcaatgcaaatgtcgctgccgcatgttgtattagtactggttcgagcacagctctttcaggctggcagctcacggtagatgccatcgagactttgcagtctcttggtcaagctcaaaaccagaacatgcagtcagactctgcagcttcattatataaggatgatcacgtcccacctagccggaagctgttgaaaagggcaaaccacagcaagagctgatctttggagcttcacgccaagagcaagattcttctatgctcatagaaaagttgtcttctccaggccctaacctgagcaggggcaatggtttgcggttttgtgaacccaccatcttgccaaactgtgtagggaatgtcaggttgattgtacctatatatatgttatgctatatttcgtctcctaaagtctgtaacatgtaacttcccattttgttgatggtttgtgctactgaataatataggcacagacaacacattgttaatcagtacaacgatgaatttcatatcttgagttggttgttgg

SEQ ID NO: 12842 - DNA, 557 bp, Sorghum bicolor
  unsure (1)..(557): unsure at all n locations
  Clone ID: LIB3481-029-P1-K1-A3
cgtcacgcagagaagatgagtcgtgagaatagcgcacatccttctctttcttgcaacgcaagagttgattctggcattgatgcatcaaaagaggaagtgactggtataatgctaactaatgatgactatgatccaggaaatggtctaggagcaataaacgtagaaaatgattatgaaacagatcttccagactttgatccaataaggcaccacaacaattactgcccttgggtgaatggaaatgtcgctgctgcatgttgtattagtactggttcgagcacagctctttcaggctggcagctcacggtagatgccatcgagactttgcagtctcttggtcaagctcaaaaccagaacatgcagtcagactctgcagcttcattatataaggatgatcacgtcccacctagccggaagctgttgaaaagggcaaaccacagcaagagctgatctttggagcttcacgcccaagagcaagattctnctatgctcatagaaaagttgtcttctccaggccctaacctgagcaggggcaatggtttgcggttttgtgaacc

SEQ ID NO: 12843 - DNA, 748 bp, Sorghum bicolor
  Clone ID: SORBI-28MAY03-CLUS38956_1
ctactggaagatcccccggaccccggccggtgtgcgtcctctttaaaaccaagacaagaccctccccttcctctgcactgccacaccacgcaccacacccattatcaattcatccaccgttcacctctctctttctactagagtctctagactgcaacaagaagacggtttcgtcgagaaggaaaccaaagttcaaagtgacaaccgaccatcgtcaatggagatggcggttaatgcgagagacgaggagaagaagtacgacggggacgacaaccatctcgggcttgggctaagcctcagcctcggcatcgccaccaccgcggctactccggtcgaggtcgacccgccgccgcggcagcagcagcagcagcgagctatcagcgtcgcgcccatctcctccctccccgcgccgcagtggtggaacggacccgccggtctcttcttctccccctcctccgggatgaagatggatccatctctggagaggaagcatcagcatcagcagcagcagcagcagcaggcggcggccacgagctacagccacgatatgccgttcctgcgtgggatcgacgtgaaccggcgggccaccgccggagagacccggaggggccgcagctgcagcgaggacgaggagcccggcgcgtcgtcgccgaacagcacgctctccagcctcagcgggaagcgcgccgcgccggcgaggagcagcggagaagtggatcgagaggccgacggccacaccccgagagcc

SEQ ID NO: 12844 - DNA, 854 bp, Sorghum bicolor
  Clone ID: SORBI-28MAY03-CLUS40332_1
tacgaccgcgcgttcgtgcccctggcgcggcggctcacgcgcctgtcgtcgggcatcaccatgctgcagcggatcggcacggggctcgtcctggccctggtcgccatggtcgtggcggcgctggtggagatgcggcggctcggcgtggcgagggacgccgggctcgtggaccagcccaaggcggcgctgccgatgagcctgtggtggatggtgccgcagtacgtgctgttcgggctctcggacgtgttcgccatgatcggcctgcaggagttcttctacgaccaggtccccgacgcgctgcgcagcctcgggctggcactcttcctcagcatcttcggcgtgggccacttgttcagcagcttcatcatctccgccatcgacggagccaccaagaagagcggggcgagctggttctccaacaacctcaaccgcgcgcacctcgactacttctactggctgctcgccggcctctgcgccgtggagttggccgcgttcgtcatcgtctcgcgcgtttacgtgtataagaagagggtgtctcacgacaataatgatgctgtcatgtagatcagtagacgtactctatgcttagtgcttacggtgctgcgaatggtgatacctgatatatatgattgaggtaatgaggtgtaaacgttcggtacgctaaaccttggtatgatactatacttgcacagtactaataaatagtgtcggtagcacccgtaatagcgtctgctatagtggtagcggtcctctatgctctattgcgctacaaaagatacaaaacttagcggacgctatagcacctagaattcgctgtgttttttttttaagttcaacgggggaattgctcccca

SEQ ID NO: 12845 - DNA, 2060 bp, Sorghum bicolor
  Clone ID: SORBI-28MAY03-CLUS40512_1
gcacgagggcgcagcggagctgcacaaagccgacgccatccagtcctacgactacgaggctccccccccccccgcccttttctccgcctcgcggccccttccctgcccgccgtccgccctcccccgctgccactcgccgcgtggcccccccctctccccggccgccgcggcaactgtttcttgcggcgtcggcttccgccgctcacgggcctgtagtcaatttgtcagtttattgagatatccaacttgcatgagctgatcaagaattccatccctggttcctgatggaggcatcatcttccttgtgctcccaagtttctggttttagtttgcccaagatatggctatgcctttttctggtacttgttcttcagaactgcagcccagcactttcagattcaccatatttggtgggtatggggagctatgacataacaggaccagcagcagatgttaacatgatgggatatgcaaattctgagcagatcgcatcaggaattcactttaggctaaaggctcgtgcgtttatcgttgctgagcctaatggcaagcgtgttgtgtttgtaaatcttgatgcttgcatggcatcacagattgttacaataaaggtgcttgaaaggctcaaaggaaggtatggagatctttataatgagaataatgtggctatcagtggaatccatacacatgctggtcctggtggttatctgcagtatgtagtttatattgtcacagcacgagggtttgttcgtcaatcatttgatgtgattgtcaatggaattgagcaatgcattgttgaggctcacaacaatctccatcctgggaaaatctatgtgaacaaaggtgacatccttgatgctggtgtgaatcgcagcccaagtgcatacctaaataaccctgctgaagagagaggcaagtataagtataatgttgatacagaaatgaccctcgtcaagtttgtagatgacgaatctggtccggttgggagtttcaattggtttgcaactcatggaacatctatgagtcgtacaaattctttgataagtggtgataacaaaggagcagctgcacgtttcatggaagattgggcagaacaaaatggcattccaaaacaggcagctcctgtaaatcatgatggtccggaatctttacacatggcctctggacttccgagaagagtctcttcaataattcctgaaccaaatgagataactgatgacttagtacaattggcgtcatcctacgaagcctcaggtggccgacgattatctggttcaagtatcaccaggcgcattagaagcgctcaacaaaacagacctaaatttgtttctgcattctgccagtcaaattgtggtgatgtcagtccaaatgtcctgggaactttctgtatagacactggccttccttgtgacttcaatcacagcacatgcaatgggaagaatgaactatgctatggacgaggaccaggatatcctgatgaatttgaaagtacccgtatcattggcaataggcagtttcaaaaggcgctcgagctttttaattcagcttctgaagaaatacaaggcaaagttgagtttaggcatacttacctagatttctcgcaacttgaagtgaatattcctacaagtacaggaggtcagcaagttgtgtaaaacatgcccagcagccatggggtttgcctttgccgctggaaccacagatggtcctggagcttttgacttcaaacaaggagatgccaagggaaatgctttctggaggttagtaagagacttacttaaggaaccagggaaggagcaagttaaatgtcaagcaccaaaacctatcttgctagatactggtgaaatgaaggaaccatatgattgggcacctgcgattcttccaattcagatcataagaattggccagctggttatcttgtgtgtccctggagaattcacaacaatggctggcaggaggctacgtgatgctgtcaaaactgtacttgcaagtgacaacagtggtgaatttaataatattcatgttgttcttgcggggctaacaaatacctattctcagtatattac

SEQ ID NO: 12846 - DNA, 664 bp, Sorghum bicolor
  Clone ID: SORBI-28MAY03-CLUS41749_1
agtgacgccttccagcacggtcaccgccaccgccaccgcccgagccccgaagcctaggccctcctgatctccaccaagcaatggaagccgccggagccacctcatcccgcctggcccgctccgcctcactctccgccgctcgcccccaccaccgctcccgcgtcgccaggttcccgccgtccccgcagctgacctcgctctcggccgccgcggcgtcgccgcgcgccctcccgctccgccggaccaggtccgacgccgagctcgcctacgtcgcgagatccgccgccgtcgtcgtcctccgccacgccccgatccccgccatcctcgaggcggacgaggaagagcgcgacagcaaggcaccggcgggcgtcgacggcgccggcaggaacggcggcggcagcggaggcggcggcggtggcggcggcggccaagatccagccggcggctcggtcgtagccatgtacgaacgccgcgtgcggccggccgttccgcgtgacccgcggctaccccagcttactgaacgatccatgcagtatggcgagcgggagtcactcggcactgtaccattccggccttttcttctggctgcatgtttttcttggttcgatcgagctcaataaatcacaaaagtactcctagactagatgtttgtaactttgtactt

SEQ ID NO: 12847 - DNA, 852 bp, Sorghum bicolor
  Clone ID: SORBI-28MAY03-CLUS52219_1
gcacgaggctccaaggacctcatggccgtcgccggcgaggcgctcaagaccaacatcacgacgctggggcccctggcgctgcccatgtcggagcagatcctgttcctggcctccctcgtggcgcgcaaggtgttcggcgtccgtggcctccggccgtacatcccggacttcaagatggcgttcgagcacttctgcatccacgccggcgggagggcggtgctcgacaccatcgagaagaacctcgagctcagcccctggcacatggagccgtcgaggatgacgctctaccggtgggggaacacgtcgagcagctcgctctggtacgagctcgcatacacggaggcgcagggccgggtccggcgaggtcaccgcgcgtggcagatcgcgttcgggtccgggttcaagtgtaatagcgctgtgtggcgggcgctgaggacgattgatccgaagaaggagagcgccgtcgggaacccatgggtggaggagatccataggttccccgtcgaggtgcccaaggtggagagcgtcatcgtgtcctgaggatgaagacgactgtggttctctggtcggaggacgacgaactacaagattgctgctactactacgactgcagtagttctctctttttttccagttcttcttcgttctgaaaattctttgttaaatatataagtattatgtcgacaaaagtgtctgctgatggagtgtgatgatacagggaagctctgtaattgtaaaaataccttacatacaacaagtgtgatgattggatgagatgtactgtagtctgtagctcacatgtgattttttttgacagaacctgacatgtgattttgagcttcgaaatgatcc

SEQ ID NO: 12848 - DNA, 828 bp, Sorghum bicolor
  Clone ID: SORBI-28MAY03-CLUS5053_1
ctctccgtgtaccacaacgtgcacccgccgtccccgtcgctctactacgtgaacgtgacggggctcagcgtggggcgggccctggtgaaggcccccgcggggtcgttcgcgttcgcccactcctccggcgccgcgtgggtgatcgactcggggacggtgatcacgcgctggacggcgcccgtgtacgcggcgctgcgcgacgagttccggcggcaggtggcggcgccgagcgggtacacgtcgctgggcgcgttcgacacctgcttcaacacggacgaggtggcggcgggcggcgcgccgcccgtgacgctgcacatgggcggcggcgtggacctgacgctgcccatggagaacacgctcatccacagcagcgccacgccgctggcgtgcctggccatggccgaggcgccgcagaacgtgaactccgtcgtcaacgtggtggccaacctgcagcagcagaacgtccgggtcgtcgtcgacgtcgccggctcgcgcgtcgggttcgcgagggagccctgcaactgagcccgaatccgtccgtgctcccattccacgcacggcgggatgacggcactgccgcatcgatcggtgtgcttgtcctgtcctgctgttaagcttttgctcctttccaatgttgtctgcaataacggacgtgacacggagaaaaaaattgtttcgtcacggactcacgggtagctagtgagaatcacgtaaaagtgcctgccagagtgtgtattctgtattactttcgttgatgttctgtaaaatgtctgttggcctgtttcgagaggttaatttggaggtaacgaagacttcaaattcgtactg

SEQ ID NO: 12849 - DNA, 630 bp, Sorghum bicolor
  Clone ID: SORBI-28MAY03-CLUS5011_2
caacttgacatcctactgtgagtcatcggcgattcagcgagcagcacacctgaccaaccgaactctgtagccaccaagaaccgaggaggagcaggagaaggacggacatggcggcagcagcgaaggcgtcgtggatggtggcgatgagtgtgggcgccgtggaggcgctcaaggaccaggcggggctctgccgctggaactacgcgctgcggtccatccaccaggccgccaaggccaacgctcccagcttcgcacaggccaagaagaagctggcgccggcggagaggaggcgggcggacaaggccgaggaggggatgaggaccgtcatgtacctcagctgctggggccctaattagttattgggcatagttgcttaggtcctctagctcttttccagctttcagtaacccagatcggtcctctggttgtaaaaatatgaccacgatgatgatgatgaaaagttctgtttcttcattctgagtgcggcgttagagtcaagtacgacctgctgcagatagctttatggaccaataatactgcgcgttcacgcggctgaacctggtccactatgctgaaatccttgcgtggatacaagcgcgtgctcaatgcacatgatgccctgcgctaccg

SEQ ID NO: 12850 - DNA, 867 bp, Sorghum bicolor
  Clone ID: SORBI-28MAY03-CLUS5011_1
gcacgaggctcagatcgcatcgagaatcaatcaccaagctagctcgacaagccaggcgccgagagctcgagaagacgaccaggagactgatggcggctgcagcgaaggcgtcgtggatggtggcgatgagcgtgggcgccgtggaggcgctcaaggaccaggcggggctctgtcgctggaactacgcgctgcggtccgtccaccgggccgccaaggccaacgctcccagcttcgcgcaggccaagaagaagctggcgccgccggcgaggcgccgggcggacagggccgaggaggggatgacggccgtcatggacctcagctgcgggggcccccactaggcatcccttcagtttcggccttctgcagcgatgatgctgatgagcatggggatgatgaaaagttctgccccttgatttccgtgcctgggactctgggtccctaggctactgtggtggcatggaaataaagaatgcgtttgtcttcataataagtatatgaatgtgggcctctgcgtccggaactcgaaaagggcatctttgctctctcccttctttactggtactcggtggtgtttcatgcctccatgtgctgaaacagaacaatcggtgatggcaaacgtggaatggcaatctcaggttgtgggatgtactcttccatgacaacagtttaggagcatctcttagaggacaaaaatgatacagcaagactcttttttcagctcagtttcggttcatcagaggtcaatttagaggcccctctgcatcaaaattttgcagtccacgttgctcaaccgtgatcatcgtcgaagagtaaactaatcaggtctaccgaggttcagggacaaactgtgcttatgcaaagtgggta

SEQ ID NO: 12851 - DNA, 517 bp, Sorghum bicolor
  unsure (1)..(517): unsure at all n locations
  Clone ID: LIB3476-054-P1-K1-F12
caacgacacagcatcacgattcttgcacacaacacagtacaagtctacagcgatcagcgagcgatcctctgattctgaagccaaacaagctaatctccaagaaagaggaggacatggcgggcgcagcgaaggcgtcgtggatggtggcgatgagcgtgggcgccgtggaggcgctcaaggaccaggcggggctctgccgctggaactacgcgctgcggtccatccaccaggccgccaaggccaacgctcccagcttcgcgcaggccaagaagctggcgccggcgccggcggagaggaggcgggcggacaaggccgcggagggagggttgaggacggtcatgtacctcagctgctggggccctaattagtcgtcataggtcttagcctcttaggtcctcttgctctngttccagctttgggtttcagcagatgagcgagcttggcggccgattcgtcctcctgactgtaaataataaagagcaaatgatgatggtggaaaagtctgcagtcatccaag

SEQ ID NO: 12852 - DNA, 786 bp, Sorghum bicolor
  Clone ID: SORBI-28MAY03-CLUS52884_1
ccactttccaggatgctgattgaagattctggtagctccaaagatttgaagaatcttttcacttcaacatcggaccaaccatttttggcccctcccaacaacttggtgtcagtgaagcattcagggactgtaacaataaaggctagttttaaggaagatattgtaaggttccgtttcccatgctcaggtggtgttattgtattgaaagaggaggtagcgaaaaggctaaggatggatgttggtacgttcgatatcaagtatctcgatgatgaccatgagtgggtaaagttggcgtgcaacgcagacttggaagaatgcatggagatctcgcggctttctggtagccatgtcatcaggctactggttagcgatattgcagcacactttggcagttcttgtggaagctctggttgatatgcgtgtcagccttttgctctgatcaatgggtactcgaaagtggttgtaccatgagttcagttccacttgtagttttgttgctagttagcactagctgcttcattgtattttataaatgtatcattgtatttgccccccaaaaaaatacatgtaattgtgcagaatgcacttgtagtcaactttgtatatatattatgtgctggaaattctgtttcaagttataaactggatttgttgttgttgtctagaatttgcacagacagtattgggttaggatgattatattgtttggaaatgtagcagattttcgtaggtcataagtccatgctgtaaacacatttgttgattctatttatatctttggaatcc

SEQ ID NO: 12853 - DNA, 797 bp, Sorghum bicolor
  Clone ID: SORBI-28MAY03-CLUS4287_1
ctaggaaaagtcagggagcaagcagtgatacaggaagcaaccgtccgcggaccagtgggcgaaggcgtgggttctgaagcagatgctgcagctcggattaaagaagctgctgaaaaattgcacactgttgagaaagaaaaggaggagcttctagctctggtcagtgttctccaatcacaagtccagagagagcagagcagcacaaagcaagtatgtgaggagaggtctgaatcatgttcaggcgctgacaattcgcctcccttaacaaagcatgttgatgcatcggatgatgatgtggacaaagcctgcgtaagtgactctagatcagtgttggtttcgagcgatagcactgaggtccagctggctgtggatggggtggacatccgtcctgttggcgatgctgagtggggtggcttccagcagtcagaagctctgatcgctgatgttcgcgaggtctccccagaggcagatggtggcagcttggatattcccgtggtcaaccccccaccagtcagtgatcatattcagggaggcgcaacccatccctgaaggcctgatgaggttgctgctggcctgccgctaccttccgagattcatgtgattgttgagaaaccgatatagggatgtctaaatctggagagaattgccgttgagggtgtattgcatcaatgcggattgtatgtcctttgtatttaagtatacgactgaataaacagatagtagctgtgtttggctgtgggattgtaaattattcgcctcgttccctttacttggaacttaaaaaaaaaaaaaaaaaa

SEQ ID NO: 12854 - DNA, 1521 bp, Sorghum bicolor
  Clone ID: SORBI-28MAY03-CLUS42773_1
gcacgccgctaatatctccacctgattgacctcacgggtggtagttctcttcttccaaaattccctcacacctaggtccaatagcggcgcccggtggccagccacttcgaatcgcctcaagacaccgaagcggtggatatgcaaatcgtcccacgatctattcttggggtcggcagagttggctccgatctgcttcgcttgtgccggtgctggtgtcctccagggtttgcgagacgagatgctccagtcatggcgtcagtatcagctcatctaaatctggatcgtccttcacatatggatcgtctttctagctctgttcatgcctcctttcgtttgtcttcccaacctgtttcgttaattcgttatagtcacgctgaatttttggatctagattccatctgttatataaggtttttgaaagagaaaggaaatctctttgacctctttactccaagcgaagctcacccacctagggggaaaaaaagaactgatattattgtattagagttgctacgggttgaaaattatagaaactattttcaatcttggttaccattttaatacagacgggttattactttggtatttgaccctttttgttattttgtgcggggccgctgtccaaacctccgagccgcatcccccctgcacaattatatggatacatagcagcacgggatgagagggatggcatgcttaactatgttgtaagttatagcagggatgatcccatcgtcgtgcaccagggtgatctcattgaaatgactggccccaaaagatgtatctcaatggattccattgttctaatagagtttgacatgaggattaagaatgaagcgctggaggatgatgatcagcaactgattgatggagccatatcatgttcatgctacaattatatagcatggaaaccagtagtaaatcgcattactggcagttctggagctgtcgacgtatctttagctgttgttgagcatgcggtggaagctacaatagaagttgttatatcacaagtactgagtggtttaaatttatctttaagttcttttgttgatgttatggatgtctacgaagaaatcaagctttttaatggcaagattggtcagtcagggtctctcagaaggtttgttgtttctgtttcacatggtactacgatgctcttgatgttcaagttaggtaacaatgtgcaaggcagtctacatggatgtgccaatcgacagatgaagtttcaagctaagctacatggacatgccagtcaacagataaagcttaaattcgctactatttcggtgaaggtgacttggtccactattgtggactatgtgtcatcaattagtattgtttaactgcgttaatcttgtgctagactagatggatctgtacgtgtttttttttgtttttttttgaaaggctgcacttctatgcctattatatgtatactagcaaaattgctcgtgtgttacagcgggttagttaaaagcatattattcaagatttaggtctaaaagaaatgattgttta

SEQ ID NO: 12855 - DNA, 1092 bp, Sorghum bicolor
  Clone ID: SORBI-28MAY03-CLUS4372_1
gcacgaggctccgctgtccccggtcgcaggatccgctcttcggcccgccgaccaccccactctccccgccggcgccgcggcggcgccgaggcagcgagcgccggtgccgctctccccggctccgcggcggcctcgcccgctcgcccccccccagcggccccggcgcctcgcgccgttgcccccctcctccgcccgccgcccggcgggccgcctggccttagaccatcgaactggagacagagaatcgtctcgcttctttgctaattgaagaggcccggagattgcagttggaggctgacagggaaggtgttcatgcatatcttcgaaaacctaatgttaggcatcgtccaaactcacggttcctcacagccacggttcgtggagttcagcaagcaaaccgtgttgtggaggtcaatgaaatgtggcgtgccagggaaaaggaactggagttagagtcaaaggtgaaaagcagaagtaacgatcgtgatgattttagaggtgagaagcgcaaaagtgaattgagaaaccatagctccagctcaagggtcgaacaagaagggaccacttataataatccttactcagaccaggaggatggtctcagggatgatgagattgaaagatttcttcattcaagggcaaagcgaggacgtggggctgttggttctaggatggacgagcctggtccataccttgattctttgtctcgtcatcaggacaacggacctagtcctgacatacgtgtggaagaaaaatgggaacgccgagtacaaggtccagagaagccgtcatttttgaggtccaagtctactgatggtcattggcataaggatactttggatggaagggcatcaagctctgaaccactgtgtaaaaaggaaaagaaaaagaagtcagagaaaaaagagaagagagagaaaaagaaggaaaaggataagaagaaatccaaacaccgccgccaccaccatcacagaagcaccagaagtgaatgagtgatgttgcctgttagcagaacagaaaaatgtacacaaggggtctgccctgagacaagctagctgactgttgcggtaacttgaaaccctgtatgtagaa

SEQ ID NO: 12856 - DNA, 1234 bp, Sorghum bicolor
  Clone ID: SORBI-28MAY03-CLUS44167_1
gcacgaggctccgctcctccccctcaggctctcacccccgtctggtggtggttgccgcggcgccgctcctcgctcgtggtggcggtggaggacttaaggtcagggatcgacggtttcttcatccgttccgttgttgggaggcgatacatttaaccagacgaaatgtcagttggcaggcaatcatactggtgttaccaatgccgacagagggtgaggcctcgtggccgggagatggtgtgcccctactgtgattctgggtttgtggccgaaatggatgatgtagatgctctcatgagccacttcgttgggatggatcctgacttccaccgtgacccaaggttcgggatcatggaggcgatctccgccgtgatgcggcatggtatgtcagggatgaacagggaggttgatgtcagaggaaggccaaacatcttttcagacctggagatggagtttggttcagggccatggctgctcttccgtggtcagctccctggtcatctcacggaggacaacggattcgatgttttcatcaatggacgacgcggtgttggcatgaggagggccaacattgcagactactttgttgggcctggattggatgatcttatcgagcaattgactcagaatgatcgtcgaggaccaccacctgctgcgcagtcctcaatcgatgctatgcccacagttaagatcactcagaggcatctcagtggggactcacactgccctgtctgcaaggagaagttcgagttgggatccgaagcaagagagatgccatgcaagcatttataccactccgattgcatagttccttggttagagcagcataattcctgtcccgtttgccgttatgagctcccaacacagggttctactacgggagctagctgctcgcacacaagatcaaccaaccaaagccagagctcaagtagttcaagcagcagcgggagaaccagtgggcgtcaaaggagaaggaacccgttctcgttcctgtggcctttccgctcatcaagttctcgctagattagtctctggtaatctttctcaggtttgaaatactgttttagtcaatacgctggtctaatgggctttaagtgtgtgggatcttagtactcaatctgtactgtatggtttgttaatgatcgccacataatgtttctccttgcaagtatattatttttaccacggtaccatcatagctactcgattttgtttacttgtgagcctgcaaacaatt

SEQ ID NO: 12857 - DNA, 1033 bp, Sorghum bicolor
  Clone ID: SORBI-28MAY03-CLUS4429_1
gcacgaggataggatcaatcctcgcgtcgcgtgctctcgtctcgccttcgcgcagccccagctccgtccaccaccatccgccaccgtcctcactctcgatccacgccgcagctaccccgggaggaaacagatcggagaaggtgatcggttgtgatggcccgcttgtacgtcggcaacctggatccccgggtgaccgctcgggagctggaggacgagttccgcacgttcggggttcttcgcagtgtttgggtggctcggaaaccacctggctttgcatttattgattttgatgataagagggatgctgaggatgcaatccgtgacctagatggcaagaatggatggagagttgagctatctcgtaatgccagcagtggtcgtggtggccgtgaccgatatggtggttctgagtccaagtgttacgagtgtggtgagactggccactttgctcgtgagtgccgtttgaggattggttctggaggtctaggcagtggaaggcgccgaagccgtagccgcagccgcagccgcagtcgtagtcccagatatcgccggagtccaagttatggtagaaggagttacagtcctgcagcacgctctccaaggcgtcgtagcgtgtcaccagctcgtgggcgcagctatagcaggtcaccacagtacaaacgtgcacgagaagactctccctatgataatggataccgccgcagcaggagctagagccagatccttgtatctgatgagtgtcatgtgacatattgggaaagctatatgatcaataacctgcttgaaagatcgttcgccgactgcttgactttggttaaggttctcataacttttttatataccttattatgcttgtgtctactttataagtagtagtaaaacctcttgatgggtgtgtttgttgaactaagacctactgtcttttcttgtgtggtaaaaaggcatcgtcctgccctgcttaaacgactcggccgactacggctttcagttctgtcttcatggttttggtctgcgctcttcattcttcacacac

SEQ ID NO: 12858 - DNA, 1662 bp, Sorghum bicolor
  Clone ID: SORBI-28MAY03-CLUS4444_1
ctgttggcctacgaactctcaagcggccgcacccccggcccgccctccgccttcgtccccgccgcgcctccgacccccaaccagcctctcgccgctcgatggcggcgccgtatcaccagccgacaagcctggaggaggtccgcacgctgtggatcggcgacctccagtactggaccgacgagaactacctctacagctgcttcgcccacaccggggaggtacgcgccgtccttagacctcgccccccaggaccgtgccttccgcgccgttttgggtgttgtgtctccgtggcgccggttgctgcccggcctattcccctgactgtcagcggcgcgctggtcccggggtctgatcgcgcggtcgggttgctgcgggccgcgtgcagccccgcggggtggcgccccgatccagctcccggtcgctccatgggccgaggggacttggcacctgacctcacagattacttactacaggagacattccgagtgaactatccatctgttagacgggctaaggttgtcacagatccaaatactgggagatctaaaggatatggatttgtaaagttcgcagatgaaaatgaaaagaaccgtgcaatgacagaaatgaatggtgtgtactgttcaacaagacctatgcggataagtgcagcaatacctaagaaatccactggctctcagcttcagtattcagctgctaaagcggtgtatccagcaacagcttatgcaatgcctcagctccaggcagttctccctgacagtgatcctacaaacactacaatatttattgggaacttggacccaaatgtgacagaagatgagctgaggcagatatgtgtacaatttggagagcttatatatgtgaaaattcctgttggcaaaggatgtggatttgtacagtatgcatctagggcctcagctgaagaggcagtacaacgtcttcatggcacaatgattggccaacaagctgttcggctttcatggggccgaagtcctgcgagtaaacaggacccatcagctgtgtggagtcagcaagcagatccaaatcagtgggcaaacacttactatggctatggatatgatgcatatggatatgctcaggatccgtcatacgcgtatggtgcctatgcaggatatagccaatatccccaacagattgagggaggcacgagggccacttctgttgctggtagccatccgggcatggaacaaaaagaggagccatatgatccaatgaacatacctgatgtcgacaagctgaatgcttcatacatggctgttcatggtagagccatgctagggcggtcattgtggttgaagaccaacccgctgccccaaccaacataagcacacagccaacattgcctaatttccccccaaagactgcggtgctggtgggtgcagctgggtttcgttgcagatgattttgcccttcccactgggcacattatggcaattgatcatcaaactctgaaattgctgtaggctgaccaacagcttcgtctatgttgacaacatcccatgtatgataggcatgacccttttatgtttcttaggctgctgcttaatattatcgtatctggacaatattgtgggaacggtgaaagtcatctgtctatctagtcgccttttccaattgataattctgctgttcaaaaaaaaa

SEQ ID NO: 12859 - DNA, 771 bp, Sorghum bicolor
  Clone ID: SORBI-28MAY03-CLUS556_1
gtggtgctacagagctgactgtatcagcgacactgaagcaaaagagttcttcagttgaaggcgtggaaaagtggccctatgaagctgctgctctagcatttgaggcaattccaaggactttggcccaaaattgtggtttgaatgttattaggataatgacacaacttcagggaaagcatgctaatggtgaaaatgcgtgggttggcattgatggaaggagtggtgatattgttgatatgaaagagcgaaagatctgggattcctacagcgttaaagcgcagacgttcaagacagcaattgaggccgcttgcatgcttttgagaatcgatgacattgttagcggtatcaagaagaagcaggcccctggagcctcagctccaaagcaaccccaaattgaaactgagggcgatgctgacaatgagcagatgatcccagagtagaggctgtgatgaacctgcactgtcaaagttatttactagtaccagaatagcacgcagagcagagttatttgtttgagtgttggtggttagccttaacttaaagatgtacctagttttctatagtttgatgagtggtccgagggttttgggatccaggttttgaagtgttgttgctgctcattttgctttggactgatggacgacagacaagcagtgaaactagtctttatggctaactacctttgcctgttgtatgccgcaaatctactttgtacttggtaatgctgtcgtttctcaagttcggcggatttagttatatggctggaaatgt

SEQ ID NO: 12860 - DNA, 1379 bp, Sorghum bicolor
  Clone ID: SORBI-28MAY03-CLUS56395_1
cagtgatcgatctcctctgccgccgcatccgatctcgatccccccgacgcggtgtcctccggtcagcgccgccgcctcctcccctcgccggccgctgctgtatcgccgcagccgccatgaattatatcattggagcattcaagccaccatgtgacatctccatcacattctctgatgcgaggaccaggaagcaggtttcagttaagaaggacaatgggaaaacaacaatggtccctgttttccagagcctggaaactatttctggagaagtatcaatagcaccagtcccaggtaaaaggattgaacacacaggtgtcaagattgagttgctcggccaaatagagctgtattttgaccgagggaacttctatgatttcacttcgttagtacgtgaattagatattcctggtgaaatctatgaaaggaagacgtttccatttgagttttcaactgttgaaatgccatacgagtcttacaatgggacaaatgtcagactgaggtacattttgaaggtgacaattggcagaaactatgttgggaatattgtcgagtaccgggatttctgtgtgagaaactactcacctgtccctacaatcaataacagcattaagatggaagtaggaattgaggattgcttacacattgagtttgaatacagcaaaagcaagtaccatctcaatgatgtgattattgggaagatatattttcttcttgtcagaataaagataaaaaatatggagctggagattcggcgtcgggaatcgacaggatcaggatctaacacatatgttgaaactgagactcttgcaaagtttgagttgatggatggtgctcctgtgagaggtgaatctattccagtgaggctgttcctgacaccttatgagttgaccccgacttaccgcaacataaacaacaagttcagcgtcaagtattacctgaatctggtccttgtggacgaggaagatcggaggtacttcaagcagcaagagatcacaatgtaccgcctcctggaatctcccccggcctcctagatcccaacctgtagcagcatgttcacctctcaggttttgtacaagttggcgctgaggttagagcgatgtcctgtatataaactccagaagagcgccacagctgactgctgctatggccatgcacgccgcactgtcgtgttaatttgtttatgctttcgttttcctttctactccttcacttgattagaacgggggtagaattacctgcgtgttcatttatcgcccttgtggtctgcaagaatcatgatgatattatttcggcattagttcatcttagctggatcctggaagttactatgtaatttgttttggtaagttgaacaatatagaattatctgttttccattc

SEQ ID NO: 12861 - DNA, 861 bp, Sorghum bicolor
  Clone ID: SORBI-28MAY03-CLUS56348_1
gcgccagggcccggccgcgtccggcggcggctccggccccaccggcgcgctcagcgccctcgcccgcgccccgcgctccctcgccgcccggacggcccggtccggcggcagcgccgtcgcgtccggcctcccgccgccgcccggcgcgcccgggggcctcgcccgcggcgcggcaagccgttcgggtttcgtcaagacgccgatgctcaggagcacccagatcccgacgtactacggcgtgctccttgaggccatcagggtgggaggtcagcagctcaacatacccacctcggtcttctcggccgggtcggtcatggactccgggacagtcatcacgaggctgccgccgacggcctactcggcgctgtcgtcggcgttcaaggccgggatgaagaagtacccgccggcacagccaagcggcatcctggacacttgctttgacttcagcggccagtccagcgtcagcataccgagcgtcgcactagtcttctccgggggcgccgtggtcaacctcgacttcaacgggatcatgctggagctggacaactggtgcctcgccttcgcggccaacagcgacgacagctccttgggcttcatcggcaacgtgcagcagcggacgttcgaggtgttgtacgacgtcggcggtggtgctgtggggttcagggcaggggcttgctgatcggcgcgcgggcgcccagccacccacatgaaagtgtgaggccaaaccatctcctattttacttcgattttgttattttgtcgattggaagtgtgcaaactaccaaccaaagataattgtaaatttctcccatagtttatgaatataaacaataataataattggttgcgtgggcgtcgtaa

SEQ ID NO: 12862 - DNA, 974 bp, Sorghum bicolor
  unsure (1)..(974): unsure at all n locations
  Clone ID: SORBI-28MAY03-CLUS5733_1
attgaagagttcatgagagtgaccacctgtgcatactttatccaaggctatggtttaacagaaacactgggacctagtaccgtctgctacattgatgacatggccctggttggaagtgctggtgtacctgccacctacactgaaatacgactggaagaagtacccgagatggggtatgatccacttggtgtcccttcacgtggtgaaatctgcattcacgggaaatctctcttcgctgggtactacaaaagtccagaactcacaaatgaagcaatagttgacggatggtttcatacaggtgacattggagagatgaccccagacggaatcctgaaggtgattgaccgaaaaaagaacatatttaagttgtcacaaggggagtatgttgcagttgagtacctggagaaagtgtatggcttccctccacttgttgaagatatctgggtatatggggacagtttcagatcaagtttagttgcagtagtcaatccacacgaagaaaacacaatgaagtgggcacactccaatggctataagggttcgtttgctgaaatctgcaaacttgaaggacttaaagagtacatcctgaaagagctggcagctgttgcacagaagaacaagctacgaggttttgagtacatcaaaggcatagtgttggatcctgtaccttttgacattgaaagggatttggtgactgcaacaatgaagaagagaagaaagaatatgcagaactattaccagtctgagattgacatagtatacaaaaagctggaggcacagaagaatgctgccaaatctaagtgaagagatgtaccctatttgatcataagctgaaaagaagaaaacatcgttgtaaattccgcatttaatgttgagaagcaactactcagggctatatgtaagcaataaaatgtatattgcccatttgctttgtctatagtaatcagatgattctcaaatctcaactagaggnn

SEQ ID NO: 12863 - DNA, 1164 bp, Sorghum bicolor
  Clone ID: SORBI-28MAY03-CLUS5719_1
gcacgaggccagcctccccaaaaaccctaaccctagccagcacccgcaccggggagatggacggcggcggcacgcaccccccgccggaagacgtgttccgggacttccgcgcgcggcgggctggcatgatcaaagcgctcaccaccgacgtggagaagttctaccagcagtgtgacccagagaaagagaatctgtgtttgtatggtcttcccaatgaaacatgggaagtgaacttgcctgcagaggaggttcctcctgaacttccagagccagctctgggaattaattttgctcgtgacgggatggatgagaaagattggctgtcactagtagcggtgcacagtgatgcttggttgctggctgtggccttttactttggtgcaagatttggatttgacaaagaatccaggaagcggctttttgtcatgattaataacctccctaccatatatgaagttgtcacgggaactgccaagaagcaaaccaaggagaaaactcccaaaagcagcagcaagagcaataaatctggctcaaaaccaccacgccagccagaacccaactcaaggggttccaagatgccacctccaaaggatgaggatgatagcggaggcgaggaagaggaggaagaggaagatcatgaaaacacattgtgtggtgcttgtggtgacaactacggacaggatgagttctggatatgctgtgatgcctgtgagacttggttccatggcaagtgtgtcaagatcactcctgccaaggccgagcacatcaagcactacaagtgtccgaactgcagtggtagtagcaagagagcgcgggtgtgatcctgctggatatatccatctctcatgcctgaagaaccaagaatttgacttgctgtaaaacgggtcgaatgcccgatggttatgcatttagttgttgctttcagtttaggaccagctgtagggtcttgatgtgctgtttgttgtatgtcagagacattctagatctattgttagtaactaggaactaactgtagtagcctgtatttcttcaagcttctcccagtgcgcctgtactggactgagaaactgttttagatctaagttgtgcattatgtacgaccgtctactcatgttagtttgttaaaaagttgtgtgctggcattctctgcgtgcatactcattg

SEQ ID NO: 12864 - DNA, 793 bp, Sorghum bicolor
  unsure (1)..(793): unsure at all n locations
  Clone ID: SORBI-28MAY03-CLUS44191_1
gcacgagggtcgtcgtcatggtctgcaccttcgtgtcctccttcgcctggtcgtggggccccctggggtggctcatccccagcgagacgttcccgctggagacgaggtcggcggggcagagcgtcaccgtctgcgtcaacctgctcttcaccttcgtcatcgcgcaggccttcctctccatgctctgccacctcaagtacgccatcttcgtcttcttctccgcctgggtcctcgtcatgtcgttcttcgtcctcttcttcctgccggagaccaagaacgtgcccatcgaggagatgaccgaaagggtgtggaagcagcactggttctggaagcgctacatggacgacgacaaccaccacatcgtcaacggcaagatcaccgccaacaatggcgcctccgtttaactgctccatctgatggtccgttgatgcatcagacttcagacttgagtagagtatatccgaccgccgacagcgtactacagtactactgctgctgaaggaatttatgagcacagtgttcacttatataagatgcaaaaaggcaactggtagtacttcaactgcaatggctatgccttgttgtacaggagccgagtgtttcaaccagagcccgtgctcctctttggtttgtatctttcaactttcaagcagagtttacacggattgtaatctcatccatcctagaaccttgtactaagcggatcttgtgaattgtaacggtgccatgccccactccccaagtgacctatatttttcagtgcagctaanaaaaaaaaaaaaaaaaaaaaaaa

SEQ ID NO: 12865 - DNA, 791 bp, Sorghum bicolor
  Clone ID: SORBI-28MAY03-CLUS44193_1
gcacgaggcggccttcttcctccgagttcgagctcgctcgcatacatcccgcgtcgtcggtcctccgttcaccttctctcccaacatcttgagctcgatcgcaagcccttagtttagttccattccatccccagctgaccgtcagggtacatatatggcgaagcacccgagagactccggcgccggcgccgtgccgctctccctcgcgctgtccctcggcggcggcggcgtggccgccgagcacggcagcaacaagaggcaccggcgcgcggcggcgggcggcggggacggcggcggcgagttcgtctgcaagacgtgcagccgcgccttcgggtcgttccaggcgctgggcgggcaccggaccagccacctgcggggccgccacggcctcgcgctcgggatgcccgcgccggcgaaggacgacgccaaggagaccaccacgaagcagccagcggcggcgtccgcgagccacctgtgccacgtctgcgggctcagcttcgagatgggccaggcgctcggcggccacatgcggcgccaccgcgaggaggccgccgccgccaccaccgcgcaggcgccgcccgtcctcctccagctcttcgtgtagagttttatttgcccgtacacggagaggccattcatcgggggatttctagtttgcagtagaggaattctttgcgtttcagtcgtccgtctgcacattgtagattcacagtacaattgttggcatatttgccaattgattgattgattgattgattcattcattcatttagttacacatgtaaatacaa

SEQ ID NO: 12866 - DNA, 875 bp, Sorghum bicolor
  Clone ID: SORBI-28MAY03-CLUS45320_1
gcgcgacgggggcgaagccggcggcggcccaagctcccctggtggaacactcctccctgctgccggtcgtcgtgccttctcccgcccccgcgccggtggctccacaggtcacgggcgagctgaggcgggctcatcagagaaccaaactgatgctcagaaagaaaacatccactcagatgtctctcagacagatgaatgcactaagactcagaaagtccctccagtaggcacacagggagaaaattctgctgaagattctgatgtgcaggtgtctgagatggacaaatgcaatgagatgccgaaggaagctccagcacatgcaacaggagcaaatcctgctgaagacgaagcttccctgaaagaagacatcactgtgcagacagacaacaagccttctgcctccccagctcctgaagatccaaaggtcagtgacaaggagaagctggcagaagaaaaccagaagctgaaagagcttcttcaaaagcttctcgcatccggcaatgatcagatgggggtcatcacagacctaagtgagaaggttaaggcgctcgagcggaagctggcacgcaagaagaggccaaaggtgagggtgcacaggccgtccgggcatgtgactgccaaagtccactgaaaggaaggataatcttaaggtttgaggttatgttgtatggatcccatgttacttcttgtgtccatgttgtatttgcatgtacagccatgttatggcactatgctttgttttggacaacacaaggtgtggcatgttctgtattttgtgtttgtgtataatgcatccgacttgatctagtgttttgtgggcaattgattggaacaaatgttaaagggtcagtatacaaatctacatatcaggtttt

SEQ ID NO: 12867 - DNA, 793 bp, Sorghum bicolor
  Clone ID: SORBI-28MAY03-CLUS4571_1
gccggcgcggccgggaaacttagccgcgccgacgcccaccagcacctgcccccctcgccgtcgccgcctcgcctcgcgcgaccgatccaccgccgcggccaccatgtcgctgatcgccggtgaggacttccagcatatcctgcgtctgctgaacactaacgtggatgggaagcagaagatcatgttcgccatgacctccatcaagggtgtggggcgccgcttctccaacatcgtctgcaagaaggccgacatcgacatgaacaagagggccggcgagctgactcctgaagagctggagcggctgatgacggtcgtggccaaccccaggcagttcaaggtgccggactggttcctcaacaggaagaaggactacaaggacggcaggttctcgcaggtcgtctccaacgccctcgacatgaagctcagggacgaccttgagaggctcaagaagatcaggaaccaccgtggtctgcgtcactactggggcctccgtgtccgtggccagcacactaagactactggcaggcgtggaaagactgttggtgtctccaagaagcgataagctagcagcggcttatggcaacagcagcagtgaacaagccttaccttccaacatatcttatgaaaggtttctgtttagacagtttcctgaaattatgttttgccctaggataatcttgcagttatggaaccttaatatattgtatcctgcaatgtgttttttccaacttctaagagtaattttattttgaatgagacttctgctgaaaaaaaaaaaaaaaaaaggccccta

SEQ ID NO: 12868 - DNA, 2454 bp, Sorghum bicolor
  unsure (1)..(2454): unsure at all n locations
  Clone ID: SORBI-28MAY03-CLUS45757_1
ggcacgaggagaaaaggttaagcctcttggcgaaggcacagaaccgtctggccaagctggatgaactccgacaagctgctaagaatgatgtggaaatgcggtttgagaaggaaagggaagaacttgagaccagagttgagtctcgtgtccgacaggcagaggagaaccgcatgcgccttctgcatgccgatatgcagaagcgggctgcactgaaggagaggacagcgaggtccctggtgcagaaggcaacatcagagagcaaatacatggagcaggtgcggtctgcaagctcgcggaagagagctgctgctgagaagaagcgactgaggttgctggaagctgaaaagacaaaggctcaggctaggcttttgcgcatccaaaaggctgccatgactgtatgcagccagagagaatcggagaggagaaaactgaaagaacagctggataacaaacttcaaagggcgaagaggcagagggctgagtatttgaagcagagaggaagtcctcgtggttcaacccacgctgattacataaagcatgcagatgccctctcaagaaaactagcaagaaactggagaatatttgtgaagtccaggaagacaacatttgctttggttcaagcttatgatgccnttggggattaantgagaagtcntgtgaaaagtnatgccttttgaaaaattagccatgtcaatgggaatctcctatggttcttcagagcacaaaggcattacttgaccgattggagaaacgccttgtcatttctcagtcagtagcatcttcatcagtagagaatgttgatcatctactgaaacgccttggttctcccccaaggaggaaggctcctcttagcagagaaggaaaaactcgggccgcggggaaaagatcagctaaaagttctgaagcaaacagcagattgcccaggtactcactgagggtcgtgctctgcgcttacatgatactggctcatcccagtgctgttttaagtgggcaaggcgagcgggagagacaacttatcgagtcagcagcaaactttatcaaggagttcgaactgttgattaagacaatacttgatggaccagggcagtcatctgatgttactggccagaggaagttcagaattcagttggctaattttgacaaggcgtggtgcacgtatctttaccgctttgtggtgtggaaggtaaaagatgcaagattattggaggaagatcttgtcagggctgcatgcaagcttgagctgtcaatgatgcaaacatgccacctggctgcagatgggcactcgccaaacaatcttactcatgacatgaaggcaattcagaaacaggttactgatgatcagaagcttttacgtgagaaggttcagcacctgagtggtgatgctggccttgagaggatggactctgctcttttggatacgagatcaaagttctttgaagcaaaagagaatgggagtccattggcagcacctgttgcaaatgtatctacccctttgagcattaattcatctgtgaaggtcccactttctgaggttaatgaaagttccaggacaaatgctgttggaacaagctctgttgtacgttctctatttggtgcttcatcatcagtcggttcatcaccagcaaagcagccgacagagaatgaacaaatggtcaatgagatgcttcatgaggatgccagtgcttttgctggcaggtctgatagtgctagtactgtggaggaggagttccagaagaaagtgagagaaaccatggagaaagctttctgggatatggtcaccaactccatgagaggagaaagacctgattatagtcaattgatcaacctagtaaaggaagtgagagattcgttgcatgacctggctccaaaagaatggaaggagaaaattcttgagaacattgaccttgaaattctgtctcaggtacttgggtcaggttcccaggatgcacaatacctggggcagattttgcagtattctctggatatggttcgccagctctctgctgctgcaaaggaggatgagatgaagaaaaatcatgataaattattgagtgagttgtctacaaattctgaagttaatgacaatggcatcaactcatttgccattgctgttatcaagggcctgcgtttcatcctggaagaaataaaggaactgcaagcagaagtgagtaaagcacgtgtccagatgatgcaacagatcataaaagaatcggctggggtggagtacctgcagaaggctttcgctgatcgctatggaccccctgagaatgcatcagcttctcttcccctaactctgcaatggattatgacatcaaataacattgtggaagtagaatggagtgaacattcagactgtctttcaataatgcaatcagcaggacaggctcctgctcttgttccggtacttcgagctggtcatggaactctagtagggcaaccatcttcttctgcagc

SEQ ID NO: 12869 - DNA, 957 bp, Sorghum bicolor
  Clone ID: SORBI-28MAY03-CLUS45829_1
aaaaaaccaaagcctccgaagccgacgagccccagcgcgagggagagagaagagagagagagagccagcgacgaaacggtttgccactgcacgccccgtgaagcgtgcccacctccgcctccgcctccgcctccgcggaaggacgacgacgcagtcacgcaactgacagtcaccgacgcgacgcgggtcgtctcctccgccctccagtccagccttcctcgcccacgatggcttcgggcgccgacgccgcggcggcgctggggatctccggcgacggcgagtgggcggcggcgtgcccgccgctgcggcggaacctacagctgctcgcgcccgacgaggttgagctagcaaaaatgctgttgaatgagggccagattcacctgtttgaacactggcctgaaccaggcgtcgatgatgacaagaaaagaggcttctttgatcaggttcgccgacttaattcaagctatcctggaggtctgctatcttacatccagaatgccaaaaaacttcttgcagattcaaaggcaggcaaaaatccatatgatggtttcaccccttctgtgccttcaggggaggttttgaactttggtgatgacaattttgtttcactggaagcagctgggataaaagaagcccgcaatgctgcttttgttcttgtagccggagggcttggtgaaaggcttggttacaaaggaattaaggtagcacttccccgggaaacaactactggaaaatgtttccttcaacattatatagagtctatcctggctttacaagaggccagctgcaaaatggttgatgatgggtgccaaacaaagattccatttgtcattatgacttctgatgatacaaatgcactaactatcaagcttttggagtcgaactcttacttatggaatggaaccatctcaagtgaaattactaaagcaggaaaaagtagcatgtctagctgacaat

SEQ ID NO: 12870 - DNA, 1965 bp, Sorghum bicolor
  Clone ID: SORBI-28MAY03-CLUS4590_1
aggaccagtatgcaattagagaggtagtgcgcgggcgtggctgcacgaacgcgtgacacaaattgggcaaaatctttttccccttcctgggctcccgccgtcgccaactccacttgtcggatcttgcccgtatggtatggagctcgccggagctgcgtcccctcgcccgccgccggaatcccacgtggcgacgccccgcccacctccgcagccgccggaaaaggatgtatgtgaagatagagaggacatgagggtcaccggggagaagccatgcacacatcaggaattagatgttgaccagacaaatagttcttctagctttaacaattccagtgagtgtgagaatctggcacccagcaatgacgaaatatccggatcagagtccaatttggagatagccaagacggagggtgatgtaccgagtggagagaaggttctgaagaagccagacaaaatcctgccatgccctcgttgcaatagcatggatacaaagttctgttactataacaactacaacattaagcaaccaaggcatttttgcaagagttgtcagaggtactggactgcaggtggaagcatgagaaatatccctgtcggtgcaggaaggcgcaagagcaagagctccagtgcgaattgccgcagcatattgattccaggcagcagtgtagctactcctgggggagaggcttccctttttccattgtccataaatggaaatcaagcggcagttagcttcgggcctgattcccctctctgcaactctatggcctctgtgctgaagattggaggagagcagattaagagttcgaaccctgcctcagcagcacagcccagaaatggagaaaaccagatgtgcccaccttgtactacatcatcagatggtccaaggaatgaatcacaaaaggaaacagcgaatgcacatcaaaatggaatcattgggcaaagcaatggagtcacttctgtgcatcctataccattctttcctggtccgccttttgtgtacccatggagtccagcatggaatggcattcccaccatggcagcagctgtgtgcccagctccagccgaagcagcaaattcttcagaaaattgcaccacaagcagtaatgttcaatggaatgtgccaccaattgtccctgtactgccaccgggattctgcggtccgattccagttcctgtaatgccgccttcggtttggccattcattactccttggcctaacggagcatggaacgcaccatggcttggacctagctctactgtgccatcatcgtctccaacaagcagcagcacatgttccgaaagcggctctcctgtcctaggaaagcactctagggactccaaacctcaaggagatgagaaggcagaaagatgcttatggatccccaaaacgcttcggattgatgaccctgtcgaagctgcaaagagctcaatctggaccactcttgggatcgagcctggtgatcgaggcatgttcagaccattccagtcgaaacctgaaaggcaggaacagatatccggcgccgctcgagccctgcaagcaaatccagcagctctgtcacgctcgcgatcttttcaggagacaacatgatagagtattactgaacttgtgtgatattattcaaagacgatgctatattaagaaaaaagaaaagctctatattctgtacaatgattggcaacgtaggtgctgctgctgtccaaggcagcaggcacccttactgtaccattggaagagtacatcctcaaattttctgttgtttccttgtagagcatgcaccaacatattgggttcatgatcaggtttccagcgtgtgcttggttgtacaagaataattgttaatagcttcccttgagtcattgtattacgctgatcattcagctatggcatacccctgtttactacacgctgttcaccctccctgacgagaggattcagtctgaagaaatgattagcagttatgc

SEQ ID NO: 12871 - DNA, 1393 bp, Sorghum bicolor
  Clone ID: SORBI-28MAY03-CLUS58962_1
ctggattaccatcgaaagcgaatttcgagcatgcattcgcggtttttgtatctgcagattttagttcaggttccagtgctgacagacttcgcctgatccgaattcacctgttgccatccttagtcccacctgcagatagcgctagcagcaatatcagccgccgccgctaggcaaggagtggaagccgcggcagcagccatggctgcgttcccggtcctcccagcacctgcctgcacttccttctctccttcgtccgtattcctcaccccctgttcctcggatggccggagcacagcgccaagggcggcggcggttcgcggatcggcggtgacgtgggcccaccggacgctctccgctaggtgggtcccatccggtctggcggtggcgaggccggctgccaggaaggcgcgcctagaggagcttgatacatccaacatgctccttcgccagcgcatcgtcttcctcggttcctcggtggatgatacaagtgctgatctcattatcagccagctcctactattggatgcagaagaccagactaaggatattaaattgtttatcaactcacctggaggttctataacagcaggaatgggagtatatgatgctatgaaattttgcaaagctgatgtctcaactgtttgctttggattggcggcttcaatgggtgcatttttacttgctgctgggacaaagggtaagaggtactgcatgccaaatgcaaggattatgatccatcagccatcaggtggtgctggcgggaaagtcacggagatgggactacagataagagagatgatgtacgagaagattaagatcaataaaataatgtcgagaattactggaaaatctaaagagcagattgatgaagacacaaagtttgattatttcatgagtccttgggaagccaaggattatgggatagttgacagtatcatagatgaggggaaaccagggttggtagctcccttggcaggatctgttcggcctccaaaatcgcgtgtgtggtacttgtggaaggcttcgggcccgaccaggaagatcatgaaacatctaccttcagaggagaaactaattaacaatggtaacggaacagcaactggagatgatgagaagctcaagagggcatcggcaacctgaagaccttctaggtcataatagttcgataatagaaatggcttagtgcactacctgtattctaaatcattgtttaaatacagactatgggaggatgttaatccagtgcagtgtgttggtttctgcgttccttcatgggtgcatttcttgttcttgcgatggaccattagtccatagcccaaggatttgcccagcataccgatgattcctgttgtacatgtgggaacgacgacggttagaaagtggtcttataaaa

SEQ ID NO: 12872 - DNA, 821 bp, Sorghum bicolor
  Clone ID: SORBI-28MAY03-CLUS6089_1
ggtatctctgcccaccttttcgccgtcttccagggtctcctcaaggtgcttgccggtatcgacaccaacttcactgtcacctcaaaggcctcagatgaagacggtgactttgcggagctgtacatgttcaagtggacaacgcttctgatcccaccaacgaccattctgatcatcaacctggttggtgttgttgctggtatctcctacgcgatcaacagcggttaccaatcatggggcccgctctttggcaagctcttcttcgccttctgggtgattgtgcacttgtacccattcctcaaaggtctcatgggtcggcaaaaccgcaccccgaccatcgtggttgtctgggcaatcctgttggcatcaatcttctccttgctgtgggttcgcatagacccgttcaccacccgtgtcactggcccagatactcaaacatgtggcatcaactgctaggaaagtggaaggtttgtagaaacagagaaataccacgacccgtgtttttgagaatacggatgtgccactgccaccaattgtctgttaagttataagcaggtggcgtcatttacagctacgtacagaccaggggatattgtttatcacaaagttacttgtgttgatatgcattcttttgttgatataagttatactactttgtggagagtgtctgacagacgagttttgtaatgttatgaagaacaaagaaataagttagtttgcatttttttcaatttctaaatgttctcgtctccgggcagtatttaattcgtgcattttagattgaacattctttatttacataatcggtctggtgttcaagattc

SEQ ID NO: 12873 - DNA, 1122 bp, Sorghum bicolor
  Clone ID: SORBI-28MAY03-CLUS60643_1
gcacgaggcaacaacggttttttcagcaccccccgcttgtttacatcctctgcatctgtcgctacaacaccacagacacaaccatcaagatggctgagcagcagactcctaccttcaagctcgtgcttgtcggtgacggtggtaccggaaagaccaccttcgtcaagcgtcacttgactggtgaatttgagaagaagtacatggccaccctcggtgtcgaggttcaccctcttggcttcaccaccaacttcggtcagattcagttcgatgtctgggataccgccggtcaagagaagtttggcggtctccgtgatggttactacatcaacggccagtgcggtatcatcatgttcgatgttacctcccgcattacctacaagaacgtccccaactggcaccgtgatctcgtccgagtttgcgagaacatcaccatcgttctctgcggtaacaaggccgcgggcacggggccattgttctctgcggtaacaaggttgatgtgaaggagcgcaaggtcaaggccaagaccattaccttccatcgcaagaagaacctccagtactacgacatctccgcccgcccgcacgcctgccgggagccccccttcctttggctcgcacgcaagcttgtcggcaaccccgctttggaattcgttgccgcgccggccctggctccccctaccgctcaggtcgacgagaagctcctcgagcagtaccgcaaggagatggacgacgctgctcagatgcctctgcccggtgaactttcggacgacgacttgtaaagatagaaacgtggcatggatcatggtccaaccgcggtggagtggtcgacgggacatcgtgaaccggagttctctggcgcagaccggcaattgctggtcatggccattatggtagaagacggcacggccggttcatttggtagactcggagctggatggagggttatacacttgctgctagacggccagcatactttgagttggttgagcccgtcctcctccaccactgactccttttcgcgccgtgtctccggggcctggcgtcccactctttacttgtgtgtgcaagtctcagcaggcagcgcgatgcatttagttagatagcaattcaacgatcagctggg

SEQ ID NO: 12874 - DNA, 1244 bp, Sorghum bicolor
  Clone ID: SORBI-28MAY03-CLUS6170_1
gcacgaggagagcctcggggtgagagtgaggatgatgggtggcaaggccgctctgctgctggccctggtggccgtgaccctggccgtcgtggagatccaggccgacgccggctacggctacggcgccggctacccgacgccgacgccgaagccgccggccaaggggcccaagccggagaagcccccgaccaagggccacggccacaagccggagaagccgcccaaggagcacaagccgactccgcccacctacaccccgagccccaagcccacgccgccgccggctactcccaagccgacgccgcccacctacacgccgagccctaagcccaagtcgccggtctaccctcccccgccgaaagccagtactcctccgacctacaccccgagccccaagcctccggcgaccaagccgcctacctacccgacccccaagccaccagctaccaagcctccgacacctcctgtgtacactccgagccccaaaccaccggttacaaagcctcctacacccaagccgaccccgccggtgtacacgccgaaccccaagccaccggttaccaagcctccgacacacacgccgagccccaagccgtccgacatccaagccgactccgccggtgtacacaccgagccccaagccaccgaagccgtccccgccgacgtacacgccgaccccgaagccaccggctaccaagccgcccacctcaactccgacgcaccctaagccgacgccgcacacgcctatccccaagcccacgccgccaacctacaagccggcaccgaagccgacgccgccggcgcccaccccgccgacatacacgccgccggtgtcgcacacccccagctcgccgccgccgccgccgccgccgccttactactagacgaagaagtgatgaggtctcccactctgctgtcagtctcggagcatttagaaggtgatcgatcgaagagtttgtgtcctagccagccggccaagatgagctgctgatgatgatgagaggcgaggagcgagtcgtacccctccctcctctgtggtgtgctgccggccgatccatgcatcatccccagctgcaggagaaaaaataatgcagagctctgctgctccgtctgtttcctgtcctcccgtgtgttagtttttgtgtgttcgtccatgtgttagcaggtgtatttgtgtgggtaatggtattgcaactattggtgtaaaaccataataaaatgtggaaatatatgcaaggaaaaag

SEQ ID NO: 12875 - DNA, 1205 bp, Sorghum bicolor
  Clone ID: SORBI-28MAY03-CLUS5386_1
gacttcccctcgccacgcaaaagccaccgcggccccgcccgtgcttccgtctcgcacctgccgatctactccccggcgagacgagcgccccggcgcgcccccagggaatgcggagcgatgaggcggcgctcaggcactgacgtcgccggcctgcgcaagctgcgcggcgaccgaacctgccaccgcaagcacgttgaggacgggtagacccatccatccatccatccttccttccatcttctagtcgtcatcgtcgtagggtagtttgcagatagctagctcggtcgtttctagtaagggatcgatccatcgatcgatcaggcggcatgggtgagggggaggcggcggaggtgaagggcggggtgctgcagggccgctacgagctgggccgcgtgctggggcacggcaacttcgggcgcgtccacgcggcgcgggacctgcgcacagggcgcggcgtggcggtcaaggtgctcgtcaaggacaaggtgctgcgcgcgggcatgatggagcagatcaagcgcgagatcgccgtcatgaagcgcgtgtcccaccccaacatcgtggagctccacgaggtgatggccacgcgctccaagatctacctcgcgctcgagctcgtccgcggcggggagctcttcgcgcggatcgtgcgcgccggccgggtcaaggaggacgtcgcgaggcgctacttccgccagctcatctccgccgtcgacttctgccacgcgcgcggcgtgtaccaccgcgacctcaagccggagaacctcctcatcgacgaagcggggaacctcaaggtcgtcgacttcggcctcagcgcgctcgccgaccacgcgcgcagcgatggattgctgcacacgctctgcgggacgccggggtacgtcgcgccggaggtgttccggaacaagggctacgacggcgccaaggccgacatctggtcgtgcggcgtcatcctctacgttctcctcgccgggtcgctgccgttcccggaggacaacatcgccgccatgttcaggaagatgagccgcggcgactaccggtgcccgccgtggctgtccaccgaggcgcgcaggctcatccccaagctgctcgaccccaaccccgacacccgcatcaccatcgcccagatcgtcgagacgccatggttcaacaagccatccatcgccaagcccgtcaaagcctttcgccgccggccgcggcgagccggc

SEQ ID NO: 12876 - DNA, 798 bp, Sorghum bicolor
  Clone ID: SORBI-28MAY03-CLUS5518_1
gccggccgggccgggagcgagaggagaaaccctaccccgcgcagccgcagccgcagcccgtcgccgccccgaactccggcgcgtgcccgagctccaccagccgctgccgccatgtcgctgatcgcgggggaggacttccagcacatcctgcgtctgcttaacaccaacgtggatggcaagcagaagatcatgttcgccatgacctccatcaagggtgttggccgccgcttctccaacatcgtatgcaagaaggccgacatcgacatgaacaagcgggctggtgagctgtcatcagatgagcttgagcgcctcatgactgtagttgccaaccctcgccagtttaaggtccctgactggttcctcaacaggaagaaggattacaaggatggtaggttctctcaggttgtttccaatgcccttgacatgaagctcagggatgaccttgagaggctgaagaagatcaggaaccaccgtggtctgcgtcactactggggcctgcgtgttcgtggccagcacaccaagaccaccgggaggcgtggaaagactgtcggtgtgtcaaagaagagataagctccttgaggcatattggtcttatcttgagtttcttttgtatgcagacatttgtgctttgatatgccacaggatgtttattatctgtaggatagatgagagttccgctttacaagacttctatatattgtagcaatcttttgctgcctgtgttccaagagggttgaattgaatgttctgtgaaacgggtaaaagttttatatgcttgtttttgctgtgtttgcctcg

SEQ ID NO: 12877 - DNA, 698 bp, Sorghum bicolor
  Clone ID: SORBI-28MAY03-CLUS54699_1
gcgcacacccacaagcttcaagctccctccaggcatctcccaaatccccccagccgaacaaacaaacttggacaggggcagctagcatccatccatccgccatggcgcgcgggggagacggcctgcaggtgctcagcgcgctggacgcggccaagacgcagtggtaccacttcacggccatcatcgtggccggcatgggcttcttcaccgacgcctacgacctcttctgcatctccctcgtcaccaagctgctgggccgcatctactacacggacaccagcaaggacaaccccggctcgctccctcccaacgtcgccgccgcggtcaacggcgtcgccttctgcggcacgctcgccggccagctcttcttcggctggctcggcgacaagctcggccgcaagagcgtctacgggatgacgctcatgctcatggtcatctgctccatcgcgtcgggcctctccttcggccacacccccacgggtgtcatggccacgctctgcttcttccgcttctggctcgggttcggcatcggcggcgactacccgctgtccgccaccatcatgtccgagtacgccaacaagaagacccgcggcgccttcatcgccgccgtcttcgccatgcagggcttcggcatcctcgccggtggcattgtcacgctctccaccgccgcccggaactcgtacccggcgccgtcgtac

SEQ ID NO: 12878 - DNA, 921 bp, Sorghum bicolor
  Clone ID: SORBI-28MAY03-CLUS55197_1
atatataaacccaggcgaggctctaccttaggtacgtacataccagcccgtggcaacagccctaaacttgatcatccttcttcttcttcctacttaatatatactgtatagctctagctctgcttccgatcctgtacgtacgtagtacccactacactagtacacaataagtagctaggcagcaatggcggcctcatcagtgacgacgacgatgatgagcttccggccggctgctgcttccctgctggtcctgatgttggtggtcgtcggcagcagcgaggtcgcggcgtgcggcagctgcccgacaccaccatcatctcctcctccaccgccgcccagcagcggcggcacgccgtgccctccgccgccgtccagctccggtaagtgccccaagaacgcgctgaagctgggcgtgtgcgccaacgtgctgggcctcgtcaaggtctccatcggcaaggtgcccaccgactcgtgctgcccgctgctggacgggctcgccgacctggaggccgccgtctgcctctgcaccgcgctcaaggccaacgtgctcggcatcaacctcgacgtccccgtcaagctcaccttgctccttaactactgcggcaagagcgtccccgagggcttcgtctgcgcctaattatataaaccattatatattgtcatgcattcatgtcactgtgattctatcttcttccggatgtacgtttttgtaacgcgcgcattattgttcgttatattacgttgttgcctgccttctctttttttactcttcctcacttgcattacattacatatatataattgcgtgacaatacaaattgggtgtaaaaggaagaaatgcatggtccgtcaacgtacaataagaatgtactagtttatattttcttggtaatttaaatggaacttgaaagatttgtcgga

SEQ ID NO: 12879 - DNA, 1093 bp, Sorghum bicolor
  Clone ID: SORBI-28MAY03-CLUS5442_1
gcctcttcatcgctgcagctatcccacgccgggacccccactccccgctggcacacgcgctcggctgcctgccgcaggttcttccgctgttgctgggagggcaacgccggctcgaccgccaggtcttgggaattcgcctcgcgctcacccgaggcccagcggagggacgaagaggcgagcacccgagccccggcgacggcccgccgtgcgacaggtcagcgacaaggggagtggcacgtcgcaatgagccatggtgaggtgaaacgtcatgggggcctttgaagcagcaacgtcagatgctaaaggatgcggctggtgaaatcgatgaccaccgtgaaaagatgttacttcagtcagagcaggagtgcttgtatgtttaaaggaggaaggttgacgtgtcttttagagtcaggatacatctcgccctacagatcgacatctgcaacatggagaggacaactgtcctttatgccataaaagttgcgacattgtttgcacatccgaatcagacacctgtgggcgggaacaagagtgtggcttggccttcacatatcccggtattgctgtccttccgatgctgaaggcatgggaaatcctgaaacagcagagggtaggcgagatgcgaataatgtgggaccagtaaatgatgatcgatcagcaggccgccgaacaggagaggctgttcgggtcaaagccgagccccgcgcggccccagtcgtcttcaaggaaggtggctggcgctcggatcagtggtgtcggtggtgcggccaatggcacaccagttcgccggctatcggccctccagagcggcggcaggaccgtgagccgggatggcaggagggatgccagcagacccgtggccccggtgaactacgtcgccatcgccaaggaagatgcggtctcgcaggcgtccagcaactgaattggttggtagtaactgaactgttgtggcggtgctttgtttagatacaagtataccagtgcagtgcagtgcagtagtaagagctatagtaccttttgcagtcggattggtggaatggtggcggatgtacgtactctaggtacaaacggtgctggatatggtatatcacat

SEQ ID NO: 12880 - DNA, 353 bp, Sorghum bicolor
  Clone ID: LIB3476-006-Q6-K1-C12
gtttagcttgcataggaactatgcttgttcaagcaaaaactcagtactagagattttactcaagctgcaaccaaaactccccaattattatttaaatgttttaggttgccatattaatttgttgcattttgtgtctgctctttgcataagtggtgatgacagattcccaatgcagcctgaaggttcatcattcgactcagaaaatggtgatgatagtattccaatgcagtcttttgatactgataagtgtccctatgttgagtctgattagtagaagaaatcaagattgcactattgactcatattagcaatattgtatccagaactactgatgataacaagttcagtgcaac

SEQ ID NO: 12881 - DNA, 1317 bp, Sorghum bicolor
  Clone ID: SORBI-28MAY03-CLUS5539_1
acgattcaatccacgagacgagaacaaaacctggttccgacccagcacgagacacgactcctccattccaaatccaaatccatccattccccctttgcgtgtggtgcgaggcccaccgatcccatccgatccgatccatttcgcgtcgcgtctaccagagggatcacgacacacccgccgccggagccggaagagagagagagagatggacgcgttctactcgacctcctcgtcgtcgtcgtcctcggggccgtacggcgcggcggcgtacggcggcagcggctggggctacgactcgctcaagaacttccgccagatcagccccgccgtccagacccacctcaagctcgtttacctgaccctctgcgtggcgctggcctcgtcggcgctgggcgcttacctgcacgtcgtctggaacatcggcgggatgctgaccatgctcggctgcgtcggcagtatcgcctggctcttctcggtgcccgtctacgaggagaggaagaggtacggactgctgatggcggctgccctcctggaaggggcttcggttggacccctcatcaagctggccgtggaatttgacccaagcatcctggtgacagcgtttgtgggaactgccattgcgttcgcgtgcttctcttgcgcggccgtggttgccaagcgcagggagtacctctacctgggcggactgctctcttcggggctctccatcctgctctggctgcagttcgccgcctccatctttggccactccactagcaccttcatgtttgaggtttactttgggctgcttatcttcctgggatacatggtgtacgacacgcaggagatcatcgagagggcgcaccacggcgacatggactacatcaagcacgccctcaccctcttcaccgacttcgtggctgtccttgtccgcatcctcgtcatcatgctcaagaacgcggctgacaagtcggaggacaagaagaggaagaagaggtcgtgagcggtctcacctgtgcgtaagtgcaacactgaaggaaggaaaggcacggcgggctgcctgctgctactagtagtccaatatatatgaatatgaatcgaagctcctgcatattatatataggagtaactgggtgcttgtgatggaactgaaagaaagtgtttcttcgttttcttgctctcttattagtctgttagttgtcctgtaaattgagtctggtaaggttttgttgcataaacgatatgagcgctgcaacaaattggatctgcttgccggtgttttccgccctgaaaactctgaagatggatggaatgcgattaagaatgttgcctttgcac

SEQ ID NO: 12882 - DNA, 858 bp, Sorghum bicolor
  unsure (1)..(858): unsure at all n locations
  Clone ID: SORBI-28MAY03-CLUS6846_1
gcacgagggcagccgtcgggcagggcttctcgatctccggcaagtatctccccccttcccctctcctcctgccacacctccgccaccgctagggttttattttgacaattgctgttgctggtggttgttaccagtcgtctccctcgcagccgcagtcgccgtagcagatcttctctcaaaccctaccgaccaacagctgcttgctcgggacgggaacctgagttggcgttgcgatggcgctgcagtacgtggaggcgcagcggcaggcgcgcccggacctcgccgactggtacgcctccctcgccgacctctaccagcggaagctatggcaccagctcaccctcaagctcgaccaattcctacagctccaggccgcacagaccggagacactatcattcagctctacaacaatttcatcaccgactttgagaccaagattaatctgctcaagcttgcccattttgcggtgatagcttctcgccagtaccctgataaggatgctgcaattactttcttagagggggtgatcacaaagctgcgtgagactagagagtcgcggattaatgaaccaattctctatgtgaagatgcaaattgcagctattaatcttgagaaaggaaaccaaaaggagtgcaaaaatttgttggacgatgggaaaaccactctggatagtatgactgatgtcgatcccacagttcatgctagcttttactggatatcatctcaataccacaaggcccgccaagaatttgcagagttctataagaacgctcttctctatctggcctacacaactgtggagtctctatctgagtcattcaagctagacttggnctttgatctttctctagcagcgt

SEQ ID NO: 12883 - DNA, 828 bp, Sorghum bicolor
  Clone ID: SORBI-28MAY03-CLUS6588_1
aagggaataaagatggaaaacaaacacacacagcagcaacaatatccaaaggtagcaactgatcaccagcagtctccaatagcatagcaacaccaagaagctacgccgaccatgtcgacgtccatggccaccacgcccacgacggcaagggccatggcgccagcgagaccccccgcgccgcggcaatgctgcaggtacctcgtcctcccctccactggccaccgccgcagcatcgcggcgtggtctgcgaagaagaagaacccgtggctggacccgttcgacgacgggcccgacgaggagttcgactaccagggcatgttctccggcgggaagcaggaggaggacccgcggccgcccgaggaccccgcgaacccgtacgggttccttcggttcccgcagggctacaacccagagctggacagcctcgcctccaaggtccgcggcgacgtgcggcgcgcgtgctgcgtcgtgtcgggcggcgtgtacgagaacgtgctcttcttccccgtggtgcagatgctcaaggaccggtaccccggcgtgctggtcgacgtggtggcgtcggccaggggcaagcaggtgtacgagatgtgcaagaacgtcaggtacgccaacgtctacgaccccgacgacgactggccggagcccaccgagtacacgcacatgctcggcgtcctcaagaataggtactatgatctgatcgtgtcgacgaggctggccgggctcgggcacgccctctttctcttcatgtcgtcggcgcgcgacaagtttggctacgtttcccccaacgtcaacagcgtcggcgcgggcctgtttctcgacgagatg

SEQ ID NO: 12884 - DNA, 474 bp, Sorghum bicolor
  Clone ID: LIB3476-022-P1-K1-B12
caaccaccaaggccccctccatcttccctaacactcagcactccagagagcgacgatgtgggtcatcatctggtcgcacgccagattgggcgtcgaggcacgtctctgtcgggcggcgtgtacgagaacgtgctcttcttccccgtggcgcagatgctcaaggaccggtaccccggcgtgctattcgacgtggtggcgtcggccaagggcaagcaggtgtacgagatgtgcatgaacgtcacgtacgccaatgtctacgaccccgacgacgactggccggagcccaccgagtacacgcacatgctcggcgtcctgaagggagacacggtagatctggtggtggcgcgcgtctccggccgggatatcgccatctgccatcacctgcaatcatgcaatgaaaacaagtgggggcactactctcaggctctaaggcatgattgacaaattcaagctgaccatgtgaaacgaagtttg

SEQ ID NO: 12885 - DNA, 1262 bp, Sorghum bicolor
  Clone ID: SORBI-28MAY03-CLUS69315_1
cccctgggttattcgcttgctaaattccgatcttctcctggttgtcgttgctgtccttgcgttgcgtgctgtcacgttgttgcacagctcgatcggctctctagctagctagtctctactgcgcgagtcgacgacatcgctcgccatgtcggggatctcgctggcggtggcgccgaggtcggacccggaccacgggacggagcggcagccgacggcgatgctgggcggcgtgatgggttcgctccgcgtcatcgagctccagctggtggccttcatcatggtgttctccgcgtcgggcctcgtcccgctcatcgacctcgtcttccccgtcgccaccacgatctacctcctcgccatctcccgcctcgccttcccgccgctgcactccaagctcgacgccgccgccgccgcccgctcgcccgcggcctcccaggagatcttccgcggcagcaagctgttccaggtgtacgtggtgctgggcacgacggtgggtctgttcctgccgctggcgcacgtgctgggcgggttcgcgcgcggcgacgacgcggcggtgcggtcggcgacgccgcacctgttcctgctgtcgtgccagatcctgacggagaacgtggtggggtcgctgggcgccttctcgccgccggtcagggcgctggtgccgctgctctacacggtgcgccgcgtcttcgtcatcgtcgactgggtctacgacgtgtgggcgaacagggcgctcacgcgggccgccaccgcgcaggaggccgcctgggtctggttcggcaggtacctcgccgccgccaatctggtctacttctccgccaacctcttcgtcttcctcatcccgaggttcctgccccgcgccttcgagaagtacttccgcatgcgcgacgaggtgtgcgcaaagacggccgaggacaagcacgcgcgcggacacctgtcgtcctcgtcctcgccggcgccggcggcggagcagcaggaggtcggtgcggcgaagtcggaggtgtccaagaaggcggactgagcagagctctcggctctcgcatgtcgatcgtgtgcgttggtcaaacctgtgggggctgtggcttgtaaatttctagtacctttgtttcttccatttcagaggaccggcgaatgcatgtagatgttgttaattgttatcgctctgaccatcgtgaaccatagagactgtccccatgtcttggaaactactgttcgcagatttgctatgagaatttgctacgggaaaaaaaacaacattgttgaatacc

SEQ ID NO: 12886 - DNA, 1574 bp, Sorghum bicolor
  Clone ID: SORBI-28MAY03-CLUS5765_1
gcacgaggcaagaaaagcttattattactgaggagaagctgaaggaatcacaataccagattactccttggcgtgctgattcttcaaataatacaagtgctgctgcacagtcgccttctcatactcctggaaatgcattaggttggcttgatatggcactatgattttcatcatatatttcttggaatgcgtgcatgattgtaggttctaacgtccatcatatttctcagagcaaagccaaccttgacattgtgccccagcaagcatattcccatgtacagtctccagcttcttctcctgttcgagctaggcgtgactgggatttgttagggaatgaaaatcatcaggtcattcgaagtgaggttgccgcaacaagtgcagagcgcgcgagggttggaaggacctctccttcaaccagcaaccataatatgaaggatgtccctcaaggaactgaccatgattccggtgctgttcgatttaacattgaatctaaggatcaaaacccatcattcaaggaccttgttaggagtgatgcctcggaaaatctggacggagctgaagcccaagttccacaagaaacttctgcacagtgggattctgggggctcacctaatttggcatctggtcttgatgatgcaaatccaccatacccttatcttcctactgtccttgaggagcccggacgcgtgggttctgaagttgcagaggatgatccgctgccagccatagacggactgcgaatcacaggtgaagcctttcctggaagagaacttcaagcaagtgggtactccatccatggaaccacaagctgtaattttgagtgggtgcgccatttggacgatggatcagtaaatttcatagaaggcgcacggcagcccacctatttagtaactgctgatgatgtggattctgtactagcgattgaagtccagcctctggatgacagaaaaagaaagggggagattgtgaaggtttatgctaatgagcaaagaaaaattacatgtgatcctgaaaccaaggagcatatcaagaaaattctctctatggggcatgtgtcttatgaagttctattacctgttagatttttagatatgtgggaaccagctgtcttggcaataaagagggaaggttacagtgttaagtgtaatggacagcgtggtgtcatcgttacagagaaattccagcaagcgatgaccatcaatatcccatttgggcgtcctactgagttttcaattgtgtctgctgatggtgccgagtacaatttaaagcctgcagaaaatgccccatcacgagatgccattgttctaatactaaggctattcagaatgaaggctgttgagaagagtaagggaagaagaaagggcatcttcttcaagtagtttgtagtggtattgttaggtagtggcatggcaggttggctgtatctattacctatgtttttgcggttcatgtatgtagaaggaaagagtgagttgtctgcatgcttctttatctgtaaagttccgattagattcaattggtactgtacccagttattattattattattattattattattattgttttgtttg

SEQ ID NO: 12887 - DNA, 1209 bp, Sorghum bicolor
  Clone ID: SORBI-28MAY03-CLUS57838_1
ggcaccacggcacgaggttcatccaccgccgtcccgcccgggtcccttccgtactactagaggcgatcgttgctctagctttgcaccagcgcgcgagaggtggtggtgggggtgcaagtgcccagagattcgggagattggttggcagactagagagggattagtgcccgttatgagcgggaggaggatgcagccgcaggcacagtcgtactacgcggtgctcggcgtgcagccgggcgccaccgccgccgagatccgcgccgcgtaccaccgcctcgccatgaggtggcacccggacaagatcgccggcggccgcctggatgcggcgcgcgcggaggaggccaagatcaggttccagcagatacacgaggcgtaccaagtgctgtcggatgacaagaggagggcgctgtacgacgccggcatgtacgacccgctcgacgacgaccaggaggacgttgagggattccacgacttcgttcaggagatggtctcgctcatggccaccgtggggagagaggagccagtgtacagcttggccgatctgcagtccatgctggacgggatgatcaaggatttcaccgcgccaccacaacctgagccccgtgtcttctacaccggtggggcatcgggcaaaccgagcagcaaagagcagagtactgcttcgtcacgcatgcatccccaggggttcggtgacgcggcgtgcttcagccggacggctttctcacgatgatggtgataaataaattgtcgagcttttatccataataatccggcagcaatgggttttctagctcgtggaaatggagggagagtaggaactaggaacccgtcagagccaacgtccgccatgggcagactctgtctgatttgcaattgctttgcattgtggggggtgaaagaaggtgaggtgggaagattgcaggacaaggccacaaaggggtagtcgcgtaggatcgccactcataagaagggatttttgtttcgttttgtttggttttcgtctcctgcctgccatggtagagatgagttgtgccaagacaatttgtacataagggtatgccatcaaaaacgagttgtcatcagagtatgccatcaaagctgatgttgccgctctaggctctacagttcgtgtgtgcttgatacaacatttcaaaggcctgattgtcagattgtgtaatggaacttctgtatcaatgattggcatgcttg

SEQ ID NO: 12888 - DNA, 1226 bp, Sorghum bicolor
  Clone ID: SORBI-28MAY03-CLUS58199_1
atataaattttcgggaacctttatctttatgcgtcgcacatattttctctccctgtctctagtactgtcgacactttaaattgcgtaactcttttatagtatagataaaaaaaagaattggaaggagtgcccgcggcatgatgacatcccgggcgctctataaaaccaggaggaccgaggacgtatcgtgttcgtgtgcactgtgttgtcatctcccgcgccgccttgtttgtgtgcttccgcgctttgacgcgtccgtgagccgttggccgttgcgttgctgctatgggctccctggccaccgcagacgagccgctgccgccgctcaagtaccctcagcctcgccgcgacgacgacattgtcgacgactaccatggcgtccttgtgccggacccctacagatggatggaggagctggattcgaaggaggtgaaggagttcgtggacgcgcagtcggccgtggccagcgccgtgctgtccacctgcgaccaccgcggccgcctgcgcgggcagctcaccgcgctcttcgaccacccgcgcttccgcgcgcccttcaagcgccggggcagctacttctacttccacaaccccggcctccgcccgcacagcgccctctacgtgcagcgcgggctgggcggcgccgagcccgacgtgctgctggaccccaacaccttcagcgacgacggcacggtgtcgctcggcatggtcggcgtcagcgacgacggcgagcacctggcctacggcaccagcgccagcggcagcgactgggtcaccatcagggtcatgcgcgtgcgcgacaaggagcacctgcccgatacgatgtcctgggtgaaattctcgcgcatcgcgtggactcgtgacggcctgggtttcttctactcgcgttttccggctccaaggggggatgttggtggggagatggattctgggatcaagactgacgttaatctcaaccacgaagtctactaccatttccttggaacagagcagtcacaggacgtgttgtgctggagagaccctgaccatcccaagtacatatacatccctgaagtcacagaagacggcaagtatgtgatcctttcagtttcagaaacgtcagagccggtgaacaagctctactactgcgacctctcagctcttgctcacgggctgggcggcatcacgaagcagagcacccatggcaatggcatgctccccttcgtcaagctcgtggacaaattcgaggc

SEQ ID NO: 12889 - DNA, 2058 bp, Sorghum bicolor
  Clone ID: SORBI-28MAY03-CLUS58116_1
aatcgatttttatttaatatatatatatatataaacgaaccgactgaaaatttgcttatttccggctcttgaaatcggcccctgattcctccgctcgtcaaatcctcctcgccgtgcccgtgtaggtagcgattccttgcgttggcggatcatcgcgggctcctctcctctctctctctccggcggcaaatcgtcgaatcgcccgcgcttggccccggccgcgctgaaacccgccgccagcctcctcgtctgaagaagaacggcagccgtcgtcgggctccggtgtttccgccgaagaacggctggtagccagtcgcgctccccacgccggcgagtcggttggcattgtatttgcctttccgtttgttgttgatcgaaagttctggacagaggaacgaatcgggattaatccgttgcatatacaaagcccccgctcctggtggatgtgcgaggccatgttgttgttgcaacagccccaagcgattcgcttcgattttgttcttctgttcttgtgacggatcaacgcgctgatgttcctgcgctgcaatggctccttcgctcgttaatctgttatattctgttgtcagttctcggttgtagtcaaggatgcgatttctttctcggttgtagtcaaggatgcgatttcttccattcaaaaaaaatcttttgggtgctcctgtagaagttggaaatcttcgtattttgactcctgtttgtctgatttattcgctgtgttttgacgcccgttaatttagtttgttcgactattgacaatgtcttttatttcttgtttgcgacagagttctcgaagcaaaacgatctgatgagattcttcaaggggagcgaggtggaggtattgcacgaggcagaggtgccatttggttcgtggaggcctggtgagatcatctccggcaacggacacacctacctggtgagatatgatgaaagtcccgttgactctagcgtggctgttgaaagggtgccaagaaggttgatgagacctcgccctcctgcggatgattctgtacgctggagtttgggtagtattcttgaggcctttgacagctactcgtggaaggttgctgaggtggtgagagtgctcggaaagaatcaatatctggtcaggctccttgggtcctcgctggagttgagtgcacattcatcggatcttcgattgaggaagctttggctagatgacagatgggttgtgactcagaagtattccgcaagatgcttgaacggtggtgcattcggaggtcgatcaaaagacggaaatttagactgcaacttgagaaaggacaggcatattcaacttgagaaccagaatgcttttgagggtgatacatctagaggcatgaagagaaaatcgtctgctatatcaacacatcctcaatgcagtgaaattactaagagattgcggacaccaaatagagatggaagcccctttacgccggcttgtgcagtcagtgtccactcagctgaaatgggccaaggctggaggcttttttagcatccttccctaggttcttgtagatggtggtgtctgcctcatgttttgcagtgcggtagatgtggcaacaattccattggacttccatcggcccggccgggccttgactgtggttccagattagttctggttcctggataaaagggtcaaattggattggtttatgatccagagacgaaaaggcgatctgtttgttgtgtgatttttcaccgaacaagcatatttcctctctggacttgcagccgatttccatgtacagacaaaatgttgggattacatggtctggccctgcatcaaggaaaacttgcagttgaaggaacatgattgaaatacaatggatagacatacaatcacatattttcagaagtggctaggaccttgtggttctgatgagcaagcgagaagcttattgtatagtcaagtacaattgaaaaatttctccatggtgtaggacgatgtaccttcgatctctttacttcccattgaacttaatgctgttcgtgtgtttggaaattcatgtaccttgttattttcctaataacaatgta

SEQ ID NO: 12890 - DNA, 589 bp, Sorghum bicolor
  Clone ID: SORBI-28MAY03-CLUS5876_1
tgccgcacgaggcccaccaccaccaccaccagcagctaccgacgacgaccgagcacagccaggcagcgcaggcgcaggcgcagcgcagctcgtcggattcaattcgttcttgagccaagttgcaaaccgcggccgttgcccacgagcgccggccgcaccggagaagctacctaaggagaagcaatggaggtcgccgcagcatcagcagcagcgagcttcggcttgaaggccgccgacgacgtggacaacctcagggccacggagctcaggctcggcctgccaggcacggaggaggagccccagcaggtccacaaggcgacggcggcggcggcggcggtggagctgccgctgctgccggccgcgacgacgccgccggcgccgtctacgcctaggggcaagaagcgcgacgtcgtcggaagcgggaacgaggacgcgcccaagaagcgcgacggcaacgccgacgccgcgccgcccgccgccaaggctcaggtggtgggatggccgccggtgaggtcgtacaggaagagctgcttccagcagcagcagccgccggccaagagcaagcccgcgccagcggcgccggcggacg

SEQ ID NO: 12891 - DNA, 809 bp, Sorghum bicolor
  Clone ID: SORBI-28MAY03-CLUS5807_1
ccgggactcgctgcacgttccgtgcacacatccaaaccggcaaaccctcgtcgcgatccggccccaaggtctcgagatgaaggcgagggcgaagtccagcggcggcgactccaggctttcggtgaagaagggcaaggctcagaaggacccaaacaagcccaagaggcctccgagcgcgttcttcgtcttcatggaggagttcaggaaggactacaaggagaagcaccccaatgtgaagcaagtctctgtgattggcaaggcttgtggtgacaagtggaagtccctgtctgatgctgagaaggctccctacgtctctaaggccgagaagctcaaggttgagtacaccaagaagatggacgcctacaacaacagcagtctggaccacagcgtctggtattctgacaaggtctgaggtatgggaggagggtcgagtgatggatgacggatggagggagctctcgcctgcccaagtgcttgcagtcagtagggaaattctcatcgtcgtgggcctaaccgggcttttgctgctccttttagcctctggaagctgtctgtctgtctttctagatgcagtagactagtagtagtcgccgctcgttctctgagttggtagtcgcaagtgttgtccgtccctgaagtgatgcagtttagctggtagtgtgttcgcttcttcggcacttgaccgcttgttggaatggcatgggatgtttagcctgcagtctgtacttacccacgagcatctatgatgcctctgttttaacaatctcagatctcaatagatgcctgttttaagtctcagatctaaatag

SEQ ID NO: 12892 - DNA, 1848 bp, Sorghum bicolor
  Clone ID: SORBI-28MAY03-CLUS7731_1
gcacgaggattctgttgaagctgtccctccatcaatcatacagaattgggtagataaagcccctaaggaagatctagacctgccaaaacgtaacatctttattccaaatgatctttcattgaaatgtgtagaggaaaaggcaagttttcctgccatgctgaggaagacatcattttcgagactctggtacaagcccgatacaatgtttttcacacccaaggcttatatcaagatggattttcactgtccactgtcccaaagctcacctgagtcagcagttcttactgatgtattcacgaggttgcttatggattatttgaatgattatgcttatgacgcgcaagttgctggcctctgctcggcggttaagccaaatgacactggttttcaggtaactatggttggcttcaatgacaaaatgagaacccttttggagactgttattggcaaaattgcagaatttgaagttaaggctgaccgtttttctgtgataaaggaagctatgactaaggagtatgaaaatttcaagtttcggcagccataccagcaagtcttatattattgttctctgatactggaggaccaagcatggccatgggatgaggaattttctgcactttcccatctcgaagctagtgatctgggaatttttttgccccgtttgctatcaaaaaccttcatcgagtgttattttgcaggtaatattgaagccaatgaagcaaaaaatatcgttcaccatcttgaagatgtcttattcaatgcacctattagtgcttgcaagccactatccccatcacagcatcttgccaagaggattgtaaagcttgaaaagggtttgagatactattatccagcaatgtgctcaaatcaccaagatgaaaattctgctcttctgcactatattcagactcatcaggataatgtcaagcaaaatgttctacttcaactacttgctcttgttggcaagcagccagcttttcatcaattgcgatcagttgagcaacttggctacatagcgcttcttaggcaaagaaatgattcaggtgttcgtgggttgcaatttataatccagtcaactgttaaggatcctgccaatctggatgccagagttgtaaattttctcaacatgtttgaaggcactctctacaatatgtctgatacagagttcaagagtaatgtaagtgctcttattgatatgaaactggagaaatacaaaaatatacgcgaggaatcagctttcttctggggagagatttctgaaggaaccctcaaattcgatagaaaacaagaagaggttgctgcactgagggagctcaagaaggaagagttgatagacttcttcaatgatcatgtgaaggttaatgcaccacaaaagaagattcttagtatacaagtgtacggtggtctccattctgcggagtacgaaacaatagtgcaaaatgctccgccgccgcagtcgtgtgagataactgatatttacagcttcaggagatcgaggcctttatatggatcattcaggggaggtgttggtcagatgaagttatagttcaacattttctcatctttctgtaaaattctgaaaaaaagaataatatttttgttcaactgcttttgttggactaggctggcctgcatctacgttcatagttcatttaatcgaggacaccatattagggcatttacctgtgtttcttttttcactatgatcattaaaatattatgatattatgagatttcgcattgctgggtaaagacaaatatctagtcatgtctggttggtctgagatacaacaaatctatatctattattagtattagtataatattaaagagctaacatttcagctc

SEQ ID NO: 12893 - DNA, 1694 bp, Sorghum bicolor
  unsure (1)..(1694): unsure at all n locations
  Clone ID: SORBI-28MAY03-CLUS7751_1
tgtccccacatcgccgcgcggaggaaaaaaaaaagattcccctttgctcaccgggaagcgccgacgccgttgatggatttcggaaggaccaaagctgccgccgtagccctgacgtccgaatcgacctccgcctcgtcccgtctgctcttctcggcccccgccacgccgtggttccgggagctgtgggcccacgcctccaaataacggctcttcgagaggagaacactggtggatttctcagctggtggtgggaaataaagcgactggcccagcatccttgtgatagcgatcacagcatcgtcagcttcttcagtttcagctgaaactagactgatcaagaaggtggccagccgtcgaaatgcatagacagaagattgcaaactctgggtgggctgcgtttgatcgcaagtggcgcagcgcagatggcagtggggatgaaggtgatgctgattcatttccggctctctcaagttttggagcccccaatcttgctagcagctccattacagaaaagaatgggctgaaaccaaagccttttgcttcagtggttcgcccttctgttgattcaggagctgttagtaatggacgtggaaataagaattctgctaatcatgtggagaatgggaatcacggtgcaatttctgcatctgttaataaagttaagctcttgaaagatgcacacagttgggctgacagtaatttaatcgaggatgtattagctgctgtgaataatgatgtcagccaagcatctgatttgttgaaagctatggtctctcctgacttgcagactggagaggatagaacatctgaccaacttgctgctgtgatgaataacacacaaggattaccatcagaaagtgctggagcaggcaaagcaaatccagatagctcaaagttgttgccgctgccgctgccgccgatgaattttccctctatacccttggagcctgaattggaagagattgatgatgattacttgaactaccggaaagatgcactgaagatgatgagggctgccacaaagcattcccagtctgccagcaatgcattcttgagaggtgaccatgcttctgccaaggaattttctctcagagctcaggaagagcgtgcagctgctgaaaagctgaataacaaggcagcagaagaaatatttcgcctcaggaatagcagtaatgacatctggaagatagacatgcatggtcttcatgcatcagaggctgtgacagtattggagaggcatctccacatgatagagttccagcaacctgggaataagtcagcttcaactgaggacttagctaagttggagtctgcatattctgaatcaaccactggtttaaacattgagcttgccgctgagaaggtggtcttacgtcggcctaagcagtatatcttacatgtgatcacagggatgggtaaccatagcaaagggcaggcttcactgcctgttgccgttaggggtttccttattgagaacgggtatcgatttgatgagctgaggcctggtgtttttgcggttcgtccgaaattccgccgcaggtgaacgtgtagaagtttgtacaattgtaacatgatgtatgtatcagttgtgccgacatagccactgcctatgaaactagaatggcagggtgggtaataggaaattccagcaactttatttttccttgattaataaagcgaatttgtactnctgt

SEQ ID NO: 12894 - DNA, 2013 bp, Sorghum bicolor
  Clone ID: SORBI-28MAY03-CLUS798_1
gcacgaggtttttgtggcaaaccctgcacgcctccgcaaccgcgtcgtcggcgagcgcgatcccgagagactcaaccatcggccattcagcctcctcggtggggtgtgtgtatgcgcgtacgctggccgtgaccagatcggctaaggtaaggccatggcggagccggccctcctcgcgccggaccccttcgcggacctccccttccccgaattccaggcgcccgtggacggcgacaccttcgcgttcgaggacttcgatctggaggatctggacctggacctggacgtcgacttcgacctcgatctatttgcctcggacgggcaactctcgcagccgccccctctcgcgcccgcgtcctcctcggccgggtctccggaggggggatcgtcctcttccggcggcggcggcgggctgaggaacgaggagtcctcggagtcgtcttcgaggagcgcgagcggcacggatggcagcgacaaggggaagggggaggacgacgaagcgaagcgccgcgcgcggctggtacgcaaccgcgagagcgcgcacctggcgcggcagaggaagaagcagtacgtggaggagctggaaggtaaggtgaaggccatgcaggccaccatcgctgacctctccgccaggatctcctgcgtcaccgccgagaacgccgctctcaagcagcagctgggtggcgctgctggagccgcgccgccgctgccaatgccgatgtaccccgcgatgtatcctttgccgatgccgtggatgcacccggcgtatcccatgcgtggatcacaggtaccgctggtgccaattcctcggctgaaaccccagcaacctgcacctactgcagcagagccaccggccaagaaggctaggaagaccaagaaggttgcaagtgttagcttcctggggttgctttgccttgcgatgctctgtgggtgtttgatttctgtagtacatcggatgtatccctctgttgatgctggagaaggtgctgcatttggtccttctcatcatgggaggatcctggctgttgaggggcctcatgataatgtctcggatggtatcgatccaaagccgccacagagtggcagtgagacccttccagcgctgttgtatctaccgaagaatgggaaacatgtcaagattaatgggaatcttgttattaagtcaattgttgctagtgagaaagcttcattgcggttgcctggctatgatgggacgagtcctcaaaagcaaaagaaggaagagactagcttggcaattcccggctatgtgactccattggaagctggagaggttatggaatcagccaaaggagtgatgaaaaatgaactgatggctttggctcctgcagatggaaatgtgtatagggaggaggatggattgctgccacagtggtttagtgaagcaatgtctggtcccttgctgagctcaggaatgtgcactgaagttttccagtttgatgcatctccatcatctgctcattcaaatggcatcattcctgtctactccaataccatgtcaaactcgtcacagaattttactcaaaagcttccctccgcttgtcctcgcacggtgaagaacagaaggatttcatactctgagaccattcctttaagaggttcaacatccaacgacaccgagcacttcaaaacaccaccgaagaatgagagctttggcagtacgaagcctgtttcatcggtggtcgtctcagtgctggctgatcccagagaggctggtgacggggatggtgaggggaggatctcttcaaaatcgttgtcccggatcttcgttgtcgttcttatagatagtgttaagtatgttacttactcttgtgtcctgccgttcaaaagccatagccctcacctttaggtctggttttggaggcgagtatatgcgttcaggtctatatacattaacttgatagtctctctgaagcaactaatatactcttctaagtatgttgatagagctggacttgtacattctatagcagaagaggttaagacagctcattt

SEQ ID NO: 12895 - DNA, 946 bp, Sorghum bicolor
  Clone ID: SORBI-28MAY03-CLUS8203_1
gcacgaggctctgcacgaggccgatccaacccggcggcgcggcggcggcagcgatggcggcggtgacgaacgccgacgtggaggtggtcgacttcgacctcgacgacgacgacctcatggacgaggacgccgggccggatccagcgccggcccccgcccctgcctcccgcctccgctccaccatcgcgggcgacgacgcgccgcgtaggaccaagggccgcggcttccgcgaggaccctaactcctccgcgcaccgcgactcccgctttggcgcggggggacgcgccgacctcgactcgctcggcggcccgggacccatccaatcaattgaaggatggattgtgttggtcactggagttcatgaagaagctcaagaagatgaccttcaaaatgctttccaagaatttgggcaggtcaaaaacctgcatttgaatttggaccgtcgtaccggatttgtcaaggggtacgctttgattgaatacgagaagtttgaagaagctcaggctgcaataaaagaattggatggagctgagcttcatgagcaaataatgagtgttgattgggcatttagcagtggccctgctaagcgcagaaatactcgaaaaaggtcaccaccaagagctcgttcaaggaccccacccaggagaaggcactgatgtttccccagcatgtcatgaattactgtgtgatgtagtgcaagacgtctggggattccaaatattagcttggtgtatgtcaccggagtttgatggttgttattagattgcctgctgtttccttatttgggacattggtagttgtatcctgctttgaattccggtctgagttggagacatggaggtgcacttagccgcttaccattatgtttggcatgccagttcgagactattgtaagcgatgatccttttggatttttgacaaagtgatgtgttggtgttggattttt

SEQ ID NO: 12896 - DNA, 1359 bp, Sorghum bicolor
  Clone ID: SORBI-28MAY03-CLUS62234_1
gcacgaggcacgcggctcatgccatctgattgactactttgagggaatagaaggagtaaagaaaatcaaggatggttacaaccctgcaacatggatgttggaagtgaccaccttagctcaagaagatatccttggaatcaactttgctgaagtatacagaaactctgacctgtaccggaggaacaaagctttgattagtgaactaagcacaccaccaccagggtccaaggacttgtacttcccaacccagtattcacagtccttccttacacaatgcatggcttgcctgtggaagcagcacatgtcttactggagaaatccatcatataccgcgactagaatcttcttcacaacagttattgctctcatcttcggaaccatcttcttaaacttaggaaagaaaattggcaccaggcaggacctgttgtatgctttgggatccatgtatgcagcagttcttttcattggaattcagaatggtcaaactgtgcagccaattgtggacgttgagcgaacagttttctaccgagaaaaggcagctggcatgtactctgctctaccctatgcttttgcacaggtccttattgagatcccacacatcttccttcagacagtcgtgtatggtctcattgtctacagcctgattggctttgaatggacagctgagaagttcttctggtatatgttcttcatgttcttcaccttcatgtacttcacgttctatgggatgatggcagtcgccatgacaccaaacagtgacattgccgctatagtctcaactgcattctacgcaatatggaacatctttgccggcttccttatcccccgcccgaggataccaatatggtggagatggtactcgtgggcttgcccagtggcttggacactatatggacttgttgcctcacaatttggagacatcacagacgtcaggctggaagatgatgaaatagtgaaagatttcgtcaacagattctttggattccagcatgacaacttgggttatgtagctactgctgttgttggattcactgttctctttgctttcgtctttgccttctccatcaaagtcttcaacttccagagaagataagagagggtgccatctaaaaaaaatttgttgttgcttcagctaactttcagtatataggcactgcagcaatgtaaaatgatgacccgtgagagagtatatatgtaggctttgtttctttctaggaagttaacatcattttttgttttccgaccagtttggcctgtactgaacagaaaggggcctctgtgtaaaattgtatgtagactgtgcacaattgagttcaatacttcaatgtaagatctcccattaaatttatacctttgtcc

SEQ ID NO: 12897 - DNA, 779 bp, Sorghum bicolor
  Clone ID: SORBI-28MAY03-CLUS6294_1
ctcgccggccgggccgggaccagcctccgcctctcctcccagtgcccgccgccgtgcgcttgctctccctctccctcaaggacttcgccggcgaagagagcctagtcgcctagcaggatgaagtttattgctgcctacctgcttgctgtcctcggtgggaacctcagcccctctgctgaggacttggcagccattctggagtcagttggctgtgaagttgacaatgaaaagatggaactcctgttgtcccaactgagcggtaaggacattaccgagctcattgctgcaggcagggagaagtttgcttcagtcccatgtggcggtggcggcgtggctgtcgcggcagctgcgcctgctgctggcggagctgctcctgcagctgaggcgaagaaagaagagaaggtggaagagaaggaagaaagtgatgatgacatgggcttcagcctcttcgattaagctgtgttgtcatcagagtattcttttgagtcgtggaaccagaggaaaatcatagtcatgtttggagactttaaccttgttttatgttggaaagtacttgaaagactcctgtctttttatgtggtaattcagctgtaggttgctatgctggttggggtttccaggtgaaccagagtttttctatcctatattatgaatcggttaccaaaaaaaaattgaaaaaaggcccctaattgaaaaaagtcgattgagtgagtacacgtatgtgctaccatgaagctctgggtagcagtcgccaaaaaaaaaaaaaaaaaaggccccta

SEQ ID NO: 12898 - DNA, 1020 bp, Sorghum bicolor
  Clone ID: SORBI-28MAY03-CLUS63119_1
cctccctgccttgctgcccttctgtgggggtgtcgctgttgctcccacggcggttgccctgccctgcttcccggggccgcccatcggctaccccgcttggggcagccccgccggggtcaccatccgcgtcaccctcaccatccctatgtggcttatcgccctggctaacatgatggttgtaatccatgtcattggcagctaccagatctatgccatgccagtgtttgacatgatagagactgtgctggtgaagaagctgcacttccctcctggtctgacactgcgtttgattgctcggaccgtctatgttgcgttcacaatgttcatagccatcaccttccccttcttcggtggattgcttggtttctttggtggtttcgcttttgcaccgacgacttatttcctgccctgcatcatgtggcttgcaatctacaagcccaaaaggttcagcctctcttggttgaccaactggatctgcattattcttggggtgcttctgatgattctatcgccaattggaggacttcggcaaataatattggatgcgaaaacatacaaattctaccagtaaactactaccagccatgactagtaggcatgattggaaatttgaaatatgtcaaagcctcaactgagtttttttgtcgtgccgaacacagaggggaaggtcatagtacaatatattgtttcagatgttgggttagttatatatatacatacatacgtattgtttcttaatattccaaggtgaccgtggcttgtgtgtgtatgtgcataagtgagaattaatgatggtggtttccccagatattggtggtttaaatatattctcccgctctggtcgcgcttcccttagtcatggcctaacctaggagtttgctttgagtggattatatacatgtgtatgtagtttttcttcatacttctttatattcagggaatgttagcttttttgtatgtataaacgcgaaaatggaagcatggtgctttgtattttttttagagaatggaaatggtgct

SEQ ID NO: 12899 - DNA, 933 bp, Sorghum bicolor
  Clone ID: SORBI-28MAY03-CLUS63382_1
gcgcgaggacgaagccttatgggccgctcgatctcctgcgctgtttgccgccgcgcgccaccgcgcgtgaacgaatctctttctcctccctccggccttccaaggttatattatatatcgtcatccattccattccacacgggctagaaggacgcccgccggcgaccccgtccggccgtgtgtgtcgatggccggcaccaccgtgtgctccatgtgcggcgacgtcgggttccccgacaagctcttccgctgcgcccgctgtcgccgccgcttccagcactcatactgcactaactactatggcgacgcggcgccggccgaggcgggcgccggcgtgtgcgactggtgcctcagcgtcagcggcgacgtcgtcggcgggaagaagcggcagtactcttcggtgtcgggacacggcaagcagcagcagcagcagcagcagcgtctgcaggtggaagaagaagaagcaggcaggagcatgcagcagccggcgtcgtcgttcgcgtccagcgggtgcagcaagggcgccggcaaggtcaccggcggcagcgagcacgccgagggtggccggaggccccgcaggtacaagctcctcaaggacgtgatgtgctagctagcgagccggcggccggccggctagctattagcttaattaggtgctcgtacgacgtcgttgtactatgtacaaaaacaatgcttgctaattacgtagtagatagcaggtaaaactagtccgctgcgcccgctggcgccgccccttcctgcgctccttctgcactaactactatggcgacgcggcgccggccgaggcgggcgccggcgtgtgcgactggtgcctcagcgtcagcggcggcgtcctcggccgggtgcagcggctgtgctcctcggtgtcgggacacggcaagcagcagcagcagcagcagcagcgtctgcagg

SEQ ID NO: 12900 - DNA, 1087 bp, Sorghum bicolor
  Clone ID: SORBI-28MAY03-CLUS6456_1
cgggatgatccccagcgtgcactcatagagagggaaatgtttggccgagaggcactcaatgttattgcttgtgagggctcagacagagttgagagacccgagacatacaaacagtggcaggtgaggaacctcagggctggatttgttcagtctccgttaaacaaagaaattgtgatgaaagccaaggacaaagtaaaagacatttatcacaaggactttgtcatagatgaagacagtggatggctcctgcaaggctggaaaggaaggataatctatgcgatatctacatggaagcctaagaataactaggttcttggtctcctattccattgatggtggcagctaattaacagtcctgctatgttatagcgtttggaccttgacctgtgaacctatctgatcaaggaaatggcttgaagaatggagaagggtcaacatggagctttgctagatttacatctgtccagccagtactctgataaactgggaaaggagcagctgtagacctctctaccttggtgttggtaccatcaccttttatttaattcgtagttttcttctttcctgttacttctgtgaccatcctggcgtcctattagcaataaaccaggtcgctgcttctagtagttaattagctagccaaactacctactatcttgaacttagtattttttacctgtatccatccatgtcaaacacgaatttggttttcagcaccagcagataaaaagttccccaacgagcaagcataaagcatctaaatttgttataggagaatggacgctgctgtttgtgtggaatgtagtatcgcatggagtgctttgcttttgatgaccagtccattcttcatttatttatttcatctcttttgtagcaagtgatgcgtgctgtcacaaattgattccttaaactttgagtggagcactagttcgagaatattaggagaaagtggtgctacatatgaacatagtacatgcttttggagttgacttgcgaacggtggcacaaggcggcatggtatcactggaccgcgaccactatcagactatcttctcatttgataatggattgttttagttaatccttt

SEQ ID NO: 12901 - DNA, 1317 bp, Sorghum bicolor
  Clone ID: SORBI-28MAY03-CLUS675_1
aattggagcccagacgcggagcgtggcggagccggcagccaagtagaaaaatcggagtaccaaaggcaggaatcggacgcgaaggcaattccggccccactccgctacccaatagggagccacgaaccgcgaagggaggagaggcggaaaggggggacgggaatagtcgtcgtcggccatgtcgtcgtcgtggaactccgtggggctggcggtcctgtaccaggtgctgggctgggtcgccttcgtcgcgtggtccttcagcttctacccgcaggtcctcctcaactacaagcgcaagagtgtcgtgggcttgaattttgattttctggtgttgaacttgacaaagcattcatcctacctcatatacaatgcagctctattcttcagcccgttcatccagcaacagtatcatgacaaatatggtgacaaagagatgattcctgttgctgcaaatgatgttgctttttcactacatgctgtagcattgacagcctttaccgtttttcaagtattcatatatgagcgaggaacacagaaagtctccaaagtttgcatatcaatttctgctatcgtctggactgccgctcttgtttgcctcattattgcttggccaaaaagtgactggctttggcttattgatgtactcaattcaatacaagttggcatgacagcaatcaagtacattcctcaggccatcatgaatttcaggcggaagagtacaattggttggagcgttggcaatattttacttgatctcacaggaggcgtgctgaacttttgtcagatgggtgttcaatctatagatcaacatacgttagtaaatttctatgggaacattgggaaaacccttctttcattggagacggttttctttgatgtcgtgttcattatccaacactatgtgctgtaccctgtcacaaaggacgatcatggtaaggcaatcatttctgaaagggtagcccctcttatcaggccttcggacaagcctgaagaagatactgtatgatctagctttagctgtattgcgtgcattgcatcacgcgctgtttgcacacaggccacacccgcatgtcttcagggttcctataattatttgttcaaaagaaatcgctgatgcgtcttgattgtattactacctttatatatatattttccttcgcattattgtgatacctgtagaagttactagatgttatctcatttacaatcaacgccccatgtaaatatttggttgcttatccatgaaaaaaggagcaccacacaataatggggcaacaactttgaaatctctgtactcttatatgtatctctcattcc

SEQ ID NO: 12902 - DNA, 1303 bp, Sorghum bicolor
  Clone ID: SORBI-28MAY03-CLUS67589_1
tgctggctcccccgtccaacccgagcgcgcagcaagagagagaaccaaataataaataataaggaagaaaataataagaaaaaaaaaaccactcccgtgctcttcgaccggcggtggtggtggtgcgaacgcgaggcgaccaaggggagacgagatgaggggggcgaagcggccgctcggcgtggtgacgtcatgggtgcggcggcagccgcccaaggtgaaggccttcctagccgtcgtcaccggcatggccgcgctcgtctttatccgcttcatcgtccacgaccacgacaacctcttcgtcgccgccgaggctgcgcacgcgctcggcataggcgtcctcatctacaagctcaccaaggagaagacctgcgccggactatccctcaagtctcaggatttaactgcgttatttctagctgttagactgtactgcagctttgtcatggagtatgacatccatacgattctggacactgctacccttgtagccacactgtttgttatttatatgatacggttcaaactgaggtctacttatatggtggacaaggataactttgcattgtactatgtggtgctaccatgtgctggactggcactacttattcatccttcaacatcacataacattgtgaaccggatctcttgggcattctgtgtttatttggaagctgtttcagtgctgccacaattacggttgatgcaaaatactaagattgttgaaccgtttactgctcactatgtatttgcattgggggttgcaaggtttcttagctgcgcccactgggttctacaggttttggacacgcgtggccgtctgttgacagctctcggctatggtttgtggccatctatggtgcttttatcagaaatcgtgcagacattcatccttgcagatttctgctactactatgtgaagagtctggttggtgggcaactggtgctacggcttccctcaggggtggtgtaagaagtgcagcaggatacaaaacttagtgcttcaccgattgatatgtactctgaataacagtttatgctctagtgcccaacctgggagccttttttagttgatgatgttacgagttatgactatgtatgacaaaattgctgcaagggtgtcctcttaaaagttaggttctcactgagactgcttagcggcgcgtttcttgatacccaatctctgagtacttagcttctgctgtatgactgtcgtggtcttagaatcgggtggttaatggtctctttggattataacgctttcatatgtttttgcgacaagcaaattgatctgatcttgcag

SEQ ID NO: 12903 - DNA, 1415 bp, Sorghum bicolor
  Clone ID: SORBI-28MAY03-CLUS9116_1
ttggcatataggatccctctgcagctcacgatgtttcaatttgccgaaacagtaatgatgtgcatggaagcttggttgataacccattggctttagcaggcgacgatccatctttgcaaatttttcttccaagtcaaccttccactgttccccttcaggaagaattgagtgagcgtgctaatactccaaatggagtccaccctgacgattggaggatatctcttacgcttgcggccggtggagggggtaatgaagagtctacaagtgttgatggtctaaaatcacagccaaaagttccatcgaaagaggcaggagtcgaacctttgcttgatgctgcttctgctctcccaagcatgaacagatgtaatggatctaatctaaatccaagaaggattgaaaatatattttctcaccctcgccaaccgcggtctgttaggcctcgtctgtgtttgtcattagatactgattcagagtagtttggacatcacactgggatagctgaatttgctactaatctggcaaagttggcttccagaatcttgatttttactgtggagggctcaggttattgttgttgatacaaagagaaacaccagtgtggatgctttgttgcattaacctgggaagattcaagtgttctatatgatccaagtgggatctgcatagagttcatctaatggttggtacaggatattttctaactgggagtggtttaatgtggctagtggagcaggctgtacattttccctgacatttactgggtataaggaatagggggccatcacttggcataagacaaatacatgtgaatgttttgtgtgtaccatcattgtatttagggtttgggtgctaatttagatgtttattattaccctgatgtttgatggaaaataaattattccttgaagtggcggtcaataaacagagcccccttcggttttgagtcggagctgctgaccgttcatctgttcttgttgttgttgtgaagtggtagcttcgttcagcttcagcttccatggtgggaccaatcatgccaaagttgtgtctagcagagggcaatctccatggtgtcttgcaatacaagtactcgtatattttgctctccaggatgataagtttctttgtgcatcatgctgtattatgccggtgttccccttctcatttcttgcttcactgaactgcttggcatagtttgaaaaatctatctgttcatttggttcgaaactctttactagtatgtgggtgcagtgcaggcgcacagggcagatcggcagttttgacttgcctgtgatctgccttgagtatctactgctactggtaccgcctactggctaccgcccatgtatgtacttagtaggcattgtaaggcatcaagagtaaacttgcaggtggtggtgtggattgtatcagcttta

SEQ ID NO: 12904 - DNA, 498 bp, Sorghum bicolor
  Clone ID: LIB3476-058-P1-K1-D1
cttcaggaagaattgagtgagcgtgctaatactccaaatggagtccaccctgacgattggaggatatctcttacgcttgcggccggtggagggggtaatgaagagtctacaagtgttgatggtctaaaatcacagccaaaagttccatcgaaagaggcaggagtcgaacctttgcttgatgctggtttgtctcccttttatgaatttaattcttctcttttgtaatcattttgcttctaagataacggtttgctacacttccttttctttttggtagcctgtcaactatttccaggatcatcaaggttaaacttttgaaggcaggcatcttaggtcatactttttttccatagaaaatgtgcaaagtctgatatcttaaaatagatccccataaactatttaattctgtagtcaataaaatgaatgagtagaattttagcaacttttagagtatgcctttgattacttctgggtattagatgacatttgatggtgagt

SEQ ID NO: 12905 - DNA, 810 bp, Sorghum bicolor
  Clone ID: SORBI-28MAY03-CLUS915_1
gcacgaggcatgagattctctcgctgccccgcggtggccgtcctcccgggtgtcggcgcatgggcacgctcctgcgggcgccctcgttcacccctccgtttcctgcctgtcgcccctccgcgtgagtctttctcctgctatactgcccatatgctacgtcgtgccgtagagtttgggatcctaatacaatatctttttgagaaattcccaaattggcaggagatagctagccatgccattgtcgaccttcaagtttcgcagacttatacaaggatggagccatgccgtgagaagaggtgtctttgaagcagaggaaaagtgcttgtccatctgagaagaataggagagcggcaaaacacaagtgcaggagggatggaccacctcgatctgtactgcccaaatttggttttagcctgaacttgaactgcaggctatataattaagaattctggacctgctgaaatagttccatggcttctcttcaggaccttttgtcagccgttatgtctctatcgatgacagcatcgccactatctgagaacatggagccatcatagtgtcgtaatctaatttccatgtttgtttttctgagtcattaatcttgtgcactatacatttacatgtgcgtgtagatgggggaccttttcacaatttttagcaagcagcacggcaaagaatatgcctcattgcaacttctgaatattaaggtcaattcctcattttataaatgatgctacaatcttggtcaattcctcgttttgcttcaactgcatcttctctatatgtccatgttttttctcagacattgct

SEQ ID NO: 12906 - DNA, 603 bp, Sorghum bicolor
  Clone ID: LIB5048-011-R1-XP1-B4
ccgggttcgttcacctgtgaggtagtgggcatgtcctgtttaccggtattatgcaatttttggagagtggcccatttgttagcatgcccttaagctccagattcatgaacaaatgatgatcgacacattactgaggcctctaagaagctctggcaactttctaaccatgtgccaattcattttgggatgctaatacaatatctttttgagaaattcccaaattggcaggagatagctagccatgccattgtcgaccttcaagtttcgcagacttatacaaggatggagccatgccgtgagaagaggtgtctttgaagcagaggaaaagtgcttgtccatctgagaagaataggagagcggcaaaacacaagtgcaggagggatggaccacctcgatctgtactgcccaaatttggttttagcctgaacttgaactgcaggctatataattaagaattctggacctgctgaaatagttccatggcttctcttcaggaccttttgtcagccgttatgtctctatcgatgacagcatcgccactatctgagaacatggagccatcatagtgtcgtaatctaatttccatgtttgtttttctgaggc

SEQ ID NO: 12907 - DNA, 773 bp, Sorghum bicolor
  Clone ID: SORBI-28MAY03-CLUS10141_1
agaggtcgccgaggaaaaaaacgcttctcttcttcttcgacgttagcccctccgctccgctcgccgccacctcggagcgctgcgccacgccgggccaccccaccctccccttcctttccctctccctctcttacaccacgcagccgaaccgtgcagccccgagcgcgcttggtttccaccgcggggacacactggacgaccgccggcatgggcgacccgacgcacaggcaccgcaacccgagtacccaacctcactcctgcctgcacttcgtctctccactgactacagcaaacacgtgcgcaccaaggaaccaaaggtggcttcagatcccactggaggaggatgcataaggacttcagagctccaacaatgtgctctagaataattaagacatctgacgatgaataaccagacgtgcttcctgttgcgggtcgaagttgttatgggtgctttagagcattgtagaaagttctcgtcaagctctggacaaatccgatggagtacaatccgtccatgtgtggtctgtggtcacgcccgggtgatgctttagaatattgacccaccacctccaaatgctgtctcctcctttcagggtggcagccattttgtcactcgttgcgcacaggagtgctggacatgtgcattgtatacgagcaaatcttactatcgtccttgcgcatggtcttggttcctgagctacccataaaaggagagcggttcaactaatttcagagatagcatttgataccttccggtacatcaccaccaggag

SEQ ID NO: 12908 - DNA, 1202 bp, Sorghum bicolor
  Clone ID: SORBI-28MAY03-CLUS10208_1
gagtcgcaggcttgccttctccttctcctctcctgtagtacgttcctcttctgctcctgctgctatagctagctagatccacatccatccaggagccaggagggagatcgatggcgaacgctggcggcgggccggctggggaaggggagtggctcaaggtcgcccagctcagagccctcctcgtccaggcgcaggagcaggacccccgcgccaaggaggtggacaacctgacgctgcgtcggttcctgcgcgcgcgcgaccacaacgtggacaaggccggcgccatgttgctcaagttcctcaggtggcgggcggaggcggcgcccggcggctccgtgccggaggaagcagtgcgcggggagctggagcaggacaaggtgtacatgggcggcgtcgacaggaccggccgccccatcatcgtcggcttcctcgccaagcactactccgccaaccgcgacatggcagagttcaagagttttgtggtctacttcttcgacaagatctgtgcgaggatccccagaggccaggagaagttcctggccatcatggatctcaagggctggggctacgcaaactgcgacgtccgggcctacatcgccgccattgagatcatgcagaactactacccggagcggctgggcaaggcgctgatgatcaatgtgcccttcatcttcctcaaggtgtggaagaccatgatctaccccttcatcgacgccaacaccagggacaagttcgtgttcgtggaagataagagcctgcgggagacactgaggcgggagatcgacgagacccagctcccggagttcctcggcgggaagatgcctatcatccccctcaaggactacgcccagcagcagcctcagcccgtttgcgagtgatgagtctgtctgttaacgacgatggctggccggccggcgtgacatgatgattgatgagcgagccaaagcccaaagctgattcgatcttgactactactgtactacagcctacaagagggaagaggatataggccctctagtactagtcctgcaagtctgcaaagcatcctccgcttggcagggtcagtggtgatcatctgcagctgatcgaacaagctagcgtagtaccctgacgctgggcttggaaatgacaattaatatgaatgtgggatggatggaacatcatgtctatacgaggcatagtaaaggattaacgcccttttt

SEQ ID NO: 12909 - DNA, 1086 bp, Sorghum bicolor
  Clone ID: SORBI-28MAY03-CLUS6976_1
gcacgaggccctcccgcccagatccccgctagggtttccccgatccccctcagccaccgggccgccgccgacgaggagaccgccgccacgatgttggagctgcggcttgtgcaggggagcctcctcaagaaggtcctggaggcgatccgcgagctggtcaccgacgctaacttcgactgctccgggaccgggttctcgctgcaggccatggactcgagccacgtcgcgctcgtcgcgttgctcctccgcgccgaggggttcgagcactaccgctgcgaccgcaacctctccatgggcatgaacctcaacaacatggccaagatgctccgctgcgccggcaacgacgacatcatcaccatcaaggccgatgacggctctgataccgtcaccttcatgttcgagtcgcccaagcaagataagattgctgattttgagatgaagcttatggacatcgacagtgagcaccttggaatcccggattccgagtaccaggccatcgtccgcatgccgtctgctgagtttatgaggatctgcaaggaccttagcagcatcggggatactgtcgtaatctcggtgactaaggagggcgtgaagttctccacctctggagaaattgggagcgcaaacattgtttgcaggcagaaccaaactattgacaagccagaagaggctaccattatagagatgcaagagccggtttccctgacctttgccctgaggtacatgaactccttcaccaaggcatcttcattgtccgagcaagtgactatcagcctgtcgtctgagctaccagtggtggtcgagtacaagattgctgagatgggttacattagattttacctggcccccaagatcgaggaggatgaggagatgaaggcctgatggcttgtaatgacataatgctcgtgttgcctacttttcattgttgtccaaccatggtttgcttagctagtgtttgcaagcaaaaagggatgttatgtgttatctaggccagactgctttagctacttgtgtctatttgtgactgccctctgaatccatggatttacagtgagcctattagattagtgggcttatgctttgttc

SEQ ID NO: 12910 - DNA, 712 bp, Sorghum bicolor
  Clone ID: SORBI-28MAY03-CLUS70147_1
ccccgcgccgcccccggcaccccctcgccggccagggactgggggtccgccgccgcctccggcgcggcctgctggcccaggccgcccccggctcccccgccgcggccagggactggggtttcgcgggggactacgtcgaggcaatgtggctcatgctgcagcaggatcagccggccgattacgtcgtcgccactgaggagtcccacaccgtcgaggagttcttgcaggctgccttcggctacgccgggctcaactggaaggatcatgtggtcattgacaagaagtacttccggccagcagaggtcgacagcctcaagggggactccaccaaggccaggaaggtgctcaaatggaagcccaaggttgggttccagcagctcgtggagatgatggttgatcacgacattgagctcgccaagaaggagaaggtcctggtggatgctggataccgtgaccccaagcagcagccataggaacagtgcagatgctccttgctctgttgggacttggggttcggatttcgattgttgccttgtagctcatatacatggtggttctcagagtagagaggttgacggaagttattatcgatacttcttctggtaagaaataaggatggttgcagtatgatctcacagtatcttcattacttttctgactatgttatgcactttaatcaaatgaatgaatgaataattcatgccaattttgt

SEQ ID NO: 12911 - DNA, 850 bp, Sorghum bicolor
  Clone ID: SORBI-28MAY03-CLUS7137_1
gcgcgggccacctcaattattgcccccctcctcctctcctccttcccgtagtcccgtccatctcctcgcatcgccgggcgtcgggaatggcggccgcgctgtggacgctggtggtcctgtcggcggcggtagcagcgctggcgacggagtggcgcgtggcggcgacggcggcagcggaggcggcgaacgaggtgctccgcgcgcaccagctgccgggaggcctgctgccggcggggatcacggcgttccatcacgacgcggccacggggcggttcgaggcccagctggaggcgccctgcaccgcgcgcttcgaggtcggcctgcgctacaacgccaccgtcaccggggtcatcagccccggccagatcgccgccatctcgggcgtcgccgcgcaggacctcttcatgtggttccccgtccacgacatcaaggtcgacatcccttcctccggcgtcatctacttcaacgtcggcgtcgtcaagaagcacctcccgctcgccgtcttcgacgcgccgccggcctgcacgcccgacccgctcctccgcaccgtcccgcagcggctggaggacgtgggcgaggacggattggccatgggcgccgcggcgtccagtcgatgatgggtggggacgaaggagggttcgacggcgccggcgaaccaggatcacaagcgcagttttgagagggggaacgaacgatcgccggtcgggcgccgccgacggccggcctcgttcgatgcacatagatagcgtgggcatttccattcatgttttttttttctttttctacttcttagctactggagtagtaaccaacctcgtcttcatcgttgcgtcaatctgttattattcct

SEQ ID NO: 12912 - DNA, 1711 bp, Sorghum bicolor
  Clone ID: SORBI-28MAY03-CLUS7030_1
gcacgaggccccggcgagaccgcgcccacgccggccggatcgccggagtcgcagccgggagcgggcggcgccgccgacgtcggtggcggcaagaagaagaagctctccggcggcgccatcgctggcattgccatcggctccgtgttcggcgtgctgctcttgctcgccctgcttttcttcctctgccggaagaggtccagcgcgccccggtcggcggcgacggtggagaaggggcgggaactcggcatggagccgatggatgtcgagccaaaggggcagaacggctcagcagctggcgcaggcggccacaacggcgctgcggcggccgtggcagctccgaccgccgccgccgccgctgcggctactgcagcggcagcgaagaccggcgggtcgaccgggtcgaagaagctcatcttcttcgggcccatggccgcggccccgccgttcgacctggaggacctgctgcgcgcgtcggcggaggtgctgggcaagggcgcgttcgggacggcgtacaaggcggtgatggagaacgggtccgccgtggcggtgaagcgcctcaaggacgtggacctcccggagccggagttccgggagcgcatcgcggccatcggcgccgtgcagcacgagctggtggtgcccctccgcgcctactacttcagcaaggacgagaagctcctcgtctacgactacatgtccatgggcagcctctccgccctgctgcacggtaaccgtgcctccggccggacgccgctggactgggagacgcggtcggcgatcgcgctggcggcggcgcgcggcgtggcgcacatccactcgacggggcccacggcgtcgcacggcaacatcaagtcctccaacgtcctgctcaccaagaactacgaggcgcgcgtgtcggaccacggcctccccacgctcgtcggcccttccttctcgcccacacgggtgtccggctaccgcgcaccggaggtcaccgacatccgccgcgtctcgcagaaggccgacgtctacagcttcggcgtcctcctgctggagctgctcacggggaaggcgcccacccacgccgtcgtcaacgaggaaggcctcgacctgccgcgctgggtgcagtccgtcgtgcgggaggagtggaccgccgaggtgttcgaccaggagctcctcaggtaccagaacgtcgaggaggagatggtgcagctcctccagctcgccatcgactgctcagcgcagcaccccgacaggaggcccgccatgtccgaggtggccacgcggatcgacgacatccgccgctccagcctcggcggcggcgaccggcaggccgccgacagcgccgaaggcgacgagccatctctataaccgcccatagcagcagctgctccgatcctcccctgattttccaccacacgtacttgtcagcctcagccccctcagtgaatgaaaattgcttagttcttttctttgcatggatcgatattgctcttgtgcatgtacgtttttctccttttcttttcttcttcttcttctttatctttttttttgggcctctctctcacgggctttgattctattctatagcacatgtcactgtactctttattcttggaaagcaacatttgatgatgccttgcctgtatctgtatctacaaccgacaccattaccagctgcactagtgtgtatgtgtattgtttgctatattcaaaaatactacgcgcgaaatga

SEQ ID NO: 12913 - DNA, 839 bp, Sorghum bicolor
  Clone ID: SORBI-28MAY03-CLUS71502_1
aaaaaaatgacttgaacaagctagctagctagcaggcaaccctctctctggtcttcccacttccacaccagaaagaaaccaccacctcctctcctgactcctgagtagtgagtaatccaatcatccacaaaagcttcagctacccatggcgccgccgaccgaggactgcggctggctgctgtacctctccctggccgccaaatgcggcgaccctcaccgcctgctcggcttcgccgcggtcttcgtcgccgcgtgcgtcgtcacctcgctcctgcactgggcgtccccgggcggccccgcctggggttggtactggtggacgcgccgggccgccggcctgggcatcgtccgcgccgcgaccatcccggggccccggggcctgccggttgtcggcagcatggcgctcatgaccgggctcgcgcaccgcaagctcgcggcggcggcccagggacaggccagccggcgcaggctcatggcgttctcgctgggcgagacccggggtggtggtcaccgccgacccggacgtcgcgagggagctgctggccagcgccgccttcgccgaccgccccgtcaaggagtccgcgtacgggctcctcttccaccgcgccatcggcttcgccccgcacggcgcctactggcgcgcgctccgccgcgtcgcgtccgcgcacctcttctcgccgcgccgcgtcgccgcctccgccccccggcgcgccgccatcgcccgccgcatgctgcgtgacctctccgccgccgcggccgccggaggcggcggcggcggcgaggtcgtcatgcggcgcgtgctccacgcgggctccctggaccacgtcatggccaccgtg

SEQ ID NO: 12914 - DNA, 1260 bp, Sorghum bicolor
  Clone ID: SORBI-28MAY03-CLUS74668_1
ctactggagcagcagcggagaccgaccagtgagggactgaggggagagatggcgagtcgcgccgtcgccttgctcgtcgccgtcgcgctcgcggccttcctcctgcaccccgcggcggcggccggtcagaagaagccggcgacggccgcgaggcgggaggacatcccctacatccggtgccaggtgtgcgagcggatcgcgcgcgagatctccgcgcaggtcgccaagaagcagcaggcgctcccgccctccaagaaggtgccggagatcgagatcatcgagatcgcggagaatgtgtgcaacctgaagaagcaggaggcggattggatgctccggatcgacatcgtcgagaaaggcgacaagctcgagcttgttgaacaagatgaggaagggcattgcaatgcagaatgcaagaccattgagcgtgcatgtcaagaggtgataggatatgctgatactgatgttgctgagtttgtatacaaaaataacccctcagctgatcagctgatgaaatttctctgcaaagatctttcaaaagcgtgtgccaaggacccgccgccagttccaaaagatcgagtccctggggaaccatttgcaaggaagccatcaaaagatgctgagatggaaaagatattgaaatcaatggagggtatgccgggagctccaagcatgaagatgtactccagggacgatctgatgaaaaataactttggtactgaagacgacgatgatgaagatgatgaagacgaggatgacaacttcccaaagaacttgggaaaagctctgaaagacaagggttctcaaaagaaagacttgaaacagcaagttgtgcaacagttcaaggataccagtaaaaagttgaaagggcatgtaaacaaggtgtccaatgtggtaaagaaatggtggaaaggggcaaagaagcctgccaaatccagcaaaagcaaaactgagctctgaagaccacagcagcattgttgaatcagttcagtaatttcacccatcacccacgtctcctggagcaaagttttagatgattttcggaagataaagttgcagcaacacatccagagcttttgttagagagtttagcataaacgtgtacaattttttttctgttattttcagtgtacactaggagaagaactggactctgatgatagttttaccaggctagtcgagtcccaattggttgttggtgtctgatactctgtaaaacaaaacaactggtgacgtcagtaaattagattattggctacgcaa

SEQ ID NO: 12915 - DNA, 2296 bp, Sorghum bicolor
  unsure (1)..(2296): unsure at all n locations
  Clone ID: SORBI-28MAY03-CLUS7661_1
gcgcgagggacgcaccctgccgcggtgttgatgcctccgcgttcgcccacccctgctagccccggtgtggattttcctgcgggggcttcggtgctctgctccttgagacctcccccagctggcttgtcgccgctggggatgcttccggggttcaggctgccggcgtcgtctccgcagggcctttgtctcccactggtgctgttccacgaaactgttgcacggaccttgactcaaggatcaacaccgatgagcatggatttccatccacttcaacaaactcttcttcttgttggtaccaatgttggcgacattggattgtgggatgctcgtgccaaagagagacttgttgtaagaaacttcaaggtctgggaccttagtaaatgtacaatgaccctccaggcatcactggttaaggatccagctgtgtcagttaatcgcataatatggagtcctgatggaaccttgtttggtgttgcttattcaaggcatattgtacagatttattcctataacggcggtgatgatcttaggcaacacttggagattgatgcacatattggtggtgtaaatgacatccccgtggctcatccaaataagcagctatgtataattacatgtggagatgataagacaattaaggtatgggaggccactagtggaactaagcaatttacctttgaaggacatgaagctcctgtttattctgtttgtccacattacaaggaaaatattcagttcatcttctcgactgctttagatgggaagattaaggcatggctatatgataatttgggatctagagttgactatgatgcaccaggtcattggtgcactacaatggcatatagcgcgcacggggcaaggttattttcctgtggcactagcaaggatggtgaatcacatctagtagaatggaatgaaagtgaaggagcagtgaagaggacatatcagggattccgtaagcgatccatgggtgttgtgcaatttgataccacccggaacaggtttttggccgctggggatgaattcatgattaagatatgggacatggacagcacaggtcttctgactaccattgatgctgatggtggcttacctgcaagtccacggatacgcttcaacaaggaaggaactctattggctgtctctactcttgacaatggtatcaagatcttagcaaatgctgatggacttaggttgctgcgcactctggaaaatcgctcttttgatgcttctcgtaatgcaactgagactgtaacaaagcctctaatattgactgcggcaaatgcggctgcagcaagcagttcagtagctgctgctccgtcagctataactgcaatgaatggtgatagcagaagtttggttgatgtaaaacctagaatagctgatgagtccctggacaagtcaaaggtatggaagcttatggagataactgagtcaactcagtgcagatcaatcaaactggcggataacatgagaacaagcaagatctcgagattgatttacacaaattctggtcttgctatcttggctttaacttcaagcgctgttcatctactctggaaatggccacgcagtgatcgcaattctggaaaggcgaccgcgagtgtgtctcccaccctatggcaaccaccaagtggcatcttcatgactaatgacacaactgataataatcctgaagaagctgttcactgctttgctttgtcgaagaatgattcatatgtcatgtctgcttctggagggaaaatctctctgttcaacatgatgaccttcaagacgatgacaacatttatgcctgcaccgccagcagcaacttttcttgcatttcacccccaagataacaacataattgcaattggaatggatgactcgaccatccaaatctataatgtccgaattgatgaggtcaaaagcaagctcagaggtcactctaagagaatcacgggtcttgccttttcaaatgtgctaaatgtgctagtctcttcaggagctgatgcccagttatgtgtttggaacacggatggatgggagaagcaaaagaccagatttttgcagataccatcaggtcgccaatccaatatcttggacactcgtgttcagttccaccaagatcaaatgcattttcttgttgtgcatgaaacccagattgccatctatgaaactacaaaactagaaccagtgaagcagtggcctgttcgagagaattcacctccaatcacacatgccacattctcgtgtgatagtcaactgatctatgcaagctntatggatgctactgttggcatatttaatgcat

SEQ ID NO: 12916 - DNA, 975 bp, Sorghum bicolor
  Clone ID: SORBI-28MAY03-CLUS11802_1
gcgctgtaacaatgaaacatacagcacagaattgctcccaatgcaacagctggatgatattagagaaccttctgattctgcgccagagatctccatatgcgaacctaacccgtgctccagtatgaactatggcacagtgcctggaagacactccatgtcagaagagcggcagagttatttgaaaagattaggttaccctgaattgcattcttcaaatttccttgaccttgatttgttgtcatcttcagggaattcgtgtgatgaggaagtttttgagaggtcatcactgatcaattcacctatggatgtgatcagtgttgaatcatctacgtcatacagtgaacaaggacacatagatgagggcagggatgacacagatctttcccgttctagcagccagctctcagacgttcgggactattctgatcgctttgcgcactgggtcgcaaatggaggcatgctttgctactaggccctgggttttgtcttggtgaccgaatttgtgacacagcaagaaatggatgtctagcggatagagcagacgaaaattgctgacggctagccggctaggtgcatctgcctgcagaggcggcgtagcggaagagattgtggacatgggagaagtctcgcatcggcttggctgtgatcacttgaaggcttgaacctgatattcgtcgaatggagattttggtggttggattgggtataggattcaatttgctatggtgaaaaattttgaccatagtttagacaataaataggcaaaatatatctgattcttttagtttagcttaccctacgttccccttcatagaaaattatcaaaaagaaaaaaaatggaaaatctattagaaaaaggagaaaaaaccttagataaagaatacttttgatgtaaatagttagtatgttattacagaagtataaatatttggtacttgttcggtttcctggcggtgtctttataattgtttttgt

SEQ ID NO: 12917 - DNA, 1418 bp, Sorghum bicolor
  Clone ID: SORBI-28MAY03-CLUS11888_1
gcacgagggtgaaaggtgcaccgcaagcgtgcgaacggaagccaagcaaagaattccaaatccccacgccgagtcgccgatccgctccctcctaccccaccacgccgccggccagctaggcctctccctcccgaatcccgatccatcacccagccgccgccagcatccacgaggaggggccatggacgggagcaggaagaagaagtgggtggcctgggcggtggcggccgccatcttcgtcgtcctcatgctcgtcacgcccgccatcccgcaggacgaggcctaccacgacttcgccgaccagcgcaccctcttcctagggattcctaacaccttgaatgtgatctccaacatccccttcttttttgttggcgtcacggggctcatcttgtgccactacaaaaactatttcaggctaagctcacagggggagctctggagttggacactgttctttgccggcgtcaccgctgttggatttggttcttcctattaccatctcaacccaaatgatgccacgctagtttgggacagactgccaatgacgattgctttcacttctgtcatggctatattcatcattgaaagggttgatgagagagcaggtgcaaagtcccttgcaccacttgtgattactggtgccttgagcatcatgtattggagacactttgatgatcttcgtccgtatgcagtggttcagtttgttccatgtattgctttacctgtgatggctatagtaattccaccgatgtatacacattcaagctactggttgtgggcagcaggattttacctccttgctaaagtggaagaggctgccgacaaacctatctataactggactcatcagattgtcagtggtcatactcttaagcatctatgtgctgcgatggtaccagtgttcttggctctcatgctagctaaaaggactattgaaccagaaagggtaagcttgctccagaaatggaagatcagttgggttacagtgagagagaggcgttccaaagatagcatcacagttgatgtggattgcaactacgctgctgtttcaaatactacatctgaacagtaaacatgcatctagttaacattatgcgcacgtgtatgagtgtatgggagaaaagcaggggacgtctgaaacatgaagaaacccaagctatggtagagttttttcacctgtgctgtgcctgtgttgttagttagagtcgctgataaagctgtgtgggtgcagacaaatcttgtacatagcaatagaagcagcataagtatcggaagcttttatttatttcatcagtcattccatttacttttttttttcgcgttggggtcaagatgcatgatatagttttgtactcgatcgatctatgaacatgaagagcgagattatattgctcctgaaacaacgtacacaaattgcc

SEQ ID NO: 12918 - DNA, 790 bp, Sorghum bicolor
  Clone ID: SORBI-28MAY03-CLUS12058_1
cctgtttctgacgaagaaaaagattccgtgagaagtgcttacctaagaaggcatcctgatgctttttgggttgactttggtgacttgagtttcctgcacatcaaacctaaagctgtgcgctatgtatctggcgttgcaactgctctccttggctctggagaattcggtgctgccgagtacaaggaagctaacgttgatccaatatctcaattctcaactcctattacaagccatatgaacaaggatcatgctgatgatacaaagctcattgtgcaacactccactactgttaaggtggattttgcttatatgctggatgtggacagccttggttttaatgtgaaggctggttatgatggaagtgttctaaagttgcgtatccccttcccaaggcaggcgcaagacaggaaggatgttaaaacactaattgtggaaatgctccaagctgcaagagcctcatcttcagatcctgaatgatgtcgtcgtcatcctagaaggtgatgaatctgtcggtgcaaatgaaagtaaacctaattaataagagttcttgggtttccatccaatctctgcaccaactgaaggtggagccacagaaatttcatggactgatacacgaccttgtatataacaaagagcgcttaattacttgtagttgcatgaatacaaagcgacttcactatattgtacttactgacatgtgcagctctttcaactgattgttcaccaagtggctgtgaacttatttcacccaaacagcgtacaactttattacaaaaaaaaaaaaaaaccc

SEQ ID NO: 12919 - DNA, 1684 bp, Sorghum bicolor
  unsure (1)..(1684): unsure at all n locations
  Clone ID: SORBI-28MAY03-CLUS12370_1
agctgggcatgttctagcactagattttattgaaagtgtgattaagaagaatcaaagcataaatgggcatcacaagaacataaccttcaagtgtgctgatgtaacatctcccgaattgaagattgaagataactctgttgatctgatattttcaaactggctattaatgtacctttcagatgaggaggttgaaaagcttgtggggaaaatggtaaaatggttaaaggtcggaggccatattttctttagagaatgatgttttcaccaatctggagattccaaaaggaaggtgaacccaacacattatcgagaaccaaggttttatactaaggtatttaaagaaggccattcatttgatcaagatggaggttcttttgaactttctctagtgacttgtaaatgtattggggcttatgtcaaaaataagaagaatcaaaaccagatatgttggttattggaaaaggtaaaatcaacagaagacagagattttcaaaggttcctggacaacgtgcaatacaaaacaagtggaatcttacgttatgagcgtgtctttggtgaaggttatgtgagcactggtggaatcgagactacaaaggaatttgtgggcatgctggatcttaaacctggcaagaaagtacttgatgttggatgtggaattggaggcggcgacttttacatggctgaaaactatgatgtccatgtgcttggaattgatctttcggttaacatggtttcatttgcaattgaacgtgccattggacgcaagtgctctgttgaatttgaagttgctgattgcaccacaaaggattacccagaagatagttttgacgtcatctacagccgtgacactatccttcacatacaagacaagcctgctctgttcagaagcttcttcaaatggctaaaacccggtggcaaagtcctaatcagtgactactgtaagaatcctggaaaaccatcagaagaatttgctgcatacattaagcagagaggttatgacctccacgatgtgaaggcttatggacagatgctcaaggatgctggttttcatgatgtcattgcagaagatcgcactgagcagttcctgaatgttctacggagggagctaggtgaagttgaaaagaacaaagaggctttcctggcagacttcacccaggaggactacgacgacattgtgaacggctggaacgcgaagctgaaacggagctctgccggtgagcagaggtggggcctgttcattgcgaccaagtgatttggcctggaagtccagagtgctctcgcctcttgggaataagaatggttgtggctctgcttctagaccgttgattcagcctagaagtagaggatcttcgtcttcgtcggaataaaaacgtgtgctgttgactgttgtggtgttgtgtctacagctatactagcatttctgttgttatgttctatgtaagctgcgaacccagagttgcagaatgtgtactgctcgctgttgtggttgtgtctacgctacgtagcatttcagttgttgtaggtgaactgcgcacccagagctgcagaacatggatgcctgctcgattaagttaacggtgtacgagataataagtttgttgtcagagtcgatgtcacgttgtcactggaggtccctgatcaattcagacgtgctttggtgctattcgaanagtatattttatgt

SEQ ID NO: 12920 - DNA, 2155 bp, Sorghum bicolor
  Clone ID: SORBI-28MAY03-CLUS1090_1
cccacgcgtccgctgttaagtgagatccacgcatttctcgcaagcttcgttgatcgttgcaaaacggcaaggaagttgttctgaatctttcagagatggatcctgctcctgcaagggtgttctgtgatgagagagttctgcagtctgcgtaggaacacaggcaggatatctcgcagtagtcagggggttcttcatggttgtgaaatatgcaggtctcttgggagaaatagtgtgctggggaggattagccccttgaattaactgtacctactactagtactagacatataccaagtgtaattagagaatgaagcatgtaatcaaaactatgtactatgcataaagagtgtagttaggagtcaattaaatctggagtgttgactcttgacattatgccacatggagtggagatgaaaccctatacaccgtgcttctttttgtgtcaaaaaaaaaaaaaaaaaaaaaaaaaaaaatcccggtcccacgcgtcgctaatgtgcttctctgttctctcgcggacccagattcatcggcctgcagcagagcaacgcccctcccttccatctccgagctgccatgccgcgccatggacagcgaaactccactgcgtaatccactaccgggaccttctgaagtgatctccttggcctgaaacttggaggcgagcgaggtgccatggttctcgtggtgctgggctgctctcctgcatcgccgcgccccgcctgcactcccaattccaggagaagatgcagcgccaccagacagaaaatcatcagatgctctctgaatgaggaaacactactgagcaaacatggagtagtatccaggcagttaatctcatgccttgctgcttcgcttgtgttcgtctctccacctagtcaggctattcctgcagaaacttttgcccatccaggcttgtgccagattgcaacagtggcagccatcgacaatgcttcagttcctctgaaatttgacaacccttcagatgatggcagcgcagggatgatgatgaggggtatgactgcaaagaactttgatccagttcgctactctggtagatggtttgaggtagcctcgctgaaacgtggattcgctggtcagggacaagaagactgtcattgtactcagggagtgtactcgttcgatgagaagtcacgctcaatccaggtggatacattctgtgtccatggtggacctgatggatacatcactggtattcgggggagggtgcaatgcctgtccgaagaggacatggcaagtgctgagacagatcttgagaggcaggagatgatccgtgagaaatgctttctccggttccccacgctgccattcatacccaaggagccctatgatgtccttgcaactgactatgacaattatgcagttgtgtctggagctaaggatacaagctttattcagatatactcaagaacacccatccccgggccagaattcattgagaagtacaagtcctatgttgccaacttcggctatgacccaagcaagatcaaggacacccctcaagactgcgagtacatgtcctcagaccagattgccttgatgatgtcgatgcccgggatgaacgaagccctgacgaatcagttcccagatctcaagttaaaggcaccagttgcacttaacccatccacaagtgtgtttgataccctgaagaagctgcttgaactgtacttcaagtaaaacaagtgtaacattgttcagtaaccaattgtccacttctccacttggagctgcaatggaatgaagttcagtttgttctggcgttcgcggcggcggtggccgtggagacgacgaacgggcagctcgctgttcaagaagctggacacgaatggagatcgaggaggcggcgggggtgtgcgtggcggtggtcgcctgcgccgcggcgttcgcgtgggcctccagcgcgcgcaacaggatcggtcagatgttcacgctgggctgcaacgccttcgtcgactccctcatcgacaacatcgtcgaggcgctcttctccgagggcgagctgcaggactggtccgacgacatataaacaagcacatatgcacacatatagagattagcagatagccagatactgtaatagacagtacgtatatacatatagtcaagtatttaatagaattaagtaggtgaagct

SEQ ID NO: 12921 - DNA, 381 bp, Sorghum bicolor
  Clone ID: LIB3481-006-Q6-K1-E4
cgtccgcttcgagaccatctccggccgcctcgccatgctggcgttcgcggcggcggtggccgtggagacgacgacgggcagctcgctgttcaagaagctggacacgatggagatcgaggaggcggcgggggtgtgcgtggcggtggtcgcctgcgccgcggcgttcgcgtgggcctccagcgcgcgcaacaggatcggtcagatgttcacgctgggctgcaacgccttcgtcgactccctcatcgacaacatcgtcgaggcgctcttctccgagggcgagctgcaggactggtccgacgacatataaacaagcacataggcgcacatatggagatgagccgattgccagatactgtaatagacagtacgtatatccatata

SEQ ID NO: 12922 - DNA, 1898 bp, Sorghum bicolor
  Clone ID: SORBI-28MAY03-CLUS8406_1
ctccattcttctcctccctccctcgtcctctctctctcttgaaccctccgccgctccgaggaaaaatccgaattttgaattgaaatcatccggacacaaggagatttttttcttccccaaccaaaggtatctcctctctcgatccgatccgtagctgctcgcgtccctgttcctcgccggcggcagcggcggcggcgactggacgaggtcttcatcggctcttcgcgggcgacgatcgtccactagtttggtcggcctgagggcatgatgatggcgaacccgaagctccataagcaggcgctgctgccgccgcggagcccgttcccgacggcggcggcgccgtcgccgtacgcggaccgcggtccaatcgcgcggccgcaggttggtgcggcgcaccaccggcacggccaccaccagcgcacgtcgtccgagagcttcatcgaggagcagccgccgctgtggctcgatgacctgctgaacgagcccgagacgcccgcggcgcggcagagcggcggccgggctgggcaccgcaggtcgtccagcgactcgtttgcgctgtttgacggtggagctgctggcgccgctggtgcttacgccaatggcttcgcggggagggggagaggaggtgggcagcctgcgccgtggggtggtgtgcaggagtactatgccaagccggcatcgtttgggagggcacatggaaggccgtgggagcaaggcatgccgaattcggcgggtttcaggcatggtggtggcctgccaatgcccatgaaagataaggttggcgggcatcatgggccaccgaacgtgccgagggagcatgaccatggcatggacaagagaactcctgatgatgctggccatgatcaaaaagttggagccaaggagggtgtgctgccgaagcatgcacagtcagaggcggacaacaagcgtgctaaacagcaatatgctcagaggtcccgtgttcggaagctgcagtatattgcagagcttgagggtagagtccaggcattacagtcagaaggggtagaagtgtctgctgaaatggagttccttacccagcagaatattatgctcgacctggaaaacaaagccttgaagcaaagactggagagtctagcacaggaacaacttattaaacgctttcaacaggagatgtttgagcgggaaattggtcgtctcaggtctctatatcagcaacagcagcagcagcagcagcaacaggttcctgctcttgttcgcagtaacagcagagaccttgatgtgcagtttgccaacttgtctctgaaacacaaagaccccaactcaggccgggatgctctctctgggcctcttcgtacttagtaaatccttccattcttgtgggtattatcagttgccaccaacgtgtggctgtcatctccaccaagaaaggagaagtgcacttggattgcgtgaataacaccagaaaaggctaatagctatttatctgatgtttattatttcgggatatgcacctggcggtcatcctcagctcgcgtccattggtgatgctcgaccagtcggcggtgtttagggttttctttttagctagatgcttttcaagcatcattgtaccatttcccatgctagggttctaatctgttactatccccttttttcctgagctgtattcttcatgcatcgtagccatgtttggattagttctgcgttattagtggaatgtggagcactagtcagcatcaggtaagttgctttggaaatgtgccacatccttgataactgtatgttgtgctattatttctcagtactcaataagctagtgcaaatgaagtattagtgatcttcaaacttcaggatgcccttgatgttggtgtcctatgaatattccgtgaattgctcagcatttcttgttgatgtta

SEQ ID NO: 12923 - DNA, 585 bp, Sorghum bicolor
  unsure (1)..(585): unsure at all n locations
  Clone ID: SORBI-28MAY03-CLUS8472_1
gccggccgggccgggattccttcgcctccgtcaggtcaggtcagcctccctctcgcagatccccacccgctccgccgccggccaccgcgtcgctcccctcggcagccaggatgacagaagcaccatttctgccacgtgagaggctcttcaagcagcaacattacttccagcacttgaccaagcacacctacctgaaagggcgctatgatgtgatcacctctgttgccatcccccttgcacttgctgcctccagcatgttcatgattgggcgtggagtttacaacatgtctcatgggattgggaaaaaagagtgatcttcccctggttaactagtgtttctgcctggcatggaagtcataccatccagattatgaagtcttctttgcttgcaaaataatgctgtcaaagaacaattcgactacattttcacatcaattttctgtttgtatttgttgatatgaaatgccagcaacttgaagatcagcattgtcactgttttggttaattactccatccctttcgtctttaaaaaaaaaaaaaaaaaaggcccctacttgcattttnnnnnnnnnnnnnnnnnnnnnn

SEQ ID NO: 12924 - DNA, 683 bp, Sorghum bicolor
  Clone ID: SORBI-28MAY03-CLUS8057_1
gccagacatgtggtgagttacttttcttccccctcgcttcatggttctcagtgtgcatgggtacctctccttaacgggatacctagaacgaaacaatgaatttggagatgatcgacttctgtcgtgaacgtcgaactatcgaattgatttgggatttgaaaggctatttgggccgataagaagattcaagcacgacaacctcctgtagccaaacaagtgtggttggaaggattcctctatttttggtgtgagatcaatggtagctcggacatcataggacatgatttgcgacgttgataatttccttggcttgtgacggtgttgtagtgagataatcgatatatttgatgggataatgtaaaaagttagttttctatattttgtgtttatgtgcttggatgatatgagcgatcctattgatttctatgtaatctctattgggtttcaatatttggttaactgagtgtctatgcatgttatgagttgggaatatcacactagtatgtagtgttttgtatgttccatttctttataaggtagtatgtgtaaagtatttagatattgtatatatttgatatattaatgttaaagtatagcatataatatgtaatggttatctgtttggatgatacgagtgaaactattggtttctatgtaacctctgttgggtttcaatattttgg

SEQ ID NO: 12925 - DNA, 467 bp, Sorghum bicolor
  Clone ID: LIB5121-003-A1-PF1-A8
gcctacgttggtagatgcttcggcgtctgagctcctggccgctcgtgcggcttggcgagcttcggaagtgatggctgtcctcgagaccttgaagcccctggaggagaagctgggtgccaacatccctcgggaggccaagtcctgcatctgcgtcatgcatggcggccgcagcaggcgtttgtctcgacgttttcaagtctgcatctgcgttagcaggatggttggaaggattcctctatttttggtgtgaggtcaatggtggctcggacatcataggacatgacttgcgatgttcacaacttccttggcttgtgacggtggcgtagtgtgatattcgatatagttgatgggttaatgtaaaaagttagttttccatatgttgtgtttatatgcttggatgatatgagcggaactattgatttctatgtaacctctgttgggtttcaatatttggttaatgagtgtcg

SEQ ID NO: 12926 - DNA, 363 bp, Sorghum bicolor
  unsure (1)..(363): unsure at all n locations
  Clone ID: LIB3476-043-P1-K1-D10
ggtttctatgcagctaatggacattagtgtcccaacctcatgtgggtcatagctatgcagctcctgctccccaccggatggtcgaaaggattcctctatttggtgtgaggtcaatggtggctcagacatcataagacatggcttgcgacgtccacaatttccttgggttgtgacggtggcgtagtgtgatattcaatatagttgatgggttaatgtaaaaagttagttttttatatgttgngtttatatgcttggatgacatgagtgaaattattggtttctatgtaacttcttttgggtttcaataattggttgacttagtgtctatgcatgttgtgagctaggaacattattccacattta

SEQ ID NO: 12927 - DNA, 1431 bp, Sorghum bicolor
  Clone ID: SORBI-28MAY03-CLUS8521_1
gcggcactaagggaggcattatgtggaaaagatgttcctgccaaggtgtatgttggaatgcggtattggcatcccttcactgaagaagccatagaacaaataaaacgggatggtatcacgaaacttgttgtgttgcctctataccctcagttctccatatcaactagtggttcaagtctccgtttattggagagcatattcagagaggatgaatatctcgtgaatatgcaacatacagttataccttcctggtatcaacgtgaaggatatatcaagtctatggcaactttgattgagaacgaactgacaaaatttccagtaccccaaaaggttatgatatttttcagtgctcacggagttcctctggcatatgttgaagaagctggtgatccatataaagcagaaatggaagagtgtgtcgatcttatcatggaagaactggaaaaaagaggaataacaaatccgtgcacacttgcttatcagagtcgagttggaccagtggaatggctgaaaccgtacactgatgagacaattattgagcttgggcagaaaggggtaaagagcctgcttgctgttcccattagttttgtcagcgaacacattgaaactttggaagaaatcgatgtggagtacaaagagttggctttagaatctggcatcaagcactggggacgagttccagcattaggttgcgaacccacattcatttcggatcttgctgatgctgttattgaaagcctaccttatgttggcgcaatggcagtttccaatcttgaggctcggcagtctctcgtacccctcgggagcgtggaggagctgctagcagcatacgactcgaagcgcgatgagctcccccctccggtgatcgtgtgggagtggggctggacgaagagcgcagagacctggaatggccgcgcagcgatgctggccgtgctggctctcctggtgctggaagtgaccaccggcgaagggttcctgcatcaatggggaatcctgccccggctccactgagctgacaatctgttcatgatcgggtcatgatttgctgcatccgaaggacgatgtgaacttttgatgctgtatatgaatcgatttgccttcaatcgccggggagaaaaggagaaaatggtaaaatgtagacagaactcgacggtatatatcatgatatactgtacctacctatgggacatgaaatagggctctcagacatgcgctatggaaattggaatacacacagacctaacacgccctacgctacggactcctgcctggtatgcctgctgctactagtagtacccagatcctctgttgtctgttcaaagtgaatgtgcgttgctttcatagaataatcgtatgagcggatgggcctctgcgttgtcatatggatgccatatcaacccagctcaataatttcagggttagctcaagcag

SEQ ID NO: 12928 - DNA, 839 bp, Sorghum bicolor
  unsure (1)..(839): unsure at all n locations
  Clone ID: SORBI-28MAY03-CLUS9144_1
cctactgggtatccctgtttctctctctctctcttctccccccaatctccgagccggagctcgagctcccaaaccctaggcctcagccggggagccatctccgccacgccagcgatgcctctcgccgcagcggcttgacggggcgtgccccatcccaaacctacctctcggcggagagcgcggcgtagttgctgtaggaggcccggcgtgggtgagaaatggagccgaggcggatctcggcgagcccgcgcccgtgcagcgggcggcgggttgtggcggccaggaagaggccgaggcaggaggcggtggtgagcagcgtgcggaagctgcagcgccgggagatcagctcccgccgcgaccgcgccttcgccatgagcgccgcgcaggagcgcttccgcaacatacagctgcaggaagagtttgacactcacgatccaaaggagaacacttcgttactcccttacttgaggaaaaggtcaaaaatcattgagatagttgcagcgcgtgatatagtctttgccttatcacagtcaggagtatgtgctgcttttagtagagagacaaatcagagaatatgctttctaaatggaagtccagatgaagttatccgcagtttattttacaacaagaataatgattcactcattactgtgtcagtatatggttcagaaaacttcagtgctctgcgatgcagaacaactcgaatagagtacattcggcgaggacagccagatgctggtttccctctttttgagtctgagtcattgaaatggcctgnatttgtagagtttgatgatgtcaatgggaaggttttgacttactctgctcaagacagcact

SEQ ID NO: 12929 - DNA, 676 bp, Sorghum bicolor
  unsure (1)..(676): unsure at all n locations
  Clone ID: SORBI-28MAY03-CLUS883_2
atcaagagctaccttgatatctccgctgatcctgcaacatttgtccagggagcaattccaaaccttctggagaacacaaaggaggaattcttccaaaaaaccatcaaaattctaaaagaaagtgcagatatatgctgggaaaagttgaaggacatcaacgcaatcacatgcccaagcaaaccagagggatccatgtttgtaatggtctgtgagtcactacatatactcttccatgttgcaggacaccacgagggatttgctaacaatgtgtgaagttcccttgacttgctgcaggtgaaactggatgtatcttgcctgtcggacatcaaagatgacatggacttctgctgccggctggcaaaggaagaattagtggttgttctgccaggatgtgctgtgggatacaaggattggcttcggatcacctttgcaattgatccatcttctctcgaagatgggcttgacaggctcaagtccttctgtttgcggtacaagaagctgacaaagtgacaagataaactcaccgcttctgtgggacgacaccagaaaaactgttataaacttgtacacagatatatgatgttgtatcatcttcactcgaagatgatatgtttgatcctncaggtctgtagtaataagcaatgggctctgcttgtctgtcatctacccatctact

SEQ ID NO: 12930 - DNA, 813 bp, Sorghum bicolor
  Clone ID: SORBI-28MAY03-CLUS883_1
atcctcatggtgtgtgccggtctaccctggtagccgctggcggccggccccggcgtcacatcccctcgcatcccactgcgttccttctgggtgctggcccgtgcctcctggccatctcctgcgacgggtgctgccaaaacaccatcaaaattctcaaagaaagtgcagatctatgctgggagaagttgaaggacatcaacggagtcacatgcccaagcaaaccaatgggatccatgtttgtaatggtgaagctggatctgtcctgcctgcaggacatcaaagatgacatggacttctgctgccggctggcaaaggaggaatcagtggttgttctgccaggacgtgttgtgggatgcaaggattggctccggatcacctttgcaattgatccgtcttctctcgaagacggccttgacaggctcaagtccttctgcctgcgacacagcagcaagccggccggtagagtgatgtgatgaactgctcgccggttcgttgtattgcaacatgagacaaactgttatgaacatctacagatgtatgtatgatatattgtaatattgtaacatcttcactcgaagatgatagatttgatgctttaggctctagctatgtcgtccgtatgtagtactatgcagtggcgtgggtctgcttctgtgttcttgttgtgtagtgtctgttagacgcaacgcaaaatgttagggggtgtatctgaagtgtagtacgacggaaacaataacctcagttcctggcgcgcaaccgccgaagtgagtcccttgctctccctggcctattgctagcaaggttggtaatgat

SEQ ID NO: 12931 - DNA, 769 bp, Sorghum bicolor
  Clone ID: SORBI-28MAY03-CLUS9865_1
gcacgaggggaagctttactctcagacttatgtatgagcagttccagaacattctgaaaatgggtcctattggccaggtcttctctatgttgcctgggtttagcgctgaactaatgccaaaaggacatgagaaggaaagccaggctaagattaagcgctacatgacgatgatggattccatgactgaagcagagcttgacagcacaaatcctaagctgatgaccgaatcacggatcattcggattgcacggggttctggccggcctgtcagggatgtcatggacatgctggaagagtacaagcggcttgctaaaatctggggcaagatgaagggtctcaagatcccaaagaaaggggagatgagtgcactgtcccgcaacatgaatgttcagcacatgagcaaggtccttcctccgcagatgcttaaacagattggtggcatgggtggtctgcagtctctgatgaaacagatgggatcgaaggagatgagcggaatgtttggaggcatgggtggcgagcggtaattttacatcgagtcctgtttttggtggatcgttgttgtgatgctaaattgagaggctttagtgctgcggtctggtcatcatcagagctttcccattacttcagcctgcgccatgttatggaacaggtttagtgtagctcccagtgcctgaaaatttaattttatatagacagtatgtttgtccttggaaaaatggatgaggtatatatttgacaaagcgaatatgcttatatagattgttactcc

SEQ ID NO: 12932 - DNA, 1053 bp, Sorghum bicolor
  Clone ID: SORBI-28MAY03-CLUS13507_1
gcaaacaattttggcggcttagcagcgggcaacagaagggtatatataagtatattctaacatacaaaattgcacgccaacttttatgacagctcttgcatgaattattattccactctttctacatgcaacaagattatctactgaacagtgcaatcaatctagtactatcaaggggtcccattttatctaatcggcatcaaatagctagtgcaccatccactgtttcgctttcatcatcgggggtgacagacttcgatttggacgtaactctggaaaacccatagccaagagaacttcctgtcgtagcacacaactctgtaagctctgacagatgtcgattccggaactcgctgatggtttcctgaatctctgacattggaagttttgcttgtgcaagaacagcagcagctagctgaaggcttggctccaaggtctcagggacaaccgccattgcaccagctttctccaaattaacaccatgatcaacgtcatgtgctctaacaaatgtcttcacatttgggaaatatttgctcaatgcccagacagctctgtagtttgcaccaggagtatccaaagtaattgcagcagcacaagctctttcagctccaactttgtgcagtacctctctgcttccagcatccccaaaatacactggaaggtcaagtgcacgcccaactgctacccgatcgcttctaacatcaagtgcaacaaaagggattaaccgctctgacaggagttgcgcaatgatctgcccaacacgtccaaagcctaatataataatatggtcttgcaaatcgtcagtctcactttccacgggcaataaactcctcacatcatgctgctcaaattttgatgcgagaaactgccccccagcagctaaccatggtgtcagagccattgaaatgccaacgactaaaaatagcaacgatgataattgaggtgatagaagaccctgattgacagcttctccaaaggcaacaaaagcaaactcaccaccaggtgcaagcaagaggccaacacgaatagcagctatagtagaaaccctcgtgc

SEQ ID NO: 12933 - DNA, 356 bp, Sorghum bicolor
  Clone ID: LIB3480-001-P1-K1-G2
cccacgcgtccggactagttctagatcgcgggcggccgccctttttttttttttttttttatgacagctcttgcatgaattattattccactctttctacatgcaacaagattatctactgaacagtgcaatcaatctagtactatcaaggggtcccattttatctaatcggcatcaaatagctagtgcaccatccactgtttcgctttcatcatcgggggtgacagacttcgatttggacgtaactctggaaaacccatagccaagagaacttcctgtcgtagcacacaactctgtaagctctgacagatgtcgattccggaactcgctgatggtttcctgaatctctgacattg

SEQ ID NO: 12934 - DNA, 760 bp, Sorghum bicolor
  Clone ID: SORBI-28MAY03-CLUS14177_1
gccggccgggcctgggagggccggccgggccaacaacaatcaccacacacatccctcctgccctctcaagagattttactccttccaactgcttgctctagctaggtcaccaacaatggcctcctcgtcctccttcctgctcgccatggcggcgcttgcggcattgttggctgttgggtcgtgcagcaccctaatgacctggacgatcggcaaggactccacctccacccgcctcgtcctcgtcgccagcgccgacgtctctgaggtggccgtcaaagacaagggcgccacggatttctcagacgacctcaaggagtcaccagccaagacatttacatacgagagcaaggaaccgatcaagggtcccctctccgtccgctttgctgtcaagggtcaaggctaccgcaccaccgacgatgtcatcccatccgacttcaagcctggctcagtttacaagactaaggaacaggtttgaggaattaattgatgggcaaatctgctctttgagagagagagattgagcatataaataagcaagccaataattcatttactatggttatttatatcttgtggtagacactatcgaaaaaataaagtacactatgttctcctgccgcgtattgctgtagagctatatatacgcgcgattattgtaaaccttttttgtcaagatggtgtgtacgttgatttttgtttaaaaaggtccctacatatgtatatatgaaaattaatgcgaaaaaaaaaaaaaaaggcccct

SEQ ID NO: 12935 - DNA, 664 bp, Sorghum bicolor
  unsure (1)..(664): unsure at all n locations
  Clone ID: LIB5047-003-R1-XP1-A4
gccggccgggccgggtgttaaactgatttttggaaatggacggagtaacaacaatcaccacacacatccctcctgccctctcaagagattttactccttccaactgcttgctctagctaggtcaccaacaatggcctcctcgtcctccttcctgctcgccatggcggcgcttgcggcattgttggctgttgggtcgtgcagcaccctaatgacctggacgatcggcaaggactccacctccacccgcctcgtcctcgtcgccagcgccgacgtctctgaggtggccgtcaaagacaagggcgccacggatttctcagacgacctcaaggagtcaccagccaagacatttacatacgagagcaaggaaccgatcaagggtcccctctccgtccgctttgctgtcaagggtcaaggctaccgcaccaccgacgatgtcatcccatccgacttcaagcctggctcagtttacaagactaaggaacaggtttgaggaattaattgatgggcaaatctgctctttgagagagagagattgagcatataaataagcaagccaataattcatttactatggntatttatatcttgtgggagacactatcgaaaaaataaagtacactatgttctcctgccgcgtattgctgtagagctatatatacgcgcg

SEQ ID NO: 12936 - DNA, 1217 bp, Sorghum bicolor
  Clone ID: SORBI-28MAY03-CLUS14307_1
gcacgaggcttccttctccggccgggtaaaagcaaaggcaacgactccgcgtcccgcttccctttcccccgtaagaacccaccgcacggcggacatcacgatccccaccggccggcgtagcggagatcgcgagttacaacggggaagcgaggaagctccctcgatcccatcccacgcagattcgtttgggtcgcggtcgtggtgaataaattggtaggtggcaaggggagaagcggcgatgtcgggcgtgttcggcagggtgttcgggaagtccaaggcgcagagccaggccaccgcgctggcctcgctcgacaagctcaacgagacacttgaaatgttggaaaagaaggaaaacttactagtgaaaaaggccaatcttgaggtcgagaaggccaagaattttaccaaagccaagaataaaagagccgcaatacagtgcttgaagaggaagaggctatacgagcaacagattgagcagcttggaaatttccagctcaggatacatgatcagatgattatgctggaagccgcaaaagctacaacagagaccgtggatgcattgagaactggagcatcggcaatgaaagctatgcataaatcaacaaatattgacgatgttgataaaaccatggatgaaatcaatgacaatatggagaacatgagacaaattcaggatctgttgtcagcgcctatgggagcagcagctgattttgatgaggatgaactggaagctgaacttgccgatctggagggggaggagttggaggcagagctgcttgcacctaccacaacagctccgtccacagctccagtgcgtgtacctactgctcagcagtccactaggccatctgcccagagtagcaaagctgaagatgacgagctggcagctctacaagcagaaatggctatgtaattataggcattggcatgatcatcttggattcagattctgtggatatctcggaactctggtacagtcatgagggtcgtcctaggaagaccgtcagaattcagaaccacaaatacaagctgcataccagcctagcttcttatgtatcatagcatgatatgttagtgttttgtaatggaatatttcagatgggctaataaacatttttctactaataaattgggttatgtcagtattatgttcttcaggttttgccatatccatctgttctagtgccaattctaattgatggtgaaactctttacct

SEQ ID NO: 12937 - DNA, 786 bp, Sorghum bicolor
  Clone ID: SORBI-28MAY03-CLUS14707_1
ggatgatagtggatctcctactgatgactcgggtgatgaggattcagatgctagtgatagtggtggtgaaaaagagaaatcatccaagaaggaagcaagcagttcaaagccagttcagaaaaggaagcctaaggccagggatgacgaagggcatgagaagaaaaaggcaaagaagaaaaaagatcctaatgcccccaaaagagcaatgacaccgttcatgtatttctcaatggctgaacgaggaaacatgaagagcagcaacccagatttgccgacgactgagattgcaaagaagcttggggagatgtggcaaaagatgtcaagcgaagagaagcagccttacatccagcaggcccaggtcgacaagaaacgttatgaaaaagagtctgccgtctatcgtggtgaagctacagctgatgtggattctggcaacgagtctgactagattcaagctcttggagatggtggcactgaatgaaattctagtggcatgtactattattacgtcggcaactgttgccgctaggtgaaattgctagcatgcgtgtgcgcgcgccctacggtgccggcactagtagtttgcctccagcattgctgacagtaaagagggggtttcttgtagcgtacctctgcagggcaaaagattgtatgagtgtagagtctagtgacttttgtggaaaaaccaacatacgtggtttatgagacatggtatttgtgttgaagcttctttatttttccccaagggacgaaaattgatctattgatgatggctgttttgcctgatct

SEQ ID NO: 12938 - DNA, 943 bp, Sorghum bicolor
  unsure (1)..(943): unsure at all n locations
  Clone ID: SORBI-28MAY03-CLUS10886_1
aaaaaaaaaacccggcgcacccgcaccaatcccgagtccccacgattcagatcagaaacgcaaaaggccaatcgacacagacacggacgtttccccgaccaccgcccgacgaatccgcgtccactacaactccggccacccccccgccggcgacgacccaccgccaccagggtagcagcgatccacgcaggcgcgacacacgatgggcggccgcaagctcgcgctgcttgtgggcatcaactacccgggcaccaaggccgagctcaagggctgctacaacgacgtcgaccgcatgcgccgctgcctcatcgaccgattcggcttcgacgaggccgacatccgggtcctcaccgacgccgaccgctccgcgccgcagcccacgggggccaacatccgccgcgccctcgcccgcctcgtcggggacgcccgccccggggacttcctcttcttccactacagcgggcacggcacgcggctgcccgccgagacggggcagaacgacgacaccgggtacgatgagtgcatcgtgccctgcgacatgaacctcatcacagatcaggacttcagggaactcgtgcagaaggtccctgagggctgcctgttcaccatcgtctctgactcatgccatagtggtggcctgctggacagtgctaaggagcagataggtaatagcaccaggcagaataagacccagtcccgtgaacctgatgagcgtcctcattctggttctggcagcggcttccggtcatttctcaaagagactgcccgtgatttgttagagtctgaggggattcacatccctcatagccgccatgggggtgatgacgaggacgatgcttacgcacagccaactggagatggccacaccanaaaccgctcccttccactctctaccctgatagagatgctcaaggagcaaactgggaaggatgacattgatgtg

SEQ ID NO: 12939 - DNA, 1442 bp, Sorghum bicolor
  Clone ID: SORBI-28MAY03-CLUS11054_1
gcacgagggcccagttgaacgagcatgctaagctctccatgttgaggaatgccacttggactttatctaacttctgcaggggaaagccacagccatcatttgatcagactaagcctgctctgccagcacttgcacgacttatccattccaacgatgaggaagttctcactgatgcatgctgggctctgtcatacttatctgatggcactaatgataagatccaagctgtgattgaagctggtgtttgcccccggcttgtggagctcctcctccatccatcaccatcagtgcttatacctgctctacgaactgttgggaacattgtcactggagatgatatgcaaactcagtgtatcattgatcatcaagctcttcctcgcctcctgaatctattgacacagaaccacaagaaaagcattaagaaagaggcatgctggacgatttcaaatattactgctggaaacaaagatcagatacaggctgtcataagtgctggcattatcgctcctttgttgcaactgctccaaacagcagagtttgatatcaagaaggaggctgcttgggccatctcaaatgctacctctggtggttcccatgagcaaatcaagtacttggtggcagagggctgcatcaagccattgtgcgaccttcttgtttgccctgatccaagaattgtaacagtttgtctggagggtcttgagaatattcttaaagtgggggagtatgacaagaacatgggtggtgcaacagctgatggcaatctctttgctcagatgattgatgaagcggaaggcctggaaaagattgagaacctacagagccacgatattaatgaaatctatgaaaaggctgtgaagcttcttgaggcatactggatggaggaggaagatgacacaatggctactgctgcggaagctggtcccactgtttttgacttcagccaaggtggcaaccctcctgctggtggtggtttgaacttcaactgaatacagtctttaaccaaagggcgttaattccctcggcgatgggcttggcattggcttgtcatgacaatgtaatgtggtcgattacatgtgggataatggtttgtggtgggtccaataagctcaagatttcgggagatgggctagcattattcccaagctgagtcatggatatcaatgtcgcaggttctgtaacaggattataatcgtcgaacatcagagtctttagttttttttaaggctactttctagggtttgcgtcgtttagctatgttatatctggcatagtgtagcctgagtgcaatcatctgcaaggccgaaagacattcctgagtggtttggttttgaggttccttaggaatggtctgcgttacagtttgtccggagctgtaaacctttaacggtttgagtatattgctcggccttgctttactacggtggtcccaaccagttgaggct

SEQ ID NO: 12940 - DNA, 1611 bp, Sorghum bicolor
  Clone ID: SORBI-28MAY03-CLUS11278_1
gcacgaggtgaagacacagagcagcatacatactccttccaagctgacatgggctcggccatttcaagctctgctctctgctgggttgatcttctgtcaggtatcctggtctgtgataacatcaggaggttcgttactggaagcaaaggtgatgacttggtgttcactttcatcccattgcctgaggaatgtgccctcaaacctgaccctctgtttcgttgggggcgggcaccagaggggtaccgttcaatgtgttgtatgagctctgacagcatcagattcgtctctatggataaccatagccatgaacactctatcactgaggtgatcctcaggacgtggactcttacattccccctaaggaacaaattgaggaacaactggaagtgggagaaagactcagccttgtgcatggaaaacctctttgatacctttcctatcttgaagaaggacagtaagctgcagcagctcgtgctcagtcgccctatcatttatggtttaactcatgctgtccacctctctgttactgaccttgaatacatgcttgagcatcagcattggaaagtttcagcattttatgagctccaaatcgacatggacatgcaaatggtctcatctgtgttcaagttaccctctggaagtcctattgttcctccctcacatatatttgcttctgcagttggccactacatgaactcaactgagttgcatccagcaaagtcaactgcttgcgaagtacaggctgctgagacagaaggggttcttgattcaatgagaaaaaaagttgcaaatttctcaactgcttttggagtacaggctgctgagggagaagaggccgatgagtcgatgggaaaagtatctgcaaagaagtgctatgacctacctgagggaaagtatccgccagaatttattgcaacgcatatgagattgaagcagcagcatgagaaggaggagtgtaggaagaagtatattttgcagcgggatgagaggaagaagatgatgagtaaagaaaggaagaagggtagactaagttcaaagggtggactaagttcaaaggaaggagctttatctgtgactactactaaggcaagcacccagtagacattagattggcagccatgaatggatattattgttactgctatgtaatcagccagtagacctttgattggcaggcatcaaatggatattatcgtgactaccatgtattcacccagtaaacctttgactggcaaacttttggccagtagaccatgctatcagttgtataccttaccgcgctctggctaatgtggggaaggaaaacatttgatctcctgcggtcctgcccttcctggaggcatatatttaaggtatcctctgaatagagtgttcgaaacaggaatggggacttcgagtgccactgtggccggaaccaaggaattttgtatgtccattttatttttatcatttagagccgtcgaggtgcgcatcgagtacaggagtattatggtttacctgcggtactggtgagctgtggttccccacccatgcccaaagctgtatgttggttgcctacctgatatgtattttattaaactaccattgctttttgtatatttaaaaatacat

SEQ ID NO: 12941 - DNA, 998 bp, Sorghum bicolor
  Clone ID: SORBI-28MAY03-CLUS11739_1
gagaaacctgcaggcatcttgcatcttctctctagctttttgtttgtgcagaaaccagataagctttaatttgtccgggggtggcctccactatatataccataccatcctagttcggggatcggccggccggcttcagcaatcaacaatatataatcctcctatcttcagtcttgacacaagcaagctactctgctctgctctgctctgctctggtctcctgtcagtcagagtttgagaggatcggatcgggcgacggcgagctgagatagaggcaaataaggcggcagcagggagcatacaccggcgtgcagttccgccatgggcatcctggaccacttgtcgcatctgtgcagcctcacggagacgaaggaggcgctcaagctcaggaagaagcgaccgctgcagacggtgaacatcaaggtgaagatggactgcgagggttgcgagcgtcgtgtgaagagcgcggtgaagtcgatgcgcggggtgacgagcgtggcggtgaacccgaagcagagcaagtgcacggtgacggggtacgtggagccggccaaggtgctgcagcgcgtcaaggccacgggcaagaacgccgagatgtggccctacgtgccctacgcgctcaccacctacccctacgtcggcggcgcctacgacaagaaggcacccgcggggttcgtccgcagcgcgccgcaggccatggccgaaccctccgcacccgagctcaagtacatgaacatgttcagcgacgaaaacgtcaacgcatgcacggtcatgtgagcaaattccatgtatatatatggcgatggcgatggccatggcgatgaatgatcgatgatccatcacaagaattccatggtcctatgtatgtatgttatgtagtacgtacgcgtggtcaagtactagccagtgagagtgtatatttttgtttgtgtatatctctgtggttcgtcctcttcgttcaaaaagacaagagaactacgaaccacgcccgcaccggc

SEQ ID NO: 12942 - DNA, 1952 bp, Sorghum bicolor
  Clone ID: SORBI-28MAY03-CLUS11438_1
gcacgaggcaagcaaaaagatcgaaattccaaatggaagggttggtgttattattggaaaagctggcgaaactattaggtatatccaacttcaatccggagcgaagattcaagtaacaagagaccatgaagctgaacctggtgcgctcgcggggccagttgagctttctggcaatcctgaccagataagcaaagctgaacagttgatcaaagaagttctggcagaggctgatgctgggtcatctggtggtggatctggccggaaatacaatgcaccacagcctggcggtgagacgttccagatgaagattgctaataacaaggtgggactggttattgggaaaggtggtgagactataaagtcgatgcagcagaaaactggagctcgtattcaggttattcctttgcatctgcctgctggtgatacttcaactgaaagaactgtgcatattgatggcactccagaacaaattgaatctgcaaagcaactggtgattgaggttaccagtgagaatcgtgccaggaatccaatgtctggtggctattctcagcagggctatcgtcctcctcgtcctcagtcaaactggggcccgccttctgcaccaccccagcagcctggctatggttatatgcagcctggggcttatcctggggcaccaccacagtacggtgcacctcagcaaccttatggtagttatcccccaacatctggtggctatcagactggatgggatcagtctcaaaaccagcaatctcatacaaccccccctggtactgggtatgattattatagccagcagcagcaacctcaacaacaacaatctgcccctggaactgctgcttctactgatgccactagctacaattatggccagccttcgacgtatgcttcacaaggatatgattctacctacactcagcagagtggtgggcagcaagcatatggacatgatggctactctggttaccagacccaagggcagcagcagggatactctcagcagactggttatgaccagcagggctatggtgcatctgcctatggatctgctgcaaactcgacccaggatgggtctgcagccagctatggtggtcctggtggggccagtcaggcatctccagggcagcaatctccaaccccagctgcaagccaccctggctatgccagccaaccgcctactagtgctgcagcaagctacccaactcaaggttcagctccatctggatatggtgctccaccaccccagtctggctatggcacccaaccgcctggatatggtcagggcgcttatgggcagccttctccacagggccagaaacctcctgcatcttcaccttatggacaggctccacctcctggatctgctcagggtggttacgggcagtatggttacagccaacctgcttacggtgcaccaccagcttaccctggtgcaccccattcaagccacccgggctatggtcagcaacaatcttatggggatgcttatggtagtggaaactatgggcagcctccagcctactctactgaagcaacagctgctgctgcatcccaggatcactctgctgcccctgctgctgcccctgcaacaacagctgcgccagctcctgacaacagtggaggtgcccaaacatctgcggaaacttaagattcatcagctggttgggagcaaacatttttcaagcctctgctatgtggtttcctctgcactgttgcttaatgttacgcacctagtttagggtccacatctacaagttatatctttttttgcctgttgttttgactctatgaatatctatttccttgctattgattagtactttgctgttttttgttgctggtgcatatgtttggactggtgatatatgtgcttgtgtggttactcttgtcggcttgttctggacagatacctgccatctatatgtattgtgagcctccttttaaaacgaaac

SEQ ID NO: 12943 - DNA, 1108 bp, Sorghum bicolor
  Clone ID: SORBI-28MAY03-CLUS1180_1
cctccgcacaagcacgcggcacaagcgcccagcacgctctcgcagtagcagcgagcgagcgtgccgagggagtgagaggtgcggagcagtcgccggcgtcgaccttcgttgtcggagatgaaggagagaagcggctccagggcggcggtggacgagcgctacgcgcagtggaagtcgctcatccccgtcctctacgactggtttgctaaccacaacctcgtctggccatccctctcctgccggtgggggccacagtttgagaaagctacctacaagaatcgtcaacgcctttacctatctgagcagacggatgggagtgtgcctaatactctagttatcgcaaactgtgaagttgtgaagccacgggttgcagctgctgaacatatctcgcagtttaacgaggaagcacgatcaccttttgttaagaagtacaagaccatagttcatcctggtgaagttaacagaatcagggagcttccacagaacagtaagatcatagccactcacactgacagtccagatgtacttatttgggatgttgaagcacagccaaatagacatgccgtcctaggagcttctgaatctcgccctgatctgatattaacgggacataaggaaaatgcggaatttgcgcttgctatgtgcccagcagaaccatatgtcctatcaggaggaaaggacaaatctgttgtcttgtggagcatccaagaccacatatctgcccttggggattcctcgtcttctcctggagcatctggcagcaagcagtctggtaaatctgcaactgaaaaggagagccctaaagttgatcctagaggtatattccacggacatgacagcactgttgaagatgttcagttctgcccttccagtgcgcaggagtttgtagtgtgggtgatgatgcttgtcttattctgtgggatgctcgaactggcactggcccagctgttaaagttgagaaagctcacagtggagatgttcattgtgttgattggaatccccttgacgttaactatatcttaactggttctgccgataactctgtccgaatgtgggatcgtcgtaagctgggttccggaggagctagttctccaattcataaatttga

SEQ ID NO: 12944 - DNA, 1337 bp, Sorghum bicolor
  Clone ID: SORBI-28MAY03-CLUS16172_1
gcacgagggctaggcacagttgagctacgtccgctaggcacagttgtggctgtgcagaactccaccaccacgaacggagaaggcggcggccatggccatggaggaaacgagcaagataacgggcaggatgaagggtggtcttagaacaatgcccttcatcttcgccaacgaggtggcggagaagctcgccgtggtgggcttctcgaccaacatgctgacgtacctcaccacgcagctgcacatgccgctggcgaaggccgccaccacgctcaccaacttcggcggcacctccgccgcgacgcccctcatcggcgccttcctcgccgacgtctgcatcggccgcttctggaccatcgccgccgcctccgtcgtctaccaagtcggcatggcgctcctgacggtgtcagcggcgctgccgcagttccgccctccgccgtgcaagcccggcggcgcggtgacgtgccaggaggcggcgccgtggcagctggcggtgctgtacgtgtccctgctcctcaacgcggtgggcgccggcgggtaccgcccctgcatcgtggcgttcggggcggaccagttcgacgagtcgcgggcggcggagcgcgcccggagctggggcttcttcaactggtactacttctgcaacggcgcgtccatgctgctggccgtcacggcggtggtgtacgtgcaggacaacgtgggctggggctggggcctcggcgtgccggccttctgcatgggcgtctccgtcgccgccttcgtggccggggcccccgggtaccggaggctggagcccgcggggagcccgttcacgcggctcgcgcaggtggtcgtcgccgccgtcaagaagcgccggctgccggcggcggacgtcgtccccgcgaggctgtacgagaacgacgacctcgacgcgcccatctccatgtacggcaagcttgtgcacacggatcagctcagcttctttgaccgcgcggcgatcgtcaccgacggcgacatggtcacgcagacggacgccgactccggcaagccgtcggcggcccccgtcccgaacccgtggcgcctgagcacggtgcaccgcgtggaggagctcaagtccgtgatccgcatggggcctatctgggcggcgggcatcctggtgatcacgggttcatcgacgcagcacaccttctccctgcagcaggcgagcaccatggaccgccgcctggcgccgggcctgtccacgttccagatcccggcggggtccatgaccgtcttcgcgctgctcgccatgctcctcaccctgttcctctacgaccgcgtgctcgtccgcgtggcgcgccgcttcacggggctggaccgggggg

SEQ ID NO: 12945 - DNA, 711 bp, Sorghum bicolor
  unsure (1)..(711): unsure at all n locations
  Clone ID: SORBI-28MAY03-CLUS15339_2
gccggccgggccgggctcgcagtcatcccccgagaaggagccgccgccgccgccgccgcgcaaagccgcttcgacgccgttagtcctcctcggggcgcagccatggtggccgcaaagaagacgaagaagtctacggacaacatcaacaacaagctgcagcttgtgatgaagagcggcaagtacacgctcggctacaagactgtcctcaggaccctcaggaactccaagtcaaaactagtgatcattgctaacaactgccctccgctccggaagtctgaaattgagtactatgctatgctggctaaggtcacagtccaccacttccatggaaataatgttgacctgggaacagcctgtggaaaatacttccgtgtctgctgcctcagtattattgatcctggtgattctgatatcatcaagactacgccaggtgagcagtaacgaagccacaccagttcctcttctcggcaccgggcttatgaactgttttagtgttgtagtggatcttgctggactcgttctttattgtgttccacagcatttatatgccagtaaaacagagtcctcgggaaacattgtcttcgattgaaaattttgttaatggcatttggcactgttgaatggaacatttggctgaatgtgcctggatcagagctgttagaaaaaaaggccccctttactggcattccnntatatctttatatatggggg

SEQ ID NO: 12946 - DNA, 639 bp, Sorghum bicolor
  Clone ID: SORBI-28MAY03-CLUS15339_1
gccggccggtgcccgatcctcgcagtcatccccgagaaggagccgccgccgccgccgcgcaaacccgcttcgacgccgtcactcctcctcggggcgcaaccatggtggccgcaaagaagacgaagaagtctacggacaacatcaacaacaagctgcagcttgtgatgaagagcggcaagtacacgctcggctacaagactgtcctcaggaccatcaggaactccaagtcaaagctagtgatcattgctaacaactgtcctccgctccggaagtctgaaattgagtactatgctatgcttgctaaagtcacagtccaccacttccatggaaacaatgttgacctgggaacagcctgtggaaaatacttccgtgtctgctgcctcagtattattgatcctggtgattctgatatcattaagactacaccgggtgagcagtaaggaagccacaccagtagagcgctcttgtgcaatagtgctgtagcggatcttcttgctggacttgtcttttgttttgttcctatagaatttacctgacagtaaacagagttcgtgggaacattattctctttgattgaaaattttgtacctggcaattgagtaattgacattgttgaatggtgaatggatcttatgctga

SEQ ID NO: 12947 - DNA, 1383 bp, Sorghum bicolor
  Clone ID: SORBI-28MAY03-CLUS16397_1
gcacgaggcgcccgccgccgtctctccaaaacccaaccaaaccctagatccgccgccctcagctccggtgagacgctcctccccagcgaagatgccgaacctcgagtgccggatgtatgagcagcggttcccggaggtggacgccgcggtgatgatccaggtgaagcacatcgctgacatgggcgcgtacgtctccctgctcgagtacaacaacatcgagggcatgatcctcttctccgagctctcccgccgccgtatccgctccatctcctccctcatcaaggttggccgccaggagcccgccatcgtgctccgtgtcgaccgcgacaagggctacatcgacctttccaagcgccgcgtctccgaggaggaggcgcacgcgtgcgaggacaggtacaacaagtccaagctcgtgcactccatcatgcgccacgtcgccgagacgctcgaggtcgaccttgagccgctctaccagcggattggctggccgctctaccgcaagtacggccacgccttcgaggccttcaagctcatcgttgccgaccctgacgccatcctcgacgcactcacctatgaggagaaggaggtcggcccagactgccaggaggtgactaaggtggtgcctgctgtcacccctgaggataaggattccctggtgaagaacataaggaggaggatgacaccacagccactcaagatccgtgctgatatagagatgaaatgcttccagtttgatggagtgctccatattaagcaagctatgaagaaagctgaagctgcgggcaatgataactgtcctgtgaagattaagctagttgctcctccactttatgttctgaccacacagactcttgacaaggaacaaggcatttcagttctcactgatgcaatcaaggcttgtacagcagagattgaaaaatacaaaggaaagttactagtgaaggaaccaccaagagctgttagcgagcgggaagacaagctattcctcgaccagattgattctcttatggagcaaaatgcagaggtcgatggtgacgctgacagtgaagaggaggaagatacaggaatgggcgatgttgatattacaaattctggcgtcactgcttactaaggctacactggttgatttggatgagatttgctgtatagcaccagctaagatctaagccgttctgtttggaagcagttccttttttgttaggttttggtggctgaaatgcccgtgaattcactgaaacttgttacttgcggtgttaatgttttgggttcagccggtgttggggtagcttttacttctgtcgagaagcatcaaatttttcttgggagtgagaacagaggtcgttgctatacagtgtttattcacttcatatacgcagtattggt

SEQ ID NO: 12948 - DNA, 811 bp, Sorghum bicolor
  Clone ID: SORBI-28MAY03-CLUS1653_1
ccatcacttgcggctggactcgtctgatgacctgtttgcatacatagcttaccttttggttcatcaggagagcaaagttccagggtcgcaggcgctgatgtcggcgcaacagatccaatccttgagccttcaattgattgggaaggactagtaggaccacgtacgtcgtgcccccgtagcttttggttcacatgtaatgccagatgttgttgccggcggaaaaacacaaactgttgttgctattggcagctagcgaaagacggataagaactccgacgtcttgccccgtggtacttcgcattctttctgatctctgagacgggtcagctcccatcaaaatgtatcgctactgcgtgctctatccagtccacacaatagatctgctccaaggaacatacatagcagagattgccatatgctgtcagttcatagccatttcttgatgttgatgctgcaatgtaattgtaccatgaatacccccaaatgtaagacgagcaccgtgttccggcccctccctccattgcagacgtagcggagacgttgcaaatcaagatttcagacatgtcctcctgatgtcatttttgccttgttattgcgattacccgctgatgtactactagtacctgagtctcagattcttcaaacctgtacagttaatcttttcatttcattcctcacccgcgctgtagaccacaggcagagtcattcaattttcaagatgcctgtcatctgtcaatgaaatctacacgcctctggcggtgcaacttgtacacagcatttgttcttgataagacataaagaaatttttgct

SEQ ID NO: 12949 - DNA, 1612 bp, Sorghum bicolor
  Clone ID: SORBI-28MAY03-CLUS12444_1
gcacgagggtcgaacgtcaccgaggcggacttcaggaggtactttgagcagtttggcgtcatcactgacgtggttgtgatgtacgaccacaacacgcagaggccgagggggtttgggttcatcacctacgattcggaagacgccgtggacaaggccctgcacaagagcttccatgagctgaatggtaagatggtcgaggtcaagagggctgttccgaaggagcagtcgcctggacctgtcgtgcgctcgcctgtgggagtggggcagaactatgctatgaacagggttcatagcttcctcaacggcttcaaccagggttacaacccaaaccccattggaggttatggcatgagggtggatggaaggtatggcttgctttcaggtgcacggaatgggttctcttcttttggcccaggttatgggatgggcatgaatgtcgaaggcgggatgagcggaacgtttggtgcaagctctggtttcatcagcaactccaatgggaggcaaatgggttcgtacttcaatgcaagttccaacaggttgggtagccctatggggtaccttggtcttaatgatgttccaggatcaatgttgagctccatgtctaggaatgtttggggtaatgggagtctaaactacccgagcaatcctacaaacatgaatgcttttgcttcacctggaaatgggggtcaagtcggtattactggcgacagttggggaggtctcccttctgctcatgggatgggaagcatttcaagccttgggtcagggaatcttggtcgtggagctggagataatacctttggtttgccttctggcagctatgggagaagcaactcaactggtacaattggtgagcctttttctgcatcagtcaatacgtatgaagtgaacaacccagatacatatgggagcagctctatttatggtggcacagcctggaggttcgcatcatctgaggttgacatgccttcttttggtcatgatattggaaatgtcgatccaactatcaaatgagacatgtcagcaagtcacatgggcaactatcctgttaacaacaatcagccaagcagaggtatcacttcctagggagagtattactatattccatatatgacttggggtagatgaagcacccattcagccaggcatccagtccaggtgcatggctgtgaattggtgattgtcagattaatatacaggttagttttgtctagctaaccagcggtgtggtttgcgaacaccaacatgctagaggtggaggagctgctagaggagggagcggatacagaaacattttgtgaatgtctttttgtttttggggtcatgttttagttttgattcgtatgcgtggtgaggccttttggtttttgaatgagatgtagtaattattgcggcacatatttagaagtccatgttccaacataagctggaaaaatgtctgtatacggatgaacatgtataccaaccaaagggatgctgtattatacatgaaaaaaaaaaaaaaaaaagccccctataaccatttgttttcactctggagattttgctgtcttgctcatgacttatgcatgcagtggtgttttctccccccttttttttttttggctgggta

SEQ ID NO: 12950 - DNA, 1268 bp, Sorghum bicolor
  Clone ID: SORBI-28MAY03-CLUS12609_1
gcacgaggattcagcagtacctggtctaaatcaggggagtgctagttttgacaagaaaggaatggaaattcatctgcctgaagaagataatttgtttaccatgagtgactctctgcctggtcaaaattctgatatttttgcatcagtaggatccagcagggttgaagggctattgcctgaaaaggcagttgatgacctcagttataggtttcaaagtcttgtgcctggcgatgcagaacacattcaagtacttggtcctgatgcacttggatctcatcctcgtgaccagcgttatcaggttgattctcagaatctgtatcatcttctacagggtaggcctcctatgatggcacctcgccctatgatggatcacattgttaataggaaacagccagctccatttgatatgccacagtcgatacaccacgattctcaccattcgtttccatctaatgtgaatcctatgcaacataatcttcatgggccaggggtccctcacttggacccgactgcacatattatgctacaacacatgtccatgcctggaagatttcctccagaaggcttgccaagaggtgtcccgccatctcagcctgtgcatcacatggctggttatagacctgagatgggcaatgtaaataatttccatatgcaccctcgccagcccaactatggagaatttggattgatgatgccaggcccatcagctccagaggtgagaggcaatcatccagaggcatttgaaaggttgatccaaatggagatgtcagccagatcgaagcaacagcaggtgcaccacccagcaatggctgcaggccgcgtacctagtgggatgtatgggcatgagcttgatgcgaagttaagatacagatgatggatgcgcggatgctttcgttccatgcagaggacccggaagtgtggtttgttgtatgcgcgtggtcagacaaatgtgtatcgtttctgttaacaaggtttagcatcagccatcgctcgcagctgattggattggaggtgtctgtctcacttgtaggattatagcatgtatgtacatgtgaatgggtgatggaatggagtgggtctatgatctgtaggagcgggcaagtctaccgggaaaaggggatatgatattgtgctgaatgaaaggcatggtgtcgccgtcttagcagccacctgtgtaatgatgttttctgtgtactgtgtctgacaactacccaattttcattttgtataaacgctgttctgcgaaagggaaaaaaaaactctgcccc

SEQ ID NO: 12951 - DNA, 713 bp, Sorghum bicolor
  Clone ID: SORBI-28MAY03-CLUS12736_1
ggggaagaagtagctaggagcgagagggagggagggagctaccggttatttgcgacgacggcatatcttcgtcgtcgtcttggcggcgtgacaccatgggcgcctattatcgccgcccctcgccgctccagcggcaactactccccacggcggtgctggtgctgctcgccatcgccgccagcagcagtggcttctcgagtgcggcggcggcggcgggccggaacgtgatcacgcacatcaagggattcgaaggcccgctgcccttccacctcgagacagggtacgtggaggtggacgaggagcacggcgcccggctcttctactacttcatcgagtcggagaggaatccggcggaggatccgctcatcctctggatcaccggcggccccggatgctccgcactctctggactcctcttcgagatcggccccctcaagttcgatgtggcggggtacacggaagggttcccgcggctggtctacttcgaggattcatggaccaaggtgagcaacgtcatcttcctggacgcgccggtgggcacgggcttctcctactccgtcgaggaggcggggctcaacgtcagcctgacggagtccgggcggcagcaccatgcgttcctgcgcaaatggctggcggagcacccggagttcgcgtccaacccgctctacatcggcggcggcgcctactccggctacaccgtgcccgtggcggcc

SEQ ID NO: 12952 - DNA, 1090 bp, Sorghum bicolor
  Clone ID: SORBI-28MAY03-CLUS13528_1
gcgcgacggcgacggcccccgcgaggacgggggcgggtccaacaactggcccgaggacaccctcttcttccgcgccgacaacggcgggtggagcacccagtacggcgacttcttcctgtcgtggtactcgcagatgctgctggagcacggcgaccgcatcctgtcgggcgccacgtccgtgttcggcgcgtcgtcgcccgtggaggtgtccgtgaaggtggccggcatccactggcactacggcacccggtcgcacgcgccggagctgaccgcggggtactacaacacgcggcaccacgacgggtaccgccccatcgcggacctcctggcccgccacggcgccgtgctcaacttcacctgcgtggagatgcgggaccacgagcagccgcaggaggcgcagtgcatgccggagcacctggtccggcaggtgggcgccgcggcgcgcgcagcgggcgtgggcctcgcgggcgagaacgcgctgcccaggtacgacggcacggcgcacgaccaggtggtagccaccgccgcgcagcgcgccggcgaggaccggatggtggcgttcacgtacctgcgcatggggcccgacctcttccacccggacaactggcagcggttcgccgccttcgtgcgccgcatgaacggcgccgggtcgtgccgggaggccgcggagcgggaggcgcacggcgtcgcgcaggcaaccgggtcgctggtgcacgaggccgccgtcgcgctgcggagctgacccccaccggaagccgcctgcgatggatttgattgtgtaggggttgggagctcgggttcttgttgggtttttccttttggggtggggaaaaaggaaagggagcgctgccgagagcgagcagagactctcgtgcagctcatcccgcgtagacgacgagattgtgacgaagccggggaaaagggaggggaggacaaaagattgtttttttttgtcacgtttcaggctccgaccatcaccggagtttgttcggggaatatatccatgcatttcctgcagaaatccgcagaaaatgccgtacgtgtgtcctgcactggctgattcggtgctgcttccatttcagtctactcc

SEQ ID NO: 12953 - DNA, 1628 bp, Sorghum bicolor
  Clone ID: SORBI-28MAY03-CLUS1365_1
acgcctccccccccccccgctccggccgcccgccgccgccgcccggcggccgcccggccgcggctcccgctcgctgccgcgccctggccccagccccctcgccgtcgccctcgccgcccggccggcctcctccgccggcccccgctgccgcccctctcgggtggcgcgaccccgggggatcccgtcggcccgtttcttggagaaggagagatggccgaaatggcggtgactgtcgcggccgccaacggcaccctccggacgtgctccggcgtgtcgccaacggcgcccggcggccgccgtgctgcggttcttggtcggtggcgggctcttgcgccagccaacttgagattgtcctctccagctgtgagggttccaagggctacttccgctgcggcggttgaggattggagcaacactgatatagtccctatcccgaaagttataatagatcaagactcagatccggatgcaacaattgtagaaataaccttgggtgatcgtcttggcgagctccttgatacaatgaatgccctaaagaacttggggctaaatgtcgttaaagctagtgtctgtctcgattctactggcaagcataacaagttttctataactaaagcgtccactggccgtaaaattgatgatccagagttgttagaagcaattcgactgacgatcattaacaacatgttagtgtatcatccggagtccagcagtcaattggctatgggagcaacttttgggccagaagcccctacagaagaggttgatgtggacatagcaacccacatagatatctatgatggccctgaaagaagcttacttgtggtggaaacagcggatcgtccggggttgctggttgaccttgttaagatcatctcagacatcaacattaatgtccaatctggagagtttgatactgaggggctactggctaaagcaaaattccatgtcagctacaggggcaaaccactgatggaggctttaaaacaggttctttctaatagcttgcgctatttcttgaggcggcccacaacagaggacgctagcttctagccagatgatcatgatgaagcctcccaactttcttatgagatgggattcacatgaattggataccatcatcaaagcatttgaaacacgtacaataatttattaagattggggaaagtatacttatgctatggcaccaccacttgaaggttccaaggcaggggaatctgttgtatccaagtgcaggagattgctattcttaagcatgcaatgacacatgattattttgctacctcggatacatgtttggtggtaaatataaataagatggaacattgtggggggcatcatcccgtgtctggatgcaaatataccttttattgtcagattaatgatgaagttaccaataaaaaaaaaaaaaaaaaaaaagcccacgcgtccgcggacgcgtgggaaaattcagcagaactaagagcttcatctcctttttgtctataaatattgttacgttataaaaatatttaggccgtttagatccaaaaaggttttggattttgatattgtagcatttttgtttttatttgacaaatattgttcaattatggagtaactaggtttaaaagattcattttgcgatt

SEQ ID NO: 12954 - DNA, 1449 bp, Sorghum bicolor
  Clone ID: SORBI-28MAY03-CLUS12787_1
gtgcccgccccgcgccccgcgcctctctcccctcccgccgccccccggcgcccggccacccccctctcgtccctccgccccccctctcgcgcccgcccccccccccctcctccccccgcgccctcccccatccccccccgcccaccggttcccgccctccgcccccgctgccctctcccgcctcgcccgcgcccccccccttgtggccgctgcccctctccctccccttcgttcccacccgccgcggcccccccgccgcccgggttccggtcccagtctcccccttcttcctccctcaaaccacccgctcgccacccctttccctttccaccatctccccctctccctcttcttcttctccatccagacgaccaggaggaggaggaggaagaacaaccacgaaggcctctctctctctctcgcgctttccccatctctctctctctccccccttgaagcacccccgtagcgagagggagggcggaagaggatgagcgcgtccaggttcataaagtgcgtcacggtcggggacggcgccgtcggcaagacctgcatgctcatctcctacacctccaacaccttccccaccgactatgttccgacggtgtttgacaacttcagtgctaatgttgtggttgatggtaacactgtcaacctcggcctctgggacactgcaggtcaagaggattacaacagactgagaccactgagctatcgtggagctgatgtttttcttctggctttctcactgataagtaaggccagctatgagaatgtttcgaagaagtggatacctgaactgaagcattatgcacctggtgtgccaataattcttgtaggaacaaagcttgatcttcgagatgacaaacagttctttgtggaccatcctggtgctgtccctatcactactgctcagggagaggagctaagaaagcaaataggcgcaccatactacatcgaatgcagctcaaagacccaactaaacgtaaagggtgtgttcgatgcggcgataaaggttgtgctgcagccaccaaaggcgaagaagaagaaaaaggcgcagaggggggcgtgctccattttgtgatttaatcatcagtagacaaagaaacaagggcgaaggtgccatggttttattatcgtcgcgtcttgcttcagcgaaacagcatggatggtcccccaccccctaggtttactggcggctgcagcgagttctcatctctttgtcgaggcattgagcgatatgtttgtttcatttcctccttcctgccttgtgattatctggtgtgtgactgacgaagtcgtggcaattaggtaacttgcttagaaggtatttcccgtgtttgagcaaaaaaaaagtatcctgttatctctgttccataagtagacatgatgtaatcgtactaagtttatttttacttatttcacttcaatggaaaattatgcttcccc

SEQ ID NO: 12955 - DNA, 496 bp, Sorghum bicolor
  unsure (1)..(496): unsure at all n locations
  Clone ID: LIB3480-032-P1-K1-E6
ttttctagttgctttgcgtttacagtggcgtgcggtgtgccttcattcattccttcttgtcctctcccattgtcctctgcccattttttctggtgtggtgaattagttgggcttttagtgatatgtantacacttactgttgttgccattgctcttctgccaggactatgttccgacggtgtttgacaacttcagtgctaatgttgtggttgatggtaacactgtcaacctcggcctctgggacactgcaggtcaagaggattacaacagactgagaccactgagctatcgtggagctgatgtntttcttctggctttctcactgataagtaaggccagctatgagaatgtttcgaagaagtggatacctgaactggaacattatgcacctggtgtgccaataattcttgtaggaacaaagcttgatcttcgagatgacaaacagttctttggggaccatcctggtgctgtccctatcactactgcttcaggagag

SEQ ID NO: 12956 - DNA, 752 bp, Sorghum bicolor
  Clone ID: SORBI-28MAY03-CLUS18903_1
gccggccgggccgggactcttcagctgtccagggagagatgtagcagttgaggtcctggaaagagcatacatgcagtccccccttgtggcatcggtctgggtctatgggaacagctttgagtcattccttgtcgctgtggttgtccctgagaggcaagctctcgaggaatgggcagcagccaacaacaaggccggcgattttgcagagctgtgcattgatcccaaagcaaggagttacattcaggatcagctgaaccaaactggcaagaaacttgggttgagaggctttgagatgttgaaagcagtttacctggagccggtgcctttcagcatcgagaaggacctcatcactccaacttttaagctcaagagaccacagctgctcaaatattacaaggatcgcatcgaccagatgtacaaggatgccaaggaggggagaactgcaccgtgactgtattaccacaagtggctatgatcctgggcattgtgattcctcggaagtgtgtacatattggttatcacaattttatgagttaaaggcatgtgggttctatgtcatgccaaaatgtaggaagaaagtgaattggttaagcagttcgattgtgatagcccattaataaatttagtgacttccactcgaagcctgaaaaggttgaacccgacataaaatttcatcattatatagtaaagttcacctttatcaaatgacagaaaaaactttcccataactttcacagcatataaagtgctct

SEQ ID NO: 12957 - DNA, 1267 bp, Sorghum bicolor
  Clone ID: SORBI-28MAY03-CLUS1901_1
ctactgggcgcgagccgcgaatcagacccgtcatcccgtccaaatccttggcctcccactaccagtgaccgccgcctccgcctacccccaccaccaccatccccggcggtccgcgtagcgcgcgcagatggcgacggcggccacggcgtccgcgacggcggcgacccgcttcacgctcctagcgggcgcggggctccgcagccgcatcagccgccgccccaccgccgtgcggttccagcgccagcgggggctcaccaccaccgcgctactgaagaccgccgacctcctgcccaaggcgcagggccagcccgagacgctcgactaccgcgtcttcctcgtcgacggcgggggccggaaggtgtcgccgtggcacgacgtcccgctgcgcgcaggggacggggtgttccactttgtcgtcgagatccccaaggagagcagcgccaagatggaggtcgccaccgacgaggccttcacgcccatcaagcaggacaccaagaagggcaaccttcgatactacccgtacaacattaactggaattatggattacttcctcaaacatgggaggacccgacttctgcaaattccgatgttgaaggagcatttggggataatgatcctgttgatgttgttgagataggtgaaagacgtgccaatatcggggatgttcttaaggttaagccattggcagctttagcaatgattgatgaaggggagcttgactggaaaattgtggccatttctttggatgacccgaaagcatctcttgtgaacgacgtggatgatgttgagaagcattttccggggacactgactgccatcagagactggttcagagactacaagatacctgatggaaagcctgccaacagatttggtctcggcaacaagcccgcaagcaaggaatatgccctgaaggtcattgaagagaccaacgaatcatgggagaaattggtaaagaggaatattcctgctggagagctctcgttagcctaaccttggcccatgggaagccaccacattctttgaactgctttcataagcatgtcgttttgtatgatgtcaccatgcttcttcgtttgcattccaaacctttttacgaactgtttaacaaaaataatcttatcggaagaataatgattctggtgcgagtttatgagaagggcaaggaatgtttgataagtaattgtcatgttttccaaacacagaaacatgtaatttatgaagttggaacactattgaactgagcaaaagcagtttgaggtcgtt

SEQ ID NO: 12958 - DNA, 1206 bp, Sorghum bicolor
  Clone ID: SORBI-28MAY03-CLUS19583_1
gccgccggactgcggcctgtcaccagccaccgacggtttcggacccgatggctgcctctgctcgccacctcttcctcgctgccttatcagtggccgtgctcgccgtcgcggcgcctcgctcggcggacgcgtggggcggtggccgcttcttcttcagcaagaccgcgcgtcccgcggaagccaccgttgagcccgacaaggctgcgtccgtgcccacccacgccgcggccgcggacaccgatgccgcgccggcgttctcgcgcccctcgacgggcggcggcagcggccgtgggtacgggctctacggccgccccgaggagaactacccgccggactacttccgccgtggcgtgcaccgcaacgccgagaagctgacgacgacgacgaccgacgtgccggccaccgcaggtaccgtggaggcggcgggccctgtaagaggccgcggtggcgaccgcgaacgcgtccggacgacgttccccgaagacggcagcggtaggggccggccgcccaccgacgtgccggccaccaccacccgcaccgaggaggcaggaggcgccggaggagacctcgacggcgtccagccgtacccggaaaacggcagcggcaggggccggccaccgtggtactacacgggcttccacaggcagcaggagcaggagcagcgggactacgggatgagcgacacgaggctgtaccagaacggccgctactactacgacgtggaggccggcaggtacggctacggccgcgagtcgaaccccatgcggacgcgccccgacgtggaggaggaggagttcggctccgggtacggccgaccccgaggcggtagctaccaccagcagcagcagtacggcaacggcgaggagttcgggaatgcagccatggatcggaacacgaacggcgggttccaggaggaagcaggccagagcggattatacattccatgagtttgcatcgtgtcatgtgtcagtactcagtcgtgtgttactactactactaccagtggtgatcgcatcgtgtgctctcctcgtttgctgcaatcgagtagtttgtgggtagaaccagctgcctgcttctgtgcacgcctacgtgcactgacggtgacgcaaccaatgaattaagtagtgtgtgtgtgtacgtactacaatagaatcttgtactgtgtattgcagatcaaaatgcccactgtatatccacgttactgtt

SEQ ID NO: 12959 - DNA, 960 bp, Sorghum bicolor
  unsure (1)..(960): unsure at all n locations
  Clone ID: SORBI-28MAY03-CLUS16377_1
gtaaaagtctacaatatgtttctgctgccacatgcttctatacggtatttatttattgtcatcttgcgatgttacttccagtgacatggaggattgtgcatatattcgaattgaagcttagctttggggatgttgttgctatttggctttcttgtagaaataggtatcccaaatcttagtaggatatgttgaatcactgcttgtattccaattgtggcacaccgccattgaagtgaagcagattaagatgagtttaggattcatcagcgactactacaatatgtttttggggctgcttgcctctctactgggtttcaggcatgccatcttaagatgttacttccagtgacatggaggattgggcatatattcgaattgatgcttagctttggggatgttgttgctatgtggcctgcttgcaggaaaagatcaaattagatgaagactaacttgaattggttgacgaaagtagttgcaaggcttctatttccatagagtacattggagcaggaaatgacatgaagattaatattacaaggatgcaacacacctgagcaaggggcaccggcacttgtaactcagacatccacataagattcattcattttccctccttatggtgggagccagaaagatgagaggagagaggggctagcagaagcagagcaagaagggatttacactatagtacctcataaacacatagagtaaaataagtttattaactcattcatgtttgtgttgcattgtgcccttttcccggtgcctgctggaccaagtgggacgtgtgtatcatggagattggaggccacagagaaagtgtaaggttatatggggcatggcacaatccatgactaaaattttgttcttatctcgaaacaatttatggatcactgtagtaatactattgatcaagtataatagattgattaaganctgtaccactaattttttaaattc

SEQ ID NO: 12960 - DNA, 1960 bp, Sorghum bicolor
  Clone ID: SORBI-28MAY03-CLUS16379_1
ctccatcagacacttgaaactgcacggcggtcaactgatgagcgggagaagaggagcgaactgcagggcctcctttgtggttgcttgcaggtcattatccaaaagttgggagggatggagtcaactaagtactctttcttgcagtatgctgatcagatgatggatctgtttttgagagtttttgcatgtcgaaatgccacagtgcacgaggaggctatgcttgctattggagcattggcatatgcagctggtccaaactttgcaaagtacatggcacagttttatcagtatttggagatgggacttcagaactttgaggagtatcaggtgtgtgccattaccgtgggcgttgttggtgatctctgcagagcactggaagacataattttacccttctgtgattgcatcatgactcagctcctgaaggacctgtccagtaaccagttgcacaaatctgtgaagccaccgatattttcttgctttggtgatattgcactggcacttggggaaaactttgagaagtatttgatctatgcgatgcctatgctgcaaagtgctgctgatttgtcggcccataccacagcaactgatgatgagatgctcgactacaccaaccagctaaggaatggaatcttggaagcctactctggtatcctgcaaggattcaagagttcacctaagacacaactactgatgccatatgctccacatattattcagttccttgatgctctgtacaatggaaaggacatggatgatactgtgatgaagactgcaataggtgtcttgggagatctggctgacacattgggtgtccatgctggccctttgatcaatcaatccacctcaagccaggcatttttagaggaatgcttggcatcagatgatccattggtgaaagaatctgccgattgggcaaggatagcaatcagccgtgcagtttcgggttgatgccacactgagtctcgagtctgcacttgcatccatccgcatgtcatcctgtctgggtcgttgattgcatcatgtccagacctgctcttcggagaagtccaacatctttacagcagagtcggagggtcctcactaactcatgcattcagtacatgtgtcaacccgtgcttcccgcttctgcgagaaaagagggttcaagttggccgcctgctaacttttgctaaaggcatctgcaaccttcatttcttattggaggtgagatgagcttctattgtcacatgacatgctgacagtttcctcggcatggcatgcctaagaattgtggcctatcattcccccctgcattaatcccatgcatcgaactctggtcggatggtcacttgggacaaaaggcccatttgcttgctgctgctccagtaagcaagattgggctcgaacgcattgtcacaggattaatttttgtatcgatcagggtggccaagtccatttatgtcaagacataccctccctgctggtagtaggttgttaatttcctagcattcttttccctttgtccatttgcattgtctttgcatttcattcatggtcggtctgttttgtaagagttgttctggggcaaaacttgtgtcctgtcctgtctgctaccgcgcgctatttgtacaagtcaagtctgtgcgtgcattggtttatttccggggtgttatcggagcagcaggtgtttgtgcattttcacaccttgtttttggtaatctacatacattgttgctccattgcggtttatcaggagctgggcgggtgaagaaacaaagagttatataggtctttgaagtggtttttgctgggggcagaggcaaattgagttgggtgtggtttatgaattgtactatgttgttgtgtggagatctgcctcttgctaccaacataccatatcatcatttgttggccatataagaataccatggtgaaatgtgaattgtctttcgttttacgcccgcaggttgctaacttc

SEQ ID NO: 12961 - DNA, 1428 bp, Sorghum bicolor
  Clone ID: SORBI-28MAY03-CLUS15614_1
ttcggcccgggggcacgtcggttagctcagcagctcgtcaggcatggcggccgccgtggcgctgaccccggcctctccagcgcgcctccctgtccccttccgcagccaccgcgacggccgggtgcgcctctcgacccgccgcccccgctactccgcggggcgctgcagagccacggcccagaccttccaggggggcgccgccgccagctacgcccgcgagatggagcgcctctccgccaaggagtcccttctcctcgcctttaaagatgctgggggttttgaggccttggtcagcgggaagaccagtgagatgcagaggatcgatgtcaatgagcgaattgttggacttgaacgcttgaatccgacaccacgccccacaacgtcgccgtttctggagggtcgatggaattttgaatggtttggtgatagcagtcctggagcatttgcggcccgccttctgtttgagaggtcacctacagctgttgcacactttacaggacttgatgtgttgatcaaggatggatactccaagctctcatctaacctcaagtttctaaatacgatacaaagcaagttcctactgacgactcaattgtccattgagggccccatcaggatgaaagaggaatacgttgagggccttatagagattcccagaatcaatgaagaatcattgcctgaacagttaaaggcgttgcttggccaaactgctggagctctacaacaacttcctagccctataagggatgctgtttcagaggggcttaaagtgccacttggtggagcatttcaacgcttattcatgatctcttacttggatgaagaaatattgattatcagagatgctgctggagcacctgatgtcttaaccagacttgaggggccacaaccgaatccaggtgatggcacagcagatgcagtgatatcagaatatgaaagctaatgcctcagtgctaactgtaactccacacctagctcctgttcatggctcctttctccttctctttggttattttctcaggctcacgcatatataaaggctgtagtgtggtcaacgataacgaccgcatgagtgtttttacttagtagtacatccctttcggctattctgaatgataaattccaagatacggcctggtatcgttcaaaaaaaaaaaaaaaaaatgacactgtgccccatgtccaatgatggtgtgctaatgtagaggccgttctgctctcatcagcagggcagctgtgcagcaccagtggcgacagcagcaactactccctccccccccctctctctctctctctctctctctctagaaaaagctgaatgatgccacagagagttctgctcttttgtaaaacaatcaaaagaacgctccgcggtagacgcaaaaatctgtaacttcatttttctagtgatcatgtctgtttcgccct

SEQ ID NO: 12962 - DNA, 1171 bp, Sorghum bicolor
  Clone ID: SORBI-28MAY03-CLUS17097_1
gcacgtggctcgctcccgccactgctcctctcctccccccccggcctgcctttgccggcgccgccccgccgtctcgaggtgccggccgtcgtcggccccggggacctggaatgcggccgctgccgtgccaagatcccgaggctcctcaaccgcatccctgccctctctttctcctcccaccattcctccgcctgctccgcggactcccaatgccggccatcgtcggctccgtgcaactggaaagcgcccgccgccgagccggcctggagggggccccctggctcgctccagagcctcgttcccgaccaaacgaccaaaccctccctctcctgctccgggctccagcggcggcggaggcggcggcggcggcgaagatgatcatcccggtgcgctgcttcacctgcggcaaggtgattgggaacaagtgggacctctacctcgacctcctccaggccgactactcggaaggggatgctctggatgctttggaattgttccgctactgctgcaggcggatgctcatgacccatgttgacctcattgagaagttgctcaactacaatacactggagaagactgagacaagttaagtgagcacatcatgctccaaaagcactactgtttcgtagtatcatagtgtgttgtatgttgtttcttatccatcaggagagagatgctttgagtgtgaacatgcttttgctcatgagcgtggacttttcatgtgaaattgcatgttgcatctatgccatgacgttggatattttaagtgatataactgtaactgaaacctaatgtatttgtgtggattgaattcgataatattttgttggcaaaaaaaaaaaaaaaaaaggcccctaagcctgccccggcgccgccgccgccgccgccccccccgcagtacgtcccccagcccgtcccccgccccccccccggcggcccctgccgcggcggctgccgggtcgtccccgccgacgcccccgccttcgcctgcgccctcgtgcccgtcctggggccccgggtcacggtgcggctcgccctttagcacccccttaccccccctcctgcccctcctcctctggccccgcgccccgccctccgcccctgccgccggtctgatcccccttctgttccctcttcttttctcgcttcatgtatagcatcagtataccgt

SEQ ID NO: 12963 - DNA, 1270 bp, Sorghum bicolor
  Clone ID: SORBI-28MAY03-CLUS1730_1
catcctatgacacagtttaccacgggggtaatggctcttcaggttgagagcgaatttcaaaaagcatacgacaatggattgccaaaatcaaagttttgggagcctacttatgaagactgcttaaatttgattgctcggcttccaccagtggcttcttatgtttaccgcagaattttcaagggtggaaaatcaatagaagctgataattctctggattatgcggcaaatttctcgcacatgcttggttttgacgaccccaaaatgctggagctgatgcggctctatgtaacaattcacactgatcatgaaggcgggaatgtcagtgctcatactggtcatctggttggagtgctctgtcagatccttatctttctttcgcagcagctctgaatgggttagctgggccgctgcatggccttgcaaatcaggaagtgcttctatggatcaaatctgtaattgaggaaactgggagtgatgttacaacagatcaactcaaagactatgtctggaagacactaaagagtggaaaggtcgttcctgggtttggtcatggagttctgcgtaagacggacccacggtattcatgtcaaagggagtttgccctgaagcatttgcccgaggatccacttttccaattggtgtccaagttgtatgaagttgtacctccgatcctcactgagctgggcaaggtcaagaacccctggccgaatgttgatgctcacagtggagttttgctgaaccactttggactatctgaagcacggtattacactgtcttgttcggtgtttcgagaagcatggggataggatctcagctcatctgggaccgtgcccttggcctgccacttgagaggccgaagagtgtcaccatggagtggctggagaactactgcaagaacaaggctgcttgaagctgttcacaaaaatgctgctttttcccaacgtacgctgttaataattaaacaggagttatagaagtagtcattttccttttggccgttgaatgaataacgcaagagcaagatgctctcaggcggtagaattttgtatcttccgtcacttggtggacatccagatagttgatccgcggcaaaactggcagaagagatcaggacctgctgattaacctttatatgccgacacttgagttttttgaacgttttgttcggcagagttaaatgatagttactgcaaatttgggttatggcatgtatgccggttatctctgaagttctgttttaagttgatccgcgacacggctggattgctg

SEQ ID NO: 12964 - DNA, 1435 bp, Sorghum bicolor
  unsure (1)..(1435): unsure at all n locations
  Clone ID: SORBI-28MAY03-CLUS1705_1
catcacatactgtactntacgttcaattctgttgcccctgaagtccgtgagcataattngttgtggtttcctatttccctttcttgcacgaggggccgggcccgcccgtcccccgcacacggcaagcaacgaaaaaggtcgaaggaggaagcggcagggctcccgagcacaagcacgccacgcgattcccgccgctcccccgcacacggcaagcaacgctcgaggtcgaggctcgtgctcgccccgcgctacccgcgaaagatctgtgcttgcttcgctcgcttgtggcgggtctcgccgctgcgtgggtgccgatgagctgcacgggggcggggcaggccggcggcgggtggctgctcgattacgggctggtggaggaggagatccagggctcggagttcatgtacatggtcgacgacccggccgtctccagcgtgatactggggttcgatgctcccaggaaggacgacggcggcgtccaggacaactccggcgccaagaagagatcccggccagagtccagcgcaccacctggcaccaaggcttgccgtgagaagctccggcgagacaggctcaacgaaaggttcaacgagctctgcgccatcttggagcccggcaagccaccaaaggctgacaaagttgccattctaagcgacgctgcccgtcttctgaaccagctgcgtaccgaggcccagaagcttaagcaatcaaatgaatcactccaggactccatcaagagtctcaaggctgagaagtctgagctgcgagatgagaagacgaggctcaaggccgagagggagaggctggagcagatgctcaagggcgtcagccacgccgcagtggcggctccagcgcccttcgtcccgcaccctgctgctgcagccgccgctccatctttccacccggcggcggcgtttgctcaggctggtaagttcgtgccgtaccccagctacccgccgccggctgcgttctggcagtggataccgccgacgtccctcgacacgaccaaggaccccgcacactggccgccggtcgcctagtcgatctacctaccagctcgccatggcatcattgatcggtgatgcgttgcccgccgtgtgtactgagcttcttgctgtgtcgtatagaatttgaccaaagcatgcctggagaacaacttcgggtgctgattgtgtagcagtgtgttatgcttgtggacgtggcgtgctaaaattcaggcgatcaaggccgattggataagtctatgtaacagccataatgctaaagcaatgaaggtgataatataactgatccagaactattgtagtaaagactctcagtgaccaataccaatctccccactgcttcagactagacatgcatgttcagcacttgtaacaccgagtatgatcatctttgatcatccgctcatgatgcaccattccaggttcaaacg

SEQ ID NO: 12965 - DNA, 1835 bp, Sorghum bicolor
  Clone ID: SORBI-28MAY03-CLUS2319_1
gcacgaggattttgctggggcttattggtgagggcacgggaattgcggcgaaggttctgaagtctatgggaatcaatcttaaggatgcccgagtggaagttgaaaagataattggacgtggcagtgggtttgtggctgttgaaatcccattcacgcctcgtgcaaaacgtgtattggaattgtcccttgaagaagctcgtcagcttgggcataactatataggatctgaacacttgctccttgggttacttcgtgagggtgaaggtgttgctgctcgtgtgcttgaaagccttggtgctgatccaaacaacatccgtacccaggtcataagaatggttggggaaagcacagaagccgttggggctggagttggtggaggaagcagtggccagaagatgcccacacttgaagaatatggtactaatttgacgaaattagcagaggagggtaaattggacccagttgttggtagacgggatccgcgtgggcgtgttactcagattttgggaaggcggacaaagaacaacccctgcctaattggagagcctggtgttggccaaactgctattgctgaggggcttgctcaacgtattgccaatggggatgttcctgaaacaattgaaggaaagaaggttattactcttgacatggggctccttgttgctggaaccaaataccgtggagagtttgaagagagactaaagaaacttatggaggaaattaagcaaaatgaagacattattctctttattgatgaagtgcacacactgattggagcaggtgcagcagaaggtgcaattgatgctgctaatattttgaagccagctcttgcaagaggtgaactgcagtgcattggtgctacaacgctggatgagtataggaagcatatagagaaagatcctgccttggaaagaaggtttcaaccagttaaggttcctgagcctactgtcgatgaaacaatacagatcttaagaggacttcgtgagagatatgaactgcatcacagactgcgatacacagatgatgctttaattgctgctgcacagctttcttatcagtatatcagtgatcgattcctgcctgacaaggccattgacttgattgatgaagctggatcccgtgttaggctgaggcatgcccagctccctgatgaagccaaagagctggacaaagagctgcggcagattaccaagcagaaaaacgaggctgtacgcagccaggactttgagaaggctggcgaattaagggaccgagaaatggagcttaaggctcaaattacagccattattgacaagagcaaggaaatgattaaagcagagactgaatctggtgaagtcggtcctcttgttactgaggcggacattcaacatattgtctcctcttggactggaattcctgtggagaaggtgtcatctgatgagtctgatcgtctcctaaagatggaagagacactgcatacacgtatcattggacaggatgaggctgtcaaagctattagtcgtgctatccgccgtgctcgtgttggcctcaagaatccaaataggccaattgccagcttcatattctctggaccgactggagttggcaaatcagagctagcaaaggctctggcggcctactactttggctcggaggaggctatgatcaggcttgacatgagtgagttcatggagagacatactgtctccaaactcattggatcacctccaggttatgttgggtacactgagggaggccaactaactgaagcagtccgtcgccgcccgtacacagttgttctctttgatgagattgagaaagcacatccagatgttttcaacatgatgcttcagatc

SEQ ID NO: 12966 - DNA, 1236 bp, Sorghum bicolor
  Clone ID: SORBI-28MAY03-CLUS2330_1
gcacgaggcgggaccgggaggctggaggagcagcgggacgagcccccgctggggggaagccagctccgcatcgcacggcgcgccttccagggcgaccgcggcgggggattcaccggcggcgggtcgggctccgggtccggggcctccggcggtggcgacggcaacaagatgctggaccggggcatcaacacggccatcgtgctcggggccagcacctacgcgctcaccaagctgctcaccgtcgaccaggactactggcatggatggacgatcttcgagatcctgcgatatatgccggagcacaactggtccgcatacgaggaggccctcaaagccaacccggttctagccaagatgatgatcagtggcgtcgtctactcccttggtgactggattgcacagtgctacgaaggcaagccaatctttgatttcgaccgtgctcggatgttccggtctggccttgttgggttcacgcttcatgggtcactttcacattactactaccatatctgtgaggcactgttcccattcaaggactggtgggttgtccctgcaaaggttgcattcgatcagaccatctggtctgcaatctggaacagtatctacttcgtggtcttgggtttccttcggttggaatcacctaccactatctacggcgagctcaagtccacattctggcccatgcttaccgctggatggaagttgtggccttttgcgcacttagttacatatggtgtggttcctgttgagcaaagacttctatgggtcgactgtgtggaacttgtctgggtcacaatattgtcgacttactcaaacgaaaagtcagaggcaaggaattctgacagtacctccacaccagctgcttcatcaaaggacaactcacgatagcagccccatagaccttggaaagctgcttggcccttcaggggttatgtaaattgtacaattagctgcagcaactctgcaggtgtaacccttttttttgtagatatatattcatgaaacatgaattgtgcagcatgtgtcatagaatatcaggaagaaatagcttactctacaactacaatagctgatgaaattagagtttgtcggtctactcctagcaatagagtagtagcaatcgttggcacgaggttcattttttttagtggttctgcacactgcactcctttgctggcttgcagtgtcagaagaaagtgctaggcccttgtgcacacaccgattgtgatacggatt

SEQ ID NO: 12967 - DNA, 1274 bp, Sorghum bicolor
  Clone ID: SORBI-28MAY03-CLUS2373_1
atcgctggacatcgagagaccgaagcagcagcagcagcagcagccgaggttccgaattgtccgtcgtgcaaacccagcagtcaagttcgactcagtcatccaacccccgatcgatcggatcagatccacaagcaattaagcaagccacgccgacatgccttcagtcgaggtgggcggcgccgccgggtggaggcccaagcacctccaccagcagtaccagcagaagcaccaccactacacccagcagcagcagcagcagccaccgccccatccccatccccacccgccgccgcaacagcaaccgctggagatccgggaggtatgggcagacaacgtcgaccgcgagttcaagctaatccgcgcggccatcgagcacttcccctacgtgtccatggacacggagttccccggcgtgatccaccacccacccgcttccgtccaccactccacgctcaccccatcacagcgctacgccctcctcatccccaacgccgacgccctccccctcctcctcgtccgcctcggcctggtcttcgcggcgtccccgtcctccccgccggcactcgcgttccagatcaacctccgcgagttcgacccgcgggtacaccgccacgcgccggactccgtccgcctgctcgcgtccagcggcgtcgacctcgccgcgcaccgcgccaggggggtttcggcccgcgccttcgccgcgctgctcatgtcgtcgggcctcgtctgcaaccctgacgtggcgtgggtcaccttctgctccgcctacgacttcgcctacctcgtcaaggtgctcatgggccggaagctgccgcgcgcgctcccggagttcctgcgctacgtcagggtctacttcggcgccgccgtgtacgacgtcaagcacatggctagggtcgccgttgactcctacggcgaggtcgcgctgctcggcgggctcgagcgcgtcgccggtgccctccgggtgcgccgcgccgccggacggggacaccaggccgcgtccgacagcgtgctcacgtgggacacgttccgggagatggctaggctctacttccccaaggaatgcagcctggacgtgtgcgccggcgtgatctacggccttgagctccgccacggcggcggcgacaccactaccaagcccaagccggctaaagtgcgcgctgcgctgcgctgctgagataataatgttgttatcatcatgtacagtacagaacctcccaaactggattttggggggaaataacagtaaagaaacaaagaacggttctttgatgggt

SEQ ID NO: 12968 - DNA, 1355 bp, Sorghum bicolor
  unsure (1)..(1355): unsure at all n locations
  Clone ID: SORBI-28MAY03-CLUS2655_1
gttatannacggatcttcttggaactccatcatctgagaccttatctcggattcgaaatgagaaggccaggagatacttgagctgcatgcggaaaaaatatcctgtgccctttactcataaatttcgaaatgctgatcctttggctcttcgtcttctagagcgtttacttgcatttgatcctaaagatcggcctactgcagaagaggctctagcagatccatactttgcatcccttgctaatgtggaacgtgagccatcaagacatccaatttctaaacttgagtttgaatttgaaagaaggaagctggccaaagatgatgttagagaattgatctatcgagagattttggagtatcatccacagatgctggaggagtacatgaaaggtggagaacagattagcttcctctatccaagtggagttgatcggttcaaacggcagtttgcacatcttgaggagcattatagcaaaggagaaagaggttctccactgcaaagaaagcatgcttccttaccaagggaaagagtggttgtatcgaaggatggcaatactgaacaacatattaatgatcaggagaggagtgcagattctgttgcccgcactactgtgagccctccaaggtcagaagatgccgacatgaatgatgtgaaatccacaagtttaagctctcggagctacctgaagagcgcaagcataagtgcttccaagtgtgtcgttgtcaaaaataaacacccagaggatgatgaaatcccagaggaaatggaaggcgtcgtcgatggattgtctgaacaggtctccaggatgcactcctaggcaggtctgtccacggcgacagcaatcttggtgcaaggtttctatctggtacactgtatgtcgacgatgatacagaggacagcctgggaaagcgaaacactctatggtacactgcccacagctagtacttgggtagaagaggaatatgccaccgtctgatggttctttcttcatcatctgtatttccaccgtgtcatgccagcatgttgtggcgtctctggaagccctgcatggattcatgaagaattcctgagatgtagcactagttagtccatggagggaacagaatgaacaatgaagtatgatcagcctgtcgaccatgaagatgttttcttgcaatggagtctggacctatgtttgagttttattacaacggcttctgccgtacgaagtgtcagcactcagcagtgtatcatccttttttccattttgaggggatatcactacagtgcacattttgcctgtcaagaaactcatgagtaatttctccagtcatataactcataagtacactgaacttccttgggtaacaccttactt

SEQ ID NO: 12969 - DNA, 884 bp, Sorghum bicolor
  Clone ID: SORBI-28MAY03-CLUS16944_1
tggccggggccaagcgcacgagggcagagcagacaaacacgcactgcactttcttctccctcctcctccccactctctaaagcagcaaaagcacttggcaaagctgcgcatccaagctttggtccggactccaccgggaagacaccaacaagccagatagagagaggccagacgagacatggcgacgtcggtggcctgcgccttcttcttcgacgcggagccgctgggcgagcccgggcggcacgcgctggacgcctgcgcgctctgctccaagccgctcacccgcaacagcgacatcttcatgtacaagggcgacaccccgttctgcagcgaggactgccgctacgagcagatgcaccacgacgcggcctgcgcgcggcaggccgccagcagcagccggcggaagcagcagcagtcgcagcggagcaggggagcctctgtggccgccaaggcggacgtgtacgtggccagctagttgacaggcaaagcacagtgaggccaaggaagaagaagaagaaggaggaggtcgtgctggttcatcgagcagctacagctgcaagagatcccgctgggggaggcgctcctggctggccgccggcggccggcgccgcgccgcgcaacgagttttgtgccgggaacagaggcaagcgggggtggatctggagactgaagaaggcgattatgacagcctcatctgcggggttggaaactcagatcgatgccatgcgtgctctccctctccttggttctgttttccctgatgggatctcttgggttgtgtgtgctagaggttgaggcgtgagggtgtgtgcggaagcaccatcggcttgtaaatgtacgcgcggcatttcaagaagttatgatagcccataaattttgatcgc

SEQ ID NO: 12970 - DNA, 918 bp, Sorghum bicolor
  Clone ID: SORBI-28MAY03-CLUS17387_1
gccggccgggccgggacagcgtgacgcagcgctgctcttttttccccctctgctctcgttctcgactcgtctcgtctgatcggggtttggacttcattcgggaagaagatcaaatcatggaggcatacttcttgttccacagcggtcgggcctccgcgtgcgcggagcaggaggaggacatcggcgcgccgtcggactccgagtccccgtccacgtccatgtccagggagtccgcgggctcctcctcctcgtcggagctcgacgacgacgccaccagcacctcctcgggctcggacccggaccgcttcgagatgtccgcgctcatgacgcagctccccttgaagcggggcctgtccaggttcttcgacggcaagtcgcagtccttcgcctcgctcgccgccgtgggctccctggaggacttgcccaagccggcggcccggaagcgcatcaagccgtcgcggagctgcggcggcgccctcgacgcgcacaaccgcggccgcttcctctcgccgcgcaggcattgcaccaagcccaagcccgccgccgccaggaagcaggcggccgcgaggagcggcgcgctgtcggttttcgcggtcgccgccgtcgcgcccaggatgccgccgtcggtgacgaggcctgagggcgtggccgccaaggttctcatcgttaattgagacacggatcggcggacgctgcctgagctcaacgttgacgcacacgacacgcgcgccttgatggggttcgctgtcgcaggcacagctacgcaccgccgcatcacacccctgcctgaactaacagccaaatcagtggcattctgttccgttttttgttcttgtttcccgatgcgtttgtggtctttgtagactgaccactttgtaatgaaaatccacagttcaattagaatggacttttagtggg

SEQ ID NO: 12971 - DNA, 1765 bp, Sorghum bicolor
  Clone ID: SORBI-28MAY03-CLUS1786_1
gcacgaggcagggtttgaacattactgatgcttctcttgccgtgattgggtactacgggaaggcaatcaaagatctgaccctcgctcgcctccctgctgttggtgagaggggattttgggtgatggccaatgccctgggcctgcagaagctcaggtgtatgactgtcatctcctgcccgggacttacggatcttgctcttgcatctgtcgccaagttcagcccaagtttgaagcttgttaacctcaagaagtgcagcaaggtctcagatggatgtctcaaggattttgcagaatcatctaaggtcctggagaatttgcagatcgaggaatgcagcaaggttactcttatgggcattcttgctttcctccccaactgcagcccaaagtttaaggctctctctttgtccaagtgcatcgggatcaaggacatctgctccgcacctgcacagcttccagtatgcaaatcgcttcggtccctcaccatcaaggattgcccaggcttcacagatgccagcttggctgtggtgggcatgatctgccctcagttggagaatgtcaatttgagtggtcttggtgcagttaccgacaatggcttccttccattgttgaagagttcagagagtgggcttgtcaatgttgatctgaatggctgtgaaaatcttacggatgcagctgtttctgccttggtgaaggcccatggtgcttctcttgcacaccttagccttgagggatgcagcaagattactgatgcaagcctgtttgccatctctgagagctgcagccagcttgccgagcttgatctttcaaattgcatggtcagtgactatggtgttgcagtcttggcagcggcaaagcagctcaagctgcgtatcctctcactgtctggctgtatgaaggtcacccagaagagtgttcctttcttgggcagcatgtcttcatccttggagggactcaatctccagttcaacttcatcggcaaccgcaacatcgcttccttggagaagcagctctggcggtgcgacatccttgcttaagaggaacaaggcgattagttgctggagatgctgggtcaaccttctccagatgcaaatatacgaccgtagcggtagtacttgagtctaagctttgtagttgagtctggtttccggctcgtgtttgtgtcatggtgggtctcctgtttgtcttagggtcggttgttttcctagggggtgtttttgccgaggctcgttttttgcaggtatcctcctgtgaggatctctgttcgttgagcctttggcagccattaccatggcaccctgccccctccatcccaacctaagcccttgtgatcagccattccaccatgcagtttctcaagttgtgtttgaagctcaagtattcgtcaagtgtgtgttcttttccagtactcctggttatagagttgcagacatcaacactcttctgattgcaattgtagcaagtccaattgtcggtgtcgctgtccggagaaacttagctccatgtcttgatgtttgggtgtctgcaatctcgccgagtgcagtgtgttgttggtcatgttgctattttacagtgtcggtagggtttgcctatgtacttggggatctggcctttgcaaggttcattctacggagcctttgccttgacaaccctgcgaggttgtttttcttctccagagacctgattttgcaggcaggtggtttgaacactgtaatatttgcaacattcttctgaagataaataaagattgtgtttcgttctgaatcct

SEQ ID NO: 12972 - DNA, 611 bp, Sorghum bicolor
  unsure (1)..(611): unsure at all n locations
  Clone ID: SORBI-28MAY03-CLUS1727_1
gccggccgggccgggacactaattacaagaaataaaagcacctctccccccagctagctagctagctagctcctcatatatattttctttccaccgcaagaggagaggagaggagcgaggctagccccccagcatggcggcggcgaacaacacggcgaggctggccatggcggcggcggcggtgctgtgcctgctgctgctgtcgacggtgccgcaggaggtcgccggcgccgatcaggggcagtacttgtcgtatgacaaggtgctcagctgcaaggcgctgggcaactgcgacgacaagaatcagagccccgaggccaaacgcccgatgaagcctgtcaacggatacacccgcggctgcagcaagatcttcaagtgccgcggctgatcgatgcatggatggatggatgcgcatcatagtccgtgtgggcgtgcatgccaattgccaactgatgtttcttgcgttgcatatcatcgatccgcgagttctgtggctattgtatactgatgtgtccgtatgtggctctcaacttctcatggttaatgtgatatataagtacagtgacaaaaaaaaaaaaaaaaaaggcccctaaaaaaaaaaaggcccctan

SEQ ID NO: 12973 - DNA, 892 bp, Sorghum bicolor
  Clone ID: SORBI-28MAY03-CLUS18067_1
gatccaccagacgcacccaccctcccccacggttttcgcctccccatctcgcccgccgttctcgcccttctcgatctcacctcgcgcccggccgcccgcacctctccccttcgcttcaccaagggtttaggaccggcggcgatggcggcgaagctggcccagctgcgcgcgcaggcggcgcgtgcggcggagttcgcctcgaagcacggcggcgcctactacaaggaggtcatggagaagaacaagcagtacgtcgttcagccccctaccgtcgagaagtgccaggagctctccaagcagctcttctacacccgcctcgcaagcctaccaggtcgctatgaggcattctggaaggagcttgatagtgtcaagcaggtatggaagaacaggaaagacctcaaggttgaggaccttgggattgcgactttatttggagttgagctttatgcatggttctgcgtaggagagattgttggcagaggtttcaccttaaccggctataaggtctagatgatttccactggttaagacctgcttcataatcgatacttttagctgatgcttgtcgaatcgacgatgatacctgccttccttcacaattttgtttcttgtaagagtttatgtagtgctgaatgccagcaaagacgggcacatcattgcaacactgcctcaataatttgctcgctcaattgttgattttggtgcaaaaaaaaaaaaaaaaattgcatctgccacagtccccttttcccctgggcgcggactgatttgggtctttctttctgccctcaaaaaaaattccttgttttccaaatatgaattgtttgggggaacagaacaatcaattaaaagggggtatgaactgatgaaagaatcagaatgagagattttgttg

SEQ ID NO: 12974 - DNA, 1365 bp, Sorghum bicolor
  Clone ID: SORBI-28MAY03-CLUS17574_1
ctcccgcaacgcccttcctctcccgtcaccacgaagatctccacttgctaaccgccgcgcagctcccccacgcagctcccctacccttctcctctccgcgcttgctgccgtcgaggccggcggacgcacgccaccctaaaccccagcacaccgccggacgcacgccaggccaaccgccgccgcgcagctcccccacgcagatcccctaaaccttctcctctccgcgcttgctgccgtcgcggccggcggacgcaggccaggctgccccagcactccgccggacgcacgccaggctgccgccgtccagctccgccacgcagatcccccaccgaggaggccgcacccaccacccgcaggtgaggcagggcggcttcgattgggctgcggtgattcggggggccggatctggctggggcttcgtcggatctcgggctatttcggcgtggttgcattccaaatctcacgatccctaatcttggctgccaccacaatctcgccgcgagcccctggaacatctacacccgcttctccgccgttggcgtcgagatcgcacgccgcggggaaggcgctcggcgctcgcgtcggcggttcgaggccacccgccgtagccgctcccatcgctgccgtaggcggtggctttgcctaggaagagagccttccctgccagttcaacggcgcatctccatctgggcaggcacctttccaaggtcacacgacgcgtctccgtcttccccgacgggcgagctcagcctctgcaacgagtgagctccccggcggcggccgtatcaggctcctctccaaggtcacgcgtgggctccgtcttccccagcgaaccacacccaggcgaggctgcgatggccctggcgggtgctcgtccaaggatccgcgcggtggtgagtcaggatggatgaggggccctcgcaccaccagttattgtgcagaaaggatttgatccacaatggttggcaaatgcactgcggacgacgaacttatccggcgtcctcatcagcaaacttgtctgtataaaaggatcagatgccctttcaaaacacttgaataattatagattattaatggctaagcaaaatcgtttctgctagagtgcacactttatgctgcaaatgccaggatgcgagacattgtcacatcttgtactgctggctaactatctgtgttctctcataagaatcaaaatcggtcataaaaccagatggtgagttttgttatttttatgtgtatgtttgatcattttatatgagaagagccatttcacctaggtgtctggttctaaatagcatatgtatgactttcttatggtcattgtttgttatctaaaaataatcatctctgcccctacataaacca

SEQ ID NO: 12975 - DNA, 1133 bp, Sorghum bicolor
  unsure (1)..(1133): unsure at all n locations
  Clone ID: SORBI-28MAY03-CLUS1797_1
cccacgcatagggcgacattcgttgaatatcacagttgagcgcaaagaagacatccgcgatgggatccctcgccaacaaaatcgtggccatggcggctgtccttgcggcgctcgtcaccggcggctcgtgcgcgcccaagaagttcccgcctggccccaacatcacaaccaactacaacggccagtggctctctgccagggccacctggtacggccagcccaacggcgccggccctgacgacaacggcggtgcgtgcggaatcaagaacgtgaacctgccaccctacaatggcttcacggcctgcggtaacgtccccatcttcaaggatggcaagggctgcggctcatgctacgaggtgagatgcaaggaaatgccggagtgttcgggcaacccgatcacggtgttcatcaccgacatgaactacgagcccatcgctccctaccacttcgacttcagcggcaaggccttcggctccctggcaaagcccgggctcaacgacaagctccgccactgcggcatcatgaacgtggagttcaggagggtgcggtgcaagcttgggggcaagatcatgttccacgttgagaaggggtccaaccccaactacctggccgtgctggtcaagaacgtggcggacgacggcaacatcgtgctcatggaactcgaggacaaggcgtcgccggggttcaagccaatgaagcaatcctggggcgccgtgtggaggtttgacacacccaagccggtcaagggccccttctccatccgcctcaccagcgagttcggcaagaagctcgtcgccccaaacgtcatcccggcgacctggaagcccgacaccctctacaactccaacatccagttctaatagactttgcatgcccttcatccggcctcttatgtttatttgcatgagagaatgcaccgctaataaatagtagtactgagtcttctgcattctagctagtatgtgatccctgttgttgttcgggctcatgatcgaattccaaacagtggaaaataaaaggttgaatatatgtatcgtcattgatggatacttgaaatgtgctattcttctaaacttcaaactgttccaaaaaaaaaaaaaaaaaaaaaaaaaaaaaaaaaaaaaaaaaaanag

SEQ ID NO: 12976 - DNA, 974 bp, Sorghum bicolor
  Clone ID: SORBI-28MAY03-CLUS18110_1
ctgacattgcaatgtgggtatcgggccggttcaaggggcctgccactatcaaggtttcatttgcaagttttgctctacagaaagtcggtaggcatattggagattgggagcatttcaccctccgagtgagtaacttctcaggtgagctgtcatctatctacttctcgcagcacagtgggggtgaatgggttgaagcttgtgatctggagttcatctctgggaacaaagcaattgtttactcgtcgaggaatgggcacgcaagctacccccaccctggctgctacctgatggggtctgagaagcttggcgtcggagttagaaacgatgtggcccgaagtgatttatcagtggattcgagcacgcagtataaaatcatctcagcagggcatctcggagatgctgttgtggaaccatgctggctgcaatacatgagggagtggggacccgcagtcacgtacagctcacgttcagagatagacacggcgcttagcttcttgccgttctttctccggtacacagtggaagcaatattcaacagccttccggcggaattgtacgaggaggaaggtcctacaggacccaaggagaagaacaactgggaaggcgatgagagatgctaggctttgtcgccttcattatttatcccatttacctcttatctgtaccctaaagctgtatttgatgaaaagattgatgtgctatgctatgatagaacatttggtttaggatatgcttgccaagcttgagggttcagtgcacttgtcaggttaaatattgcactgtttatttagctgcagtggtgcaagtgcatgacaacttgtcctgtgcgtctgccaaccaaattgcgcttgtatattgtaccagtcatactttttctagtggagtatttggtaagagccagatatgtagttcaaaattaataacttgggagttcctctcttgcagtaaaacatttgcaaagctttcttagcgcc

SEQ ID NO: 12977 - DNA, 1070 bp, Sorghum bicolor
  Clone ID: SORBI-28MAY03-CLUS25314_1
gaaaggaaggaacatcgacgtttttgcagagaatagcagcttagcaattaatcctcactatatccggtcctggttggatcttttgtcacggacaccacgtgttgcaccttttctgcagaaaaatgatcccttcatatcagcactgaaaaaggaactgtctgaacacactactgatgtgcatattcaaagtgatgcgcttgatggcatgttcactttctatgatgcaacgaaagcaactctaaatgtgtaccaggttgcaagtgtgacctttgatctgctgttccttctggtgctcggttcctatctgatcgttctcttctgtttcctagtaatcactacacggggtgttgatgatctcattaacatattccggcggcctccatcacgcaagctcaagggggcgtaggctataggttatgttttgtgtattagcgccaagagacgcgtgcctagttattagaagaagagatagacatgaggatgacaggcaagctagcttcccacagcacatagacatgtactttcaaaattttactgttcccccgcactccggccaatgtgagtggcttcaagttccagagcacaaaaaacaatttcttccttttttgtgtgaggaattgcgactgtaatttagctgtatgttggttacaattttggcttacttattcgggtggacaggtggttgtgtctgagagacacaaacacgtaccacagctctgaactttggatgctgtgaaattgtttcttgtctgaaacactgaaggcctgccgtgcctgtgtccatgaagtgcgctgctgtagttttaatttgcattgtctggaccaggcatctctcttaggtgttggatttccagcgcctggggctgagctgcattgccgggagcttttggttgaatagctgtctttctagtttttggcttttggaataaacttttagctccaatagttgtaaagcaaacgattggtaaaccaataagtttttcgagtctgtagcatatttgttggggctcttcttcactttgtaatttctcagctcctaaaagctatctttttgttttttaaaattataa

SEQ ID NO: 12978 - DNA, 1025 bp, Sorghum bicolor
  Clone ID: SORBI-28MAY03-CLUS25828_1
gcacgaggcacaaacggaaaaccctcgtctacattcacatctaggcggcccctcctcctcgctccgatccagctcgccggcggccatgtcgcagccggcggcgacggtggccgcggcggcgcagccgcagggtcgcggccccgcggggcgccagggcggcggcggcggcctggggcagaacatcgccggcatcgtgcggatggcggtgttctggtacttcgcggccaagttcttcgggcccaagcgcccacccgcggaccccgggatgctcatgtccaacctcttccagaagggcgagccaatggatatgtggatgtatttgtcagagaacgagaagttcaacgattttgctaatgaggatgcacttatttggcatgagtccaacataccatatgcagtctggggacctaccagtactagaacacgatcattaacatactatccttcagagactctcaagcataatggctctttgtatgctcatgtttactttgcccgctcgggttaccctgtggaccctacagatccagaatatgagcagaaatctgcatttgggaggacacatcctgttgtggcattcttgccgaaatcaaaagctggtaaaaagaagagcttgcttggagattcagaagagcttgaagagcaagcaccacctaaggagaataaagaatttgaggataaagatgagggtcctactgaatatatatcttattggaaaccaaatgtaacaataaatcttgttgaagacttcacacgatatcccaacaataatgtacctcccaacgttgctccatatctgaatgtggatccagctacgggcgattattatcctacagtattcttcaatgagttttggctactgagggataaattaatagcgcttaatgagactgtggaggaattgcctttaaaccttgaagttggtcctattagcatgaccaagtggcagttgtttttacagattgagcagtccttccaggttcatcgtagttatggaagtatgcttgaaggcgaggctgatgaac

SEQ ID NO: 12979 - DNA, 757 bp, Sorghum bicolor
  Clone ID: SORBI-28MAY03-CLUS25854_1
ccaccatgatcgccatgtccatgctcaccaaggaggtgctccgccggaacccggacttcaaccccggtaagcccaccgagtaccggaactacctcgtcatctccgtcgggacagggtccgccaagctcgccgagaagtacaccgcgccgcagtgcgccaagtggggcctcatccagtggctctacgagggcgggttcacccccatcatcgacatcttctcgcacgccagcgccgacatggtcgacatccatgccgccgtgctcttcgaggccctccattgcgagaagaattacctccgcattcaggacgattctctgacgggccatgcgtcgtcggtggacatcgcgacgaaggagaacatggaggcactgattgggatcgggaagaagcttctgaagaagccggtggcgagagtgaacatcgacacggggatgtacgagcccgtcgccggcgagggcacaaacgaggacgcgcttgcgcgcttcgccaagatgctctccgacgagcggaggctacgccaggccaacctcaactcctactagcaggcactagctagctatgttggttctctgttgtatgtcgttggtgattgcaaataattgagcacagtgaatagctgggagagctagtagttcatgtccttgctggtgtgtttgttgtaaacagtgccccatctatagtcgcatcatctgtgttgtcgctctctaactttggtatggtccccagtgcatatgtatgacgatcgtttataatgtcc

SEQ ID NO: 12980 - DNA, 987 bp, Sorghum bicolor
  Clone ID: SORBI-28MAY03-CLUS1998_1
aaggagctggaaagggccaagcactagcatattcgcttaaaaagctaagctcatgtggaaaaccgcccaacaatactcttgtttgtggtgactctggtaatgatgcagaattattcagcatccctggtgtacgtccggtcatggttagcaatgcccaagaggaactacttcagtggtacacagaaaatgcgaaggataacccgaagataattcatgcaaatgagagatgcgcagctggtattatacaagctattggacacttcaagctaggacctaacatttctcctagagacatggagttcccttatgcaaaggaagcctctttcaaacctacagatgctgtagtaaagttctacgttctctatgagaagtggcgcagggctgaggttccaaagtctgattcagttataaaatacttcaaagacatcactcatgcaaatggagttatcatccatcctgctgggcttgaactctcactccatgcatccattgatgcattgggatcatgttatggtgacaaacaagggaaaaagtaccgagcatgggtggacagactttttatcacacagactggttcagatagttgggtggtgagatttgacttgtgggaatcagaaggtgatgtccgtgtgtgctctctgtcaagtcttgctttggttctaaaggctgaatcccccgagggctttgtgctaacccacatccaaaagacatggctgaatggatactcttcaggggttgagcaggcgtctaagctgtagagcaatatacagtctccgctcgcgattggagttttcttgaggatagaatagaataatgtatctacttcatctgagaaaaacttttttctcttgtttataatgttaacttcccaaaacctcactgggaggatctccagggagaggatttggtgcgtaaagataaatgttctgtctcatggctttcatgagaagatgaaataattgattcatcttggtatatatttacgaa

SEQ ID NO: 12981 - DNA, 696 bp, Sorghum bicolor
  Clone ID: SORBI-28MAY03-CLUS20529_1
gccggccggggcacctttgaggcatgtgttggcatattctggccatcaatcatgaagatgagatctcagtacattcccgaggaagcaagaagcacaatcatgaatttcttccgcataccactcaacttatttgtttgtgtggtgctttacaatgtgaatgcattccctatcactgtcatgtttgggatgtgttctatcttcctcttcatggcagcgatcttgcagagacggctgatggttgtctctgatctacacaaatcatcaactaaagcacaagaaatgatcgaggaagatgagccactaaatccttaggtgtcgacagaatcatacgttcaaatcagatatgaagacggcatccatactgcaattcattaccacctgcgcaataagatggacgtcagaaccatgtagtagagtccagttgtttttgtttgtaatttcgtttctgtagtgtagatgtgaccaggctgttagtttgcacctcgggtctgcttatatccacagggcaattatatagttcagcaagtattgaactatacctatgtcccgagaagattagatgagttggcgctgttgtttcttgcaattattttgaaaaaatgttggctttaaagtttaaacaatacacggtatatatattcttgaaagtgttatattactgcatctgataacaattctggctgatgtacatgtagc

SEQ ID NO: 12982 - DNA, 1006 bp, Sorghum bicolor
  Clone ID: SORBI-28MAY03-CLUS2052_1
gcacgaggcagcaggggcaaccgcccggacgtcgacgcagggattttcgtgtcgtggctagacgcccggccgccgtcgtccgtgctctacatcagcttcggcagcctcgcgcacctgccggcgaagcaggtcgtcgagctcggccgtggcctcgaggcgtcggagcggccgttcgtctgggccatcaaggaggccagttcgaacgccgacgtgcaggcgtggctcgccgaggggttcgaggaccgcgtcaaggacagggggctcctggtccgcggctgggcgccgcaggtgaccatcctctcgcacccggcggtgggcggcttcttgacacgtggcgcgccgcgcgccgcgccggcgcccaccgcccgccgcggcccgctgcgcccgtcgccccccttctccgacccggccagcggcggcccgccgcgcgccgccgcccccgccgtcggcgtcaggtccagtgtccgcccgcccgccttcctcttgcccccgggggcgtgcaggtgacgagcgccgacgtggagaaggcggtggccgagctcatggacgtgggtcccgacgggacggcgaggagggcaagggcgaaggagctcgccgcaaaggcgaaggcagccatggaggaaggtgggtcgtcgtacgccgacttggacgacatgttgcgccacgtcgcggagctaagcatgaagaagagccacgtcgaggacacgagcgtgagcactctgccttctgcgccagagcttgggagtaagagcttgcggacctgaggggccggcgccacaagttgccacgatgtcggtgtggtcagcattttagacgatgaattgtttgcagcaaatgcaccatgttacttaagtcttcagtaatctaatagtgtaccaatgcttgcggacaaacgagaaccacaaaacagaggataggatacaaaggacgggaaaaatttaatgtagaagctattcaaaattagttatcgttgctttctctttctatgttttctaacatgatatcc

SEQ ID NO: 12983 - DNA, 1307 bp, Sorghum bicolor
  Clone ID: SORBI-28MAY03-CLUS2067_1
gccggccgggcctgcggaagcagaggcttgtcgcaggttcgcaccttctagaaccatccacttctctcatcctcctcggactcttgacctctcccccccgacctgtgagatccgatcgaattcgtactcccggttcttgtacaattcctctccttgcgtgaccacgcgtcccgggaaggagcgcccgtagatgctcgtcctagggtttccgtttagcggcttctgtggcggggcgccatgaacagcagcaagcaggcgctgatttacagcttcgtggccaagggctccgtcgtgctggcggagcacacggctttctccggcaacttcagcaccgtcgccgtccagtgcctccagaagctccccccccaacagcaccagatccacctactcctgcgacggccacaccttcaacttcctcgtcgaccgcggcttcgtgttcctagttgtcgccgatgaggctgctgggaggagcgtcccgttcgtcttcttagagagggttagggaagacttcatgcagcggtatgggtccagtatcgatgaggaagggcagcacccactcgctgatgatgccgatgaggacgactttctgtttgaggaccgcttcagcatcgcctacaaccttgatcgcgaatttggcccgaggttgaaggatcatatgcagtattgtgttaatcatccagaggaaattaacaagctctccaaggtgaaagcccacctatcggatgtcaaagggatcatgatggacaacattgagaagatattggatcgtggtgagaagattgagcttttggtgggtaagacagagaccttacagtcacaggctgacagcttccacaggcatggcagagagttgaggcgaaagatgtggcttcagaacctgaggtttaagctgatggtgggtggcggcatcttggctctgattctcatcctttggctgatggtctgcaggggattcaaatgttagagcacacaaagttgtttgccttttcttttcaggcgtttgctgtgtttgccgtgtcatgtacacagaattgccaccaaattgtgttttcacagtgctaccggtatcgcaatcatgtagtagtggactctaatccccgcagtctttcccatgttccatatgataatggtaggaagctggagtacgcgtgagaaatgtgtggaggagatatgacatcacgacttaaatatctgtacattccaaaatgcaagctcttattatttgggcggtcccgtctgtactggtgccaacgatcattgtaaatgcagaacgctcttgggtctcaagctatatatatgtttcccgc

SEQ ID NO: 12984 - DNA, 1121 bp, Sorghum bicolor
  Clone ID: SORBI-28MAY03-CLUS20877_1
gccggccgggctcgcggcaaaattctatccatcataaggtgtatgtgagatctacatctgctcagcagagggtaactggtgactcccaagcagtacaaaaatgtattattacagaaagtctggcaaagaccatgcagagagttgttccccagcctgcagcgaaggtcacacatccggttcatcccccgttgtctgttaaggcgccagttggaagatctgacctacctccaaagttttcgggaagtgtggcgtcttcacctgctggagtgatgggaagatttgatcctccacctgttaagatggtgtcacagggagttcagcgtccagcttccatggtgtcacagaaagttgatcctcagttagcgaaggtgttacagaaagaaacgagatctgctgtttgcctaccagacgccccgcagcctcctgttctgcaaaaacccaaggacttgactgttctcaagcagcaggatctcatcacctctttgccaaaagaagagccttgcttctctggtagaagtgcagaaacagttcaagtgcaggatactaagctctcccggtcagatcggaagaaaatccgcaaagctgagaagaaagaaaagaagttcagagatctgtttgttacctggaatccgatatcgctagagaatgaaggttcagatcttggtgatcaagattggctgttgagcagtacaaggaactctgatgctagcatggctcaatgcaaatcaactggtggtgtagggccgatccatccaatggtgcagcagcagccttctttgcaacccagggccacttttctgccggaccttcatatgtaccagctgccatatgtcgtaccattttaaacatctgtcgaggtagatgagaattagatgagatgttgggagagagctgtgtggatgtgggagataatggttccctgccgcagttttccagctttgttccaatcgtgtttgtttgaggccaatagagttctggcaaaacttgtaatgttcgttaattatttcgcacgtttatgtaagcagttgaactgcaaaagcttaactgttactgttgtatgacacgcagtatttgttctatccttaatctcttttatttgtatatatgaatggattaattgc

SEQ ID NO: 12985 - DNA, 1874 bp, Sorghum bicolor
  Clone ID: SORBI-28MAY03-CLUS2181_1
gtttaaagctactgccatggaactaatttctgttctagaacagaagcagaagacggttggtaggacaaaggtgcttcttgatacagttcctgtttacaggctagctgatatttttgttgctagctttgagataagttttgaggagcagctttcgatgctggattcagttgacttgaaagttagactttcaagcgcgacggaacttgtagacagacacctgcagtccatccttgtagctgagaaaataacgcagaaggttgaggggcagctatccaagtcacaaaaagaatttctactgcgccagcagatgagggccataaaagaagaacttggtgataacgatgatgatgaagatgatgtggctgcactggagagaaagatgcagaatgcaggaatgcccgctaatatttggaagcacgctcaaagggaaatgaggcgcctacgaaagatgcaacctcagcaacctggttatagtagctcccgagcctacttggaacttgttgctgaccttccttggcaaaaagttagtgaagaaagggagcttgaccttagagctgcaaaagagagccttgatcaggatcattatggactaacaaaagttaagcaaaggattattgagtatttggctgttcgtaagcttaaacctgatgccaggggtccagtgctgtgttttgttggaccacctggtgttgggaagacatctttggcctcctccatagcaaaggccctgaacagaaaattcataagaatctctcttggtggtgtaaaggatgaagctgatattaggggccaccgaaggacatacattggaagcatgccagggagacttattgatggactaaagagggtatctgtgagcaatccagtgatgcttctagatgaaattgacaagactggttctgatgtacgtggtgatccagcatcagcactactagaagttcttgaccctgagcagaacaaagcattcaacgatcactatttgaatgtgccgttcgacctgtcgaaagtcatatttgttgcaactgccaataggatgcaacctataccccctcctctgttagataggatggaagtcattgagctgccaggctacacacccgaagagaagttaaaaatagccatgaaacatctcataccaagggtactggagcagcatggcttgagtatgacaaatcttcagattcctgaggctatggtcaaactgatcatcgagaggtacacaagagaagctggtgtgcgcaatcttgagcggcgtccggctgcgttggcccgtgcagctgctgttaaggttgcagagcaagattaaaactcttagacttggcaaggaaatacaaccaattactacaactcttcttgattcaaggcttgctgatggtggtgaagttgaaatggaagttattcctatggagcatgacatatcaaacacttacgaaaatccatctcctatgattgttgatgaggctatgctagagaaagtacttgggcctcctagatttgatgatagagaagctgcagatcgggtagcaagcccaggagtttcagttggtcttgtctggacttcggttggtggggaagttcagtttgtggaggctacagccatggtcggcaagggtgacttgcatttgactgggcagcttggtgatgttattaaggagtcagcgcagctagctctgacatgggtgagagcaagagctgctgacctcaatttgtcacctacttctgatatcaatttattggagagccgtgatattcacatacattttcctgctggtgctgtgccaaaggatgggccttctgcaggtgtgacattggtaacggctctggtgtcactttttagtaacagaaaagtcagagcagatactgctatgactgga

SEQ ID NO: 12986 - DNA, 1190 bp, Sorghum bicolor
  Clone ID: SORBI-28MAY03-CLUS2266_1
gcacgaggaaaggaatgcctgtcgcatgtgcatgtgcggttgctgcattcaagctacagcgtccagttcggatgtacctcgatcgcaagacagacatgagaatggcaggcggtcggcatcaagtaaaggtgaagtactccgttgggttcaagtcagatggcaagatcacagccgagcaccttgatcttgggatcaatgctggaatatccccggatatgagtccaatcatcgccgcaccttggtgaggtcctcccagggaggtctgttgcggctctcttgcttctgtcaccgggggctgcacggcaatcccttcatcatttccgcctgggggcgctcctggcgctgcccaggcctcttgcagcgcgcggcataaccatctattgttcaacacaaattcctgaggtcacgcaaaatgtggttgcaaagtgccttggcattccatttcacaatgtccgcctcatcaccagaagagttggaggaggctttggtggaaaggcaatgaaagcaatacatgttgcatgtgcatgtgcggttgccgcattcaagctacagcgtccagttcggatgtaccttgatcgcaagacagacatgataatggcaggcggtcgacatcctatgaaggtgaagtactctgttgggttcaagtcagatggcaagatcacagccttgcacattgatcttgggatcaatgctggaatatcgcctgatgtgagcccaatgatgccacttgctatcataggttctctcaaaaagtacaactggggcaatcttgcatttgacaccaaggtctgcaaaacaaatgtctcatcaaaatcagcaatgagggggcctggagatgtgcagggctctttcatcgctgaagccatcattgagcatgttgcctcggcactttcagttgacactaacaccataaggaggaagaaccttcatgacttcgagagccttgtggtgttctacggagataccgcaggtgaagcttctacctacagcctagttaccatgtttgataagctggcctcctctccagaataccagcgccgagctgaaatggtggagcacttcaatagaagcaacaagtggaagaagcgtggcatttcttgtgtgccaattacatatgaggttaggcttcggccaactccaggcaaggtgtctatcatgaatgatggttccattgctgttgaggtcggagg

SEQ ID NO: 12987 - DNA, 644 bp, Sorghum bicolor
  Clone ID: SORBI-28MAY03-CLUS29215_1
tccccacatcaaggcacatttctcgtgacaataagagatttgccatcatcaccatctctctcctcacagtaatatatcttgctgccattctcataccaagcatttgggacgcattccagtttactggtgccacagctgccgtcctaattggtttcatctttcctgccatggtcatacttagggattcttatggaatcgcaaccaaacgtgacaagattctggctgtaaccatgatcgtgcttgctgttctgtcaaattctgttgccctatacagtgatgcgatgaacatcttccgtaagaaggaagtggcctgaacttaagatttcaaaagtagtcagtggtggatgaagaatgatcgtaatgcaaaactcgatgatacgaaggaagatgatgcacttggcttccgtgaagaaaaaatttatttatcagcacctcggaatttggccacttgaaagaatctgaagcttgaagtttcctggttttgtgtacacaagttggctcagtatccgaattgagccgcatgaaatatatgtatattctatgcgaagagtaaggcttggaaaaagctttctccacaataatgtacagttatgccaatttctgaataaattttgtgaaatgtggacaaaaaaaaaaaaaaaaaa

SEQ ID NO: 12988 - DNA, 1148 bp, Sorghum bicolor
  Clone ID: SORBI-28MAY03-CLUS29227_1
tgcccggccccccactagcaaggccattatgtgatctaatgcatgaggctaaccaagaggtcccaacatggcttgagaactatgctgcccgttcttcatacggtggtggcggtggtagaaatcgccgatcaggtggtgctcgatttggtggccgtgacttccgccgtgaccgggacttcaggggaggcggcggcggaggaggatatagtggcggtgggggtggatgtgggggccgggggctcgggggggctggcggttttggcgccggctcccggcgacgtgcatccacggcgtccgaacacaaccggaaagagagtacgcattgaggtccttcaagagtggagcaacacccatacttgttgcaactgatgtggctgctcgcggacttgacatacctcacgttgctcatgtcatcaattttgacctcccaaatgatatagatgactatgttcatcgtattgggaggacaggacgagcggggaaatctggtctagctactgcctttttcaacgagggcaacctatcactagcaaggccattatgtgatctaatgcatgaggctaaccaagaggtcccaacatggcttgagaactatgctgcccgttcttcatacggtggtggcggtggtagaaatcgccgatcaggtggtgctcgatttggtggccgtgacttccgccgtgaccgggacttcaggggaggcggcggcggaggaggatatagtggcggtggttatggtggtggtggtggatatggcggcagctacggtggaggtgcaactagttcctgggactagatactgattcctagtcaatcgagaactgaactgagatgtgttctgttggcattaaccgaaaacagatgttgagtttgtagtcaaccctagggtggttggtatggtgctggagaaagtccccatataccttagtggaggttggttattggcttattggttattgctctctgtttgcccgtgctgggctattatttgttaccgagtgttattgcccgtgtggaggtagttgggaacttgggatgttctttgctgctcatgttactagttttggatgatgtgtattattgggttgttggttaatagtttctggtggtctcgttgctacggagtattattataccactgataaaaatgg

SEQ ID NO: 12989 - DNA, 1739 bp, Sorghum bicolor
  Clone ID: SORBI-28MAY03-CLUS30452_1
gcacgaggccaggtccttcctcgagtagattcccttcgccactccgttcccaccgcccccgccgccgccggccgcccgatcctttccccgtctgagagggcatccccggccccggcggcgcttgaggaccccgtgggccgcctcgaccgccgccgctgcggcggccccctccccgcgtgcggaagatcccctgcgtcgagggcacgagcaacgtcatcgtcgagttccccggcaccgtccccggccgcgttgtctcctcctgctgcgcccgctgggctctcgcaccggccgaggccatcgcctggggcggaggtccagtctcgccaagctttgatggcacgtcatcggacaagccccgcggaccggccccggccgcgtggcttcgtccgtcggcacgcgcggggctgccatcgcggcggccgcctgagggcaagactcccttcatgcctcctttcctcgcggtggcgagggccagcgcgggcttcgcggccgtcgctcgcctggctgtcgtgggcctcgtgcacggtggattgcttgacaagctcaagacaggacccttgttttggatagatacagctgataagcagccgtgcattggcactggtggaatgattccatggcatctcaaggcaacagggaagctgttccaaaggggggattgcttgacaagctcaagacaggacccttgttttggatagatacagctgataagcagccgtgcatcggcactggtggaatgattccatggcatctcatggcaacagggaagctgttccacagtggccttgcacataaggccataaatgcaatggagatgaacgtggaagcgctgaaagtaatccaaaaacggttttacactgacttccctccacacgagaaagagaagctctataagtttgctactccatcgacaatgaagccaactaaatggagctatccaggtggggggcttaatcaaattcccggcgcgtgcacaatttcaggggatgtaaggttgactcctttctatagcacttctcatgtcatagagaagttgaaggaatatgtagaggacatcaatcagagatttgagacaatacttgatactcgtggtcctgtgtccaaatatattcttcctgatgaaaatctacaaggaaggcttgaaatcacttttgatggagatgtgatgaatggggtggcttgcaatctggagtctcgaggctatcatgcattatgcaaagcaaccaaggaaatagttggccaagtggagccatattccatcaccgggagtctacctctgattcgggaattacaggatgaaggatttgatgttcaaacagctggatatggcttactgaagacgtaccatgcgaagaatgagtactgcctgttttcagacatggcccagggctttgaggtgtttctgagcatcatttcacaactggaagaagaggtctgagccttcttgctgggatagaccaatacctccaatttaaattactcgttgctcagtgatatctgtttgtaactcttatcaagaggccgcgacacggacatctaacaataagattagttggccttcgagcgtctgtttcacgttgagactggagacatttcacctttgtgcaattgttctgcaactctacggtagctgcaagagaggtgggcgtttggacttcatgtctataccagtccctatgtcctaaagaaagtcaattctattttttccctagtcaaatcatgataaattttatgaaatt

SEQ ID NO: 12990 - DNA, 743 bp, Sorghum bicolor
  Clone ID: SORBI-28MAY03-CLUS34856_1
cgcctgagcgagctccgcccgcggcggcggcgccgagcccgcccgcccgcccgcccgcccgccttccccccgccctgggaagaggagcaggaggaggagcaagtcctcacaaaccttgtacagttttcgccgtccggccggccgtcgtactactaccaccacgatgatgatgatgatgatgatgctacgtgtgctccgttcgtccgtctttcttgtggtatatacagcagcgggtttttcatttttattaacagcagttcagttcagatcagaatcagaaataggcaagaggcgacggggagattacgacatcttctcctctcgccaagaagagtacaagtagattgatgttcgccgataccacaccacacagcagcagggagcgagctgagggtcaaagagagaagaaactgaaattcttttcctttataattttttttactgggttttgtcagcaaggttttctaaaagtttgtgttttgtgttcgtgtttgtaaactagcatagcatgggtcgatcgatccatctcttgttcgttgctgtgatctgggggtggagctgtctgtagatataaaattcagcactcaggtcggtcagcgttcgtgttcttgtagtagttgagagaaaaaaaaaaaagatgtcagcttctcgctttgcttaagcgagcgatgaagctaccgccatgtaaccatggttgtacttgctagaaacaatatgtataaaagaaatgaacccgtgtccaa

SEQ ID NO: 12991 - DNA, 1424 bp, Sorghum bicolor
  Clone ID: SORBI-28MAY03-CLUS21806_1
gcacgaggattcatcctcctcgtccactccgcaggggggcgcgacccgtcgccccccccgcccactccgccgcgggagtgccttcggcgccgcctcccccggctcgctcgccgcctcaccctcccccgcacgcggccggtctccgacgccgcttcctcgctgtcggcgcccggcgagcctccgccgcctcgctgtcgagctccctccccctttccgccctgcccccgccggtcgacctcctgctctgtggtcgcggcgttccccgcctctgtaatcccggctgttgccgctccgccggttcttcctcgttctggccgtccctggcccgtcgctcaccggggtctttgattcgtctttccgttccttggtttctgggtttcatatctttgtttcctcgccggtatccagattggttttatttgggaccgaagcctatttcttacgtctctgtactgtcttggtccggtacttttccgctgttgcttttgccttatgtttacaggttacatgtcaccagaccaaaacaaacatgttacagccaggctttatcattgttcgaaactacctcattgggctgagaccatggaatccagaacatggatcaacagcagtctccttacaaaccgtgctaacctcttctccactcaacatacacctagctacaaacataccctcatcagatccacatcaacacctatccactcacattaccggcctaccaccgcatctttgctgcaactccctcatacacaaactcttccacaaaatctgcatcatccattcagtcaactttatatctgctacaactgaatatgaggttagtgcccgcggaaggctaacaatgatcccacaaattgctcatttgggaattagaaacctaagcggacagagtgaggtaatcaacatatggcagttatcttaccagacattcacagacgaaatgctaggcagacaaacaccaccaggagaccgacgatctgacctccgcggatactcagacatcgacacagagcaacgactagaactggtcgacagcgacggaaataacgaggcaacctcccgactccaagtcgcctccgatacttcgtcaatggacacatacaacagtaatgaagaatgagagtcaggccacaacaagtcaaaatccagctacgaacaacagaggcagaatgatccatcagagttcagagcatgtaaacacttgctaatctatatcgtgtccaccacgacgccatgtttataatcagcaacctatcaaactttcgtatgtgtactctatatatccctccactagatcaggcctttccatgtacacataaaggcctactaaagaccatgtatccgtagcttcatgcaggagtatatttacttaacctctgtataattgctatgctgttccggtcaaacaaactgctacaaaacaa

SEQ ID NO: 12992 - DNA, 745 bp, Sorghum bicolor
  unsure (1)..(745): unsure at all n locations
  Clone ID: LIB5048-008-R1-XP1-H12
ccgagactttactactaccacctaccccctacctcgttcccgtcgcttcagaaacccacaaaacggcggccatggcttcggcgcagtctacctcgaccatctcctcaacctaaactcagccacacaccttccttcagaaaatcacctaacctattagcagcaacagtcgacccctcgtcctctccaacatcaactccatcgccaatacagctaagtccatggcgaacaccctactaaactgaagacgccagattcacaccagcttcaatacgtccagatggcgcagcaccggttccagaacctcagaatcatcgataatacagagctcagagacatcgatgccactatgtccggcaacacagtcttcgcaacagtcccggatactatctcggacacattcaaccactatgacctcgcggaggcaatccaacaacagttccagataaacatcgaggtagaagacatatccaggatactcagacatcgacacagagcaacgactggaactggttgacagcaacggaaataacgaagcaacctcccgactccaagtcgcctccgatacttcgacaatggacacatcagacaacagtattgaagaatgaaagtgaagccacaacaacaggtcaaaacccagctacgaacaanagaaccaaaatggtccaccagaccatatagacacttactaatctatttcgtatctaccacgatgctatgtttggtatcagcaacctatcnaactttc

SEQ ID NO: 12993 - DNA, 634 bp, Sorghum bicolor
  Clone ID: LIB5121-008-A1-PF1-E12
tggattttcctcctcgtccactccgcagggggaggggtgtacccgtcgccgcttcttccttgtcgttcgctggatttccttccataatcggctgccgagctcacacggcgtttcctcgctgctcgcgcccggcgagcgtccgccgggtggttgttgcggtggtcgcccctttgggcactgctgccgcggcttcgtctgttcttccccgttctggctgtgctcggtctgtggaaacccgggtgtttggattcggctcttcgttcattggtttttgggtttcatatcttagtatcgtcgcctgtttacagattggttttatttgggaccgaagcatatttcttacgtctctgtactgtcttgttcagaaacctaagcggacagagtgaggtaatcaacatatggcagttatcttaccagacattcacagacgaaatgctaggcagacaaacaccaccaggagaccgacgatctgacctccgcggatactcagacatcgacacagagcaacgactagaactggtcgacagcgacggaaataacgaggcaacctcccgactccaagtcgcctccgatacttcgtcaatggacacatacaacagtaatgaagaatgagagtcaggccacaacaagtcaa

SEQ ID NO: 12994 - DNA, 1576 bp, Sorghum bicolor
  Clone ID: SORBI-28MAY03-CLUS24576_1
gcacgaggcccgccccagccacgccggaagaggccgccgcgtgaggtcaccgtccccgttgctgccgcctctaacccgaagcccaggccgccgccggtgcaaagcaaggagaatcaggcggaggggggagcagcagcggagggggcagcagctgaggagggggagaagtaccggccggcaccggaaatcctgccgctgccgccggccatggcgaagctggggccggggcaggggctcgggtgcgaggcggcggaggggtcgctcgtgcccagccggaagcgggagtacaagccctgcggcaagcacactgaggggaagcgcccgctctatgccatcgggttcaacttcatggacgcgcgctactacgacgtcttcgccaccgtcggcggcaaccgcttgacaacttaccgctgccttgagaatggtagttttgctcttctacaagcttacattgatgaggataaggatgagtcattctacactctaagctgggctcgtgaccatgttgatggctcaccactgctggtggcagcaggaagcaatgggatcattcgggtcatcaattgtgctacggagaagttagctaagagctttgttggccatggtgactcaataaatgagataagaactcaaccgttgaagccttcgctcatcatttctgcaagcaaggatgaatctgttaggctatggaatgtccatacagggatctgtatcttgatatttgctggagctggaggtcatcgcaatgaagtgttgagtgttgactttcaccctagtgatatcgagcgttttgcaagctgtggcatggacaacactgtgaaaatctggtcaatgaaagaattttggctatatgttgacaaatcatattcatggactgaccttccatcgaagtttccaacaaaatatgtccagtttccggtcttgattgctgcagtacactctaactatgttgactgtacaagatggcttggtgacttcatcctatcaaagagtgttgacaatgaaattgtgctctgggaaccaaagacaaaagaacagagtcctggggagggaagcatcgatattcttcaaaagtaccctgtcccagaatgtgacatctggttcatcaaattttcatgtgattttcacttcaatcagttggctataggcaatcgtgaaggaaaaatatacgtgtgggaagtacagtcgagccctcctgtcctaattgctcggctgtataatcagcaatgcaaatcgccaataaggcaaactgcagtgtccttcgatggaagcacaatccttggagctggcgaagatggcaccatctggcgatgggatgaagtggatcatccgagcaccaaaaactgaagcaagtgttgctgctctgccaccagtggtagttctggactgatggttatgctcagttggggttgtgatgatttaatctctttgtggaaggtgcaacctggtggttttttagtcaaaacggttggtgttaactgaatgttgaatgttatgcttcgaatgttgtaagttgggatacttgtgctgttactttgctccgtggacaagtaaacttaaatcgttgttgcaactc

SEQ ID NO: 12995 - DNA, 983 bp, Sorghum bicolor
  Clone ID: SORBI-28MAY03-CLUS24713_1
gcacgaggctaatgcagcaggtaagcaaagcactttatgctgaatttttgggtgcacaaaagaagaagcggccattcaagggattgggtttggaacacttaaatggctcaacccctgttattcctgataagctgacaagtaacatattaaggagctccaagttccagatggacctattctgcttaagggagagagatttactgaagcagtttgcagaggaggtttctctccatcttgcacaaggcgaaagcagagaaaaggctttgatgctgagttaccaacttgctgaagacttagctagagcgtttactgagcgtacaatcctccaaatatttctggaggatgagaggaatgtcccttctggttccctaaaggaggtactgggtttgctgaggtctctatatgttatggtgaacatagatgaatccacatcttttctaagatacgggtatctatcacgtgacaatgtagcccttgtgcggaaagaagtcttgaaaatgtgcagtgaactcaggccccatgcgcttgctgttgtcagttctttcggaatccctgatgccttccttagtccacttgcttttgactggattgaggcaaatacactgtcaaccgggagccactgatctcaagtttcacatacgagccaggttacccagtgaaagtactgaatattgatggcggagcatacaaaccatatactgtaatataataactacaggagcacttgatgcctcacaacaattgttgtgaagtgtatagctggagaggcagatgctggtccgagatgcaggtggtgattcgtgaaatcctgttttgtataatagttttcttgaatataaagcgaacgtagccttaggctgcggtccatgtaatggggtttaaccgagttgttcaacagtaaataaagtctttagtgctgctacaggatgttcaagtgcccctgaaagggaatcaaataagcttgtgtcgatccatttcaaatc

SEQ ID NO: 12996 - DNA, 1365 bp, Sorghum bicolor
  Clone ID: SORBI-28MAY03-CLUS24783_1
tggcacgaggatcaccctcaatctcaatttcttctgctccccaaaaacacagatccgtagcctagccgcgtgcttgccagaaagatcgagcggaaggcgggcaggccggcggtaggcgcatagatgcaggggtgagggcacgggcggcagcgcttgacgggcgacgagtaaaccctaacgtttcgatcgcgggcggaagcgtctgagccagtccccgagtcgatccgccgccatgcctgtcaatcctcctcccccgccgcctcctgggtcgtcgtcttcggctccggcggggcccagctacttccctctccctttccatctgcagcagcaccagccgccgccgcagatgccgccgcctatggcggcgaacagctaccagcagtaccagcaacagctgcatcaggcgcatcagctcttccagcgggacgcgcagaccatcacccccgaggcgctgcagagtgtcaaggctgccatcgccaccagcgacgtcctcgaccccgccgccgccgctaacgccaggccctccgatccctctaccagcaagaagcccattccacgccgcgctgccggacaatcctgggaggatcctaccctcactgactggcccgaaaacgactaccggctcttctgtggagatctaggcaacgaagttaatgatgatgttctctccaaagcattctcacggtttccatccttcaacatggcaagggttgttagagataagaggactggcaaaactaaaggttatggatttgtgagcttttcaaaccctactgacctggctgcagcaataaaagagatgaatggaaagtatgttgggaaccgccctattaaattgcgtaagagtaactggaaggagaggacagatgttgaggctctagaaagacaaaagaatcatgtccataggaagcctaaaattctgaagaagagtattcttcacaagtagagatatagagggtgaaggccagctcatggtcatgtgctgctgtggtgctgccttcgaaagatgctacttctggaatctggaatctcttcactctctgcactactcggggtggaatcacacaagggctgttgtttcatggaaattggcaacgagctgcagctgccttttggtcgatggggttgtgggcttgtgaacatagcgttaagtgccacccgaggcaacttgtgctccgttttactgttccccctagtaccttcacatggtgctcatttgagatgttggagttgtgtcatggctactgactaacgaggccttggcaagttggcattattagatggcttccttggttgggagctgaacaagaaccaaatgggaatttcaatttgggtttcaacaagtaataacatgacgtgttggac

SEQ ID NO: 12997 - DNA, 1036 bp, Sorghum bicolor
  Clone ID: SORBI-28MAY03-CLUS25111_1
tggaaccaacccggaagcgcccggaccttcttgagcccgaagcaaaaaaaggctccatattgctctcctcaccgatccgccaccacgccacaaaatcctctcctactcgagcagttccgctcctcgccgccgccacgatgccggaagacgtgcagatgaacgactcggagccccagcctgcggcgccagttcccgtcgccgccgccgccgccgcggcggcgccggcgctctccacactgcaccatctgaaggagatcgcgaccgtgatcgaggctggttccctgtccaaggaggtccgccggatctcccgcgccttccgcctcaccgtcgcgctccgccgccgcctcgccgcgcgggacgtctccgccttcctcgccttcgcgctacccgcgtcctctgaagcctacggacgcctcaccgcgctggtgcccaaggaagatgatactgagatggatgttgatgctgcggctccggcaactcagatttcaatcaaacatggtctccctgagattgaaatattttgctacttgcttgtactgattttccttattgatcagaagaaatatgatgaggctaaagcatgcgcaaatgtgagcattgctcgcctgaagaacctaaaccgtagaacggttgatgtcctggcatctcgtctgtacttttattactcttatgtgtatgagcttaccaacagccttgctgaaatacgtgggactctgcttgctctacacagaatggcaactttgcatcgcgacgagcttggccaggaaacactgctcaatctcctcctccgcaattacctccactacaacttgtatgatcaggcagagaagcttagatcaaaggcacctcgttttgaggcacattccaatcaacaattctgccgatacttgttctacttgggcaaaattaggacaattcagttggagtacactgatgctaaagaaagcctcctgcaagctgctcgtaaggcaccaacaacagcccgtggttttcggattcagtgcaacaaatgggctatcatagtgaggctgctgct

SEQ ID NO: 12998 - DNA, 866 bp, Sorghum bicolor
  Clone ID: SORBI-28MAY03-CLUS2208_1
cagaggaggaggaggaagaagcgtgccgcacgcggtccggtctcatggcgcccttcgccgtcctccgctcgtcgtcgcttgggggcgggacgcgcctcgcctccgactgggtcgaccccgacatcttcgagtccgcctacctcctcgcgctcctcctcctctcgctcctctccgtcgccgcctccggtggtggccgccgccgccgccgcgaccgcgccgtcgttcagtcgtcgcatgtccagccacgcatctgcactgcgcatcatctccagcaagagccgcgtctcgtgcaggggcagggcatccagcaggtcgctgtccatcaggtgcgagcagcagcgcgcgaagcagggcggcggcggcggacccgacgtctggctgggccgcgcggccatggtcggcttcgtcctcctcctctgcttctttctttctttctcactgcctgcaagagcaaatccattccatcctctgctttgctgctggatttgttacaaatccttcctaccatcggcagtcaggcaatctgtaattttacatacggacagcaacatgtgatgaacatactttagcactagtacctttctagagagaattgggaatttgggttggggacaagaataattggaatctgtacttgtaagggtggagttgatgtaggatttgcttctcctcttaaattgtgggaagaatgaacatactatgaattattattatgaaatgagggtaggttaatttctttctcagggacagtggttccttcttatttagaccggttacaaagatgcgcgatcgccgacgaggtcggcaccggcaaaggcttcctccagaacttcggcgtggctactccggcgccgacgctggcgctc

SEQ ID NO: 12999 - DNA, 943 bp, Sorghum bicolor
  Clone ID: SORBI-28MAY03-CLUS2529_1
gccggccgggttgggatcgcgttcctaacgccgcgaggcgaagcgaagcgaagccaaaacccccattcccctccctcctcgtcgtctccgttgtcggcgtcggaccaaagccggatcccggagccctaaccctagcaagcaggcggcggcggagatggtgtactacgcgctgttggtgggcgcggagctggacggcctcaccaacctgcagccccgccgcggctgcgacgaccccaacttcccctactacctcaagctcaagtgcgagaactgcggggaggtcaccgccaagtccacctacgtcaccctcagcgagcaagtcgacctgcccaaaggacacggcaccgctcacctcgtccagaagtgcaagctttgtgggagagatggaacaattgtgatgattcctggtcaggggacgccacttactattgagcagagccagaaagaagagaagacttgtttgatggtgtttgactgcagaggctatgaacctgttgagttttcttttggcgctggctggaaagctgaatctgtgcatgggactcctttcgaaattgactgctctgaaggtgaattttctgagtatgatgagaagggagaatgccccgtcgagctaagcaagctgcagtcaacattcaaagtggtgaagaagcatgacaagggtggcaagactagatttgtctagatccaatgacttggaggctgtcaggtattggaatcgaaggtgtacaaatggtacatttgggccaaaggttgtgcgtaatcagacgtccttttttctatctgttgattctgtggatgccatgaaccatgtgaacctttcagtgatagtgtccacaggggcattgccctggaccgactgctattgttctatgtggtcttaggccatccgaactgatcttgttatcgtccactaatggttgaacatgctgctgatttgagc

SEQ ID NO: 13000 - DNA, 1439 bp, Sorghum bicolor
  Clone ID: SORBI-28MAY03-CLUS33261_1
gcacgagggaacagtaaaccagtagctcttcctgactctactgtgccctctctctccactgataagcctgtgattgtacttgatgcttcagtgccaacctatctatcatcgtctcagccaccatctgctaatgatgcatctccagtcaatgttgcagagcaagttccattggtaactcccgcgcggcttctggcaactacttcctctacaattgtatcatctcatgccttgcaaacttctgctgtggttccatcctctaaggctgtcccctcttcagttccatcctctcaggctacattgtctgttgcttcacccacacaggttgcttcctcttctgttttgtcgcaacaggtggaagtgaccagtgaaagtaagccagccaagcagcgtgagtggaaggcaaaacaacctgtggttgctacacctggaaataagaaggccctattgcctgcgcccaagcccgtgcttcaaaagcctgtaggagtttcctcgtatgtccagtacaacaatagaggccggggaagaggaagaggccacggaagaggaaatgggcaatcacatcccataaccaagttcacagaggacttcgatttcatggcaatgaatgagaagttcaacaaagatgaagtatggggccatcttggtaaaagcatagggcagttaaatgatgaaccaaatggttatggagatgttctagaagacgatgagatatcacctagaaagccagaagctatggctgtgtatgttaaagatgacttctttgattcactctcttgcaacacaattgacaatggagggagaaatggaagagtgaaattctctgagcagaggaaaatagacaccgagacctttggtgactcagcaaggcatcgaccaacgggcatccgaggtagggccccgcgtggtgggggtggtggccctcgtggtcgtggctattatggtagaggatatggatatatgggtaggggccgtggctactcttacccaaatcaccagtcgtgatacctcggtgtctggaagcacagtgaatggcaatggccaatttgcgtagtaaactgagatgtatcgcagattacagtgctgctgttgtaagtgcctattagagtttccttatcttctgctatagataaaatgccttaatattttgttagtgatgtgacaattcaagaatcagtgtcagttttattgatggtagattagagtagaagctttcacatctgtatctttcttgtcagtgtcgatggtcatttatttatattctttttgaggtagaagctgttagcagattgctagatgtaacacagatctgtccagtaccaacagaaaaacaagcactactactgataatctgatacaataagggagagagttccgggtagggaaagggatagagttcaggctctagtactgacgatctgataggggagttaagctaggaa

SEQ ID NO: 13001 - DNA, 1311 bp, Sorghum bicolor
  Clone ID: SORBI-28MAY03-CLUS3353_1
agccacaccaatcgcttcgtccccgcgtctcgcccggccgcgtaggcgccacagaaactcccacgccacccacgccgtccgtcgccgtcgccgtcgagtccaatccatggctccacccgcggccccgaccgcgctgcaccaccgcacgcccctcctcctcccccgccgcgccaccgccgccccgggtgccaccgccaccgccaccgcgcgcgccgccagagccgcttctctagccgtcgtcagggcccagccggacaccaccgccgcgacctccgcccccgagccgccgacgccggagttcaagccgccgccggggttcaaggtgcccgagcccaagaggttcgaggtcaagcccggccagcagaacagcgtcctcggcgcctcgctcgccatcccgctccgcctcggcaccggcgtcttcgtcctcgggtactcgccatcacttgtttctccgtcagagataccatcagatcaatatgcactggaattcggagcttggaaggtgaaggaggaatcaaaaataggacagtgcaaacgaccggaaaagcctatcgagatatatgaatttgaaggttgtccattttgtcgaaaggtcagagagatggtatcagttttggacctagacgtattgttttacccctgtcctcaaaaaggcccaacattccgacctaaagtcctcgagatgggtggaaagaaacagtttccttacatggtggatccaaacacaggggtcgccatgtatgaatcagatgacatcataaaatacctagctgacacatacggcgatggaactgttccaattatgctatcacttggtctgttaacaacaatcacagcagggcttgctactcttggtcgttttggaaagggaaattcctatactgcttcaaaagttccaccacagccaatagagatatgggcatatgagggatctcccttctgtagattagtacgagagacgcttgttgagttggaattgccacatctgctgcacagctgcgcacgtggcagccccaaacgacaagaattcttgaagaaaaagggagttttccaggcgccttacattgaagatccgaacaccggagtccagatgttcgaaagcgctgaaatcatagactacctgaaggcaacatatgccctgtacccaagctcatagtggcatatctcaaatatgaaatgcccatttgtaatgttgtgtagagcgtgtaaattcaattctttcccagtaaaggaaaagaaatagcaaaccatatattctgtatgatgcacagccgattttatctacgctggtctgaacttcgaagttactgc

SEQ ID NO: 13002 - DNA, 1049 bp, Sorghum bicolor
  Clone ID: SORBI-28MAY03-CLUS34142_1
tgggttcttccccgatccgagccctgcgtggacgagcagccggacccaattgggaggcggtggcgcgacggccagcagggacgaacccctagagcttgagctccagcgcacgggtcgggtccccctccccgttccccgccatcggccggaggcaggcccactgcacgatcctgcagcccgtcacctgcatgtaggaggtcctgcgtaggctctcgccctcctcctcccagcgcttgcactcgacgtagccgagctcgtacagcagcgagctgctcgccatgttcccgaagcggtgcagcgtcatgtgcgacgcctccatgtcgcggtcagagagccctagcccccgctgcacctcgtacagcaccctccgcccgcccgggtggatgcagaagtgctggaacacctcgccgaacgccgggcggtactccttcgtcgtccctgcactaaagagcctgtttctaacgatggagaaggcgacccggaggagctcggagacaggtaccacggcgcggccgaacgccgtgatgtggcccttgagcgcactcgcggcgaccaccggcaggtccgcggaccggtggaggcctctgtgccccgcgcccgcgcccacgggccgcgcccacctgcccgctcccgcccatgaggcggccagcgggggcccgctggggccgccaccgcggcaggcgcaagcacgggagttggtcatgatcctggcggccgcgcccatccggaacagcacattgggcaccaccatctcccgtttcgctccggtgtagagcatggacgacaggacctcggtggcgatgaccaggacgtgccgccccggccgcgcaacccgcacgagggtcctggcgaggccgacggcgatgagcgcgcccaatccgtttggatttggagtgcaagggggtgcggccgcgcagtccagaaacgcctctggcacggcaaagccatttcaaaataagtgggtaagggacccctcagccccgacgaagcaacaggaagcggcacagcctgcaccagcagcccacacctcctgtacagatcctgagtcc

SEQ ID NO: 13003 - DNA, 747 bp, Sorghum bicolor
  unsure (1)..(747): unsure at all n locations
  Clone ID: SORBI-28MAY03-CLUS27096_1
gcacgaggggcacatagccgagttgcagagcaagtacattgttattagcaatgtcgatgcattacttggctgctctgtcggtgactctgctgggagctatcttgctccgttgggccttcaaatggatgaactacggccggacgggcggtgaagaagggatgctgctgccgccggggtctaggggcctgccgttcctcggcgagacgctcgagttcttcgcggcgtccccgacccttgagctagtgccattcttcaagcgacggctggagaggttcgggcccatcttccggacgaacatagtcggcgaggacatgatcgtgtcgctggacccggagctgaacgcgcgcgtgctgcagcaggaggagcgcggcttccagatctggtacccttcctctttcatgcgcatcttgggcgctgacaacatggtctccatgctcggaccgctccaccgccacattaggaacctcgtgctccgcctcttcgggcccgaggccctccgcctggtgctgctccgcgacgtgcagcggagcgcgcgcgacgagctccggtcatggctcgaccggccggaagtcgaggtcaggacggccacctccaggatgatatttggcgtcacggcaaagaagctgatcagccacgacgacgtggcatcaggaggaagcctgtggaaatgcttcgacgcctggactaaaggcctgatgtcattcccgatctgcgttcctggaacagccttctatagatgcatgcnag

SEQ ID NO: 13004 - DNA, 1428 bp, Sorghum bicolor
  Clone ID: SORBI-28MAY03-CLUS26894_1
gccaacggcagatcggggatcccagttaggtcgttgtgccctacctgtcagtgacaaaccggttatccaaatccaactcggcggctgccgcctgccgcagccgcagcagcaccaccgtcgacgactctgacctctccctttcgcactccccttccacgtcacctcctcacggcatcaactcccctcttcttcgtctcctacaagtagccagacaccactcccacttcgccggcgatcgctgagagcgacgagggcgcagcatacggcatacgggcacggcgagccatggcgaccagctccaaacccgccgcgcccgtggaccccaagttcgtgctggcccacaagttccccgaggtgtccttcgactacgacgagagggatgtagcgctgtacgcgctcggggttggcgcctgcggcgatgacgccgtcgacgagaaggagctccacttcgtgtaccacagggacgggcagccaaacatcaaggtccttcctacttttgtttctttatttcccaacaagaacagcaatgggcttggatttgttgatgtgcctggccttaactttgatgcaagccttctactgcatggtcaacaatacatagagatctatagaccaatcccttcatatgccagtgttgtaaacagggttaaagtagctggtttgcacgacaaagggaaagcaactgttcttgagctcgaaactaccacaagcctcaaagagtctggagaaattttatgcatgaacaggagtactatctacttgcgtggtgctggagggttttcagactcttcgcgaccatactcatatgctacttatcctgctaatcaagtttctcgcatttctattcccaattcggcaccttctgcagtatatgatgaccaagcaaagcaatcccaggcattattatacaggctatctggggattacaatcctttgcattcagaccctgatattgcacagcttgctgggttcactcgtccaatcctgcacggtctctgcaccctaggattcgctgctcgggctgtcataaaatctttctgcaacggtgaaccgacggcagtgaagagcatcttcggccggttccttctgcacgtctaccccggggaaacgttatccactgaaatgtggcttgacggccagaaggtgcactaccaaacgaaggtcaaggagcggaaccgtgccgtgctctctggatatgtgttgctccaacacatcccgtcatcattgtaagtaaaaagaaattgtttcttatttggtgcccgctgaaaaaagcaattggctgcgatggattgagagttgcttcacgacgtgggctgccactgtaatgatagccagaagtcatgtacaggtctgcacataacacattcgtactgtacttgataaaaagtacgcaccacttaaatacgcagatctgaacgcattgatgtt

SEQ ID NO: 13005 - DNA, 785 bp, Sorghum bicolor
  Clone ID: SORBI-28MAY03-CLUS27202_1
gcacgagggagcaaactgggaaggatgacattgatgtgggttcaatccggatgacgctgttcaacatctttggcgatgatgccagcccaaagatcaagaagttcatgaaggtcatgctcggaaagttccaccagggcgaatcaggtgagcatggcagtggtggtggtgtcctgggcatggttggtgccctcgcacaggagttcttgaaggctaagcttgaagggaatgaggaagaggctttcaagccagcattagatcaagaggttcacagtgttgacgaggtgtatgccgggactaaggcctgggcaccaaacaatggcattctgatcagtgggtgccagactaaccaaacatcagcggatgctaccacaccgcagggtgtctcatttggtgctctaagcaatgctatccagaccattcttgaaggcaagcacgggaaggtgacaaataaggatctcgtgatgaaagcacgtgagctgctgtccaagcaagggtacactcaacagcctgggctatactgcagcgatgagcatgttcatgtcgctttcatatgctaaaacttggattgttacagctattactttcctccctccttttgtgttgatcggtgcaccagaggttgaagtttttctccccttgtacgttacagttatattgtatcagcgttgtttgagtatgtcaatattgaaataactttgagaaatgtttctatatatgaacaatatacacacctgtatcatgagctataccaacctgcaagctgctctaaatatatcagttttcct

SEQ ID NO: 13006 - DNA, 1443 bp, Sorghum bicolor
  Clone ID: SORBI-28MAY03-CLUS27774_1
gcacgaggggagcgtgctgcaatctcatcacgctcgcggctagcttcaagaagctgcaacgaacccctcgaccatatcgcccgctgctactcctatccctttcctgctgccactacctaagctaagcatggccatgatgctgctagcgcgcaacctgcgctccggcctccgcccgccgctcgccgcggcgttctcgtcggccccggcggcgtcggcgtcggcggccgcggcggaggcggagagggcgatacgggacgggccgcggaacgactggagccggcccgagatccaggccgtctacgactccccgctcctcgacctcctcttccacggggctcaggtccacagaaatacccataaattcagagaagtgcagcagtgcacacttctttcaatcaagactggtgggtgcagtgaagattgttcttactgccctcagtcatcaagatacgacactggattgaaggcccaaaaattgatgaacaaagatgctgtcttagaagcagcaaaaaaggcaaaagaggctgggagcacccgtttttgcatgggagctgcatggagagaaaccattggcaggaaaacaaacttcaaccagattcttgaatatgtcaaggaaataaggggtatgggcatggaggtctgttgcacactgggcatgatagagaaacaacaagctgaagaactcaagaaggctggacttacagcatataatcataacctagatacatcaagagagtattatcccaacattattaccacaagatcatatgatgatagactgcagactcttcagcatgtccgtgaagctggaataagcatctgctcaggtggaatcattggtcttggtgaagcagaggaggaccgggtggggttgttgcatacactagccaccttgcctacacacccagagagtgtccctattaatgcattggttgctgtaaaaggcacacctcttgagaaccagaagcctttagagatctgggaaatgatccgcatgatcgccactgctcggatcgtgatgccaaaggcaatggtgaggctttcagcaggtcgagtacggttctccatgccagaacaagcgctctgcttccttgccggggccaactccatctttgctggcgagaaacttctcacaaccgcaaacaacgacttcgacgcggaccaggcgatgttcaagatccttggtctgatccccaaggctccaagctttggcgaggaagaggtggcggctcatgctgacaccgagaggtctgagcaagctgcttcgatgtagaataacatcattaccgactctctgtatcacagttagggcgaaactagacctactgttattatagctagagcattgtattgtagaaaccacaatatttcatttcattattttgtagttgcttgagacagacgggaaacaaaataaggaatgccatatgtgatgtaagttcc

SEQ ID NO: 13007 - DNA, 1351 bp, Sorghum bicolor
  Clone ID: SORBI-28MAY03-CLUS27804_1
cctactgggaagccggagtcggagccggacccgcagcccgaaacccgtctcctacccccgcccgtctcgcctcgcgaaggctttcctttcctctcccttcccgtccaagatggaagcagagtacgcacgaggggcaggcccctcctcctcctccaccaccctctggccgtgcgcgactcgacgcaggaagagggacgagggcgagggcgacgacgacctctcgtcggaggaggacatggatctcgacgccgacgcgcagcgcgccgcggacaagctgaaagcagtgtcagaggaacttggacatgagatccgagttttttcgagtgagaattttgctctacaacccagcaagctgcctagtgcagatcatgaggaagatgatgacttttacgagcttcagcctgctgattactacaagttgatttcaaacaggataggagagcactctaaaatgctaaagactcgcaagatgcgggaggcagaacttgctgctcagcgagcaaagagaacaaaggcagtaatgagggtgcgattccctgatggctacattcttgaggccgactttcttccatcagagaggattcatagtctagtggacctgctcatgaaagtacttgctagaccagatcttccgttctatctttatacagtacctccaaagaagcgaataatggacacatcacaggacttctgtaccgctggttttgttcctggagctaatgttcatttttcttatgatctgcccgaaggttcattggtaaatgcagatgatctaaaagcaggaccctttctccgtgaagaaattcgaagtttggacggattgtcacttctgctgaaacctgctagtcaacctgatgattctagaatgaactcttctactcttcaatctggtgcatctcaatctgatcctgtaccaacaacaaataagaagcctggcagaccaaagtggttgaaaaggtgataccactccaggcgtcaagtgcgtgccgtcaacacagaatcactctgttaggcttctaaacactactcatggttaaacaagttcaaatttgaacaggctacactgctgtgtagtacaagaattgggtcctctgctcactgaagctgttgggggcattagaaatgggtcccacctttttccaggtgggagccaagtagcatgtaaatttgaatgcgttgcgactcatcagaacagcgctctgctctggctaagcactttgccatcttacacatcgtgtaaaccccatagaaagttagaaacggtggaaataatagtccagtgttcttaacgcttcacggtgcaatgccatgcctgtcttcactattcacacaatacatttcagaaaactga

SEQ ID NO: 13008 - DNA, 1129 bp, Sorghum bicolor
  Clone ID: SORBI-28MAY03-CLUS28539_1
gcccggcccccgagccctccccttacggcgcccaaggcctaatcgcgacctccgttccccaaaaccctacccttacggcggccatggacggcggaggcggcggcggcggtggtggaggaggtggggtcggggcaggtgtcatggtgggcggcggggtcgggcccggcggcggcgtcggcgttggcgggggcggcgacgtggagctcgtcagcaagacgctgcagttcgagcacaagctgttctacttcgatctgaaggagaacccgcgggggaggtacctcaagatctcagagaagacctcggccacgcgctccaccatcatcgtccccgtcgacggcgtcgcctggttcctcggacctcttcgactactacatccgcaccgacgagcgcgacgccttcagcaaggagctgccgcatcagcaacacatggagccgccagagcgtcttcctggcctttccgatgatgtgggtgccggatttatagctggacatggtagccagtccgcttctgggccagaggtagatgtcgaccgcttggttgatctgcctcctcaagaagaaattagtggcatgggtatgtctaaggtgattagggcagatcagaagaggttcttcttcgacctgggcagcaacaacaggggccattatttgaggatttctgaggtggctggacctgatcgttcgtctataatcttgccactctctggtttgaagcagttccatgaaatggttggtcactttgtagatataatgaaggacaggcttgaaggaatgacaggagctaacgtgcgcactgtcgaacccagccagagatgattacccttgactgtggccttggcaagactgctgttatgcctcctgtaggtttgccatgtggtgtgtggtaatgtagatcacgcagtattaattcatctggtggggataataatgtctcttttctctttattttttgaaattcagtggtgaggattgatttgtttgggacttttttctttcagtcggaggaataataagcagtgtattgttcgtggggtggtataattgtggttgctgcagtgttagccctgttttcatgcttcgccgttcttgtttaggtaaaaaaaggaatgttatgtttctggcattgtgt

SEQ ID NO: 13009 - DNA, 1233 bp, Sorghum bicolor
  Clone ID: SORBI-28MAY03-CLUS28487_1
ttcgcgcccgcggtcccggtcccgttcccgttcggccttgacaatccccaccccaagtccccaacgacgcaggatcgaaccgaatcctccggaactcgccgccgtaggaccgccgccgccgccaggaccggccgacccgattccatcgatcgaggatgtcgtacgcctacctcttcaagtacatcatcatcggcgacacaggcgtggggaagtcgtgcctgctgctgcagttcacggacaagcgcttccagcccgtgcacgacctcaccatcggcgtcgaattcggcgcccgcatgatcaccatcgacaacaagcccatcaaactccagatttgggacacggctggccaagaatcattcagatctattactaggtcatactacagaggtgctgctggtgcccttttggtttatgatatcactaggagggagaccttcaatcatctcgcaagttggctagaagatgcaaggcagcatgcaaatgctaacatgacagtgatgctgattggaaacaaatgtgatctttctcatagacgtgctgtcagctatgaggaaggcgaacagtttgccaaggagcatggtctggtctttatggaggcatctgctaaaactgcacaaaacgttgaggaggcattcattaagaccgctggtacaatatacaagaaaatccaagatggcatatttgatgtatcaaatgagtccaatgggatcaaagttggctacgttgttcccaactcatctggaggtggtgctggctcgtcctcccaggctggtggctgctgcagttgagtggtggcagcgagtcatacaattgcacaagtttctccctgcactatcttgatgtttgcctatagctggccccggatgatttgttctttcagccatcacgtttcaatccatgaacaaaccatctccagtgttagctgtcatttatacttgtgcaatctttctgtaaagccaatcattgacgattactaccctatgtgtcttctgtaaccaaattgaaatcagttttctcctgggtgctttgttatttgacgcaccaacggattctgtgcctcaacgatttaagagattcagttttcccttcgctggtgtttggtggcgctctgtgctacatcccgagactctgttctggctgccgtcatttagcattcacgaattctgtccgtctgcatgtgtaaatgtaaataacatacctcgatgcattgtttgggtgaaaattaatttgtct

SEQ ID NO: 13010 - DNA, 746 bp, Sorghum bicolor
  Clone ID: SORBI-28MAY03-CLUS37265_1
caaagaacgtgttttggtacttgctgccactaataggccatttgatcttgacgaggctgttgtcaggaggctccccaggaggttgatggttaacttgccagatgcacccaacagaaaaaagattcttagtgtaatactagcaaaagaagatttggcagatgatgtagatctggaggcactagcaaacctgacagatgggtattcaggcagtgatctgaagaacctgtgtataactgcagcacattgccccataagggaaattcttgaaagagagaagaaggagagaaccttagctgaagcagaaaataggccagctccacctcagtgttgtagcggcgacgttcgctccctgaagtttagtgatttcaagcacgcacacgagcaggtttgtgcgagtatatcatcggattcaaacaatatgaatgagctcgtccaatggaacgacctctacggagaaggcgggtcgaggcagaagacatcgctgagctacttcatgtagcctaacgcttttagatgatttgtacatagagaagcagccgagaagatagtggcaacaagaatagccttctgtataggtggtttccagttaaatttgctggaaatctttattcatgtcaggtttcgtttccataagcaaatagtgccccggactcagcttgtcccgtcgagcacgtgtctgaatgtagcctgagcttctgattcagattcgttagtaatttatttcgatggcgagtgcagttcgttgt

SEQ ID NO: 13011 - DNA, 789 bp, Sorghum bicolor
  Clone ID: SORBI-28MAY03-CLUS3389_2
gcggcggccgcgtggaacactacaaacaaagctctagctagcacgagaaacaagcagcagcatccatggcgtccccggcagcttcctcagtgctcagcctgctcctcctggccgctttcgtgggcaccgcaagagcggcgacattcaccatcaccaacaactgcggctcgacggtgtggccggcggcgaccccagtgggcggcggcacgcagctggacccggggcagacatggaccatcaacgtgcccgccggcaccagctccggccgtgtctggggccgcacggggtgctccttcaacggcggcagcgggagctgccagacgggcgactgcggcggcgcgctctcctgcacgctctccggtcagcctcccatgacgctggccgagttcaccatcggcggcagccaggacttctacgacatctcggtcatcgacggctacaacctcgccacgcgattctcctgcagcaccggcgtgacgctcaactgcggcgggtctagctgccccgacgcatacctgtttcccagcgacaacaccaagacgcatgcctgcaacggcaacagcaactaccaggtcaccttctgcccttgatcgaggaggcagcagtggtccaacgatgcaaacatgcataagagagatgctgcatccgtattatgaattaaagtagatgaataagacagtttcaaaaaacaatgttgaataagaagatggcgtgaagagtcgttcacgcatatatatttccaaaaaatgattaaaaaaagcgaccatgcaatggttgtgtttcacactc

SEQ ID NO: 13012 - DNA, 1276 bp, Sorghum bicolor
  Clone ID: SORBI-28MAY03-CLUS3389_1
gccggccgggctgccgcagcagctcgcctatttccacaagaaagaagctcgatcgcctagttccacaagaaagaagctcgcatagtattagcatcaatggccgcctcatcgtcctcgatcctcctgctcctcctcgccgccaccttgatggccggcggcactcacgcggcgacattcaccatcaccaacaactgcgggttcacggtgtggccggcggcgaccccagtcggcgggggcacgcagctgaactcaggcgggacgtggacgatcaacgtgccggccggcaccagctccggccgcgtctggggccgcacgggctgctccttcaacggcaacagcgggagctgccagacgggcgactgcggcggcgcgctcgcctgcaccctctccggcaagcctccactgacgctggccgagttcacgatcggcggcagccaggacttctacgacatctcggtcatcgacggcttcaacatcggcatggccttctcctgcagcaccggcgtggggctggtgtgcagggactcgagctgccctgacgcataccaccagcctaacgacgtcaagacccatgcctgcaatggcaacagcaactaccaggtcaccttctgcccgtgatgatgaggcagcaagtatatgcatggcttctgtatcgcatatatgcatgtatttacgtatacggcacctagcaggggatgtcggataggagagtgaataagacgtgtcgtggtagcgtacatgtccaagcgtgcatgcatgcatgtgcacgcgggcatatgtacctggaactgtgtgtacttacagtatactccagcagtataataatatgataaaatataataatagtaagacactgtcatgtcatgctagaaagcagggattaaaaaaagtgaaggtatattatacggctacactagaaagcgaccttttgggtcgatggtgacagattcagccactagacacacgtgtgtttgatcgagtcaaacaaaagttatattaggcaggacgaattaaaaaaatatttagagaagattctactactttactactttaagataattttaaccccttcttaagtggagcgccaaccttaaagagaaagatcagaagtagatcatcaagatgaaggggctgccgtcacaagttggctcaaagacttcaagactagctcggttaatccttctaatgtagtggaaatctagtcgtgtagttgtatttggttttcagctgtactgctatgttttgaactggtaaccccagtcgtgatgctctaatg

SEQ ID NO: 13013 - DNA, 1257 bp, Sorghum bicolor
  Clone ID: SORBI-28MAY03-CLUS37364_1
cgcgggggcatgggcgggatcccggcccaccgcatcgcggccgccgccgccgccggcccctgcctccgccaccccgccgggctcacctccgccgtcgacgtcgccgccgcgctgcctccgggctcggcgagcgtgtgcatcaagatcaccgcgctgtgcccgatcgcgctgctggagaagacgagcgacctgcttcggtggcagaagaagcacccatcgttcaacctgccatggaagacgcactcgttcccgatcctgtctgactcgagcccgctccacctgaccccgtcggagccgcctgcgctgacgtcggaggaggagacggagctgcagctggcgcacgagcgtctgctggcggtgtgcgcgcggtgcgccgagcacggcatcccgctgctggtggacgcggagtacgcgacggtgcagccggccatcgactacttcaccttcgtgggcgcgctggcgttcaacgacggcgccggcgccggcgactgcgagcagcggcccatcgtgcacggcaccatccaggcgtacctccgcgacgcgcgggaccggctggaggccatggtgcggtcggcggagcgtgagcgggtgcggctggggctcaaggtggtgcgcggcgcgtacctggcccgcgagaccaggctcgcggcgacgctcggcgtgccgtcgccgatccacggcagcatccaggagacccacgactgctacaacggctgcgcgggtttcctcctggaccgcgtccgccggggcaccgcctccgtgatgctcgccacccacaacgtggagtccgggaagctggcggcggcgcgcgcgcaggagctcgggatccccaggggagaccggaacctgcagttcgcgcagctgatgggcatggcggacgggctgtcgctgagcctccgcaacgccgggttccaggtgagcaagtacctgccgtacgggcccgtggagcagatcatcccctacctcatcaggcgcgccgaggagaacaggggactcctctccgcgtcgtccttcgacaggcacctgctccggaaggagttggtgaggagggtcaagaccgcagtggtgggaatgggacgtgagtgagtgaagtgaacttgccgagcctgtgatggatgaggccgtgaagctgggacaagggcgagttgaaggctagtagaagctgtaaatacacccttcaacagtcttcagacattgatgatgatgtttccggggcttttcctgaataattcgaatgaatcgaataatgtttttggt

SEQ ID NO: 13014 - DNA, 1437 bp, Sorghum bicolor
  Clone ID: SORBI-28MAY03-CLUS3792_1
gcacgaggagttgatgtagtggtagaacatgtgcttaagcagatattgtcacaggaaactcagtatcttcctatcacaaggggttgcaatgctgtgctcattatgaatggatatacgagcagttgaattaagtggaatatgattgcagcgcacaatgcatatgtcagctttctacattggcatggcattgctgttgacagagcagacactaaatatcttatcacactctttccttttgcaggattatctattaccattatgaagtccgatgaaagcgttttgaagagacttgatgctcccactaaagctccagcttggcctgttggttctgaaggaaaacgtccaccagcaaagtttcctgttcctctaccaccatcaccttcaatgaaggatgacgagattcttgctccatctcaggagctgagcaagcaaaggtgtatcctggaggctgctattgaagcaagtgctactgcaattatcaatgtcaaggatagcctaaatgaatgggacagtaaagtgggcgatggtgactgtggaaccacaatgtatagaggtgcaacagctattcttgaagatatgaaaaagcgttaccctatggatgatgcagcgggaacaataaatgaaattggggcaacaatccgaagggtgatgggtggaacaagtggaatcttgtatgacatactctgcaaggctgcgtatgcaagcttaaagcagagctccactgtcactgcaaacgaatgggctgatgctttagaggcctccgttgctgctgttagcaaatatggtggtgccagcgcaggataccgcacaatgttggatgccctaattcctgcttctgctgttctgaaacagagacttgaggctggggatgatcctgtgactgctttcgtcgcttcttctgaagcagcatcagctggcgctgaatccaccaaacaaatgcaagcaaaggctggacggtcatcatacatcgcaccagatctcctggcttcaatccctgatcctggagcaatggctgcagctgcatggtacagagccgctgctcttgcagtgaagaacaaactgcacggttcaaagagctagtgcatatggctatgcttcattgctagacccaaaatagactgacaggaaaaatcaccggggcattttctcactccccttagatttggtttccgcttgtgcttttgcatgggccgagaaaaacgacttccatactgtttcccccttctcacatcatacaaagagatgttcaaagagtttgtagacggtacaagttaagggaagctatgcttttgcactcccgtgatatctcagcgtgctgtcaatgttgggaatgatcattgtttattttgcccgagtttcgttttaatggcgcgcaaaataaacaactatattatctatactgtctaaaaaacgattttttccgaaaaggaagatttt

SEQ ID NO: 13015 - DNA, 699 bp, Sorghum bicolor
  Clone ID: SORBI-28MAY03-CLUS30468_1
ccggctgcctcttctatttgcggggaacggtcaaatacacgttcacggccggtatccgcaccggcacggcggaccgcctctcggagaatcgaagccgagccggggccgggcggcggccggcgggcgtaatggatctgctgaagcgggagctggagaagaagcggaaggcggcgacggccgacttcgggggcaagagcttcgtgcggcggtcggagctggagcagaagcagctccagaagcgccgcgacgagcaccgccagctcctcgccaaggcgagcgcgtcggcgccctccccggattccgccgcagccgccaccggttccgacaccagcaaccccgacgccgcagctcaggcggcggcggcgaaccctaaccctagctcctcctcctccgcctcgtcggcgccctccgtcccacccgccctcgcgccgaagaagaccacgcaggaggaggcgctgctctccgaggagcgtcgcatcgacgagctcgacctcccgcggcacgaggtggtgcggcgcctccgcgtgctgcgcgagcccgtcacgctgttcggggaggacgacgacgcccgtctcgcgcgcttcaagctcgtgctcaagtctggcgtcatcgacgacattgacgacatcgacatgaccgaggggcagaccaacgacttcctccgcgacatgatcgagatgcgcaagcggcagaaggctg

SEQ ID NO: 13016 - DNA, 2097 bp, Sorghum bicolor
  Clone ID: SORBI-28MAY03-CLUS30893_1
gcacgaggtctgaagttcatccatttgattttcctgaagaaaacttgcaagatactgggcctgttgggcgcaatttcaaggatgtggacatcaggagacctagctctgatcacgagagcacagatgactactatggtaactttaattcttcacatgatacatttgcccatggcagcagcagcactgcttgggacaagcagaatgacaaagctcaaggcaattcttcacccgttgtttttgatcaatatgattccgcgggggaagaagagaatttattggacacattctcctcaaagcacactgaacaactacctgatcccagagatcatatgggattctcaactgcagattggagtgaacagcatagaagtgaatctccatccaaccagaaaacgtcggccctattttccagaagagaaacacaactatctgataatctaggaacaaacagaagtgatattccttcacctcattcttatgataacttgcatcccgcttttgattcagatggtggtaactctgatgaggaaatagccacaaccatgcatgcagtgtctttaaggtcccattcaggaaggtcccatccaggaggctctgtttcatctggcctgaacaaaggtggtggacctgatggttcactatatgattattcaggagcacaggcagtgaggaacttgaaccgtgtgcaaagcagagattccgatctttcggaagaagagacagatttagataaatttaaaggttcatcctcagctggcgcgagggagcagcagtcgttgccttttgccattagtacttcagcagcttctgatgataaggaaggtgacatcggccttaactttggtaggttaacgcctgggctaagaaacaaaaccaggcaacccccaccatacaccaaagtttccagggagagcattctgcctaagcagtccttgcctacggtttcttccagcactgaagagtcagttgattctgaagagaatacttcattcaaacagaatataagtagccccaaaagctcgttttcagccaggactaattcaggtaaaaaccacgacagtgaactttatgaaaggaatcaaaatgctggaacacactgggaagcaagatcaaccatagcaagaaattcctttggtttagctgacactgagaagttatctgagctacctagtaatataagtcttccaacaactaagagttctgaacgtgcgaattcgagtcaagtgctttatcatgaaaagccaggtattggagcacgccgaggactgagatcaacaatggctagaaattatttcgatacagatgacagtgaagaagaactagagcaacaacagactcctcagtcgaagcggtctggagtgctgatacaatcacgcaggacacgggaggtaacatcagacacaaagagagagagtcgtatccaaattggagctcaatatgatgatgaaactgagagcatgccaagtaagacacaagtccatcaaggattcaatagctcaagtactgaacaaaggactgaaatgagggatgcaagcgtgtaccccagggttgcagtacagcgctcttcgcctaaagctcagcagattgaatctccggtggctagacggaagccacaagaagctgaaatgagaagaaactttgttggaggaaacgagggggacgcagaaacctcagctggaactccaaaagagagcaccccgaaaacaccccctgcacatgttcatcccaagcttccaacagactatgattcttttgccgcacattttaggtctcttcgaacaaaccggccttaggtttacacgacatgtatagagcttggagtttcagttgaattaagtcatacatacgatagacaatgatacgttttatagtggttgagttgagatctgtacagtatagcaacacagaatgttttctggataccatggtgctgtgctagtttgagcctacaattcttttgttctcttgtacccttaatatattcaatagaatcatattgtaaagacttaaatttcctgctagtgattgttaataagcacggcatgttcccgtatgtatacaacttccggggttctttcatttcattccattgtaacg

SEQ ID NO: 13017 - DNA, 755 bp, Sorghum bicolor
  Clone ID: SORBI-28MAY03-CLUS31392_1
tggccgcgctccccattgtcgccttctggtcgcctgcgtttgttacagcgttgctgcttcgagtcagccgtaaatcttcacttaacaagatggactcccgctgccttgctgtggaatttgcgcctttgatcatgtggcggcaaggtgacgctggcacagatttgcgtaaccatctcaagtttaccctgaaaccgcctccaaaaattgtagatacaacatcaaatactgccacatgggacctgttagacgaggatgacgaggatgcttcatcccagatccccttggacgatgcttcaccgccagactacagctccattgaggtcatccagtgtctcatcgagcatcacaatgccatcttcactgatgcaaatgaaaccgtgtggagatgatcagcatctcttctagatctctctggtgttagctcgtgctatgtacaagttccaggtaggaaggtggattaccgctcgctattgttagggataagcattttggccggaacatttttggagtaggtgtgtatatacgctagtgttaattctccacgggactagaatctggtcatgtcatatcaataaaagtatacttggatggatgtaaaccagatgtgctgttttgatcatttgctgaattagcttcgctactgttaattgggaattattttcctgtgcattcgctgttagctggtgtaacatacttcaaaacaaatcattctagatattgccttacaagattccaatttttttcttgacgggttt

SEQ ID NO: 13018 - DNA, 1503 bp, Sorghum bicolor
  Clone ID: SORBI-28MAY03-CLUS31164_1
cgtccggcagagcgccaacctgtacgcgcgcaagccgctgcccaaccagagcaacatcttcacggcgcagggccgggaggaccccaaccagaacaccggcatctccatccaccgctgcaaggtggcggcggcggcggacctgctgcagtcctcctcctccaccaagacctacctcggccggccatggaagcagtactcccgcacggttttcctgcagtcggagctggactcgctcatcgccccggcgggctggctcgagtgggacggcaacttcgcgctcgacacgctctactacggcgagtacatgaacacggggcccggcgccggaacctccggccgggtcaagtggaaggggtcccgtgtcatcaccagcgcggccgaggccagcgcgttcaccgtcggctccttcatcgacggggacgtctggctcgccggcacgtccatccccttcaccaccggcttgtgagcgcacggcggcggcgtgctaggaggagttcacgtacggcaagtgatggcaataaattaaattggcagagcggaagtaattcgttcatttcatcagagccaaaaaggcaccgatccagtcgtgttgctgtcgttgattcttttgtgtctggggaccacgccaattatataataatatagaaatcgtccttcgcgtaccagaacggcgggcgggtgcggcactacatcgagccgaccttccaccacgtctcccgcatggtgagcaactcgctcgccatggccaagaagctgcccggcgccagccccagcccctcctcggcgcctacgacgacggagactgcagcggtggcgcggcagccattcatggggtacgggcagatggtgaaggggttcccgcggtgggtgcgccccggggaccggcggctgctgcaggccccggcgacggccatcaccgcggacgcggtggtggccaaggacgggagcggggggtacacgacggtgtcggcggccgtggcggcggcgccgacccaactcgaagaagcggtacgtgatctacatcaaggccggggcgtacatggagaacgtggaggtcgggaagaagcacgtgaacctgatgttcgtcggcgacggcatcggcaagaccgtcatcaaggccagccgcaacgttgtggacggctacaccaccttccgctcagccacagtcgctgtggtgggcaacaacttcttggcccgcgacctgacgatcgagaactcggccggcccgtccaagcaccaggcggtggcgctccgcgtgggcgcggacctgtcggcgttctaccgctgcagcttcgtgggctaccaggacacgctgtacgtgcactccctccggcagttcttccgcgactgcgacatctacggcaataaattaaattggcagagcggaagtaattcgttcatttcatcagagccaaaaaggcaccgatccagtcgtgttgctgtcgttgattcttttgtgtctggggaccacgccaattatataataatatatgaaatcgtacc

SEQ ID NO: 13019 - DNA, 1085 bp, Sorghum bicolor
  unsure (1)..(1085): unsure at all n locations
  Clone ID: SORBI-28MAY03-CLUS32724_1
agtttctcaactccctgtacaactgccagtacaagtcattttttgttgcattttctggtttgacggagcaaatcaagttagaccgttatcttcagcctcatttccgctactacatgagggaagtccgcactgttgtctactcacaattcttggagtcatacaagagtgtgacaatggaagcaatggccactgcattcggtgtatctgttgatttcattgaccaggaactgtcacggttcattgcagctgggaagcttcactgcaagattgataaggttgctggtgtcctggagacaaaccgacctgatgagaggaatgctttctatcaggcaaccatcaaacaaggggacttcttgctgaaccgcatacagaagctttcacgggtcattgacctgtaaggactgctgtttgtgttggagctttacctgcaattggcgccctgcaaatgtttcccaccctagaagggttggtcaacttaattcaccaaggcttccataagacatgagcattgctctccttgagtggggaacaagtccttaagaatacttgtgttttaagcgctaatttggtacatgtatcccaagagtttatagaatgaggaaagcgcagatcaattccatggacgtttcatttatcgtaaacgctgtcctgtcatttcaagtctcatatctgtggctctgtctatgaattgcttccttaagttactggcttgacagtccgagcccttttgacctacataatgtgctgcaacacgtaaagagagttcagtggaatatgatgcaattcatatccacactttacaaccacactcactttcaagtttgcttccaagaatcaaatcaatatatcgttgtactctctattttaaattattgttgttttgggcttttggcttctttattagatatataaaactcttataatttaggacagagggaacaaccttcattcataaaccgaattgcttcagtggaattttgtgaaattataggaagttgttttagttttggaattgctacaagttgtaaaatttctctacccaactctgtttgaaatcaaaggccgttttagtttttcnccaagtt

SEQ ID NO: 13020 - DNA, 941 bp, Sorghum bicolor
  Clone ID: SORBI-28MAY03-CLUS32949_1
gcctactgaaaaaaaaaaccccagcccgagcacccgggactccgtgcgaccgaagcgagagccagcgtccagaaccgaacggaagcgagagactcccggcggcgagcgagatggacggcggcgccggcgaggaggggaagcaggagcggcacctggtgctggcccacaagctcttccttctgtcccaccccgccgtcgacgacctctccaaggtcgccctccgcgccgaagtcctcgacaccgtgaaatccgatgatatggcgacgctgtttgagtcgctggtcaccgcgggtgttctggaggcggacgccgcgctgctggccgagatgcgtgggaggatcgacgaggagatccgcaagctcgatgagaaaatcgctgatgccgaggagaacttgggcgagagtgaagtccgtgaagcacatcttgccaaatccttgtacttcataagggtcggtgagaaggaaaaggccctggaacagcttaaagttactgaaggaaaaactgtagccgttggccaaaagatggatctggtgtttcacactttgcagattgggtttttctacatggattttgatctgatctcaaaatccattgagaaggcaaagaacttgtttgaggaaggaggtgattgggagaggaagaacaggttgaaagtatatgaaggcttgtactgcatggcaaccagaaacttcaagaaagctgccagcttatttttagactctatttcgactttcacaacttatgagttattcccatatgatacgttcatcttctatacagtcctcacaagtatcatcaccttggatcgtgtatctctgaaacaaaaggtggtagatgcaccagaaatcctggctgtgattggcaaagtacctcacctctctgagtttctcaactccctgtacaactgccagtacaagtcattttttgttgcattttctggt

SEQ ID NO: 13021 - DNA, 836 bp, Sorghum bicolor
  Clone ID: SORBI-28MAY03-CLUS33152_1
cgacggcccaaacctcatttgagcgtgcgagctctttcgcctcgaaccctctcacgcttgcctccgcgctccagtgctcccctcccacctcgccgccgcagcagccatggcgatcacagcgacgacccccgacatcctcggcgagcgccagtccggtcaggacgtccgcacgcagaacgtgatggcgtgtggggcggtggccaacatcgtgaaatcctcgctcggccccgtcggactcgacaagatgctagtggacgatattggtgatgttacaatcactaatgatggagcaaccatacttaagatgttggaagttgagcacccagctgccaaggttcttgttgagttggctgagctccaagaccgtgaggtaggagatggaacaacttctgttgttatcatagcagcggagttgctcaagagaggcaacgatcttgtgaagaataagatccatccaacctctataatcagtggctacaggcttgctatgcgtgaagcctgcaaatatgttgaggaaaagttggcagtcaaggttgacaaacttggaaaagactcccttatcaactctgcaaaaactagcatgtcttcgaaattgattaatagtgacagtgatttctttgcaactctggttgttgaagctgtccaggctgtgaagactacaaatgccaagggagaagtgaaatatccaatcaagagcatcaatattttgaaagctcatggtaaaagcgccaaggatagttacctgctaaatggctacgcactaaacacaggccgtgcagctcaaggaatgcctacaagagtaactcctgctagaattgcttgtcttgattttaatc

SEQ ID NO: 13022 - DNA, 1039 bp, Sorghum bicolor
  Clone ID: SORBI-28MAY03-CLUS43468_1
agcttgtcaatgcaaggtttgtccactcgcgcgccttcttgtacttggtctaacgaactactgtagctagaagctcgagagtgccactgcatgcgcagcagctgccctcgctcgccattgctagctgctgtgtgttcaagcttaattacttaggtcgatctgatccagcctctagctagctagcaacctagaacagaagttagctagctagtgtgcaccttgcttgtgtataggaggaatcaggaaagagagaaggatggccggggttgggaggaacatggtggcgccgctcatggtgctcaacctcatcatgtacatcatcgtcatcggcttcgcgagctggaacctcaaccacttcatcaacggccagaccaactacccaggcgtcgccggcaacggcgcgacgttctacttcctggtgttcgcgatcctggcgggtgtggtgggcgcggcgtcgaagctggccggggtgcaccacgtccgggcgtggcgccacgacagcctggccaccaacgcggcgtcgtcgctcatcgcctgggccatcacggcgctcgccttcggcctcgcctgcaaggagatccacatcgggggccaccgcgggtggcgcctccgcgtgctcgaggccttcgtcatcatcctcgccttcacgcagctcctctacgtgctcatgctccacgccggactcttcggcggcagcggcggctaccgggaccacgactacgccgccggcgagcccaagggcgtccccagggtctgatgatgatgagcgatcgagattctgaccgatcgatcgagagcatcagttatctatcagcatgcagtgtgtgatgacgtaataagtactagtacccacatatacagtgtgtgcgtgcgtgtgttcacgtaccacgtacagtacagtacgtgtgtacctagctatagtccaccgtctgctcgatcatcttttactactgtttatgttagtaagtcagctcctcgtttctggtttgtaaatgcatcatgtttcccgtgtcaaatgtatgtcaagtttcagccggtc

SEQ ID NO: 13023 - DNA, 870 bp, Sorghum bicolor
  Clone ID: SORBI-28MAY03-CLUS44139_1
gcacgaggcacggcacacccttaagcccctgggattattgttagtcaagcgatcacgtcactagctatacttgccgcgagcaaaagcgagagagagatcaagcccaaacaggtagctagccatgcaggccgggaagacggcaatggaggcgaccaaggaggcggcggcgaacgtgggggcctcggcgaacgccggcatgcagaagacccgcgccgccgtgcaaggccaggtggagaaggccacggcgcacaacgcgtcggacagggccgcggcggaggccaaccagcgggagcgcgtgcgcgccgcggagctggagaagcaggacgccatgcgcgccaacgccgccgccaaggagcgcgccaccggcgcggccacgtaccagcacccgtcgcagggcgcgcccgggatcgtcgacgcctcccggcagggctacggcgccggcggggctgccccggcgggtgggcacgtcgaggacggcgttggcgagacccgccccgtcgctagggccaccggcacggcgcggcccagcgccgcgcacaacccgcacgtcgggagcgacttcccgcaggcgcgcggcaccggcggacagtaccagtgagctgccgcgacgcgcgcgtacccgtgtgacgtgtcatgtactgtatctgttatgatataggcttggacacgaatggtccttgtgaactgtgataatagtatatgctaaataatctgtgtaatatgtagtctctaatagagcaaagtgcatggccggtccctaaactgttgaactgtgtcaagccggtccacgaactctcaaaatgattacttaagtccataatctatgttttggtgtcatttaggcccaaacccactgctgaccaagaaacc

SEQ ID NO: 13024 - DNA, 1005 bp, Sorghum bicolor
  Clone ID: SORBI-28MAY03-CLUS4410_1
gcacgaggccttggtcctcctctggtttggcatctcagtaccccttgtctttgttgggagctatcttgggttcaagaaacctgccatggaagctccagtcaagacaaacaacattccacggctgatccctgagcaggcttggtacatgaatccacttttcactattctgatcggtggggtccttccatttggagcagttttcattgaactcttcttcatcctcacctccatctggctgcaccagttctattacatctttggcttcctcttccttgtgtttgtgatccttatcatcacctgtgccgagatcacaattgtgctctgctatttccagctctgcagtgaggactacatgtggtggtggaggtcttaccttacctcaggatcctctgccctgtatctcttcctgtatgctgctttctacttcttcacgaaactgcagattactaagctggtgtctggcatcttgtacttcggctacatgcttctcgcctcctatgccttctttgtgctcactggcacaattggtttctgtgcctgcttctggttcactaggttgatttactcgtcagtgaagatcgattaggtgccaatatgacagaatagcacatgtcacatgttcagtgatggagacaagagaattgtatgattaatgtggattggggaattaccccccttttaagattcaggaaaaaaaagggttactttttagggtttagtttatgaatggtttatgttttgttgttgtcagattatacactttagtgatttgaaactgagaaaaagtataagggtaaacacattgtgatgaggctgtaccttttgacattttttgtggggctctatataaattcaattcattatgaccggtatgcttgtactggtgaattactgtaaggctccaggaccagtatgaaataccctgatggcaattggcaagaatgtaacctcagttggcttagaaaccagagctggcgcttgaacttgcaaaaaaaaaaaaaaaaa

SEQ ID NO: 13025 - DNA, 854 bp, Sorghum bicolor
  Clone ID: SORBI-28MAY03-CLUS35002_1
agggccgccagccccggcacccgcgccacctacaccaacaagggcgagatctgcgtcgccggcacacgcatctacgtgcaggaagggatctacgacgcgttcgtggagaaggccgccgagctcgccaagaaatcggtggtcggagacccgttcaacccgcgtgtcaatcaaggccctcaggttgacaaggaccagtaccagaaggttctcaagtacattgatatgggaaagcgcgaaggcgccacgctggtcaccggagggaagccctgcggcgacaagggatactacatcgagcctaccatcttcacggacgtcaaggacaacatgacgatcgcgcaagacgaaatctttgggccggtgatggcgctcatgaaattcaagacggttgaggaggtgattcagaaagcgaacaacacccggtacggcctagcagctggaattgtgaccaagaacatcgacatcgccaacacggtatcgcggtccatccgtgcaggtgccatctggatcaactgctacttcgcattcgaccccgacgcgccattcggggggtacaagatgagcggatttggcaaggacatgggcatggacgccctggagaagtacttgcagaccaagaccgtggtcactcctctatacaacacgccctggctctgatcggtctcatccttccattcatcacagaaaaaaaaacaagaagaaacatgtcttgtattattatatacaacagataaaaagggaaaaaggatgggttggctgtagttatattatgttcttttacctgcatggattgatgatgtagtacaatgtagcatggacttgtttaaaacaataaagacatgtttcggattgctttc

SEQ ID NO: 13026 - DNA, 768 bp, Sorghum bicolor
  Clone ID: SORBI-28MAY03-CLUS36145_1
ctactggacgcagcagagacctcgacgcactcaccacacagcctcgcgtttccacctacagcgacacaggccactaccagctagctacctcggcacgcccagccggccagctctcagctgatcacgtccgtacgcgtcatggcaatggcatcggctctgccgccgttcacggtgcggcgcggggaacccgtgctggtggcgccgtcgtcgccaacgccgcgggagacgaagccgctgtcggacatcgacgactccgagggcatgcgcttctacagctctggcatccacctgtaccgcgccaacccatccaaggccggccaggacccggccacggtcatccgcgaggcgctggcgcaggcgctcgtcccctactacccgctcgccggccgcctccgcgaggtggaaggcaggaagctcgtcgtcgactgcgccgcgcagggcgtcctgttcgccgaggccgacgtcgacctcaccgccgacgacttcggcgacgtccagagcccgccgttcccgtgcttcgagcagttcatcctcgagagcaccaccgtcgccggcgtcgagcccgtcgtcgaccgccccttgctgtacgtccaggtcacccgcctggcgtgcggcggcttcatcttcggccagcgcttctgccactgcgtcgtggacgccccgggcgggatgcagttcgagaaggccgtgtgcgagatcgcgcgcggcgccgccgcgccgtccgtcgcgccggcctggggcagggagatgttcatggcgcgcaacccg

SEQ ID NO: 13027 - DNA, 779 bp, Sorghum bicolor
  Clone ID: SORBI-28MAY03-CLUS36161_1
gtcccggtcgcagcacgcgcattcctttccgttcaagtgatcactctagctagcacactagagagagagagagggtagcacagctttgacaggatgcagacggcgaaggtgaaggcgaaggacatggcgagcgaggcgaaggagaaggcgaaggaggcgacagccaagatgcagggcaagacgggcgaggcgacggcggccacgcacggcgagaaggagatggccaaggaggcggcccgcgccaagaaggaccaggccagcgccgacaagcaccaggagaaggccgagcaccgcgtggacgccgccgccacgactggccgccacggcgccggcgccggcgcggccgtcgaccgcgcgtacccgtccgccggcaccacgtacccggcgtcgggcaagtacatctaggtgactgcgtcagatgaggccggccgggatcgtcgtgtggtcgcacttgcgtttttgtgtagcgaccgagagatcgatcggctggctgtaccggtagcgactggtagaagctggtgtatgtgtgcacgtgcacgcaagtcgtcgtagaataaaaatggcctagctgttgtcaagttgaaccttggttagttgtttaatttcaaaatggtctagctgttgtcaagttgaacctagtggttattagtagtttaatttcaaaatgtaatcgtcgttgttccttccatatctgtgtggtactgctgtttcaatctcctcagtatgaccaagtgaccaagttttaacgtcaaactgcaaccaatgtgaagacctaaaag

SEQ ID NO: 13028 - DNA, 1970 bp, Sorghum bicolor
  Clone ID: SORBI-28MAY03-CLUS3623_1
aatccctcgtcgctaggtagttcctgcgcctccatcccgaccccccgttgattcaatcgcaatcaggatgatgcccggatcggcaccggcggccggcggcgccggtatgttcgtgccggcggcgacggcgggcacggtgctctgctgcatgtgcggcgtgtccatgcagcccaacccggccaacatgtgcgcgcgctgcctgcgctcgcgcgtcgacatcaccgagggcgtcccgcgccacgccgccgtggtctactgccccgactgctcctcctacctccagccgccgcggtcctggctccgcgccacgcccgagtcgcccgagctcatgcagatcctgctccgccgaatcaaccgcccgctcgcgcggctccgcgtctccctctccggcgccgagttcgtcttctccgagccccactccaagcgcctccgcctcaagctccgcctccgccgcgaggtgctccacggcatcgtcctcgagcagacgcaccccgtcgagttcgtcgtccacgaccgactctgcgactcctgctcccgcgcgcaggccaaccccgaccagtgggttgccgtcgtccagctccgccagcacgtgccccaccgccgcaccttcctctacctcgagcagctcctcctcaagcacggtcaggcttccctcgcgatccgagtcgcggcggcccccggcggcctcgacttcttcttcggttcgcgttcccatgccgcccgcctggtcgacttcctcgccaccgtcgctcctatccaaacttctacagcgaagcagctcgtctcgcacgacaccaagagcagcgtctacaactacaagtacaccttttcggtcgagatctgccccatctgccgcgaggacctcatcgcgctcagcccccaggcgtcccgggacatgggtggccttggcccgctcgtgctctgtgtaaaggtcacaaatgccattgctcttcttgatcccctcacgttgcgagtgcaccacctggaggagaaaaagtacagggtgtataatttcaaggcggctctcaccagcaagcagctcgtggagtacattgtgctcgacatcgaacaagaatcgcctgaaatttccattgatgggtctcgttaccaattggcttatgcacaggttgcccgggtgtcagatttcggaaaaaatgacaccatctttactgtgaggacgcatcttgggcacctgctgaaccctggggatcatgcccttgggtatgatctctatggtgccaacctgaatgatgatgacatggacacggctatggcccggtacagcttacctgaggtggttcttgtcaagaagagctatgagaagaggcctcgcacacggagatggaagcttaagaggttgccggtggaggaagatgctgctaacaaggccaagggtgaggaagagaggaggctagatgagtatgaggctttcctcagggatttggagctggacccagagatgaggttcaagatggatctgtacaagaatgaggactataggtctgagatggcatcaacagttggtgatgatatccctacggtgccaattgatgagttgcttgaggacttgacccttggtgaggatgaggaggatgaaggggaagaagctgtggaaggcaacactagtgctggaatggtggaatgagcaatactatctactatttatttctgactgagatgggttggcctgcctgccccttcaggtcataggtctgagatgcgcctgttagttatcatatatgttattttttgtcgttattactgctataagttagaattttggtcgtactgcttaagttttgaattctgctgtttgttggaatcaactttatttcaacccttatactgtgtattggaggtgtttcttggagccagctttacattaaatttttattaaaaaaaactttacattaaaatgtctatgcagcgtgtgatctgttgtttattgtcacctggttgcccatcacagc

SEQ ID NO: 13029 - DNA, 750 bp, Sorghum bicolor
  Clone ID: SORBI-28MAY03-CLUS36521_1
tcggcaaaacattccagatttcttgctagtccactttctagctacgcacccgtccttccaatagcgcagcttcgccggcgccggcacgcagctagccatggtcatcaaagatgggctgcagccgttgctcatcctcttcttcccagtcctcccgccagggcccctcctccccatgcgccgcatggccgcgctcttcgctccccgaggcgtcaagtgcaccatcctcaccaccccggtgaacgcccaagtcatccgctccgcggtggaccacgccaacgacgcctcccgcggcaccgatggcgccctggccatcgacatcgccgtcgtgcctttccctgacgtcgggctgccacccggcgtcgagagcggcccggcccttaattccatggaggaccgcgaaaagttctcccacgccgcccagttactccgcgacccgttcgaccggttcttggtggagaatcgccccgacgccgtggtgagcgacagcttcttcgactggtcagtcgacgccgccgcggagcacggcgtcccgcggatagcgttcctcggcatcagcttgttcgcgcggtcctgcagcgacaccatgttgcgcaacaacccagtggaggccgcccccgacgacccggacgcgcccgtgctgcttccgggcctgccgcaccgcgtcgagctgaagcggagccacggggcgcagcccccccgtggaggccgcccccgacgaccccgacgcgctcgtgctgcttccggggctgc

SEQ ID NO: 13030 - DNA, 746 bp, Sorghum bicolor
  Clone ID: SORBI-28MAY03-CLUS37110_1
cagtcatacgcaaagaacatgggactttatggacagagagcgggatgcctgagtattctgtgtgaggatgagatgcaagcagttgctgtcaagagccaactgcaacagatcgcgagaccaatgtacagcaacccacctgttcatggtgcactggttgtttctataatcctcaatgatccagaattgaagagtttatggttaaaagaagtcaagggtatggctgatcgtatcattggcatgcggaaggcacttaaggaaaatcttataaagctaggttcacctttgtcatgggatcatatcactaatcagattggaatgttctgctacagtggtatgacacctgaacaagttgaccgtttaacaaatgaataccatatttacatgacccgcaatgggaggataagcatggctggtgtaacaacaggaaatgttgcttacttggcaaatgcgattcatgaggttaccaaaccaaactgagttacggtcctacctttggcggatgaaatgaggctgaggcaccttttttttttctttcctgacataataacatggtcgttctggtgaaataagtgaagcctgcggtcccacatgcatggagactcagagatgtaaaacttcagttttgagagctatatacatgttgatcctattcctcgtattttctgtttcccggtcttgtcatgacaaattgttaccccagctgcaaaaggctatagcataatttaaaaacttcagttttgagagct

SEQ ID NO: 13031 - DNA, 690 bp, Sorghum bicolor
  Clone ID: SORBI-28MAY03-CLUS45952_1
atcggtgagcacgaggctcacatcgcaatgcgagctctgctccggatccactcgcccgcggtcatctccaccgcatccttcctccacacctactcaaccgccgcctccaagatcctagccccgagccccaccttcgtcccgctccggctcatccgccgcttcgcggccatggccgccaccgccgcggacgagttcgtgaagggccgcgtcttccccaacggcgtcgccgtcatcacgctcgatcgccccaaggccctcaacgccatgaacgtcgaaatggatgttagatacaaggcacttcttgatgaatgggaagcaaatccaagtgtcaagtgtattcttgtggaaagcagctcttctcgtgccttctcagcagggatggatattaagggggttgctgcggaaatacaaaaggacaaaaacacaccacttgtgcaaaaggtcttcacagcagagtactccttgatttgtaagatacatgagtatgcaaaaccttatatatgcttgatggatggagtgacaatgggatttggaattgggctatcagggcatggccgctaccgcattattactgagaggacactcctagccatgcctgagaatgctattggcctgttcccagatgttggttttgcttacattggtgcaaaagccccaggagggggcgcagttggagcttaccttgggata

SEQ ID NO: 13032 - DNA, 1639 bp, Sorghum bicolor
  unsure (1)..(1639): unsure at all n locations
  Clone ID: SORBI-28MAY03-CLUS4730_1
gatccatccgattcccaatcccccgcaagcgcagaggaggtcaggagggagggaggaagaggaagacggagtgaagcgcagagcccagccgccctcccctcccatcccactcccgtccacacgccccgcttcccatggcgctcgcgctgcgctgtcccccggccgccacctcctcccggagccccttcctgccgtcgccctcaccggccccgccggggaggctcccgaggaggccgcccgccagctggaggtgccacggctactacggcgacgacggatttcgcaagagctacgaccacatccccaagcagttccgcgaggagaacctcaaggatggactgatggataattacaagaatgttcctcaatttctttatggattaagttctgcacagatggaaatgtttatgaatgacgacaatccttataatcgccaatcccagaaagtcacagaggaaagcgtatctgctgctaggagttacgatgaatttggtatgtacaccttgtcaggcatgcatgagggtcctgcaagttacagcatgggtatgggcatggggggcagcatgagcatgagcatgggcagaggagggagaggatatacaagaatgagaagctctgctccagatctgccatcattgctactggactctcgaattatatttcttggaatgcctattgttccagcagtaactgagcttattgctgctcaatttctatggctagattatgacgaccgcacaaaacccatttatctgtatataaactccactggaactatggacgaaaataacgaacttgttgcatctgaaactgatgcttatgcaattgctgattttatcaatcgaagcaaatccaaggtttacacaatcaatcttagcatggcatatggtcaggctgcgatgcttctttcccttggtgtcaagggcaaaagaggagtgctgccaaattcaatcactaaattacacctgcctaaggtgcacaaatctggtggagctgccattgatatgtggattaaggcaaaagagttagatacaaacacagactactacctcgaactcttgtctaaaggagttggtaaaccaaaggaagagctcgctgagttccttaagggcccaaggtacttcagagcacaagaggctattgattatggacttgctgatacgatcttgcactcactggatggttctttcaagccaaaggacctgactgcgcagctggccaaagcacaggcgatgcggcagtcaggtaagcgtgcagctgctggagctgggagatggtcaactccaaccgcacccaggtagattagagaggtacaccaggatagtatatgctcatctggatgatggtgtggttccgctattcaaagaagccagcctttggtatatttaggttggaaagaatcatctccatggagcttggaattagacgcacgctggatagtgaaatgttgtaaactgtagtgtcagttgtgacgtgtatcatctgtgtgcaatctttgttacgcacagccattgcattcagatagatttcatcagtggaaatgatagcctgtatgaatcatatgacccatagcatccaattcagtagatgttctggactattgttgatcagtggtccgttcttttggtgattaattant

SEQ ID NO: 13033 - DNA, 870 bp, Sorghum bicolor
  Clone ID: SORBI-28MAY03-CLUS4796_1
actgtagcaaaaccgcgtccgcgtgcaatagcgagcgtccaactccaacccaccaccgcttcccccgttccccaccccgaccgactgctcctcctcccccgcgccatcctcaaggcatcgccggcgccgcaacttcgccgaggaggaagcccgcaccccggccccgatccgatggccaacagcaacctcccgcggcggatcatcaaggagacgcagcggctgctcagcgagccagcaccggggatcagcgcgtcgccctcggaggagaacatgcgctacttcaacgttatgatccttgggccggcgcagtcgccctatgaagggggagtttttaagcttgaactctttttacccgaggaatatccaatggctgccccaaaggttaggtttctgaccaagatttatcatcccaacattgacaagcttggtaggatatgcctcgacattctcaaggacaaatggagcccggcacttcagattcgcacggttcttttgagtatacaggctctcctgagtgcgccaaatccagatgaccctctttccgataacattgcaaagcactggaaagccaatgaggtagaagctgttgaaacagccaaggagtggactcgcctgtatgcgagcggtgcatgagaacctggttctgttcttgatgtaataacccgtcatacttcagtcctaatctattgccatttgcttgataaaaacagactggagatatttgccatggaaggaagtctctaaatgactaccactctgaattgtttggttgtacaactatggtcggttccctttacctttgggcacctttgactaatcagtatctgtggtagaacttgctgttactttaatatatttgtcacttcatgt

SEQ ID NO: 13034 - DNA, 872 bp, Sorghum bicolor
  Clone ID: SORBI-28MAY03-CLUS4591_1
tccatctgttgaatgcacatcatcagtgctacaagctctgattatgttcagagacctagatcatgggtatcgcaaagaagagataggaaattgcattgaaagcgcaactaagtttattgagaaagaacaacgaaaagatggctcctggtttggcagttggggtgtatgtttcacatatgggtcgttctttgcgataaaagggttagctgcttctggaagaacttacaaaaatagtgataccatcaggaaagcatgtaactttttgttgtcgaagcaactacatacaggtggatggggagaaagttatctttctagtgaaactgaggaatatgtggatgctagtagacctcatgctgtgaacactgcttgggcaatgttagccttagtttatggtgggcaggtggaacgtgatccaacaccattatataaagctgcaaaagtgttgatcaatatgcaactagaatctggtgactttccacaacaagaacatgttgggtgctttaatagttctttgtacttcaactacgggaactaccgcaacttgtatcctatatgggctcttggggaatttcgtcaacggctccttgcaagaaagaagtgaaaccaaaatccatgaaatctaggctattttactttattacaaagaatatacaaaatgttcagaattactgttatatgttagtaattgtgcttacggtccggttatgatagtggaaaactaatggctgtcgtacataatatattgatgtgaccttccgaatctaaggacagagctgtcgctctttcttgttcttttgtttttaggtagttagccaaatatacaatcatttgtttgacactttgtttgatgtatatacttgtgtattttacgt

SEQ ID NO: 13035 - DNA, 610 bp, Sorghum bicolor
  unsure (1)..(610): unsure at all n locations
  Clone ID: LIB3481-046-Q6-K1-B11
gcgttctgaagnacaactaaaanaggctcctggtttggcagttggggtgtatgtttcacatatgggtcgttctttgcgataaagggttagctgcttctggaagaacttacaaaaatagtgataccatcaggaaagcatgtaactttttgttgtcgaagcaactacatacagngtggatgggggaggagagggggctttctagtgaaactgaggaatatgtggatgctagtagacctcatgctgtgaacactgcttgggcaatgttagccttagtttatggtgggcaggtggaacgtgatccaacaccattatataaagctgcaaaagtgttgatcaatatgcaactagaatctggtgactttccacaacaagtctccaagggatcggaactagattattacctttcctgacaaatctgatagccctctcctgtgattttcggatagttaaaagcagataggaaaagacacatgagaaacgtaatcacagtgatgcaacaaagttctaccatttccaactaatgatgtcataaatgatggctaacaatgatcatttatggatgaactttgaaccacaaaagtctgcacgctattgctacagagagagtata

SEQ ID NO: 13036 - DNA, 1069 bp, Sorghum bicolor
  Clone ID: SORBI-28MAY03-CLUS3776_1
gcacgaggggagcgagggcgacgtcaccttcttcaggccccgccccgcccgggggtaggcgtaggcggtaggcctcagctcggctcagccgcctcgctcgaagtcgaaccagaaagcgaagcagagcagaggaagcgaggcgcgcgggcgggcggcggaggcgaagatgtcggcggggctggtgaccgacgaggccaccgtggggcggctctaccggatccggcgcacggtgatgcagatgctgcgtgaccgtggctacctggtggtggagcacgagctcgccaccagccgccgcgacttcctccgcaagttcggcgagtccttccaccgcgaggacctccaaatcaacaagtccaagaagaacgacccctccgaccagatatatgttttcttccccaatgatgacaaggtagggatgaagcacatcaagaagtacgttgaaatgatgacccatgagaatgtctccagagctatggtggttcttcagcagaacctaactccatttgcaaagtcgtttctcatagaattggagccaaagatccatttggaagttttccaggaggccgagttgcttataaacatcaaggagcatgttcttgttcctgagcatcaggtgctcacaaatgaggagaaaaagacgctattggaacggtacaccttaaaggaaactcagcttccaagaatacagatttcggatcctattgctaggtactatggcctcagaagaggtcaggtcgtgaagatcatcagacccagtgagacggcgggcagatacgttacataccgctatgttgtatgagacaaaacgtcagaacgcaggtgaacttaagaagagaaccatagatatggtaattttttgaagctacacataccccatgtgcttggagacatcagtatcgctttgtagcagacactattaacgataagtggctgttgtgtaagtgaattgaataagctgagtatatggaccatacgtgaattctcatgttgtacactttgttgtatgaactgtataaacactcaaataataaaaaagaagcctgttttcggagctgacagaagctcctgc

SEQ ID NO: 13037 - DNA, 1414 bp, Sorghum bicolor
  Clone ID: SORBI-28MAY03-CLUS38989_1
gcacgagggcccagtgggctcaaaacacttggcggcgccacctcgccctcctccgactactcgctcgctcgtcccgccccgtcttccgcccccgcctccgcccccgccgcccttggctcgcaccagcgccacctcgccctcctccgactactcgctcgctcgtcccgccccgtcttccgcctccgcctccgccgccgccgcccttggttcgcctcatcgtcgtcgccatgggcaaggcctccaaggacaagagagacatctactaccggaaggccaaagaggagggatggagagctcgcagcgccttcaagctcctccaaatagaccaggagttcaacatcttccatggagtgaagcgcgtggttgatctgtgtgctgctcccggaagctggagccaggttttgagccggaacttgtatgtaccagcaaaacagtctcctgattgcaaggaaggtgaccttcctctcatcgttgcaattgacttgcaaccaatggccccgatagaaggtgttatacaagtgcagggtgacatcaccaatgctcggacagcggaagtggttattaggcattttgatggatgcaaagcagacttggttgtttgcgatggagctccggatgttactggccttcatgatatggacgaatttgttcagtcccagcttatacttgcggcattgactatcgtgactcatgtactcaaagttggtggaaaatttgtcgcaaagatatttcggggtaaagatacaagtctcctgtactgccagctaaaactgttcttctcacaagttacatttgcgaagccaaaaagtagccggaactcaagcattgaggcatttgcagtttgtgagaactattcacctccagaagggttcaaggaggaagatctataccacctgctagagaaagtagggactccttcaggagttgacgatttagattgcagaagcggatggctcgagggaccaaacaaggtgtatatcccgttccttgcctgtggggatctcagtggctacgactccgaccgctcatacccgctcccaatcacagacggtggctcctaccggagcttggaccccgtccagcctcccatcgccccgccttacaaaaccgcccttcagatgaagaaggcctccagccacagcgccagcagggacgccatgaaaccatccacagactcttgagctgcaacctgggccagcctgaacccccaggcgatgatgtttgtcccacactggtagcatcgctgggtcctggacctggctctctcctgagcctcgtctattaaaaaggaaaaagaaaatttgggaacattttgtgtcgaggtgggacattttgtggtagttttgagctgtggctccgcagcatgtacctgatcactactgattacgcagagatcctgcttgtgtccttgtgc

SEQ ID NO: 13038 - DNA, 1475 bp, Sorghum bicolor
  Clone ID: SORBI-28MAY03-CLUS40115_1
gcacgagggtcttcttcaagcccggcgagcagttcagggatcttgtcgggagcgcctactacgtcgccccggaggtgctcaagcggcgatacggagctgaggcggacatatggagtgccaagcagatcctctacatcctgctatccggcgttcctcctttctgggccgagaagaaggatggcatatttgatgctgttttgcgaggtcatattgacttcgcatctgatccctggccttccatatcgaatagcgcaaaagatttggtcaagaagatgctgcgccaagatcccaaggagcggcttactgctgctgaaattttgaaccatccatggattagggaggatggagaggcgccagacaagccaatagacattacagtaataagcagaatgaagcagttccgggcaatgaacaagcttaagaaggttgccttgaaggtcgttgcagagaacttgtcagaggaagagattgtgggcttgaaagaaatgttcaaatccctggatactgataacagtgggacaataacgctggaagaactgagagctggtttaccaaagctcggcaccaaaatctctgaatcagaaataagacagttgatggaagcggctgatgttgatggaaatggtaccattgattatgttgaattcatatcagcaacaatgcacatgaatagactagagaaagaggatcacatttttaaagcattcgagtatttcgataaggaccatagcgggcacattacagttgatgagttggaagaagctctgaagaagtatgatatgggtgatgaagcaacaattaaagaaattattgctgaagtagatacagatcatgatgggagaatcaactaccaggagtttgttgccatgatgaagaataatagctctgatattgttcccaatcggaggcgcatgttttaagtctctcctacatttaattgaaaaaaaaggcttctaagatatttccagggtcagagaggagagcaactactactctgaagtggaactcagccaggcatctgtgcaatgatattccatacttggacaagttaccaatcatggtttactgcctttgtgtgcccatctacatggatggtaggaggttctttctggtgcttccatgttctaccatctcatcttacgatttttccatgtatccttaatgaggcgtgccttatggtctaatgtttccttcctactggatcttttatgtaagaaatgggcttctaaaacagttccaaattatcatatagtatcaggcaaaaagtaatgcactaatgcgatgtgccttcagatcctctctctctctttttcttttctttttggtcactggatcatatatgtgagagacctggctttgtatgacggtccctgatgtcgataccagacaagattatactttgtaacgaacatagctcgacttttaatttccatttcctacagtaaaaagtactggaatcataatgtgtcatcctt

SEQ ID NO: 13039 - DNA, 1416 bp, Sorghum bicolor
  unsure (1)..(1416): unsure at all n locations
  Clone ID: SORBI-28MAY03-CLUS4065_1
gcacgaggcagctgtgacacgaaaaaaaacgaatccttttgtagctcgtcatttattggcaaaaatcgaaaaggtcaatatgaaggaggagaaagaaataatagtaacgtggtcccgggcatctagcattctacccgcaatggttggccatacaatcgcgattcataatggaaaagaacatatacctatttacataacaaatcctatggtaggtcgcaaattgggggaattcgtgcctactcggcatttcacgagttatgaaagtacaagaaaggatactaaatctcgtcgttaattgaattcagaatagaaagattcagaataaacaaaatttataggattcaaataatcaaataaaataaagataggcgggtaataaccttatttatgacaagtttcaaattggtaaagtatacccctaggataaagaagaagaaggggctgagaaaactcgcaagaaaagttccaaccgatcgtctacttaaattcgaacgggttttcaaagcacaaaaacgcatacatatgtctgttttcaaagcacaaagagttctagatgagattcgctggcgttactacgaggaaaccgttatgatactgaatctcatgccttatcgagcatcgtatcccatcttaaagttggtttattcggcagcagcaaatgctactcattatagggatttcgacaaaacgaatttattcatcactaaagccgaagtcagtaggagtactattatgaaaaaattcagacctcgagctcgaggacgtagttattctataaaaaaaacgatgtgtaatataacaattgtactaaatatagtaaagaaatctaaataatctttagatcaatctaaaatttcgattcccagtaaaaaaaagaaatataatagaaaaatatgggacaaaaaataaatccactcggtttcagacttggtacaacccaaaatcaccattccttttggttcgcacaaccaaaaaattattctgaaggtctacaggaagataaaaaaatacggaattgtatcaagaactatatacaaaagaataggaaaaaaggctcgaatagaaaaatggaatcagactcaagttctgaagtaattacacatatagaaattcaaaaagaaatcgatacaatccacgtcatcatccatattggattccccaatttatctaaagaaaaagggagcaatcgaagaattagagaaagatctccaaaaggaagttaattctgtaaaccagagacttaatattgctattgaaaaggttaaagaaccttatagacaacctaatattcttgcggaatatatagctttccaattaaaaaatagagtttcattccgaanagcaatgaanaaagctattgaattaactaanaaagcggatataaagggaataaagatccaaattgcgggtcgtcta

SEQ ID NO: 13040 - DNA, 857 bp, Sorghum bicolor
  Clone ID: SORBI-28MAY03-CLUS4120_1
cggttggcagggcagtggacttgacgaggttagatgggtatgatgatcttcacgtccgcccgggcgtcctgtttgatatccatggagagctttctgccaacctcaggaaatggaaggttgtttacacagatgatgaggatgacatgatgctggtcggggacgatccatggaatgaattttgcaggatggtaaaaaggatatatatttactcttacgaggaggccaaatctttgactcccaaagcgaagctgccagtcattggtgacaccatcaagccagacccaaacaaattgtcaccggaatctgacatgccacagagtgacacaaacagcaatgctcccgttgctgctgataaggattgatgaatgctaacttggccctatcttttcttctcctcttggatgttggtcatgggaggcaatgcccatgctccttgagactgctaagagttattctgttttgttgcttcgcgggcccaaaggacgctgccctgcatcatctgcctcggtctggaacggcttggaccagcgtggtcctttacccgcaaggaatggctgtgagggaatgcattaccattccgtgtgtggcacccgtgttttgtttgccgtgtttggtaggaggcatggcttattgccgggtactttggttttggagactgccactgactgctgccgtctcactggccgtgccgtcggcaggccgcccctctcacctctagtaaataggacttatgtagacaactattttggtagtagcagtagtagtatatgtatatcatcggtcatgttgcttgctacatatactcactcctatatagcatccttcgtagctgctttttccccccaaaaaaaaaaaaa

SEQ ID NO: 13041 - DNA, 1864 bp, Sorghum bicolor
  Clone ID: SORBI-28MAY03-CLUS40750_1
ctgcgctccctcgtcggcacgccggcatcctccgcgctgcactccttcgagccccaccccatcgtcggcgacgcatgggaggcgctccgccgctcactcgtcttctttcgcggccagccccttggcaccgtcgccgccgtcgaccacgcttccgaggaagtcctcaactacgaccaagtgtttgtgagggatttcgtgccgagcgcgctggcgtttctgatgaatggcgagccggatatcgtcaagaacttccttctgaagaccctgctgctgcagggctgggagaagaaagtcgaccggttcaagcttggggagggagccatgccggctagcttcaaggtgatgcatgacgccaagaagggggtcgagaccctacatgctgattttggagagagcgccattgggcgcgtggcgcctgtggattctggtttctggtggatcatactcctccgggcgtacacaaaaaccaccggtgatatgaccctggcagagacaccggagtgccagaaagggatgaggctcatactcagcctgtgcttatctgaggggtttgataccttcccgacattgttatgtgctgatggttgctgtatgatagatcgcagaatgggtgtatatggataccctattgagattcaagcccgtggctttatggcactaaggtgtgctcttcaaatgcttaagcatgataatgaagggaaggaatttgtagagaagattgctacccgccttcatgctttaagttatcacatgcgaagttatttttggctcgatttccaacagctaaatgacatttatcgttacaagacagaagaatattcccacacagccgtcaacaaattcaatgttattcctgattcaattccggactggctatttgactttatgccttgtcagggtgggtttttcattggtaatgttagtcctgccaggatggacttccgatggtttgcacttggaaacatgattgctatactttcttctcttgcaacacctgagcaatctgttgctataatggatcttattgaggagcgttgggaagagcttatcggtgatatgcctctgaagatatgttatcctgctattgagaaccatgaatggcgaattgtgacaggctgtgatccaaaaaatactagatggagctatcacaatggaggatcgtggccagtacttctgtggctgctgactgcagcctgcatcaaaactggacggccgcaaattgcaagaagagcaattgacctagcagagaggaggctgttgaaggatggctggcctgagtactatgacgggaagcttggtcggtatgttggcaagcaggcaaggaaattccagacttggtccatcgcggggtatttggtcgccaagatgatgttggaagatccttcacatcttggcatgatctccctagaagaggataaggcgatgttgaagcctgttttgaagcggtccgcatcatggacaaactaagatggcgacgataatttttcgggaagcaaagtcagctgaaaacacgaattcttggggtagcatctccttgtctgctgacccccttccttgacttccaaaccgggttggtttgtgtcttctggatttttcttggttgtacaatatctcagctcgtttcctgagttgaaaaaaaagaagcaactgcagaaatgggcgttttgttttttctttccaaatctctctgtaagaagatactctgattcttgcttgggtcatcataagttatggatccttttggttagactcaactttgttgtaccagtggactatacagatgagtaagctgattccagcttccctgtgaagcataagtgctatttctaacgaatgaataaagctcctttctctgcgttgctgc

SEQ ID NO: 13042 - DNA, 1195 bp, Sorghum bicolor
  Clone ID: SORBI-28MAY03-CLUS4254_1
tactggccgcccgggacttcccagaacgccagacggcacacacacacacacacacacacacatcctcacgcccgcacgcgcgcgcctcccgctgttctctccacaaagaaagaagagcaacgaagccatggcgccgagaacgtcagagaaaacgatgacaccggcggcggcggctgccgccacggggctcgcgcttagcgtcagcggcggagccggagccagcggcccgcacttcagaggcgtcaggaagcggccgtggggccggtacgccgcggagatccgcgacccggccaagaagagccgcgtgtggctcggcacgttcgacacggccgaggaggctgcgcgggcctacgacgccgccgcgcgcgactaccgcggcccaaaggccaagaccaacttccctttcccttcgtcgtgcatgccactcgccgccggcgccggcgccggcagcttgcctgcggcgaaggccgtcaccggtggcggcggcagccggagcagcaacagcagcaccgtcgagtctttcagcagcggcagcgacgtgcaggcggcgcccatgcaggccatgccgctcccaccgtctctggagctcgacctgttccaccgcgcggcggctgcgggcacgggcacgggcggcgccgccgtacggttccctttcaacagctaccccgtgacgcacccgtactatttcttcgggcaggccgctgctgccgcggcggcagggtgccacatgctcaagctggcaccgacggtgaccgtggcggccgtggcgcagagcgactccgactcctcgtcggtcgtggatctgtcgccatcgccgccggccgccgtgtcgacgcagaaggccgccgccgcgttcgatcttgacctgaactgcccaccgccggcggagatggaggcctagccgccggagtttttagctgaaaaaatgactgcctgtagtttctttctttcgtcgccttttgcccgtagaggaaagcttagaagagaaccctcatgttcgacagagggcggaggacatttttgtaaatagtttttccgctggggacctagctttagctgatgataaaagcttgtattgtcacccaagacaggtcctgccggcgttgttatggaccggattattatattattattatgtattttgatagtcaagagaaacgcctcagaaaaattccaaaaaaattctcacagaaac

SEQ ID NO: 13043 - DNA, 2670 bp, Sorghum bicolor
  Clone ID: SORBI-28MAY03-CLUS52_1
gcacgaggagcgcgccgaggcggcaccgcaccgtggtagtagtagaaggcacgggacgcgcgcccccccggggggcctcctcactttctccgcgccatccacggcacccgcgcccctcctgctgctccctctccgcaatggcgacgccctcggccgtgggcgccgcgtgcctcgtcctagcgcgagccgccgccgggcttgggcttgggcccgggcggggcggcgatcgggcgcgcccgcgccggctccagcgcgtggtgcgcaggcggtgcgtcgcggagctgagcagggagggtcccgcgccgacgccgcgcccgctgccacccgcgctgctggcgcccccgctcgtgcccgccttcctcgcgccgccgtccgagcccgagggtgagccggcgtcgacaccgccgcccctgcccgacgccggtctcggcgacctcggtctccaacctgaagggattgctgagggttccatcgatgagacagtagttgtggcaagtgagcaagattctgagatcgtggttggaaaggagcaagctcgagctaaagtaacacaaagcattgtctttgtaactggcgaagcttctccttatgcaaagtctgggggtctaggagatgtttgtggttcattgccagttgctcttgctgctcgtggtcaccgtgtgatggttgtaatgcccagatatttaaatggtacctctgataagaattacgcaaatgcattttacacagaaaagcacattcggattccatgctttggcggtgaacatgaagttacctttttccatgagtacagagattcagttgactgggtgtttgttgatcatccctcatatcacagacctggaaatttatatggagataagtttggtgcttttggtgataatcagttcagatacacgctcctttgctatgctgcatgtgaggctcctttggtccttgaattgggaggatatatttatggacagaattgcatgtttgttgtgaatgattggcatgccagtctagtgccagtccttcttgctgcaaaatatagaccatatggtgtttataaagactcccgcagcattcttgtaatacataatttagcacatcagggtgtagagcctgcaagcacatatcctgaccttgggttgccacctgaatggtatggagctctggagtgggtattccctgaatgggcaaggaggcatgcccttgacaagggtgaggcagttaattttttgaaaggtgcagttgtgacagcagatcgaattgtgactgtcagtaagggttattcatgggaggtcacaactgctgaaggtggacagggtctcaatgagctcttaagctcccgaaagagtgtattaaacggaattgtaaatggaattgacattaatgattggaaccctgcgacggacaaatgtatcccttgtcattattctgttgatgacctctctggaaaagccaaatgtaaaagtgcattgcagaaggagctgggtttacctataaggcctgaagttcctctgattggttttattggaagattggattatcagaaaggcattgatctcattcaacttatcataccacatctcatgcgggacgacgttcaatttgtcatgcttggatctggtgacccagagctcgaagactggatgagatctacagagtcggacttcaaggataaatttcgtggatgggttggatttagtgttccagtttcccaccgaataactgccggctgcgatatattgttaatgccatccagattcgaaccttgtggtctcaatcagctatatgctatgcagtatggcacagttcctgttgtccatgcaactgggggccttagagatactgtggagaacttcaaccctttcggtgagaatggagaacagggtacagggtgggcattcgcacccctaaccacggaaaacatgttgtggacattgcgaactgcaatttcgacatacaaggagcacaaatcttcctgggaagggctcatgaagaggggcatgtcaaaagacttcacgtgggaccatgccgctgaacaatacgaacaaatcttccagtgggccttcatcgatcgaccctatgtcatgtaaaggggaccacaagtggtgtgtccttaaagatcttcagttcttcatcctacagtggaaggatgagaaaacccctgtacattacatggaaggcggaccggctgttgggtggctccaatgtccaggttagccttacggagcctgctgctttggctggtttgtcccaaaggaccgtgatgcagtgaggaccagttgaacgacagttttgaagaataagaaggggatgctggaagcagtcgtgcaggcagcctcgcagtgatacatatggattatggaacaaactggagtcagtttctgctttgccactcactgtttaccttaagattattaccctgttgttgtcctttgttcgttagggctgataacttaatgactcatagaaaaccattccttgtttttcttgaccacttctgtgcgttctcggccgtttactagagatggccattgctgatggccgtttactatatatcgaaagcgtagctatgatggtatggaggaatcctgtaaagcgcatggtgttggactgttggtgtatgccttgtgtcccagcacgggtttccatgtttcaggtgctttatacttgtcgtgacca

SEQ ID NO: 13044 - DNA, 461 bp, Sorghum bicolor
  unsure (1)..(461): unsure at all n locations
  Clone ID: SORBI-28MAY03-CLUS4971_2
caattaattatacattatttgtcttggactctgtgatagagtcttgcattgtgagtgccctaagcaaaagaaaaggtggcgactgattcctaaaccacacacagcattgtgccgtacatattatagccagccttttgcatgtatacatgtactgaatttaataatttccctgcaaactggacaaaatagccaatgtgatgactcagcaactgagaacatcaaaaagcttagccatcagaaggtaactgatcctcctcaagctccattgtacatatgaaacattccctctggaaaattattaaattcaggacatgtatacatgcaaaaggctggctataatatgtaccggacaatgctgggtgtggtttaggaatcaggcgcccccttttcttttgcttagggcactcacaatgcangactctatcacagagtccaagacaaatnaatgttaattaattgcg

SEQ ID NO: 13045 - DNA, 843 bp, Sorghum bicolor
  Clone ID: SORBI-28MAY03-CLUS4971_1
gaacaaaatcttgggatttcgagttgcatcttatatagattttccaacatgtgtatctgtgcttgtacacatacacaaggggactgaaacgggccaattctcggctgctgttaccagctggtccattctcgtgcacaatcgtgcagaaccacagtaaagggatatgacattacaatacatataatgttacacagtggacacctatacacaccaaatttcatcattccgtttccgttacaaaatggtgtggcaatacatcagtcacagcaggttcttcagtcttgacgtcataatggattgaagtatgccggtcatgactcatggattagtgcaaatgatttgcattcataagcaaaagaaaaggtggcgactgaatcctaaaatcccctgaaaccacacacagcattgtgccgtacatattatagccagccttttgcatgtatacatgtactgaatttaataatttccctgcaaactggacaaaatagccaatgtgatgactcagcaactgagaacatcaaaaagcttagccatcagaaggtaactgatcctcctcaagctccattgtacatatgaaacattccctctggaaaatcaaaaattcctgcaactgctgctggctgaacaaatgcatcattccagactcggctgaaccaactaactcaattagtttgtcacagttatctagagaatcgccagctgcggagagtgcaatacatgcctgcatagatcttagaattgtttcaggaaggcagcatctccgacacagccctcgaattatgtaagcagcagtgctctccacagagccactcccatcagaataccaagcatcaagccgtgaaa

SEQ ID NO: 13046 - DNA, 823 bp, Sorghum bicolor
  Clone ID: SORBI-28MAY03-CLUS531_1
gccggccggggcccggagatccatccatccatcaatcagcagcagcagcagcagcatcatcatccaagaagaggcgcagccatggcgagcgagcacgcggcggcgggtgaggggaagcacgagaagcagagtctgatggacaaggcgaaggagttcgtcgccgacaagatcgcgcacatcccgaagccggaggcgacgctggacgcggtgacgttcaaaggtctgagcagggagtgcatcacgctgcacagcagcgtgaacgtgtccaacccctacgaccaccgcctccccatctgcgaggtgacctacacgctccggtgcgccggcagggaggtggcgtcggggaccatgccggaccccgggtggatcgccgccagcggcaccacctcgctggagatccccgccaaggtgccctacgacttcatcgtctccatcgtccgcgacgttggtagggactgggacctcgactacgagctccaggtcgggctcaccgtcgacctccccatcgttggcaacttcaccatcccgctctccacctccggcgagttcaagctacccactctcaaggacttgttctgatctgatagcttgctttctgttctgtcgtcgcctgagctgagagcctgagacggatgagtgacagcgatctgtactgtactctgtgttgtgcgtgatctgaatgatccctacgacgaacgcaccatatcttgttgcaaataaacgcaggtcctctgttccattcaaaagctttcagtttgtttcccatgaatgaatgcaaaaggaagatggtttgattgcaaaaaaaaaaaaaaaaaggccccta

SEQ ID NO: 13047 - DNA, 824 bp, Sorghum bicolor
  Clone ID: SORBI-28MAY03-CLUS5679_1
ccctctcgcgcacgcaccaacgtgcacccggacccggcggcacgcccagcgccagtcaccaaccagcccaccttccagtccaacgccaccttctccctccgtcgctcgccatggcgcgcaagaagatccgggagtacgactccaagcgcctcctcagggagcacctcaagcgcctcgccggcatcgacctcaccatcctctccgcccagatcacacagtcaacggactttgcagagcttgtgagccagcagccatggctgtcaaccatgaagctagtggtgaagcctgatatgctgttcgggaagcgtgggaagagcggcctcgtcgctctcaacttggacttcgatcaagtcaaggagtttgtcaaggagcggcttggagttgagattgagatgggcggttgcaaggctccaatcacgaccttcatcgtcgagccgtttgtgccccatgatcaagagtactacctttcaattgtttcagagaggctgggcagcaccatcagcttctcagagtgtggtgggattgagatcgaggagaactgggacaaggttaagacgatttttctgcctactgagaagccaatgacacctgattcatgtgctccgttgattgcaacgcttccattggaggcacgtgggaaaattggtgacttcattaaaggagtgtttgctgtctttcaagactaggatctctcatttcttgagatgaatccattcaccatggtcaacggggagccatatgctctggacatgacgggagaacttgatgacacagcatcctttcaagaacttaaagaagtggggagatatagaggtccctctacc

SEQ ID NO: 13048 - DNA, 703 bp, Sorghum bicolor
  Clone ID: SORBI-28MAY03-CLUS5888_1
attcctaccgaaagggcatatgtctataaggttgccccgcaggcagagtgtaatatacctttccggattgactcctcggctgaaggtggggaggaaaatagctgcttgaaagggggtgtttacttagctgatggtgatgaaactgttccagttcttagtgcgggctacatgtgtgcaaaaggatggcgtggcaaaactcgtttcaaccctgccggcagcaagacttacgtgagagaatacagccattcaccaccctcgactctcctggaaggcaggggcactcagagcggtgcacatgttgatataatggggaactttgctctgattgaggacatcatcagaatagctgctggggcaaccggtgaggaaattggtggcgaccaggtttattcagatatattcaaatggtcagagaagatcaaattgaaattgtaacccatgggaagttaaagaagcgccaactcattgattgcgttccaaagtgattgcctgagtgcaactctgtggattttgcttatataaatattgtaatttttcacacttcattcgtccctttcgcaaatttacattgacaggacgctgatgcgatgttgtaccactatttgggaaacgtacggcattgtatattaaaatgtacaggtgtaagttacatttgctagctgaaatcccgctcgcgatctagaactggttaaagtttttatgt

SEQ ID NO: 13049 - DNA, 926 bp, Sorghum bicolor
  Clone ID: SORBI-28MAY03-CLUS555_1
tgcctgcgctgacacacatttcccatggcagcgtccacggcctcgcccaccttcacgcccttcctccaccggcaccagcagcggcgcaccaacgcagtcgtcgtcgttgccgctgcgagcaaccccggcgccgaaccgactccagcgacggcggcggacggcgcgggaccagcagggaagaagaagacggtggacacgaggatacactggtccaaccctgacgaagggtgggtaggaggcaatgccaagaaggaaggcggcggcagtggcggcggcggcggcggcagcaagaacgagccgctgggagggaggttcgccgacctcatcaacaacgcgtccgagtctcactaccagttcctggggatagcgccggaggcggacatcgaggagatcaaggcagcgtaccggcggctgtccaaggagtaccacccggacacgacgacgctgccgctcaaggtggcgtcgcagaagttcatccgcctgcgggaggtgtacaacgtgctgagcaaggaggagacgcggcgcttctacgactggacgctggcacaggaggccgagagccgccgcctgcagcagctcaggtccaggctcgaagacccctacgagcaggacatcatcaactacaagtccgtgccggacatggttgaccgcctcggtggcaagaacatggagctcagcgaccaggccatgactgcgctcacctttgatatcgtcatcatcatcatctcaatctgcagcatcatctatgctgtgtacttcaaggagcagtactgatcgcagttgcaggagtgtaccatagacaacagtataggttaatgtcctaagattgtcttttcggatgttatgcagtgcgtcatgtgatgtcaaatacaataaggtatggtgccaacaatcctatatttgctatcaaatcatagttccagtat

SEQ ID NO: 13050 - DNA, 1070 bp, Sorghum bicolor
  Clone ID: SORBI-28MAY03-CLUS56626_1
aagcttaacacagtagcaaatctttattcctgggagtacttgctaacgcaaggctactttacccaacgttaacgtacacaagtcactccattcttactgtattgtgcacatgccacatgcttgcacgcacgcatatatccacgtcatcatgcatggggcgcgttacttacacacacacacacgtatcaaatcaaactatcaaggatgcacgatgatcttggggttcttcgtacatatcggggggggcgcggccgccggcgccgccgttgccggcgagcgggaagtataaggggtaaatttcgtagcgcccccggcggctgcggcggctgcgccggcgcccccgccgcgcgccgcaggcggcgccggccccgccgccactggtgacggcgccgactgacgcacggcgcgtccataggaggacggtaggagccgcccccccggagggggtcacgaacggcgtgtactgatccttgtcccgcccgagccccgcgctgcccgccgccgacgcctgcgccgtcgccttgccggtcgcttttcccaccgccttctcgaacgccttcgggttgtccatggcctgcacgttcaccaggatcacgcccgcgcccgtgtccgcctgcccgaagaagtcggcgttctcgtaccgcatgaagcagtagtcataccatattctggcgtcggaactgtagctgcaagtgctggggagctgcttggcggcgtcggcaaggcaggccgcgcagtcgctggcggagacgtcgccgcggcattgcgcgaggccgtagatgatgttgttgcccttgccggcggtggacgtggcgtagccgcctccggtggaggccgtggcgacgaggtcggcgaggacggagttgatgctggtcacggccttgttgctgcccgcgtagcggcttcctgagcagtagctgccgatggagtccgcggccatgcccagcgggagcagagccaaggagacaagcagcacgcagcagcgcattgtgctaaacttcatggcctcgggcgtatgaatcatgcccatgtttttggttgctatcttagcctgcgtgctagcctcgtgc

SEQ ID NO: 13051 - DNA, 1416 bp, Sorghum bicolor
  Clone ID: SORBI-28MAY03-CLUS56139_1
acaccaagctaagcgcgcgggggccaccgcacgagggaattactaagctagcagaagcaagagtgtagctaccgagagataaagcaaagcataggcgccatggctgcctctgcttcttgcctcgcctttttggtggcggcggcggtggcctcggtggcgtcggcgcagctgtcgtcgacgttctacgacacgtcgtgcccgaacgcgctgtccaccatcaagagcggcgtggacgcggcggtgatgcaggaggcgcgcaccggggcgtcgctgctccggatgcacttccacgactgctttgtgcatggctgcgatgggtccgttctactgaacgacacgtctggggagcagagctcacctccaaacaagggatcgctgaggcgcttcgatgtcatcgacagcatcaaggcgcaggtggaggccgtctgccctggggtcgtctcctgcgccgacatcctcgccgtcgccgcccgagactccgtcgtcgcgctcggcgggccttcgtggaccgttctactggggagaagggattccaccgcttcattcccgagcgagacaaccgacctcccagctccaacatctagcctccaacagctgttatctctgttcagcaacaagaacctcgacgcaacagacatggttgctctctcaggggctcacactatcggacaggcgcagtgctccaacttcaatgaccatatctacaacgacaccaacatcgacgccgccttcgcgacatcgctgcaggccaactgccctgcatcaggcagcaccagcctagcgccgctggacaccatgacccccaccacattcgacaacgactattacaccaacttgatgtcgcagaaggggctcctgcactcggaccaggagctcttcaacaatggcagcaccgacagcacggtcagcaacttcgcgtccagcgcatcggccttcaccagcgccttcacggcggcgatggtgaagatgggaaacctcagcccactcaccggaactgatggggagatcaggctcgcctgcgggatcgtcaactcctcctaattaagacggacatcgacgacgacgactcacgttggcataataatcagcatcaagtatgggaatgtgctgtactgctgatgagcgccaacccgcattctcagttcgcatagccaataagatcctgcatgcatggactaccaagcaacaaggatatatatacatatatataggagtatgtataacgagtgatgtacgtatgtacgccacctcgatttctttgttccatatcaatatgcatggaacggatacttatagccgtgtgtatcgatctacatatgtaacgaggacctctcatgcaaaggcattgggaggttaattaggtactactagccaatcatatcactttccctagctatatatgtttccacatttcct

SEQ ID NO: 13052 - DNA, 753 bp, Sorghum bicolor
  Clone ID: SORBI-28MAY03-CLUS56736_1
gcacgagggccgcaggtagaggagagctatggatcaggatacggcagcaggccgcagggtggggaggagtatggcagtggtgggtatgggaggaatactcaggaggagtcctcggggtatggctatggcaggaagaatgaggagcagagctatggtggttctggatatgggtatgagaagaaggcatctgaggaggatgaaggtgcctatggctctggtggttaccggaagccaaaaccgtatggcgaggagacacagggttcatatggttatggagaggagcagtccaagtatcagagtggtgggtatgagaggccaagctatggtgggggagaggggtactatggccgcaagaaagatgatgatgactcggatgatgagaagaagcagcgtcatcagaagcaccaccaccatcgccgccacgactatgatgattaagcaccagcgccttctgctgggtgtgtttgcataaataaagatgggtgtaccttctggacattggaccatcgttgtgacgttgcctcctctgcattgttactgctcagtcgtgagtgtgctgtgtgttttctgtgttcaaatcgtgaccaaataagtaccggctgtatcatttgtgatgaaccatcgcccacgcctgctgatgccgaacagaatgtctgaattctactttgtacttgtccttgtggtgtttctttcagcgaccgggactttgtttggcatcctactggaattgttctcaactctggtgatggtgtg

SEQ ID NO: 13053 - DNA, 1399 bp, Sorghum bicolor
  Clone ID: SORBI-28MAY03-CLUS5723_1
ccttgctcaaggtacatgccctccccttcccggccctatctttgattcagcacttttaatgtcgtattgcttaattgtgcagctacgtatctgaaatctgaaatattaagttttgaaacagaaaatatctgattttaggttccatatatggtatagttgtttgtggcccatatgatttggagcagatttctttgcttgtgctagacaacctgttttcaatttgtataggcatcactagaaatgggaacatgcttcaggtggttgtggttaattggtatccttttcaagtctatgctcaatctatcttttataaggcagtggatcttcgtacatcagtaggtgcattgtgggagcatgttggtggatgggaagttattattttcggtcaagctagcttttttctagcagcttgcgttcttgattttctcggcacctcatttgtgatctacaggcttgatgagggctctattggaaatgtgggagtgtggaaattgccgtccgttctctggaggtggttgactatgccccgagagatagttgtgaatgtttgtgaatgtgtatcacattatggttctcgcataacattacaattttgaataagttgtcgaaacgagtatcgtattgggttctaggataacaaagaagcctggacactaaatccgggtagaacataacgacagctggagataatgcaaaggttgagtgagactaagcaatttttaagtttttaactgcaatagttattacttttgtgcatgctgaagtttctcatttggggtagctagtttatatttcataggagtcccagtactgctaggaaagagttgacaccattttttgggcacgtgtccaagagggctagacagggtggcagtatgatatgggttgctggtaaggatggttgccgatgagggaagagttgaatgtgactaagtcctcagacagtaacatggtgccgatgaccgagtaaaagggtctgccgatgactatgacaaggggattgccgatgacgcgaaggaggagtccggaagctgccagttgtcatgtggaggagttccggtttgtcacgaaggatggttttattatttccttatgttattcgtatcgttttatgtacgggttccgtgtaatttggaattcgaattctaatcgtgtctggtcgtagctctttgagcagggtataaatataagccctaagaccttgtaatcatatatcaagaaatcaatcaaacacacgtttttactcatattccagcgtttacttttcgacgacttcgtcaccctttttctttcttattacgagttcttatgaattcgtcgacttaagctcggcgtattctcgagttccgcgtgagtacctcttagccgtgacatccgggcgcatcgctgttgtcaggac

SEQ ID NO: 13054 - DNA, 1479 bp, Sorghum bicolor
  Clone ID: SORBI-28MAY03-CLUS58108_1
gcacgaggcagtgagaccctgagggtctgggggcgcgggcggggggcagtgggtgggggtgcgtggcacagggggagactgtgccagggaggctgtgggtgattctgcctggcggttccggagcatggtccatacagcgaccgctgaccgtctagtcctggatgtcccggaccacccggtccctccggcagggtaggcctcctttctgacagtgtcacgtgtgtggctttgtcccggcttgcatgctgccgggggacgctctccgctcctcgttgcgcttcctatgtacgttccaaagggtgatccggttaggtgcggtgctgctgtagtgggcactgcgcggggttgcctgcctcgcctgggtactttcccctgagacctatggccagaggtctcttgccttcccggagctgggcccattgccctgccgctcttcgacttgtcttgcttgtcttcctccccccctcccgtccttcttcctgtgcatcatttcagcacgaggcacatgtgtgtcttattaccgactattatgctggcggggaactctttatgctcctcgataggcaacctatgaaggttctaaaggaagatgcggttaggttctatgctgcagaagtggtcacagcacttgaatacctacattgccaaggtataatctacagagacttaaagccagagaacattttacttcaaagagatgggcacatttccttgacagactttgatttgtcttgcttgacatcctgccaaccacaagtgtttcttccagaagatgataagaagaaaaggaggaggaagagcaggagcaatcccatattctttgccgagccaatgcgagcatcaaattcttttgttggtacagaggagtacatagcaccagttgtaggagattattaccggagccggccatacaagtgctgtagattggtgggcgctaggaattcttctatatgagatgttgtatggttatacaccctttagagggaaaacaagacaaaggacctttgctaatattctgcacaaggatatcagatttcctgcgagcattcaggtgagccttgcggcaagacaattgatatacaggttgctacaccgggaccctgcaaataggctaggttcctacgagggtgctattgagatcaaacaacaccccttcttccgtggcataaactgggctctagttcgtgccgcaacacctccagagttagaggctcccttgcaagatacattggaggccacaggagagacattgcctcctcctgattcagctcacaccgatatgttttgaacatacattgagccatgaagctacatgttaatttgctcaaagtaagcaaataaagattagatgatgaagatgcatgtttgtctatgcatgaatgtgacgtaggtgagaacaataatgtatgtcaaggactaattaataatagcaatccatctttatgcatgcaggtgcaatgaaagtaagattatgtgtgt

SEQ ID NO: 13055 - DNA, 888 bp, Sorghum bicolor
  Clone ID: SORBI-28MAY03-CLUS5801_1
gccggccgggccgggacggtccgccgcttcgtcttcttataccctcctgctgactgccccctccctccccgcacatcctctccatcggcggtcttcccccaagtcgtcgtctaaactaaaccctaatccccaaatccccgacgcagacaacacgacgcgcacctgcgttcacgaggagcaagcatgagtcgccacccaatcactaagtgggcacagaggtctgacagggtgttcttgacgatagagctgcccgacgccaaggatgtgaagctgaacttgaagcccgaaggtcatttcaacttctcggctaagggctcagatgacttgccctatgagtttgaccttgagctgtttgatgctgtgaatgtggaggagagcaaagcagctgttgccccaaggaccatatgctacctgatcaagaaagctgagagcaagtggtggccaaggctgctgaaaaaggagggcaaggcacctgtgttcttgaaggttgactgggacaaatggcaggatgaggatgatgaggatgttggatttaatgacttcagtgatatggacttctcgaaactggacatgggaggtgctgatgatgacgattttgaggatgacgaagacgatgtggttgaaagtgctaacaaagatgaaggtggtaagacagagaagagcaacggggaggaggaagcagctgccgcagcagcagccgctgaggaagtgaagccatgaagaagcatttgagtttgctccacgccataggtgtccatggtatctagctaggctaaatgttcccttagatttttggtgtaaaatctggaggatgaatacaaaacagttgtgctgttttagttttatctgaaccctgtgaactgctgatataatttttgatcagagctc

SEQ ID NO: 13056 - DNA, 927 bp, Sorghum bicolor
  Clone ID: SORBI-28MAY03-CLUS6453_1
acgcctgcaggaaccgccccggaattcttcccgggtcgcacccactcctacagagcaaggagagatctttgatccggagagaaattcatgggaacaaatgcctacaggcatgggtgaaggttggcctgcaaggcaggctggaacgaaattgagcgttgttatagatggcaatctgtatgccttggagccagcaacttcttctggcagtgcaaagataaagatgtacgatgctcaagaggatacttggaaggttgctgtaagccaggtacccgttggtgcctttgccgagtcagatagtccttatttgcttgttggatttcttggaaagctccatttgatcatcaaggatgtgggtagcaaaatcaatgtcatgcaaacggactctctggagccattggattcgccagccctttcggctggcacaacatgtcaagtcccagatgtctccttggagcaggcagatgtttggaaagccatcgcgtcgaagagtatcacagctgctgaacttgtcagctgtcaggttctcagcatttgagtttttaaggttgagtttctctggatctttgtataagtttgtgcggtagatatatttctgccgccatcgaatttgtcaggtaacttcttgtggtttcaacctgaagaacagataatctccatcttctgctacaaatgtgatcagtgtctgctgcagttctgctacaaatgtgatcagtgaactgcagaaattctgtcagcaatgtacatatgtgtgtgcaatctgggtagttcagttttgtaattgttttcttctactcttatctatgtatatgtcattacataaaactgaataaggttgttgcagctttgtccagttccaaaggcaacagtgctgagtcaatgaacagagtagtctgaaccctgcccattgttcaaagtaaaaaaaaaaaa

SEQ ID NO: 13057 - DNA, 1645 bp, Sorghum bicolor
  Clone ID: SORBI-28MAY03-CLUS6445_1
gccggccgggttcgcctcttctactctggccgcggctcgaacttaaaccctagagccgcagcccaggtcgctccagcgaccccaaatctcaaatcacccggagctcgctcgctcgtgaaggctgaacttatggctcgcgtctacgttgggaatctggatccgcgtgtgacggcgcgggagatcgaggacgagttccgcacgtttggggttctgaggagtgtatgggttgctaggaaaccaccagggtttgccttcattgactttgatgaccgcagggatgcacaagatgccattcgtgaattggatggtaagaatggttggaaggttgagctgtcaaccaaagctggtggtggccgtggccgagaccgtaacggttctgatatgaagtgctatgagtgtggtgaatctggccactttgcacgtgagtgtcgcttacggattggttcgggaggcctgggtagtggaaggcgtcgcagccgaagtcctagatatcgtagccgaagtcgcagccgcagccgcagtccaagatatcgaaggagcccaagctatggcagaaggagctacagcccacgagatcgttctcctaggaggcgaagttacagcaggtcaccaccaggatctcgtgcacggagtctcagcaggtcaccgccgctgccgccgcctcctcccagaaataacagcaggtcaccacggggagcccgagaaatgagcaggtcaccaccaccacctcctcccagaaataacagcaggtcaccaccgggagcccgagacgtgagcaggtcgccgccaccacctcctgatgctagaagaagctatagcagatccccaggacagcagccccagcgcgatgagtccccatatgccaatgacgcctgagattcttatctgccccaagatgctggaaaacgcaagggggcccagcatgttttgcctgagtgcatcgatacaactgtaattctataggatgatccagtctgagattttgttccagtgttttgggtttcccttggacacaccgctgctgatacaattgtggaggcaaacgtttctgtttttatgtattgactggatgactttgggcgcttgtagttgtcaagacaagacctggttcgtgttacacttgtattactggtttgtattcgaatttggacaatgtatttgtcgtgtgctatgggcctgtttagatcttaaatctttacatcccaaaacttttggctgtaaactttacattcaaataggtgtttagatgcttcccaaattttttggtcaacaagacacatgacacgggtccctaagcaagtttacacatttttggggctccaaggtcccaaattccaaatctttacagccaagttttacaagcccctgtttagatccattcttccaaaaagtgctcatttctccaaaagttttggctgtttggctgcatctaaacaggcccttacatatatttgttcaagcaggcagatgataaatcggactacctaggcgtgtatgtatgttttagttgtggactttcattatggttggaatacgttaagtgccattattatggactgtcattatggtttaccgagcatgttatttaatctgatttagttgattgtactattcacatataggatataatttacaattttttggc

SEQ ID NO: 13058 - DNA, 344 bp, Sorghum bicolor
  unsure (1)..(344): unsure at all n locations
  Clone ID: LIB3476-020-P1-K1-C9
cccacgcgtccgatcgaaggagcccaagctatggcagaaggagctacagcccacgagatcgttctcctaggaggcgaagttacagcaggtcaccaccaggatctcgtgcaccaggatctcgtgacctggccaaggtgcagcgcgccgtgtgcatgatctccaactccaccagcgttgtggaggtgttctcccgcatcgaccacaagttcgacctcatgtacgccaagcgtgccttcgtgcactggtatgtgggtgagggtatggaggagggtgagttttttgatggccgtgaggacctgnctgcactggagaaggactatgaggaggtcggtgctgagtttgat

SEQ ID NO: 13059 - DNA, 1108 bp, Sorghum bicolor
  Clone ID: SORBI-28MAY03-CLUS7089_1
tgtcaccgccaacgaacacctagaagctctccgacaaggacggcctcaccaaaaagtagggattccccaaggaggagggataggtcaaaatcaaggtcaacttcaagaaaacatgatacctctagacatagaaaagaacatgatagatctcggtccaggtctccccactcgagggatcatcacaggcgatctccaagaaggcattcgccaaggcgcagatcacccccaactagtcatcgccatcgttcaccaagaagacattggtcaccacctgccaacaggaagactggattgggtaagcctggaaagaatctctttattgcaggatttagctatgccaccactgagcgagatttggagaagaaatttggcaagtttggacgtgtaacaagtgcacgtgttgttcgtgataaacgaactggagattcccgtggctttggattcttatccttggagaaggatgaggatgctgatgcagcaatccgtgcttgtgacgagactgagtggaatgggaggatcattcttgtggagaagtcaaaggcacctgcatggtgaatcttctgccttgtgggcctccgcacaccattgttgggagggggatctcattgcttaaccttgcacagattttatcattcaggaaaaagttactatcggtatgacatactcggtacatgtcaaagttcatccgaacctggcttttgatgctgtactaggacttgtttcagggccctgctgctgataagagggacttagtggtaccttttagtgtctgcaacctctacacatgaaatgtgatacgtgcctgttcgtgagctgtcagttctcttcttcaccttcgtctcgcgctcactgatgccatgaaccgattccgggagactcaacaagctttgtgatgctgagggttatgttagtagttcaataatctacatattagtagcttttcaatgtttgcatcctctgaatgaggatttggaacatgtcctatagtttgtgtttcggattccagatgatgcttaattatggttgccacacgacacctatgcccccatctgttggtgatgtattttttttcccgctaaaaaaaaaataataaataaaaaaaataaac

SEQ ID NO: 13060 - DNA, 721 bp, Sorghum bicolor
  Clone ID: SORBI-28MAY03-CLUS48207_1
caagcagcagcagcacgtacaatggatgggatgtgcctggaacaagctctggtcaaagttcatcaaaaccccacaaaaccgaaaccaaccctccagtcttgattccacaggaagcacttcaggctcttccaaccccaaccgcgccaccattcgctgaagaaaccttctacagtggtcctgttcactatccatccatagactctacgcctgttgatgtaaccatgccggctaccaccgaaggcggtacaacaggcagtacaacggcagcagcacctacaaaacaggaagaaaacgaagctgatgcaagtgacagcggcaaaactccctccggtacttgtgttatatgtttggatgcccctgtggaaggcgcctgcatcccatgcggtcacatggctggctgcatgtcctgcttgaaggacatagagtcgaagaagtggggatgccctatctgccgtgccacgattaaccaggttgttcgcctctatgctgtttgaagagttgaaacggtgggtccggaaagttagcaatggatggttctcccaatagattttgatgggaacgtctccgtctcaaaattgtgcagttatgctgttgtgcacttcgtactgcactgcaaaatatgacttccgtgtaatgtatgtgtgctggcgccttatgtacataggtactccatgcaagacaattcaaaaaaaaaaagtattgttgcaagttgcaactcgcg

SEQ ID NO: 13061 - DNA, 1696 bp, Sorghum bicolor
  unsure (1)..(1696): unsure at all n locations
  Clone ID: SORBI-28MAY03-CLUS4862_1
atcaacaagattctggcaaagatagaaggtaatcttgcccaggctgaggatgccattatgctagacaaggtcggcgctctatcagaaacaaatgcaacaaacatttttatggttaaaaagggaattgtattgacacctcatgctgactattgccttccaggctccccgcgcgctccgctcggcgctccggccgcgcgcgggcacttggcgccgcaggcgcgacccgtgtctcccgcggtgttccacgcggcggcggcgccgcgctcccccggcaccagccgcgtgttctcccccgccctaagggttgacgggcgggtgctcggcgagccgctcttcgcgcctgtcccgcgtcctacccgcgtcgcctgccccgtccggccggcgcgcctggctgtaccggtcccggggggtgctgaggtggtcttggcggtgatgcttcccccagctggctaggagcagcccccctgcgagcccgtcgctacccatcgtcccccacacctgtctagcgacctcctgttgtcgcggttgcttttcggctccatgcggagccctctaattattctgccatcttctcctttagttgttccaccatccttcagggaccttggcatcggcgttcttccccccaggcgtggtcggtcgcgtgggcttgggagcccaccccctgtgatagatgcagatgatctgcaacaggatcctgaggctgtcctgagtggactctgtgaggatctgggcattcctttccagccacaaatgttgaaatgggaagctggccccaaggaatttgatggtatatgggccccctggtggtatgggagtgtgcacaagtcttcgggcttctctaagcctcgccaatatcctctgactttcccattcgcgttttatgacctgcttgagcaaagcttgcctttctacaacatgttgaagcgccaaataaggaagacaagaggactccagcaaccaccattacctgaccctcctctgcctgtccctgcaaataaaaacattcttgtttgggttggagatgaacttttgccccgtgacagtgcaaaggtttcagtgtttgattcagttgtacaaggaggagatgctgtttgggaaggtttacgtatatatgatggaaaagtattcaaactagatgaacatttggacagattgtttgattctgcaaaagctatggccttcataaatgtgcctactcgtgattggattaaggatgccatctttaagactctgattgcaaatggaatgtttgataatgctcatataaggctcacgctcacccgtgggaaaaaggtgacatctggaatgagtcctggtttcaatctttatgggtgcgccttgattgtgcttgcagagtggaaaccgccagtgtatgataactctcatggaataaaattggttaccgccaccacacgtcgaaattctccaaatagtgtagactccaagatacatcacaacaatcttatctagctaggatcagtcccccaaggagcctgatgataccaatctagcacaacaataaattaataatctccatttatcactgttgtttaaaggcaccatgtggagcataataataaattaataataatctccatttattatcactattgtttaaaggaaccatgtaatcattgttattccaaacaggatgtatnacttctggagattataaacgcaataagtcattgca

SEQ ID NO: 13062 - DNA, 1447 bp, Sorghum bicolor
  Clone ID: SORBI-28MAY03-CLUS48914_1
aatccagcccagcaaccaacgacccccaccggccctcttcccttgccaccattccccaccaccgcatagatcgcccgccggtgacggcgaccactgatgatggctccggccgtggccggggcggcgtcggtggcgatgagccaggcactgcgggaccgccagatcctcgacgccgtgggcaccggcgccgccgcgctctcgctggcgggctcctccttcatcgtgctctgctacctcctcttccgcgagctccgcaagttctccttcaagctcgtcttctacctagccgtctcggatatgttttgcagcttattcactatactgggggggccatcgaatgcattttactgctttgcacatgactacagtgctcatttcttctgtgtggcttcttttctatggacaaccaccatagcattcactctgcatcgcacagttgtaaaacacaaaactgatgttgaagaatttggatctattttccacttatatgtgtggggaacttcactagctaccactgtactacgttcgataggaagtgactatggaagaccaggttcatggtgctggatccagcagggaagcatggcaaaggtcctgcacttagtaactttttatcttccactttggggtgccattttgtacaatgggtttacatactatgaagtaaaccgcatgctgaacaatgcaacacggatggctgctggcataagtgatcgatcaaaccagtctgatattagggcagacaggaaggcatttaaccgatggggttattaccctctaattctaatcggttcatgggcatttgcaactatcaatcgtctttatgactttgccaatccagggcacaagatattttggctctcctttcttgatgttgggttcgctggacttatgggcctattcaattccattgcttatgggctaaactcttctgtgcgccgagctatttcagaaagaatcgacatgttcctacctgagagaatcaaaaggagcctccctactttctcacgattgaggagtcaacaggaaaatgaactgacttctcttattgtcgagggtaactgatatgtaatgcaatctatgaattttccatgcatacaattttttttttctatcttttcgttcttcaatctccaacaagggaatacaacatcactgtaggagcagttggttagcattgttgatcgtccggtgtccggtacatgttgagttggttcggctgtgtccattgttgatcgtcttaacacgagacctgggtttggggggttcatagttccggccagagtatatagtaggctagaataggaacagtcgttagatacactgatgttcatctgtagctagttaagcagaatttgtttgttcagatgtacgagtataatcacttctgtacaatgcacatctagcgctacacgatttgcaattttccagtttgtcccaaaaaaaa

SEQ ID NO: 13063 - DNA, 717 bp, Sorghum bicolor
  Clone ID: SORBI-28MAY03-CLUS48987_1
atggtttggatggcgtaaaattgatgacatttgggcagccccgtattggcaatgctgcatttgcttcttatttcaagacatacttgcctcaagcaattcgagttactcatgcccacgatatcgtgcctcacctgccaccgtacttcgcattcttcccacagaagacctaccatcacttcccaagagaggtatgggtccataatgttggattaggaaccctagtgtactccatagaaaagatctgtgatgattctggtgaagaccctacatgctgcaggtcagtaattggaaacagcgtgcgggaccatatatactatcttggtgtcagcatgcatgcagaagactggagctcctgcagaatcgtcatggactacagcaaattgcggtatcagatggacctcaacggtaatcttgtattatcgaagcagcccgctttgtcgaatgacagaggattcagtgcccagtgaaccagtgtatgatttgtatagtataatagcatcacgaatcagtaatgttcagagctagcgctgcacatatgttccctctcacctcccttggccgttgaattgttaatgcatcaaagagagggttggaacgagcatgcggattcggagatgcttgttgtacatgtgattacgtgatgtatttattgttcagtttgcaaatatatattgccgatatttgatcaaattcatctgaaaatcaataatgttcagt

SEQ ID NO: 13064 - DNA, 1783 bp, Sorghum bicolor
  Clone ID: SORBI-28MAY03-CLUS4800_1
atttgagaatgtggcgaagacagagactgttgtcccatcagttgtgcctgtcaaaagcatcagcaatccaacaccacaaatgacgttggaggtgcacaaggatgtcatcgaacccactcaaagcagaaagttagacaaggaaagggaaattattgaaaatggtagcccagttgtcgagacacccattgttgcagctccagtggaagaggcagtcacaagcctaaataagaaaccctctcagaacatgcccttgcttccacatggtttgaggaacacaggaaatatctgctttctgaatgcaactttgcaggcattgctttcatgctcgccttttgtccacctattgcaggatttgaggaaccgtagtatacctaaggttggctacccaactctgaatgcatttgttgagttgatctctcagtttgatgtggcggatgagtcagttatcaagaaaaatgagaaggctattactgttgctgcaaaaccacttaatcctgccatgtttgatgctgttctcagaaactttacaccagatgtgccggctggagtaactgctcgaccaaggcaggaagatgctcaagagtttttaagttttgccatggatagaatgcatgatgaactgctgaagcttaatggcaatggatcagattcaaaggagggtatggttgtttcttctgtggatgatgatgcttgggagacagttggacgaaagaacaaatctgcaatagttagaactcagagtttcgttccctctgagctaagcgctatttttggagggcagctacagagtgttgtgaaagctacaggcaacaaagcatcagctactgttcagcccttcctactgctccatcttgatatattcccagatgctgttcagacacttaatgatgcacttcatctgttctctactcccgaatctttggaaggatacagaacagctgctggaaaggctggtttggtgacagctagaaaatcattcaagatacacgcgctttcaaagataatgataatgcacttgaagaggttcagttatggaaatcatgggagcactaaagtctataagccactccacttcccaaaagaactggttcttagtcgtgagctgctgagctcaccatctacagagggtagaaaatatgagcttgttgcaaccatcactcatcatgggagggacccttacagggggcactacactgctcacgcaaagcatgccaacgggcaatggcttcgcttcgatgatgatgctgttgtgcctgttgccgagaacgatgtcttgcatgaccaagcatatgtcctcttctacaaacaagtctgaaagcactacgtagttgattagtcactctttcgtattgctgctgcttaaacagccagatataccatctaactatcgtcctgttaatgtagccgccgagtaacagcagagtatttatgtgaagtaccttggtgctgcctgtgtttattattatatatgcttggtcatatagcgagagggggatttgtcttcagcccattttgaggttttgtaaaattcaactgctcatcattgtaatgaccagcgaagtaatcatgggatgttaatcatggtcacccctgttgctgacagctgctgaatttgtggtgtgattggttgcatgtggcatgccatggttctgaattggtagttgacaagacattgccatcacagcgtgccatgtgccctgtctttggtagtgtcaagaggtgcaagacaatgtcagctggtgtatgtgccttgcaagcatgattaacatttcggaaagcttca

SEQ ID NO: 13065 - DNA, 510 bp, Sorghum bicolor
  Clone ID: LIB3476-061-P1-K1-D11
gcattctacatgttgtcaattaatgaagtgtctgtctatgttaccctttgatataatgagaaaggatctaggactgttctgtgtcctgtaaggtaattctatgttgttgtcactgccattgaagttttactgataatagtgcacgaatgcatctcaacactaacccagctatatcctgcttagttaaaactgcccccattcagatgcttctgttttctccaatggaatatgatatcatgatcgcattagttattcaccatagggatatgctgaaacttatgtttgagtaggcccacttgcgctgtttcttatctgtcttttcagtgttgtatactgatgaatacacctttcaggcaacaaagcatcagctactgttcagcccttcctactgctccatcttgatatattcccagatgctgttcagacacttaatgatgcacttcatctgttctctactcccgaatctttggaaggatacagaacagctgctggaaaggctggtttggtgac

SEQ ID NO: 13066 - DNA, 969 bp, Sorghum bicolor
  Clone ID: SORBI-28MAY03-CLUS49367_1
gcacgagggcatcccatccacagagctctgcgcgcagcagttaattaagctcatcgatcagctcacattggacgaccgacgcacgaggggcagttaagctcatcagctcaccgaggacgacgaccgcgagagaccagcgatggcgggcttcaaatcgctcggcattgtcctggttgttgtcgcggcgctcctcgccgccacggcgagggcggtggacgacgagcacatgtaccactggaagtgcttcaagtcgtgcacggggaactgccacgacgaggacgccgccgccgccgccgttgacgacgacgtcgtcgccgccaacgacggcaaccactccggggcctcgaacatctccggcggcaagtgcaagaacaggtgcctcagcgagtgcttcgaggacctgccggcccaatgctaccaccagtgcgtcgtcaccaactgcctctccttcccaccctttagcaacgagaaaacgatgtgcctgaagagctgctgcgagaaatgcttccaccacggcccgccagcgcctggtcctggcccgaagccgcctgccccgacgatgccgaagccaccgccgaggccgccagcgccaaagccgcctgccccgacgaagccgaagccaccaaagcctagcccgcctgccccgaccaagccgaagccaccgacgcccaaggcgccaccaccgcccaagaagccgtgtcctcccggcagcgacgaggtgaacaacaactgatacgatggatccaccggtcatcagaatatatatataactcatatacttaacgtgtgcatcaagtggatccggcccactatatacgacgcatatatattgtacgcagtttggagagtgcagttaactgctgcgagcaaaagaagcaatatagtgctattatctctgttgctctatagtgctagaattatagagctcccggtggcaatgtatatatgtgctattatctctgttgctct

SEQ ID NO: 13067 - DNA, 1260 bp, Sorghum bicolor
  Clone ID: SORBI-28MAY03-CLUS51265_1
gcacgaggataatacaccgattgctgttttactgggcagctccgcctccacctccaacctccaccaatccaacctaccattgggcattggccattgcaaagcaagatactttaacaatgggctactcgaagctgattgcattattagtacttgtcccggctcttgtagccgtccatgtccatgtcccaatggccagcgcagcgaactccaacctgttccgggactacatcggcgccatcttcaatggcgtcaagttcaccgacgttcccatcaaccctagagtccgattcgacttcatcatggccttcgtcatcgactacaccaccgccacggagccgcccaccccgaccaacgggcagttcaacatcttctggcagaactcggtgctcaccgcctccgcggtggccggcatcaagcagagcaacccgaacgtgagggtggccatcagcctcggcggcgccaccgtgaacgaccggccggtgtacttcaacatcacctccgtggagtcctgggtcgagaacgccgtctcctccctgaccagcatcatccacgagtacaacctggacggcatcgacatcgactacgagcagttccaggcggacccggcgaccttcgccgagtgcatcggccgcctggtgaccacgctcaagagcaacggcgtgatcaagttcgcgtccatcgcgccgtacggcaacgccgacgtgcagcgccattaccaggcactgtgggcgagctacgggagcgtcatagactacgtcaactaccagttctacgcgtacggcgccagcacgacggaggcgcagtacgtggactacttcgaccagcagctcgtcaactaccccggaggcaacatcctggccagcttcacgacggcggccaccacgacgtcggtgtccatcaacacgtcgctcagcgcttgccagacgctgcagtcgcagggcaagctctacgggatcttcatctgggccgccgatcattccaggagccaaggattcaagtacgacacacaagcacaagcgctgctcgccaacgcccctgctggctactagctagataggactagctagctagtagatacctaccataccttcaatgcatttcagttcagttcagtgcagttggatttcgatttcttttccagctgcactaatattatgtatggaataagaccgcctttgcaacgcgggattttttcttgtgaaaaaatgaactgattttctataaaatcctatataagataattactgtgaaattcttttc

SEQ ID NO: 13068 - DNA, 827 bp, Sorghum bicolor
  Clone ID: SORBI-28MAY03-CLUS7633_1
cttgggcgttggccctctggcgcccgtcgcgggatgctccccggcaggtggggtgggcgccggcgctggcattctccggtcggcattgctgttgacgcacccaagcggcgttcctgccacgacgatcctggctcccaggcgatcccctgctccgctgcaagaggtgatgcatgtcttctatgttgcattgctctgcactgagggcccgagggtgcagcgccctacaatgagggaggttgtgcagatcctgagtgagcttccaaagccagctaacaagcaaggagaggatgttccaaattccggtgacggctctgcatccagtcctctacatccagcaccagttgagaccaatgaagcaccaacggtcgaagcgagagatcagcagcagcaaacaagctctccgtcatcaccacctccagatctcatcagcatctgagagaccaaaattgaaaagaattttaccattccttgcaaaatctgcacttcaatctctcaagcttaggtcgtaatttaggatgcagtaagtttggctcctgtgctgtacatattcaagtttgttggctggttgtttccagtttgccatggttcatttgctgctgcaatgtagtatgagtctgtagcgtgttgagttacattgctagagcctttcatttcccttctctaatattagtaggcactgaattatcaagtgcactctctgtcaaatttagcgccagaatctttgttgtggaactaagatcttttaagtgctttctgcttctatgtaaacactggaagtgggccataactaaaggccttgaagtcagatcttaagctacattggtccc

SEQ ID NO: 13069 - DNA, 620 bp, Sorghum bicolor
  unsure (1)..(620): unsure at all n locations
  Clone ID: LIB3476-037-P1-K1-B7
actcactgcattccagcgcctggacttcaccagtgatgatgtgctggattgcttgaaagaggagaacattattggcaaaggtggtgctgggattgtgtataagggggcaatgccgaatggtgaacttgtggctgtgaagagactcccagcaatgggccgtggctcatcacatgatcatgggttctcggcagagatacaaacacttggtagaattcgacaccgtcatattgtgcgcctgctaggcttctgctcaaacaacgagactaacctgctggtttatgagtatatgcccaatggcagccttggggagatgctccatggcaagaagggtggacacctgcactgggatactcggtacagcattgctattgaggcagccaaagggctttgctacttgcaccatgattgttcacctttgatacttcaccgggatgtcaagtcaaataacatacttcttgactccaactttgaagctcatgtggccgactntgggctagcaaaattcttgcaggactcggnggcatctgaatgcatgtctgccatcgctggctcatatggctacatagcgccagaatatgcatacacacntgaaggtcgatgagaagagtgatgtctatagc

SEQ ID NO: 13070 - DNA, 1824 bp, Sorghum bicolor
  Clone ID: SORBI-28MAY03-CLUS7853_1
cctacgggaatcctccacccccacctccccttctctctccaccacctttcccttccccacccctcccaaatcgagccagccagccagccagccaggggcacgcaccaccaccgtcacctcaccgccgccgtcgcctttactctctcacacacactcccccccaagctctagctttcgcccatgggcgcgccgctgctccgccgccgcctcctgctgtccctcgcgctcctggccgcctgctgcgccgcggtggggacagcggcggcggcgaaagcgaaagcgcccaggctgtcgcccaactactaccgccacagctgcccgcgggtggagcggatcgtgtcggacgtcatcgcggcgaagcagcgcgccaacccgtcgacggcggcgggcacgctgcggctcttcttccacgactgcttcgtcaacggctgcgacgcctccgtgctggtctccccgctctcctccaccgcggccccggagcgcgcggcggagatcaacctctccctgcccggggacgccttcgacgccgtggcccgcgccaaggcggcgctggagtccgcctgccccggcgtggtgtcctgcgccgacgtcctggcgctggcggcgcgggacctcgtggggatccttggcgggccacggttccccgtcgcgctgggccgccgcgactccgcccgctccgacgcgcgcgacgtggagggcaacctgccacgcaccaacatgtcggcgcgcgccatggtgcggctcttcgcgggcaaggggctctcggcccgggagatggtggcgctggccggcgcccacaccgtggggttctcccactgcgccgagttcgcgcaccgcatctacggataccggggcgccggcgccgccggccacgacccgcggctcaacccggagttcgcccgcgcgctgcagcgctcctgcgcggggtaccggaccgaccccaccgtctccatcttcaacgacatcgtcacgcccagtgagttcgacgaggcatactacaagaacctgccccacgggctgggcctgctcgcctccgacgccgccatctgggagtacccgcccaccagggtgttcgcgcagcggtactccgccaaccgcaccgccttcttcgaggacttcgccgccgccatgcagaggctcggcgccgtcggcgtcaagaccgggcgccagggcgtcgtcagacgccgctgcgacgcgctcgactgagtcaggcgttcgtcgacggcgttgcttgggtgtggcattgggtcgatcggtgattgtaagggttcgaattcgacagctttaggattcgattatgggaggggctcttgtctgtacttgaaaactgagggcaagctaattctgaattgcatatttgcataccaatggggttacatttggcctgtcgcctgcgcccgttgcatcctgttgctgtcgtcgtccatggctccatgagaacgtccgcatctgacagtggcacgtcccctttgttactgcacgatcagtagcgcaagaaatttaacagttcgctgcagtcgaagcaggagtatctcaagccgcgctgaagggtccaagcagcagcggacgccctccggtgcacctgcagccatttgtgtcggcacggagccgaagggcggcattggctgctgcctttttgcgtgggtgctcgtgatcggttctggatgccaccaatgggccatgggacgcccgacgccctccattaaaccgaccaacctggccagcgaaagaaattgtatagttgttctgataaatggccagtgaaagaaattgtatagcttgtacattttacctttcaatcaataatactatcgactacgatca

SEQ ID NO: 13071 - DNA, 1439 bp, Sorghum bicolor
  Clone ID: SORBI-28MAY03-CLUS7924_1
atatatagcacaattcatgtgcctgggcagttggccttgcttacttgtcgatcgagtgagactactgcagccgccgccgccgccacctcctctccgatccgtttcctcctcctccctcgaaatcgattcgatcgatcaatcaatcaatcattgtcgtctgcaccatctccaatcccctaccttgctagatagtctagtcaggccgcctgctgcctgcctcaaacggatcgacgggactggagggaggaagaagacgacgatcggagtcttggagatggagggcggcaacgggcagatcgaccgcagcgacgagcgggaggagatgaagctcatcatcgacacagatcccggcatcgatgacagcgtggcgatcatgatggctttccagttgccgggagtgcaagtcctagggctcaccaccattttcggcaactgcaccacggagcacgccacacgcaacgccttgatcctgtgcgagaaggcaggccatcctgaggttccagtagcagagggcagccatgagcctctcaagggaggaaagccgcatgttgccgactttgttcatggatctgatggcctcgggaacatagttcttcctgatcccactatcaagaaagttgaggaaagcgctgctgacttcttggttgataaggtctcgcaatttcctggagaggtctctgtgcttgccttgggtcctctgacaaacatagcattggccatcaagaaggatccctcctttgtgaaaaatgttaagaagattgttgtgctgggtggagcattctttgcagctggaaatgccaccccttctgctgaagcaaatatccacagcgacccggaggcagccgatatagttttcacttctggggcagacatctatgtcgttggcctcaacatcacaacgcaagttagcttcacagataaggatctcctggagctaagaaactcaaaagggaagcacgcgcaattcctatgtgatgtatgcaagttctacttggactggcacatcaagtcttatggtgctcctgtgattttcctacatgatccggtgagctttgccgcgctggtttgtccggagatgttcacgttcaagaagggtgtggtgagggtggagacacagggcatctgcgtcgggcatacttccatggacatgttgctgaagaagtggaattcagagaacccatggactggctactcgccgatttcggtcgcatggacggtcgatgtgcccaaagtggtcgcatttgtgaaggagctcgtcatcaaacagtgaacggaattaactaacatgttatgagcactgcgttctcgcacaccagatgtgcaccaaatttgagatgtagatatttattcacatttgacgcactgcaaacactattatgtcaatcattggttcctttggaggacttcaaatcaatttgagattttttaaattgcagcat

SEQ ID NO: 13072 - DNA, 1321 bp, Sorghum bicolor
  unsure (1)..(1321): unsure at all n locations
  Clone ID: SORBI-28MAY03-CLUS795_1
cctactggacgcacgcccagacgacgaccaaaggaaggggaaagaggaggagagcgacaacagcacctcgagcaaattgaagcaggttttgtgttgattcggagtggagatttgaggcctgcggcgacgatggcacctgcgaaatccggggagaaggcgaccagcttcgccatggcctgcagcctgctcagccgctacgtcaggcagaacggcgccgccgccggcgatctcggcctcgccatcagagctgaagccgatggaaagagggcgtcggcagacacggaaaagggggacacgacgaaggagaccatggatctattccctcagaacgctgggttcggctcggaggctgccatgaaggaagcccctgatgtgagggagccagagaagcgccagctgactatcttctatggcgggaaggtccttgtgttcgatgacttccctgctgagaaagcaaaagacctgatgcaaatggccagcaagggttcgtctgtagctcagaaccctggcatgctgccttcccccacagttgcaacagttactgacagcaccaagatcacagcagtgccagccgcaccaattgctgtggtcaatgcccaaaagagtccagcagatataccccaggctcccaaggcatctcttcgccggttccttgagaagagaaaggatcgccttaccgcgaaagcaccataccaaggttccccttcagatgctacacctgtgaagaaggagatggcggagggtcagccatggcttgggctgggacctcagatcgccaatcctgatctgagcttgtgcaaggaggggagccaatgatcgacaatccagcatcaccatcttcaaaactgcgatactcctgtaccagagtaaaggatcatagagagactcaacagtcatgtgtcaaagtgttctgttttgggcctattgttccgtgtgtttttcgcgtggatacgtaggttgtacgaatgtaaaggacgtagctaaagatggacttgactaaggattaccggtgctggggcaggtttgctggctgatcagcgtgtggtggcctgacccaaatggccatgttagaaagatgaaactgtaatgtagttgctagaacaagttcatattttgggatgttctgtgttgtttggctttggcactggtgtgtgtcacaaagctatttattgtaacagatacatcccgtatgattgttttatttttattttcatgttatactcttaatcttctggttgtctctgtaagtctgtacggtcaatgtccctggactataaaaatgctgatctccaaagttataatttacaaaaaaagnccccta

SEQ ID NO: 13073 - DNA, 1010 bp, Sorghum bicolor
  unsure (1)..(1010): unsure at all n locations
  Clone ID: SORBI-28MAY03-CLUS5242_1
gtttctctataagatctccccagataaagttaaagacgctgttaagtgcatgcatttccgggcatcaaaggctgattgtgtatttaaaggcgactacatactgtcagaggatggccagatagaaatggctctcctgtatccaggacatcggtacacgcttgtcaggatgcgccttaggggggggggaaccacanntggtgcaaataacaagttggatgtactgaaaatcctaaccactgcatagcaatgcttatttccttatttatctgtagcaaaaggcacttacatgacctctgatgacagatatgccagcacgaaacaacagactacaccactacaaggtaggaaactacttaagattaccataacagagtacatcaaacaagcacactatagatagctgacggcttacaaaaagatagaacacaggagaacatcacataaataacacatcacccttgtaccagctcatatgcatgtcaaagaaaggcagggagatgtgcatgctgaaatttagatcaatacacagtcctgccatcaccatccaggatcatatccttgaaagccccaccactagggatcataggcaacacatgctcctggtgcgggacgattatatccaagaggtatggccctggagtctcaagcatcttcttgattgctgcatggacttcgctcttctttgtcacacggactgctggaatgttgaaccctttggcaattgtcacgaaatctggatatatctcactttcattctctgggtttcccaagtatgtgtgtgctctattggccttatagaacctgtcctcccactgcaccaccatccccaggtgctggttgtttagctcaaagaccttcactgggaggttctcaattcggatcatagctagctcctgaatgttcatgaggaagctaccatctccggcgtctgtactataaaaacaagcagtctatcgttgtaaactcttgtatatattttctgaactgtacagttggaaaggcagcatact

SEQ ID NO: 13074 - DNA, 566 bp, Sorghum bicolor
  Clone ID: LIB3480-042-P1-K1-C7
ccaaaatgtggaaacaaaacaacactgtgtatttacacattgctctagcaagcgatctgcgagggaatgaaatcgttggtcatcatcattttaacctgtgacatggccatcaaccatcattctccaatagccatcttcgtcatgaagagctcacccagggacgtagtagtccatcttctccacagggaggtttagcaccgaagtatcagcctcctcaaacggaacaaacacaaagggcgacaaacccctgctgtgggaaacagcaggcacatctgggtcatgtgtctcatcctcttcccagccgtcaacaagttctagtatgctgcctttccaattttgcagttcagtggggatggtggtgcagtgggaggacaggttctataaggccaatagagcacacacatacttgggaaacccagagaatgaaagtgagatatatccagatttcgtgacaattgccaaagggttcaacattccagcagtccgtgtgacaaagaagagcgaagtccatgcagcaatcaagaagatgcttgagactccagggccatacctcttggatataatcg

SEQ ID NO: 13075 - DNA, 1993 bp, Sorghum bicolor
  Clone ID: SORBI-28MAY03-CLUS5904_1
gcacgaggatcaactagtgactgctatgtccactcgtaaaattcgagctcgaggtgacagtatcactaaaaagctgacattaactcaggccattgatgcaagagatgcactagcaaagtcaatctacgccaatttatttgactggattgttgagcaaattaaccactcacttggaacagggaggcaatttacgtggagatccataagtattttggatatttatgggttcgagtgtttcaataagaatggttttgagcaattttgtataaattatgccaatgagaggcttcagcagcacttcaaccgacatcttttcaaactacaacaggaggaatacttggaagatggaattgattggacccccgtggaatttgtggataacactaattgcttatccctctttgagaagaaacctctagggctactgtcattattggatgaagagtctactttcccaaaggcaacagacttttcctttgctaacaagcttaagcagcaattaagtggtaactcttgcttcaagggtgaaaaagaaggcacatttgagatttgccattatgcaggggaggtgacctatgatacagctgggttcctggagaagaacagagatccattgcactctgagtcaatccaactactatcatcatgtaaatgtgaacttccaaaacattttgcctctgtcatggttgctggctcgcggaataaatctagtctgtcatggcattcagtaatggatacacagaaacaaagtgttgtcacgaaatttaaggctcaactgttcaagctgatgcagcagttggagagtacaaccccacattttattcgatgcattcaaccaaacagcaaacaacatcccaggttattcgagcatgatcttgtcttgcaccagcttaaatgctgtggggtgcttgaagttgtccggatatcaagaacatgctatccaactaggatcactcaccaacagtttgctgaaagatacgggtttcttctcttgcgttccgttgcatctcaagatccacttagtgtttcaattgctgttttgcaacagttgaacattccccctgaaatgtatcaagttggctacacaaaattgtttttccgtacaggacaggttgctgcactggaaaatgctaaaagacagatgcttcatggaaccctccgtattcagaagcacttccggggtttgcattctcgacagggatatcaacaactaaagaaaggggcaatgaatttgcaatcatttatacgcggtgaaagagcaagaatacactttgataatcttgtcaagagatggagggcagctgttcttatacagaagtacactaggcgtcgacttgcagctaacatgtttaatgatgaactgagtcatattattattcttcagtctgtgatgcgtgggtgcctggccagaaggaaatacaagtgtctgcagaatgaaaaggagtcaaaggccagtcacaacatagttcaaggggacacaaggaagactaattccgaatcaagagtttgccatgaaatgaatgggcattatctccacgaaccagtcatcactgagcttcaagatcgtattacgaaagctgaggctgcattgctggacaaggaggaagaaaatgtaatgctaaaacggcaattggaacagtatgagaggaaatggtcggagtatgaggccaaaatgaaatctatggaagaggcatggaagagacagctctcttctctgcagctgagccttgttgctgctaagaagagcctagctgctgatgatgcggccactagagccgctcggactgattttactccaacacatgcccagtatgactctgaagatacgttgtccactgggacccatacacctgaagtgatagaatcaagacatcacaaccacaaccctgaagctaaagtttcagcaggaaactcggataggcgagtaaatgctgtgaaccacctaacgaaggagtttgaagacagaacgcaggtgtttgaggacgatgcgggc

SEQ ID NO: 13076 - DNA, 2103 bp, Sorghum bicolor
  Clone ID: SORBI-28MAY03-CLUS5492_1
gcacgaggcttgtccgagggccgaggctatgtaccgtatggactaagtctccgctccttatacgaggaggaagagatgcgagacgaaaatttccagacgaaaagcgtgccttcgccagccagcgaccacccccctcccggccccggactaattcgaccccaacccgcgggttcgctcgcccatcttctcgtctgtagatcgcatgctcagttcagagtttgcgactccgactcgatcccgcgagggaaaaagaaaaataaaactgctcgcagtcatgtgccggtgtgccctgttggatccgcatagcaattcctgtgacgactgcaagcgcgatctcggcgaccccccacctcgccgactggcttccccctccacctcaccgccgggcagcagagacccctccgggctgggatcgggttcctccttccccggctcttcagaaacttattcacccaaacattgtgaagctgaaggatgtgacaatggataatcatgagccattcttcatctttgaaaacatggtgggctgcccgagccctgtccctggtgctccccatccattgtcattcgctcctgcaggatctaatccaagttccagctggtcggacctcccaaaggatcttgtcctcagcatcctgcaacgccttcaactcccagaagctattgcttttgcatcagtatgcacatcatggctttcggctgccacagctgctggcgtcccacgctcttgtacaccaatgatcatgtcttggcgggacattctcgagagtagagaatcgcgaggggccaagggcagctcttctgtcaactgcaagttcctccatctcttggatgtccataaggcttatgatgtgagatttccccaaggtttatgcttcatggcatgctgtggatcctcccatggctggctgattctggtgaacgaactcgccaatctcgtgctctacaaccccttcacctcggaaatgatccctctcccaccaattactgatttcacatgcgttgaggcagtctgtggtagcaaaggcaacattgaagcatacaattttgagaatcatcgagtccaggatgcaaagtacttggcaacatggttctaccagaaagcggtgttgtcttgcagtccatccaagagtgctaactatgtcgtcatgatcatccaccgggataacaactggctttcttctgttagggctggagatagcaattggcaagtggctgcaactttagtcgctcagaaggcggaccggtatgcggactgtgcgtaccacaatgggatgttctacaccgtgacatttgaaggaatagtggagaaatgggatgttgatggaccgaatggaccagcaaaggaggtgattgtagccaagaggagcagtagacgcattctctccaggcatctggtgtctacaccatggggtgacctgctggaagtgcgagcatttgttgcaaactccaggaggatgtatagagatggtgtcgcattccgaattttcaaggttcatcttgatggatatgagaaggtatcaccagtaccaaagatagacttaatggagcatgcaatcttaatcggcttgaatcactcggcatgtttgtccaccaagaatttcccctggctgaggccttgttgcatctacttctcagtaccttggatgacgcccatatgtcatctgcttcgtcgatgtccagaatggggaggcgtgaggacctacgacataaaacaaagaacatttgatcatgttttccgtctctgccctcatacaaatcgcctcaaccttgctccttctgaggtttggatcacaccgaatttataataatttactaggaagaaagatgcactgtgctgtgctggctcaaggtagttctgtctgccaatcatctttttttgtgtacatttggtaccgtgtgcgaccctgctggccgctgtcgcctgcccgtgcatgccggcccaagaatcagcccaccagaccatcttcccctttttctttgttttcctttaagaaaaaatgctaataaatttgattatattctttgtttacaagaaaacgtcacgccttaacccatcaaagaattagagaccttttagtgtgcgtgtataggactacgtga

SEQ ID NO: 13077 - DNA, 399 bp, Sorghum bicolor
  Clone ID: LIB3476-007-P1-K1-A11
gctcgacatcgagcgagtgagcgacgcatcccgagcgagcgccgattgcttcttccccatccaccgcaccgcccagatccaggcgcagccgaggttgatgcccagctccagatccaggccgccgccgccgagcttcccccaccggctcttcagaaacttattcacccaaacattgtgaagctgaaggatgtgacaatggaaaatcatgagccattcttcatctttgaaaacatggtgtgcaaaccaagacctgtccatgatgcttcccatacaaaaacaaacgaacctacaggatctaatccaagttccagctggtcggacctcccaaaggatcttgtcctcagcatcctgcaacgccttcaactcccagaagctatggcttttgcaatagtatgcaca

SEQ ID NO: 13078 - DNA, 881 bp, Sorghum bicolor
  Clone ID: SORBI-28MAY03-CLUS5997_1
gcacgagggattcaccggggtcgatggtaggcgcggcggccacgtgggacggagggagagagagagagaagggggggccaagccctacgcgtcgtctcctgcggtttcttcccacccctttcctgcctcggcttgcgccttcaacctttgctgaaaattctgtcctcagaaagtgaaaggggcctgtgaagagttttcttgcggcagtgcaatggaggtatttggcaaatctgtgattgctgagcccagcaatgtgattttcttgtctgcaatccttaacacagaagggtcaaaccctagtcacaagtgtgacaagaggtgccagaacgagcacatttttgggaacatgtaccgttgcaaactcactggaaccactcacatctgcgacaaaaactgtaaccagaggatcctctatgacaaccataactcgctctgccgagtgagtggacagttttttccgctctctccattggagcagcaagcagtgaggggtatccgcaggaagcatgaagtggacagcaatgagataccgccctttacacctttttcaatatggcagatgcaagagcagcccttcgagcttccatacacttggcaagctgcagtttgaacagcttccacctgcagtttgaagaaatctttctaaggtcttggactaaaggtgaatccttctgtgtcaatcttgccttcaccccaagcatgctggataccttgtaatgattgtagtacttgacaactgttaccaaagtagtggatgcttttctttcgcatgaagttttgttggtaccccacctcgtctgtctgtaagaaaaaatgttatgcatcctggtccatttcttctatgcatcctgagaaaatggtcagtattttctggggctttc

SEQ ID NO: 13079 - DNA, 731 bp, Sorghum bicolor
  Clone ID: SORBI-28MAY03-CLUS6_1
agtgtatgcgcatctggcttcgtggagcaacaaccattcggcggtgcaagtgctactcctgctccttcccactagcggtagtgcccgtcgtctcgccgccgcctcctctccctccgggctcccgccgccggaccgcgtcgtcagcgatggccgaggcacacagcgggcggcgcgtggggatggtaggcgacgtccgggacgcgccggagggccacgagaacgacctcgaggccatcgagctcgcgcgcttcgccgtcgacgagcacaacagcaagaccaacgcgatgctggagttcgagaggctggtgaaggtgaggcaccaggtggtggccgggaccatgcaccacttcaccgtccaggtgaaggaggccggcggcggcaagaagctgtacgaggccaaggtgtgggagaaggtgtgggagaacttcaagcagctgcagagcttccagccggtcggggacgccgcggtcgcctgaggtagtgaaggtatcatcttccagtgccatgatgtgtttttcccctcgaggctcacaagcttttggctgggggctggagcacaagaatgaaagaatttagccgtcggacatggaatacatcccccactgggaaagtatatatgatatgatgaataaaccagcatcttaccacatgtattgtacgctgtatgaaatatcgactcctgtaatggaatgagctgtgctaagaaatctaaaagccttcttgctttttgt

SEQ ID NO: 13080 - DNA, 1188 bp, Sorghum bicolor
  Clone ID: SORBI-28MAY03-CLUS6219_1
gcacgaggctccagtgcgctgaccgctgccctcctcctcctgccctcctccccctcctgtctctctctcgctaccctcgcgctcccagacgactattgggccgccgccgccctaggccaggtgctgaggctttccttggtctcttcgccggcgacgagcaccccaccagctgatggcgagcataaagccccagcaatcgctaattcaaagcaagacgaagaaggctccatctcggatcagctactctactatcatcacatggaacttgattctcatcttgattgtgctatctctctatgctacctacagccattggcatcaaaggtctgcccaagactttgaaatggagcttcatgaagctgagcttgctgtgagaccggtggatccaaaaatgataagtagaccaagatatgcggtaatgaacaccgcaaagggtccaattactatagaaatatacaaagatgcttctgctggtgttgtggatagatttattgacttgtgcaagagtaatcatttcaaaggaatgccatttcggcatatcatcaaaaattttgtaattcaaggaggtgattttgattttgatggagctgcccaagaatggataacgaaagctaaagctagtgggaaaaatgatctcagtccaaaacatgaggcgtttatgattgggactgcaaagaatcctaataacaaaggatttgatttgtttatcacgactgctccaattcctgacttgaatgacaagcttgttgtatttgggcgagttatcaagggagaggacatcgttcaggagattgaagaagttgacactgatgagcattatcagccaaaggccgcgataggcatcatcaatatcatgctaaagcaggagccttgagctgcgtatcctcctcttgtcatgtacatgaagaccttaaccacatgcctgatgactctgtgttcgaaaaggtccatacatctcattgagttccctttgtattgatgacatgtgtgcggatgcgatccttcctcgggagtctggatgacgccttatgtcttgcgtggaaggcatttgtgacgcttgttacagttgttgttgcagcgtttgtgtataatatttgttcgtttggctgataagccatggtagaaagtactgtggtttgatttgttgtttgagaaaaacaatgctgaatgactagcagatttagcgtg

SEQ ID NO: 13081 - DNA, 1592 bp, Sorghum bicolor
  Clone ID: SORBI-28MAY03-CLUS6422_1
gcacgaggctgacagagagcatgctcaagtagatacactgtatagtgaccgtcttcaagatgttccatctgatttgcagaggagtactgatgcaaacgtttctagtcaagatgtggctctggataactctggtcaagcttgtgctcacgcaggggatgacatgacaggggagttcaatgattttgttcatagcaatgctaatatttttgagagtaatgaggtccctgcttctgagattactggggtggaatataatcaagatgtctctggttttcctcgaccaacagaggatgaaaatgcggtgggatataatcaagatgcctctggttatcctcgaccaacagagaatgaaaatgcggtggaatttaatcaagattcctctggttttcctcgaccaacggaggatgaaaatgctgtgtctgctatgggagataattctggcttccaagaaaacaacatgggttctcttatggatctggatatggtgaatgactatgaacttaaggaatgcaatgattttgggagtgcaattcatggtgttgatacagattttctgaactatgatgatgatggggacttcgacgacgccaatgatgatgagccaaaccctagtgaatttcagtctcttgacaacagtggttggtcttctcgcaccaggggtgttgcaagatatctcaagactttattcgatgaagactcgggtctggggaggaagagtgtcgccattgaccatctggtgcgtgggaagacccggaaggaagcatcgagaatgttctttgagaccttggtgctgacaacaaaggactacatcagcgtggatcaaccgaacccctacgactttgtgagcataaagccaggtccaaagctgctgatgtcagaattctagtcatcaaagtcagcttagcctagcgcgatacgtaccatgcgtcataccattgtatccatcacaccgatcaacgacactgcagattcccccaccgtgccctcttaccccatccaacaaatccatttttgttgttgttaagttatcctcccctctgtagcatctcccgcgctgatccgttgttgctagggtttaagtaggatggttgttatgttgtgccgtcggctattcactgtatatatgatttagtgacacttgtaaagcctgccatgtaatctgatagcttcggctgccctaagttattgtctttgcttcgctaagcaagcccttaggaattgtatacgttaacaacctgagatgatgtacctgttgattatgtcaggattgacagttttaactcagttattcaagtgacctttcttgggaaccatttcttcaggctggatctggggtaagattaaatgggccaggattctagcgatgtctgattgggaaaacaggttgcgatgctcgtctgatgagggctctgattggtacagcttatctaggaagtattgggtacagcttctgtttttttttaatacaaatgtgaggtgggaataaccgttgtaaaaaaaaggagcatattgtttggctgttgtttcagtttattttggccatataagcgggtaccaaacagccctgagtaagggccattgtaaagcgaact

SEQ ID NO: 13082 - DNA, 1171 bp, Sorghum bicolor
  Clone ID: SORBI-28MAY03-CLUS9367_1
gcacgaggctctctccgactccttttcctctctcgttctcatccgtccaggcgagccaacaggcaaaagtaaacgggcgagcgaggagctggagggagagaccccggcgacgcgaagcaaccgcccatcgatcggagccgcggctgaccaggaggaagccccgagatggtgggtctcgtcggcggcagcacggcgcgggcggagcacgtcgtggccaacgccggaggggagacggagtacgtgcgccgcctccaccgccacgcgcccgccgagcaccagtgcacctccaccctcgtcaagcacatcaaggcccccgtccacctcgtgtgggagctggtgcggagcttcgaccagccgcagcggtacaagccgttcgtcagaaactgcgtcgtgcgtggggaccagctcgaggtcggcagtgtgcgcgacgtcaacgtcaagaccggcctgccggcgacaacaagcaccgagcgcctcgagcagctggacgacgatctgcacatactcggcgtcaagttcgtcggcggggaccaccgcctccagaactactcatccatcataacagtccgcccggagagcattgacgggagaccaggtacccttgtgatcgagtccttcgtggtcgacgtacctgatggcaacacaaaggatgagacatgctacttcgtcgaggctgtgatcaagtgcaacctcaaatctctcgcagaggtatccgagcagctagcagttgagccacctacatcgccaatcgatcagtgagtcacctgcatcgccgatccatcagtaacaccggtacaaagacgggaattggcaacaaataagaagcttcaaaggccggctggagagttcaacctttttgagactggtggttctgccaccgtcttctgcgtgtatgtctcttggaatatggaaggattagtggtatgtaggattaaatatctgtagtagcttgtatgttagggatgatttagctgtaggagctgcacctacatacctcatggcatgtatgcatactgctagtatgtgtagaaatcagggaaaccatggagcggtttttgccactttggtgcatggagatctatcttttttctccattttgcggtggctagttcttcgataaatatactttcccgctgacacgtagggtctggaaaaaaaaaaaaaaaaaaaa

SEQ ID NO: 13083 - DNA, 1238 bp, Sorghum bicolor
  Clone ID: SORBI-28MAY03-CLUS9471_1
gcacgagggcggtacgactactacaccatcgggtcgtatgataagaggaaggaccggtactacccggataatccgaacggcgactaccaccggctccggtacgactacggcaacttctacgcgtccaagacgttctatgatccggcgaagcggcggcgggtgctcctcgggtgggctaacgagtccgacagcgtccccgacgacaaggccaagggatgggccggcatccatgcgatcccaaggaagatctggctggatcccagcgggaagcagctgctgcagtggcccatcgaggaggtcgagaagctcagaggaaaggccgtcactgtgggcggcaaggtggtgaagcccggcgagcattttgaggtcacaggcctcgcgacttaccaggctgatgtggaggtgagcttcgagatctcgagcttggacaaggcggagcccttcgacccggcgtacgacaacgacgcgcagaagctgtgcggcgtcaagggcgccgacgtcaagggcggcgtagggcccttcggcctgtgggtgttggcctctgccgacctgcaggagaagacagccgtcttcttcagagtcttcaaggacggctacggcaagcccaaggtgctcatgtgcaccgaccccaccaagtcatcgcttagtccagatctgtacaagccgaccttcgccggcttcgtcgacactgacatttcaagcgggaagattgctcttagaagcttgatcgatcggtccgtggtcgagagcttcggcgaaaaaggaaggacttgcatcctgtcacgggtctacccgtccatcgccattggaaaggaggctcacctctacgttttcaacaacggtgacgtggacgtcaaggtgtcaagcttgacagcgtgggagatgaagaaaccgctcatgaacggcgcctaatagaagcgtgaatgacttgattcgtttttcttcaacgacgaccgtaccattgctgccagaaatactactattgattattattagttaattagttaattgttgaggtccttcagttttcgcccttcatcatctgcacaagtgacgactagtagtttgagttggtttacttccattggctggatgattcttcttcttatgtgtgtacacacacggatgggagtataggcattacgtgctcagctgtccggcaaagagaaattgattacgcttcttcttgtattgtacaataatatgagatgaataaaaggctgctaatttacaggtcc

SEQ ID NO: 13084 - DNA, 968 bp, Sorghum bicolor
  Clone ID: SORBI-28MAY03-CLUS70212_1
ccagatcgtgaagccagccactactctgctccgagtcatagctcagcccccgcgcgtcgatcttatcctccacctccagtctaattccagctccgagcctccacccaccccgatccctctctcactattaatacagccccggtgcttcacccctgatctccatcaccaccatcaggtcctccctccctcctcgatcctcggacgaaacgcgccgccttttcttcgccccgtctcgtctcctgccgtttttgggtcgcccggatctcgccctcgtcgcgcgcgcgcttgttgtttctgtcggcggtgctggaaaggcggggtccttttcgtggccgcgcgccctcgtgatccttcttcttggggtggggaaaagaaaaagttgccgccgcgatgaacgcgctcgccgccaccagccgcaacttccggcgggcctcgaagctgctcggcctcgactccaagctcgagcagagcctgctcatcccgttccgggagatcaaggtggaatgcaccatccccaaagacgacggcaccttggcgtcgttcgtcggcttccgcgtgcagcatgacaacgcccgcgggccgatgaaaggcggcatccgctaccatcctgaggttgatccagatgaagtaaacgcccttgctcaactcatgacatggaagacagctgttgcagcagttccatatggtggagcaaagggagggatcggatgctctcctggtgaactaagtagaagtgagttggagcggttgacgcgagtatttacccagaaaattcatgatcttatcggaacgcatacagatgtcccagctcctgacatggggaccaatgcacagaccatggcatggatgttggatgagtactcgaaatttcatggtcactcaccagcagtcgtcacaggcaagccaattgatcttggtggatcactgggtagggatgcagcaacagggcgaggtgtcatgtatgcgac

SEQ ID NO: 13085 - DNA, 1223 bp, Sorghum bicolor
  Clone ID: SORBI-28MAY03-CLUS71406_1
gctccctcgacctgcactccgacagcggcggtggcgtcccaatcctgtccacccgcccaccccccccgctggggagcatccacctgctgccgctgcttctccttctccttctagctccttctagtgagttcccttcgcttcgccgtgagagaccatgacacggaactgcactcgccgctcatatgtagtagctcaaggatcttttgtgtagctgagaggatttgccttccatggatcttgaagctcctgctgcggatgaagtattcagttcaagtgacgagttgcagacggtgtggcctctgcgacaaggaaacccgaagcggccgctgctgccgtgttgctccgtgcggattccgagccccggacgttgcggcctcgcgccctactagacccacggggggagtgcccccctggatggatctgtcgtggtccttgcagggtcgattttagtgagtgtggctgatcttgcttatggttctgtcgccgggtgcctgcagctggacagggcaaagcgcggcttccctgccagcctggcggcgcacgtgtgcgcggtgtcccacccgcactccggcgccgggacggcgctctcggcggccgccccgctgcggtcggcggcgcggcgcttcgagcacaagtgctacaacctcttcacctgcaacagccactcgttcgtggccgactgcctgaaccggctcgcctacggcggctccgtggggtggaacgtgctgaacctgggggcgctagtctggctgcgcggccggtggctggaccccatggccgccgtccggtccttcctcccgttcgccgtcgtctcctgcgtcggcgtcctcatggccggctggtccttcctcttgggcatggccgcgttcactctgctcctgctcggctggttcgtgatcgccgtctactgcatgaagggcctggtcggctgacgcacgctgactcggagccgaacgtgttcccagcttcactgatgtatcggctatcgcctatcggggtcatgtagtacatgaatgaaggccgaagggcgggagcttgaaaagcgccgaatcgtggaggcggggacagaacacagtgaaacaatttttgagcctgttttaatagtgggaccgaaattcagatgtttataaaattagagtctattttgaacaaagtaatgcaaaatagagggggaaacaagtacgcgagtagaacaggtgtgttatggggaaaacaaaggaatg

SEQ ID NO: 13086 - DNA, 885 bp, Sorghum bicolor
  Clone ID: SORBI-28MAY03-CLUS740_1
tcagcggcagggtgagggagatccagctgcagaattacacgaggaagatggagcagaagatgcagagggaagaggatctccggatggggctcaggctgtacaaggatgggaaatatgaggtggcattggagaagttcgagtcggttttgggatcgaaaccggagtccagtgaggcttccattgccagctacaatgttgcctgcagctactcgaaactcggccggatagaagctgggctttctgcactggaggaagccctgaaggcagggtatgaagacttcaagagagtccgcaccgacccggatctcgcgaacctgaggaagtcagaggaatttgagcccttgctgaagaattacgacgagtcgttcatcaatgagaatgccatcaacgccatcaaatccttgttcggattgggaaagaattgagcaactgaaacatggtggtaggccggtagcagcaggaggcaatgcctctcagctctggtcttgcagtttttgcatactgcagaagcctaccaaggcttaagctcatgcccatacagttcagctccccccactctgccagtagtttgcagttcacacctgtaccttagctattcttggtgaggctgactatctctgggagatgcctccttgccctcgtacttaaccatttgctgtttgatgcagatacattatgtatatgagtattatatccaatttgtaaaggaaacatgagtacattatgtaaagaaaatgtgcagttgtgcttgtaagccatgccaaatatgttaagaatgaggcaaaaggtgaatatgttagcggacaaaaaaaaaaaaaaaaaaaaaaaaaaggggggtttgcaggttcagacagtgtaatgtgtcgggggaaaaaagcacattat

SEQ ID NO: 13087 - DNA, 2105 bp, Sorghum bicolor
  Clone ID: SORBI-28MAY03-CLUS7123_1
gcacgaggatatggcccaggtgaagagcgtcacattccaagaatcctgtcacttgcaaagttgggattagcattcttcaagattgggggcccagatgtgaagacagattgggtctatatcgataatctagttcttgctctgatattggcaagcatgggacttttagatgacattcctgacaggaagggaacccctgtagcagctggtcaggcgtatttcatttgcgatggatcaccatgcaatacttttgaatttatcatcaagcccctatttcaaagtttgggttattctgctcctcaagtgaggctggacacctctgttgcccttgccatttcaagaatgtttttattcatatctacattgttctacccatggcttgatagtaaatggatgcctgagcctttaattcttcctgctgaagtgtataaggttggtgttacacactacttttcgttcttgaaagctagagaggaactcggctatgtacctatggtgagcccccacgaaggcttagctgcaacgatctcatactggcaggagcgtaagagaagggaactagatggcccgaccatatttacctggctggctgtaataattgggatgctggctgtattttcttctgcttatcttccaccagttggcccgctgaaatgggtgcttgacatccatttgtttgtttttcgatcatgctggtgatccggctggtctttgtgacagcagttgcagcgcatcttggtgaagctgtgtatgcctggttcttggccaaaaaggttgatccaaggaatgctacagggtggttttggcaaacctttgttctagggatcttctctctcaggtatcttctcaagagagccagagggtgaatttgtgttgcttgattccaagttcggctccctggacattgtcatctttctcagttcgaacttaagatggctgcatcaccaatcactctgccactatggttttgctccactgttgctgtggctgctctcctcaaatgcgtatgctgcctagctcaaatcctaaggacatgatactggaaggagcgggaaaagggtcagacgagagggtcggatgtatcgtgggatttgattcattactacttcatgagaacggatagataatgcagtgagaatgtgagatgttcttgtctgaactccgcatcgcttgctgacactaaacctacagttttgtggttctgtgttacatagatgttcgtaacgaggaacaatttggagatgcagtttttaaaacccagaacaagagccataaatgtattgtcaaggagcaggattacaatttggggttgcactttgtcaatctccccttcgtacgcatcttttaattgttaccactgatcctttctgccatatgagcttcatattgttgaagcaacattttttgttgcacgaggcattcacccattgagcaggatcttaatttacacagaaaccaatatccaagctacatctccatatatgttcagcctttgaaacaaataacatataagtgtataagctataataattggctccttggtgtatgaccattgacaaatattctgtccccttatcttctctgtaaactaaagcacataggtctactggagaaagattggaaggagcataacatgcactgttgagataatttttgatgtaccaacaaaccttgtattcaaaggcatcatgtcttcgctcgaacagcttcagccttaaacattatgcctccaaattgttctccagtcatttgtagtgatgattgttctcatcatctcatgtaagctcatatcaacatgccagctgccagcttttgctttcctccctctcataccggagcactaaaagatgacctcattttcacatcttcaccactgaggaagtccatgtccagctgagctgggtgcttgttgctgcagtatgaacactatttgacttccagttcaattcatgagttcactgaagtccatatgttgaactcatccattcttagagtgaatgaactcgaaccttgttttccacctccaccatatgcctttgcaatctctgacgtattaactgtactgtcagtagtcctcaagcaaacctttaggacaccccgttgcatga

SEQ ID NO: 13088 - DNA, 747 bp, Sorghum bicolor
  Clone ID: SORBI-28MAY03-CLUS7231_2
tatacaatcccggggacgtctctatcgtcccgagaggccgagacagcatccatccacaaacaaaactaaacaaagaactgtgtgactgtgtgagagcatggcaacaagctcgcactgctttgagaacccgccggcgctggagccggccagcggaggaggcgaggtcgttgacgacttcggcgggcagaaggcatacatcaccggctccgccgggtccaaggcggccgtcgtcctcatctccgacgccttcggttttgaagcgccaaacctgaggaagatagccgaccaagttgcttcgtccggttactttgttgtggtgcccgatttcctgcatggggatccatatgacctcagcagcagcaatcctggaatgtggatacaggctcataatccgcaaaatgcatttgaagaggcaaaaccagtaattgctgcaataaaggagaagggagtgtcgagaattggagctgcaggttattgttggggagcaaaggtggttgtggaactggcgaaagttcacgagatccaggctgctgtattgttgcacccttctttactaactgacgatgatatcaaagaggtcaaatgtcccatttccatacttggagctgaaatcgataggtcatccccgcctgaattgttaaagcagttcgggcaaattctttcagctaactctgagatcgatcactttgtcaaaattttccctggcgtggcgcatggatgggctgtgagatacagcgacgatgatgc

SEQ ID NO: 13089 - DNA, 1107 bp, Sorghum bicolor
  Clone ID: SORBI-28MAY03-CLUS7231_1
tgaacattcgcctgctctcgccggccgtccgcttcacttgatgcccgcccgggtcacttgtcagactccagtccaactccaacggcagcactctgcaattaggaaaaactaaagaactgttaggatggcgagctcgcactgctgggagagcccgccggcgctgaacccggccggcggagtgggtgaggtcgtcgacgacttcggcggactcaaggcctacgtcgccggcttggcggaggccaaagccgccgtcatcctcgtctccgacatcttcgggtttgaggcgccaaagctgaggaagatagcagataatgttgctttgtcaggttacttggttgtagtgccagatttcctgcatggggatccattcgaccccagcaatcccaataatcgtgcaatgtggttgcaggcacattctccgaaaaaggcatttgaagaggcaaaaccagtaattgctgctctaaaggagaagggagtggcaatcattggggctgcaggttattgctggggagcaaaggtcgttgtcgagctggcaaaagttcacgagatccaggcagctgtattgttacacccgtctttacttactgttgatgacattaaagagatcaaatgccccatttctatacttggagctgaaattgacaaagcatcacccccagaattgttggaggagtttgagcagatcctgtcagcaaactctgggatagagcactccgtcaaaattttccctggcgtagcgcatggatgggctgtgagatacagtgacgatgatgtggctgctgtgagtagtgctgcggaagctctgcatgacatgacccactggtttaataaatacctgaagtgaaatctgaagttgtatcttgaaatttaaagacgtcttgacagatcatcgtgtgactgtaccaattgtgtttgtggccattttggagtttggacttccgttttcagtttattttttgctcgaatacgcaggaagtctgcgcatcattttattaagaaggaacgaaattaagtacaaagaccggctggccaggctggcggctctttctgcgctgtaccccgccacggtgatcgtatttaccttttcgacctctatcattataactc

SEQ ID NO: 13090 - DNA, 948 bp, Sorghum bicolor
  Clone ID: SORBI-28MAY03-CLUS7272_1
cgctcgaggccggccgggccggggatccctactcgtgcgttctgtctgcggtctgcctgtctcgccccctctcgctctcggccgccgccgccgccgccctaagccaggtgctgaggctttagttggtctcttcgccggcgacgagcacccaccagggttagctaaccaagagaaggagagtgataggaggaagaaagagtaacgggaacaatggcggcagactctggcgctcgcaggcagccaaccttcaccaaggtcgatcagctgcgccctggaacccacggccacaacctcatcgtcaaggttgttgactccaagatggtcgtccagagaggccgcgacggagggccccagggaaggcagatgaggattgccgagtgcttggttggcgatgaaaccggcatcattgtcttcactgcaagaaacgatcaagtggatgtaatgaagcctggaacaactgttgaactgaggaatgcaaagattgacatgttcaagggttcaatgcggcttgcagtggacaagtggggaattgtgaaagctgctgaaagctcagctgagttcacagtcaaggaggacaacaacctgtccttaattgagtttgagctggtgaccgtggtggagtgaaaaccttcctttgcttaaggagtattggttgtatgctatgtcgttgaacctattcatcgtcaccaatcaataaggaatcatggttgatgttctcctctgcatcggaaggtggatgtttagttatcaaagccagtgagttatggaacaatcgaagatgagtaacatagctgagatagattgtcgtaatgctttgagttgcttatttgctgcacattacttactgtgcgtcgtggctacttttgttttgtttttgcgatgactcgattgctattgaataataaattggtgttgtgaggtgaaaaaaaaaaaaaaaaaaggccccta

SEQ ID NO: 13091 - DNA, 1076 bp, Sorghum bicolor
  Clone ID: SORBI-28MAY03-CLUS7814_1
aaaaaaaaaaaaaaaaaaaaaaaaaaaaaaaaaagcacggccggcacccttcttcgcttccactcctccccaccattccgaagcttccacgcctttccgcctgctgctcctccaggctccgtccggtcagatccgcgccccctcgcgctctggtcgaggaggaggccggaggccggtgccgcgtgcgtgggtagcttcggcgggcggggagagaggtagcagcagcagcagcagcagccaggtgccatggcggtggagaagacgctgcccggcgcgaatgccgggaggaccgtgctcgtcacgggcggggcgggctacatcggcagccacgccgtgctgcagctcctcctcgcgggattccgcgccgtcgtcgtcgacaacctcaacaactcctctgagctcgccgtccgacgcgtcgccgcgctcgcgggggaccactcgcgcaacctctccttccacaagattgatctccgtgacaagggaacgctggaaatggtttttgcttctacaagatttgatgctgttgtccactttgctggattgaaagctgtgggtgaaagtgtacagaagccattactttattatgacaacaacgtcattggcacgataaatcttctagaagttatgtctgctcatggttgcaagaagttggtgttctcatcatcagctgcagtttatggatctcccagaaactcaccttgcacagaagagtttcctctgactccaaacaatccatatggcaaaacaaagcttgttgttgaggatatttgccgtgatatctaccgttcagatcctgaatggaagatcattttacttaggtacttcaatccagttggtgctcatcctagtggatatcttggtgaggacccacgaggaattcccaacaatcttatgccctatgttcagcaagttgcggttggtaggaggccagctctgacagttttaggaaatgactatgcgacaagagatggaactggggtccgagattacatccatgttgttgaccttgctgatggacatattgctgcattacagaagctttttgagaactctagcataaggtggaagcatacaac

SEQ ID NO: 13092 - DNA, 1378 bp, Sorghum bicolor
  Clone ID: SORBI-28MAY03-CLUS10763_1
accacctcagcaggggcgttggccagtaggcgcttcagcctgctgtcatcggtgattcccgtccagtctacccgcctgcctcctctcttcccggcctgctttccttcgtcttcgccgtttccgcagtcccacccatagacgccgagctcgtcttcccagggtgcgcaggtgggctccccggccgggtcgctgttggtagggtccctgtgatcggctcccggtgctgcgcggacgctctctagctgccgaccaagtcccagtggcacccctggtacctcgacagccaggtgcctgggagcttggtggagtaccctgccttgtgcatcgggacggtctgcggtccccgccgcctggtgccccttcacgaccccgccgccgcgccgactctcctctccccggccctccctgctgcgcggctccccccccaccgcggctcctcgctcgcctagcgcgcccggtccgtctctgcctgctcgcagcgaccagcgggtcggataaactgcaatgattgtgaaattggagttaccatgatgcccattagggatcacggttccgtgttaaatagccaagaacagcccctgagtgtggcttgtacaagtgtagcttgcattacatgattacagagaaaggaaataaaacaatttgtgctagcaaaaaaaaaaaaaaaaaaaaaaaaaaaaaaaaaaaaaaaaaggaaagggtactgggtcaccccctctcgaccaccaccagaccacaccaccggcggcggcggcgaaccagtcgagaacacgaaggcgatggcgacggcgctgaaccgcggcctccgctccgggatccgcctcctcgctgccggcgccgaggcgtccaggccagcttctcgtgggttccatgccactggtgtgaagagaatgggaggacatggccatgacgagccatactacatccatgccaagcacatgtataacttgcacaggatgaagcatcaagggttgaaggtgactctttccgtgctgggagcggttagcatcggtgttggagtccctgtgtacgcagtcatattccagcagaagaagactgcctcaggttgagatgatgcctctcgttgcctgcatattggagacttattttcaacaacattttgtgaagttaaaagcttggacttcattccaccttggttgttgcctgatacggcattttcttaccataagttgtaacctcgtttcttgcgatttggtgtaggacacaaccttttctgttaataatatcgtggcttgaacattccaggctgtggatatcgtttgttaattttcctgtttcttgtcacgctacttgttctaactgctgaacacgggtagcaggtgtgttaccttttgaggtgtcacttccttttgtatcc

SEQ ID NO: 13093 - DNA, 1040 bp, Sorghum bicolor
  Clone ID: SORBI-28MAY03-CLUS10786_1
gcgcggggcatgggcgacgcgactgcacagcgcgcggtcctctggctagcggggctgcggctcagccggtggagaagttcataaatgacgcgacttcaaagggagcaaatatcatgctaggtggttaaagacacagcctggggatgacattttatgagccaactgtagtagggaatgtcagcaatgatatgcttcttttcagagaagaagtttttggtccagttgcaccccttataccattcaaaactgaggaagaagcagtccatatggccaacgatacaaacgcaggcttagctgcatacatatttaccaagagcatacctcgttcatggcgtgtatctgaatctcttgaatacggcttagttggggtaaacgagggaattatttcaacagaggtggcaccatttggtggagtaaagcagtctggtctagggagggaaggttcgaagtacggcatcgacgaatacttggagctcaagtacatctgcatgggaaacttgggttgagtcctgaaatcggccccaggctagaaacgcttggcagatgatgatgaaccgagaaaccaagtaagcaggcgtgcttagaagggtgcgagttgcgtttagctgcaagatcggagatgggaaaggggccggccactggttgtgggtgagcagttttagaataaagcgaataagtcgtggagcatgaataagaaagccgaatgagttgtaaatgacgtgaactattaaagtatggcttcgccttcgtacttttgtatacataatcatggcacttgtctatagtgtctccaaagacgttcatgttatacggaataaaagcatgtaggtcggatagactgtgtcagatgctacgttacaggctgtcggtggtatgtacagcgacctcgccgggttcctgaagaaaggtggatcctgcattcctgcctgcaggagtaatatgattatctcgtggctgcgccgatctttcaaccaggctggtatctactatatattaccagattcatcatagaacccaaatcaggctttgtttggatgtgt

SEQ ID NO: 13094 - DNA, 901 bp, Sorghum bicolor
  Clone ID: SORBI-28MAY03-CLUS11006_1
gccggccgggtctggactcccctacgcctctcctatcgtctccccagtctccacgccgcgagcgcagggtgacggaaagcgacgccgcgcgagcccgagcgagggaggagggtcaaggggggaagaggggaggcaccgcaccaggaccctcgttccccgccgccgccgcctccgatctccgcgaggtagtcaggtttcaagatgtcgaccagcacatttgctacttcctgcacgctgttgggcaatgttagaacacaggcctcccagacagcggtgaagagcccttcatctcttagcttcttcagccatgttatgaaggttccaagcctgaagacctccaagaaactcgatgtctctgcgatggctgtctacaaggtgaagcttgtcacgcctgaaggtcaagagcacgagtttgatgctccagatgacacctacatacttgatgccgctgagactgccggtgtggagttgccgtactcgtgccgtgctggggcttgctccacctgtgctggcaaaatcgagtctggtgcagttgaccagtcggatggatccttccttgatgacgggcagcaggaggagggctatgtgctgacatgcgtctcctacccaaagtccgactgcgtcatccacacccacaaggaaggtgacctgtactagggctagggcttttcaatttggcaagggaccaattgctctcaaatgtgttgtcaagcaaagctccatctgccctaccagttgtgcaaactgtttggcatcaaacttttgtggttgctgtcttctgtgttctgctagtttatgttcggggttggtgcattaagattgggaacccatgggaatactagctaatcaataaaaaaacatgatgtgatgccataatagtataatttcatggctttttgtt

SEQ ID NO: 13095 - DNA, 814 bp, Sorghum bicolor
  Clone ID: SORBI-28MAY03-CLUS11187_1
gcgcgacatatacagggatttggctgagaagtatggagttactggatttcctacattgaagtttttcccaaagggaaacaaagctggtgaagattatgatggcggtagggacttgggtgactttgtcaagttcattaatgagaagagtggtaccagccgtgacacaaagggtcaactaacctcagaggctggccgcatagcaagtctggatgtcctggctaaggagttccttggtgcttccagtgacaagcgaaaggaagtcctttccagtatggaggaggaggcagctaagctcagtggtccttctgcgaggcatgggaaggtctatgtaaacatcgcaaagaagattctagagaaaggcaatgagtatactaagaaggaaaccgagaggcttgatcgcatgttggagaagtccatcaacccctcgaaggccgatgagtttatcatcaagaagaatgttctctcgactttctcatcctaaggcatctgctagctccattttcacgtttcagatataggtgacaaaactgcaagattagaagtgtgataatgagttaagtggcggtagaactaattttggggttttccctcgaggacatgtgatacttgtacttcttgcaaattgcagttcttttccgcccttgtgcttatggatttattccgtagcaccatagtttatttttggttcgacatagagaacattgtgactacagaactgagttttactgtccaataacactgttcacttgatggggcttatgcgaacctgttctgaaaaaaactcgagactagttctctccctcgtgccgaattc

SEQ ID NO: 13096 - DNA, 1802 bp, Sorghum bicolor
  Clone ID: SORBI-28MAY03-CLUS8196_1
cccacagatctctcccgaagtcccaaaccaattcaaggtgcgtcccccatccagccagatcgccggcgatgatggaccaccgagacgtgatgttgcccttgtccctccgaaccctagccacccgtacccttctcctgctcgtcatcgcgtccgccgtttcctgctcttccttgccgccggaggacggcatccgggtcgtctctgcagagaaaaggatcgacctcacgggtcccatcgtcaaagtcttcctaacattgaaggttgagaatgctcccactgcctctgaagcatcaggagttcttctcgcgttcacgcccacagaggctcaacatctctctattgccaaagccacaagagtggaggggaagcgcaagaagaaggcattcatacccctctcgatcacagcttctgagctcaccaccaccgcttctgatgcccctcgcctctactctgttctgctcagcactcctctgaaacctggcgatgcaaccactctagaagtgttatacatgctcactcactctttggagccctttcccgctgagattagccagtcagagtcccagctggtttactaccgtgacagtgcagtgcttctctccccctaccatgtcctggagcaggttacctatatcaaaatgccaagcaataggattgaatccttcacaagggttgatcctaccacacgggctggttctgaagtgaaatatggcacatacaataaccagatgccaaactcctatttgccaattcttgtgcattatgagaataaccgtccatttgctgttgttgaggaacttgtacgcaaggtggagatttctcactggggaaacatccaaatcaccgagcagtataaactgaaacacggcggtgctcgtcacaaaggagtcttttccaggcttgagtatcagcctaggccatctgtcagtggagcttcgtcctttaagaatcttcttgcaaggctgccacctcgggttcattcagtttactatcgtgatgagattggtaacatctcctcatcccacctgcgcactgattcacacaagtctgagctagaaattgagcccagatatccattatttggtggctggcattgcacgttcaccattggctatggtcttccattgcaagattttgtgttcgagtcagttgatggccggcgctacatcaaccttacttttggttgccctctattggatactgtggttgatgatcttacagttaaagttgtgcttcctgaaggatcaaaaaatccacagcctgtagttccttttgtgacagagaaacatcttgagactagttattcataccttgacgttgttggaaggacgacagttgtactgaagaagaaaaatgttgtaggagagcacaacgttcctttccaggtgtactatgaattcaatccgatcttcatgctggcagaaccattgatgctgatatctgcagtgttgctgttttttgttgccttcattgcctaccttcacatggatctttccatcagaaaatcatcataggcctgttggctcaaagtattttgaggcacatgttctgctaactgtgattgttctggagcattagttgtactgtgctgtctgtgcaccctcaatggagaaggatggagttttttggggaatatgattgcttcatgctaggaataggaacgaacgagatgatttatataattgatgagacttaaagagccttccccagctcctcaagcctctagagctgcacacatttaattttaaaacctaagatgcgcgtgacttggagcattgacaaatgctgtaggagggtatttt

SEQ ID NO: 13097 - DNA, 921 bp, Sorghum bicolor
  Clone ID: SORBI-28MAY03-CLUS8093_1
gcacgaggtggctgttttatcgaggtggtattggtgttaaaggagaagaaagctgggaagcttggtgggaagaagaactgcaacatatttacagcattcgagggaggatactggaaaccatactaagcctgaggtttttcatcttccaatacggagttgtttaccacatgcatgccagcagagaaagtacagctttatcggtgtattggatttcgtgggctgtgcttggtggccttttcatcctcctcttggtatttggtttaaaccccaaggccatggtacatttccaattgttcctgcgtctagtcaaaagtatagcgttattgatggttttggctggtctggtcctggcaattttgtttacggaactcagtatcggagacgtttttgcttcgattctagcatttgtgccaactgggtggggaatcatttcgattgccatggcatggaaacctgtcgtgaagaaattgggtttgtggaaaactgtccgtgccctagctcgcctgtatgatgctggcacggggatgatcattttcatacccatagccatttgctcgtggtttccattcatatccacattccagacgcgacttctgttcaaccaggcgttcagcagaggtttggagatatctctcatccttgctggcaacaatccaaatgctgggatttgatggtggcagttccggtcttgcttcaccaatctgactgtggacctttcttactttaattaatcctcagttaacagtagcgatgtacatatctgatatctccatgttcaccggcagttgtttgccgtgggtataaatgtgaacggcaatatttctagaggtagcttgtatctgtatttgttcagccggtgtactttgtatgccacatcttatttttttacattgatatatgtgctgattgcatcaactggtt

SEQ ID NO: 13098 - DNA, 1104 bp, Sorghum bicolor
  Clone ID: SORBI-28MAY03-CLUS8551_1
aaaaataagcactccatcatcccgtgatctcacgagtgagtgagtgagtgagtcactccaaagcagttaccggcaccagcagagcagcaatggcgctgcgaacgctccacctcaacgcgccgccgctcctccatattctgcgctcgctatgcctcctcgtcctggccgcgtcggcggcggtgtcggtgtcggggcgccaccacgcgcccaccccggcgcacggcaccgggcagagcatgtacctggcgccggcctgccgggcgcacacggcgtcgctcgcggacttcggcggcgtgggcgacggcaccacctccaacaccgcggcgttccgctccgcggtcgaccacctgtcgcagtactccggcgaggacgccggcggcgccatgctgtacgtgcccgccgggaagtggctcacggggcccttcaacctcaccagccacttcaccctcttcctccacagcgacgccgtcatcctcgcctcccaggacataaacgaatggccaatcattgatcccctgccttcttatggaagaggaagggataaaattggaggaagattcgctagcctcgtcggtggatcaaacctgaccgatgtagtcattactggtaacaacggcacaattgatggacagggcgcgatgtggtggtcgaaattccacaagaaccagctcaagtacacgcgcgggtacctgatcgagctgatgcactcggacaccatctacatctccaacctgacgctgctcaactcgccggcgtggaacatccatccggtctacagcagcaacatcgtggtgcaaggcatcaccatcctggcgccgacgaactcgcccaacacggacggcatcaaccctgactcttgctcgcacgtccggatcgaggactgctacatcgtgtctggcgacgactgcgtggcgatcaagagcgggtgggacgagtacggcatctcgtacgggatgccgagccagcacatcgtgatccgtcggctgacgtgcgtgtcgccgacgagcgcggtgatcgcgctggggagcgagatgtcgggcggcatccaggacgtgcgcgcggaggacatcacggcgatcaactccgatccgggtgcgcatagac

SEQ ID NO: 13099 - DNA, 968 bp, Sorghum bicolor
  Clone ID: SORBI-28MAY03-CLUS835_1
gcacgaggcttctcttcgcctacctctctccctccctcccctctcgactctcgacgccaaaacaggaaaaaaagaaaaggaaaaaaacaaaaaaaaaggaaaagaaattctcctctgggggaaaaagtcgcgtgccgtctcgcccacagcctgttgatagcagcaatggcacaagagagctggaaacaagagtctgaggaaactggagtccatgcccctgaggccccgattctgtgcataaacaattgtggtttcttcggcagcagcatgacaaacaatatgtgctcgaagtgctatagggacttcatcaagttgatggaaacccctgtggtggagaagaaggttatagcaggggcatcatcctctgcagtgctgccactagaggcagcaaagcgagacgcattgcccaccgctgctgctgctgctgctgctgaagcagccgcagctgtagacgacaagcaagcagcacaggaggagcccccaaagccgccgagcaaccggtgcctgacgtgccgcaagaaggtggggctgactgggttccagtgccgctgcggtggaaccttctgctccatgcaccgctacacggactcccaccagtgcaccttcgactacaagacagcggccagggagcagatcgccaagcagaaccctgtcgtgatggccgagaagatcaacaagatctgactgatgagcggtcattcatcgtcgaaggatggatctctggattcgttcgtgtcccgtgcctgggttcagtcgagtgttcgctcggatcgataggttccttcaggtcgtcagtcaggtggggaggtctgggttagtagtgtgttagttggggggtggggtggggtctctcaattgtgtctatccttctccttattatcatggtttcattatctcgattgtgtaataatgtaaatatatgccctattcaaactgtaatttaatcctattgcttccctattactatt

SEQ ID NO: 13100 - DNA, 1117 bp, Sorghum bicolor
  Clone ID: SORBI-28MAY03-CLUS8318_1
caccaggttgttcacatactggactagtgatgcataccaggccacagggtgctacaacatgttgtgctccggtttcattcagataaacagcgagatcgccatgggggctagcattttccccatctcgaactacgcaggctcccaatatgatatcagcatcctgatctggaaggaccccaaggaaggcaactggtggatgcagtttggcaaggaatacgtcctgggctactggccgtccttcctcttctcgtacctggcggacagcgcttcgatgatcgagtggggtggggaggtggtgaactcgcagccagacggcgtgcacacctcgacgcagatgggcagcgggcacttcccggaggaagggttcagcaaggcgagctacttcaagaacatccaggtggtggacagcaccaacaacctcaaggcccccaaggggctgggcaccttcactgagcagtcaaactgctacgacgtgcagaacggcaacaacggcgactggggcacctacttctactacggcggccctgggaggagctccaactgccagtaactttcaaggtgtgacagccatcggagtggtaatacatcagttttctggtagctctaggtagtagtatgtgatgtgaatgggtgggtctgtcttttgtttgtgctggtggcttcacttgtagtagtttctctcttgagtttcttcttgttctcttttcattagtgccaggatagcttctgaagagaagcatggcacccttatggtggcctacctccttttcctatatggtagattcactcctccgtgggggtaacatgtgcatgtgatttctagatcttggtgtttttttcttcttttttgcggtggtattttcttcttcatttgccatgtaaagtttctgaagagaagaaggcatggcttgaggcggcagtggtggtttggctggttcagtggtgacctttacggattttttgcaagtctgctaattggtcaccttcgccagttattttgaaagtgtgctatagcagcttattggttgatgggtgatgataatgatatcgcttggagatcataaaatgttatgtactcgggtagtgaaggtataaatagtgcaccaatgacatgtac

SEQ ID NO: 13101 - DNA, 1447 bp, Sorghum bicolor
  Clone ID: SORBI-28MAY03-CLUS8759_1
tactgggaaacgatcagctaaggatgagaagtcttccgcaaagaaggctggtgaaggagaatcgtctaagaagactcaaaagaacaactcaaaacagcagaaggatgaaactctttctgaggatgatcctgccaaggatctgatcataaaggaaatgatatcgccgaaatcttcgaccaagggcccaggtagaatcaaagggcaaagcacagagaataacacacctaagatgaagcaagaacaagaaactgaagagcctccccgttcaaggaaaagcaaaggccttgatagaagtctagttggtgcaaggatcaaagtttggtggccagatgacaagatgttctacaatggtgttgtggagtcatttgattctgtttctaagaggcacaaggtcgcatatgatgatggggatgtagaggtactactgctgagggatgaaaagtgggaattcatcagtgaggagaagggagcttctgtggcatctgaaaagccacgaggcagaaaaaggaaagtggatgcggtgaaggaagaaaatacagaaacccctagaagtgatgctgtggatactccaaagaaaagaggacgtcccacgggcgtgcgatccagcaatgggacaccaagtaattcggctactccaagcacgaaggggaaaactgccggcaagggtgccaaagaaacacctaaaactggccccaaccttaaaaaggaacttgagaagagctccaagggcaaagctagtgtatcaactgagacaaatgatgaattgcctaaagatgatgataagagtgcgaccaaacctaaggaggctattagcaaaggtaaggattcaaaagatgaagggaaatccactgaaggaaaagctaggccaggtcggaaaccaagaaatgctggtactcccctgaagagtgatgctgacaaagagaagcggaaggagaaagaagtcaaggcagctgaaatagagcaggaggcatcaggaaatgcttctacaggaaagtcagggaatgcttctacaggaaagaagcgcagaaggaaggcttgaagttaacactgatgaacttctcttgtaaatggatgtgctccctaggtttgctcctttaggcagaggcgttggcgctgcaccttgtactattgagcgttaactcgaaatttcgtctgattggtctctattagttaggtgtggaagcaacatttgctatagctgtaatgttaggagtaacatgtgttcgttgtggtcagatccatgttgcattggcgctgagccttaagcggaatgaaccctatgctcgctgtgaggcccatggcatcgtgttgtcgggtggtgttgtagcttattgatgttctatttattataaccaatttaagcagtggattttgtagcaaatgcacctttttaactaggatcttggcctgtttttcaagttcaaggcttgtttctctgctgtatgct

SEQ ID NO: 13102 - DNA, 1407 bp, Sorghum bicolor
  Clone ID: SORBI-28MAY03-CLUS90128_1
gcacgagggttgcgtctgcgtgcgtcacgtcttcctcgtcccgtcactccaccgccgtccccgtgggcgcccgccccaaccgatccgatccgtctcagcttccattaaaaaaatctctccctcccccttcctattcaggaaaaaggagaaggaaccacctcgatcgatcttccttccatttactcctccgtgcgtgagagctcccgattcgatcgacggcgtttggcaatctccttttgattcgatcggcggcggaggcggagagagatgaggaagcgtgagcgagagaacccgtgcgggatctgcgggcactaccacaagtacgaggagggggaggtgtgcggcgtctgcgggcaccgcccacctgcagcgtcgccagcgggggcgaggcagcaggactcggcgttcccgtccgagatcctcaaggagttcctcttcctcggcagctacgacaacgcctcccgctcggagctcctcaagaccatcggcgtctcgcacatcctcaatactgtacctttatgccaaaacctttaccggaattcattcacttatcactgccttcaagaggacaagactctgcagtttgatgatgcaaaccagtttctagagcaatgtgagagggagaaagcacgcgtcctagtccattgcatgtcagggaaaagtagatcggcagcttttgtagtagccttcttgatgaagtcgaggggttggagattgacacaatcctttcagtgggtgaaagagcggagaccacaagtgcaactgtctgatgcagcacagcagcagctgattgattatgaaatgaagctttttggttctaataatgtcagcataccagctcaaccttttgctccagtggattcgttcccttctcttggatttggttttccaaaaccagcaggcgacatccaagtgcctacctttaaccagcaggctccagcatctatctttgagcgcgttaccccaaacagcttccctagtaacttcacattcggagctgaaagaactagtgaggcgaaacttccggatagcaacaatttcggtgtgataaactcgtctgggagtgatagcatgatggacagctcctaggatggttttgccttcattgatacacaaatgaaatgactcagttgcaaatttagtcaggtttctcgggatgtttttgatttctgagaaagaaatgcatttttgtaataggatgtcgcaatatttggcagtattattacaattgctgctgtgcattttaacaattatgagtgtgcttttttatggaacttttctagtgtaatttacgataacaaattacgctggaaagtttgaataaaaagttgcacacgtgcttgttaagatgtacagatttgtgggctcagaaagtgtaactcaatatccataccaagttgtgtcatc

SEQ ID NO: 13103 - DNA, 672 bp, Sorghum bicolor
  Clone ID: SORBI-28MAY03-CLUS12619_1
tctgaacagcgtgtggtaccagccggaggagatcttcccgatctccggcacgccggaggagcggcagcacgcgttctgggtgcccgtcagcaagcgctactacaggctcgccgcgaagctggaggggatggagctgccggcgtgcgtgaacgagacgacgtgcctgccccgtgcgccccgggtgacgcgtgtgcccaggggttgcagcgccaacatctacaccgacaacgccagctaccggcagttcatccgcgctcacttcgggtgcacccccgtggagatggagagcgccgccgtggcgctcgtggcgcaccagcacggcgtccccttcattaccatccgctccctctccgacctcgccggcggcggctcgtctctcagcaacgaggccgccacgttccttgacatcgcggccaagaacgccgtcgacgtcatgctcaagttcgtgcccctccttggccgcggtggcgagcaggagcaggccgacggtctggcccaagacatgtaatgtaaggcgggccaggagacagatagacgacgctgagcagtcacgtcgtggtacaatacaatttcgtcttgtaaggtttttatttaaaataatttcccacccacgaattaacttgtatcgctattgcaaacctatcttcgggaataaataagattggtgtcggc

SEQ ID NO: 13104 - DNA, 894 bp, Sorghum bicolor
  Clone ID: SORBI-28MAY03-CLUS13496_1
gttctagatcgcgagcggcgccctttttttttttttttttgttaacattcctcgtcccatttaggtaataaataaataaataaatagcaaacgtttgtttcacttatttgttacagtaacaagttattaactgtgaaacagtactcaacagagattaatcaagttgtgactgtgtggaccatatatggatgcatgagacgtcgacgacgacgatttatggatacgtcatttcggagcggggaggcgtgtagccgctgacgagaccctggacgacgagtatggatgggtacatgacagccttggtgggcagcagcttgtcggcgtcggggacggccttcatctccggctggcagtcccgggagaacttcatgtccatctcgtccatccacgaagagatgtcgtacacgtactccaccttgttgtcgtcgcccatggcggccagggccctgatcttggcaagcttctcgggctccttcttgccggggcccggctcgaactccgcggcctgctccgcgcacttgcccagcttgtactgcttggtgccgttgagcttccgcagctcggcgagcaaggaccggaagttggccaccatgagctccgtggcggcgccgatgaccctgatgctgctgccgttgaagctcccggcctccggcaggagggagtcgtagcagtgccgcgcgatcacctttggcatcacgctagggctgcaccgaccttggaggaactccgccgccgccggagacgccgccgctgcttctgtcgtcgtcgtcgtcaaggtggcagcggcggcgacgacgatgaatgcaacgaggcaaattgcattagtcgacctcatcatcatctttgatgtatctacaacttccgtcgtctgcaagtggtcccaacccggccggc

SEQ ID NO: 13105 - DNA, 1258 bp, Sorghum bicolor
  Clone ID: SORBI-28MAY03-CLUS13540_1
gcacgagggaaaaaggcagagtggagcacaccttccgttttaggaaggtgagaagtgggggagccggggagttgggagagagagtgagagagagagagaggcagggatcagcggcggctggcggaggagatggaggagcgggagaagctcgtgtgcctggccaagctcgccgagcaggcggagcgatacgacgatatggtggaattcatgaagaatcttgctaggatggatgtggacatgagtgctgaagaaaggcatttgttctcagttggtttcaagaacactatcggggcaaagagagcatcgtggagaatcatttgttcacatgagcaaaaggtcacaactgatcgtcagactggtgtgatgatagatgcctataagaagatagtagaagatgaactaaggaaggtttgcaatgaagtattgtcagtcatcgctattcactgccttcccttggccaatacgagtgaaaatgtcgtattcttttataagatgaaaggtgactactaccgatacttggctgaatttagcagtggaactgaaaagaaagctgcctctgaccagtcacttatggcctatcagcatgccatggttgtcgcctccagtgagctctcacctgcccaccagatccggcttggtcttgctctcaatttgtcggtcttcttttatgagataatgaactctcatgagagagcttgccaagtggcaaaacaagcattcaatgaggctcttactgagataaattctggtgaaggggtttacaaggatagcacacttatgatgcagcttctgaaggacaacttagcattgtggacatcagaactaaccggaggtgaagcatccaaggataatgatgtcgacatggagggttgattgatatgagctcaaggaacacagaacacacgcaaagtatccaatctgcgctgctagcgaacccgggtcctcaagtttttctgcatcggaattcggaagatccccacttatttttctgaagttttctgttcctctgtttcggccatcgtttggccctagagtcagtgtccctactaagtgtttctcagaggtctggactggtgaccatccaacaagctttggtcatattttgtgagcttgtgctggtgaccacccagctctgatgttatgttgcttctttttttttcggtgcttcagaggcatctttgtacaccgatgacaaaatgtatctcttatcaatacattaaaagactgtcgctgtcgttattaatctagctatccgttc

SEQ ID NO: 13106 - DNA, 1110 bp, Sorghum bicolor
  Clone ID: SORBI-28MAY03-CLUS15977_1
gcacgagggcgcgcgtcgcgctcgggtgcggccacgacaacgaaggcctgttcgtggccgcggccgggctgctgggcctgggacgcggcagcctgtcgttcccgacccagatctcccgccgctacggcaagagcttctcctactgcctcgtcgaccgcacctcctcgtcgtcgtccggcgccgcgtcgcgctcccggtcctccaccgtcaccttcggcccgccctccgcgtcggcggcgtccttcaccccgatggtccgcaacccgcgcatggagacgttctactacgtgcagctcgtgggcatcagcgtgggcggcgcgcgcgtcccgggcgtggccgagtccgacctccgcctggacccgtccactggccgcggcggcgtcatcgtggactcgggcacctccgtgacccggctcgcccgcccgtcctactcggcgctccgcgacgcgttccgcgccgcggcggcggggctccgcctctcccccggcgggttctccctgttcgacacgtgctacgacctgggcgggcgcaaggtggtgaaggtgcccaccgtgtcgatgcacttcgcgggcggcgccgaggcggcgctgccaccggagaactacctcatccctgtggactccaggggcaccttctgcttcgcgttcgctggcaccgacggcggggtgtccatcatcggcaacatccagcagcaggggttccgcgtggtgttcgacggcgacggccagcgcgtcgggttcgcgcccaagggctgctgactgctgcgcaccaccctgcctgaaccgctgtcggagagagagggagggagcagcgcggttaattaattagcgagtgattagcgggtaaaaaagtgagccagccgccttgttagtcataattaatggaggcggtgactggtgggttagctttgcttggtgggcggccttggatgctgtaaagaaaagggcagtctctgggcagtggctcagagtttgtctttgtgacagtagctttgatgcgcgaggaggatatcaggatggtcgatgaaggctgtaaaaggcgctgtcaaagtgtttggcttaagtaaaaaaaagtggtgcttaatgtaatgtactggttggtggctggtgt

SEQ ID NO: 13107 - DNA, 1178 bp, Sorghum bicolor
  Clone ID: SORBI-28MAY03-CLUS9792_1
gccggccgtttctcatgcgggttcgtcctcccaatcccgtgcagccggcctcaccaccggcgacgggacgcggagacccggaccgcccctccttccgcactggttctcccttcgtcgcccccgccaaaaccctctccaccagccggggggtcaacagctgctcgagatctggccgggttgcttagactcatctcttcgttcctcggtatggacttccacacactatcgcggcctgagcttcaggtgctgtgcaagcgcaacaacgtccgcgccaacatgaccaacgccgccatggctgaggcgctggagagcctagattttgttgatgggataaactacgagatggcgcccattccaattctggtgccagcgtccacagtcacaacacgcttgactgcaaggaggtccgcgtcgcgtaagacggaaatggttatgttgaacccagttccagccattcttcagaggagccagagaacagcaacgcagaaggctttggatcagaaaccaaaagatgacatcactgaagtgaaagaaagggctgcttctaagataccacaagctaagctgacagatgagacttgtgaagacgacggcctcgatgaagatgactctgctgaggaaattgggtctactgatgaggagaatgacactgttttcaccagtggcttactacaggagtttgacaaggagatggacaccaggcccgaccaggcatttataaaggagctgctccaggatcttaaaaccataaacctaaatatgcttcgagccacgtacaacgaattcaaagacaaaacaaatcatctgagtactgcataggtacagcaacctagggatgttgtgttggttcgtgaacaggggaacagccaattggggcttgtaataaatcgtcttacttctgttttagtggtgaaacgctatgcaatagtatcgaagcataagaattcaacctgtgctattccgtcaccggaaatgaacgccagcttatatacctgttattttatacctccgtgctaaatagcttattgtaactgtgcactgatacccagcttaacagttcatttttctccttatttagaaagaagttgtatttgtagagattgatgatttcaacttatggtagcttaccgagaactcgtatggatcaatgctgttgatctcgagttttgcgttctgtc

SEQ ID NO: 13108 - DNA, 1434 bp, Sorghum bicolor
  Clone ID: SORBI-28MAY03-CLUS1015_1
caaaatcgcactgctgagtgttgcttgtggattgccgaatgttggagtgcattatgagacatggaacactggtgttggtggtcctgttgggcttcatgggttgaatgaaggatcacgagatcttacttggcagacttggtcctatcaggttggcctgaaaggtgaacagatgaatctgaactccctagaaggctcaacctcagttgaatggatgcaagggtcgttgatagctcaaaaccaacagccattgtcctggtatagggcttacttcgaaactcccagcggagatgagccattggctctggatatgggtagcatgggcaagggccaaatctggataaatggacaaagcattggacgctactggacagcatatgcagatggggactgcaaagagtgcagttacactgggaccttccgggcacccaagtgtcaagcaggctgtggtcagcccacgcaacgttggtatcatgtgccaaggtcctggctacaacccaccagaaacctattggtagtttttgaggaacttggtggggattcatcaaagattgccctagtggagaggtcagtctcaagtgtctgtgccgatgtatctgaggatcatccaaacatcaagaactggcagattgaaagctatggcgagcgtgagtaccacagggccaaggtgcatttaagatgctcacctgggcagtctatttctgcaatcaaatttgcaagctttgggacacctatgggaacatgtggaaatttccagcaaggagattgccactcagctaactcacacactgttctagagaagaaatgcattgggctccaaagatgtgccgtcgccatctcccccgagagctttggaggagatccctgcccgagggtgacgaagagggtggcggtcgaggcagtatgttctcccactgcttagccctacttctcttaagcaatgaatttgaaggcggtcgtcggtcgccatctctgcaatgaatttgaaggcagtcgtcagtcggcaaaaaagattggccgaaaccaatgtgggtagagtggaactgtaagtatcgacttcgattagatgtgtctggctggagagattaggtcttgagcttagcgttgttcgtcgtcagattccagatttaggattgtttactctgctacatctccatgaattgttcaaagtggccagctggatattgtagctggtccaggaatggagtgtagagaggagtgaaggcagaagactgattatgcattcttttgcttggtggtagctgttgtacccgtgccatctcgtctttcttgaaacggagaaagatgcaggtgaagtgtggcattgtgccttttttgttctactactagtggtaagatggaggtttaaagaacaggctttggaattgtctgtaagactataactgaagttcagatttaatagtgccttgatttctg

SEQ ID NO: 13109 - DNA, 1471 bp, Sorghum bicolor
  Clone ID: SORBI-28MAY03-CLUS9554_1
gcacgaggctcctcctcctcctcgggtgtgccgcagttcgttgcccgattcccacccgccgatctctctctctacatcttctccaccttcgttccttcgggcgccctggctgttatattgccaccggcgccgccctctcctcctcctcctcctcctccgcgggtgtgccgcagttcgttgcccgattcccacccgccgatctctctctctacatcttctccaccttcgttcgttcgttcgcacaggaacggttgagcacaaacgagcagccactctcgaatcccgatcgcgattactcgccgcggcatcagtactcccagccgccaccatgagcagcgggaagcgatccttcttcgcgcccaagaagaaggcaaccaacccgttcgattccggctccgacgacgacaaaccgcagcggcgaccggcgcgggcttcctccgtgcctcccccggagtcggacgaacaacagcgagggggctcctctctctcgggcagcgccggcggcgacagggccgggctcttctcctcttcctcgaccaaccatcactaccggaacgacttccgcgacgccggcggcctggagagccagtccgtgcaggagctggagggctacgcggcgtacaaggccgaggagaccacgcgccgcgcgcagggctgcgtcaggatcgccgaggagatgcgggacaccgcgtccaagacgctcgtcaccgtccaccagcaggggcagcagatccaccgcacccacatgatggccgtcgacatcgaccaagatctctccaggagtgagaagctattgggtgatcttgggggcctattttccaaaaagtggaagccaaagaagaatggcgcaatcaggggtcctatgctaactagagatgattccttcataaggaagggcagccatctggagcaaaggcagaaacttgggctggcagatcatccacctcggtcaaatgcgcgccaattcagttctgaaccctcatcagcacttgagaaagtcgagatggagaagggaaagcaggatgatgctctgtctgatctaagcaacatactgatcgagctgaaagggatggccgttgacatgggctctgagatagagaggcaaacaaaagcaatgggcgatgcagagaaggattatgacgagctgaacatcagggtcaagggagcaaacactcgagctcgccgtcttcttgggagatagaaaaaaaaaacttatattcttgtctcctggatatatcacattaactgtatggggcatcaaattctgatgattttgtgcatcagattttgatcagcattgttactgtggacatgtcggcatgtatggtattagacacatattttatacgttttgcttcttttttctgatttgtttagcattgcacgaacttaggctttcagcagtttaacttggaaaccttgtctgattagaaacttcttttcgggtaaataatgctgattcatagtgaat

SEQ ID NO: 13110 - DNA, 351 bp, Sorghum bicolor
  unsure (1)..(351): unsure at all n locations
  Clone ID: LIB3478-003-P1-K1-E2
ccaacgcgtccgtgcacaacactcccaatttcaaaccagaattggacagtccctgaaatctgctcatgttccggctaataactatacaagtagtttctacaggggagactgggttaaaatctggaagtactaacaatggcatgcttgctactatgagcttgctgacatgttagtgacaggtgctgaacaaatgctttgtccttctttacacaattttcagagtgagaagctattgngtgatcttgggggcctattttccaaaaagtggaagccaaagaagaatggcgcaatcaggggtcctatgctaactagaggtaaattaccttaaactggactgcatgatgactaatg

SEQ ID NO: 13111 - DNA, 1325 bp, Sorghum bicolor
  Clone ID: SORBI-28MAY03-CLUS10164_1
agcaaagggcgaatagtctagtccagttccctcccccagattccccttttcatagctctccttctcgtcgtttttctattccagttctgctggcttttttttttctatatttctatttctgctattgttatttgcttccctatctattctatccattagtttatggacttctgcggatagatctcatggtttgttttgcttctttcttgcgtttcttgggccatatatctgcctgatgcttggattcgaagcggagctcctatcattccaatgaagggcccttttcatgggtggttccgctgctcgttcatggttcccactatcctatctcatcatgtatgtgtgtatgtactctagagggcccgagaagagattcatgtggtcgtcagtctttgagataggcttgtggtttgcatgaccgaggagctgcaccgtccccttgctggccgctctttggattgaagggagctctgcatcctgatccatccattccatccccccatgcttgctttgtttattggctgttcctgagtgagatctgaggctcatggctgtatgtagccatggatttttttccctttctcctagctgcttctgctgctgtttctccaagattcaataggcacggtctgccgtgcttatccgtgctggagctggatgaagcaggctgctttgctgctgccctcatcctcatgccctggatggtgtggtatcggtaccccgtacttgcgtcgctttattcctatctttgctggtgaggtgttatgtcagtacagtagtttatgtcaccctcgtttatcttgttctatatgcttcggtttcctattcttaccctgcgtcgggcgcgtgcgtgcattatatttccggtggtgctcttggatcttactctggacgcacgcagctagccgcacggccagcagcttcacctctccatggccacatcgtcaactcctccattgcagattcgcatctcgcttcctcggcgctccgctcatccgcgctccggccggtgacggtgagctcgctcgtcggcggcgccagtgactgatgcaagtttggggatgcaaggacgtcgtcgttctagcagttgcacttacagccatggttgcgccaagcttgtttggactttggatctggtgtgatgccggatatctgtaagaaatgctttgtggtgtaatgagaactgagattctctgaatgaaatatgtgagcctgatgtaccacttgggatacttgtatcgtgagttggatgagcatattgtattcgtccgctttttgtataaactttcaatgcctacgtgcaacgtatgcgcaatgccgattca

SEQ ID NO: 13112 - DNA, 1090 bp, Sorghum bicolor
  Clone ID: SORBI-28MAY03-CLUS996_1
aacaaatcccacaaacatttggttattatcagacacatggcaaaccagcttgctccgagccatcacaggctgaaagggcaaaaaggtgactcttctgataggctaacgcccgaggctaccgtgttccccggggcacgcaacagcattcccgctacctcaccaggacctcacgcgatcccccacagctgcctccagcgagaccaggaagggttgttggtccagtaatgccttaccaaaatggagacaccaaagacccctatgacacacgaaggttggcaatgaactcaggatatcctccccaacaacaaatcccacaaacatttggttattatcagacacatggcaaaccagcttgctccgagccatcacagggctgaaaggtacacgctgcatcagcaggcctatgcctgtgcaaaccgtacagctgcatctgatgttgctctggacatgagagcacccccttttcatcatctatcggcagggcaaaaaggtgactcttctgataggctaacagccgagacaaacttgtacacgagatcactcaacggcattgctgctactgcagcaggagtggcagcaactactcacagaaaagtcggtgttgttccatttggcatgtcaagcatgtattagtgaccggatcatggccgagttatggtgaatcctacgtgcctttgttggagctatgctgccttcaggtggctaaacatcgataatgaagcggccaatcaaacctttggctggatgctgccaagtttagagtgcagagcaatacagggttttcctgcgtggtcaggaaaacaggaaccaccatcggcggcgtgaagcgtgtcaacatgtttgttctatttagggcaccagctagtatctgcctgtgcttgagaagtgtgcccttggttgcacactgaagggtactccagcggcttgtaatctgggcaaatttaggcgccaatttcttttctagagcgaggaggcagaagggaaaggaaggaacattaacgttttaaatattgtatagagatgtttctcatatatcaatcaacgtgctacaccagaattactttagggagatgcaagatatagcaaaaat

SEQ ID NO: 13113 - DNA, 475 bp, Sorghum bicolor
  unsure (1)..(475): unsure at all n locations
  Clone ID: LIB3476-014-P1-K1-G8
ccgcgtacggctaacctgtcttttgcaggtctactattgttcactcagctccaattccagtcaaggaacaaccccgtatcggcccatctagggagaggccttcatctgatgagtcctacagaaatcctcgggagacagaaaaatattctggcaatctcccgagaacgtcacaggctccacaaagagtgccaacagcgagaccaggaagggttgttggtccagtaatgccttaccaaaatggagacaccaaagacccctatgacacacgaaggttggcaatgaactcaggatatcctccccaacaacaaatcccacaaacatttggttattatcagacacatggcaaaccagcttgctccgagccatcacanggctgaaggtacacgctgcatcagcaggcctatgcctgtgcaaaccgtacagctgcattctatgttgctctggacatgagagcacccncttttcatcatctatc

SEQ ID NO: 13114 - DNA, 1121 bp, Sorghum bicolor
  Clone ID: SORBI-28MAY03-CLUS10260_1
gcacgagcgtcgtcccgtcttccccttcgtcctcagccgcctcgctccctcgcaagcagcaaaacctcgtcacgaatcgccgatactccagcccggaagagccaacgaggtgactgcgcgctgcggccatgggtgacagccagtactccttctccctcaccaccttcagcccgtcgggaaagcttgtgcagatcgagcacgcgctcacggctgtcggatccgggcagacctcgctagggatcaaagctgccaatggtgtagtcatcgccactgagaagaaactgccttctattttagtggatgaaacatctgtgcaaaagattcaggcactaacaccaaatattggagttgtctatagtgggatgggtccagatttccgtgttctggtgagaaaaagtcgaaagcaggcacaacagtattatcggttgtacaaggagcacatacctgtaactcagcttgtacgagagactgctgctgtcatgcaggagttcacacagtcaggtggtgtaagaccatttggagtatcattgctgattgctgggtatgatgacaatggcccacagttgtatcaggttgatccctcaggatcatacttctcctggaaagcatcagccatgggaaaaaatgtgtccaatgcaaagacttttcttgaaaagagatacactgaagatatggagcttgatgatgccatccacactgctattttgactctgaaagaaggatatgaggggcaaatttcctccaacaatattgaaattggaattattcgagctgaccgtgagttcaaagttctaagcccagcagagatcaaggatttcttggaagaggtggagtaaattgcctgttgacgatttactgtttcgaacaacaatagcagcatcacttatgagcagccagcctgaagcttgtcttagttttatcactctgtaaactgatctgctccagtgacatgtggtgcttacatttgaaccctcctgaatgcattctgtagacaagtgagataacgtaagatgtggatggatgttgtatttgacatactctctgcagcttgtttatgtgatgcacgttcttgtggaccgtaaggatacctaggtgtttattgtggcacattgggaaaaaaa

SEQ ID NO: 13115 - DNA, 1677 bp, Sorghum bicolor
  Clone ID: SORBI-28MAY03-CLUS10278_1
gctcgtgggtcccccggatgccctgctccgccctctagcgctacgcgtcttcacggggtgatccttgttctagctttggatgcggggttcgaggatcgcgcccgcctgctcctacgtgcgtgggtcgaaggccgcgaggaggctgcccgctgtcccgcccccggccctccctgtgctggggtggccctgcgtgcgctgcactttgctgtcccctccctctgcgggtgcgcccggcgctggaattgcactgaggaagctcatcgaccagtgaactgcgagactgtttctaagtggatattaaagaacagtgcagaatctgaaaacatgaactggatactggctaattctaagccctgtccgaagtgcaatcggccgatacggagtgaccgcgggtgcgggcctttgacatgcacccctccttgcaaattcgaattttgctggttatgtctgggcgcatggtcagatcatggagagggaacaggtggcttttatgcttgcaatcgttatgaatcagcaaagaaagagggagtttatgatgagactgaagcaaggagggaaagagctaagaactctcttgagagatatatgcattactatgaacgctgggcatccaatcagacatcgaggcagaaggcccaagcagatctgctaaaagcggaaaaggatcagcttgcaaatttaactgacatttttgggataccagagacccagcttaagttcataattgaagcttggtcacagattatagaatgcaggcgagtgctgaaatggacatatgcttatggctactatctggatgataaggtcaagagtgaattttttgagtatctgcaaggtgaggctgagtctggcttggaacgtcttcatcagtgcgctgagaaagacttgcaaaaatttttgccttctgtgaaatctgacagcactgaaacgacggcaccaacaccggatgaatttagtgaattccgcgtaaagcttgctgggctcacaagcgttactcgtaattactttgagaaccttgttcaagctttggaagctgggttggaggatgtccgtgccactgcccaggctgctggtacatccagcgctgccaccagctccaagaaaggaggaactaaatccaagaagaagcagcccactaagccatcatctgaccacactgatgatgggtggccctgcgagcgctgcacatttcttaaccctccctcagtggatgcgtgcagcgtctgcgaaaagagtaggtactagatgatggaatagctcaaagggaggcaccccaagaaaagctcaaagttcatgagaaggaggggcgctttagatccagcatcagatgctgagcttccagcagctgcaatggtgtacagagagttatttaagggcctcaaatggttggaaacggagtgaaggctcaaatgtttacgtgtgtgtggtggttgggtggggttcatttggtttcctagttcgtttctgttgttccttgtaaatattagttgtgaagtggtaacctgtgtgttatgtggtgggttttgcttctgaccaatctgtgaaattgaactttcacaaaactgatgggaggtagctctgtttattcccctcgtaattgcgggcagggcctttgtctgttatctaatgactggttacttgcctcctgctagtgctggtaaatattactccaaaccg

SEQ ID NO: 13116 - DNA, 755 bp, Sorghum bicolor
  Clone ID: SORBI-28MAY03-CLUS8884_1
gagaatcacgggaggaacgcgcaacttgcttgcctcccgatagccaaccacctggcatagcgctcaaattcattgcttggttcatcagagccagcgaacttatcgtggtgcgccagtgctgcaaacatcttacacatacacagggaaaccgtaaaccagggacaacacaactatatatagaaccgaaataccgctcaagacagcacaaaacaaaagtaaattcgatgggacttcgagatctaacccaattcccgctgatttggaacctcatgtcggattcatttcactgatacttcgaaatcatggagatgagcaatatactctgtagagaactgcaatgtccgttatcgttcccataaatctccttccttgtgtcgttgcggaacccgcccactctggttacagatgctttgctaggtataaggatggaaccaggcacctatacctccaagtcgggcttccaacaccccaaaaggaacctactaaccataatggaggactgtacccactggatcgcattgctgtctcaattggatcgcatggtaattagatgtttcagacgtagttgtgtaggagtaataagggaccttgtttatggttactaataaccccctgcaccgtccctgctgacctcgttgcttcctggcgaaccgttttttttcctgaagaaggtttttttaaccttagtaagagcatctcccaagagtttttataaagtttctctcaattatcatttggagagtcatttgattaac

SEQ ID NO: 13117 - DNA, 471 bp, Sorghum bicolor
  Clone ID: LIB3476-055-P1-K1-B7
gaaggttctcgctgaatttaaggagggaattgaggtaaaaggaaaaatggtcagggtatctgcttgtcaagataataataccatttacctgggcaacatttgcaagggctggaccagagatcaggtgctgaacaccctaaaaagtattggaattcaagagtgcaagataacctttcccacttacaaggggggaagcagagggtttgcttttcttaagtttgcctctcactactatgctagagaagcattttgtcgcttaatgaaatctgatgctgtttttggtactgatagaagagctaaagtatctttttctgaaacccccacaaaatcatccaagagtcttttggaggcaaaaaaagtatacctggaacatgtccctgtttcttgggatgagaataagattaaagaatactgtgaagaatatggggagattctgaacagtgatcttttccagatattaaagaatttgga

SEQ ID NO: 13118 - DNA, 1178 bp, Sorghum bicolor
  unsure (1)..(1178): unsure at all n locations
  Clone ID: SORBI-28MAY03-CLUS1553_1
ttcctcttccccctccttcccaactgccgttgcctccctccaggctccagcggtccagcttcctccgcgcatggcctccgtggcgttcgctctggcgggggccttcaagggcctctccctggcgcccaccaccacttccttcctgcgcggcgaccgcgtctcgctctccgtcggcggcggcagcggcgccgtgggcgtgtcggtgccggcgcggcggctcaccatccagatggcgcacaagaagggggccgggagcaccaagaacggacgagactccaagggacagcgcctcggggtcaagatatacggcgaccaggtcgccaagcccggggccatcatcatccggcagcgcggcaccagggtctatcctggaaataacgttggaatgggcaaggatcatacactcttttctttgattgatggactagtcaagtttgagaagtatggtccagacaagaaaaaggtaagtgtttacccatatgagaaagagcctgaaaacccaaacagttacagagcaaggaagagagagtacttccgcatgcggcgtgaacggaagaaggcaagagcggagggagctactgagcctcaattggtactagctgctgttgacaaaaactctgaggccagcgccgactgctgataagtttcctgtgtagtatttctctttttcacagcccttgttacatattttttcccctgaattgtaagacacatgatctatataaggttatatttacatgttgttttccttgccgcttttatttttcttaaatagatcttttggacatttcaggtctatcctggaaataacgttggaatgggcaaggatcatacactcttttctttgattgatggactagtcaagtttgagaagtatggtccagacaagaaaaaggtaagtgtttacccatatgagaaagagcctgaaaacccaaacagttacagagcaaggaagagagagtacttccgcatgcggcgtgaacggaagaaggcaagagcggagggagctactgagcctcaattggtactagctgctgttgacaaaaactctgaggccagcgccgactgctgataagtttcctgtgtagtatttctctttttcacagcccttgttacatattttttnccctgaattgtaagacacatgatctatataaggttatatttacatgttgttt

SEQ ID NO: 13119 - DNA, 820 bp, Sorghum bicolor
  Clone ID: SORBI-28MAY03-CLUS14417_1
ttgccggacgcgtgggtgagaccacatcccgtttgcttacctggacaatgttcttgcttagtgtttatccagaatggcaggaacggctaagagaggaggtcctgagagaatgtggaaaggaaaatcctactgcagacatgcttaacaaacttaaagagatgacgatggtgctccttgagacactgagactctatagtcctgttttgctcatgctaagaaagcctatctccgatataagattgggaagcctcagcatacctaaaggcaatggaattgtcatacctattccatttctccaccgagacaaagaggtttggggtgacaatgccaatgattttgatccattgaggtttgagaatggcatcacaaatgcagcaaagaccccacaagctcttttatcattctcaataggaccaaggtcatgcatcggtcagaacttcgcaatgttagaagcaaagtcagttatggccatgatcctgaagaaattctccttcacactttcctcaagttatgtgcatgcacctgcggatcatataacgcttcagcctaagttcggtcttcccatagttttgaggccactggatgtatgatgttaaatggttgtatatgtgttggctgtttttttttatgttttttaaatatgcttaggacgtcggttcccccgccttactgtccgccgccagaccctatgcctgttgaacttgggctacttgctggggcgttacgcccatactatgtatacaatatacgatgcttcttataactttgtattcagagttcattctgagttgaattacctgagtttccaaactcttgccgg

SEQ ID NO: 13120 - DNA, 1614 bp, Sorghum bicolor
  Clone ID: SORBI-28MAY03-CLUS1560_1
cacacacccacacccacacccccgcgccatggcctctcctcgccccacctccctctcctcccccgccgccctcatccacctccgcctccagcccctccccagcatcccgccgctccaccccgcacgaggccccttcccgcgctccctcccgctccacctcccctcgctccgcctcaacgggccccacctccctcctctcccgctcgcctcttccggcagcggaagcgccatcaccggaaccggcggcgaggccgaccttcctcccctcccgctcgactcttccgacagcggaagcggcatcaccggaaccggcggcgaggacggccttcctccctcgggcgggggaggcggagggggaggcggagatggcgagggcgagggcgagggcgatggcgagggcagcgacgacgcctcggtcaacaggagggaggccctgtttgttctggcgcagctcgggcggaagctcgagagcctgccggccgacctcgccgcggccgtggagggcggccgcatcccggccgagatcgtgcggcggttcgtggacctcgaggcctcgccggtgctcggggggcttctgcagttcggtgggttcaaggagcgcctccttgccgacgacctcttcctcaccaaggtcgccatagagtgcggcgttggcatcttcaccaagactgctgcagagtatgagaaaaggagggagaactttgtcaaagagcttgactttgtgattgcagatgtggtcatggcaatagttgcagattttatgcttgtatggcttcctgctccaaccgtgtctttacagccaccactagcggtgaattctggagccattgctaagttcttctacaactgtccagataatgccttccaggttgctttgtctgggacatcatactcacttttgcagagagcaggagctattttgaggaatggtgcaaagctttttgctgtcggaactagtgcctctctggtcggcactggtgtgaccaatgcactgataaaagcaaggcaggctgccagcaaggattttgatggtgaagttgagaatcttccaattgtatcaactagtgttgcatatggtgtgtacatggcagtttccagtaacctcagataccaggttttggctggagtgattgaacagcggatgctcgagccactactgcaccaacacaaactagtattgagtgcagcaagttttgcagttcggacagggaatacgtttttgggttctctactgtggatcgactatgccaggtgggtaggcgtacaataggctcaagcatacaggcacaaatacaattgctcagagcttcagcaatatgggttcttcatgatttgctattaccatgcttcctccaactggcaactactcgtttgcttcatgggagactcttaggacagatttgatatcattctttgaacaatgccttgaggaaagcgtaatttgtcgaattattcccacaagcaagggatcaaatttgtttttgacagcttaaggttgtgttgtgtgttggattggactggttaaaattcgtacagtttggtcattgtttgtgcaagttcctgtgatttggctatcgtggtcgagcatcaatttttgctggccatgccttcccc

SEQ ID NO: 13121 - DNA, 1498 bp, Sorghum bicolor
  Clone ID: SORBI-28MAY03-CLUS11074_1
tactggaccaccacttctgctcgtcgaacgactccacactctcgtcgtcgtcgttggccatcgctcggccgctccaccatgctgtccatcgccatggccgcgcgccccgtcgccgtgagccgctcgcgccgcccgcgtctgccgacccaggcagcgtctgctgctgctgctgattcggatccctcttcctcccccgcggtagcggttcgtggagtcaacaaacaggaggcaacggcgaggcgctcgtgctcgcgccccatggttctggcttccgtggcggtggggagtctggtcgccgctggcgccgcaaatgccaccgagctatgggatcccttggctttgcacggatcgtcaggactcatcttggctgaccttggcattggagattggtttgggggtttgctgttttcagctgggcagcaggctaatgaggctgtccaagatcagttgtctgctcttagtttctctagcttggcagttatttttggtgctggacttgtaactagtttgtctccttgtacactcagtgttctaccattaactctaggatatatagggccgtctgcctaaacatgtaggtgcatttggctcagggaaaggccgatctgaggttgttgggaattcaattgcattttcactaggactagcaacaaccttagctattcttggtgttgctgcttcttttgctggaaaggcttatggtcaggtaggtcaagggctcccggtggctgcttctggtttggccatcatcatgggattgaaccttctggaggtacttgagttgcaacttccctcatttttcagtgattttgaccctcgagctgctgcagctaacctcccttcaggtgtacaagcataccttgctggtcttacatttgcattggcagcatcaccttgcagcacacctgttcttgctacccttctgggatatgttgccacttcaagagacccaattattggaggaagcttattgttgacatacacaacgggctatgttgcgcctcttcttgttgcagcttcttttgctggagcattgcagagtttgttgtcattcagaagatattcggcatggataaacccaatcagtggcgcatttctacttggtggaggtgtttataccctgctggacagagtgtttccagcaacatcaatggcaatgtagaccattgttggacaagaattgttacttgttaggcaacagtctgtttggtgtgtgataaaattcggatgtgaagtagtgaaatgatgctaacaaagtttagtcggttctctttgcgctgtataggcatgcagagcatctcgggacaagcaaaacatcttgacctcagtactgtagtctgcatcaccctgtatgggccttgataattggggctggaggtctaccctacttaaatgtatttcttggtagattgaaagagtatgaaatccatataaataccagaacaggaaaatatgagtatatgactatgcaagtagtcatagggatgcttatgttccc

SEQ ID NO: 13122 - DNA, 1253 bp, Sorghum bicolor
  Clone ID: SORBI-28MAY03-CLUS11413_1
cgctttaaactccccaccccaacccagaataccgatcccaccgcacactgcacccagtgcggcggccgccggcaatggcggcggcggcgcacggcggcgactacctgcggcggttcgtcgcggagacggagtggtacaacgcggtcgtcctcagcgccgtggcgccaggcgactggtggcgcggcctgccgcacccggtgcagtcgtggatgcgcaactgcgtcggcggctacctcctctacttcatctccggtttcctctggtgcttcgtcatctactactggaagcgccacgcctacatccccaaagatgccattcccacaaatgaagctatgaagaagcaaatagttgtagcatcgaaggctatgcctttttactgtgctcttccaactttatctgaatatatgattgagagcggatggacccagtgttactttaatatcagtgaagttggtttttctatgtacctctgttatatggctatgtatctcatttttgtggagtttggaatttactggatgcacagagagttgcatgacataaagccattatacaaatatctgcatgcaacccatcatatttacaacaaggaaaatactttgtctccatttgctggacttgcatttcatccactggatggtattctgcaagcaataccacatgtgtttgcgctcttcctctttccaactcacttcaggacacatattgctctcttgttcttagaggccgtgtggacaacaaacatccacgactgcattcatggcaagatatggccagtcatgggcgctggatatcacaccattcaccatacaacttaccgccacaactatggccactacaccatctggatggactggatgtttagtaccctccgtgagccagaagatatcctcaagaaggattgagttcctcgtagctgtggttttcctttggtgctgggaagtgcttgatttgctcccagtgtctctaatccgttgagcgcctgttcagtactgtctgttgccgtaggcgtcggtgtgttacttagtgtgctaggttcatgtggtgttgtggttattccgtaatttagcgatgtttgtctcatgatgatgcaatggagttcaggaggaataaaactctgctagacacattctgaactccagctgcttgtacaatgttgcacctcaactgtcaatataggatgtaaaatggattccttatacctggtgacttggtgagttcgttgtggtttctgtgcatgcattgctcagtct

SEQ ID NO: 13123 - DNA, 1863 bp, Sorghum bicolor
  Clone ID: SORBI-28MAY03-CLUS1147_1
tgggttccccagcaggggaatcgcctgcatccggcctccccaaaccctagcatcccgaatccgccggtcgccatggcgccgttccggcgctggagctgaccttgccgcccaggatctcctctgccgcatcggagaccgcctcgacctcaagtggtatgccagcgcgcggggcgcctgcacggcgtggcgctgcgcgctcgcgccgccgtcgcccgcgctcctcgtggtcgccgacgacgcccgctggtgcccctacgccgcctccctccccacgcggaggtccttcgagctcaccgccatcgtctcgggaagccgctgcgtcggctccagcaacggctggctcgcgctctccgtcgtcctcttcagcggccagaacgtcttcgtgctcctcaaccccatcgccgccgtggagatcgtcctcccgccgctgatctacgagagccgctgggtttccaaggtcgtcttcaccccgagccccgccaaggacgacttcgccgccgcggcaatctgcgacatcgacaggatcgcgtacgtcaccgccggtgccaggaggtgggccgtcatggaacccgtccgcctcaccagcggggaccagctcaccgacgtcgtctacaccgacaaaggtaaggtctactgcctcaccaagtgcggggacgtgcatgtgctccgcctccctgagcgccggcgccggaagcctgccaacgccgatgcagcaggccgctcggagccagagttttctgttctccagccaccacagcctactgaacgcattaatttccgcccactgcgatggcaacatcagcgcaattttcggatgctgcgctatgaacaggcccgaccaagagaggatccaactattccactgagggtaacgttctgtgcagagacattcatcccttcctataagaaagttcctcctgaatcgcaaggaccacacctaaatgcaccagccactgttgagcccttgttgtctgaggccaacctcccattcaaccctgccaccgtctttgctccaccttatgacactgtgtcgtccttcactagtgcgaagaacttggtgttctgtgagggcaatctgtaccaagtttggaggaacgcaagctgcactgttactctgcagctgcctgcaggaggtcagcgtcgcgtcgcggaaaatgagatattggtgcttaggtactatcctcgacggcagccttgctgggatgtggtgaaggacctgggaggtcactcgctttttgtgggaaggaacaatgcagtgtcaatgtatgcagagggtgtggcaggactgaggggcaactgtgtatactggattggtgggcgtggtagggatcaaggcatggtttttgacatggaatctgggaggtccacaccatgcagggctcctccggttggctttttacctgggcatccccatagcacaatctgctggtacttcttgagtgatgtaatgagcatcaacaacagttacaacactagcgtcagcagcagcagcagtggaggaagaaaagtttatcagactcgagcaagagcacgagcagatcttgcagacatggaagaatgattgcgtcgccaaacttcttggcgacatagtgaggaccaccaagcaccttggtggaaattgagtttatagtcttgggagtcggagcttgatttcaaggcgaagcaaaatcttgtagagaaggctgaggaacttcctcatgtgtagcctgtttcctgaaataatgttcagtttgtttaattgcctgtagcctctataatgtttgtgtttgttcgcatgtaaccggataataattttgtctttttatactcaattttccgtggtgggataaactcaatggattatgtaatgtttttggtgttggt

SEQ ID NO: 13124 - DNA, 1089 bp, Sorghum bicolor
  Clone ID: SORBI-28MAY03-CLUS1165_1
gcacgaggatcaccttgtagagacggctgaggttctttcaactattgatgctggccaaagaacacatcgtgcttgtgcccgggcttctcttctgtcacttcagatccgaatacctgatcttatgtggattggtctttcggagaccaatgctcggcgaatttttgtggaacaatctaggttccaggaagctcttattgttgctgaagcatacaacataaatcaacctatagaatgggctccagtcttttggaatcaaatgctaaagccggatctaatcgagcaattcgtggctgagtttgtatcagtgctgccccttcagccaccaatgcttctcgagcttgcaaggttttacagggcagaggtcgcagccaggggagagcaatcacacttctctgtctggctttcacctggaggcttgcctgcagagtgggtgaaacatcttggcagatcattcaggagcctgctgcgtagaacaagggacatgaggctgaggctgcagttggcaactctggcgacaggcttcattgacgttctagacatttgcaatagagttttggataaagtcccggacaatgctggcccgctgatcctaaggaagggccatggcggggcataccttcctctcatgtaaatatttcccttttcttttttagatgcattgggttcagaactttttggcagttaggctatcttgaaaggcacatgaatcttgcaagattatatcagttttcgttggttcggcatcttgacagaagcttggctgtagtcttcgacttggattctcatcgatgatgccatggaagacttttctgattgtatgtacagcagtttgagggaagccggcataggtcggatttttttcagcttcatccggcaggtgttttctcacacataatatactggatgcttgtaattttttttaccgtgcccaaaataattaaattttgagtcggtttgtccaagactttattgtacgaagatgcaccccgtatttttgttcctttttttgtttgtttgtcttgcaagtgaagcactagctgccttgtcattgtaggtcactgacgcgtccagtgttcagtccagcgaaag

SEQ ID NO: 13125 - DNA, 1968 bp, Sorghum bicolor
  Clone ID: SORBI-28MAY03-CLUS11908_1
gcacgagggcgccatgcaatgaattgccagacaaatggatcagaaaataatgcagccagcaatcatataagtgcaaatgttgctaatgggtcaaagacaggagaaaacagcgatgaggaaagtgatgcacaaagctttggtagcaagagggagaccgaaattcagagtgttgagaagttaccagacattcgtagagatgaagatgaagtggctggctcatccaaaaaaactgaatcacaaaataagtcttatgagcacgaggtaaacacaaaagtggatgcgtcaaaagatagcgatggtgctccaagtggaagtgagaagaatgtacactccaaatgccttaatggtattacttctgcaaaagtggctgagcaaattatggataatgccttgaggatcacggatgcaagttcacgtcgtccaagcaatcttggcaaagatttggctatgactgagccagaagctgacagaaaatgccaatcttcagtcatggaaaataatgctgtcacagaaaataaccttggtgtaaagtcaaagggtgctgcaatatgtcctgctgattcttgcccctcccagtttctggagaccaacttgggaaagcaacaccatcttaatggttacaaaaaccaagaattcagggaaaaagatatctttaatcactcgaattcctctgccttttcaagatatggcaataaaaggatagaaccatcaggggaaatacaattttttccttctctctgcatcactgggcaagagcatgttcatggcaaggacccagttttccaacccattggggtgttgctgcctcccaatgaacataatacaggtgagagtacaaggcaaactcgaattactttggacagtagcccggagggtgctgccatcatgtgttccagtagtgctagggaagatgctggtgtaagtagttcttcccatagaaaggacagcatgagccatccgtcatatgggtttattcctgttccaattcctgtcggtcctgggatgccctaccattatggtgcaattctgcagccagtatactacccacagggtcctcttatgcactgtgattcagctggaatcaacaaggcagcaatccagcatggctctggtcaatctaattaccatgaagctcctggtaaaccatctcaggatgatgagcacaaacagtcagaggaaaaccaccagttgcatcattcaagacaaattcttcgggaatcaggagaaccaattgagatggcgagagctcacatggatcgcgctaaccagagtgcaagttgcagccaagatatctgcaaaggaagtggatgcacgggtagtggtgaagccgatatcaatgcaaatacaatggttgcccttgagagtggcaacgaaagtggcatccaaaatggtgataggtctcgccgtgaagccgcgttgatgaagttccgcatgaaaaggaaagatagatgcttcgagaaaaaggttaggtatcatagcaggaagaagcttgcagagcaaaggccaagagttaagggacaatttgtaagccaaaagcagaaatctgctacaacaacagaagcagaaactgacttgtgaccggcgttaatttgtaactgtaattttgattcttgcttgcccaccaggtgtgggcaattggactgataatactgaaggctggcaacagtttttcccttacatggttagcctttctgtacaatggtgaactctttagtctttatgtctagtgtttgttggcattcaagccttattttgtaaagtacatcaaattgacgacaaatgttcagagtgaaaggggggtgtgggggattaggaaaacggtgcaaccaccagatttcctctatgtacttagatgtttgtggagtgagaaagcagagcctgtacagcttattcacccattttgttgccattaaaatagtagtaacttgtaactactaactactgctatgacaacaacagacactgtgt

SEQ ID NO: 13126 - DNA, 1082 bp, Sorghum bicolor
  Clone ID: SORBI-28MAY03-CLUS1176_1
tcttacgaaagtataattgatgtgctgttgagtaagggcttccaggtccttacttgtcgttcccttgaaatgagatataatctagcgaggtaggttccttcttatattagcttcacactggtaaaggttctttgtatattaggcccttacttatgggaagcgggactgttcttggtcttgcacctgtctcccaagtatacattcattatatttggctctcccgggcgcatcttcgtgttggagcgtgcagccccgttttgtttcatggttggcgacaagttccatcgtgctactcctggtggtactggaggtgtgaagaccataggaaattatgcttcggtgttgatggcacagaaaattgcaaaggaaaagggctattctgatgtcctctacttggatgctgttcacaagaagtaccttgaagaagtttcttcatgtaatatttttgttgtcaagggcaatgttatttctaccccggcagtaaaaggaacaatattacctggtatcacaaggaaaagtataattgatgttgctttgagtaagggcttccaggttgaggagcgacttgtttcagtggatgaactgcttgatgctgatgaagtattctgcacaggaaccgctgttgtcgtgtctcctgttgggagtattacatatcaagggaaaagagtggaatacggccaccaaggtgttggcgttgtgtcgcagcagctgtacacttcactgacgagtcttcagatgggtcaaaccgaggactggatgggctggactgtgcaactgaattaattgaccgtggatcattaccaacagatgagttcgcaagatcctcatctaagacgatcacaatcatgtgtacctcttcagttacagttttgtagtgtctaatgcgatggcgtcctgctgtatatttcgtagatagtctatttataaaccataaaacagtcatcgtctgtacccttcagttttgtagcatctgccggagacgagtactagtttggttattttctttcttttctggcctcagcacagttctagttctagcgtggtctctcgccttctttgctggacaaagaacagttctagtt

SEQ ID NO: 13127 - DNA, 701 bp, Sorghum bicolor
  Clone ID: SORBI-28MAY03-CLUS1731_1
gcgccggccggggcggaggggcggaaagcgagagacagacaaccactgcgaacgaatccatcgccatggcgtctcgtctcgttgcggcggcggcggcggcggcctcctcctcctcctcagcgtcccccctcgcccgcctaatctctcgccgcggccttgccggtgccgctgacggccatggacctgccaaggtgcccttgtggaaagatccgttgagcccgagcaagtggaaggaagagcactttgttctagcaagcctgtctatgtggggggctcttatttatggcggtttcaagctttttggtggaaagaaggaagacaagactgaggtggcaccagcaaaggcatagttgcttgagatggagctctacctatttctgcggtcaggcaacaatgttaaataaaaaagaacgttctatgttgtgctttaaagttgataaattgtggcaaccagagattttgatttatgtaggcaagatacacttactctcatccaccatgaataatcttgctgcagtggaatttcatgtcggcaaacactgcaaatgatgtacttctttcatgtgattgagtagatgttttacttctgttgacatcaacacttcagcactgtacttccaaattgattcgcgcactgtgcagtgcttcctttctattgtgctgttactgatgaatttaacacaagtttgattgatacaaaa

SEQ ID NO: 13128 - DNA, 583 bp, Sorghum bicolor
  Clone ID: SORBI-28MAY03-CLUS17354_1
tgggccggccgggcccggatcatctggtccgtccccaactcgccagtttaccccagccgccgcaagcagggacagaaggagctcgtgcgtgcgcgcgctccgcccccgccgacgcaatgagggccaagtggaagaagaagagaatgaggaggctcaagaggaagcgccgaaagatgaggcagagatctaagtaggcgcatcttggggctgagggaggggagcttcacctgcaccatggctgcttagctgtagatgttggtgatgtaaaccatccttggtcggttaattctactagctcgttgttaagagtccagcccatgttctgagactgggtttattgtaatgtgaggataatcatatgttgctttgtgactgatgttaatgccgttaaatgagattcctggtgtttaaatttaaataaaaaaaaaaaaaaaaaaagtccagaatctttagctttacaaaaaagtttcacttacaatacatccctgaagagtattttaagctatgcctttttcaatcttcaacaagaaaagtgacgccgcggccaagccccaggacgcctccgccgccgccaacggtaaca

SEQ ID NO: 13129 - DNA, 1523 bp, Sorghum bicolor
  Clone ID: SORBI-28MAY03-CLUS17585_1
cgctcgaggccggccgggccgggattcgaagtcgggacagcacccatcttctctccgcactagaaaccccaagaagacgcctgcctagctccgatcccaagatctcgtacgagatggccggcaagatgaaggagttagacggcgccagccctgctaagatcttcatcggcgggctctccaaggacacaagcatgagtacattcaaagaacatttcgggaaatatggggatataattgatgctgtcattatgaaggaccgctacactcaaaagcccagaggctttggctttattacctttgctgatcccgctgttgttgacagagtgattgaggatgagcatgttatcaatggaaagctggttgaaattaaaagaacgatccctaagggagctgctcccttgaaagatttcaagacgaagaagatttttgttggtggattaccctcagctctaaaagaagatgaattcaaggaatttttttccaagtttggaaaggttgtggagcatgaaatcatccgtgaccatacaaccaatcggtcacgtggatttggttttatagtctttgatgcagaaaaaacagtagatgatttattagctaagaaaggcaatatgattgatctaaatggttctcaggtggagatcaagaaggcagaaccaaagaaaccctctaaccaaccacctcgttcacttgatagcgaacctaggggccgtccatatgcagacagttatgatggatttggcagctcttacaattatggtggtagttttggtccttatagatcacctggaagttttggcgctaggcctggaggttacaatagtgcttctggtcctggtgattatggtagcggctatgctacttatggtggagcattagtaggataccgtggagagccatccctttattctagtcgctatggtagcacttacggaagcagctttggtggcgggtatggtggtggcagttatgcgggtggattagctggtgcatatgggcgtgaggctgggggctatggtggttctagctatggtcctagttatgattcttcaggggctaatactggtgctgggtttggcaccggtggactctatggtgctaggacaggctatggtagcactggtggcagtggtgctgctggtcgttaccatccatatggaagatagaaaatccccagtgctgctgtttgctagagaagctcccagaagatcaattctagatgtattctcaagagatcatctgcatttaaaagatccactgaagttcaatgtgctcagttttttgtattaggacgtactgttagataaacttgtagaaatttaaaccattgttttagtatttggaattggaatttaagcatacttaatatgggtatgcccttttatagatagaaaacttagtgacttgttaaagctagctgctagtatatgcaggtgttctttgttagtatagtttgctttgtgtttacggatattatggagtgctcaaacttaccctaagggccgaatgctgctgcccgtttcttc

SEQ ID NO: 13130 - DNA, 1076 bp, Sorghum bicolor
  Clone ID: SORBI-28MAY03-CLUS1762_1
tgggacttgaagaccaatactgagaagattgaagcagctgccaagaagaaagatgaagggaatgtgtggtttaagatgggcaagtacgccaaggcctctaagagatacgagaaggctgcaaaatacattgagtatgacaactctttcagtgaggatgagaagaagcaatcaaaatctctgaaaatcagttccaagctcaacaacgcagcctgcaagctgaaactgaaagaatacagagaagcagagaaactctgcacaaaggttctggatctcgagagcacaagtgttaaggccttgtacagaagggcgcaagcatacatcgagcttgttgacctagagctggcagagttggatgtgaagaaagctctggaaatcgatcccgacaacagggatgtgaagctggtgtacaagaccctgaaggagagaatgagagagtacaacagacgggatgccaagttctacggcaacatgtttgcgaaatggaggaagcttgaacagctgcagaaggtgcccgggaagcaagagctgcaaccgatggccatcgacagtgctgcataagatctttgcgccagtttgccatgctttattacttatactgtgggatcagaggacaatctccttaaccatttttatcgtttgtcagtgtttgtgttcttttcttctttgctgctgctacccatatgtgttcagccgcatgcgtgaaatttggtcatctgctgctgtgatctattttgttttggtgtgagtggtagagagactcacaagagactgtatgctgcctctaagctatgggatcaatctttagaggcacacataagttgttgtcgtcacgcgcctgtccatttccgtgtcccaaactaaataacctatatgctgatggtgctgagtccgaaatgtcaagatatgtggttgagaagttgcactatgaggtggatccaatagtcaccccaaaaaaaaaagaaaaaaaaagctggatccaatttgtactccctccgtgctaaaactaatctacaatttgataaaaaaatctccatcatatgtttttatagttaacttatttgaaatagaactgtgga

SEQ ID NO: 13131 - DNA, 1419 bp, Sorghum bicolor
  Clone ID: SORBI-28MAY03-CLUS13599_1
aacaatgcaacaacccaacccatcagcccgacccgacccggcaacgaccaagcccgacccaacccggccggcgcggcgcgggagcgatcagcgggtccagggcggcggcgaccagggcgtccagggcccagcggcggcggatccgcgaggggaggggagaggcggctgccagctgcatcggatccggtgggggagggtagaggcagctgtctgccggatgtcccgcggcggcggggagtagggcgacggcggcggggcggcaccacgtctgcggtagtctgcggcgcgggagcccggcggatcttcgtcgacgatagtctgtggcaagaggtcctcctccctcttcgccgacgaccccctcccgccgtgcccaaggtccccccactcctcccctcccccccagccggcggcggcggccgcacgcgtggacgccgacgggaggcgctcgtccaccatctacttgcgctcttccccgacatggatccccagttgcttgaaaaagctctggaagcatctggagacgacttggattctgcaataaagagtttgaatttgctgcgcttagagtccacatctactggtttcaaacctgaaaatggtcagcatacaacaattcagccttccgttgaaggtattcctaatggtggtgtggatacggttacagttacagaacatccgcctactgtagataattaccagacaagtaataatggctccgaatgggttgagctatttgttagggagatgacaaatgcttctgacatagatgatgcacgggctcgtgcgtcaagagctttggaggctttggagaaatcgattgtagagcgtgcaggagctgaagctacacagaatgtgcataaggaaaacatgatgctcaaggagcaactgactgttgttctgcgagagaatgctgtgctgaagcgggcggttgccattcaacatgagcgccaaaaggagtttgacgagaggtctcacgaggtccagagcttgaagcaacttgttttgcagtaccaggagcaagttaggactctagagatgaacaactatgccctgacaatgcacctcaagcaggctcagcagaacagctccatacctggacgtttcaacccggatgttttctaagcatagctgctgagtgatctgcaccagatcaataacctatggctatgaagatattctgttttaccaagtgcccctgaaatggggataccagataggttgattcaccgcccatgggtccaaaattttcaagatacggttttgatttaaacgtgttgctttcacgcaattggctaccaaatatattgtgtgtttccattttcctcggtatggtttatttgatccatggctaacatattcgtcacagagagattactatatccagttgtaggtctttttttttgaaaatggacaaaaaaa

SEQ ID NO: 13132 - DNA, 2208 bp, Sorghum bicolor
  Clone ID: SORBI-28MAY03-CLUS13601_1
gcacgaggatgaggagggagcccgcgggaaccaccgaatctcgcggtcgcggacggagcggcggcgcgggcgagcgagtctctctctctctctctctctctctatgcgtgcaagctttcaaaggaacttctctgatgctacagtaataatagaagaaaaatggagctgctcaacattattctagttatagcatctttactcccattctcagcatctgatcgtcaaggtgatgccttgtacgatatgaagctgaaactaaatgctactggcagtcagctttctgattggaaccaaaatcaagttaacccctgcacttggaattctgttgtttgtgacaataacaacgatgtcgtgcaagtaacattggcttctatggggtttactggagttctgtcaccaagaatcggagatctggagtatttaaatgttctgtccttgcctggtaacaacatcactggtggcataccagagcagtttggcaacctctctcggttgacaagcttagatttggaaaacaacctgttggttgggccaataccggcttctcttggcagactttcaaagctccagcttctgatactaagtcaaaacaatctcaatggctctattcctgatacgatagcaagcatctcaagcttgacagacattcggctggcttacaataaactcactggtcaaataccatcccagctgtttcaagttgcacgttacaatttttcaggtaataacttgacctgtggagcaaacttcctccatcagtgtgcctcaaacatgtcttaccaaggttcatcccatggttcgacaataggcattgtccttggaacagttggaggtctgatggggcttctaatcataggggctatattcattatctgtaagggaaggtgggcatgccgtctacggcaacttgctactggttgtttcagtgagaaaaatgttcttggacaagggggctttgggaaagtatataaaggagcacttccagatggcactaagattgctgtaaaacggttaactgattacgaaagtcctggtggagaggctgctttcttgcgtgaggttgagctgattagtgttgcagttcaccggaatcttttaagattgattggtttctgtacaacacaaacagagcgcctgcttgtttatcctttcatgcagaatcttagtgtggcctaccgtctacgagaatttaacctgggagccaatattagattggtctgcaaggaagcgagtggctataggcacagctcgtggactggagtatttgcacgagcactgcaatcctaagattatacatcgtgacgtcaaggctgccaatgtcttgcttgatgaaggttttgaaccggttgttggtgatttcggcttggccaagctggtggatgtacagaagacatctgtgactactcaggtccgtggaactatgggtcacattgcccctgaatatttgtccactgggaagtcatccgagagaaccgatgtttttggttacggcataatgcttctcgagctagtcactggtcagcgtgccatagacttttcacgtctggaggaagaagatgatgtgttacttgatcatgtcaacaacgtgcaaagggaagggcatctcgacgccatagttgaccgtaacctgaacaacaattacaacgggcaggaggtggagatgatgatccagatcgcgctgctctgcacgcaggcttcgcctgaggaccggccgtccatgtccgaggtggtccggatgctggaaggcgagggcctcgcagagaggtgggaggagtggcagcaggtggaggtgacgaggaggcaggactacgagcggatgcagcagcggttcgactggggtgaggactccgtctacaaccaggacgccatcgaactgtccgccggcaggtaacgacgtcgggtcacacggagcttcagcttgtcgtcgacgtcgcagggctgacatgtaactatatgtatgtaaggcattgttgcaaagcttgttagcaaaatttgtgccacttggcgttgatacgtgcctgtattttataatgtgtataaggatgatttaaaggggttcaggtgttaaccagctcccacccctgtaatttgtagagtgggggaaagctggggacgcatgtgccgcctggttgaaacttgaaaccacatcacatgcaagctgcaagcaccggtttggcgaagccgagtcattctcagccagtttgcgct

SEQ ID NO: 13133 - DNA, 708 bp, Sorghum bicolor
  Clone ID: SORBI-28MAY03-CLUS13864_1
cgcatgatctccacacctctgactgcctacatgaactccggcctggtgatcatattgagattcagtggagaaggaacaaagaattcccatatggctggtggtatggggttgttgggcacttggagtcatgtgatggaaatgaacacttttgtcggtgtcatcttagtgataccgtcgtgctggagttcaatcagtacacgccaggctcaagatggaggcaagcgttggtaaatcggaaggaacacagggaagagggcaatgagggcgacgggttctacggcggtgtcaggaagctccgcagcaaggatgacatctccaagtggaggcagctgtggccaacagacatcctggagtagcaagaacacatatattacttctcacattgggattgatcgattgctcaattgacatgccttccattgaccattgctttgtgctctgtccacggccaattcctctgctgcgctgttgtacacggattagaacacaaggtggcaacaaatcctgtagctggacaagggtgtaaacttattgtcaggcattaccgggcgcagactgtttcatgggactgtaactgtaagcctgtaactactaagcagtctgcgtcttgtgcctgctgttgtagctgtagggcagaaagatcaaatgtaaattacattttttttctagctcaaattcacgacaaaaaaaaaaaaaaaaagggcggcc

SEQ ID NO: 13134 - DNA, 1483 bp, Sorghum bicolor
  Clone ID: SORBI-28MAY03-CLUS14035_1
aaaacccccccgcaatagacttgtctctgctaccaccacgccaccgcgtttaggagagaatagagcaagagcgagagcaagcaagcaagcgagaggtttcagctgatccgatggcggccgcggcggcagcagcagacggggagcggaggatcggggtggccatggactactcggagagcgccaagaaggcgctggactgggccatcgacaacctgctccaccacggggacaccctcgtcgtcctccacgtcctgcaccacagcggggaggagaccaagcacgcgctctgggccaagtccggatccccgctgatcccgctctccgagttccgggagcccgaggtgatgcagggctacggcgtgcgcaccgacgccgaggtgctcgacatgatcgacacggcggcgcgccagaagcagctcaaggtggtggcgaagctgtactggggcgacgctagggagaagctctgcgacgccgtcggggacctcaagatcgattccctcgtcatgggtagtcgcggcctcggcccgatccagaggattctcctgggaagtgtgacaaactacgttctgtcaaacgcatcatgtccggtgacagtggtcaaggggaagtaatgacctgggcagcctgccagtgatatggctaaagttttttattgtcgtgtcttttcttccccttgaatcttgatgccagtggtcaaggggaagtgatgaccggtgacaacaaaaaacttgttatttagcgttcagtttgtgtggtttacacatatatgttcggtattgtttctgcatttgaataaagtcttgttatttatgatgttgcagctttcgcaaatccagctgaggctctgaccttatctataagctgtgaaaatgtccatactttgttcctgttcagatcgaattttgaggattcatagccctttttattgtcgtgtcttttgatctgttggtactctactcagtttgtatctggtgaccgcatctcaaatagtttctaagatcttgacttgatccccaggactcacgagtcgcgtcgggggaaccgatggagtcgacgtcgccgcgtctgtctcgacaatggccacgatggcgcaaatacttggccgtctatgcgcggcgacattcctcaagatgcgctctttcctcgagagagaggtgatggctggatggaggtggaggtgggtgagttccgcagcagtgaaggcgacgatggtgaggtttccatcaggcttaaggagacgtcagtcgcgaagagtggccttgttgtcctgggcattgagattagacctaaggtctaaggagcaagtggtttgatgagaaccttgattgtgtgagtaaataatggattgagaaattaatattgtaagtatttattacttcgcgcgttgccgtgagttttggagctgaaactgcagtataggatgaatactaaagaggtagattattctgtcaggttcttcctagaaatataaacttaaaagtcg

SEQ ID NO: 13135 - DNA, 906 bp, Sorghum bicolor
  Clone ID: SORBI-28MAY03-CLUS14098_1
ttaatcttggcatttatgtggaggatggcaacaaagagttgtctgtactggtagacaggtcaattggaggttccagtataaaggatggacaaatagaactaatgctacacaggaggctactccatgatgatgggcgaggcgtcgccgaggcgctaaatgaaacagtctgtctcgataagcaatgtgaaggactaattatacaaggaaaatactacgttaaaatagatccacaaggagaaggagctcggtggcgtcggacatttggccaggaaatatactctcctctcctccttgctttcacagagcaggatggaggcaactgggcgaattcgcatgttgcaaaattctctgccatggattcaacttacagcttgcctgataatgttgcaatgcttacccttgaggagcttgaagatggaagtgttctccttcggtttgctcatctatacgaggccggggaggacaaggatctttcagctttagcgagtattgacctcaagagagtgttcccagataataagattggcaagatcatcgagacaagcctatcggcaaaccaagaacgcacggccatggagaagaagcgcttgaagtggaaggtgcaaggttctgctgctgacgagaaggtggtccggggtggtcctgtggatccttctaagcttgttgttgagctggggccaatggagatccgcacattcatcgtcagtttcgatcacaacattagggacaaacagctgctctgaccgcctccgagtaggtctggacggcgaagtcaatgttgcatttttagcatgggttctcctgcggtttggaaataaaacaaataatgtggccaggcgctggccatgatgacctgctgtgggttaacccggttctaagtttataaggctgaggactggtttcact

SEQ ID NO: 13136 - DNA, 887 bp, Sorghum bicolor
  Clone ID: SORBI-28MAY03-CLUS14125_1
gccggccgggccgggcccttctttcccagacaaccgcagcaaaagggcaacaccacctcctcgccgtcgaaacgaatccaagtgaccagcgaaccggcggcggcggcggcgatggggatcggtgagcacttcgagggcttgaagcagcactgggcgagcaacctcgccttcctcgactacttcaagaaggtctacggccgcgccgagcccctccccaagtggaccgacgccgacgtcgacgagttcatcgcctccgaccccgtctacgggccccagctcaaggccctgcgggagtcgaggaagttcgcgctcgccgggggcttcatcggcgccgcccacctcggaggcgtcgcgctcaagttctccaaggcgccgcacggcgtcctgttggcgaccgggttcggggcgatcaccggcgccgtgctgggatctgaggtggcggagcactggtaccagctctacaagatggacaggcagggggccaaccttaggttcatctactggtgggaggacaaggtctcaggccagaagagctgaatcatgttgaatgatgcctattgtgagcataccagtttgacaaaacattgatgtctcttatgtggaatgcttagtttttgtttcctagttttctctaataaggtgtgtattggttgtggaaaccaactggacaatgtattttcattgctgtcatgagtgctgtttatccttagtacttacaatgttcatggtcactctggtgtaaacagcaaatcctatccgttttcaagacatgttttctcaaactactatttttctgtcagtagttacaatctcggaaatacaaaggctgcacgctgcatccgaaataataaacaatttgctctgcaggtgtttcttggtctttgggt

SEQ ID NO: 13137 - DNA, 1403 bp, Sorghum bicolor
  Clone ID: SORBI-28MAY03-CLUS14264_1
ctccgtgctggtctccaccctccctccctccctcttgtataaacttggccaagaaaagcaaccggagggaggagaaaggcaagggaagtgggaaggtaggagagagagagggagccagggaaagctctcttctttcttcctcctcctctcgaattccgtctctggtctctgtcctcctcgcccggtttcccccgttttttgagaggggaaagaggaggcggaggcggaggagggagggatggggcgggacgagaggttcccggtgtgggaggccgcgctcggcgccggggtcgccgccgccttcgccgctgggctcgtcggggtctacctttccatgccggactccgactacagcttcctcaagttgccacgtaatctcgaggaactccaaatcctcactggccatcttgagaactatactagtgattacaccctacaggtgttagtaggttattgcgctgtgtacatcttcatgcagaccttcatgatcccagggacaatattcatgtctctgcttgctggtgctctatttgggcaactccggggcttggccctggtggtctttgctgccactgctggtgcttcttcgtgctatttcctgtcgaagatgattgggaagccactggtgttcacactgtggccagataagctcagcttcttccagagacaggttgctaaaagaagagagaagctgttgaattacatacttttcctcagggtgaccccaacgttgccaaatactttcatcaacttagcttcacccatagtagatgtcccctaccatacattcttactgggaactctcattggtcttatcccagctgcttatgtgactgtcagggctggaattgctctaggagagttaacttcgctgagtgacctttacgacacccagtctatagcactgctattcctgatcggtgttgtttcagtcacaccagcattgttgggcaaggacgaggcacaagaaaaaccatcagaaatggtggtaggcgcgtcatgatcaccaaagcaccgagaggtgtccacctcacctgtatatatcaacatccagcatgcagtggcttcattagttcggatccacaggcccttgtggctggatgacagaactggttggcatggctacacagcttggcgggtcctcggcctaaactccgtcgcaccgccggcctacagaggcacctgtgtcaccatcatcagaacatgattcggtggccattcaccacattatgaatgaatgaatgaacctgggaagcagaatgcccgttagacaagctgctcttatgtgtaaacgagtagtgctgttcggatagaacaggcatttagtccaatccctgtatatatagaccagattcattcaatccatattcagtggttcaaaaaaaaaaaaaaaaaggccccta

SEQ ID NO: 13138 - DNA, 1414 bp, Sorghum bicolor
  Clone ID: SORBI-28MAY03-CLUS12168_1
ctttgaaggaattcttcaggctgggtcaacaattgtcgagaaccttaggacatataatcagcctgcgtttgtctacattcctatggctggagagcttcgtggaggagcttgggttgtggtcgatagcaaaataaatccagaccgcattgagtgttatgctgagaggactgccaaaggtaatgttctcgaacctcaagggttaattgaaatcaagttcaggtcagaggaactccaagactgtatgggtaggcttgaccccgagttgataaatctgaaagcaaaactccaagatgtaaagcatggaaatggaagtctaccagacatagaatcccttcagacgagcatcaccagcaggctcgcgatcccgagcccggcggccaggcgctcgtcgcccaagcagcacttcatgggcttccacacgcccgccgtggcgctcacgctccccaagcacaaggcggccaagtgatgtgctgcgaattcattgacacgaaggaaaggagggttaacaattttgttggttggttgcttcgatttgatttgttgtatgtaaacaaacatgtgtttaggttgcgttctctgatcgatcgggtaccattcttttgtacgtttcttcatcctcgtcgtttcgccttgttcatcagtgcacatgctctgcgtgcccactactgtacaagtctagtagcacatgcttctagccatgtgctagtggcctgaaactgcactcactcgatctcagagctccatgactccagttcagatctacaagcattctcgcagggtctttctacgctattagataagatggatccctctcaaagagcgaagtttgttcaggaagtcaagaaggtccttggttgatgatatgataccaacacatccaacactatgtgcatgctacatgtttttgttcaagtacatacatagaaggatattgcttggcctcgtttgcttggccgtttgatcatgtctgatctaagtcgaccattatttgttgaaacttcctttttggacctggtgctatggttgatgaatgtatattggacgtgtgcgactgtgcgttctgccaggtgtaagctcaaatgtttagacagaccgagttatggttaggaagagcacgagtgaacatgttctggttttgcagtggttcaggaaggcagaaagttgtttcactgtagttctgagatgtactaccagcggccccctgctgtaattttagggtgtataatgcggatactagtaaaacaattgagtggttcattaaattttgaactcgaataatgtttttctaggcatatgtaccgtacctctacgtgaaataaatgctgttgaaatagcattcgacaccagaatatatgtaccttacctaagagctaagtattataatacaacaagttgctggccgtaagatttcttt

SEQ ID NO: 13139 - DNA, 1318 bp, Sorghum bicolor
  Clone ID: SORBI-28MAY03-CLUS20754_1
gccggccgggctgggaattcaactcccagccgttgagggacaggggaacgcaaaacccaaaccccctcaacactccggctccgctgccaccgccgcgacgccgcctccgtcgccatggtgaagtccaaggccatcagggtccatgagctgggcggccccgaggtgctgcgatgggaggaggtggaggtcggggagcccggggaaggggagatccgcatcaggaccaccgccgtcggcgtcaacttcatcgacatctacttccgaaagggggtctatgccgcgcccaccctgcccttcaccccaggaatggaagctgttggcgtcgtcaccgctgttgggcctggcctcactggcagaaaggtcggtgatgttgttgcatatgctggcaaccccatgggctcctatgctcaggagcagatccttccagcggctgtcgctgttcccattcctccttcggttgatcataagcaagctgcttccgtgatgctcaagggcatgaccgcccatgttctgcttcgccgggtattcaaggttgagaatgggcatactgtcctggtccatgccgctgctggcggagttggctcactcctttgtcaatgggcaaacgcgctcggtgccactgtcatcgggactgtctccaatcaagacaaagctgctcaggcagctcaggatggatgccaccatcccataatttacactagcgaagatgtcgtcgcaagagtcaaggagattacatcaggaaaaggtgtcaacgtcgtctatgattctgttgggaaggatacatacaaggcttccctggagtgcttggcgccctgcggcttcctggtgtcctttgggcagtcgtcaggtaaacctgacccaatcccaatgagcgacctggcttccaagtcgctgttccttactcgtcctagcctcatgcattacactgctacccgtgatgagctgctggagtcagccggggaggtgtttgccaatgtcgctaacggggtgctgcgcgttcgcgtgaaccacacatatccgttgtcggaagctgcccaagcccatgcagatctggagggcaggaagacctcagggtccatagtgctcatcccggatacagttagctagagatagacaggtagcatcaaatgaagcaagggcatgtaaatgaataaatgtaaaacggagaagctaccagcagtatgatctggttaggggaactgggtaatgatatctatgctggttttcttatataagctgtctatgctatgttcgagtctgtttctctgactctgaaatatgaacgaatgaacaagtggcgctcttgttgttggtgatg

SEQ ID NO: 13140 - DNA, 1146 bp, Sorghum bicolor
  Clone ID: SORBI-28MAY03-CLUS19829_1
gccggccgggctctctattctctcctccagtcctcttcacacgcaacagcggcggcgacggtggtgtctaccgagcgctcacgagtgcccgcgcatcagggagaaaccatgcggcggtggtggccaggacgtgcccatggccaggctggagctgactgcgctcccgagatcccctttgccgtagtccgcgaggccaagcaggacctctctgatattggcgacgatggagacgagcggtgccaccaccacctctcttgttctatcaaaccgttcggcataatgaaaggctccaggcgccgggctttgttgttgggcccgcggccattgagcatcatctggtcctgtttgatgggaggtctggtcttgtgatggcacttctacgtgaatggatggcctcttgtatagtcttttttgcccttttttggtgagccggctatgttctcgtgcaggtcatttttggtttccccatatggttcctccacaggatttttgcggcagcctgcaggtcgagtcgcgtcatgcgtgcttctcgtctccttcatgtccgcacggttagttagccggcggaccttcctcctctaggcacctcccatcatcatcaggtatctactatacatcattagcttagctggcgtgcaatcacaggtctagatttattcttttgtgggagaagcagttagagaaacagaaagagacatgaagaatgagcgtgctccttttgttaactaaagcaaaactattttgcgttgtgtgttgccggttcttttatgcagcaagtgtctgtgctgctgtcactacatttactttgaatttacgcaattggaaactgtttggaagctggaaactgtacttagtggagccaaatactgttagcgaggatttgataattgccatataatgcagattcttgaattgtaagactggtgatttagagataatattatgtgatgtatgggctgatttctgtgatgtatgagttgtattggtggcttgctgtgttcgagcggctgtttcccctattgttagtctgctggtttggtggttggactgtgtgtggtgtgcgctgatttcgggtgggctgcaattaataaaatggatatgggcaagaaaaaagaaaaaataatgggttccccaatttcagcccct

SEQ ID NO: 13141 - DNA, 2330 bp, Sorghum bicolor
  Clone ID: SORBI-28MAY03-CLUS2228_1
gcaatcccggcaaaatccgaacccccgcctcgccgtcgcaccggctccaccccgcccggatcaaccacctgacctcctccacagcctcgacacacgtgcccgtcccgagcgacctccaaccagcagcagcctcgccccggccgccgcgaccgtccccgcacccccctcgtctcgctcgaggcaacgaaacggatgggagcagcggcctgacgcgatgagcccgcccgccatgctgctgcccgtctgctccgccgcgcccagctgctcccccctctgcccggtgacggcgtcgcacgtcgtcgcgcgggtgccgcggagggtggacgtcggcgccgcgctaaggtcctacgccgacccgctcgtcgcgcaggtacccgaccgcccgccgctcgccgactcctccatcctctccccctacaccgccgcgccggacgacatcgcgcgagccttcggcgcccccgcctccgagctcccgccgctccctagcgctgaccccagcgccgggctatgttgcacgggcaccgaccagccgctcacggccgtcgcggacctggccgccaccgccgtggtcaactcggcccccaccgatgccgcggagcgggccctgtcggacgcgccgttccccagcacgttcccgtccgacgcgtccgaggtcgaggactccgtggccaggttcatcgataaggtcggcaagcaggtgttccaggcggaggacgcgctcaccgaggcctacgacaagctgaggctgtcggcgtacgacgcgctcggtgcgtggaggaagacggtgcgcgacacgatcggtgggctcaaggcgtcggtcgacgccggtaaggagcaggccgcaggaggggtcacggacgcttccggcgcgttgcaggcgaaggtggccggagctggggctgtggctgttgatgttcttaggaaagcgattgtttcagcagaggattcactgggcagtgcagccacattcgttgtgtattcttatgggtctgccaaggagtctctaccaccaaatgttagagatttgttgagctcgtctgaggagaaagctggtctagttttgagaccaattggaaatgctctgcaacaggtatatgtaattgttgaaggtgttgaaaagaatgttggtttcgatccaagcgatccgattgttcaattggcagttgtgcttggaggttcagtgacaatagggacaacgtactggctcttcatatacggtggctattctggagacttgtcacctgaatcagcgttggagttattgaaaaatgatggcaaagccgtacttgttgatgttcggcctgagaatttgagggaaaaagatggtgttcctgatctacgccttggggctaggtctaaatatgcaagtgtagattcacctgagatcaaaggcccagttaagagtatgcttaaaggtggaagagaggttgatgacgccttactggcagctgtcattcgaaacttgaaattggtgaagggtgattcaaaggtcatagttatggattataatggagctcgatcaaaagccattgctaggttactgaagaagctcggtgtgcagagaccttaccttgttaaaggtggtttccaagcatggtcaaagaaccttcgtgtcaaagaactgaaacctgagactgcattaacgtcaataaatgaggatgttgaggaaatcctcgaacaaataaagcccaccccaactcttgtgtttggatctcttctgggcctctcagcactttcctatgctttacttgaatgggagatgactttgcaatacatcgctgttctaagcgtagggctgactatctacttgcgattctctacatacgaacgttctgaggacttggagcaagacctaaagctgttgctgtctccagtaagagtaggcgcagacgccgtatcatgggcagctaagaagatagagccaaacaaggtgggcctgccgacgtccccctccacgacggcggtgaaagaccgggttctccaggccgcagcgaagcacgagtcacagccagcggacgccgaagagtcgtcggcccaaacagccgaggcatgacgcgctgaaacctgaaaggttgggaaccagtggagcggatgagcgcaagaggtttctgatgtaatttgtgaattcgatgtcgtttctgatgtgaggtgttggttttgagtcactgtaaagcagctgtaaattaatcgtgtgagcagcatctgtaagttgccaccaacttgggttgagtgtgtgtgtgtgtgtgtgtagactatagagaaagaggtgccgatgttaattcctgagcctgttttagctgtctacgatcgatcttgcctgtctgagttca

SEQ ID NO: 13142 - DNA, 1776 bp, Sorghum bicolor
  Clone ID: SORBI-28MAY03-CLUS22445_1
acgctgctcccctcggcccggccgtcggccgtgctggtggcctcagcctgggcgtcgtcgccatcgcctatgcccacggaggagcagcagccacctcccgcccctgctcctgcgccgcccgggctccgctacctctcggggctgggcaacagcttctcgtcggaggcggtgccggggtcgctccccgtggggcagaacagcccgctggtgtgcccgctgggactctacgccgagcagctctccggcacctccttcaccaccccgcgcgcccggaacctccgcacgtggctgtaccggatcaagccatcggtgacccacgagcccttctacccgcggaaccccaccaacgagcgcctcgtcggcgagttccaccgggccaccaccgtcgccacgcccacgcagctgcgctggagacccgccgacgtgcccctccacccggacctcgacttcatcgacgggctctacaccgtctgcggcgccggcagctcttgcctccgacacggatacgccatccacatgtatgctgctaacaagtccatggatggatgcgccttctgcaatgccgacggtgacttcctcattgttccccagcaaggaaggctattgatcacaactgagtgcggaaagctgctcgtttcacccggcgagatcgtcgtgattcctcaaggtttccgctttgctgttgacttgccggatggcccctcgcgtggctatgtctctgagatcttcggcacccattttcagctccctgatcttggcccaattggtgctaatggtttggcttcaccgagggatttcctttccccgacagcatggtttgagcaggaccaccaccctggatacacaatagtgcagaagtatggcggtgagctgttcactgccacgcaggatttttctccattcaatgtggtcgcatggcatgggaattatgtcccttacaagtatgatctgagtaagttctgtccattcaacaccgtcctctttgaccatggcgacccatcggtaaacacagttctaactgcgccaactgataagcctggcgtcgcgttgcttgattttgtaatattcccacctagatggctggttgctgaaaatacattccggcctccgtactaccaccgcaactgcatgagcgaattcatgggcctcatttatgggatatatgaggctaaggccgatggttttcttcctggaggtgccagtcttcacagctgcatgacaccacatgggccagacaccaagacatatgaggcaacaatcagccgtgctggtgccaacgagccattcaggctcagtggaacgttggccttcatgtttgagtcttcgcttatccctcgcgtgtgtcgatgggctctggattccccgtgtcgagatctcgattactaccagtgctggattggattgaagtcccacttttcacatgacaacggtggagtggcgaccatcgagcctgctgctggcacggatgagaaagagtagctagctggcttactgcagcagcctccgatcctcgcttcgcttgtgtatactactatgtgctccgctagtttataagctgtgttgtgtacaagtacaaggtagaataaatcttcgtcgaacgagagaggcccaaggaaacatacattccaaactctgctcagctggctcttgtcttgggtactcagctgtaatgctagctctgcagtctgtagaatgtactactgtccccagtgtgcataaccataacgtccagaagcaagcaatttgcagcaatagcatgggaataaatgacagatt

SEQ ID NO: 13143 - DNA, 1097 bp, Sorghum bicolor
  Clone ID: SORBI-28MAY03-CLUS6153_1
cagaaacctcttgtcatccaagggagcggagccggggagccgccgcccgtttccgtttccgttgccgtggggaggagttcttcccccgaccccgactccccgagctccgagcgaagatcaccgagaaggaaaacctaatcctttccgttcccggcgcccctttgcgtgccgtcgtatatagcagccgaatagagaggggggcgaggagagatcaggagaacccaaaccacgtcgtcaaccctatctattctttattcgattcgactggactcttctcttctcgccaagaaggaagacgaacgaacaaaatccgatccctttctggtaaatccatcatggcagcggcaggagcagcgctccttcgatcggtggcaaccaagatggcccgcgcaccgcctcgccttccatctgccctggagcgccatcgccgactctcaacgagttctagattctctacatctactggttctacgccgcagccagccaaccagggcccgcaaactcataaccaggaagttcccagcagtctgtggtacagggccatagttgcattcaacgaagctgcatccgttgtaactttcttcctgctcggtggcatcgcgtttatgcattttagtgtcagtccagcactggaccgcatggaggctgacttggacgctcaacgtaaatcatgggccaccatcagggaagagattaagaaaagccatgaaaggacgcgtgcgatcctcgtttctaataaggaaagtcagattgaagctacagatgtttttgaaggcaaaaggattacgggcatcgggacaaagtaagagcatgttgcttaggtggcttaaggtgatcattggaaacaagagttcaaacaatccttggaggaggatgaggatgacaagaaatgatatggaactgacaatggagatcaaagacgagcaacttatgtgtgattttttgtttttgtttatgataattgattatcagaaacaaaattgtatcttctttgttgagcggcgacaaaaaatggtctgtgatagcatctgttagcttcatgactgtaatgaaaatagtttccaataatctagacatgatgaatgaatcaaggaagt

SEQ ID NO: 13144 - DNA, 701 bp, Sorghum bicolor
  Clone ID: SORBI-28MAY03-CLUS2385_1
gcacgagcaaaacagcaagcgccgcgggcacacacacaccagcatccctctcgcagtgaccctgctagctgcctgcttctcccagagctgagccgccgatccagctgatcgatcaagctaagtcagcttagatccaccatggctgcctccaccgcgtccaggaccaactcccgggtgaactactcgaacgaccatgacatcggcacggtgcagaactccaccatgatgccccccacgtactacgaccgatcgctggcggacatcttccctccccacctcctcaagaaggtggtctcggaggtggtgtccacgttcttgctggtgttcgtgacgtgcggcgcggcggggatctacggcagcgacaaggaccgcatatcgcagctgggacagtcggtcgccggcgggctcatcgtcacggtgatgatctacgccgtcggccacatctccggcgcgcacatgaaccccgccgtcacgctcgcgttcgccgtgttccgccatttcccctggattcaggtcccgttctactgggccggggcggccacgggcgccatctgcgcgtcgttcgtgctcgtgcccgtgctgcaccccatctccgtgctgggctgcaccacgccgacggggccgcactggcactcgctcatcatcgtcatcgtcgtcgccttcaacatgatgttcgtcaccctcgccgtcgccacggacac

SEQ ID NO: 13145 - DNA, 430 bp, Sorghum bicolor
  unsure (1)..(430): unsure at all n locations
  Clone ID: LIB3478-021-P1-K1-A12
atccacgacctgtccaccgtgcagagcggctccgctgtccctaccttgttctaccctgacaaatccatcgccgacatcttcccgccgcacctcgggaagaaggtgatctcggaggtggtggcgacgttcctgctggtgttcgtgacctgcggngcggcgtccatctacggcgaggacaacaagcgcatctcgcagctggggcagtcggtggccggagggctcatcgtcaccgtcatgatctacgccaccggacacatctncggcgcgcacatgaacccagccgtcacgctctccttcgcatgcttccggcatttcccctggattcaggtgccgttctactgggcggcgcaattcacggtggcgatgtgcgcggcgttcgtgctcaaggcggtgctccaccccatcgncgtcatcgggaccaccacgccgt

SEQ ID NO: 13146 - DNA, 913 bp, Sorghum bicolor
  Clone ID: SORBI-28MAY03-CLUS2432_1
gccggccgggctgggccaaccttacgaaacccttctccagtcctgctcactcccgtctccgagcgccgccgccaccagcgccagcgccgacgcgcgagaaacaggaggaagaagaggctagccgatccagctgctatggcgggcgggggcctgcttgggggcgcgttctgggcgacgcgggcgctggaggtggtcaagcggaatgattccccgggcctgctgtggaagcgcatcaagctgacaaccacccgcaagaacaacgccaagaagcgcctcaagcgactctggcagaatgaggcggttataagggcttgtggtgaatcagaatctgtgtcagcatcaaacacggcttctacggctgagaaacaacagtagcttggagctgaatacaaaactggagcaggtcctatgacttttgcacgattggctgaagcctgaactatcccccccagtattttgagtttgctgtcctcagattgaaagccaagtgcgtgtataaatcttactttcttcttccagaggacatcattgcttgctaccgcatgcaaccttgccccctcctgcttacatcagttcctagcatctatcccctcctgaattccatcgttttcgatttcgctgtttccatgttacttctggaaaaactgttgagcttgttttctttcctctattctgcatcatgcctaggtcagtctaactactattctgcatatgctgatatgctatatgagagaaaaacactgcttattgtctgcggcaatgtaatgcattgcacccgttgctgtcgttgacatcagcttgccaccggttttcgaagcttgcaagtttggttaaaacatgttgaaagaatctgggcccatcaaaggacagatgttcttccaaaaaaaaaaaaaaaggggcggcggtctaaaag

SEQ ID NO: 13147 - DNA, 844 bp, Sorghum bicolor
  Clone ID: SORBI-28MAY03-CLUS24420_1
tgaacactaagatcggatccttctccgtgcccgctgcctctatgaactctgccgaggtgatcttcatgcttatctgggttgtgttccaggacagcatcgtcatcccgatagccaggaggtacaccgggaacccgatgggactgacgctgctgcagcggatgggcgtcggacggttgctggcgatcccgtctctggcagcagcagcactggtggagacgtggagactgcgcagcgtgagggccgggcataacctgagcatcgggtggcagctcccgcagtttgtgatcctggcctgctccgacgtgttctgtggcattgcgcagctggagttcttctacgcggaggcgcctgcgtcgatgcgcagcctttgctcggcgttccagttcctggccatgtcgttggcgtactacgtgaacacgctggtggtctcattggtggcggccgtgaccacggcctggggcggccagggctggctccccgctgacctcaacgacggccacctggactactacttctggctgtggactgggatcagtgtggtgaactatgtcgtgtacacggcatttgcaaggcgttatacggtcaagaaggttgtccttcagtaaaggttccagactctctgtatgttcaattactgcatgtatccatcctactgtgttttgcagtgtacgctactctggaaccaaagatttctgctgttcatttgaatgtatggtcctctgtactagcctaccaggatgattcatcttactgtcttgtcttatgatttacgatttttataaatatttaccatgggaaaaggaagataatttgtatgcatatgcagattgggatgttgtgttgg

SEQ ID NO: 13148 - DNA, 1007 bp, Sorghum bicolor
  Clone ID: SORBI-28MAY03-CLUS24602_1
gcccctgccccctcccccccccccctccgtccgcccccctcccccccgccctccccctcctcgcccgcccgcccccctcccccctcccccaagccaaacaccaccacccctccttcctccccacaccccctctccctacgcctcctcgccctctcgccgctttccccacccaatccgaccgccgggccgcctcctctccgccggggcgggcgattccccggagattccgcgcgattcgccgcggattcggggctcctccgggggtttctcggcgaatcggcggggatcgggacttcccggctggagaatcctccatctgtttcggtaactatttggaacaatttacgtggagattgcataccatcaccttccctgaagtgaaaaatatatgggctgatcgtggcatttcatgggaggttttgaagatgatgaaccaccctcaaaacgcgcaagagcatcctcagtagaatctgcaagtttaccagattatttctcgttttcgaaatccgtcaatcctttgggaagtacaatggctagacctttgccttcccaagggaaagaagttatggttggttccaagggtgttattaagaaggaggaatttgttaggataatcaccaaaactctgtatagtcttggatatgaaaaaagtggagcagttctggaggaggaatctgggattattttacataaacctatggtgaatcttttcagagagcaggtgattgatgggaattgggataatgcggtggttaccttgaataagattggccttcaagatgaaaacatcgtgaaatctgcgtcatttttgatattggagcagaaattctttgaacttctaagaaatgacgatgtcatgggtgctatgaagactttacgatgtgagatcacaccccttggtgttaatagaaaaagagtgcatgaactgtcgacttgtatgatttcttgttctccacagcagttggtccttggtttttcaaagcttggaattgattcttctagttctc

SEQ ID NO: 13149 - DNA, 679 bp, Sorghum bicolor
  Clone ID: SORBI-28MAY03-CLUS25410_1
tggggccacactctccctcccgcctcaagtccctcgccgccgccgccgccgccgcccaaaaccctaccctcttctcccccttccctccttcacctttattctaatggcagcccaacccgtccgacgaagctgctagtgcttgaatccactctcttcatcaggtacctcgcgaccctactgaagcctcccccgccgtcgctgccatggccaccctcaacatgttcgaactcctcggcgccgacgacaacgacgacccctcgcagctgattgccgccgcggaggcggcggctcagaaagccgaggcgaagaagtccgccgcagcgcctgctgggaaggctgcccagcctgcggcggccgccaagttcccgaccaagcccgctcccccctcgcagactgtgagagatgcacgcggtggtggtgcatcagctcgtggaggctttggccgtggcgaacgcggccgtggtagaggtggacggggatatggccagaaccgcgacttcagtggtgacaatgccaatggcttccagggaggttatggtggcggaggctatggtggcggaggctatggagatggtgctgtaactggtggagctgaaggggaaagggagagaggccctcgccccccataccgtggtggaggcagacgtggtggttacaggaatggtgagtttggtgatga

SEQ ID NO: 13150 - DNA, 1374 bp, Sorghum bicolor
  Clone ID: SORBI-28MAY03-CLUS25278_1
caggccgttcaactgcaagctgctctaccacgacaggctccggatcgacccggcgctggaggcggagaccggcgcccagttcgaggcggacctcgacgccatgctgcccaagtgcgacgtcgtcgtgctcaacatgccgctcaccgagaaaacaagaggcatgttcgacaaggagaggatcgcgaggatgaagaaaggcgtgatcatcgtgaacaacgctcgaggcgcgatcatggacacgcaggccgtggcggacgcttgcgccaccgggcacatcgctggatacggcggcgatgtgtggcaccctcagcctgcgcccaaggaccacccgtggcgctacatgcccaacaacgccatgacccctcacatctccggcaccaccattgatggccagctgaggtatgcggccggggtgaaggatatgctggaaaggtacttcaagggtcaggatttcccggtgcagaattacatcgtcaaggaaggcaacctcgcgggccagtaccagtgagcatacatgaagacgcagctgcattgagcgaagcctgctgctgcctcagcgcccttacttcagaaaacacatgttaatcactataaataaaagtcgcgacgtttaaacattttcgtcatggtgactatggatgagaagtagtcccattttccaactttcatgcctttatttggttgaaatttgcaatttcgaatgacctttgatacaagtaccgctatgccctagcccccaagacaacagcattgctatgttggcctttatttatacctacacaattttcagttctctcatcaacagccaaacaagcaactcaacatcagaaaccacccaccaggaattcaactgctgcacttcttctgaacacgataatcttgagaatagctgttatgtcgctgaataaaaaaaccagacttcaacttgttaaacaaaaggatagtgaaacccagttgacccttgtctgtttgtctgtttgagcttcacagtcgttggaatgatgcaatctcctgttatagactgcattcaacctgacagatacatatctaagtactccaatgtttacattaatgtgatggtgtgcaaaagctcacaattgaagtgcattcaggcctttcattaatgcatcagtgtgctcaggtttcccaactgagatacggatataccctttcagttccttcttgtcatagtggcggatcatcactcccatctttgcaaggtcttcctttattttctttgcatcctttcctgatgtgacctcacagagaatgaagttagaatgactgggaaacggtttcaggaatggtattccttcgagaagattaaacaacctctccctctcttgtaccagtaaatttttcacattctccaaa

SEQ ID NO: 13151 - DNA, 1175 bp, Sorghum bicolor
  Clone ID: SORBI-28MAY03-CLUS2525_1
ggcgactggctcctcctcctcctgttcctgtcctgctaggccgcgactgctacaactacttgtacccgcgccgcgcacgcccatcccttcgcgcacgcaacgcaagcacagacacgcgcgatccgatccgatctgcgccccccgccggctatccatccatggcgactagggtttggctcaccgccctcctcctcgccttcctcctcgccgcctcccccttcaccgcccgagttgctagagctgattctgaggaagatgctgctgcagctgaggttgttgaaggggctgatctaggtattgtgggtgatgatacacaggtttccagtgatggacctttaagccctgctcctggtgtagagacagtagttgtcttccccaaaaatgctggcaaaattgtaccagcaggtgaagaaactgaattactagttggtttgcaaaatgacggtgaatcaactttgaatgttgttgctgttcattcaactctccatcttccttttgaccatcgtatgtatggccagaaccttactgttcagaatttcttcaatgcatcagttcctgtttctgtgcaagcaaccttcccctataaatttgttgtgagcaagttcttgcagcctggagcctatgatctagttggttacatagtgtatgagatcgaccagcacccttaccagaatgtgttctacaatggcactgtcgaggtcgttgaggctggaggcttactcagtgttgagtcggtgttcctcatcacccttggaattgcacttcttggtctctttggattgtgggcatatggccaggttcagcagttctcgaagaaaacaaagaaggccccaaaggtggagctcggaactggaacaactgatgccaacatcgatgagtggctggagggcacttcgtttgtgcagagaagcaaatccaagaagaagcagacctgaggctctccagactagctaatccttttgagggtctagaatgaagcatttgagggtagcccttcacaagtgacttttgcagaaagatagatgcgtaaggaggtgctgaaaactgtagtttcgtggtcgaacatctttgttgacaccatttttcgaccttgtgtactttacatggaacttttcttcaaacaacattttgttaaaaaaaggtatatgctgttgccgctggaattgctgatcata

SEQ ID NO: 13152 - DNA, 1103 bp, Sorghum bicolor
  Clone ID: SORBI-28MAY03-CLUS25472_1
gcacgaggcgcaatccactcccagaagaagtctccagaaccgcatgcgcccttataaaatggtgatctcgatcggcctacaaagagttgcgagtgattagcagagtgagaaagaactcacaatcacatcagcaggggtacgaacaggcgcgctaatctacagcattcttgggctgattggttgatctctgacggcgggggaaccgatggcggacgacgcgttcgacctccccatctctggcgagggggaggaggaggtgatgggaggcctggaggaggaggaggaggccataaaggacctcgacgctggggtggacgccgatgaggactatttccctccgacgatgaaggccggggaggagagggagattgggaaggaggggctcaagaagaagctcgtcaaggagggccaggggtgggatccccccccgaccggcgccgcggcccccgcgcggtgctctgcccctcctgccgacggcccaccgttcgattcgagccgtgaccgtggaaccccgttcaaattcaaacttggacaagggcaagtgattaagggatcggccccggccggcgggcccgcgtcgtcgggtccgcccgcgacccccccgaccccgcccccgcggcccccccccccgccgccgtcgccgtccgcctccccgccccccgccacacccccgtgtgcccgcccccccccgtcatgggccagcgtcaaggatatatgcaaggatggtggaatctttaagaagatcctcgtcgaaggcgagaagtgggagaaccccaaggaccttgacgaagtttttgtcaagtacgaggcaagactcgaggatggaactgttgtgtcaaagtctgatggtgttgagtttgccgtcaaagatggttacttctgcccggcacttgccaaggctgtgaagaccatgaagaagggcgaaaaggtcctcctcactgtcaagccacaatatggcttcggggaacaaggaaaacaagcttctggagatgaagcagcagtgcccccaaatgctatgctgcatatagaccttgagctggtcacttggaagactgtgacgctaatcggagatcgcaagaggatcttgaagaaagtccttaagg

SEQ ID NO: 13153 - DNA, 1050 bp, Sorghum bicolor
  Clone ID: SORBI-28MAY03-CLUS25484_1
gcacgagggccgctgccgcggcgcgaggcggaggcggaggcggaacggaggacggcatgtacacggagctctggagcctctgcgccggcccgctggtcacggtgcccagggtcggggacaaggtctactacttcccacagggccatatcgagcaggtggaggcatcgaccaaccaggtggctgagcagcacatgcaactttacaatctcccatggaagatcctgtgtgaggtcatgaatgttgaattgaaggctgagccggacaatgatgaggtttatgcccagctcactctgctacctgaatcgaagcagccagaggagaatggctctagtcaggaggagatgcctgctgcacctcctgctgcacttgcaaggccacgtgtgcactccttctgcaagacattgacagcctctgacaccagcacacatggtggtttctcggtgctgcgtcgccatgcagatgaatgccttccaccgctggatatgagtcgtcaacctccaacacaagagcttgtggccaaggatctgcatggtgtggaatggcgctttcgtcacatattcagaggtcaaccccgaaggcatcttttgcagagtggctggagtgtttttgttagtgcaaagcgtcttgttgctggggatgccttcatctttctgagaggtgataatggggagctgcgtgtgggagtcaggcgtgccatgaggcagcaagcaaatgttccgtcttcagtaatatcaagccacagcatgcatcttggtgttcttgctactgcatggcatgctgttaacactgggaccatgttcactgtctactacaaacctaggacaagtccagctgagtttgttgtcccctgtgatcgctatacggagtcactgaaacgaaattaccctatagggatgagatttaaaatgaggtttgaaggtgaagaggctccagagcaaaggttcactgggacgattgttggaaatgtggatcctgaacaagctggatgggctgaatctaaatggcgttacctcaaggtgaggtgggatgaagcttcctccattccacgtc

SEQ ID NO: 13154 - DNA, 948 bp, Sorghum bicolor
  Clone ID: SORBI-28MAY03-CLUS25598_1
gcacgaggcagggacattactcctccaatagggattaagcaggctatggagatgcaggctgaagcagaaaggagaaaacgcgcccaaatccttgaatcggaagggaagaaacaagcccaaatccttgaatcggaagggaagaaaactgcccagatccttgaatctgaaggagctatgttggatctagcaaaccgtgcgaagggtgcggccgaagcaattcttgccaagtcggaagctactgctcgcggaatgagattggtttcagatgcgatgacaactgaaggcagtgccaaggctgctagcctaaaacttgcagagcaatacatcgaagcattctcaaatctggcacaaaagacaaatacaatgctccttccaggcgacagtgccagcccagcatcttttgtggcccaggcgatgaagacgtatgagcatatccattcccacaaccaggcattaaagagccacccccagatacaagagctggaggaatcaggagagaccagtcctgctgccccatcttctgaggcgagcacgatgccaccactcattgaggatgcagactctaaccagaccttcacgctgcaacgccccaagaacaagaagtgagcttcgctcaagtgctcgaagtccttttctttgtctctactgttctgcaacatgagattgtcactgagaaacaccagtaggtttagttttctttagcctgaagagagagctgatgcgcggcggagaagcaatagaaccctaggcatttggtttctgggagctaattgcgaccctggatagagagattttgattctggtgaaggttatactttggttccttcttattagatggaagtttgtaaaaaggcaaggctgtttttaacggtggtaaaactaatcgcacacgatggcaaatgctttagtttatggctattgttgctctggctttgcccagttcacgct

SEQ ID NO: 13155 - DNA, 882 bp, Sorghum bicolor
  Clone ID: SORBI-28MAY03-CLUS3100_1
gccggccgggccgggctagtccagaacgaactaaaacccgcaaccgcgaagccactagtagaaggcggcggcggcggcgatggggagcgacacggagacggagaagaagaagaccccggtggcgctgatgcccatcgcgaagcccctcgctggaaagaagctctgcaagcggaccctcaagctcgtgcgacgagcctctgaggccaagtgcctcaagcgcggagtcaaagaggtagtcaagagcattcgccgcgggaacaaagggttgtgtgtgattgctggaaatgtttctcctattgatgtgattacacatgttcctatactatgtgaggaagctaatgttccttacatatatgttccatcaaaagaggatcttgcgactgcaggaaccacaaagaggccgacttgttgcgtcttggttctgaccaaaccaaccaagggggagctcagtgaagaggtgaaggataaactgaagtcagactatgaccaagttgtaacggaagttgctgaggctacgtctgcaatgttctgaggaccatattatctgagaatcaggcaactccatgtgcacatctttcttggtgtagtatgtaacttgatcctgtcaacctgtcctgcctgcttggaacaaccgcaccagtatgttttgcatggtggctggagcgatatgactatatgagtttacctgcatattatggactatccttgttggcgtattatcctattattaatgattagatttagccaattataatcagttcggtgaccacactgtttccttgggttgtcgaatcttggtagctagtaggcacgttccaggtcttgtgttgatgacttgtcacaagatgtgcctgtaaatcttgcggtatcttagcgccttat

SEQ ID NO: 13156 - DNA, 795 bp, Sorghum bicolor
  Clone ID: SORBI-28MAY03-CLUS17942_1
gccggccggccctgggtttgttctttcccgaattccccagcgtccacctcgctcgcaaccttcccccagccatggcgaccgcgacgcggaggctgctgcccgcgctcctcaagaccctagcaccagccggcgcgcgcggcctctccaccgagaaggctgtcggcgccgccgccgtcgtcggcagccacaccgctaagtggatgcaggacacgagcaagaagtcaccaatggaactgatcaacgaggtacctccaatcaaggttgatggtcgcattgctgtctgtgaaggggcttctgaaggtgttggacttggccacccgatcgagtatatctgccttgatctggaggcacctaatgtatgcaaatactgcggtctccgttatgttcaagttcaccatcactgaacagggaagatactgccatttaccgctgcagaagtttggagttgaggagtttgtgcatgcacatttgtttcacaatgttctgctactgctagtgtactttgtactatgcttgagggcaaaatattacctttgatgatcatcctcttttcggatgaccttttaataatcctgtgttaactgtgggttgatttttctatagatgaattgtgctcccctttcagaacactatgcaagctgtgtgcctgtgtgtattgaaatccaactctgaatatgaaaagtatagaattaattctgagggcaatttaataaaaaaagtttcaatcttaaggaaaaccatgatcctgacgttttccttgctgagccttctgggatccgtgtgcttcagttacgt

SEQ ID NO: 13157 - DNA, 771 bp, Sorghum bicolor
  Clone ID: SORBI-28MAY03-CLUS17489_1
gtgcggcgctcgagccggccgggccggatactattccttgaggcgagccgtttgcccccacggaatcaagaaaccaagccagccagccagccagccggccgaccggcctgactgccggatcctcctctcctccatagccagccatagccagtgtgtgcgagagagagagagagagaagagcagaatgttggaggggaaggcgcgggtggaggacacggacatgccggcgcggatgcaggcggcggccaccacggcggcgtcccgcgcgctcgatctcttcgacgtcgccgacttccgcggcatcgccggccacatcaagacggagttcgacaagcggtacggcgtggggtggcagtgcgtggtgggcgccagcttcgggtgcttcttcacccacaccagcggcaccttcatctacttctccctcgagcgcctctccttcctcctcttcaaggccgccgccgccgtcgccgtcgccgcctcctaatcaaaaccatcatcaatctccggatcctgcccggcggcgcgccgcgaacacccgttcgtcctcatcagaacagaaatggaaccgtgcactttcgtctagtagctagtatcatttgtaatgtccgttacgtccagaagctcaaatcagctgtatgcctagcatcctgtaaatacaccgcaccatgatgctcgctcgttcctggaatcatttaaagcctccattaccatcgattctgctacctctacaaagcagcggcagctgatgcactgcaagttccgttccgtgcc

SEQ ID NO: 13158 - DNA, 1163 bp, Sorghum bicolor
  unsure (1)..(1163): unsure at all n locations
  Clone ID: SORBI-28MAY03-CLUS18324_1
gcacgagggaagactgtctctagaacacctaacctcatcttataagaaggctaacaggaggatgatatttctggactatgatgggactcttgtgccgcaggcatcacacgacaaatctccaagtgctgaacttatttctatccttaacagcctgtgcaatgatatgaagaacacagtatttatagtcagtggacgaggaagagattccctaagtgagtggtttgtttcatgcgagaaccttggtattgctgctgaacatggttactttatcaggtggaacaaagcagctgaagctacctccctttctgagcctgccatttctgaagtatttgcctgttccgttggcccaaaggccagcaaagcaaactactatgtcgatggctgcagcgaagtaatcagattactgaagggtgtcacagccatttccccccaaaaggatactgtcagccatagccatgcggtcttcaaggatacactcgaggttatcagctgatccacacaagcagtcagctcaaactacctacatccaactgtgttcagcctgtcaatctcaaatttccactgcatgcaagctatacatcactcaaaaacatatctgccacgtggaactctaaattggacaagaacaattgcaattgttgacacgaagacaacagtgatcacaaactgcaagttcctgcaaatggcatcaccattgatgatgcaatgacaacagaaatcacaaaccgcaagttcctaatttgtaggtaagactaccagtgggatgccatacattttgtaggcggttgatctgatggtgaaaggatttcctgctagagccccaactttgcagcagctgggagagccctggacctgtgtacagctcgtgggttgcacctaccttcagaatgatttgcaattcatcccatctgacgcttgtgctgcactgagcactattacactatttctttatagaaaacaggtgtgattaggtgattaccgctgtatctgtaggttgtaattcacccacgtacctttgagaaaaacatggtgtttttgatttgaggaatctgttagtccatcacctactcatttctcatttctttttgtttgctttgtggaatagaataggttgatgtatcatggtcttattcttcacaagctnagtaattatcactaatatg

SEQ ID NO: 13159 - DNA, 1164 bp, Sorghum bicolor
  Clone ID: SORBI-28MAY03-CLUS180_1
cccgaagcttcctcctcgcagcgcgccgcgcgtcgtcgtctccacccaccccgagacccgacctcgcgcgccacgccgagcctgcgagccatcacccccacccaccgcctcgccgcgcagatctcgggagcttaccctcccaccggcaccgggcggtgattctcccgccccatcaccgatgcggacgccggcgatgctccggtgggccgcggcgctcgcggtcctgctcgccgtcgccgcgccggccgccgggttctacctccctggcgtcgccccgagcgatttcgccaagggtgatctgcttccagtgaaggtgaataagttgacatctatcaagactcaactcccgtacacatattactcccttccattctgcaagccagataccataatcgacagtgccgaaaatcttggtgaggttcttcgtggtgatcgcattgagaactctccttatgtgttcaaaatgggagagcccaagatgtgtcagattgtctgcaaagcgaagatcggtgagaaagaagccaaagagctcaaggaaaagatagaggatgaatatcgagtgaacatgattctagacaacctcccgcttgttgttcctgttaaaaggcaagataagaacagtattgcttatcaaggtggatatcatgttggtcttaaaggcctgtattctggaactaaggatgagaaatacttcatccacaaccatttgtcatttgcggtgaagtatcacagggatgaaaattcaggactttctagaatagtgggatttgaggtcaacccacacagtgtcaagcatcaggttgatgataaatggaatggtgtagacactcgcttgagcacttgtgatcctcatgcgagcaaatttgtaacaaactctgataatcctcaggaagttgaaactgacaaggaaatcatattcacatatgatgttcattttgaggagagtgagatcaagtgggcatctcgatgggacacctacctgttgatgactgatgatcagattcactggttttctatcgtgaactctctcatgatcgtgcttttcctatctggcatggttgccatgataatgcttcgcaccctctacagagatatctctagatacaatcagcttgaaactcaagaagaagcacaagaggaaacaggctggaagcttgttcatgg

SEQ ID NO: 13160 - DNA, 639 bp, Sorghum bicolor
  Clone ID: LIB3481-049-Q6-K1-H1
cgcgtccgatttggggtatagttcaaatgggagagcccaagagtgtcagattgtctgcaaagcaaagatcggtgagaaagaagccaaggagctcaggaaaagaagaggatgaatatcgagtgaacatgattctagacaacctcccgcttgttgttcctgttaaaaggcaagataagaacagtattgcttatcaaggtggatatcatgttggtcttaaaggcctgtattctggaactaaggatgagaaatacttcatccacaaccatttgtcatttgcggtgaagtatcacagggatgaaaattcaggactttctagaatagtgggatttgaggtcaacccacacaggtttacttctaactctgtttggcaggattttattcttcttgttatttatgaaatggacctaaggtattttgttacatatgttgacagtgtcaagcatcaggttgatgataaatggaatggtgtagacactcgcttgagcacttgtgatcctcatgcgagcaaatttgtaacaaactctgataatcctcaggaagttgaaactgacaaggaaatcatattcacatatgatgttcattttgaggagagtgagatcaagtgggcgtctcgatgggacacctacctgttgatgactg

SEQ ID NO: 13161 - DNA, 744 bp, Sorghum bicolor
  Clone ID: SORBI-28MAY03-CLUS18745_1
aaaaaaaaaaaaagaaaaaagggccgggaaagtttcgtccaccatttcgctctcgcagccaccgatttgtttactgctcgctccggcgcgctgcggcggagcacccgacgacgactgaaccatgtgcggcggcgcgatcctcgacgacctccgcgagccggagctgcgccgggtcacggaccgggacatctggcagaagaagaagcccaagaggggcggcggcggcgggaggcgctcgttcgcggcggaggaccatgaggacttcgaggccgacttcgcggatttcgaggctgactccggcgattcggatttggagctcggggaaggggctgacgacgatgtcgtcgagatcaagcccttcgccgccaaggggactttctcaggagatggtttaagcaccatgactactgctgattatgatgcccctgttgcaaggtcagccaaaaggaagagaaagaatcaatacaggggtatccgcaagcgcccttggggcaagtgggctgctgagatcagagatcctcagaagggtgttcgtgtttggcttggtactttcaatagtcctgaggaagctgcaagagcttatgatgctgaagcacgcaggattcgtggcaagaaggccaaggttaactttcctgatgcaccagcagttggtcagaagcgccgttctggctcagcttctgctaaagcacccaagtcaagtgttgaacagaagcctgtcgtcaaagcaccaatgaccaaccttgc

SEQ ID NO: 13162 - DNA, 1612 bp, Sorghum bicolor
  Clone ID: SORBI-28MAY03-CLUS1985_1
gtactctgaagccaaggagcagttggacttggcgaaaagaattgggaaagaagagcttatggtggaagactatggcgatgtggagattgaatatgaattagctcctgtgtctgctcagcttgcttatgtgcagcagctacaaggacaatctcaagaagctctgcaaacctatcttaatatgataaatgggcagtcagctgatccatcatcacttgctgtggcaacaacaaaccttatttcactaaaaggtacaaaagatactgcagatagcttgaagaagcttgatcggcttattggaacaactacagctccaaaccagttacatcttgttgaaaaccttgacttcaagttatcccctaggcagaaagaagctctttattctgcacgtgttcttctactgctccatgcaaataaaactgatcaggcacatgagttggtcagtggactgcttggtatgtttccagatagtgtattccctgttttacttcaagccgctgttcatgtgaaagaaaagaaggttcagaaagctgaagatgttcttagccagtatgctgagaagaatcctgagaattctaaagggcttctccttgcacttgctcagattgctgctaatgccaaccattttcagcttgctgctgactctctatgcagaatacctgacatccagcacatgcctgcaacagttgctacattagtggctcttaaagagcgcctaggtgactccaatgctgcagcttctgtacttgattctgctatccactggtggaagaattccatgaccgaggataacaaattagatatgttaacacgggaggctgcttcatttaagctcagtcatggacatgatgaagaggcttgtttgttgtacgaggaactcgtgaagagccatggaagtattgaagctttggctgggctagtgatgacttcagcacgcacaaacctggagaaggctgaacaatatgagaagaagctgaagccattgccaggcctcaaaggagttaatgttgagagcttggagaagacatctggtgcaaggcatgttgaagggccccaagatatgaaggttgatgttcctgaggaagtgaagaagcaaaaggcaaagaagaggaagcggaagcctagatacccgaaaggctttgatccagcaaacccagggccgccaccagatccagagagatggctaccaaggagagagcgatccagttaccgtccaaagaggaaggataagagggctcaggtcagaggtgctcaaggagctgtgtctagggagacagcagcaaccaatgccggtggttcctcaaaaggaagccaaaccaccagttcatccaagacaccagcggcaaatactgatcagccaaaaactagcaacaaatccaggaagaagaagtccaggtcttagatcagaattttaaagttataacacagtacaaaagaatatgttcgtttatcttcttgatgacttgcaattttgggctggatggcatgcagttgcagatttgctttgcttttacactaatgtttcaagcgactgagactattgaaatttttgctgagacgtgtttccattggttgccacagtagaattctatttttataagttaataaacctttg

SEQ ID NO: 13163 - DNA, 1343 bp, Sorghum bicolor
  Clone ID: SORBI-28MAY03-CLUS2034_1
cccacgcgtccgccaaacccccgcccgcgaatctaaagccgaaccaaccaacggggaggggaggggaagggcacggcggggggcatggagttcctgcacgggcagaggctggagaccacggtggccatcgcggtggccgtcgtcgccgtcgccgcgggggccgcctacctcttcctccgcagcaggaagaccaggggctgcctggaccctgagaacttcaaggagtttaaacttgttgagaagaggcaactgagtcataatgttgccaagttcaagtttgcgcttccaacacctacttctgctttgggtcttccaatcggacaacatataagctgcagaggacaggatgctgctggtgaggaagtgatcaagccttatactccaactactctggactctgatcttggatcctttgagcttgttataaagatgtatccccaaggaagaatgtctcatcatttccgtgagatgaaagttggtgattatatgtctgtgaagggacctaagggtcgtttcaagtacctacctggacaagtgagagcatttggaatgatagctggaggatcaggcattactccaatgttccaagtcacaagggcaattcttgagaacccaaaagacaatacgaaagtacacttaatctatgcaaatgtcacatatgatgatattcttctgaaggaagaacttgacagtatggccaaaaactatcctgatcgtttcaagatctactatgtcttgaatcagcctcccgaagtctgggacggtggtgtcgggttcgtctcaaaggaaatgatccaaactcattgtccagtgcccgctgccgacattcaggtattgcgatgtggccctcctcccatgaacaaagccatggctgcacacctggacgatctcggttacacgaaggagatgcagttccagttctaagcattctctctaccaataccaaaataagcggcgatgggacaggtttctttgcctctttgagactttgagtagacgaagcctgatcctgtcgccatatagctccaaacagacgaagtatgccgttcagagcatcgtacctggatgaaagcaggagtaccgcgagtacctacctaatctgtattggtgtcgggacattattgtaccatgccatttttcgtgtcgtcgcaatcgctgctccaatgaagacatgttatttttgttttctggcatcgccattttttttgcctcatatctgcaatgttaccagtggttacactgcaccctctccccccaacacaatcgtttgtcactccgagccggcacacggtgccaacttgcgtcattctgacgcgtcatacaaatacaaaaactgtgcatgt

SEQ ID NO: 13164 - DNA, 1505 bp, Sorghum bicolor
  Clone ID: SORBI-28MAY03-CLUS28492_1
gcacgcggcgctattccccctccctcctcccgcctcccgccaggaccaggagccggatccaccaccccatggaccccgcaagggagccacttgccggaggcggtggcctccaacgccgcgccgcggccgccgcgaggagcggaggggggccacaggagccgcctccacgcgggcagcgcgccaccatccacgccgacgtcgacccgccgccgcggccgtggccctggatgcagaagctggccatcgtcgccatcgtcgtgctcgggtgcctccacgtcctcccggccacgcacttccgggaccccaacgacccccagcgcaactggatccccattgacggctcggggaatccaacgggttctctaaactatgttggaagtgtagatgtcttctcttggataagctgtctggatcttcgcactcttgctgtgatgacaaattccactctttccagctcaagtgatccacaaaatatatctttccatttcttaatacctgaaggcggcaacgataaatcgtcctaccacaagctaaaagccttgctacctgattcagatctcactgttactagtcagaagcaaatcaaggacaagctaaatgttgccactccagaaggaaactttctttggttattccacatggaattgtcaccctttcttattgcaaaatctcagttgtccaaaaagagatatgtttatatcgctgcagactccatcataaagggtaaagtagaagatcttggtcgcatggatttaggcagttatgccatcggtgctgtcttagattgcagcaagcgtctcaatgattatatcagtatggatgttcttagtgccatacaaagagctggagctgcacaaagttgggtgtctaaagaaccttataacaaggatgcatgcctacttgattttgatgtgcttttgatagagcctcgcaagctggataaaaacctggttgcttccatcatgtggtggattaatgccattaatttagccaatcaaagggaccagattaggttggctgtaactctggccttcaatgataagtatatgaagctcccttcaaactggaagcgcaaagatggtgacactgatatcctcaactttgatggacccaagattgtttgttctgaagatggacgtcagcatgagcaatcaggctacggtgcaacctggcagcaatacctaaaccagaaatctgaagccatactgaacatctaaataacggcagttcagtgcacacaatttttccgttgtcatcaagtggaagctgacttgggacattgatattaacctgtaaaccctacatagaatgcatattgtactccaattactccatttccgcataacattcaggatactagaggaaattgtttttgcagctgacgccgaaaacttttcctcagggcatgtttagttcgtcaactattttggaatgatgaaatgtaaaatacaaaaaattttagagttatgtttaattccatccaaaatacataatttattgccctc

SEQ ID NO: 13165 - DNA, 1107 bp, Sorghum bicolor
  unsure (1)..(1107): unsure at all n locations
  Clone ID: SORBI-28MAY03-CLUS29031_1
gcacgaggctgatgctgagctccgcttgcttgaagtattttaccataagatttataagatctttccgcctcatgagaagatagagaacataaatgatcagtactggacattacgagctgaggagatcccagaggaagagaagaatctcggtccacatgatcgattgattcatgtttaccatttcatgaaagaccctaatcagaaccagcagattcagagtttcggagatccttttttgatggttatccgtgaaggtgagacttctgcagaggtaatggagcgcatccagagaaaactcagagttcctgatgaggagttctccaagtggaagcttgcattcatatccatgaaccggccagagtacctccaggacactgatgttgtatcagcacgttttcagaggagagatgtatacggtgcttgggaacaataccttggcttggagcacactgatacaacatcgaagaggtcttacacagccaatcagaatcggcacacctatgagaagcccgtgaaaatttataattgagaaaccttcatcacgcttcaatcgattgacaaaggcctcaacaacaagtacgcccaagatgatagggggcttggaacagaaaaaagctggtagaggagtatagttgctgtctgtgctgaggcctacaagcccatcaatgctgcgtcaaccttttagtgttgctgctgttgtctattggcaacggggtattcttttcggggcttttccgacttgcttccaagcaaccaagcatgtgtgttggttttttcatcgtgtctagtatgatggcccctgctaggataggtgtttgcttaatttgtagagcaaagctagtacataagaaaaatattttttagtagggggcatgtatacaggatcatagccgatactgattgctgaatttgcgcctcttgtagctgtgggaacaatggcagagattgtataatgggtttggtattggttccagttttccgtgctgttgacaaatgtaaggataactgcgcggatagtacagttttgagttccgacctaggttgtttgttggtatctgtagccatcttgtaagaaacnatcatccttgggtctaatattctgcctgc

SEQ ID NO: 13166 - DNA, 878 bp, Sorghum bicolor
  Clone ID: SORBI-28MAY03-CLUS29259_1
gcacgagggaaacttgctacagccatggttgcagacaaagaggtcccaacaaaatttcagcccccagatatgttggacaagcaaataggactcctcccaggtgttgtgtttgactccacacctcatggggtgaagtttggagatgtcagttcagatgttccagcaagctcaactttcagtaagggcagtattgtgaatgctacattctattcagcctgcccaaggaatgaccttctcacagatggtacattcgcacttgttgagaagctggagggtaccgacaactgggttcctgcctatgatgacgacgactggtcactacgcttcaagtggtcaagaccttcaaagttgagttcaagaagctttgcaacgctggaatggaccattcctgaagatgccccatcgggtgtttatagattgaggcattttggtgcctccaaaccactgattgggtccatcaaccattttacagggacctctcgggctttcgcagtgcgttaggtagtacaccattgcgttccgcggcacacctgtcagagaacctacaccgggtcatatttacattgcatacctgccagtgtatcgacatgttttccctatggtttttacatgtgctcgatattaataacgttgtccatctctcattctctctggtcatatcaaaccgctatcactacggtaatgtacatagctacagacaatatatgtgtgaaatgttaaacgggaaacctttggagttgcgggcgctccgaaatccccatttgccctgctaattgagtggcatgtcctagcgagttaggatatactgtaatgcctactctgtgtttgcattggtaacttctacttgtgggttatgatgagaccttcctagttcctag

SEQ ID NO: 13167 - DNA, 1139 bp, Sorghum bicolor
  Clone ID: SORBI-28MAY03-CLUS29588_1
gcacgagggttgacacatatgatgtcatgagaagtggagtgccaaacttctgtgctgttgctttggccctcaatgatatggggtataaggcagtcggaattaggttggactctggtgatttagcatacctgtccattgagacccgcaagttcttccgtgcaattgaaaaagaatttggagttgttggttttgagaaaacaagaatcacagcaagcaatgaccttaatgaagaaactatagatgccctgaacaagcagggccatgaggtagatgcatttggtattggcaccaacctagttacatgctatgcacaagctgcacttggttgtgtattcaaattagttgagattaacaaacagcctcgcattaagctttctgaagatgtctcaaaggtatcgataccatgtaagaaaaaatgctacagattgtatggcaaagaaggatatccattggttgatataatgactggagaagatgagccaggtccaaagattggtgaaaggctcctgtgtcggcaccctttcaatgaatcaaagagagcatatgttgttccgcagcatgttgaggaattattgaggtgctactggcctggaacttcatcgaatccacgggaggtgcttccatccatccatgagattaggactcggtgtattcaccatctggaccgaatgagaccagaccatatgaggcggctgaacccaacaccttacaaggtaagcgtgagtactaagctgtatgacttcatccatttcctgtggctcaacgaagcacctgttggagaactgcaatgaagaaatgaggtggcggtagggtcagagcccaaacctaactctaataacctgctcctctcatatgggaggtcctaataaactgttgccgtcggacaaatttctgatcctaataataaactgttgccgtcggtgcaattcctgcgtttgttttaccatcgatgtgcttcggtaaaatgtgaggatgtgttggtggtgtatctgtgaaaaccgaagccgaagcgttacgtactgggaatcaagaggatacccataccatactgagttgtatgactctttaaatgtgatgaggagcaatcacagaatttgagacaaaattacttttgtgttgaaatatcaaagcaaattccc

SEQ ID NO: 13168 - DNA, 1008 bp, Sorghum bicolor
  Clone ID: SORBI-28MAY03-CLUS23368_1
gcacgaggctcttccttcctcctcgacgacgacgaagaaacactccaagaaaccaagaacaccacacacacacccaccgacacacggcaggcgagaacgaacagacaaggaaacaataatggcttcgtcgctcgcgtcgacgccggtgttccccagctgcggcgcgcggcgcggcgcccggtgcgtggcgcgcgcgtccgcgtccgcggtggcggtggcgtctccgtcggcggcgaggacgcactacgaggtgctcggggtcggggccggcgccagcaggtgcgagatcaaggcggcgtaccggcgcctggcgagggaggtgcacccggacgccggcggccgcggcgacgaagggttcatccgcctgcacgacgcgtacgccacgctcgcggaccccgacgagcgcgcgcgctacgaccgcgccgtggccgtcgccgcgccggtccggagcggcagctgggccgcgccgtcagggtccgggtcggggttccggccgcggaggtgggagaccgaccagtgctggtagtagcagcatagcaccatcgccacgtagctgtgcggcgctccacgcctgcacgcgtccctccgctcgagcgcggcggccggtggagtcgccggacgccggagcgcggctcgatggtctggtccccgggcccggggccagctcagctgcgaccgacggggatcgtattgaagatgggccgcatggaaaatggaacggatcgcgatcctggcggcccacatgagctggatcgtggacgttatgggccggaggctccgtgggccttggcgccactggcgatgaggatgccgcggcctgcgggccgagagagcaggggtcgcgtggacgcctctctttcttcgtgtccatcttgccatcatagctgcacgaagagaggcatttttaacatctcttgtgtactactagtacttgctaaaatgctgctagtgattgctatgcttgtaaaatacgtgcaattctatgtgaattatggacggatattgtct

SEQ ID NO: 13169 - DNA, 563 bp, Sorghum bicolor
  Clone ID: SORBI-28MAY03-CLUS2242_2
gccggccgggccgggaaaccctaactctcttcacgccgccgctgacctgccccctcgccccgacgccggtgactaggagcaggagcaagagagattcgggatggccaagtcgaagaaccacacggcgcataaccagtcgtacaaggcgcacaagaacggcatcaagaagcccaagcgccaccgccagacctccaccaaggggatggacccgaagtttctgaggaacttgaggtactcaaggaagggcaacaagaagagtggtgaggctgaggcagaggagtaagatgggtggtggctgagtttgtggcgacaaatgcatctcttgtatcgctagagttttagttgtgaacttatttctcacttctgtatgatcaaaggagacctacagttggtacaatagtgtttttttcgatcttgttgcctatctggaattaattaaaaccatcagttgtccttttgcgaattgggcacttgatgtgttaaataaaaaaaaaaaaaatctgtcttcaccaatttacctgtagatttcttgcctcgaaaaaaaaaaaaaaaaaaggccccta

SEQ ID NO: 13170 - DNA, 516 bp, Sorghum bicolor
  Clone ID: SORBI-28MAY03-CLUS2242_1
gccggccgggttcggccttcccggcggggctcgtaaagcaaaccctaactctcctcacgccgccgctgacctgccccgacgccggtgaataggagcaggagcaagagggattcgggatggccaagtcaaagaaccacacggcgcataaccagtcgtacaaggcgcacaagaacggcatcaagaagcccaagcgccaccgccagacctccaccaaggggatggaccctaagtttctgaggaacttgaggtactcaaggaagggcaacaagaagagtggtgaggctgaggcagaggagtaaaatgagtggtggctgagtttgtggcgacaaatgcatctcttgtatcgctagggttttagttgtgaacttaattctcacttctgtatgatcgaaggagataccatcaattggtaccaaagtgatttttttttgtcttgtcgcctatctggaatttaattaaaaccatcagttgtccttttgcgaaaaaaaaaaaaaaaaaagaccctaaaggccccta

SEQ ID NO: 13171 - DNA, 1711 bp, Sorghum bicolor
  Clone ID: SORBI-28MAY03-CLUS24_1
gcgcgacccactgccccaacctctccccacctccctccaccctgtcagtttcccgtcgtcgtcgccgccaccgccgccgcctctcctcctagtcctagtcccgcagcctcctccgtggggagctcccccctaccatacccgcagccattggaatttccgctccatgcgtggatcctcgtagatccccacccgcgtgcactcgaatcccgaggcggcggcggtctccgtcgcgaggctaggccagcgggccgcacccatggcgtccgtggcggagctcaaggagaagcacgccgccgcgacggcgtcggtcaactccctgcgcgagcgcctccgccagcgccgggagacgctcctcgacacggacgtggcgaggtactccaagtcgcaggggaggctgccggtgagcttcaacccgacggatctggtctgctgccgcacgctgcagggccatagcggaaaggtatattctctggattggacccctgaaaagaattggatagtcagtgcctctcaagatggaaggttaattgtgtggaatgcattgacaagccagaaaacgcatgccataaagctgcattgcccatgggtgatgacgtgtgcttttgcacccaatggacaatctgttgcctgtggtggtcttgatagcgcgtgctctattttcaatctcaactctcaagcagacagagatgggaacatgccagtatcaagaattcttactggacacaagggctatgtttcgtcatgccaatatgtcccagatcaggaaactcgccttattactagctccggtgatcagacatgtgttctttgggatgttactactggacagaggatctcaatatttggaggtgaatttccatcaggccatacagctgatgttcaaagtgtgtccatcaactcatcaaatacgaatatgtttgtctctggctcatgtgatacaactgtgaggctgtgggatatcagaattgcaagtcgagctgttcgaacctaccatggacatgagggcgacgttaacagtgtgaagttttttcctgatggccataggtttggtactggctcagatgatggcacatgtagattatttgatatgagaacagggcaccaacttcaggtgtacagtagggtgcctgatagaaatgatgatgaactacctactgttacatctattgcattttcgatatcaggaaggctactttttgctggttactccaatggtgactgttatgtgtgggacacacttcttgccgaggtggtacttaatttggggaatctgcaaaactcccatgatggtcgtataagttgccttgggatgtcatctgatgggagtgcattgtgtacagggagttgggacaaaaatttgaagatttgggccttcagtggacaccggaaaatagtttgaaggacaacttttctcccccatgttgtatgttccttgtcatgccttaacaatggacaatggtgatcagtgatcgactcagacttgttcctgggaatccccttcttgtttttgtagtatagaatcttgtgcactacgccctatgtttaatggaaaaaagtgcaatttgtcttggcgctacatcttgttgagttagtaactgtttatactgttattacaagaatatcagtaacgtgtgatctgccctttctttgtacaaccattttacttttcagatttagataagtagcatgtatattctggaatcagtttatc

SEQ ID NO: 13172 - DNA, 864 bp, Sorghum bicolor
  Clone ID: SORBI-28MAY03-CLUS24542_1
agctcacaaatgctgtcagggttggggaccttgaactgttcagggccgtcgcagacaaatttgcaagcacattcagcgcagacaggactcgcaacttgattgtgaggctgcgccacaatgtcattcgaactggactgcgcaacatcagcatttcttactcaaggatctcccttgctgacattgctaagaagctcagattagactctgagaaccctattgctgacgcggagagcattgtagccaaggccataagagatggcgcaattgacgccaccatagatcatgcaaatggctggatggtttcaaaggaaactggtgatgtctactcgacaaatgagccacaaattgcattcaactccaggattgcgttctgcctcaacatgcacaatgaggcggtcaaggcgatgaggttcccccctaattctcacaaggaaaaggagagtgctgagaagcgccgagagaggcttcagcaggaggaagaactggctaagcacatggctgaggaggatgacgatgacttctaaattagctgcctttttgagcaaccacttgcaatgcaagtggagttgttcgatttgtgaacgcctggttcaaagcaattcccctgcctctagccactcgagtcatgcaaacactgaagtttgaaattcatcttctgtaatgttatgttgatcaggattttgtattaattccatacttgagttttagtctccctgatgaattgttgaaccagggaatttacccgccatgccagatacggatttgtttatttcatgagttctccgctcccggcttttctgaaatgctgtattttgtgttcattgttttcttgtattaatttaatgaactattattggttaaagt

SEQ ID NO: 13173 - DNA, 1940 bp, Sorghum bicolor
  Clone ID: SORBI-28MAY03-CLUS24554_1
gcacgagggtgatgcgaccgccggcgccggaggagctgcggagggggctgccagtggaaggccgcggtacaagatggaggagctcgtccccgggggtcgcgtggggcgcgaggccttccaggcgtttctggggtacatgtacaccggcaagctccggccgtcaccggtcgacgtggtttcttgtgctgacccagtgtgcccgcacgattcgtgcccgccggccatcaggtccgctgtcgagctcatgtacgcggcgtgtaccttcaagatcccccacctcgcctcgctcttccagcggcgtcttcttaactttgtagacaagacccttgtggaggatgtcattcctattttgaaagttgcttcccactcagggctgactcaagtgatcgacaaatgtattcaaaggattgctagatcagatcttgacgatatatctttggataaggagctccctccagaagctgttgaggagagaaaaaatttgcgcaagaagtcacaaactgctgatggcgatggcgatgcattcatttcggaccctgtgcatgagaaaagagtcagaagaatccacagggcactcgactctgatgatgttgagcttgtgaagttgcttcttaatgagtctgatagcacattagatgacgccaatgcattacactatgctgcttcttactgtgataataaagttgtctcagagctattagatttggcgctggctaacttaaatttgaagaatagccgtggatacacagcactccacttggctgctatgaggagagaaccagctatcattatgtgtctccttaacaaaggggcaaatgtatcacaactgacagctgatggcaggagcgcaattggtatttgtcggaggttaacaagattaaaagactacaatacaaagatggagcagggtcaagaatcaaataaagataggctgtgtatagatattctagagagggagatgatgcgaaatcctatggcggtggaagatgctgtcacctcacctttattggcagatgatcttcacatgaagcttctctacctggaaaacagagttgcatttgctagattgttctttcctgctgaagccaaggtcgctatgcaaattgcacaagcagacaccacagaagaattcggcggtatagttgcagcaagtacttctggtaaactgagggaggtcgaccttaatgagacgccagtcacacaaaacaaaagactccgttcaagggtagatgcactgatgaaaacagtggagctgggccgtcggtacttcccgaactgctcgcaggtgctggacaaattcctggaggacgacctgccggacgggcttgaccagttctacctccagaggggcactgctgacgagcagaaggtgaagaggatgcgcttctgtgagctgaaggaggacgtgctgaaggcttttagcaaggacaaggcggacagcagcatgctctcgggcctgtcttcgtcctcgtcgtgctcgccaccccagaaatcggccaagaggtgatcaacggactagtttttgccgtatactagttcgtaatcacggtcttggagacttgaatccggacagcatatagggacatgtacacctatgtatgtatagtgcttacaaatggtgtaagtagaagtgtagaactacatatatggaaagaaacatggcaagaacaccgtgcaaaaagatgaaaagatggccggagtgctctatgcgagtatgcacctgattcatcggccctgttcaacggtagcgaggaggctcattgccctgtgagcatgccactgaggttgttgaggctgttttgcgcagaaaacaagtggcaagctagaaaggaaaatgaggtcgttgaggatgtgcatggatctgatgtactgtggtatgtagtccttaacaatcttcgatcttaatatatatatatataagcttacttaggtttgttgtt

SEQ ID NO: 13174 - DNA, 904 bp, Sorghum bicolor
  Clone ID: SORBI-28MAY03-CLUS24778_1
cagcccatacataggtgcccaactcgttcccagcgaagaaccggacgaacgagcagcaagaggccgcctcctcaagcttcgaatcctttcttccctccccctcctctcctcccctttccagtcccccaccccagcgaagcttccgaaccccccccctcggcaagcttcgaatccatccagccacgccaggcctcccaccgtgccctcctccctcccctgtccccccacgcgcctcgcgacggcaaaaccccagcgaattccccacgcgccggcctccaatcccgccagcagcccggtggcggtggcggcggcccaggaaccaagcatggacaagtacgagctgctcaaggacatcggctccggcaacttcggggtggcgcgcctcacgcgcaacaaggacaccaaggagctcgtcgccatgaagtacatccccagggggctcaagattgacgagaatgtggcgagggagatcataaaccaccgctcgctgcggcaccccaacatcatccgattcaaggaggtcgtgctcacgcccacgcacctcgccatcgtcatggagtacgccgccggcggcgagctcttcgaccggatctgcagcgccgggaggttcagcgaggacgaggcaaggtatttcttccagcagctcatctgcggtgtcagttattgccacttcatgcaaatttgtcaccgggacttgaagctggagaacacgctgttggatggcagcccggcgccgcgcctaaagatctgcgactttggctactctaagtcatcgctgctgcactcaaagcctaaatccacggttggaactcccgcttacattgctccggaggtgctctctcgccgggaatacgacggcaagatggcagacgtttggtcttgtggagtgactctttacgtgatg

SEQ ID NO: 13175 - DNA, 1827 bp, Sorghum bicolor
  Clone ID: SORBI-28MAY03-CLUS2376_1
ccggccttgtttttttttttttaacagacgcagggctgcttccttcaaacctctcaacgatactagtatttacataggtcagtttgttcgcaatcccttctcaagatcatacacgaagaaggaaaacgaaatcgcactacatggatggccaccaatacaaacaaaaatccacggtgagccgccatggccgcatggctggcggcagggagggaggtcctaactactctacagacagacaaagaacggcgtgggcgctctgcccggcccgtgtgtctagactcgaggctctcttctaccagcactggtccgtctcccatgtgcggcggggccggccgtagacgccgccgccgctccacgggcgctgcgccacggccacagcgccgcggtcgtagcgtccgcgggtgtccgcgtgggcacgaggcgaatctggcgtgagatccgcccgactctcgctccgttccggcgctctcggccgggtaaggttccaccttccaccgacgacatggcggggaagggagccaaggccacggccgccaagtcgtcggacaaggacaaggggaagaaggccggcggccccgtctcgcgctcctcccgcgccgcacctcaggagaaggagaagtcagctccgaagaaagatgtttatcaattgttcgctgagaaggttagggataacaaacaactggaatcgagatgggcaatcatgcaagaaacccgtgtggagtattttcgtggaaaagatttcaataccttcatcaagaatcatccagaagtcagggaaattttggggccagataaggatttagaagtggaagacattgtcaacactttgctgaccaagaaccttgtgataaggtgtgatcgagttatgaaaactgtgaggcctggcaagaaaaaactatcatcatggcctgctcatttggagatacataatgaacaagtcttcactgaaaatgatggtttttttgcttggatgtttctgaaaaggcggaccttgtggcagacaattctttcatttgtttggcctctttttgcactggcagtctgcctatttccagtttacccgtaccaatgcaagattgttgtactgtattcatgtgctggagctctactgttcatcgtctccattcttttgctaagagctgctatctttggcatattatgggttctccttgggaaacgcgtgtggttcttccccaacataaatgcagaggagacaacatttagagaacttgttcgtttttggcctgaaaaggatgaaggggagcggccaaagtggacatcaagacttttctatgctcttgttgctctattggtgatattactgcttaggcaccatgctcctgacgaagctgctagagccaggtaccaaaagaaggtttcaaacataattgatgatgttcttgaatggtctccgaagttagctatttctggaatgattgaaaaacacaccggggctaacattacagaagaaagcaattacaccagcagggctgcgagtagtcatgtgcctccttccaccgaaggcaaagcttcagaaggtggcccagatatggatgttgatggggataatggggctaacttagatgaaacccaagataatgaatatgctgatgatacaagatcaagcgaagcttagaatcagccttatattgtagtattttttgagtaatctttgttattgttaatctgcagaattatatagatatagcttactgctgacaacaaaaaattagggtgtcatgttttgatgttacatccatatattgcctgcaatgttccaaaagaatattctcatagagcaggggcaaatcatcactgtttctcttc

SEQ ID NO: 13176 - DNA, 1144 bp, Sorghum bicolor
  Clone ID: SORBI-28MAY03-CLUS33179_1
gcacgaggcccatcgcgttgccggatcgagcttggctctctcgaaccttgcttcgccgcacggcaccaaaagcacggccgcgcccgcgccctcatcccctccacacgtttccgcctcccgatccacagccgccgtaggccgccgccgacacagctcctacccatcgcaactctccagccctcggaggcccgaggctcatcaacccgcgctccttcatcctcggcacctcacccggcggcgcgggcgcgcagtgcccaccgagagccgcgcggcacagccgctcttgttgtcctccgtgggtgcggttcgacgcgtcggcaggatggcggcgagcgcgcgggatagcgcggatgcggcggagcgagttgtcgatgaccacgacggttgggtgtcggacggcgagatggacgtggagatggatgtggaaggcgagttccaagacctcgacgccgaccggagggacggcggcgcggatggtgatgatgagtacttgctgctcactaggataagggacacgtcggcagctgaagcaagggcaggaaaggatatacaaggtataccatgggagaggatacacatagccaggcaagattaccgaaaagctaggttggaacagtataagaactatgaaaatttccctcaatcaggagagctcatggataagttgtgcaagcaagtggagaagagcagcaagtattatgagtttcagcacaacacacgatcagtgaagccatcaattctccattttcagctttgggctatgggcaacctcgaagcatgatgtctatttcatgtcaaattctacagtaagccactggtcagcattgtctcacaaattatcagaggttctcgacttctctgggcacgttgctccagcggagaagcatcctggcagtttactagaaggtttctctggggttcaagttagcacacttgctgtgaatgagggtttgttggtagctggtggttttcaaggagaactaattggcaaggatttggaaggccgtaatgtaaaattctgtgcaaggacaactttgagtgacaatgctataacaaacgccatagatatacacagatcgacaagtggaagcttgcgcattacagtatctaacaacgattgtggtgttcgtgaatatgatatgga

SEQ ID NO: 13177 - DNA, 960 bp, Sorghum bicolor
  unsure (1)..(960): unsure at all n locations
  Clone ID: SORBI-28MAY03-CLUS33315_1
gcacgacggcgacgggccctttcgcttcgcccgcggcatattcccccccgaaccaaaccaaacacaacacccagatcagcgaaacacactccgctccgctctcccgaaaccggacggacgcatggcggcggcggcggtgacgtccaacggcggcgcggtggcggcgaacggcgggccggcgcccggccggctggcctccgtgtacagcgaggtgcagacgaaccggctcctgcacgcgctgccgctcccctccgtcctccgctccaacttctccgtcgtcgacggccccgccagctccgccgcgggcaaccccgatgagatcgccaagctcttccccaacctcttcggccagccctcggcgtcgctggtgccggcggccgagcccgccgcgaccaggccgctcaaggtcggtgtcgtgctctccggtggacaggcgccgggcggccacaatgtcatctgcggcatctttgattacctgcaggagcgtgcaaaaggcagcaccatgtatggattcaagggaggcccagctggggttatgaagtgcaagtatgtggagctcactgcagactttgtgtatccctacagaaaccagggcggatttgatatgatctgcagtggaagggacaagattgaaacaccggagcagttcaagcaagctgaagacacagccaacaagcttgatttggatggtcttgttgtcattggtggtgatgattcaaacaccaatgcctgcctccttggtgaatactttaggtcaaggaatttgaaaacccgtgttattggttgcccaaagactattgatggagacctgaaatgtaaggaggttccaacaagctttgggtttgatactgcttgcaagatatactctgacatgattggcaatgttatgactgatgcgagatcaacagganaatactatcactttgtgaggcttatgggtcgtgctgcttctcacattac

SEQ ID NO: 13178 - DNA, 920 bp, Sorghum bicolor
  Clone ID: SORBI-28MAY03-CLUS33509_1
ccgcccgttccacttccaaggcctcacttcgccaccgtgcgcgggaagagagcggacgccaatcaaggcctcaaaccgtgtgcggccatggcgtccgtgctgctcgtggcctcggcgacggcgctcctggcgctggcggcggcctggctctgggactacgccgtggtgcgcctcctgtggcggccccgcgccgtggccggcatgttcggggcgcagcggggccgcggaccgcccggcagcttccgcaggcgcccccgccgtgaggtggggagggtcaaagcgccggccgacgcggctcgacttccgcgccgccacctctcccacctccgcagggccttgctccattacctggccgcaacgcaacggtgcgcccggccttttctggattggttcactccccagccccggccccctctcctcggagtcgggtcggcaggttcggttttactagtcaggccagtccttcaagatcgatgcgcacccgactatcctggcattgctcggcaaagggctggttttggtggaaggcaccgactgggtacggcaccggagggtagtcaacccagctttcgctatggacaagctcaagacgatgaagacgacgatggtcagctgtgctgagccattgatcaaggagtgggaacgactggcatccagcaatgaaagcagggaagtggaagtggaattcagcaaactgtttcaggacttgacggcagacattatatcacatactggttttggaagcagttataagcagggcaaagaggttttccatacgcagaggcagctcctggcactcgccgtggcaactctcctcaacgtgcaactaccaggactcaagtatcttcctactaaaaacaacagactgaagtggatgctagataagaagattaagacgatgctcatggcaatcatacagc

SEQ ID NO: 13179 - DNA, 878 bp, Sorghum bicolor
  Clone ID: SORBI-28MAY03-CLUS25758_1
gcacgagggacgtggaggtcaattcctgcggaaagtcgtgcttgcgtggaactaactagcacacaacacttcgcttcctaaaccctagcaatggcggcggcgaacctgctctcgcgctcccttctcccgaccccaaacccaacccaaacgagccacccgaaccgccggagccccgccgtcgtctcattcccccgccgccatggccgcctgtccgtgcgcgcctccgtctccacggcctccccgtccccaccgccacagcccgcggcggcggcggctgccggcgtgccgaagcactgcttccggcgcggcgccgacggctacctgtactgcgagggagtgcgggtggaggacgcgatggcggctgccgagcgcagccccttctatctctacagcaagcctcagatcctccgcaacttcgccgcctaccgcgacgctctccaggggctccgctccatcgtcgggtatgccgtgaaggccaacaacaacctccccgtgctacgcgtcctgcgtgagcttggctgcggcgccgtcctcgtcagcggcaacgagctccgactcgctctccaggcgggattcgaccctgccaggtgtatatttaacggaaatgggaagacattcgaagatcttaaattagctgctgagagtggagtatttgtaaatgtggatagcgaatttgatttggaaaatattgtcagagctgcaagggctaccggaaagaaagtgcctgttttgcttagaataaatccagatgtggatccgcaggtacatccgtatgttgccacgggaaataaaacgtccaagtttgggatccgcaatgagaaattgcaatggtttttggactctatcaagtcatacccagatgaaatcaaactcgttgg

SEQ ID NO: 13180 - DNA, 707 bp, Sorghum bicolor
  Clone ID: SORBI-28MAY03-CLUS26550_1
ttcttttactgcaaaagaacaaacaggaaccaaacaagctgacgatggcaagaagcctcaggaggcaggtgcttcctcgtctgctcatgctgaagatgagaaaaaggctgatagaggactctctcttatgggttctgccataaggccaggcatcgctccaaatgtcaaattcggagggtctggatcatatccggatcttccctgggtttctaccaacggtgctggaccaaatggcagaaccatatcaggtgtgacatacaagtttggtagaaacgaggtaaagatagtatgtgcctgccatggcactcacatgtctccggaggagttcatgcggcatgcaagtgcagatgctcctgcccaagaaaatagtgcaactctaccggcattccctgtcggtaaccaagcaacgtctgcagaaaattaatttagcggttcacagagaatgcttgactaataatccttacccctcttctgtctatatcagccattcactgtaatactcagtgtttatctcatattgatttttatcatgcaagtttagattctttgtattttgagctttgtttggggacaaaagttgtgtatttttagtgctatgtaacacatggactgccaatgctatggttggattttgatttatagacgatgtgcccactgggcagtgaaagtattgaagagggaaaaaaagataaacagagacttgtctc

SEQ ID NO: 13181 - DNA, 988 bp, Sorghum bicolor
  Clone ID: SORBI-28MAY03-CLUS2687_1
cgtccggaaatggtttcagggagtaccaaccgaaaggcttgaaccctcctaatggcaaccaatttggatttacggtgggccctttacaggaccagatgttgcaccaacagaaggtccatgcaccaccatactcgtcaccattcatggggttccacaatcaccccttggcagttccaacaaatgggtacttgccatatcctcagcctggtcacttctaccctggccctatggcccctgttggatatggagtcactggcaaccagtgtgttgacttcccaatgcagtacagcaataacatccatccttacactggccctgaatttggttttctgccttcacaaccagttcacaagaccccagtgagcttccatgccgtgccagtgccaccactgaccccgctgtgtagaagcggagtgccagtggtgataaatcaagagaggcagcagagccctgccctctttcctaaactaaaacaggcagtgtcggtccctgagaccagctgtgcagaagacaacaccgtcaaacataaaggtgatgacacagacagcacacccttctccttgttccagttcaacctgccgattgccgctccctccctggcaacatccaaagaagagcaaagtggagcgatgccttcaacggcaccggcaccagctcagatagctcgagcccagccgtgctcgagggaggagaccaacgtcaaggagtacaacattttctccgggtgtaacggggtgatgtttcagctcaactagagatgaagaaaagtgagcagctattcaatatacagtgatacatggtgagtgatttgtattctcgtaaaaacagaataaagtagatcgaggtttttactgtgttgccctcgaatatttatttccttttttccctcattttgatttgttttgctttccctctccccgtttttgtgtgtatgaaaaactgaaaagatagtgagtggtatagattctgcagttttgacacaagagtc

SEQ ID NO: 13182 - DNA, 1163 bp, Sorghum bicolor
  Clone ID: SORBI-28MAY03-CLUS2697_1
atcctcatcgcaaaatgcaggcgctcctactccccgcgcgggccgcgccgccggcgatgcttcggcagcgtgcggtttccgggtccgcttgtgcgtcgcaggtctgccgcaccctactcagcgcctccggttgcctcagctgtggggtccacggaagcgctcgacggcacctcacagtggcggtggcggcggcctcgtcctcatcctcgccctcgtcgggaccgctctacccgacgcctccacccaccgagcaggaggtggagcgggtcaagctcgagcaggttatgaagagactagagaaaacagcaaggtatttcaagaatttgggtagctttgggttctggtcccagttggtgtgcacaattgtttctgctgggattttggcattctctacagttgtaacggggaaggtgacagcaccctttacattctatgcaactgctgctggtattgctgctgcttttatctcagtcttctggtcatttggttacatccgtctctctgaaaggcttagaagaacatcaaaagaacctgctaaggctcctccacgcgctgatgttgttaagagcctgaaaaatggcattgtgcttaatattctcgggatgggtgccgctgttctcggcatgcaagctactgttggtgctttggtagcaaaagctctcaccacctctgcagtaccctattatgctgctgctcctggccaaagccctgtcttggctttagatgttttcctagttcaggcttcagcgaacaccatcctgtcgcatttccttgggctggcgagcaccctggagctgctgcgctcggtgtcactgcctccagcggaagctgccccggcccctacccctgcacgggcctgagccatcatggcccgtggcaggtcaagaaagaaccctcatcccttcggctctactagacacttgctgttctttgattgtatgtacatcttgcatcaatcttactgaagcttagtgcttacagacacatcgcatgccttccagttcagctggaaaccaacatgttcgcgtaatccccgccgtgtgtgcgtgtgtgagctcttgcatgagcacttgtatgtgccgcatgtttgctgttgctgtgagtgttgtgactactggctcgctcgttcgttcctaattattgtacccgcttcttcgctggtt

SEQ ID NO: 13183 - DNA, 2031 bp, Sorghum bicolor
  Clone ID: SORBI-28MAY03-CLUS2706_1
gaaacatgctctgctatgctagaagctccgcgttccggtcggtgaacgccactgccgccgcgagctcagctcacctccgacggcacagaacgaagccactgccgcacccgaggcaaccgcgtcgacccaccccacccagacgacacctcctcagcaccaacacgccgggactaccagggccgcgcgcgcctcgcgcccccgatccaaatccaaacggtgcaggcggaccagcagcggcgcgcacgggcggccaccgcgcctaattggcgctgcggccgccaccacgcctgaaaacacatgcgatcgtgggacctccgatcccgtcccatgtcaccgccggcctgcccgtgccttcccaagttcctagcaccacaggcggcgcacaggtgacgacggagcggcagcagtaaccggcaggcgaattcgaagtccagccgcgccgcggggcgaactcgctctcatgtgcaggcgtggcgtggcgtgcagcgccggccccaaccgcggccggccgtcgcgccgccgaggctacgaccgttcggggccctccctgcctccgcgcggaagctctacttcctgcccctccctcaagactgaaccccgtcgcctctcgggtcaccttcgccagtcgccacgccgtcccgcccggaccgccgtggcgctctgctccgatctaccaaatccatggctcggcaccgaggacgcggacgcataacaatcatgccatccgccagcgccttgtctcgccgtcggatcgccagatgggagatacggaaccaaacaaggaccaagaacgggatggaacagcacatatgctgctgagtgctgactactggaagaagcaccatctctagcctgtcttctgctaatccatgcaaggttcccctaacaagcaattttgtgctgagaggcccaacaggtaccagtggcacatacgtcgtgggaatgaagagttgaaccaagatgagaagtggtagcgtgctggatcctcccctcttttttttttggaagaaggcaggaacgttgcctcgaacaattaaggaggagcgttccccccctcttgagctgtatccaatatatatatctctctcgcacatcttccctgggattccgtgctcctcttgcagtcctcagaacgcagctcccgcagccagcccccagagcgccgccaggcacagggatctgaagtatggcaccgtctcaacttccggagctggagctgtcccctactgctatcttcacccgctgcaaggtgtgtggaggttgtgaagagaaggacaagaggttcctggtctgcagccactctgagtgcttttacaagtactaccacgttcgttgcctgactaaagagcagattgcaagtgatgtgcagatgggcagccagctctggtactgtccatcttgcctctgccgtgtctgcctgtgtgacacggacgatgataagatcatcctgtgtgactgctgcgatcaggcctatcacctctactgcctcagtcctcctaaaacaaaggtgcctacgaagtattgggactgcgacccctgcaagaagcggaaggaaaaggagaagaggatattgatgctccacaggaaggattacgacggtgacattctcaagagtaccgagatcgatggcctggacttgctgcttaatgctgcggaaaactcgacgggtgataaggagacggaggtggctacgaccaccggaaagtaagaggcatggaggttgtgagcaagcggattttgttgtcctctgccgtgagtccagctagcgcgaagtttctgccctgggaggctcagctctgcccagctgaatgggacgagcggctgagggcagtagaaacttgtgctttctgaactgaatggttagagaatatgaatccgctacaattgctccaatctatttctttatttaccatttctttcacctcagcaaggtcatacttgacaaacttgccagcgtctctgaacttgagaagattgtgattacccgtgaggttttaatggtttattatggaactggaacttggtagactt

SEQ ID NO: 13184 - DNA, 1108 bp, Sorghum bicolor
  Clone ID: SORBI-28MAY03-CLUS283_1
gtggaagttggaggggttgaaccaggaccattatttagcgaacggataatgaccggcagcacgaggctcacctccggcatctctgcctcaccatcggcagcggccagcactgctcgccaccgccatgacggagcgccgcagcagctgagggtgaaggcggcggtgcggccacagcagcagcaacagctgctgcacggtggccgccggcatacaaggggcagcgcggtggtggtgagggccggtcctgggccgctgtcggagatcgagccggacctggaggaggacgccatcgacgtgtatcgcaccaacggcatcgccccggaggacttcgtgttcggaaagtacgatggacatcacacctatttcgaaacccaagacaagaagggcttctgggaggatgtctccgagtggtaccaagaagctgagcctcctcagggctttcaagcactcatctcctgggcatttcctcctgcaatcatctttggcatggctttcaatgtgccgggggagtacctgtacatcggggcagctgtcttcatcgtggtgttctgcatcttcgagatgcgcaagccggacaagccgcacaacttcgagccggagatctacatgatggagaggacggctcgcgacaagctcatcgccgactacaactccatggacatctgggacttcaacgagaagtacggcgagctctgggacttcaccgttaaccccagggacgacatcgtcaaatcaacctagatatatatgactctgtcttcagattgttctctcagcaaaagcctgtcagggaaaagaaaccgtagctgctaggaaatgctcttgatgaactaaataaaggaataacaacaacaatgtgtgcctcaagttctcagcagtcatccctgtaaaggaaaactggagagcctgaaatctttgtagccatatatgatgcatgcatgtcaggcttctcataaaaaaaaaaaaaaaaaaaaaaagaggccgccctctgttgctccaacttcctgcatgttttttttttcatgtttctccaatacattgagaaaacacaagcaagactgatgcactgaacattaagatccgttggtctgccaccaaaaaaaaaaaa

SEQ ID NO: 13185 - DNA, 1192 bp, Sorghum bicolor
  Clone ID: SORBI-28MAY03-CLUS39594_1
gcgcccgcccgcgcccgccggccccgcccccacccctccgcatccgcgagtcgggagtcgcggctggagcacggcggcggcgaaccgagcgcccgcggcccctctcggcggcgtcgcccactacgtcctccagcgccctcggtcgtccgccggtacacgtcgtccacctcaagctgcccagagactccagattccccgtcctgctcctcgccataccctaggtggctacgtcgccactgtccggggcgtccgttttaggttggattttctgaatggccagccgtggggatgcggatggcgtcacctcctccatgggggagctgagcgtagaagcagcgccttcatcaatcgaggctgaagtcccccagcatgctaatggtggtgatgttgctgctgccgagctcgatgatgtatgggaagatgtttcagattctcctcggcatgcaaataccttagacagagaatggatccacaggcagaaccagtttcagaagatgggctatcgggatggtataacagaagggcagaaggactctgctcaggaaggcttcaatgttgggttcaggcaatctgtaaacgttggctacaagtggggtcttgttcgcggggttgctagtgcactagctagccttcctgacagcttgaaagaaaaactggtgccggatgttcagcatagagggaaattacaggatctgcacaactccgtgcacgaaatatcagctgatgatgctcttcagatgttccatgagagtctttgccaaagtaatcgtccttcagagggatcaggatcacatgtaacgtcaacctcaaatggagctacagaatcaaataggatggaaagcctatcaaaggatcttgtgttgttgttgcacgaatgctcagatattaaggtaagtgaagagttggcatgagattcatgaacagggtggccaggaatttctaccattacggattttccaattctggcagaatcgcgttgaattcctagattactgaacatatacggatgaaactgggctatactaggtgaatgtgatccgggaaatttattttgaaaggagctgatactcaaaaggctcaaacctctgagacctagaatgtaaccgtggatcctgttattccatatttcccttttgctgctgtaacctgtaactagaattgtaactgttactcctataaatttgcagttctt

SEQ ID NO: 13186 - DNA, 716 bp, Sorghum bicolor
  Clone ID: SORBI-28MAY03-CLUS3981_1
ccgggaattgtcgaatagtcatccagtgcggcgctcgcggccgccccgggccggcaatcgcattcgacctccggatcggcgaccaccgcgccccgacgacgaggaggtaacaagagacgagcggagcaagcaacggggtcaaagccaaggaggccgatccatcctccagcatcccatcccatcccacgatatggtttgcgtcgcgtgcctgctgccgctcttcttgatcccgctggtcaacgccctcccttacctcgtcgacctcatcatcagcaaggtgtatcggctatttggatgggagtacaggagacctgaaagagccccaccagcttgtccttacaagcctgcagctcagaagaacgatgagggtgcgagtgaatcaaaacccctagtcaatccacatggtgctgcggcagaagataagaaagaggaataattcatgtattggatcctgctcgtgtcagcaggcgcttaattaaaatggagaccactgctctatatgcggacatatcgtaactaagaaataattgctgtgattgatgaatatgtatctggattgacgagtcgatgaatgtatatgtacctgtaatgccactccggatccttaccagttgcgcgactaatcactgctggcctgtctgaatcgatggagttgaattcgcagttgcaaatagctaagctgaattttgttgtgcaaaaaaaaaaaaaaaaaaaaa

SEQ ID NO: 13187 - DNA, 943 bp, Sorghum bicolor
  Clone ID: SORBI-28MAY03-CLUS40595_1
agcggcaccagtatatggtgatgtgatcgccgcggcccgcgttctactccagctccagtacaccacaccgtacacgcaactgcggcgtaccggggcagcacggcaatggacgccaacacccttctcctgccctgctccgacggcgccgtcgccggcgcggtggacttccgcgggcggcccgcgtcccggtccggcaccggccgatggtccgccgcgatgttcgtcctcggggtggagatagcggagaggttcgcgtaccacggggtgtcggcgaacctgatcagctacctgacggggccgctgggggagtcgaccgcgggcgcggcggccgcgatcaacgcgtggagcggggtggcgaccatgctgcccttgctcatggcgtgcgtggccgacgcctggctcgggcgctaccgcaccatcgtcctcgcctccctcctcttcgtcgtgagcatgggcatgctgaccgtctcggcgctcccggcgttccaccacgacggctgcagcagctacgcctccagctcgctggcctgctccccgtcccccgcgcaagtgggcgtcttctacgtctcgctgtacctggtggcgctcgccgaggccgggcacaagccctgcgcgcaggcgttcggcgcggaccagttcgaccagaacgaccccaaggagtccgtgtccaggagctccttcttcaactggtggtacttcggcatgtgctccggcaccgccgtcgcgaccatggtgtgcagctacgtccaggacaacgacggctggggcctcggcttcggcatcgcccgtgcctcgacatggtcttcgcgctcctcatgttcctgctcggcaccaggaattaccgctactacacgtccaccgaatcgagcccctttgctcgcctcacccgagctttcatcgcgctcatcaaaggctccaaatcgagccaatctgacggcactct

SEQ ID NO: 13188 - DNA, 1285 bp, Sorghum bicolor
  Clone ID: SORBI-28MAY03-CLUS3864_1
gcacgaggcctttttgccctttcttctgcccctggtcatcccgcgcatttatctctttcgcagtaccacgccgcagcaggaggcgtctggcttgggaagggcaacactagcctatattacagttgcttcttttctccttggagcattatgttctggactagctggctttgttggaatgtgggtgtctgtacgtgcaaatgtacgagtttcaagtgctgctcggcgctctgcgagggaagcattacacgtccgcccacgcgtccgcccacgcgtccgtggttatacttctccttctccaacgattggaaaagtgtgagggaaatcacagatgttctggatgctgtgggcaacacaactaaagctactacaaaaggatttgccatagggtcagcagcactggcttccttcctcctgttcagtgcatacatggatgaagtagcttcttttgctcaattgccattcaaggaggttgacatagcagtcccagagatcttcgttggtggtttattaggctcaatgcttatattcctgttcagtgcatgggcttgctcagcagttggcaaaactgcacaggaagttgttaatgaggtcaggagacaatttattgagaggcctggtattatggactacaaagagaagcctgattatggacgctgtgttgcaattgtggcatctgcatcgttgagagaaatgataaaacctggggctttagcaatcatatcacccatggctgttggggttgtcttccggattttgggccactacactgctcagcctcttcttggagctaaagttgtagcctccatgcttatgtttgcaacagttgctgggattctcatggcactcttcttgaacactgctggtggcgcctgggataatgcaaagaagtacattgagactggcgctcttggtggcaaaggcagcgagtcccataaggctgcagttactggtgacacggttggagacccattcaaagacaccgcgggtccatcgctgcacgttcttatcaagatgcttgccacaatcacattggtcatggctccgatattcttgtgattaaccaaccactcaatcaagctttgccattaaccctgcggagatgtatctatgcgacttatagatgaggtgttcacctgcttgtgatgtaatgatccactcggttttagtatcaatcactacatgttgtacccagagaaagaagcagcgatttatacccgtgtttcacggtagatataattatactgatgatggaaatgccatattttgtgacgaacattactgaact

SEQ ID NO: 13189 - DNA, 553 bp, Sorghum bicolor
  Clone ID: LIB3480-052-P1-K1-G1
agaaaatagaggagctgtctgctctgcttgctgaagccatgacaaagaagcttccttcctcctgttcagtgcatacatggatgaagtagcttcttttgctcaattgccattcaaggaggttgacatagcagtcccagagatcttcgttggtggtttattaggctcaatgcttatattcctgttcagtgcatgggcttgctcagcagttggcaaaactgcacaggaagttgttaatgaggtcaggagacaatttattgagaggcctggtattatggactacaaagagaagcctgattatggacgctgtgttgcaattgtggcatctgcatcgttgagagaaatgataaaacctggggctttagcaatcatatcacccatggctgttggggttgtcttccggattttgggccactacactgctcaaccttttcttggagctaaagttgtagcctccatgcttatgtttgcaacagttgctgggattctcatggcactcttcttgaacactgctggtggcgcctgggataatgcaaagaagtacattgagactggc

SEQ ID NO: 13190 - DNA, 1209 bp, Sorghum bicolor
  Clone ID: SORBI-28MAY03-CLUS31325_1
gcacgaggcgaaggtttccttgatgtctttgatcccaatgcatctgggaccccttctggaatatttagctcccgccctgaggtgtctgactttgaatgtgttccagtgtcagtgatggagcgtgtgattgagttcctgaatgatgtgagggcggacttgagacaggctgtagcaaaggatacagtgacaatcaagaatgaggatcttgctgtgggcgagcatcgcaacttggagaagagtgacaagagtgggtccgaggtggtaaaaactggtcaggatgtattggatttccagaagaagataacgccccatagggactctgagcaagcattgaacttgaacgccagaggtcattcaggcattggtgatgaaagcatttcaagaatagtatcagagatggaggaagatgaccaagttttcaacctagcactagaagcaagactgcatgctgcggaaacaatcaaacaaagccggcaagaactgatcgtggtggcatcattggtcgaccgcataccaaatcttgcagggctgacgagaacgtgtgaggtcttcagagcagctggtctggttgtcgctgacaagagcgttcttcaggacaagcagttccggcttatcagtgtcaccgcagagaaatggttgcccgtgacggaggtcccagttgacagcgtgaaggcgtacctggagaggaagcggggcgaggggtactcggtgatcgggctggagcagacagcccacagcaggcctctggatgggttcgtgttcccggaccggacggtgctggtgctggggcgggagaaggaaggcatcccagtggacatcatccacatcctggacgcgtgcgtggagatcccgcagctgggcgtggtgaggtcgctcaacgtccatgtcagtggtgccatagccgtctgggagtacacgcgccaactacgcaatcagcgttactcctagcttgtagcttctttttttttgttccattgatcattgtcagaactagtactgtttgggttgcgaccattcatttgtcattcccccgtcagtcaactcttttttaagtagattcatttcatttgtcaccccctctcttttaagtaggaattctctctttgggagagtaggagagtagagttccacacacacaagaccctggatgggcccaccttccctcccaccaagattgactgaacatacatacaaacatgccctaatttt

SEQ ID NO: 13191 - DNA, 1141 bp, Sorghum bicolor
  Clone ID: SORBI-28MAY03-CLUS3137_1
accaggcttggagccgtcgagtcgaaggttctgggccacgccgccacaaaaggggaaggaacaaggccttcttcgcccccgatgcctccgctgctcacctcacccgcctccgcctcctcccctctcctcctcgcctcccgcgtcggcgctctccaccaccgcgccgccgcctcggtccacttcctcgcgccgcgcaggaagacccgcccgagcccgaccccgggccccgcgatgagctggcttgggaagctgggcctgagcgggctgggcggcagcccgcgcgcgtcggaggcgtcggcggcgctggcgcaggggcccgacgaggaccagcccgcgcccgggaacgagttcgcgcagtcgtccgccggctgcttctggggcgtggagctcgcgttccagcgcgtgccgggagtcacgcgcaccgaggtcggctacagccagggcaacctccacgagccgacctacgaggacgtctgcaccggcgccacgaaccacaacgaggtcgtccgcgtgcagtacgaccccgccgcctgcaagttcgacgacctcctcgacaccttctgggcgcgccacgaccccaccacgcccaaccgacagggcaatgatgttggaacccagtataggtcagggatctacttctacaccccggagcaagagaaggcggcaagagaatccctggagaagcagcagaagcttctgaaccggacaatcgtcactgagattctaccggcgaagaggttctatagagcagaagagtaccatcagcagtacctggagaagggtggccgcttcggcttcaggcagtctgcatccaagggctgcaatgaccccatccgttgctacggatgatccaaatggacctctacgtgcatggtgtgaatcgtgcctgaataagggatgcatcaaagccagattttatactgctttcctagatttgtttggccactattgaacggctgcaagagtttagctatataacatggtactccaatcatcgtgtacaaaaccaggcttgggaacctaatatagtccatgcaagtgcgagtgagatttaagcttaaaccgattcttgttgaattgtaccagctttaagagcaaaaccgatgggaagtttggagtgatagtactagtatatttctgg

SEQ ID NO: 13192 - DNA, 962 bp, Sorghum bicolor
  Clone ID: SORBI-28MAY03-CLUS32864_1
gcacgagggcagagcggaccactcctcccctccctcgtggcctcgtgtccgtcggagcctccgcctccgcctcggcttgtccccaccaatccacagctcgctcgctctctcccaccaaaccccccacacgcgcacaatggcgtcggcgtccaaggaggaggtgatcgggaagctcaacgtccgcgtggtgcggggcaacaacctggccatcgccgacccgctcacccacaccagcgacccctacgtcgtcctccagtacggcgcccagaaggtgaagactagtgtccagaagaagaatcccaatccagtatggaacgaagtactgcagctatcagtgacaaatcctacaaagccaattcaccttgaagtttttgatgaagacaagttcacggcagatgacaccatgggtgttgctgagatcaacattactgacatctatgatgcagcaaagctggatctgaagcatgccactgatgggactaggatcaagacaatctacccagtcggtgtaaactaccttggtggtggcacgagggttcagtggaaggatggcaaggtgatccaggacttgattctgaagctgaagaaggtcgagagtggcctgattgtggtgcagctggagtgggttcatgttcctggtgtgaagctgtgaggcctatctgaatttgcggtcgttgctttgatggagctgcagttgtagttggtcgtccctggtttgagtgttttgttgtaaactatatcctgaacgtggtgatttgcagtgtatgagtgatgtttgagtgttggtttaagtgtgatgttcatttaaggtacttcgtggtgacatgatatgggtgtgactgttaaaaggttgtggcgcaccaataagaaacgccctgtcaacacaagtggagtgagatgtaaattaagaacttagaacttaaatatagaagtgattgggcgttaatgctttcatttgttcc

SEQ ID NO: 13193 - DNA, 746 bp, Sorghum bicolor
  Clone ID: SORBI-28MAY03-CLUS33226_1
agcacgagggaacaaccagcgcacgcagcacttccactccagcacacacacacacacaccatctcaatctcatcgaatcgatcctcgtccaccgacaatggcggcgtacatgcgggtgacgcaccgggacgaggaaggcaagaaggtgacggagaagatgccggtgccagagacgcggcggccggacacggcgaagcacttcgagcggaagctggaggagcaggggctccaccgcttcgagcggcacccggcgaacgcgccccgcggcgtgggtatcggcacgccgccgcccaagtctgggcgcggcggcaagttcacctgggaaggacccggtggcgtcgtcgacggccagctcgacccggccccgcccgccatcgacgccaatgatcccaactacgtcgcgccggaggaggaggaggaggaggtggctagggaggtggtcgtcggcgaggtggaggtggctaaggtcgctgagagcagggttggtgttgccagagtcgacgtcgcgccggccctgctccaggaccagaaccagtagtcgctttttttttcctctctttttcctgttgttttctggaagtgtctcgactcggtgtgtgttttgagtttgttgggtgcagatcgtgcaacaccgtaaactctgctttaattaatgtatgtatgtactgatcagtaataaaccagtgtaatagcaagtgtgattatctttgcatcgccatcatcggattagcttgccccaatttgcc

SEQ ID NO: 13194 - DNA, 776 bp, Sorghum bicolor
  Clone ID: SORBI-28MAY03-CLUS33251_1
tactgggcattgccgcctccttctcacccgcctcacgaaaaggcaggcaaggcaaggccaacccgtcccctccctcctccgttgcttcagttcgtccgttccattccatcccatcccctcatctaatcctctgcttcctcgaccccggcctgcaaatctccagccgcagcggtgcctgagcatctccgcccgaaggaggaaattttagcgagattgagagatccggaggatgccttctagggccatgaaccggctgttcgtcgagtccgcctccggcagcggcggctgccgggacgccgagccggtgctctgcgcgcctcgcccgcgcagggtccaggtccacccatgcagcgccgatctcatccttggcccgccgcccttcctgctcaacaagagcagcaaggaaggaggcaggaccaagcctgcggaggtgagggaggaggaggacgcgggttgctgggcggtgttcggcgggtcgccgccggcgcgcgcggacaacccgctggtgcacgacccccacttcctgctcaaccagcagcgccaccccgcggcggacccgacgccgctggagctcgggttttttgaccaccggagccgcaccagctacgtccaccgcccgacgtatagcagcagcagcagcagtaataacagtaacaacagcagttttgccccgtcgtcgttcgcgccggccgtgaggatccaggggttcgacgtcgccgcgtgccggagctcccacagcaacggtggcagccgcgtgctgtccgcccgcgcctgag

SEQ ID NO: 13195 - DNA, 741 bp, Sorghum bicolor
  Clone ID: SORBI-28MAY03-CLUS3331_1
gcacgaggggccaacgccactcactctagactctaccccgccgtgtgcacaagcagcagcacagctcgcggtcgcgggcctgccgtgccgagcgaccaccaagcggccagcgaggctctccgcttgcgctgcagcacgaggccgagacaggctccgtggcgcacgcgtgcacgcaatgacgatgcccttgctgctcacgccgggcgctcgggcggcgccctcgccgtcaacgctgtcgcgcctactccttccgctccacctacaaattactaatggccggcacaaccaccggcacggtcacgtctccgcttcccccctcctctaccctcgcctccgcaaccgccgcggccgattcttcgcgtcctcctcctcctcgtcccagatggcggcgcctgccgacgcccccggtggttcttcggacgcgtttgaggtgatccgcgttcaccaggcaaaagctgctcgtctttctccagttgaagaaatacggaccattctggaccgaagtgtcagaggcgttcttgctacccattctcaggatcatgctggttatccatctagttcaatggttgattttgcatgtgatcaagatggttcccccatattagcagtgagtagtttagcagttcattcaaagaatctctccggaaatcctaaatgctcacttcttgtcgccaaagaccctgaggacagaacggatactgtaatcactgtatatggtgatgctgttcctgtttctgacga

SEQ ID NO: 13196 - DNA, 1644 bp, Sorghum bicolor
  Clone ID: SORBI-28MAY03-CLUS46113_1
gccgctgttgccctgtttgttcttggacctctctgtttcagttcttcgtgctgccattttcgtcaaggctagctgctgctgcttcttcttcttcttttctcgcgcagccgatcaccattgaacagccgcagcgcggttcgccggtttgttcttggacctctctgtttcagttcttcgtgctgccattttcgtcaaggctagcttcttcttcttcttcttcttcttttctcgcgcagccgatccgtcggagaagaagatgacgatcaccattgaacagcctcagctcgatgcggtggcggagaggaaggtccccgccggcggcgaccccgcggagctggtgctggacgccggcttcgtcgtgccggacgccaacgccttcggcgatacattcaggaactacgacgcggagtcggagcggaagcagacggtggaggagttctaccgcgtgaaccacacgaggcagacgcacgagttcgtgtcgcggatgcgggccgagtacgggcggctggacaagacggagatgggcatctgggactgcatcgagctgctcaacgagttcatcgacgacagcgacccggacctggacatgccccagatcgagcacctcctccagaccgccgaggccatccgcaaggactaccccgaccaggactggctccacctcaccggactcatccacgacctgggcaaggtgctgctgcacccaagctttggggagctccctcagtgggctgtcgttggtgacacattccccgtcggctgcgcatacgacgagagcaacgtccacttcaagtacttcaaggagaaccctgactaccacaaccccaagctcaacaccaagtttggggtctactccgagggctgtggcctcgacaacgtgctcatgtcatggggccatgacgactacatgtacctggtggccaaggagaacaagagcacccttccttccgcggggctgttcatcatcagataccactcattctaccctctgcacaagcatggagcctacatgcacctgatgaacgaagaggacaaggagaacctcaagtggctgcatgtgttcaacaagtatgacctgtacagcaagagcaacgtcaggatcgacgtggagaaggtgaagccctactacatgtccctaatcgacaagtacttcccgggcaagctaagatggtgaaaagggcggtctggacctggaggccggccggagggaaccccccaagaactgtccctaagagtccatgtaccataatagggtactactgtacagtgtacccattttgtatcgtgcagatcagaagctccatgcatgccatgcaaattcgaataaaacttgcctgcgtttgttcaaaaaaagtctacgggaaaagctaataagtgggcgtcgtttcgttctagtacttcccaaacttgtggtgtgtgtgaaagtgcctgctggctgctcttcaatactggtcctaatagtctaataatagtagagaaactgcaaagagtactggtaatggggctctccaaatccagaaccgggatctgtcaaagtttgtggttgttgctttgggcctctttgatgggcctgaatctgatcctaagaaaggcccttgatccagccaacgatttatggacatcattcaatattatattttttcc

SEQ ID NO: 13197 - DNA, 1411 bp, Sorghum bicolor
  unsure (1)..(1411): unsure at all n locations
  Clone ID: SORBI-28MAY03-CLUS46427_1
gccgggacgggagcatacagttcgccgcacgtccgcacctccgccattctgaagcagtcaagctccgctgcggccgccgtccggacctgatggccaccgcgacgcaccacgccgatgccccgggcctgaacggggccgagggcgtggagatggcggagaccaacaacgagctccgccggcggggcaagcccagcggcgacgaccgcgcggcccgcgacgggcctggcgcggaggaagaagacgcggcggcggcgccgtcgtccgtggagcgcgcgttcgcggaccagcccgtgccgtcgtggcgggagcagctgacggtgcgcgccttcgtcgtcagcgccgtcctgcccgtcctgttcagcttcatcgtgatgacgctccacctcaccacgggcatcatcccgtccctcaacatctccgcggggctcctgggcttcttcttcgtccgcctctggaccagagccatcgagagcctgggcttgctcatgcagcccttcacgcgccaggagaacaccgtcatccagacctgcgtcgtcgcctcctacggcctcgccttcagcgggggctttggtagctacctatttgccatgagtgataaaattgctgccatggtaactgaggcaaataatgctcaaaatataaaggatccacagcttggatggataattggcttcctgttcctggtcagcttcatcggactcttcggtcttgtgccactgagaaagattatgatcgttgactacaagctgacttatcccagtggcactgccacagcctacctcataaatggctttcatacaccccagggtgccaggcttgcacggaagcaagtaaagaaactgggcacattctttgtccttagctttgtttggggtttcttccagtggttctatactgctaattcagatgaatgcggattccaacaatttccatcactaggcttgcaagcttacaacaacaagttttactttgatttctctcctacgtatgttggggtgggaatgatttgctcacatattgtcaacgtatctattctcctgggagcaatcctctcatggggaataatgtggccgctcatagccaagaagaagggaatttggttttctgctgatctcgatgacactagtcttcatggaatgcaaggttaccgggtcttcatagccattgccttgattctcggggatggtctatacaacttcctgaagatattcattctcaccgtggtctccttaagatctcaaatcaaaaaagctaatgttagcacacttcctatctctgatgatggcacagttaccaacagcacacctatctcatatgatgaagagcggcgcaacgaactctttctcanagatcanattccttggtacgctgcacttggaggctatgttgccattgctgctatatctatcgg

SEQ ID NO: 13198 - DNA, 1884 bp, Sorghum bicolor
  Clone ID: SORBI-28MAY03-CLUS46642_1
acatcaggaagctcatgatggaggacatgccaatggtttcatccaaggtagaagggcctaaccccaggaggatcgacggcttcctgtacaggtacaaaaaaggcgaggatgtgaggatagtatgcgtctcccatggtagcttcctcactcctgcaaagtttgttaagcacgctggcggcggtaatgtgtcgaatccgcttcggcaaatagttgtcaaccctgctccattttcatgaacagggggttacagggttaaactgctgctggtatctactgtgctgtaacatgtaggctccctgtttcggggagttcaacggaaggtttttgtatttgtccttccttccgtgcccctgccgcctcatctcccccacgattgcgattgccccggggttggccattgcatgcctcgctcgcgtctccttcgccgcccgcggatcccgccgcgcttctaggagctttcgtccgcgtgccggggctcccgacatcggacttgctgtgttcccccccgattcgtcggtcgggtcgtcgttgctcgccgccatggattcttcttaatcaaatcaattctctcttccccccaccccaagctttcgtccttgcttgggagcagcctcctgcaaggctgtgttagttaccgtgtggggggcacggaggccgaggccggcccatggcgtccagagacttcctgcgcgtcttcggcgaggggtccgggtccgggtcgccgaaggccgccaacgccggcgccggaggccagtccgacgacgtcgagctcagcctcggcctctccctgggcggccgcttcggcaccgacgccgccgccaagcgcccgcgcctcgcgcgctcctcctccatcgcctccgtctgctccgtctcctccctccacggcgagggagacgccgacgccgacccgtccccggccgcgccgctgccgctgctgcgcaccacctcgctgcccaccgagaccgaggaggagcgctggcgccgacgcgagatgcagagccgccgccgcctcgaggcgcgccggaagcgcgtcgagcggcgcaactcctccatggcctccctggtccccgccggacccaagcccgccgctgcagccgcggacgcgaacgcgaacgccgccgtcggcagcgggaggaggtccaacgcctcgcaggggagcaactctgtaagcaccaccgagcaaggtattggtggaagcgcaattaaccagtccacagatgctaggagtccatcaacctctgataacacaaatcaaaatagcatgcttcctccaaccaaagcggctgagaagccactaaatggcactcccacagagcagcctcgcctgcggacgcttgggtccctcacaacacgtacgagcagtaccagtgacatcaggaagctcatgatggaggacatgccaatggtctcatccaaggtagaagggcctaacaccaggaggatcgacggcttcctgtacaggtacaagaaaggcgaggatgtgaggatagtatgcgtctgccatggtagcttcctcactcctgcagagtttgttaagcacgctggcggcggtgatgtgtcgaatccgcttcggcatatagtcgtcaaccctgctccattctcatgaacagggggttacagggttaaactgctgctggtatctactgtgctgtaacatgtaggctccctgtttcggggagttcaacggaaggtctctgtattttacataaattgagtgtgacagcaaattcaagagaaatgtcatctgcaaatgttataggcttgtctacaaattgacaaggattcagttgctgcaataggtgggtcgtagtctggcaccctggaggacatgcaggcttacaacacgagcctgttctttaacattaaatcgctcaaattcacttt

SEQ ID NO: 13199 - DNA, 1162 bp, Sorghum bicolor
  Clone ID: SORBI-28MAY03-CLUS341_1
gcacgaggcaccaggccatccccccgtatacccatttccttgttcggtcggaacgcggcggcggcggcggcggcgagagggagagagaggggagagtcggcaggccccgagggaggaggcagcggcgggccggacaatatgagcggcaacggcgcgaagaaggtggtggatgtggccgtgaaggccgccaaggcgatcgattgggacggcatggccaagatgctcgtctccgacgaggcgcgcaaggagttcgccacgctccgccgcacctttgaggacgtcaaccaccagctccagaccaagttctcccaggaaccccaaccgattgattgggagtactacagaaaaggaattggatcaaaagtggtggatatgtacaaagaggcttatgaaagcatcgagatcccgaagtacgtcgacacagttactcccgagtacaagccgaagtttgatgctctggttgttgaattgaaggaggctgagaaagcgtctctgaaggagtcagaaaggatagagaaggaaattgctgaactcaaggaaatgaagaaaaagatcagtacaatgacagcagatgagtactttgagaagcaccctgaactcaagaagaagtttgacgatgaaatccgtaatgattactggggatattgaagagattggagagaactcttatcttgccatttccatgtctgtgaagaaccaataatttttctgtgccccgatatgtataggggaaatctgcaatctcaaattggtggtttccatagcatgtgcacggggtttgggtggaatgcctacagaatcgactgtgtcaagctttcttgaaattccatcgaaacatgttttgtttgatctcatcattttgaagaggatccctgcttttgtcatacaaagattatgatatgatcttagcccctttctacttgaataagaggttttctgcagacccttttcctctactggccttctgtgacgcattggtctgaatccttgtaaatgttcgagtgcaagtgtggcacttatcctaccttactattagaaagttgaaactgccgtcttggacatcaacagtcttcaaaacataatgtttatggattgaaatgttgatgtatgtacttgtgaaggaagaacctactattctttgttgaacttaaggcatgatgat

SEQ ID NO: 13200 - DNA, 1442 bp, Sorghum bicolor
  Clone ID: SORBI-28MAY03-CLUS3433_1
gccggccgggttgcaacacaacatgatatcttagggcaattctcacccacccatcccctcaaaattcgcagcgtgtccctccctccctccgtccctgcgctcgtcctccccctctcttcctcgcgttcctccaccccgggcgcaaaccctaaccctaccgtcgctcgccccgcggcgcctgcgaatggcgcgccccgtgtgagtgtgtgagagagggggaggagacctagagcccgctacccgggggaggagagagagggagggagagcgaagcgatgtataagcaggggggagcggggggaggggctgggctggaccggaagcggatcagcgacgcgctagacaagcacctcgagaaggcggtcgcgtcgccgtccacgtcgagggggtcggcgggcggcggcggcgggcgcgaccaccaccgcctcgttgtgccgtcctccgtctcgaccatcctcaagggccactgctccgaaggggagtctgattctgatagtgaagcatcagatgttagcggctctgacggagaagacacctcatggatttcatggtactgcaaccttagggggaatgagttcttctgtgaagtcgacgatgattatattcaagacgacttcaacctttgtggcctcagcagccaagttccttattatgattatgctctcgatctcattttagatatcgagtcatctcatggtgatatgttcaccgaggaacagaatgagcttgtagaatcagctgcagagatgctttatgggctgatccatgcacgatacattcttaccagtaaaggactggctgcaatgctggagaagtataagaactatgactttgggcggtgcccacgtgtttactgctgcggtcaaccatgcctgccagttggacaatcagatatccatcgatctagtaccgtgaagatatactgccccaagtgtgaagacatctactacccacggtccaagtaccaaggcaacatcgacggcgcatactttgggacaacgttccctcatctgttcctgatgacatacgagcacctcaagccacagaagccctcgcagcgctatgttcctcgtgtctttggcttcaagctccacaagccatgagcctcatgtatttggcttttaagcaccacaaccacaagacgtggcacactgggggggaaagactggagttttgcaaggtcaaggtccttgaagactacatataagagtgccattggcagatcagcagattggtgaaattctatcatgctgcagcgcgcatgtaacttagctggctggcaagcgtatccagcatttgaatgtagctctaaggatatcaatgttgttgtaacctaactgcaattgttctttgattagtaaaccaggaccccctacaatgtagaatatgggcattatttagggctttgcagaaaattgttatgctgtcctcgcaaccctttt

SEQ ID NO: 13201 - DNA, 756 bp, Sorghum bicolor
  Clone ID: SORBI-28MAY03-CLUS33670_1
tataaacaacggagaagaggacccttctcccgaaaaccctcgaaccatcatgtcgctctccacactgagccacccggccgccgccgccgccgccgccaccgggagcggaaaatcccatttccggactgccccggcggcgcagtccgtacgtttccccaaggcacgcccccctgtccccgcagccgtctccgccgcttccgcggctgtccacgcggatcccgcggaggatagggtttcgtcgctgagccaagtctccggcgtgctggggtcgcagtggggcgacgagggaaagggcaagctcgtcgatgtgctcgccccccgcttcgacatagttgcgcgttgccaggggggagcaaatgctggacatacaatctacaacgcagaaggcaagaaatttgcccttcatcttgttccatctggtattctccatgaagggacactttgtgttgttggcaatggagcagtgatccatgttccagggttctttggagaaattgatggtcttgagtccaatggagtccgctgtgatggaagaatactggtatccgaccgggcacatctgctatttgatctgcaccaggttgtggatggacttagggaagctgagcttgagaattcatttattgggacaactaagagaggcattggtccttgttactccagcaaggtaactcgaaatggactgcgggtttgtgatctaaggcacatggacacttttggggataagcttgatgtcttgttcaaagatgctgcttc

SEQ ID NO: 13202 - DNA, 924 bp, Sorghum bicolor
  Clone ID: SORBI-28MAY03-CLUS34687_1
gcacgaggtaaggttactcagaagagtgtgccgttcttgggcaaccttggccagtctcttgagggcctcaaccttcagttctgcaacatgattggcaaccacaacattgcatcgctggagaagcagctctggtggtgtgatatccttgcataggcagacaagatggtccattgctggaaagggctcgtgtctactgggagccacttccagatgcagatatacaaccgtagcagtagcacaaccagatgatcttcaggtttttggctcgcaagcgagtcatgatggtgggcttccgcattgttcaaggaccagttgttttagggggtgctttctagccaactgctcgtttttcacagatcacctctcagggggtttatctgttttttgagccttggctgccatcactggcatcttgcccctcgatccagacactggtccttgcctttatagtcataaggttttttaggttgccatagtgtccaagtcctttttcgttttactgcttcctggttatgaagttgcaggctttggcaatccattggcagctctggactatcacaattctaactcaaccaccagaggctggtgtaggacatcgtttccagggctgctgatgctggagcgtctgtggacttgtgcagtgtgtttggttgttgagttttgagtttgttttgagtcttgatgtgttgtgtgtgatgttctccatggtgtgtaagggtcatgtagggtcgcatcttttttacagtctctttgggatgcctggtgttcatggtgatcttggccattgcgaggcgcatactagaagccttgccttgacaaccttttatggttgtttttttgccagatcccaatttttacaggtagattgttgagtgctgtaagcttggtgaccctctatgaataaatgaaatatgtgtttatgtg

SEQ ID NO: 13203 - DNA, 1020 bp, Sorghum bicolor
  Clone ID: SORBI-28MAY03-CLUS36279_1
gcacgagggttttctcccttcgatagctaatttcgccgtcacccgtcaggccgacgcggcggaaggagaggagggaggggaaaagtaagagagatggtggaggcatcgccggagcccgtcgccgcggcgggcggaggtgcctctggtacggcggcgccgcggaaggggaagtcgtgcaagggatgcctctactactcatcagtgctcaagtcccgcggctacaacccaatctgcgttgggatcccccgctccatcccccaagttcctaactacgtggtggatgagcctaaggaggaggcgacggcgcaggggcatgatctcaggcggttcaggtacgggtgcgcgggttactccatgttcgtggacaacagggacggccagggtggtgagagcgagggcaagacgttgttgccatattgcaggggcctcgagttattggtggacagcagattggttgagagaaaaccatcaacagctgaacaagctccagcacatgttgcaaaggacgcagctaccacccgctctcaccaacaaggacagcagagacctgccaacttgtcaaggcaggaattcttggaaaggtttaagaggagcgctggactggtcgcttcaggtgtcgcaaagaatctaaacaaaacagcccattatatcaaggaaaatattcaggacatattgtaccctgatcgtcgcccaccaaagtagtagccgtgccttgcgatcatctatgctcaggttgagagctgaatgtatggcttactgctggaaaaccttacataatcttatagtccctgtaagaagcagctccagtttcgtcactgattaaaaaaatggagcctttctgggataccaactttctttgctttacttgcctaatcttgtaatttacggctgcatatgtacatgcaaattacttgctgcttgtttgaagcgaaaatcagatttcatttggtgtattgatgaataatgtccataagtcccagtgcatttcaaagtgaaagaattttcattctccctgttgct

SEQ ID NO: 13204 - DNA, 758 bp, Sorghum bicolor
  Clone ID: SORBI-28MAY03-CLUS38299_1
gcccgacggcttcccggttttcgtccccacctgccttccccattctctcccgtgactcatccatccagtccagtccacccgccactccacgcaggaggaaggggaacggcggcggcggcggaggagtgacggcagcggggcaagatggcgaggaagccgctggactacgaggagctgaacgagaacgtcaagaaggtgcagtacgcggtgcgcggggagctctacctccgcgcctccgagctccagaaggagggcaagaagatcatcttcaccaacgtcggcaacccgcatgctctcggccagaaaccgctcaccttcgggcgccaggtggtggcgctgtgccaggctccgttcctcctcgatgatccccacgtcggcctcatgttcccggcggatgccatcgctagggccaagcactacctcgccatggctaagggcggtctaggtgcgtacagtgattcccgtggtatccctggaattaggaaggaagttgctgacttcatctacaagcgtgatggatatccgactgatccagaactcatttacctgacagacggtgccagcaaaggtgtgatgcaaatactgaacaccatcatcagaaacgagagggatgggatcttggtccctgttcctcaatacccactttattctgcttccattgccctatatggtggtgctctggtcccgtactacttggaagaagaggctaactggagccttgactttgtaaatatccgaaaaacagtggcagaggcacg

SEQ ID NO: 13205 - DNA, 648 bp, Sorghum bicolor
  Clone ID: SORBI-28MAY03-CLUS3470_1
agtaagaatgcgactcgctagcatccacccggctctcccccgcctccgcccccgcgggggaccgataaaccctaggccccgccgccgtcggaggcggcgccgcaggaggacacgcgatgtcgcacttcgggaggtcgggtccgccggacatccgcgacaccttctcgctgctcgtcctcaacatcagcttccgcaccacggccgacgacctctacccgctcttcgagcgctacggcaaggtcgtcgacgtcttcatcccgagggaccggaggaccggggactcgaggggtttcgcgttcgtgcggtacaagtatgccgacgaggcgcagaaggctatagatcggctcgatggccgtaatgtggatggaaggaacatcatgctgcagtttgcaaagtaacgccccaatgctgagctgatcaaaaaaggaagggtcgatgaagggcaatggaaataacgagctacattcaaccgctatccaaggttgctagttgttcctttaatggattcttgtgtttttgagttgtcaaaaatctgctcttggtttgtattccgacctctattgtgtttttatgcccttgtactgcatcatctactttatatgcatcagtttcttgataccatcatattaatttgttaaaacatttgtg

SEQ ID NO: 13206 - DNA, 400 bp, Sorghum bicolor
  Clone ID: LIB3480-030-P1-K1-F3
gagacagggactatcgtcgtcggagcagaagtagaagccgaagtccaagttcaagccctgaccgcaaaagtcatcgtagagcaagagatgatggcaagcgcaagagcaggagtaagagtagaagcaagagcaggagcaggagcaggagcaggagcaagagtatgagcagaagcaggagtagaagccgctcgtaccatagtgcttcacctgcccggcgtagtgctagccctcacaagagcccaccgccacggaggagccccactcctgaaaagcataccaatgggaaagattcacctctgtcacgcagtgtttctccatcaccaaagcgtgcaagctcccacagcccaggcagcgatggcaaggaatgaagcttgttgatctgttgatgcctaaagaacac

SEQ ID NO: 13207 - DNA, 1232 bp, Sorghum bicolor
  Clone ID: SORBI-28MAY03-CLUS5226_1
gcacgaggggaccaccaagaggtggtatgggctgtgaccagaggcagggccctgcacccgatgcttcgtaccagggtggtggtgactactacaagcagggctctcagccatatgatagccagccaccaagctaccctcctgggccagggaattacaacagttatgggcaatcccagggtcctaactatggccaacctcagtatccgcaacaggcgcctcaacagaactacagccatgggtatggtgatcctagatacaatgctccccctccgaaccagcagtactatggtcagccaccaatgggcccgcagcaaggctatcctcaacagccagatccctatgctaggcctccatacagtggacctggacaatggccgcccaggggtgctccagccactgatggctcctaccaggcgccacctgcatcttatgggccgccgtctcagcagcctcctgcttatgggcaaacatacagtgcagcaactggacctgatgggtatgcgcaacagggttacccacagcagggtgggccggcaccagctccatatggtcagagtgcaccagcagctccaggctatcctcagcaaggcacacagcaaggtagctatgcacagtacccgcagacccaaccagcatatggtgatcaatcagctcaagctaatgcaaactatgggtaccagggagctccagcagatcctaactatggaagtgcgtactcacagccaggatatggtcctcctggtcaggcaactggtcaggctggttatgccacctctgcgccagcagccggccagcctgcatatggccaggcaggatacacccagccacctacgaatcctccaagttatgatcagtctgcagcaccagcagcgactcagagcagctatgctgcacctccagcaaatccacagcagcctgctgcagcaaaaggggtctcgccacaacctgctgctgctggatatggtgctggtgggcagtggacagcatgagcctcgtctctcaaactttgctgacagcaagatcgtgttggataccgcttttggcgcctgttccagtgtttgcgtcttttggatgtctgtggatgcatcgggtaggtcttgacttcgttatcaaaagggattgtaaccccttgttgtgatacttggctctcgttaatgtgactttattaaacatcatattcagtttgaacgaaaccttgtcttgctacttcgcatcttgtcaagtgattttgg

SEQ ID NO: 13208 - DNA, 1567 bp, Sorghum bicolor
  Clone ID: SORBI-28MAY03-CLUS54639_1
gtggctgtgtctgcccccccttgctttcctaaattcaatattcaatggcgggagcaagattggcggctaggccggacacacacgccccagcacaccagctccctcgcgccgccgccttcgctgccgcaggtcgccgcggtggcgattcccctttcttcccgcgagcaccaggtacggcgttccccgcgccctccctaccccgcccccgcggcagccccagcgcgcccccccgggcccccttcggccgccgcgcccctccgtccgccaccgggttgacgaagcgggccttgcgcaggtacctgatgttatccaccactgccatggaggggtcgcggtgggtcgccgcatggctgcaggggtcattccccaggcggcccagccgtcgactccggtggtccgcgccctggggctgcgggttcagcacatgatctcccccttacctgtgcttgccggtgtccggaagtgggttcgtcatgggtaactttccccgccacccgccgcctattattccagcccgctcccctctcgtatcgcccctcccaaacttcgctgcctagtgctttattagcttctactatacttccattattttctcctgcacgtcggggttctatctgcctatgatctgctagcgttggattcgattgcaggtatttattgttgccttgaacgtggatcctgttgcgcgcaaaccactcatcatattagactatatgtggttcatatccacacatatcgcgtgttactcatgctggctggtatacaacaactgtctaccttttacctccatgttgtccaaccttcttcaccggttgaccaagccctggagctgctggtacagcacaagatctctggcttacctgtggttgacgatgatgggaagttggttggggttgtatcagattatgatctgctagctttggattcgatttcaggaaatgaattgcccgatacaaatacaaacatgtttcctgatgtggatagtacatggaagactttccacgagatacagagactattaagcaaaactaatgggaaggtcattggtgatgtaatgacgtcttcacctttagcggtgcgtcaaaatactaatcttgatgctgctacaaggttgctgcttgaaactaaataccggagattacctgtagttgatagcatggggaaactagttgggatgattacaaggggaaacgtcgtcagcgctgccctcaaaataaagaagaaaactgaagaaggtgcttgaactagattgctcgtcactgcttggggttaatcttgcagccatttggcatttgattcattgaggcatctattggtgatgttcagagtgtagctacagattttccttctgaatatataggtactatactagtttggggctttgcgtgcggccatttgccctgtgtctcatcgtggcctcttgtgctgtcgttctgggtgtacctactggtttcccgtgctggtgatagaggtactatactagtttatagcattgtgtaggttcatattcactgtttctcatcgtatccatatgaactttctttgttgatttacatagtggatacaa

SEQ ID NO: 13209 - DNA, 1329 bp, Sorghum bicolor
  Clone ID: SORBI-28MAY03-CLUS55349_1
cctactggactgacaccctggtctaccccttggtccttgttcttcctatcctaccaacagccctccctcaccgaaaggatctctcaaaatcaccaaccactaaccaatcacaattaacattattgttagttaacagagaaggagaggagaaactgatgtgattatacaggtgcaaacacaagaaacactcttgttcttgccacaaacgaagtgaaggtgcaaaccacgtatgccaaggacgcaaaccgtgcatattgtggtgcgtaacgtcgtagcagagtgagtccggcaggctgctgcagacaagacaaggcgcgggcggtgagctcgagagccgagaggaagaagaaaagcactagtctttcctttgctaacgaaacgacagagaccaagaccgagaaggcagctacctaggcagcaatggcgacctcggccagcggcgtctcactcctcctcgcccagccgctccctcccaacggcaccagcctgcggcgcgtcggtgtcgccgcgcgagctcctgctcctgctcctgctcggctcgcggccacggcggtcaggtctgcgcacccgctcgccgccaacgccgacgccaagacgaggacgctccggttcgttagcgttagcgtcaggtgcgtcggcgtcggcggcaccgaggcgctgcgctccgacgccgccgagccgccggtgccgtcctcggtgccgcggtccgtgccggtgcgcgtcgcctacgagctgcagcaggccggacaccgctacctcgacgtcagaacggagggcgagttcagtgctggccacccggaaggagctgtcaacatcccctacatgaacaaaaccggctcaggaatgacgaaaaacacgcactttcttgagcaagtgtcgaggatcttcggaaaggacgacgagatcatcgttggctgccagagcggcaagaggtctctgatggcggcgacagaactctgctctgctggtttcactgctgtcaccgacatcgctggtggattctcgacttggagggagaatgagctgcctaccaccatccactgatccgagcttgcctcagcagcatcatgcatgttgttggagctattagcccagtgttgtgtgaaagcctccaggattgtacatatgtctgatgtcttccatagttcgaataaaagtgctggaaaatggagcatgtagagtaaaggagagtagcagcacaaaaaatagggggttttacattatgcttcatctcatgtatagtcgtacattatctactcagtactccctgcatttggatgttgctttttactttttttttaacgaaccggcactggatgtgccatttct

SEQ ID NO: 13210 - DNA, 1308 bp, Sorghum bicolor
  unsure (1)..(1308): unsure at all n locations
  Clone ID: SORBI-28MAY03-CLUS412_1
gcacgagggtccctcccctctcagcctctctccctctcggactcgtcgcggcataaacaaaccaaagcaaagcaaagcaaaggcaaaaccccacctcctccacaccgcacccccccgcgtcgtctgcttttcctcggtgcggcacaagcccctgtctcgtcgcctccattaccgggctgtgcgcgcgagcgtggtggctgtctggcttgcggcggcggtgatggtggagatggacggaggcgtgggagtagtaggaggagggcagcagacgccggccccgcgacggtggcgcctggcggacgagctgcggtgcgacctgcgcgccatggagacggactacgtgcgtcggttccaccggcacgagccccgcgaccaccagtgctcctccgccgtcgccaagcacatcaaggcgcccgtccacgcacgagggtctctagtgaggcggtttgatcaaccacagcttttcaagccctttgtgagccggtgtgaaatgaaggggaacattgagattggtagtgtcagggaggtcaatgtcaagtctgggctgccagccacaagaagcacagagaggctggagctgttagatgacaacgagcacatactcagcgtcaagtttgttggaggtgatcacaggctgcagaactactcctccatcctcaccgtccaccccgaggtcatcgacggccggccggggacgctcgtgatcgagtccttcgtggtggacgtccccgacggcaacaccaaggacgagacctgctacttcgtcgaggccctgctcaagtgcaacctcaagtcgctcgcggaggtgtccgagcgccaggtcatcaaggatcaaacggagccccttgaccggtgatgggacattatatatataggtcgatcgatctgttcggatcattgcattgcattgcattccttagaatgtgcagagctattctccaatggagcccctaggttccagctggaaatttgcatggaaaatgagttttgaggaactgccactgctatgccaagttcagagttaagtcttttcctccttgcgattgtgttttctgttcttctccggcgttgtatgcctccgaaggaggaggacagaatatgatgtgctattgtagtgatgaaaattggaagaaaaaaaattaaaactgtgaggccctgaacatcttctttctcagatcaatatgtggagtggagggttaatttctctgtaattagattcgctcctagattgctccatcttgatttctttcttttttgtgtctttgtntgtgtgtgttgtgtaaatacaatgcccctagtgtgtaatta

SEQ ID NO: 13211 - DNA, 1137 bp, Sorghum bicolor
  Clone ID: SORBI-28MAY03-CLUS4250_1
cttcgtccccactgctccccccgcgccaccgtccaccagctcgcatggcgctccacgccgtctcccccgcggcggtctcctccccgctgcgcgccctctcgcgcagcctcccccagcgcccaggctgcggttgtttaccaaagcaatccctcgcagtttactcctccataaactttgcgagacttcgggctggaccagtggacttcggtggcaggcctctggttcttcgacactcggacaagagagcagttttgatgcatgctactattgaagaaatcgaagcggagaaatccctcattgaagaccaagctaaagaaaagatggagaaggcaattgaaacagtccaaactaacttcaacactgtgaggacagggcgtgcaaacccagcgatgcttgaccgaattgaggttgagtactacggaactccagtgaacttgaagagcattgcgcagataagcactccagatgcaacttctcttcttatccaaccatatgacaagtcaagcctcaagcttattgagaaaacgatagttgctgcaaatcttggtgtgacaccaagcaatgacggagaagtgatacgagtgactgtcccacctttgacatctgatcgtagaaaggaattagcaaagacagtagctaaattatctgaagatggcaaggttgctataaggaacataagaagagatgcaatcaaagcttatgataaactacagaaggaaaagaagctttctgaggataatgtgaaagatttatcagctgatctacaaaaagtcacagatgagtacatgaaaaagatcgattccatccagaagcagaaggaacaggaactgatgaaaatttagatctcaagctgactgtatgactgcttggcgctgtgccggggatgcacgttttgagtcaggtgctttgctgcaaccattggatgcacacaagttgagacaataccgctgtgtgtgcttctcgtttttgtaatgctcgtaaataggctctcgtcaccgtgttgtcggacttgctagtgctacattgtcaatgtttctcaccatctgaatcgaatgtctgaattgtttctgaacgtctgttgtcaaaactctgccgaggttcaaagcaatcctcctgctcaaaactctgctgaggctc

SEQ ID NO: 13212 - DNA, 1298 bp, Sorghum bicolor
  Clone ID: SORBI-28MAY03-CLUS4324_1
ccgggtgctaatgttcgagccgagggccacggtggcccacgcgtcggacgagcgcttgtgcagggtcggggatgacaagaagaagtcggaggaggccgggcaggacctcgcgagcttgtacattgagcgccgcctcgaggaggccgaggctgagaagcagttcatcttcgagaagatcaagctgcaggaggacaaccagcgcgcgccgccgcaggtcgagaacagcaccggtggcggtggtggtgttgggatgaggggtgggaactctggtgctctaccccgctaggatccagagatgctggatatgtcggtcctgtggacagagatcagggacgttgggtatggattgcggtacgttccactggtcaacaacctctacctgagttttgacgcgtgacatggagacaaggtcgatgtgattattgtcggctggtagacgtggttgtttaacgactggtgtagtggtaactatatgcgatggatgtatactgcatttcttttttttttaaaaaaaatgactgtaggagcgcagcattgtttagtagtaatgggggtgactggttctgaggttttggatgacagtggcgcttctgagatgcctgtgtgagtattgtgttccattccgttttcatgataataatacataacgcattaattattaatattaatattaatatatgtaatgcgcgacactacactagatagcagcgttggtgtatatatattgtatgaacttatcgttgttggactaagtgtgacgagtgatgtatgaacctttgcttgatgcacgtaaaaaaaaaaaaaaaaaactcgaggaggccgaggctgagaagcagttcatcttcgagaagatcaagctgcaggagaacaaccagcgcgcgccgccgcaggtcgcgagcagcagcggtggcggtggtggtgttgggatgaggggtgggagctctggtggcgaaccctcgcaggtgatgatgctgtccaagatccaggacctgctgaagaacgtccgcagcatgccgtcggcaaagccggacgggccacgctccaagtagccgtgacgtgggctgggcgcgggcatttgcccctccatcgatctgatgattgtttgttggtagacgtggttgtttaactactggagtagtggtaactttatatgatggatgtatactgcatttcttttttttttaaaaaaaatgactgtaggagcgcagcattgtttagtagtgatttggttcactgattatgtgatgttgtatgacaattgtatcctggtaattagaagtgtaaccaatagcgtagct

SEQ ID NO: 13213 - DNA, 869 bp, Sorghum bicolor
  Clone ID: SORBI-28MAY03-CLUS43540_1
gcacgaggaaatatgtcatctccccaccctcgcatctcacatttgtcatcggcgcactcccttgttggcagccacctgtctccaccaatcagcataaggtattcattgccccaattggcccagtctgggcatggatcactcagtccacatgtcagttcatcctacatctcgaattctgggtatggttcttcaagctactactatcttggaggatccagccagcatgggtcatacctaaggcgatgtggagaatcagggccaagcctgtctaccatggcccctcagtcgccacagcagtttcagtcggaggcaaatgtggtagcaggcacatcatcagctcagtcctttcggcagtcctacctgagacactgtggggattcagatgccagtctgtctgacatgatgtcagcccagtcattgccacagcagtttcagtcggatgcaaatgtggcggcaggcgcatcatcagctcagtccttgcggcagtcctacctgagacgctgtggcgattcagatgccagtttgtctgacatgacatcagcccagtcattgccagggtgctgaggagtgaggaaggtgttcggatgtgtactacaacatgcggcatgatctgtgcatacaatgaggcctgtaacattacctaggtggggagaaacatgtatagcatagattttgttcttgttcttatctttgtcgtgtcttgtgtgcatatgacaaataacaggaagaatctttgtttgtatggaagctggtaggttgaattagttcgtttgtttcaatgtttccatttcatttgatcaggtgttgggctggttgccacccctttgactctaaagccttaggaaaaatggaaagcctgctgtctcccc

SEQ ID NO: 13214 - DNA, 1186 bp, Sorghum bicolor
  Clone ID: SORBI-28MAY03-CLUS3912_1
cctaattccctctcacggagtcatcaagatgctctcttcctccattagttcagctcccgccgcgctgtcacgcgggttgccgctccaagaaccatgccctgcctattgcttctagctccacctccaccgccaccgcctcgcccctgtctaatcgactcggtaagtcggccaccactccccaaatatcggttcttcctgccccggacccggaggcggccaagtccgtggcttggcgtgcgaatggcggagatgaccagggttgggagcggcggggaaccgcccgaggttggggtttccatggagagtgacccgcttgtgggaggggacgcgccgtcccgcccgaggtgggaagcgagccggtgggcgtccgtggaggctgcgctgaatcggatgagtaaatggctggtgtctggttcttttgcttttgcagctatatggaagcatgatgctgaaattatgtgggttttgctgggtgcggttggcaactctctgctttcattggttcttaaaaagatgctaaaccatgaaagacctgcaccagctttgcggtctgatcctgggatgccatcgtcccatgcacaatccatattctatgctacgaccatcctagctctttcattgtactactggcttgggacaaattatctgaccatgattcttgggcctgcaactctgttagtggccgcctatctgtcttggctacgagtgtctcagcgccttcatacactaaaccaggtcactgtgggagctgttgtaggatctgccttcggtgctctatggtttgtgctctggcattggcttgttcaggaggcttttgcttcttctctgctggtcaggattgcagtcatccttggatcaacaacattttgtgttagctttgtcatctacattattcatcactggctcaaggatgagtaatgcatttcgtagctgcaatgggagatcgactgataggcacggtgcgtttggatgattgaatctgttctgattcttatcagaattgattgaaatggtgccaaacgggttttgagccgagtgattcaggagtgaaacgattctcctttccttcagaaattctaggaacggatcataccgatttgtgatagtaacatgtctcctgtctcactagcaattgtagttttcccaattaatcattttaagtaaaataaatttaaaatggggttgt

SEQ ID NO: 13215 - DNA, 556 bp, Sorghum bicolor
  Clone ID: LIB3481-031-P1-K1-F11
cgtccgttcagctcccgccgcgctgtcacgcgggttgccgctccaagaaccatgccctgcctatggcttctagctccacctccaccgccaccgcctcgcccctgtctaatcgactcggtaagtcggccaccactccccaaatatcggttcttcctgccccggacccggaggcggccaagtccgtggcttggcgtgcgaatggcggagatgaccagggttgggagcggcggggaaccgcccgaggttggggtttccatggagagtgacccgcttgtgggaggggacgcgccgtcccgcccgaggtgggaagcgagccggtgggcgtccgtggaggctgcgctgaatcggatgctatatggaagcatgatgctgaaattatgtgggttttgctgggtgcggttggcaactctctgctttcattggttcttaaaaagatggctaaccatgaaagacctgcaccagctttgcgggctgatcctgggatgccatcggcccatgcacaatccatattctatgctacgaccatcctagctctttcattgtactactggcttgg

SEQ ID NO: 13216 - DNA, 1024 bp, Sorghum bicolor
  Clone ID: SORBI-28MAY03-CLUS44204_1
agccccgccccactattctctcgcctgcgcttccgcctccggacgtgcgccgccgtctccatctccacccgtccatcctccgcggcgcccctgcgctaccgtcgcactcgcctctctatcccttttcctctgtccccaccttgcccgcgcatcctccgcgccgccgccgccgccgcggtctcgtcgtcgctggatctgcgcgcgatagccggcgggttcgcgctgttcagcatggctgctgcctcctccgccacatccgtccacgacttcaccgtcaaggatgctagcgggaaagatgtggaccttagcacctacaaggggaaggttctactcatagtcaatgttgcatctcagtgtggcttgaccaattccaactacacagagctgagccagttgtatgagaagtacaaggaccagggttttgagatccttgctttcccatgtaaccagtttggtgggcaggagcctggcactaatgaggagattgtccagtttgcttgcactcgcttcaaggctgaatatccaattttcgacaaggttgatgtcaatggtgacaatactgcacccatctacaagttcctgaagtccagcaaaggtagtctctttggggagaacataaaatggaacttctccaagtttttggttgacaaagaggggcgtgttgtggagcggtacgcaccgacaacttccccactgagcatcgagaaggacatcaagaagctactagggagtccttcaaccttgtaattggatcaactagctctactaaactgctgcattgcatttgcctcagtagcgttttaataaagctgttcttagaaccgagatgtttgaagctgtgcttagaaccgagatgtctttactgtatttcttctgtatgccctgttttatggtaaatgtcatgtatgtaataaaaatgatgcaatgcttgaattctcttgaaaggttatgtatccgggttggttgttgaaaaaaaaaaaggaactgggttggttgttgagatatttgagaaataagttttgcc

SEQ ID NO: 13217 - DNA, 1770 bp, Sorghum bicolor
  Clone ID: SORBI-28MAY03-CLUS4538_1
gcacgaggggaggctccacgacgagaagggattcgccgtcgccgtcatgatggacaccgagggcagcgagatccacatgggcgacctcggcggcgcgtcctccgtcaaggcggaggatggagaagtatggacgtttagcgttagatcatttgaattgcctctcccagaacggactattaatgtgaactatgatggatttgctgaagatgtgagagttggtgatgagcttcttgtggatggtggaatggctcggtttgaggtgattgagaagataggaccagatgttaagtgccgttgcacagatcctggtttattgttgccacgtgccaatcttacattctggcgtgacggcagtattgtccgtgagaggaatgctatgcttcctacaatttcatcaaaggattggcttgacatagactttggaattgccgaaggtgttgatttcatcgctgtttcgtttgtcaagtctgcacaagtaattaaacacttgaaaagctacatagctgcaaggggccgtggcagtgatttagcagtcattgcaaaaattgagagcattgactctttaaagaacctggaggagatcatccgagcatcagatggtgccatggtagcgcgaggggatatgggtgcacaggttcccttggagcaggtcccctcaatacaacaaaagatagttcaactgtgcaggcagctcaacaagccagtcattgttgcttctcagcttctcgaatcgatgatagagtatcccacacccaccagggctgaagttgcagatgtttctgaagctgtccgccagcgagctgatgctctaatgctttctggcgagtcagcaatggggaggtacccggataaggctcttagtgttctaaggagtgttagcctaaggattgaaaagtggtggagggaggagaagcgtcatgaggcactggaacttcaaaccgtttcatcttccttctctgacaagatatcagaagagatatgcaactcagcagctaaaatggctaatggcttgggagtagatgccgtttttgttttcacgaagactgggcacatggcctccctgctctcgcggtgccgtcccgactgcccagttttcgccttcacaacctcaacgtctgtcaggagacggctgaacctccagtggggcctgatccccttccgcctcagcttctccgacgacatggagagcaacctgaaccgcaccttctccctgctcaaggccaggggcatgatccaatctggggacctcgtgattgcgctctcagacatgctgcagtccatccaggtgatgaatgtaccctaagatcgagcctgatctccatgtcgcacgatcctgtatcagatggaacacgcacattatcggcaccttgaaggacagttccttgcgcctatgctactatgctaggcctagtctggcccagggaactgttccaataatttgtggctttcaggctgttgtagaacccttatattacttacagtataggcttaggtgacgtttaatgtgcaagtagttgtttctgatgtttttgcgtgataaaagcggtttccagctatgctctctcgtgatgttgcacgatgatgcctgcagctaatctgcttaaactttagttagtgacatctgtatacttggcacattggaatggtgtgtagatttttgtctagaaaaataactttagttagcgtcgtaaaaatgatgttaactttagttagcgtcatcattttgattaaactgattattagatagactgggcaggcagaaatgagccg

SEQ ID NO: 13218 - DNA, 1396 bp, Sorghum bicolor
  Clone ID: SORBI-28MAY03-CLUS5914_1
gcacgagggggcgatgcagagcgcggctgccgtcgggctcgtccggccatgcgccgcgcggccgctccccacctaccctagcccacgccgcggcgccggcgcgtgcagtccgccgctcctcacaacgccccgcggcctccgcctgtccgcccgcgccggactcgtgccggcctcgccgctggaggaggagaaccggagatgcaggcacgtggcagcggccgccgggaaggtggcggcggctgatacggcccgaggggaagcgggaggagggctcgccaagacgctgcagctcggggcgctctttgggctctggtacctcttcaacatctacttcaacatctacaacaagcaggttctgaaggttttgccataccctataaacatcacaactgtgcagtttgctgttggaagtgccattgctttgttcatgtggatcactggtatccttaaaaggccaaagatttctggcgcccagctttttgctatccttcctctagctattgtccataccatgggcaatcttttcacaaacatgagccttggaaaggttgcagtgtcatttacacatactatcaaggccatggaacctttcttctcagttctcctttcagcaattttccttggtgagttgcctacgccttgggttgtgttgtctcttcttccaattgttggtggtgtggcattggcatcccttactgaggcctcctttaactgggctggattttggagtgcaatggcttcaaatgtaaccttccagtcaaggaatgtgctaagcaagaaacttatggtgaagaaagaggaatctctcgacaacattaatctattctcgatcattacagtcatgtcatttttcctgttggccccagtaaccttacttacagaaggtgttaaagttagtccagcagttttgcagtctgcgggtttgaacttgaaacaggtatacacaaggtcattgatagctgcattctgcttccatgcataccaacaggtgtcatacatgatcctcgccagagtatccccagtcacacattcagtgggcaattgcgtcaagcgtgtggtggtcattgtgacctctgttctgttcttcaggacccctgtttctcccatcaactctctcggcaccgggatcgctcttgctggagttttcctatactcgcagttgaagagacttaagcccaagccaaaggctgcttgatcatagacatttgcaggtccatccaatagaactttggaagttatgctaccgttggagtgattagtgagtgcagtagttagaatgatgtttaaagaagagtaccactttggcggataatttgtgatttgattgctagcatttttggacgggtttgttcgtgtattaataattttgctgtgatgccacttaaaaaaaaaaaaa

SEQ ID NO: 13219 - DNA, 1434 bp, Sorghum bicolor
  Clone ID: SORBI-28MAY03-CLUS59142_1
gctcatccagtcatccactccactcgacgccgcccctccaatccgtcgcctgccatggagctccgcgagctgggcggtacgggcctccgagtcagcgccgtcggctttggcgcctccccgctcggcaacgttttcggggacgtgccccgcgataccgcccgcgccgccgtccgccgcgcgctcgacctcggcatcaacttcttcgacacctccccgtactacggcggcacggtctcggagtcagtcctcggcgattgcctccgccacgcggccgttccgcgggaccgagtcgtcgtcgccaccaagtgcggccgctacaaagacgagggtttcgacttctccgccgaccgtgtgacgcgcagcatagacgagagcctcgcccggctggggctggactacgttgacatcctccacgcccacgacatcgagttcacccatctcgaccagattgtgaatgagacaattcccgcgctccagaagattaaggagagtgggaaggcacgtttcattggcatcaccgggctgcccctcagcatctacccttatgtcctcgacagggtagcaccaggctcggtggacctgattctatcttactgccactacgggatcaatgacacctcccttgttgatctgctcccctacttgaagagcaaaggtgttggggttatcagtgcttcgccactctccatgggtcttttaacagataatgggccaccggagtggcaccctgcaccagaacaacttaagtcagcatgcagggctgcagcagatcactgtagaaagaaggggagaagcattaccaagctagctatgcagtatagcttgatgaataatgaaatctcgacaattcttgttggaatgaactcttcagaacaggtggaggagaatgtggctgctgcactggagttgtcaacatcaggcattgatgaagaacttctgcgtgaagttgaagcaattcttgagcctgtgaagaacctgacttggcctagcggcatccaacaagtctgatggccaaaagctgcttgtctgatttgagaagctagtgtgatggacgtatcactgctgttcgatttagtcaattgtgcacgtagcatcattgactgctgattgggaatttgcaatgccgtatagctattgatgaaagggggccattgggactgttgggcttttatggttgggtcctgtggtaatttagacgtgtcgaatgaaggcgacacgagcaataaaagatcgatgctgatcactgaataagcgtctcacatgcatctggagtggagtaacactagttaatttggttgcgcaccacatttacagggaaacaagatgttgctgaattatgcaccaaacatggatttgtttttcatttacttgttctcatgagtatcagtgcaaacttatgctgtttacttgtggacacaatgttttgtcagttca

SEQ ID NO: 13220 - DNA, 1388 bp, Sorghum bicolor
  Clone ID: SORBI-28MAY03-CLUS5983_1
gcacgaggcttccttgctcggttcctctcctctcctctccccccaccaccccagcgccccaaatgccgctccaaccctagcctcccgcccccgtcttctgatctcgggcggccatgggcaactgctgccgctcgccggccgccgtcgcgagggaggacgtcagctcctcgcacttccccgcatccaacgcgaagaagaagccgcaccaagcgcggaacggcgccggcggaggaggaggaggaggaggaggcggcggcggcgggcagaagcggctctcggtgctgggcgacgaggggtgcgaggtcgtcgggatcgacgacaagtacgtcctggacagggagctcggccgcggggagttcggggtgacgtacctgtgcatggatcgggacaccaaggagctgctcgcctgcaagtccatctccaagcgcaagctgcggacggccgtcgacgtcgaggacgtgcgccgggaggtggccatcatgcgccacctacccaagagccccagcatcgtgtccctgcgggaggcgtgcgaggacgagggcgccgtccacctcgtcatggagctctgcgagggcggcgagctcttcgaccgcatcgtcgcgcggggacactacaccgagcgcgccgccgccaatgtcacccgcaccatagtcgaggtcgtccagctctgccaccgccacggcgtgatccaccgcgacctcaagccggagaacttcctcttcgccaataagaaggagaactcgccgctcaaggccatcgacttcggcctctccatcttcttcaagcctggtgaaaagttttcagaaattgtgggaagcccctattacatggctcctgaagtattgaagagaaactatgggccagaaatagacatatggagtgcgggagttatcctgtatattttattatgtggagttcctccattttgggctgagactgaacaaggggtggcacaggctattcttcgtggaaatatcgattttaagcgggaaccctggcctaatgtttcagaaaatgcaaaagatttagttcgacgcatgttggagcctgatccaaagctcaggttaactgcaaagcaggttcttgaacatcattggcttcaaaatgcgaagaaggctcctaacgtccctcttggagatattgtaaagtcaaggctcaaacaattttctaggatgaatagattcaaaagaagggctctaagggtcattgctgatcatttgtctgctgaggaagttgaggacataaaggagatgttcaagactatggatactgacaatgatgggattgtatcttatgaagaactgaagaccggaatagcgaaacttggttcccatcttgcggaatcagaagtacagatgctcattgaagctgtggatacaaatggtagg

SEQ ID NO: 13221 - DNA, 952 bp, Sorghum bicolor
  Clone ID: SORBI-28MAY03-CLUS46993_1
cgcaaccggtacagcagccccaatccaatgctcaacagtatcctccaccagtgcaaccacagcaatctagcccacagcttcctcaggcaatgcaaccacaacatcctcctgtgcaaactcagatgagacctcaaaccccaccaaactacactcattatccaccccaccagccattgaaccccagcactgaaactcttcctgccaatgtggctatgcaaggaccctacaacactgctgctccatcaggtgccagccgttctgaaccgccgtattcgtatggagggcctggcatccctccgtctcagccaccgccgcagcacaacatgcaaaggcaccaactaccaccttcaagtcagagctcctttgggccacctccaagcaaagggtcctatgctagccctacacagtatgctccgcagggcaatccgcaaggctacaacacaggttacgcttacccaccaagcggccctccagcagtccagccgcaacagatgcctccaggtggagtcggcatgagccatccagggtcgcatatgatgcgtggccatccctacggagaaatgatggagaaggcgatcaccatgggataccctagggaccaggtgctgaacgtcacccaaaggatggccgagagtggccagccaatggatttcaacaccctgctcgacaggctgaacgaagcagggtcgggagcaccacccccgcgcgcgtggtgattggatccagtttgggcgcggtgcttggtgtcagttatgtgacttacgactgttatcatgcagctaaataaatacgtaagatctgggctgatgccgtgtactgcttatctgtactatgtacatatataattgtgaatttttcatgtaactgatgcagcacttgtactacgaacatatcacgccactgttcagatatgtatatttcgaagccaattaccggcaggcatcctgacatt

SEQ ID NO: 13222 - DNA, 1222 bp, Sorghum bicolor
  Clone ID: SORBI-28MAY03-CLUS47_1
tcccccacgctcccccaacacccagccggcggcagagctagctagaaaccggcagcagcaggccagctagctacaagatcatggcggcggcgcgcaacgacgacacggccaccatcatccgctccgcccgccgccgggaggagcaggtggtcccttcgtggcatgacgggcctcgtcaccggcggcacccgcggcatcgggtactaactacgcacaatcaacaggtggcgcatgctggcttgctgtgtaacggtaactgaactccatgtgctcaggcgtgccgtggtcgaggagctggcggcgctgggcgcggcggtgcacacgtgctcccggaacgaggcggagctccgcgaccgcctggccgagtgggaggccgccgccaagaccaacggcggcggcggggtcgtcacgggctccgtctgcgacgtgtcggcgcgtgaccagcgagagcgtctcctccgcgacgtggccgagcgcttcggcggcaagctcaacatcctggtgaacaacgtgggcaccaacttcggcaagccgacggcggagtacaccgccgaggactacgcgttcctgatgtccaccaacctggagtccgcctaccacctgtgccagctcgcctacccgctgctgaaagcccccgccgccgccgccggcaacggtaacggcggcagcgtggtgctcgtctcctccgtgtgcggcggcgtggcagtgtgcacgggctccgtctacgccatggcgaaggccggcatgaaccagctggcgaggaacctggcgtgcgagtgggccggcgacggcatccgggccaactccgttgcgccgtggtacaccaggacgccgctcgtggaaggggacctgtcgcgggggcagtacgtggaggagatcctccggcggacgccgcagcggcgcgtcggcgagcccgaggagatctcgtcgctggtggccttcctctgcatgccctgcgcgtcctacatcaccggacagaccatcgccgtcgacggcggcatgaccgtcaatggcctctaccccagctcatcgccgtcaggactaagctacagtaattaatgaagaaattaaccagcgacgcgtcaaggaatagcttgatgaatgaagaataaagtacttagttattagtaccaataagggggaatacagatgttggataaaatttggagaatatgggcacattattgcacatggatatatagaatttccaacttaattctcg

SEQ ID NO: 13223 - DNA, 628 bp, Sorghum bicolor
  Clone ID: SORBI-28MAY03-CLUS4966_1
gcccgcgcggctgcgcgccgcgggcccgcccccacgctgcgctccccccaccgcctctttcgaatccccgattgcgcccggcgcctggtccggctcccctcgcgccctcgcccgctcgcctagctcccctgtctcttcccttcatcctccccacctcctcccccggtaccgagctcccgcatgccagcgctctgaccggcaccggcgggcagcggggggtcggggccgggtgggcatcatggacaagtacgagcctgttcgggacatcgggtcgggcaacttcggggtggagcggttgatgcgcgaccgcgagacccgagggctcgtcggcgtcaagctcatcgatcgcgaccaccggattgacgagaatgtgtaccgcgagatcgttaaccaccggtcgctgcggcacccgaaaatcatccagttcatagaggtgatcctaacaccgacgcaatttgcaatttagacggagtatgcggctggtggtgaactatttgatcgaattgacgatcgtgggcgatttagcgaggatgaggccatgtatttgttccagtagtcggtcgctggtgtgagcgattgccatcacatgcatatttcccatggagatttcttgccggcgtgcgttctc

SEQ ID NO: 13224 - DNA, 1199 bp, Sorghum bicolor
  Clone ID: SORBI-28MAY03-CLUS512_1
tacaggcccagaattccagggatcctagcgagagagacaacctggagatcacagagctagagagagaagctcgacagagagctgagagccccgccgagtagagagctagatactcgagcagcctagatgttcgactgcaagatcctgccctactcgctggtagctggactacgtgaacaacggggaggagtccgggatcacgctgctaaacgccaagttcttccacatgatcgccttccgcgtccgaggacatgctgattaaggatgtgacggtcacggcgcccggggacagccccaacacggacggcatccacatgggcgactcgtccggggtcaccatcgagaacaccgtcatcggcgtcggcgacgactgcatctccatcggccccgggacaaccaaggtgaacatcaccggcgtcacatgcggccccggccatggcatcagcatcggcagcctggggcggtacaaggacgagaaggacgtcacggacatcaacgtgaaggactgtacgctgaagaagacgagcaacggcctccggatcaaggcgtacgaggacgccgcctccgtgctcaccgcctccaagatccactatgagaacatcaagatggaggactcgtcgaaccccattatcatcgacatgaagtactgccctaacaaaatctgcaccgccagcggcgcctccaaggtcaccgtcaaggacgtctccttcaagaacgtcaccggcacctccgccagccccgaggccgtcagcctgctctgctccgacaagatcccctgcactggcgtcaccatggataacgtcaaggtcgaatacagtggcaaaaacaacaagaccatggccgtatgccaaaacgccaagggcagcgccacaggctgcctcaaggagctcgcatgcttctagacctccatccacccatctcgctctttacttagttatttctctcgtccatccattggtgccatccattggtaacgaactagtaccatccattggtttatttcttcatattctttctctcttcacacatcgagcaacattatgtttccttttttgacacaggaatgtacgtaaaagcacctatcttgcatgtacccgacctctaggacatgccttttttttggctagcacaacatagcagtgtcaaaactaatcttcaatttcagcattcgtcaaaaaaaaaaaaaaaaaaggccccta

SEQ ID NO: 13225 - DNA, 1073 bp, Sorghum bicolor
  Clone ID: SORBI-28MAY03-CLUS4674_1
atatctactcttctaccagtgtattgcgacatatatcagtagtcttctacttttttaggtgcatccaatcagattccatgtaagaggatgtatgagtaattaacatgcttttacactaaacggatacctgacacactgctaacgacctgcggctctttcgaacaagtatggcctacagtctcagcacaacaacgaactgcaaagatccagtagttaacgtcaggtatcttggaccgacaaaatgtctacctcatcatttttgtgatatgcacaggcacttgcttcacatgaagaaaataaatgatatgtcatgtgcatgttaaactctttgtattattagaacatacctccgagggtgcacttccttagctacaagatttacatgcctaggctcaacaaacaatgcagctactaactccctctttccttcacaaaacccttttgtgttactatgcaggaggttatatcaaatcactgaactaaacatgggaaactttcctttggcaccttacagaagagcatacaaggtgcagattgtggttgccctatgcagtgttgtgcttcagtgagactcagcgattttatgtgcttgtagccatggtttgttaaaatagaagcttcgtcagagtcctcatatttaatcgctcactgttggcattttaaaaatcaaaacaacggaaccacgattagggacatgcgaaaattgaggtgtcaggctaattcaagcgatcaagactacaaatgatgaacccatcttcaaatcaaacaactttagatcaagactgcaggcaatgaatcgatgggtgaatctacaaaatcacttacaacaattatatgggacttcaatatgggttcacagatggtgattttttaaggctctgttaagggctcgaaatcatccctgcactttgtaaattacagcgaccttgtagggtaggccgtaaactaccaatgccactgccatataacggcacctttgtactttataactattctgcaaatatatatcagtgaaggtaccttaacgatgcaaatgataatgcctacaacatgtgcatcatactcataatttt

SEQ ID NO: 13226 - DNA, 446 bp, Sorghum bicolor
  Clone ID: LIB3476-052-P1-K1-H8
ctaaatttttaactgctataaattcagttggtaaggcagtatgactaaagtagttgtttatagtgcatccgtatgcttagttcttgttctctgttattgtgctcttggcaacaactcaaatacttgaagttgattcaaatttctttaagaattatttcagtttcactagagcatcttctgttttctaacgctggctaagtgaatcagctgacacactgctaacgacctgcggaactttcggacaagggtggcctacagtctcagcacaacaacgaactgcagagttccagtagttaacgtcaggtatcttggaccgacaaaatgtctacctcatcatttttgtgatatgcacacgcacttgcttcacatgaagaaaataaatgatatgtcatgtgcatgttaaactctttgtattattaaaaacatacctccaagcgtgcactttc

SEQ ID NO: 13227 - DNA, 414 bp, Sorghum bicolor
  unsure (1)..(414): unsure at all n locations
  Clone ID: LIB3480-029-P1-K1-G3
gtgtatcagatgttcttcatagggcatcaatctcagacactgctaaagacctgcagaacttttagagaagggtggcctaatgtctcagcacaacaattaactgcagcgttccaatagttaacgccagcaggtatcttggaccgacaaaatgtctacctcatcattttgtgatatgcacgggcactngcttcacatgaagaaaataaatgatatgtcctgtgcatgtcaaactctntgtattattagaataagtntgccgtgcgctnntgtagcttcattagtcagctaagaccacctaaatctttcaagaagcttatatgcttctatattagtagactgaacaacatgtttgtactgaactactgcaaaatactaaaataaccagtctgtatatcataactgtnnaaaanaaaa

SEQ ID NO: 13228 - DNA, 764 bp, Sorghum bicolor
  Clone ID: SORBI-28MAY03-CLUS4753_2
ccgggctcttctcgcactcgcgcgcctttcccattcgcgccgccgccgccgccgctgcaagcgccagctcgccgtcgtccgagccaaacaccccaacgccgccatggggcgtatgcacagccgcgggaagggtatctcgtcgtcggcgctgccgtacaagaggacgccgccgacctggctcaagaccgccgcctccgacgtggaggagatgatcactaaggcggcgaagaagggtcagatgccgtcgcagatcggcgtcctgctccgtgaccagcacggtatcccccttgtcaagagcgtcacgggcagcaagatcctccgcatcctcaaggcccatgggctggcgccagaaatcccggaggacctctacttcctcatcaagaaggcggtggcgataaggaagcaccttgagaggaacaggaaggacaaagactccaaattcaggctcattcttgttgagagcaggatccaccgccttgcccgctactacaagcgcacaaagaagcttccacccacctggaagtatgagtcaaccaccgcaagcactctggtggcctaagtgaggagctcaacattaggtgcttgaagctgggctattcttggaatcatttttatgtaccgttttatgagtttggagtgaactagagatcttgaatgtcctgtggaggatgccataaacccttttggttacatagaactgcctgttgttaacttttgctactcggcatccagattttgtcagctataatatgatcatttacatt

SEQ ID NO: 13229 - DNA, 863 bp, Sorghum bicolor
  unsure (1)..(863): unsure at all n locations
  Clone ID: SORBI-28MAY03-CLUS4753_1
gccggccgggccgggaacgccccgccggcccgagccggagctctctcctaacgccgcacgcgcctcctctcgccctcgcgccgccgccgccgccgcagctgctgcagcagcaagctcccgcccgccgtcgtcgcctgaggtagacaccaatccgccgccatggggcgtatgcacagccgcgggaagggtatctcgtcgtcggccctgccgtacaagaggactcctccgacctggctcaagacggccgccaccgaggtggaggagatgattaccaaggctgcgaagaagggtcagatgccgtcgcagattggcgtcctgctccgtgaccagcacggcatccctctcgtcaagagcgttactggtagcaagatcctccgcatccttaaggcccatgggctggcgccggagatcccggaggacctgtacttcctgattaagaaggctgtggcaattaggaagcatttggagaggaacaggaaggataaggactccaaattcaggctcattcttgttgagagcaggatccaccgccttgcccgctactacaagcgcaccaagaagctcccgcccacctggaagtatgaatcaaccacggccagcactctggtggcctaagtgatatcctccgatggcgtggtcttgagcacctttgaacttgttctagatatgaatttatgtaatgcttaatatgtctggagcgggttagatggacaaggaacctcaacttttttatgttattacttggagaatctataaaccatttttggttttgcaattctgtctagtaaacgcaacatggatacaaaattggtccccttcagtgagcgtttactgtgccaccatttagaatgntgcttgccccc

SEQ ID NO: 13230 - DNA, 364 bp, Sorghum bicolor
  Clone ID: LIB3478-043-P1-K1-E6
ctcgaccccatcccattcgggcgttgtctgcttccgttgttgttgggatgggattgctgattcggttggctgatgcgtgtgtgtgttgttggttctcgtctggtaggtggaggagatgatcactaatgcggcgaagaagggtcagatgccgtcgcagatcggcgtcctgctccgtgaccagcacggtatcccccttgtcaagagcgtcacgggcagcaagatcctccgcatcctcaaggcccatgggctggcgccagaaatcccggaagacctctacttcctcatcaagaaggcggtggcgataaggaagcaccttgagaggaacaggaaggacatagacttcaaatcaagctcattcttgttg

SEQ ID NO: 13231 - DNA, 928 bp, Sorghum bicolor
  Clone ID: SORBI-28MAY03-CLUS4945_2
cttcctcgcagcgccggcgctccatcttctgctccgtcccccactcgcgctcggcatgacggcgacggaggcggcgctcaggctcgggctctcagcgacggcggggcagtcccaggctcggcggcggcatcagcggctcctcctcccgcctctctccagtagcctcacgacctcgcctccgtcctccgcacaccggccggcgaccctgcgattcaaatctgtatcacatggtgtttcttcacagcatgctgagaggatacactgccgttcttctctcaggcaaaacacaatagttgcatctgagaacgaaaatccacctttaatgccggcaatcatgactcctggtggtgctcttgatctcgcaactgtactactgggaaatcgtgtaatctttattggtcaatatattaactcccaggtggcacaatgtcaactgtagaacatccctttgatgatattacctacaatatacctgagaagccagtgacatttactgaaggtgcttcttatagtcttgtaatacttgctggactcggaattgcaggggtggctggatatgctgtgttcaaagagcttatatttgagccaaaagagtacaagatatttgggaaagctctagcaagaattcagagtgatagccaggtcacctcaaggattggccaccctattactggatatggccaggaaactagaaaccgtgcagctcggcagagaattccaaataagatttggacagatgaagatggtgttgaacatgtggaggtgaactttctcatccgtgggccacatggagctggaaaagtgtattcagagatgttcaaagataattctgatcggacatggaagttcacataccttgttggtgatatagtggcaccaccacatgcaaaaacaacagctgatggtagaatcttacttaccagcataa

SEQ ID NO: 13232 - DNA, 1260 bp, Sorghum bicolor
  Clone ID: SORBI-28MAY03-CLUS4945_1
actcctcgccgcatcatcgcagcgccggcgccccatcttcctccccgccctccccgcctcgcgctcggcatgaaggcgccgctccttcttctccgccctccccccgccgcccccggcatggcggcggcggcggcggcgctcagcctcggcttccccgcggcggcgcagcaccccccgtcccggcggcggcgtcagcccctcccccccccccctctcccccgtccccccgcgacaccgtccccggcctccgcacaccggcgcctgcccctgcgttctttatcaactctggaaccggggatttcatcagtctacctgtgtcagcgggcgcactctgcaacatatagctatacgctggatgacaggttacagggagagctagatgatttcaatggagaacagaaaaagcaagagacagtcggtgcgtttcagaaaataccaatggtgatgcctgcaactgatatactaatgtcagcacaaaggacatctagaaatgtgctaccaacaaagggtataccaaatatagttaagcgtgtaagaatcaaaggcgtgaataagcttgatgccttaaagaaagtactttctgtacctttcagaacatacagcaaacatccttgaaggcggcgaaaagggcatgctttatacaatgccaaatgttagagtaatgattcatcaacctcaaggtggatcagagggtaatgtggaggaggtgaggcgacaggttggagagaccgtctatgctcgtgataaagttgataaaatgtttgctgctttcaccgggcaaccacttgacatggtgcaacagtggacagagagggatcggttcgtgtcttcttcagaggccatggatttcggattggttgatgccttactggaaacaagatactagagaaaggacacaaactcacattttattagcagacttgaatgctgcagaactggagctgagcttagatgttggctgtccatcttgtttaaggccctggaattacggaggtgcatgccaaagagcaagattcgctgttgtgcatacatagagcaatatatgttgatcggccactctttggactacgactttccttccaatgcatttgtagctgtaacattgtgaaaaaaaaaaaaaaaaaaggcacctccttgtcatgcactctcgctaaagctatgaaccctgtttactgtaggcctagatatctttgcggatgggagaaaattgtttttttatatatatataaccaagccagtagacactatgcaaattgaacc

SEQ ID NO: 13233 - DNA, 723 bp, Sorghum bicolor
  Clone ID: SORBI-28MAY03-CLUS5206_1
aatcagaagtacagatgctcattgaagctgtggatacaaatggtaggggggcactagattatggggaatttttggctgtttctcttcatttgcaaaggatggcaaatgatgagcatcttcgccgggccttcctattttttgacaaggatggcaatggtttcattgagcccgaggaacttcgggaggctctagtggatgatggagcagctgatagcatggaagtggtgaatgacatattgcaagaagttgacactgataaggatggcaagattagctatgacgaatttgtagcaatgatgaagaccggtacagattggagaaaggcatcccgacactattcaagaggaagattcaacagccttagcatgaagcttataaaggatgggtcggtaaaattgggtgttgagtgaaacggcaccctcgttcatatgtgtgcatgtagttaggcccttggcccactaagcagaagaacaacttttggccttccttttttctcccctcatgattatcttgcgtggaaatttagataggtggaagaaccctctgattgtcttacctgtgtaattagctaccccggtttcgctgacaagcactgagcgaaccaaatgatgtaccgaatggtgtgctcctgctttcacctgttctcttgatcctgtggcacctgatgccaagtgttgtataatacaatgttttgcagtcttgaaaaatgcagtttgttgacct

SEQ ID NO: 13234 - DNA, 1127 bp, Sorghum bicolor
  Clone ID: SORBI-28MAY03-CLUS6869_1
ccactcgccccccccccacccttttcccccacttccgccccgcgcgatctctccccggcccgccatggagatgttctactacctcgtgttcggcgcgctcgccgccatcgtggcggcggccaggcgcaccgctccgcgccaccgatccattcccccccggtctccctccctccggtgagcggcggcgcgggcgcggccatggaggtgttctactacgtcgtgttcggcgcgctagccgccgtcgtggcggggctagagctcggcaagagcggcaaggaccgcgtcgccaccacctccgccttcaactccttcaagaacaactacgtcctcgtctactccctcatgatgtccggggactggctgcagggcccctacgtgtactacctctacagccagtacggcttcgacaagggcgacatcggccgcctcttcatcgccggctttggatcctccatgctcttcggcaccatcgtcggctcgctcgccgacaaacagggccgcaagagggcctgcatcacctactgcatcagctacatcctcagctgcatcaccaagcactcccccgagtacagggtcctcatgatcggccgcattctcggcggcatcgccacctccctactcttctccgccttcgagtcctggctcgtcgccgagcacaacaagagaggctttgacccgcagtggctgtccataacattctccaaagccatcttccttgggaatggcttaattgccattgtatctgggctattcgcgaaccttcttgctgagaacttgggttttggtcctgtggctccatttgatgcggctgcatgctttctagcgattggcatggctatcataatgtcctcatggagtgaaaactatggagatccatctgaaagcaaggacctgatggcccagttcaaggttgcagctaaggcaattgcttcagatgagaagattgcattgctgggagcaatacagtcattgtttgagggctcgatgtacacatttgtcttcctatggactccagcattgagtccaaatgaagaagacattcctcatggttttatatttgctacattcatgttgtcatctatgttgggtagctccattgcgtcacgtctattagcccgaaagctcaa

SEQ ID NO: 13235 - DNA, 1690 bp, Sorghum bicolor
  Clone ID: SORBI-28MAY03-CLUS696_1
gcacgaggctgggactctgggcggggggaggaccggagaactccaactctcgagtctcgaaggctcagcggggtcggaactcaaaagccgacgaggaacaagaggagcccggctccgcacgcgggagcgagaggatcgccggcgcaggatgtggtgcgcgtcgtgcttggcgtccgcctgcgcgggctgcacctgcaacctctgcgcgtcggcggcatcggccgtgtcccgccgctccgcgcgcctcgcctactgcggcctcttcgccgcctcccttatcctctccttcttgctccgccagttcgccgcgccgctcctcaagcatatcccatggataaatgcatttgatcaaacaccaccagaagaatggtttcaaatgaatgctgttcttcgtgtaagcctggggaacttcttgttttttgcaacatttgctctcatgatgattggtgtgaaagaccagaatgatcggcgagatgcatggcaccatggtggctggattgcaaaggttgctgtatgggctgttctcattgttcttatgttctgtgtgccaaacattgttattactatttatgaggtactttcgaagtttggatctggcttctttctcctagtacaggttgtgatgcttttagacttcacaaataattggaatgactcatggattgagaaagaagagcgaaaatgggaaatagctttgctggtagtgactgtggtttgctatctctctacattcgccttctctggtgtgctcttcatgtggtttaatccctccggtcatgactgtggtctcaatgtgttctttattgtcatgacattcatccttgcttttgcatttgcaatagttgctttgcatccccaggtcaatggaagcgttatgcctgcttctgtcatttctgtttactgtgcatacctgtgctacacaagtctctcaagtgaaccggatgactatgagtgcaatgggcttcacaggcattctaagcaggtttcattgggtgctcttatactcgggatgctcacgacggtgctctctgttgtgtactctgcagttcgtgctggatcttcgactacattcctttcgccgccatcatctcctagatctggagccaaaaacccattactcggtgatgaggaggatggcaaaggcgatggcaaagaaagcgaaccgcgccccgtgagctattcctacaccttcttccacctcatcttcgcccttgcaagcatgtattcagccatgctcttgactggctggacgagcgctgcatcagagagatcagagctgatggatgttggatggacaaccgtctgggtgcgcatctgcacagagtgggtcaccgccgcgttgtacatctggaccctcatcgccccactgctcttcccagaccgtgatttctcctaggcaccccgcaccgatagcctatgagttgtttagtattgttagttgcagattgtgaatatgaataagcagaagttgggaattggtagggatctggtattatctgtatgctatctggcttgcctaatgtggtggtagtggttagtacctgtttgtgtggccttgtagaaaatatgtttcggccgagtgttggttgtggattttaaagtcatagctatatgtgacatgaggtcaagttgcggttgactctgtaatgacgacagttatcatttgtaaagaataccgtctattgctcgt

SEQ ID NO: 13236 - DNA, 1795 bp, Sorghum bicolor
  unsure (1)..(1795): unsure at all n locations
  Clone ID: SORBI-28MAY03-CLUS13230_1
gcacgaggcccgcggcccccaccctgtgacccaaccggggcgccggcggtcgtctctctgcacgaggctagatcccagcgccaatcaccacacggcacgccgcctcccacgcgcgcgtgctcctcctcttcctccccttcttctttctttccctccctctttccttccttgctcccttccgggattcggatttggggattgctgtctgtcctgtgcgtgccaagaagaagacgagggggagggagatgggttacattggccaccacggcgtcgccacgctgcggcgctacaagtacagcggcgtcgaccactcgctcgtcgccaagtacatcctccagcccttctggtcccgattcgtcaacatcttcccgctatggttcccaccaaacatgattacactaacaggcttcatgtttctactgacatcagcattccttggctttttatattcaccacatctagatacagcaccccctagatgggttcaccttgctcatggactgcttctcttcctttatcagacttttgatgctgtggatggaaaacaagcaaggcgtaccaactcatcaagtcctctaggcgagctttttgaccacggatgtgatgcgcttgcctgtgcttttgagtccttggcttttggaagcacggcaatgtgtggaaaggctaccttctggttttggttcatttcagctgtcccattttacttcgcaacctgagaacacttttttacaaatacacttattcttcctatagtcaatggaccaactgaaggccttatgctgatctacttgtgccattttttcacctttttcacaggagccaagtggtgggcacaggattttcagaagtcaatgcccctgctgggttgggttccttttatatctgaaatcccggtgtatgacattgtgctatgtcttatgattgcttttgctgtaatcccaacaattgcatctaacattcacaatgtatataaagtcgttgaagcaagaaaaggaagtatggtgctggcactagccatgctctttccttttggtttgctcttggctggagttcttgtctggtcctacttttctccttcagatataatgagaaatcaaccacatttgctaattattggaactggttttgcatttggatttcttgtggggagaatgattctggctcacttatgtgatgaacccaaaggtctcaaaacagggatgtgcatgtcccttgcgtattttccatttgcaattgcaaatgcgctgactgcccggcttgatgatggaaatccccttgttgatgagcagctagttctcctgatgtactgcttatttacagtggctttgtacatgcattttgctacgtctgttattcatgagatcaccaatgcgcttgggattcactgtttcaggatcactacgaaaaaggcatagttctccatccatggaccatgggcatcagcgttgccctggattgtaatcaatcacaagtggtgcctgtcaaacaagcaacttttcatatttatctccattacacatggatgctgcttcccgtatcacgtttgcctcgtccattacggtgatggtgccccctgaaaattcacatcagcatgaagaacttgcagatgagaaaacagtgtatttttgaaacaattagtaacatgttgtatcttaccttgagcatgtgtgctcatgtaatgctcggcaaaaatttttgtggaatttgttgagctctgactgatagtgatatattgcaaattaagaattgctttgtattgttaaaggaaatgttcctcncgtgcattttgtgtgct

SEQ ID NO: 13237 - DNA, 867 bp, Sorghum bicolor
  Clone ID: SORBI-28MAY03-CLUS12036_1
ccggttggggacgacgacgacccacgaacgcaccatcacccgatccccaaagcccggaccccaaccccaaccccgaccctcgaggaaggcgatctcaccggaccggagatggcggcgtcgtcgtcggtggagaagctcaaggccctctgggactcgcaggtcaacgacgaggagcagtgggcgctcaactataagctgctgaaggctgctggtctgtttgcgggatccatcttcctgatgcggaactttggtgatctgatggccatttaagcaggcttagtgttgtttagaagcatagtggtttggcagtcaatatcgtgggattgtgcccctgtggagttactctacttggattctatgagtttgttttggtgttccaagaattcatactatgcataaagaggacgatctggtcattagcctcttggccattgcaaactcaggccgtcaggcgtgatgtagcaatagaaattagatcttgctttaatgtggccctgtatcatgaatattttggaatgatggtatctacctccatatttttcacctattcaaatttaagagcaatgtacagcaaaaagtagtaagctagtatgttcatgctaaacagtatgttgtatacacaatgattgctggtgactacgattctttgttgtggctcggtaggtgttctttagcagaaaaactggattgtaagatgaagaaggtgaagttgtcgttttcaagcatgcaggacagcaggagaactgcaatgtaataaatttgctgatgtctatgctccgctggagctgtactagcttgttttcctcctttatttatttatttatctttttttgttgggaaggtttgaccaagtatggtgcctcgtgc

SEQ ID NO: 13238 - DNA, 452 bp, Sorghum bicolor
  Clone ID: LIB3478-037-P1-K1-G4
gcgcgacgacgccccaccgccgcaccatccccctatcgccatggcttccaccgccaccgctgctgtttctctccgcctcgccttccctctcgtgtccacaccggcctgctcggcgtcgtcctccaatacccttcgcttccctctccgccgccgccgcgcctcccgctcactcgccgtagcggccttcaagaagctctccgaggcgtcccccgtggccatccctgaggagcccacccagcccctggtcgacgaggacgccctgccccctaagcccggggtctacggcgtctacgaccccgccggtgagctgcagttcgtctggatttcgcgcaacgtcagagcgagcgtctagggccaccgccggaaggtccccgccaacctttgcgcctcctgcaaggttgcagtatcagatgaggagacaccagatcgagctgcccttaaacatgcctgga

SEQ ID NO: 13239 - DNA, 1310 bp, Sorghum bicolor
  unsure (1)..(1310): unsure at all n locations
  Clone ID: SORBI-28MAY03-CLUS1325_1
ngtttacagactatgctgacttctgttttaagacctacggtgatcgcgtaaagcactggtttacattcaatgagccaaggatagcagcgctacttggctatgacgtgggatcaaatcctcctcaaaggtgcaccaaatgtgctgctggtgggaattcagcaaccgaaccttatattgttgctcataattttctcttggcacatgctgctgcagttgcaagataccgtacaaaatatcaggctgcccagaagggtaaggttggaattgtcctggacttcaactggtatgaagctcttacaaactcacctgatgaccaagcagcagcccaaagagctagggacttccacattggctggtttgttgatccattgataaatggacattatccacaaataatgcaagatcttgtgaaagagaggctacccaggttcactcctgagcaagctaaattggtcaagggctcggcagactacattggtatcaatgaatacacatccagctacatgaagggacagaaactgctccagcagacgcccagtagctactctgccgattggcaggtccaatatgtttttgcacgcaatggcaaaccaattggaccaaaggcgaattctaattggctttacatcgtcccgacggggatgtatggatgtgtgaactacctcaaggagaagtatgggaatccaactgtctacattaccgagaatggaatggatcagcctggaaacttgacccgtgaccagtacctgcgcgatgccacaagggtgcggttctacagaagctacattggccagctgaaaaaagccatagatcagggcgcaaacgtggctggctacttcgcctggtctctccttgacaacttcgagtggctgtcaggatactcgtccaagtttggcatcgtctacgttgacttcaatacgctcgaacggcaccccaaggcgtcggcctactggttcagggacatgcttcagaagcattgagatctctagggccaccgagcctgaaggtagtactattttgttcagctttgcctcgtgttttggattgcccaatggttcaaatccagccttgtgcttggctagcaaaatgggagtaaaagagagccactccgatgaattgtgcattccgagttatggtcagaatgttgtgagtttgtgagtatgttctctgtggcgtttgagatgtggttattttatcgtgttgattgatcttatttgaaatgcttagtcaggaacgtgacatctccgagggttttttacccctgaactacctcaaggagaagtatgggaatccaactgtctacattaccg

SEQ ID NO: 13240 - DNA, 1123 bp, Sorghum bicolor
  Clone ID: SORBI-28MAY03-CLUS13515_1
gcacgaggcacacgcacgtcgtcctacaacctttctccctcctccaactgtctaccatttcttcccacggcaaaacacacctcgccggcgcgcttggcaatggcgtaccgtgtcctggaggtcacccttgtctcggcaaatgacctcaagaaactgtcggtcttctcccggccgcgcatctacgccgtggcttccatttccgggctcgacctccgcatgcctagccacagcacccaggcagaccagaccaacggttgcaaccccgcctggaacgccgtggcacacttccccatcccggctgccattgacacccgcggcctcgcgctccacgtgaggctctgcgcccagcgtgtgtacctgggcgaccgcgacatcggcgaggtgttcgtgcccatcgacgacctcctggccggcgccgacaagggaggtgatccgaggcccgtgagctaccaggtgcgcaggccgcactctggccgcgcccacggcgtcctctacttctgctataagttcaccgacgtccccgccgtggcgtgtgtcccggaaccggaaggcaaacaaggccagtacgccaagtacgtgctggactccgtgaacacgacggacaagacgatggtgccgcccaccgcgtacccaccgtcggccatgccgtctacgtacccaccgccggccatgtcgcctgcgtaccctccgccgcaatatggctcgccgtacccggcctacccgccgcagccttacgcgtacgctgctccgccaccgtacgggtacaatgcggctaccccacaaccggcgatgtacggctacgccgcgcagccggtggctgcacccgcgagccatggcggaggcatggggatggggcttggcctagggctcctaggcggtgctgtcggagggatgatgcttggagaggcgatcggtgactatgaggccgacgccgcctatgatgcagggttcaacgatgcgttggcattttagatcttgccgtgcagtgatggagattattgtccttgtaaatctctaattcatacgaaacgatgaaatagaatttgcaagttttgcttctcttctcaaaaaaaaaaaaaaaaaaaaaaaagaactagttctagatcgcgagctagaactagtc

SEQ ID NO: 13241 - DNA, 266 bp, Sorghum bicolor
  Clone ID: LIB3480-005-P1-K1-A9
ctaacagcctgcgtgcgtgcctgcggcgtcgaccgcgccgtgctgggcctccccatcgccagcgccatggccgagggcaatggcctaccgtgtcctggaggtcaccctggtctcggcaaatgacctcaagaaactgtcggtcttctcccggccgcgcatctacgccgtggcttccatttccgggctcgacctccgcatgcctagccacagcacccaggcagaccagaccaacggttgcaaccccgcctggaacgccgtggcacact

SEQ ID NO: 13242 - DNA, 1505 bp, Sorghum bicolor
  Clone ID: SORBI-28MAY03-CLUS14725_1
atccccccctcttcctcttcgtctccgtccgctccgcccctttcccccttctcgtcgtcgcaaccgccgcccatccggggcttggattggccttcccccgctgctcctgctggtaggtggatgagcccttgactgcccagcgcccgcccgcccgccttcttgcagcagcaatggacgacggggacctggatttctccaacccggacacgtacctgtgcccggcgctcggcaccgacccgcccagcagctgctccatggacagctacttcgacgagatcctcaaggacacggagcaccacgcgtgcacgcacacccacacctgcaacccgcccgtgcacgacctctcgcacacccacacctgcgtccacgtccacaccaagatcgtcgccgcctcgcccggcgacgacgccgccgagtcgccgtccgagaacaacaccaacaccaccggtaacagcaacgccgcctccaagaagcgcccctcggggaaccgcgccgccgtcaggaagtaccgggagaagaagaaggcccacaccgcgtcgctcgaggaggaggtggtccacctccgggcgctcaaccagcagctcatgaagaagctccagagccacgccacgctcgaggcggaggtggccaggctccgctgcctgctcgtcgacatcaggggcaggatcgagggggagattggcgcctttccctatcagaggccgccggtcaagaacgtcgacctcgtgtctagtgttgaccagggaagcttcctcggtggtgccggcaccgcccaggttaccaacgcctgcgatttcagatgcaaggatcagatgtattgcaaccctgggatgcagggcgctatcagtggtcaggtgttgggacaaggcgcctgtgatgtcgcgagtatccagtgcattggaagtaacaagtctggatccactaagctacctgtctgtgggggaatggatacagtacctgctgtctgcttgccaaatgttgaaaacaagtgatggactcctgacagtgtttatggcctctccttttcggagactgctggggcttcccgttctgcctcaaaaggaacgctgtataaactgctagctcttctatgtaggaccgcactggttcaaactgctatgtgtgtgagttcgtcgcccatgatgcttctatggtgcctgaggcgattcaagtttgttagctctagagctgacaagacatccttgtttattttccttagttcccagatgctttctgatcaagtgcagaactggaccggatctgaaggagtcgaacatgaactggttaaaaattggcatatgtggtctaagacgctcagatttttgtagagaatctcaagtttaatgtaaaccctgttgcccatgtagatgcatcgttcctgaaatccctttgtgggtgccatgtctctctgctgctgtgtgcgtgatctgagggaacctggattcgtttattgtttgaatgttttactatttcattcgcaaataaataatttgttgcattgatgg

SEQ ID NO: 13243 - DNA, 985 bp, Sorghum bicolor
  Clone ID: SORBI-28MAY03-CLUS14811_1
gccggccgggccggccggccggtccgggagtctatctatctcattcccaaattttcctcatcggcttcgcttcccccaaatcgaatccccatcgctctgctccatccatggcaactctcaccatgcagccgatcggtcccacccccgccccggctgcgcaggaagaccagaggaacggggagaatcttcctaccgtggatgctaccgatttgagtgacatcgactcgggttgggttatcctcaagaactcggatattgtttccgcggatttggcagccgccgccgtcagtggaggtcagcgtctaggctcttcaacgattcctagctgggcacggtgggttctgggaggtgtggtgtacacggtcgtgccgttctacaacagagttaggcatctcgaagacgagaccgtggggttcgtggagaatgctgtggaggttgtggagcatatagctgaagtaacagagaagctagctgcgaatgtggctaagcaacttcctgaagatgggtctctgcagaaagcagcagaggatgttgagcacattgctgaggtggtggatgatgatgcagagaagtttgaagcagtcgctgaaaagatcgacaaggtctgtgatgagattgatgctgctgtggagccagtcatcgaggagcttgaaaaggaacttgatcagagtacaacgtctgagaaaggagttgacacaaagaattgatcaacatcatgttaggggtactcctcattgtatatagcgtctgtactattgtttttcttctctcctctttggaaaaactgcttgtacatatgtatggtgttgtatgaactgcacttgcaagatgcaacccaccatgatcatagtaaggcatggagattgtgtgcttgggtgctcgtagatgaagaaccgaagactgtttgatgttgaaagaattatttgtactctatcaagtcattatgcataaataaatacatattggttcgcatttgtttctctgt

SEQ ID NO: 13244 - DNA, 1488 bp, Sorghum bicolor
  Clone ID: SORBI-28MAY03-CLUS14852_1
ctactggctccccctgtccgctgtccccaacccctctctctctctctatagagtagacccaggaaagagggaagaggcgatggatatggccatcgacacgccatcgccggcgccgccacccacgccgccggcgccttcggcggcggcggggcggcagacgcgtgcggcggaggcggtgcgtctggagcaccagctggtgcgcgtgcctctcgagtccctccgcgccaccgtccgctcgaaccaccgcctcgccgagaaggagatcgccgccgtcctctcctccgcctccgcggcccccgctgagagcagcgccgccgccgtcgaccacctcacctccctcgtctcccgcctccacggcctcaagcgcaagatggaagagggcgcacgggtggaggagctgcaggtgcagcgctgccgggcgcgtctggatcggctggcgactgccagcaccggtgacgatgctgagtgggaggacattcggctgaagaggatcctggtcgattacatgcttcggagctcctgctacgattccgccaccaagctcgctgagacttctggtattcaggaactcgttgatattgatgtcttcctggatgcgaaaagagtaattgattctcttcagaataatgaagttgctcctgctttagcttggtgtgcagaaaacaagtcccgactaaagaaatcgaagagtaagctcgagtttttactgaggcttcaagaatttgtggaatttgtcaaggctaagaattgcattcaggctatagcatatgctcgaaaacaccttgctccctggggcaatatgcacatgaaagaattgcagcgtgttacagcaacattggtttttagaagcaatactaattgtactccatacaagatattgtttgagcaagagcgctgggactatcttgttgacattttcaagcaagacttttgcaagttgtatggcatgaccctagagccgttgctgaacatatacctgcaagcaggcctgacagctctgaagaccccattctgcactgagggtagctgccctagggaagaccccttgtccctggagggcttcaggaaactagccgagcctctgcccttctctaagcaacaccactcgaagctcgtctgttacatcaccaaggagctcatggacactgagaacccacctcgggttctgccgaacggctatgtctacagtgagaaggcgcttcaagagatgtccaagaaaaatgacgggaagattacatgccccaggacaggagatgtttgcgacttctcagagtgtgtcagggctttcatctcctaatcatgaaatacactctgatttgtgtggcttgggagtctggagtgaatgtacatagagtggtcagcgcattgtgcgtcatgttaagttaattgaattaacctgcaatgttaaactggctggatgttggaagtatctcatctgcctctcgattgttgcaactgtgttctgtgagactgacgtttttcatttcc

SEQ ID NO: 13245 - DNA, 924 bp, Sorghum bicolor
  Clone ID: SORBI-28MAY03-CLUS7470_1
gcccgaggagggcgcccggccccgtctccggggcccacgagacgggggagggaggaggccaaggacgcagccgcgaagccaagcccacccgatccagtccctgccgccctgccccagctcgtctctcaggtcgccgtgccactgccagtcccgcgagcagctcagattcacgagctcgtctcctagatcttgcgccgtttggctgaattctgttctttgggagcaaagaggtgctggttggcggcgttgtttggtgctttgggggcggcgagtttttgcgttctcccgctgtgcttgtgttgctgctgcggcggggtggagatgggggtggcgggggagaagttccactgggggacggggggggcgctcagcctctcggtggtgtcctccgtctccctcgtcatctgcaacaaggctctcatgagctccctcggcttcaacttcgccactactttgacaagctcgcttctcctcgtcacgttttgttctctccatgtggcattatgtatgaagctctttgagcacacaccctgcgcccctcgggccgccttggggttgggggtcctcgagcgcatgccgttcggtcctcgtaccgtcaggcggggtggcgttcctgttggtttctatcaggtatacatcccctttttatttctctagttatttgtattcatccgaacttaaggtttattggatgatctggcactaatttcttattcggccccataacatgatgtactgtaatcagtaaaggtatgtcaggatgggccaaaaacgccctagaaacatggtttcagtttgacactaataatgccactccatctcgcatctaatcactccaccaaactcataacgaaatattgtgtatgttcagatgacaaagctggctattattccctgtactgttatattggagacccttttctt

SEQ ID NO: 13246 - DNA, 414 bp, Sorghum bicolor
  unsure (1)..(414): unsure at all n locations
  Clone ID: LIB3476-034-P1-K1-G8
cacgtattgttctctccatgtggcattatgtatgaagctctntgagcacaaacctttcgatgcaaggaccgtcatgggatttggagtgctcaatggcatatcgattggacttcttaacttgagtctgggtttcaattctgttggtttctatcagatgacaaagctggctattattccctgtactgttatattggagacccttttcttcaagaagaaatttagtcggaatatcaaactctcccttagcgtgctccttgttggtgttggtgttgcaactgtaactgatctgcaactcaacactgtgggatctgtactgtcactgctggcaatcatcacaacctgtattgctcagattatgacaaatacaatacagaagaagttcaaggtatcttcaacgcagcttctgtaccaatc

SEQ ID NO: 13247 - DNA, 895 bp, Sorghum bicolor
  Clone ID: SORBI-28MAY03-CLUS8132_1
gcacgaggctccccaattccttgccccgcttcgtcggtcgtcgcctgccccagagagcaggagccgcctcgtccctcccggccccgcccccgccccccgatcccgtgcgtcgccatgaatcccgagtacgactaccttttcaagctgctcctcatcggggactcaggtgttgggaagtcttgcctgctgctgaggtttgcggatgattcatacctggagagctacatcagtactattggagttgattttaaaatccgcaccgttgagcacgaggggaagacaataaagctgcagatttgggatactgctggccaagagcgctttaggaccatcacaagcagctactatcgtggagctcatggcattattgtcgtgtatgatgtaactgaccaggagagctttaacaatgtcaagcagtggctgaatgaaattgacaggtatgccagtgaaaatgtgaacaagcttttggtggggaacaagtgtgatctggctgagaacagagtagtttcttatgaggctggcaaggcccttgctgatgagatcggaatacccttccttgagactagtgccaaggatgcaacaaatgtggagaaggcattcatgaccatggcaggggagataaagaacaggatggcaagtcaaccggctgcaagtggtgctagcaggcctgcaactgtgcaaatgcggggtcagcctgtttctcagcaaagcagctgctgctcttgattgtctatctagatcacaatagtgtgattgtgcagcaagcaaaacttaaattggttgctctatccctgtacattaagcctatcactatccaaaaaaactcagtgttatctgtcggatattggaagtctgtctactgactgcaacgcttaagcagattatgggcctgttt

SEQ ID NO: 13248 - DNA, 1225 bp, Sorghum bicolor
  Clone ID: SORBI-28MAY03-CLUS9035_1
cgcggcgcaccacgaactcttctttcttcgccgtcgccccaccgctaccgctcggactaccaccaccgctccacacctcccgtcgcgccgccgagcgacggcggcatccgcctcctccggtccgtcccgccacccgcgccgtctcgcctctgccctgcctccctccgtcgttcctggccgccgggcttcttctccgtcgtcggcgacgcgcgtgagaaggaaggaggagccgcagcacgtggatccagggcagcggcgtccgtcccgcgtgagaagagagaaggaaccgaaagatgattaatcttttcaaaataaagggtcaaaagaaagaagaggcagcaagtgctgctggaaaggccccggttaagaaacagtctgctggggagctccgtcttcataaagatattagtgagctcaacctgccgaagaccacatcaatttcttttcccaatggcaaggatgatcttatgaattttgagatcatcatccgacctgatgaaggatactacatgggaggcacttttgttttcacctttcaagtgtccccatcttatcctcatgatcctccaaaggtcaaatgcaagaccaaggtgtaccatccaaatattgatttggaaggcaatgtctgtctgaacattctgcgcgaagattggaagcctgttctcaacatcaacactgttatttatggcctgaatcttctttttacgcaaccaaacgacgaggatcctttgaaccatgaagctgcagttgtccttcgtgacaacccaaagatgtttgaggcaaatgtgaaaagagccatggctggaggctacgtaggccaacactatttccaaagatgtgcttgacttgatgtgatggcttcaaaacgatttcagtggcgccttatgccatcgggcccctgtatcagcaccagggcgcccagctttgctggatttgtgtggttttagtgcgcggaaaagtgcttctggaagcaaagtccaaatagttcatggtgtgatactgtgacgtatctgtttgcccgtctttgtgatgtgtttaaaaccggtaaagtaaatttggtgatatggtagtggcacatatgacaagcaaatgcttctcaaaactgtatcactcgataaatcctaaacggggaatgggaagtggattatataaagaagaattgcttcttttccagacgaagcaaaaaaaaaaaaaaaaaggccccgagactagttctccctcgtgc

SEQ ID NO: 13249 - DNA, 2010 bp, Sorghum bicolor
  Clone ID: SORBI-28MAY03-CLUS8942_1
gcacgaggctccccctaaacacctctccttcttgtagacggcagatctccggggggtcgccgtctccggccacggcggccggcactcggagtagcggtggaactaggggcggaggtcggcggccatgtacaagaaccagctgcaggagctggcgcagcggagctgcttcaacctgccggcttacacgtgcctgcgggaggggcccgaccatgcgccgcggttcaaggcggcggtgaacttcgcccgggggcagttcgagagtcccgggttcttcaccacgctccgccaggcagagcacgccgccgcggaggttgccctcgccgcgctcgcgcgacgcggcccgtcctactcgctcgccgcccgcatcctggacgaaacaggggtttataaaaaccttctgcaggaagtagctcaaagagttggggcgccattaccattgtatacaacagagcgatctggccttggccacctaccggttttcacatgcacagtagagctagctggtattacatttacaggtgatcctgctaagaataagaaacaggctgaaaaaaatgctgcttcagctgcatggtcagcactgaaacaattggtacgcgaggaagtgaattcatccaatgagccagaaaacaatgatgagcaggagcagatcaggattgcccgagccctcctcaattatcgcttgaaggagaagatggcgatggccaattatcctcatgtttcaccattccctaagaaatttcccatgcagccagagaggaagccttcttttggtcaatcttctcagtccagctactcgaagattctccctctattccgccctaaatctaattcaagatccagaccagagtccctagcatctactgatggtgtatcacaaattcctagtcgggccatggatagcctcactccaagtccaaggtcaagatttccagctgcagaggcagccccctatgtgccagttgggcactaccgtatgccttgccacagcatggctccttcagtcacaattaggactgcagttcctgtgttctctgctccacctctcccatctccgtctgcacgcccgcagcagcttcctccactcatgagccacccaccaccgattcggatggcatccccagttcgcatgaggccatcctctccaatgtttgcctcctcggctgctgttcaagggccgaaacctgtgatgcctattcagttaaagaatgtgcaagatcaatcaaggaaggaaacagctccatctgcgatccctgttcaggtaaaagatgtgcaataccaaccaaggaagagctcaatgtctcctgtgattcctgtctcggtaaaggatgcacaacgccagcctcttgtgggatcactatcaactgcaatcccagttcagatgaaggatatgcaaacccaaaccccaaaggaatcactatcaactgcaatcccagttcagatgaaggacgtgcaaacccaagccccaaaggaatcactgtcagctccaattccagcaatcaggccttctttagttaagattgatttgcctgctcaaggcaaggaagcttcagctagtgctaccagcgaagtgccatcttctgctactggcaataatgctgctgtggaatgcactgcatcatcagatgctctcttggcaagacaatcaagggctgcggatggggacaaggataaggcggaagctaagcacgaggccgaggctcaagcagttgcagaggcagccatcaggcagctggagatcaattgacttaagaaaatgtgcgccgccatcttctccaagattttgtaattagctgcctcccgtgcacattccattctgtttagttcttgtatgtcttggggttcggattagggctgtctgggcaggctgcgttgtggtaggaacacctagtttttctgttgagaaaaaaacaaaaaaaaaacatgaagtggtggtaggtggtttgcccagtgtttagttggagacgattatcttcttccctggatatgcagttggtctgcttttacccc

SEQ ID NO: 13250 - DNA, 1022 bp, Sorghum bicolor
  Clone ID: SORBI-28MAY03-CLUS6217_1
gcaccacgcggccttcttccctcctccttctctctctctctctctctctctctctctcgctaccctctcgctcccagacgactgttgggccgccgccgcctacgcctaggccaggtgctgaggctttccttggtctcttcgccggcgacgagcacccaccaggggttaaggtttggatggcaagaattatacaatgctctcgattccatcctcagaatgtatgaagaaatagtccgtaatatatcattgcaattaccaagaactggaaatggacgatgacaatgggcttgagcttagtttgggcctatctttgggcgggtcatcagggaaggccaaggctagagatgcacctctagaaccaaaagcagaaccccaagtggaagaaagcagtagtaaaggcggttcacaaactcctgatgctccttttgggaaattttatcaaaagagcgctgaaaaccaagaacaaaatagtaaacagaggcacagccctgttgcacaacagtttggaaacttctggggacaaccagggagttcctctggtccagtggtagacggatctattgaaccagtgagccatcagccccagctttccagttatcaagatggaaggatgccaaataacagtggaaacaattctgaggagcagaagccagtctcgagtaaccgcaagctttctgaagagatgaactttcagaagaagcatcagacagctagtgaccagcctgatgcattcagtaagagctctgatggaggtgcaaaaaatgcacctatctcaattagcacggatgatggttcaactggtgaaaatgaggatgttgccgagtcagaagcagaaggctcaaattcttggttggttgcacagcgtgaagacagtgctaagggctctgttgttaacaagggatcggataggaaaagatccgcagatgatgctgcagttggttttcaaggaaagaggcaaccaagtttctcaggaagtgagtccagctctggaaagctgacacctgggaatccgttatcgatgc

SEQ ID NO: 13251 - DNA, 676 bp, Sorghum bicolor
  Clone ID: SORBI-28MAY03-CLUS6380_1
gcacgaggcgcagaagcaaacagcacctgcatcacacgagcagcgagcgtgtgttggagatgagaggactcctggtgctcgccctgctggtcgcggccgccgcgtgcctcgtggcggtgcgcggcgcggacggcgcgggcgagtgcggggcgacgccgccggacaggatggcgctgaagctggcgccgtgcgcgtcggcggcgcagaacccgagctccgcgccatccagctcctgctgcagcgcggtgcacagcatcgggaagcagagccccaagtgcctctgcgccgtcatgctgtccaagaccgccaagagcgccgggatcaaggccgaggtcgccatcaccatccccaaacgctgcaacctcgtcgaccgccccatcggctacaagtgcggagattacactctgccatgagctttgagagcttacttgagcaccagtgcatgatccgtcggagttagcacgacgtctgtgggaagtgacggtgactgtgtcagtgtgtgtgtgtgtgttgccagtaaacgagacttgtgattaccatacatgtggaactccagtatgatacgggtgtctcagtctcactagatacgtgtgtacttgtactctcttgtagtcagagtcaggatgttccagagatgctgtcctgcatcctccaaataaaacttgttgtcttggac

SEQ ID NO: 13252 - DNA, 1013 bp, Sorghum bicolor
  Clone ID: SORBI-28MAY03-CLUS6526_1
ggtcagctcatcgcgcacgcgtccacgcgccaacagcgcgacgcaaccgaccccaccgccccctttacgcgaagcttcaccgcggaatctaaaactcgccgctgatccgcgagtcgtcctcttcgtcttcgctcggcgatcaatcgaagagtggggagggagagatggcggagaatccgcagctgtttgggaacgggatgccggtgccgttctacggcgagatgttcgtcctcgcccgggacggcgtcgagttccacgtcgacaagatcccgtcagctcctggcggtcatgtgaaaacaaaaggcacaatttacctgtctaatataaggatggtggtttgttgccaacaagcctgttggcaacttctttgcttttgatatgccactgttgtttgtgcacggtgagaagttcaaccagcccatatttcactgcaacaacatctctggattcgttgaaccagttgttccagacaatcagaacagggccctgtactcaactcacaccttcaagatcttgttcaaggacggcgggtgtggtacttttgttcctctcttcctgaacctggttgcatctgtgcggcgctacaaccaatttgaagcccagtctgctgctaacatggcaccgcgtgtggaccctctgcaagctgcgcagactcctgttgatgacatgatgcgtcatgcgtacgttgacccaaatgatcctaccaagattttccttcagcaacctgcgccagaatcccagctgaggaggagaaactacagcggcccagctgatgcgaattagcgcttggttggattggcaaaactcatgctcaattaactgttgtgtccatttgagcatctcacctacccctgccgtttatcacaactgacttgcatatttgggtgtccccgtgtctagtgaccttacatcgtacataatgttgtgagttctctcaataagtgatgtacataagcagaggcgtgttcaaatattattgctggagtgatatagttgctgcttggtctattgga

SEQ ID NO: 13253 - DNA, 985 bp, Sorghum bicolor
  Clone ID: SORBI-28MAY03-CLUS6549_1
gggcacgaggatcgaggactgtatattgttctaaccaggggaggcgggttacgggagatgatgtaaagggtttcttcaagcaatcctgcgtgaaggtttctcgctatgtcctcgacattgatcatgatgtcaccgcatgcaagctcgctgttgtgttttctgaattaagtaaagtggtggcttgtgctgtttgtggtgacccccattctgattttagttaatcgtcgattgagtacataataagagggcctaggagtgagagttatgtgaatcaagggaaccaagatatctattatcctgttagagttttgccttctaaaacagcaattctacctgttaatcctaaatttcttcctcgaactgaagacgagaaagaaatggtatcgaggactgtatattgtactaacatagacaagaaggttacagaggatgatgtaaagggtttcttccagcaatcatgcggaaaggtttctcggctgaggctccttggtgactatgtacactccacatgcattgcttttgttgagtttgctgaagctgaaagtgcaattatggccttgaacttcagtggtgtggtccttggtttactccctatcagggtgagcccttccaagacaccagtacgtccgcggtctcctcgtgtgatgtccaactgagcccgattcaagccgccgtcacccttgaggctgccaccaatggcaaatcatcccaggcagagcttcttctagctatgagcgccctagaacccttgcttcgtggatcagtgacgtcgtcgccgtcgtcccgagagtgtcccagtacctaagtcagtcataggaaaccaacttgctgctgctaatgttcttcggtctttcacagacccatgcaccatttcccttgttttttttctcatccccacttatatgttaattatgtatggattcgtctataactgcctttctcgggcattggaagaagaatgaataacattggtatttgttttcca

SEQ ID NO: 13254 - DNA, 2029 bp, Sorghum bicolor
  Clone ID: SORBI-28MAY03-CLUS6631_1
ctggatgtctcttcgatcagttgtcgtcggcgccgcgatgcgatcaatcatggagctgtctgaaactctgaatttcccaacacctctttttttatccagtgttctactagtatctctaatgcttcaaaacatgcagccctgacgacgccgatgattctgccatatccctttttttttctcaggggagggcacgcagcgcgtagaggctatctgctcatctgatgcgaccgatctttgggcacgccgacgaacgatggacgcgtcgagttccctcgtgctggtcatgttgaccctccattctgccatgaccgccgcggatctgccggcggcgcagccgagccatcggaggctactacttcagcaggacaccacaaatctcgccgcgctgcctctgcctgcgaacgttcatggcgtcccagtcgacgctcatgtcccgtctcatggaaccggctcttttccggcggcgtctcccagtcgacacggggggcagaacgatccgagcgaggcggcaccaacgacgccggcggcttatttgtcgagatctatgaggtggctctacatggttgttcttccggcgcttgccctgctgttgcttgctggactagcgtgctggcttctttgtcgtaagagtgcggttgcgaccattggcccttggaagactggactcagtggccagctgccgcgagcctttgctacaggagtaccaaagttgcagcgttcagagctggaacgtgcctgtgaggacttcagtaacatcgtggcgagctacccacactacaccgtctacaagggaactttgtcaactggggttgagatcgccgtggtgtccactatgattacatcgagcaaggagtggtcagagcattcagagacctgcttcaggagaaagatagacaccctgtcgcgaataaaccacaagaacttcatcaatctgcttggcttctgtgaggaggaggaacctttcaccaggatgatggtgctcgagtacgcgccgaatgggacacttcatgagagtcttcatgctgaggattttgagcacatcgcttggcgaggtaggatgcggattatcatgggactagcatactgcatccagcacatgcatgagctcagccctcctgtggtgcaccctgatcttcagtccagttccatactgctatctgaagatggtgctgcaaagatagcggacatgagcgtttggcatgaagtgatttctgaagccaaaacggcgacgaatggcgagctcgaccatcaccaagaacaggtgtccgctgggttagcagggaatgtacatagcttcggtgttctactgcttgaaatcatctcagggaaacttccatttccataccccggacacgagcgctccctcgtgagctcggctctggagtgcatagccaacgatgaccggagtatagcctccttgctggatccaacactgtgcgatcacattcacagggaagatgagctagcagtcatcggcgaggtgatccgtgcctgcatccagagcgatcccagaaacagaccgagcatgagggaggtcgctgccaggctgagagaagccatcggtatctcgccggtcgctgcgacgccgaggctgtctccgctctggtgggccgagctggaggtgctttcgaccgcggaaggaagctaacttggcaagacgggatgcccctgcaggctgtgtcgctgtgcatactgctgctatgcaacctttgtgcatcgcccagcatcgtcaacgtaactggacaactgcatatatatatatatatctcctgctgtaaatgtgaaactgcaggaatagtactagtaatcctcgtgaaccgacgatttctaccacccgttgcattgcaccatcatgtgtctgaaactctgaaggtgctggtgttctggcaagatatacacgtatcctccgcttttgaggttcctgggacaggaacgagacacgcgaggacgaaacaaagattctactaatgacacgcgccggccgatcgccatggccggcagccaggcaaataaaacctccattattgat

SEQ ID NO: 13255 - DNA, 695 bp, Sorghum bicolor
  Clone ID: SORBI-28MAY03-CLUS66942_1
tccggggctccaaggtgccagcggaggcgctggcggcgatcgacaggagcgagatgagcgacgtcctcgccgcgccgctgcggttccggtcgccgctctcgctggccaccgcgagcatcgccaggggcaacgtgtgcgtggccggcgacgcgctgcacccgatgacgccggacctcggccagggcggctgctcggcgctggaggacggcgtcgtccttgcccgatgcctcggcgacgccctgctgctgcctgatggcaagggcaaggaggaggagcggatcgaggcggccttgcgtgagtacgcctggatcaggcggtggaggagcgtcgagctcgtcgcgaccgcctacgctgtcggcttcatccagcagagtgacagcgccgtcgtcagcttcctgcgggacaggttcctgtcgggagtgctcgcgcgaaggcttgtgagaatggcggactacgactgcggcacgctcgcaaattagccccactactgtttcgtgtgtgtagatgttgtgcttgctgcaggagcacgcctaccgttatgtgttactagtagaaatctgtaaaacaatagacatagcatgtcgtgatgatttagtgatcttccgacgtgatatcaaggtgaaccatatctatttgagcatctccaacagtttgctaaaagtcgtttgccatattttgagttttgacaacttgct

SEQ ID NO: 13256 - DNA, 787 bp, Sorghum bicolor
  Clone ID: SORBI-28MAY03-CLUS6885_1
gcacgaggggacgctcgaggtagagacgtacgtgacagcgaggaggaaggaagaaaggcagggatcgacatgtcgaggcccaacaggagcgacgcgcacctctccgccgaggacgaggcgacgctggaggccgaggtgcgggggtactacgacgacgcggcgcccaagcgccacaccaagccctcccgcagcgagcactccgccgtgtacgccgacgcgctcgtcccggacgccggcggcaacacccctccggagctcgacaagttccaggagctcgaagcccacaccgagaggttggtgtacgacggcggcaatgtcggagaggagttcgtggagacggagtactacaaggacctcggcggcgtcggcaagcagcaccacacgaccggaacgggcttcatcaagattgacaaagctaagggcgcctcgttcaaattgtctgaagaccccagtgcagaggagcgccatgcttcttgcaagggaaaccctgctaccaatgagtggatcccgtcagctgacacggtgtacccggcgtcagacaagccgagcagaagcgacagctgagcaattcaggcgagtgctttccaccatcagaataaggaaccacactggttgtccacggatcaagaatgcccgtatctttactattctgtgtcgaaattcttgtaatctttacttggaaaaaaaaacgagctatgcactagatttcttgttctggctgtaaatggcaaggaataaagttgtaatcgtggttcagcagtcaatcaatttcctgtgttatatcgtt

SEQ ID NO: 13257 - DNA, 1745 bp, Sorghum bicolor
  Clone ID: SORBI-28MAY03-CLUS6890_1
gcacgaggtgaattcatgaataagatgcagcaagagcgtgctagttggctaagcaggatacaacaagaaagagaagatctgaagaaagacattgatatccagagaatagagttactgaattctgcaaaggcaaggcagatggaaatagattcatatttaagggaaaaagaagaggagtttgagcagaaaaaatctaaggaactcgagtacatcaattctgaaaaggaagctatcaactcaaaactagaacatgccaggcttgaattgcaaaaacttgaggaagagaggaaaggggctatgctggagcgagagaggagagagcaagagctgtctgaaataaagaacactataaacgcgcttaatgagcaacgcgagaagttgcaggagcaaagaaaactgcttcattcagaccgagaatcaattacactgcaaagcccgcggcttaatgagttagaagagctgaagattgaatctgagaacaagcaactgtctttgagacagtgtgggaaatcaaagaatggtggtgtggaaaacctgaaagagaatggtgttcacctgtctcctgatgaggatcaaaatgctagtccaaaacaaactagtgtaaagaaattggaagtgtccccttcagtctccacaccaatttcttgggtcagaaaatgtgctcaggtgttcattttcaaacgctctccagagaagagtgctgatccccacaatgatagattggtacctgcaaacccacgcgtccccattgactctagcttagctgctgcctattcagatggattatttgctcatcagctggaaaatggtgctgggaaagtaccacaaactgttgatggcctgaaagttgggaaaaagaggcttaataatgcactctctcatggtgactctgaaatttcacagccaaaacgaaagcagcaaaggagcactactcagactttgagagtgattggaggagaaattgattccaactgcagtttatcaattctagaagaaaaatgttcaaagaatgaacatgacacagtcccagttggtttgtgtgggaagggaccacataatacccaagcaggagaactgccttcatctgatgatgtacccttagtaaatgggaaatcagatgcttcagaggtacctgaagacgacgagcattcagaggatatttcagtgtctgcagctgacccctccaacagacatggtgttgtggactccgtggacaagcatgaaccagatgaggactctgatgatgaaggcgaggaggaggagaagacgtcatcagcaaagaagatttggcgttttctcatcacatgattatattcgtcgtataataaataacacggctaactgtaggctgacagttacctttcctatgatgatactccgtatgtcgtattgtgagcagctgcccctttggcattcaaagctctactagttccattggctttgtttgtgctctaccttctggtttgtagaggaagaaggtactggtttggttgtgtgctttaggtgttgtgagcagcgcggtggttttggaaggcgctgtggactggggttccccatatgtttctttttctgttttcttgccctcagcaaaacttgtaaagtggttgacagtttccaggttggtgtaaaaatgatgggtcgtcgcaaacatgcatggttggtaccattggccagaagtgttagtccttgcgtttctgttgcttgtttgaaatgttccagtgactgcttctatcgatttgaatcca

SEQ ID NO: 13258 - DNA, 712 bp, Sorghum bicolor
  Clone ID: SORBI-28MAY03-CLUS9723_1
tactggagaaattccccacacgcgcccacctctcctctagtcctctctccccacccacacccgacctctgcgtccgtgcgttgtgtttgttagggaggggcggcaaccgcgaggcgcaagcaatggcggccgggcgagagctggtggtgagtttcggcgagatgctgatagacttcgtgccgaccgtggcgggggtctcgctggcggaggcgccggcgttcctcaaggcgcccgggggcgcgcccgccaacgtcgccatcgccgtctcgcgcctcggcggcggggccgccttcgtcggcaagctcggcgacgacgagttcggccgcatgctcgccgccatcctccgcgacaacggcgtcgacgacggcggcgtcgtcttcgacgccggcgcgcgcaccgcgctcgccttcgtcaccctccgcgcggacggcgagcgcgagttcatgttctaccgcaaccccagcgccgacatgctcctcaccgccgacgagctcaacgtcgagctcatcaagagggctgcggtctttcactacggatcaataagcttgattgctgagccttgccggacggcacatctccgtgccatggagattgccaaagaggccggtgcactgctctcttatgacccaaacctgagggaggcgctatggccatcccgtgaggaggcccgcacccagatcttgagcatttgtgaccaggcagacattgtcaa

SEQ ID NO: 13259 - DNA, 1736 bp, Sorghum bicolor
  Clone ID: SORBI-28MAY03-CLUS9086_1
ccgggaacctcttaatgtaagctatccatgcatcatctcaagttttttttttgaacaagcaagacatcaacatcatcttccactaatagtcatgccatgccactaacttccaacatcttaatgcaaattatccacaacatctcatgatctatctcaatatgcaagacatacttgctctccgtatagcttctagtagttgtcctgggaagagaggaaagagaagcaaaggaagtcgccaggcggccacaggcgtgtttctggactactttgcccttgctatatcatatttaagggcctgtttggacttcccctccgacgcggcggcgctgctctgcccctactcccacgtgcccggcttcatggccaccgtctgcgtggcgctcctccagcgccccctcctcgcagcccccgcccgacgagcgcagccgcttgctctctcgccgcgcaaccacctgcctccggaccaagcggaacaacagtaggttatgtcatctctctccctcatttctctctctcacctacaccatgcgtacatggtacaccgacatagccagccacgctctgcaacagagctgagcttcatgtaggcagtcactcgtgaagcgattctctcataacaacggattgactagttaagttgagcctctcctatcacgcgctacttacacgaatataacgacagttcacaactgatttgttgtaagctattttaacccttgcgtagcttaccaatcacgagaactgcacgggccctcttttgtttctaaacacttcatggttgaagctatttatgtccttctctcacaaagacatgagttggatgaagctggaaaaatgtagcttattgcagcttctttcttatttctctctctcaactatgtatgaagtagttggtgaagctattttgccaaacactttttccaaaaatagcttagcttcatctagaaagtcactcatgaagctattttctaaaaaaaacagctttactagtgaagttgagctgtatcaaacaagccctaagtttctcagacacctccacccgttgcccgcggccggccccccgccgtcgccgccctgtgccgacggacgactgccgctgcggcgcggccggctcccgcctccgtccgcccaggcccggccccccgcccctgccggccccggccccctggggcccctgcccgctccctgcgctagctccgccactgcagccagccacacgcgatgagcaaagcaggcggcggccccagctcggccacgggcccgacggccgcggcggccgcggccgcggtgcagaagcagaagtcgctgctgcagaaggcggacgccgacgtctccagcctcgtcgacaatttctcctccctcatcaacatcgcccgagtacgtccgtgcgcacctcgaaggagcttgtgcttgcactcgtgaagggtgctgagcctgttgttgcttgtgtttgacgtttatgccttcaagatggagatgcgtgccgcccgcatggtatggacctgctcgctgcccaccaacccttagcggatttgattctgaaacgtggtttctgagccgtttttttggcatataatgttgtgattgttctacttctgcagtgccacaaaattggggttagaagagagataagtaaactgcatggtctgatttttctaataaacgcaacagattattgctttcttgtttgtctggatatcttactttcgctgtacttttgtgattctgcctcgtgc

SEQ ID NO: 13260 - DNA, 461 bp, Sorghum bicolor
  Clone ID: LIB3476-057-P1-K1-H7
cccacgcgtccgcccacgcgtccgcccacgcgtccgcgctctcaggtgcagcccacaggtcgaagcggcagccacccgcgatgagcaaagcaggcggcggtcccggctcggccccgggcccgacggccgcggcggcggcggcagcggtgcagaagcagaagtcgctgctgcagaaggcggacgccgacgtctccagcctcgtcgacaatttctcctcgctcatcaacatagctcgagtcaacgatccgccagtgcgcaactcgcaggaggtcttccagatggagatgcgcgccgcccgcatggtacatgcagcagactctctgttgaaattagtgtcggaacttaagaggacagccatcttttctgggcttgcttcattgaatgaaaatgtggataggaggaattgagtgctgggcagcaagctgagggaactgagagaatgctggagaggatgggcagga

SEQ ID NO: 13261 - DNA, 1427 bp, Sorghum bicolor
  unsure (1)..(1427): unsure at all n locations
  Clone ID: SORBI-28MAY03-CLUS1004_1
cctgaccgatcctctctctctctctctctcttaaaccctagctgctgccaaccagaacctgctagtcatcatcaatctgatttgatttgatcccccattccattcttcttcttcttcctcgcggctgcgccatccatccagtagtcccaccaatccatggcttcagcgttcgggaccgggaccgcctccacttgcggcatcaagcctgcacctacaggagttgcgcttgctgcgcccaagatgcacctttccctcgtctcgccctcgctggtttcgcttccgcgcaagatgaggccccagaggaagtgcaacttcagagtaaacgccgcaaaggagctgcacttcaacaaggatggctcggctatcaggaaactgcaaaatggggtcaacaagcttgcagatctcgttggggttactcttggaccaaaggggcggaatgtagtcctcgagagcaagtatggctcacctaagattgtcaatgatggtgtcactgtggcaaaggaggttgaacttgaggaccctgtcgaaaatattggtgctaaattggtccgccaagctgctgctaaaacaaatgacttggctggtgacgggacaaccacttcggtcgtccttgctcaagggatgatcactgagggtgtaaaggttgtagctgctggtgctaatccagtgcagatcacccgtggtattgagaaaacagccaaagcgctagtcagcgaactccaaaagatgtccaaggaggttgaggacagtgagcttgctgatgttgctgcagttagtgctggaaataactatgaaattgggaatatgatagctgaggccatgaaaaaagttgggcggcagggagtggtcacacttgaagagggaaagagtgctgaaaataacctctatgttgtagagggaatgcagtttgaccgtggctatatttctccctactttgtaactgacagtgaaaaaatgacagtcgagtacgagaactgcaagctgctccttgtggacaagaaaattaacaacgccagagatcttatcactatcctggaggatgctattagaagtggatatccaattctaatagtcgcagaggatattgagcaggaagctcttgcaacccttgtggttaataggcttagaggtgcattgaagattgctgctatcaaggcccctggttttggagagcgcaagagtcaatatcttgatgacattgctactctcactggaggcactgtcatcagagaagaagttggattatccttagacaaggcagacaatcaggtcctaggaactgctgccaaggttgtagtaactaaggattcaacaacaatagtgggagatggcactacacnaggaggagtaaacaaaagggtgacacaaatcaagaaccagatngaggctactgaacaagaatatgagaaagaaaaactaaacgagag

SEQ ID NO: 13262 - DNA, 691 bp, Sorghum bicolor
  Clone ID: SORBI-28MAY03-CLUS7132_1
tctggctctctctctctctcctcctccgtgcgaccaggcgcgaaccctagccgagattagattggaggcgagcgccatcaccggaggagcaggaggaagaggacgacacgatgctgcgggttgcggggagaaggctctcgtcttccctctcgtggcgccccgccgcggcggcggccaggggccccctcgccggcgctggcgcccccgaccgggacgacgactcggctcgcggccggagccagccgcggttctccatcgactcccccttctttgtcgcttctaggggtttctcttcaactgaaacacttgtcccaaggaaccaagatgctggctttccagcaactgtggctgctgtgaagaatcctaaccctaaggtggtttatgatgagtataaccatgaaagatatcctcctggagatcccagcaagcgtgcctttgcttactttgtcctaagtggtgggaggttcatatatgcatcactgctgcgtctcctcgtattgaagtttgtcctgagcatgtcagcaagtaaggacgtgctcgcccttgcctcacttgaggtggacctctccagcatcgagccagggaccacagtgaccgtgaagtggcgtggaaaaccagtcttcatcagacgcgctttttgacatccatttcttgatgtctgtgttcgaaacgattgcctcctacctttagt

SEQ ID NO: 13263 - DNA, 418 bp, Sorghum bicolor
  unsure (1)..(418): unsure at all n locations
  Clone ID: SORBI-28MAY03-CLUS6922_2
ctccaactcgtctcccccgatcatccaaaaccagaccaaaataacaaatctcccccatcgatcccaactcccccacccgatcccctcgctcggctgttgcctcctcctacccgaagccgcgccttccaacgagattcctcccctcctctctccaataacgctagccgccgtcgtcaccgtcaccgtcgncggcgacgaatccggcgttttgagtttcggttgccagtgtagccatgtccatgttcaataggatcttcgggaagcccaaggagcaggccaactccaatgccttggccactctcgacaagttaaatgagactcttgatatgctggagaagaaagaaaaagtgctggagaaaaaagcagccgctgagcttgagagagccaaggaattctcaaaagcaaagaataaaagagc

SEQ ID NO: 13264 - DNA, 1312 bp, Sorghum bicolor
  Clone ID: SORBI-28MAY03-CLUS6922_1
cctcgctcggctgttgcctcctcctacccgaagccgcgccttccaacgagattcctcccctcctctctccaataacgctagccgctgccgccaccgccaccgccgccggcgacgaatccggcgttttgagtttcggttgccagtgtagccatgtccatgttcaataggatcttcgggaagcccaaggaattctcaaaagcaaagaataaaagagtgcctatccaatccttgaagaggaaaaaactttatgagcaacaaattgaacagctgggaaattttcagttgaggatccatgatcagatgatcaggttagaagcagctaaagctacaacagagactgttgatgcgttgtgaactggaactgacgctatgaacgcaatgcaaaaagcaacaaacattgatgatggagaaaagacgatggaagaaattaattaaaagactcaaaatatgaaacaaattcaatttgctttgtcagctcctcttggagctgcatctaagtttggcgaagatgaactggagccgctactgctacaactggggcgggcggtgcggggagctctgctgctgcagcctggtgcgcctcccccgatgcatccagtgcatgtaccagccaacaagcaaccagctcgccctgctccacagaaagctacagctgaagatgatgagcttgctgcactgcaagcggaaatggctctgcggtctgggtcgcgggtggacgggaagcgggtcttggagtgccgtcacactacgaagatcaaagctgagtcagcgagcctgctgctgccccgccggtgcatcctcggcgggtccctgcccacccgcagccggctcgcccggctcctccggccgctgctgctgtcggtgatgtgcgtgccgctcggcgagcggtgacggctgtgtggtcacggtcccccggttggcgcgatgcgtgcctttcagtgccgccatgcgtccatggcgttggctcactcaggctttattatatttgccatgtgtgtataatcttggtggatatttggcaaccgaagcagaaaaaaggctgctccagccagtgtttgtttcagtgattttgggctcggttcacagacaatttagttaatgtcgcccggttagctctatgctaactattcaggtgaccaacgtgcattgtttgtcatagtattgttcatttaaccatattgtctggagccatgtaagagtgtggaacgtataaagcctcggggttcacatttgatgtcccggttcgcagctatttcaacctttcaagcagcatatgtttccttgttgcacccgaaaaaaaaaaaaaaaaagg

SEQ ID NO: 13265 - DNA, 1864 bp, Sorghum bicolor
  Clone ID: SORBI-28MAY03-CLUS7243_1
gcacgagggctctgcgccacttccaaacccaaaacccccctcctcacgagatctgcgcagcagcaatggcgacgcggcgccacgtcctcctcctcgccttcgcgaccctcctcgcgctcgccgcggccgcggagggggccgaagaggggccccgcgggcggcggctgctggtcctgctggacgacctggccgtgcggtcgtcgcactcggccttcttcggctcgctccaggcgcgcgggttcgatctcgacttccgcctcgccgacgaccccaagctctcgctccaccgctacggccagtacctctacgacggcctcgtgctcttcgccccctccaccccacgttttggtggatcagtggaccagaacgcagtcctcgaatttattgatgctgggcatgacatgatcctggcggcagattcctctgcctctgatcttattcgtggcattgcaacagagtgcggggttgattttgatgaggatccagaggcaatggttattgaccacattaactatgccgtcacggatgttgaaggtgatcacaccttgattgctggtgatgatcttatccagtcagatgtgatactggggtctaaaaagattgaggctcctgtattgtttcgaggaattggacacacggctaatccatcaaacagtttggttctgaaagtcctatctgcctctccatcagcatattcagctaacccaaagactaagttgtcatctcctccatcgctcactgggtcagctatatcattggtttcggttatgcaggcaagaaataatgctcgggtgctgatatctggatcactcgacctgtttagcaaccggttcctgaagtctggtgttcaaaaggctggtagcaaaacgagatacgagagggctggaaatgagcaatttgtgaccgagacaagcaaatgggttttccatgagagggggcatctaaaggctgttaatgttaagcatcacaaggttggggaggccaatgaaccaggcatgtaccgcattaatgatgacctggaatactctgttgagatctatgaatggtccggaacaagctggaagccatatgttgctgatgatgtgcaacttcaattttttatgatgagtccttatgttctgaaaactatgtcgactgacaacaagggtttatattcaacatccttcaaagttcctgatgtttatggagttttccagttcaaagttgagtaccaaagattgggatatactggtctgtcttttacaaagcagattccagtacgcccttacaggcataacgagtatgagagattcataacatcagcttacccatactacactgcctcattttcaacaatgggtgctttcttcatattctcgcttgtgtacctgtaccacaaataagggactcatgggagcacacaagtttctggaggctgatgcgacctagatctgtggcactgaatgtgtgctataagccaagtgttacctggtgcaattttatggaaccatatttttgtagtgccaacttagataacatttgacgaccgtgaccgcactcatgagaatttacttgtgctaggatgttcgatctgcctcactttttcttggatcctttctgatcaacacttgtgaaaacgtctacagtatagcattgaaatgatgagcatgtagtgattttgaaagtactacactcttgagcttgcattctgatttccggtcctgaatgtggacttccaagtttgtgattgttatatttccgcacttgttggtgcttattccttggatgtgcttgattttttacctgggtgtgttgaaaaatgaatactcgaagacagtagagcttcatgttcaaaattccaaatttggaatgctatctggctcct

SEQ ID NO: 13266 - DNA, 1337 bp, Sorghum bicolor
  Clone ID: SORBI-28MAY03-CLUS7296_1
gctattgggtcggctagtttggaaggcgcgcaccaggggacacaggggcgaggcgaggaggagaacaagctatgggcgcgccgaagcagaagtggacgtcggaagaggaggatgcgctccgcgccggcgtgcgcaagcacggcgcaggcaaatggcggaccatccagaaggaccccgagttcagcccggtcctgtcctcccgctccaacatcgacctcaaggacaaatggaggaatttaagtttcagtgcaagtggactgggatcaagtaaagtacgggttccaaggataactggacccacatcttccccatcgcctagtgcacaagctctgcttctcccagcgccaaataaagttactgaagctacactgcctgcagatgctgagaaaaagccacaagatgggaaaactccgccaaagtatggtgtcatgatcatggaagctctttcggaattgaatgagccgaatggttcagatatggctgcaatcctccgcttcatagaggaaaggcatgtggtgcaaccgacctttagaagatttctaacctcaaagttacggcgacttgcagactcaaacaaaattgtaaagatcgataagtcttataggctcccagattcctttgcaacaaggactccagctccaataaagacttcagctccaaaacagaaggatccatcaaagccatcgaaggtgtcaaagaccataggattatttactgcctccagccctgcactagaggcagcgatggcagctgctgtcaaggtggctgacgcggaggcaaaagcacatgacgcacatgatcagatgatggaggcagaaaggatcctcaagatggctgaggatactgagtctctcctcacaattgcagtagagatctatgaccgatgtttaaggggagagataaccacaatagtggcgcaaagggatgtttgagatctattggagactctcgtcctgtacatggatatgttctggaatccagtggcccgtattgctcctgtgttgtataattatcagtttgtgctgtacttgagtatgtcctagggttaactaaataacatcaaggcaccgcctgtctttaaacttctgtaatatgtaatcccatcgttcccagcctgtcactgcaagctgcgatcgtgaatcctgatggcagtaatgttttttaattacatgatgagagaacagagaaggaagaagtgttttaaacagatgaagtagggtaggaaggtaaaacgttcctggtataagataatatataacttgtgccgcacttgtatctttcaaaaaaaaaaaaaaaaaaggcccctacggtccgcccccttcttcacgcacggcgtg

SEQ ID NO: 13267 - DNA, 855 bp, Sorghum bicolor
  Clone ID: SORBI-28MAY03-CLUS73480_1
aaaaaaaaaaaaaaaaaaaaaaaaaaaaaaaaaaaaaaaaaaaaaaaaaaaaaaaaaaaaaaagcctactgagcaacacaaaacattctataagtagaggtaacaaagccagatgaagggcagcacgctgtttgtgatcctggttctccaggcagctctggtcatgggaatctttgcagttgtggctaaagaaaacgctgccgtcggtgagagcaagggcaacacggagaccaacggtggcaagctcgggtgctgcaccaagtgcaacttctccttctccggcctctacacctgcgacgacatcgtcagcaagtgcgaccccgtctgcaaggtctgcaccgtcgtcaagaagtaccccgtcaagcagttccagtgcaccgacaccttcctcggcatgtgcggcccaccgtgcaagaagaactagggctcagcatggccctcctgactgagctagctcacctcacgcaaatgtattccacgctacacgccatcaataaaagccgtcgaggcttccatccatctatcagctagtatgtatgagcgcccctgctcaatcgagcatgggtgaataaaatttatcgtcaaactttcctctgatgttcgatgttcaatgcttcagtgcttgatcgaatatccaaaataccccatttgctactgtcagcgcttactatgaatcagatctgcgttcgtttggcaaccaattgtgaataaggattagaaatgggctaattagaggattcttcccagatcaataagcttttctttcaagaggtataggagtccggcagtctgaacttcgagagcggcatccgatctctgatcatggcgccagcattgggcatagcatgccagtgt

SEQ ID NO: 13268 - DNA, 1637 bp, Sorghum bicolor
  Clone ID: SORBI-28MAY03-CLUS7685_1
gccgcgctttcgctttatcacttgtcgacaccaacagtcgccccttccccgagcccgggcgcctcttcaccgccgccgccccgtcgtcgccggtcgggacgctccgggcggccgcgcgcccccacagaggaatgtcccccgcggcccccgccccccgccgccaccgcggggtctcaggcagagcaaccttacctgtgcatcatggagaaagcagagtccctccaggagcttgtttcatgggcacatcgcctatgttggggccaatgagggtatccttggtatgtggtgcaagccccaaccaccataggccaaggaattcggatacatcgcgacaacaaaaaggggggtcctccagagggaaaggcaagtcataccaggataaagatgattctgagaacattgatgaatttgatagcgatatcatgttctccaagaacggaccaccaatatctttggcaagcaattcccgtcctcaagccacatcagctcctggggaaagagagaaggagatcgtggagctctttaaaagggttcaagcacagctgcgagctagagggaaaggcagggaagacaagaagcctgaacctgcaaaagtgcagggtgaaaggggcagtgttgattcacttcttaagctgcttaggaaacactctgtggaccagagaaggaagagcagtgacgacaaagaacagaattttgatgtaatgaggagaaacaacgattctggaaatagacaaagttcaaccatctttggcacaaaaagtgacatccaggaagagcagaggaagccacctccggcacccttcaaaaggccagcttcaaatttcaggcgaaggtctcctgttcctggagtgaagttccagcctgctatcaatacggacgtagacagagatgccgatcgcaagtccatcggcagtaatgtcgccgatgctgtacagaaagctaagacagttcttgatgagaggactgttacagatgagcctgactccatgtctccgtatgaacctgattctgtaatagaaccagaaaatatttctttggaagaccttgatgacattttagatgacgatgaagaatctgatacagatgaaccagacgatgagtatccagaaccttctttggaaatcactgatgttacagatacagatgaattgcacgagaacaactccacggaaagttcagatctaacctctctgaaggttgcagagctgagagagcttgcaaagtcccgaggaatcaaaggctattcaaagatgaagaaaaacgagctgattgaagtggtgagcagcagcatggcttgatgataagcgggtgatattgtcaacctttcagtcccactttgctgattgaagtggtgagcagcagcatggctattccatttgaacccactttgcttggcctgatccgctgcctttcagtcccgtagaaaattgtaaatgagcgaggctaacattgttctggtctgtgctgatcttttgctggttctcattttgtacgctagtttgctagacatttagctgaattgtgtgccgagtggagtaaggtagctgagagcctgagatgctgtttgtgtactaaatgaatgcaccacatctgttctaggtgttgttcatcttttctacagagttgacctatgggct

SEQ ID NO: 13269 - DNA, 1206 bp, Sorghum bicolor
  unsure (1)..(1206): unsure at all n locations
  Clone ID: SORBI-28MAY03-CLUS7754_1
cggaaatgcccatcatccatcggttggtctagcccaccgcccgccacagggcacacacacacagcacgaggaaattccccaatccagcacacccagatctcgcacgcggcagtggcgacgaatctcgcgggtgcggaggcgcgacggaggcggtgcagactccgacgaactcgcagtcaccggtgggagacgcagcaccaccggcgcactcctccagcgttcatagtttaagggtttggtttgaataattggagtcatcaacaaaaacgatacaaaatggtggttcttgcagcttcgatcgtttcaaagtccggaaaagcacttgtttcgagacagtttgttgacatgtctcgcataagaattgaaggattacttgctgcgttcccgaaactggttggaactgggaaacagcacacctatgttgaaactgaaaatgtgcgttatgtttatcaacctattgaaggtttatatcttctactcatcacaaacaagcagagcaatattcttgaagatctggacactttgaggctcctctccaagcttgtgcctgaatactccccttccctggatgaggagggtgtttgtaaaacagcatttgagattatatttgctttcgatgaagccatctctcttgggaacaaggaaaatgtaaccgtgcaacaagtcaaacaatattgtgagatggagagccatgaagagaaggcacacaagttgatgatgcaaaccaaaatcaatgaaaccaaggatctcatgaagaagagggctaatgagcttgacaaaatgaggatggaaagaggcaaacttgacaaaggaggatactcatcaatatctggtccacgcatgattgaaaaaactttcagtgacatgagcatcagtggttctggatttggtagtggttctggattaggtggactgagcactgacatggactcatttgccagcaagcccaaaggtcgtccatctacagcagctactgcacctggtaaaggttttggtatgaaattaggcaagacgcagaagacgaatcaattcctcgaatctttgaaagctgaaggagaagttattttggaggatgtacaaccaagtgcagtttctacaagatctgctctntcaacaagtgaccctgtcacagtgactatagaagagaagctcaatgttgttgttaaaaagagatggtggtattaataactttgatgttcaaggaac

SEQ ID NO: 13270 - DNA, 935 bp, Sorghum bicolor
  Clone ID: SORBI-28MAY03-CLUS7864_1
ccgcaagattgggttcgaccttgactatgatgagaaagacacaagctataacaggatcaagagccttgtgactgaggagttgaagcagtacttccggccagagttcttgaacagattggatgagatgattgtattccggcagctgactaaattggaggtgaaggagattgcagacattatgctgaaagaagtgtttgacaggttgaaggccaaggacattaatctccaggttacagagaagttccgagatagagttgttgacgaaggttataacccgagctatggtgccagacctttgcggcgtgctatcatgaggcttctggaggatagtctggcagagaagatgctggctggtgaggtgaaagaaggtgactctgccatcgttgatgtggattcagatggcaaggtaatagtcctgaacggtggcagcggtgttgctgagccactggaacctgctctcagtacctaagcaaggtcaaaacctttggtccgaaatatggccttctttacaagtcagctgggctcctcgtgatggtaaaagtagactgacattacttggcgtctgccccattaggtgctttatctttcatggttttccttttcattggaagtgaggccgtagggttgctatggaaatgaatagatggtgaggaatttagcgaatgaaatatatgctagactttgagttgccttgtttttggaagaaacttggaattttcagtttgatgcacttgtattattaggacttgttagcaatgagatacggatgtttctgcgtttgatgttgtactttagtaacttatatcctgtatgtatggatatcacgtatccaagtttcgaataacagtggtgaattgctacactctgccttttggtctgcggatctaaaatttggaatcatttatttccctcagaggttataattttcgaacttc

SEQ ID NO: 13271 - DNA, 1253 bp, Sorghum bicolor
  Clone ID: SORBI-28MAY03-CLUS1135_1
ctggcttttttctttctccggcacgaggacgagaccgagagaagtcttctctatctcagcgccgacgcttcccaatttccttccaatcgactccgctcgccgtccccagctctcccctgcgcctccctcccaaaaccctacgccccgcgccctgaccaagctccggcggggacgaatggacggaggagccgccttcccgggcacgccgccggtgccgcgctcgccggaggacgtcttccgggactaccgcgcgcgccaggccggcctgatcagggcgctcaccaccgatgtggagaagttctacgtcatgtgcgacccagagaaggagaacctatgtttatatggacttcccaatgagacttgggaagtgaacttgcctgctgaggaggtccctcctgaactcccagagccagctctgggaattaattttgctcgtgatggaatgaatgaaaaagattggctatcacttgttgcagtgcatagtgattcttggctaatgtctgttgcattttattttggagcaaggtttggatttgacaaggaagccaggaaacgtctcttcaccatgatcaataaccttcccagcatatatgaggttgtcacaggaactgctaagaaagagcccaaagaaaaaactcataaaagcaacaataagactaacaaatctggctcaaagccctcgcgccaggcggaacccaacaactcaagggtcccaaagatgccacctccaaaggacgaggaggagagtgaaggggaggaaggggaaccacaggaagaccatgagactgcgctgtgcggcgcatgtggcctaggttatgacgacttctggatctgctgtgacttatgtgagacatggttccacggcaagtgtgtcaagatcaccccggctaaagcggagcacatcaagcagtataagtgcccttcctgcacaggaagcaagagggccaaggcttgattatatctatggtagatctggattgccgacgatgctccaagaactaaggagcctttgacgagagttgtaagctgaatctttcgggtagggcagctaatagatttgagtactttgtttggatactttggtgcttgagatgcctctaaatctagtgtcagtaattacgagtactgaccaactgtaaactgttgtagtttgtgtggccctcaagcatctatgttctgtagtctactgagttgtgtggtttagattccaacttgccatttgtgatgaagcagtcgttttaaagttagatccc

SEQ ID NO: 13272 - DNA, 2351 bp, Sorghum bicolor
  Clone ID: SORBI-28MAY03-CLUS1157_1
ctcgctctctcgctccgacaaaaaccctagacctcccaccacgccgccgccagccgccagccgccgcctccctcctcacagacagccggttccatcgctgagattcttcctgtgaggaggtgttgggggtagctggcgatgggggcggagcagggctacgacgacatggaggtgaccctcagagactctgacgtgttcaattatatcgtggaggtgctgcagaacgtccggatggatccatttttaatcgacctaaggtacaaaagtcaatatgatttcctgctagaccttgtagaccctaccaagaaaaggactagtgatgaggaggctatgtttgctactactttggaggcactatcagaagcagtatccacgatagacaccatgtatcaccatgcacttctacacaatatatttaccatgtgcgtctggtacttaaacagctacacaagggttgtgcttttggacttaataaccagattggctgctgtggcagaccagtacctcagagaatgtttgcagatgcttgtgaataatttcactccacctggaccacttattcgttacattgaagagccaaggtggcttgcaaagaaggaagaaatatactctcagttgcaagagagtttgaaaaagatttctgacactgtgcccttagcaccaaggatgttaaaggatataatagataggagtatgccaaagttgtttgatagcaaagctaagatggtatcatttgtcgaatgcatgttgggccttgatgctgacacttgggacatcattggaccttcattgttggagaaagttgtttatctacttacggaattggatgttaatataacatgggaagatattcttcaagatgaacacaacaaaggtatatttgacatggaacttgaggatttggatgaggatgaagataaccttggtcaagaaggaacaaaggtcctgtttggaggaaatgtgtgtgccgaaaaacttgatggtttaatggtggttgtgtgcaagcacctcaagtcacgcgcagaagaacctgatcgcctaaataaggaatttgacactttgaaggctatattcaaatcacatgtgattagggtgcacaaatccaaatttgcacagtttatcatgttttatgcttgttccctgtatccaaagatttgtggtgagggctttgctttttttcttgtcgatatttttattgacaaggacaaaaaggaggatgcaataactagaatgtctgcagtttcatatgttggaagctatctgtcccgggcaaggttcatttccgtaaatacagttgttgctgtactccaaaggttagtggagtggtgcggggactattgtggcagtcagctggacaaaggggtgacagccaatcctataaaacatcaactattttatgccagctgccaggctgtgatgtatgtcctatgctttcggttaagatctattatggactacccaaatcttaaactacaacttttttaaatgcgaatccagaatatcttggcccatccattggagccattaaaggtgtgcttgccttcaatagtgaatgagttcttgagacaggctaggtctgcgagtctgttccatgcatctgtgaattcaacacatgaagatgcagttgaatctgatctatcgaaggcatttggaggacttaataggcttgacatgttcttcccatttgacccatatctgcttaaagagtctgacaggtatatacgcccaaattttgagttctggtccttggtcaagacgacatacagtaacaacaacagcgacgaggacaatgacgagcttgcagacattgacgcacccggaatgaatgtgggcagcttggatgatcactttgaaatagatttcaacaatgatgatgacattgagtattcgatgaataagatgtccataacgccgcaccgcactttctaccatccactggctacaaacagtgagttcagcagcatgcctgcgaggatcagaccttcagtgagccctccatcatagctggccatcagaagatcgttctgttctactcaactctttgcttgactgatgatgacaaagcctgatgctatgaagctgtacgtgccaagaaggaaccaggggatgacaatcaaacagataccggagctttctattgtagttgttagtagggtcaaaacccattattctgcagtttgtaggctaccatttgggatgaaatgcaaagtgtatgtgtgttacaggggacggtgtggaaaatggttttgtgattgtatacttggtaggcacccctcagggatgtgtagtaaagacaaatgtgttgtgaaatggttcaccgaaaggtattctcttgggaacatcaatggtct

SEQ ID NO: 13273 - DNA, 1453 bp, Sorghum bicolor
  unsure (1)..(1453): unsure at all n locations
  Clone ID: SORBI-28MAY03-CLUS12118_1
gcacgagggtcgtcgccatggagctcaccggcgccgcgctccggcgatacgcgctgccgtcggcgtcaccggtgtccgcgagggtggggaggaggaggaggctcccanccagggtggcctgcgtcgggggcggcggagggttcgcgggcgcggggcacctcaggtactacgagggggccccgcggaggaaggcggtggaggcggtggcgagggacctgggcaagctccgggccatggggctcgtcgcgggggacgcggccaaggagaaggtcctctcggaagccacagatctgctgctgcaagagctgagccagatgaaggatgaagaatacaagataaagaaggtagagaaagaagagaaggctgctatgaaagcactgaagaagcaggaggacgcgacgaagacagccattgcgatgatgaagtgtgaagaagatgagtcctcttcggagtcaagcgagagcgattgcgaggacgaggcgaccatgaacgttgatcagcgcacaatgatctcaacagcggatcctgaagttgttgcatcaagcatcttagctgtctctgcgatggagtgtgataaggctgcaatgaaggccatgaagcagatggagaaggaacaaatgaaggccatgaagaagatggagaaggccgcgaagaaggccatgaagatggaaaaagaagcaaagaagatggcaatggctacgctgaatggctgcagggatgaagacgattcctcatgctcatcagagtccagcgaaagcgaatgtgaggggcaacttgtcaggatgagccgctgcgctacaatcaccacaccagaaatgccatctccaaccacaggtctccccatcatagttcctcaaattccagcacctttggcaccggaaccatctcaacctttagagccagtaaccgcggtgcaagccaccagggtcagcagcgttgcagtagctgagacatccacaaccagcagaattgaggtctgcatgggaggcaaatgcaagaaggcaggcgcacttgctcttctgcaggagttcgagaagactgtgggtactgaaggtgcggttgtcggctgcaaatgcctggggaagtgtggcctaggtcccaacgtgcggctgaggagcgacatctctgcagaaggttctgcaaaggggagcccactctgcatcggtgtaggttttgaagatgttagcaccatagtggcaggtctcttcggagacgctgatctgggcatgacacccacatagacttaatcttacttcaagagaagcttctattcacagatgttgcactgaacaaatgtatagactcaagtgcaaataatagctacggccttgctaggctgctagtgctaagtttatgtactatatgtctatactatatagaacatgtatcatgtatggtaatcaaagtttctgatttctgatccaaaaaaaaanaaaaaaaaaaaaaaaaaaaa

SEQ ID NO: 13274 - DNA, 642 bp, Sorghum bicolor
  Clone ID: SORBI-28MAY03-CLUS12272_1
gccggccgggtcgggaccacggcgctggccggggccgggggagtgactcggtcgcatcttcccctttcccattctccatccacccaccggcggcggcgcaagggaagcgaagaggaagcgacgatatgtcggcgaccacggcggccgtgcccttctggcgggcagcggggatgacctacataggatactccaacatctgcgctgcgctggtccggaactgcctcaaggagcccttcaagtccgaggccgcgtcccgcgagaaggtccatttctccatctccaagtgggcggacggcaagcaagagaagcccactgtccgcacagaagatgaataaagatctggcgccatggtgacatagtccttgctacagatgatttgaagtgttgttgcaagtttctggaagttgctatttagctggcttgattttatagtcaatggtgaagaataaatacttttgcgacaattgtctttttgcaatgacgtgttattttcgttgctaattgcacttgccctacccaaatcaatcatgtgaacagcatggaatgcttcagttttgtgcaatttggtaccgactaaatttacctaggtgtccgacagattatgctgggtctttaaaaataaaggatcagtgaatgtactcg

SEQ ID NO: 13275 - DNA, 1408 bp, Sorghum bicolor
  Clone ID: SORBI-28MAY03-CLUS9053_1
cccacgcgtccgcccacgcgtccgctgctcctggtgctgaaaatgcaaagattgatgaagctgacacagaacagcaactgcctcctgggcagcaggtgaaggaggctccaagcaaccctttggggaataatgaaaatgtgaaaatggaaaatgaagcttctgctcagggaccagtaaatgaggaatctgctcctcgtgctgaaaatgtaaagattgatgaagctgacacagaacaacaactgcctccatctggtgagggcacgatggacatatctagcgagctactcagccatgacgaaaaggtggctccaagcactgtccctttaggaaatgatgaagatgcacatatggaagaggcttctgctgcacagagagagctaagcactgaagttgctcatggtagtgaaaatgcgaaacttagtgaagctggcacgtctggtgaggccatggtagacgtatctagcgagctactcagccaagatgaaaaggtggctccaagcactggccctctaggaaatgatgaagatgcacagatggaagaggctgctgctgcacagagagagctaagcactgaagttgatcatggtagtgaaaatgtgaaacttggtgaagctggcacggagctgcagttgccaccaccttcatctggtgaggcactggtagacatatctagggagcaactcagccaagaggtgcaggaagttgcaagctctgggccctcaggaactgatgaaaatactgagatggaacggctaaacaccaaacattcacctggtggtgaaacctcaaaacttgttggagctgatccgggaatacaattgccaccgtctggtgaggctgtggtagatatatctaatgagccacccagctgccaagaggtaaaggaggccccgagcagtgacagtttgggaaatgatgaaaattcagacaccgagaagactgctgctgccttacagggacggctaaacaccgagcttgctcctagtggcgaaaatacagaatctaatgaagctgacactgggaaacaagagacacccgtgtctgctgatgctatggtagaatcatccagcgagcctcccagcgatgaggcaaaggaagctccaaccactgacctgtctggggatgatgaaaaagcaaagtcggcaagggctgctgttgttgcggaactttttggagatgcaacagaaggtggttcggatcagccattgccgtctccaagagaacaaggcaaggaagcagaggctgatggtgacttgtagagtaaattatgcaaatattgtattaagagctactagaatctgtgtaagtaagaaatgatattagtgctttagttgtaactgttggaagcttttactcagaatcaaaagcaacgtgctgagattactgcaacagtggcccacggcagttt

SEQ ID NO: 13276 - DNA, 2462 bp, Sorghum bicolor
  Clone ID: SORBI-28MAY03-CLUS9197_1
tctagatcgcgagcgccgccctttttttttttttttttttccataaacctaggatactgaattaggcattaccatattacatacacctgtgaggttttctgcataaaactgacaaaatcaaaccctgctgacaaatacctagtcatctctagtgaacctacagcactgtcattgtgccactgttgacatgtcaagctaccaaagggtatggagctgcagaaaaggtaaaaatgttaatgccagtaaataacataacccgacagctactgcaaagcctacaaatagtatgggcaggaaagccattcactttccttcatttgataatttcatttaagttacaaaaaactaaatatgatacaaggagcaacaaaacaagcactagagctgctaccgctaatggtgctacctgcttcctatgtccttccaaggatccgcgtcactgcccataatcttagaaccgggaccatactgagccttgatagcagcagccacagggtctgagacgttgctaacaaggataccagcacccccaaaacgggcgactctaccaggctgctggaaacccgagatgagttccagcccattcctcttctgcggatcagaaaacctttcctgccgcttgggatctgattgatgtggcggcactaaaggttgttgataatctgggaacacaccaagcgtcccattcttagccgagtaaaacggtacaccggccaaggatctctggcactttgccatcacgagcagaggctcaggctgtgtcgtgcttccatccaaatggccatagctcctcgctgatctttcctccagacccaaatgtggagtgatgccaggcctggaagaacaaaccacacgatcccttggattgttcatcaatctcacagatgatgtgtcaatctttggtgagggaggcttgctcttgctaccattacacaatgagccagaactttgcaaggtcgacggctggctgagaatctgcccaaacaacttgacatcaccaggccgcttttgttgctcatcaccctcagagcttgtattgcgagagcaaggcctcaaagagccttcctgtatttcttcgtgttttctggaccattgaatcccatcagaactgtttggaaggcacaagctgctggacctgccattctggaattttgtttggttgaaccgatctgtctgtgaagtactcacattgccacttgcagttctttcagaaaaaattggtaattcagttgtcagacgatgattcacataaccccccgtgctacgaaacaatgtgtcatgctgattaccagatgggtctttaaaagctgggtacttgctcatgtctttagcccctagagcactgctgactctgttgccactgtcctcaaagttgggcgtagttattgaggctatgccctcaaaacgaaatgcagtgggatcaggaagcactgaactgaactgcacaggcattaaatccttgggggtcaggggggtgaccagtggctttggtttcagcaggggcatatctcctggtacagaatgctgataacttgaagtgaatgcaggactaacggtggaagtaccagtcatgtttaagatgtgaacattgtccttgataccactatctgaagcaccagaatttccagttttcattggtgtgttatcaagagcatggtgtgaacattcttccacctgggaaggatctgtaccagtaccttcagctttgtctgtttgaagtacctctatagaatgtaaactggatctcacttccgagtgcatggccattgtatgcttagttgtagagctgatggcactactactatgcacgtttacttggtcaacgacatcatcagttccttgcagcttatctgtgctttctgggcctcgggcgtcaataggaacagcttgatgagtaccatcactggacctcttatcatcaacaatgctgcaatttttatcagcttcctcctcgtcttcctcaattttagcatctacatcacacccatttgatatctctcctgcctgcttagagattataacagagttaggccctccaatggctccttcagtaggacaaacatctatcacaatctttgaacaagactgagtgctacagatagctgaatccatttccacagcgcaagcctcgtcagtatcactcctccctccattggtatcactagctggcatactaacatcagctgccccttgatggatcaaatccaaaccgagtgatttccgagccttactaaagaacactttgcactgttcatatgacttgctcttcacacatccccgggcccgagcaaaatcttttccgtagttattcatagcctcaatgaaaattgacttctcatcatcattccaatcaactggatcaacttcgcactcttgatcagagagtgtgtcttcctcatcaacgattttgtcattttcttgggataagacatgttccactcttttcatgctaatcctcgtgc

SEQ ID NO: 13277 - DNA, 1235 bp, Sorghum bicolor
  Clone ID: SORBI-28MAY03-CLUS9638_1
gcacgaggctcttctcttcccccacgccccttgcctttgcttgcccattgtgattcaaagcaaccatggcaaccgcaatgtccccctccccctcggccgcaatcgctcgccccagccatcctcgctcctgtgctgctgcttcggtggccctccgctcgggcttcctgggccgcgggctggccgcggtggtgccggtggccgtggacgaccccagatgccgtctccgccgccgcgtctccttctccgtgcgcatggcctgggacgggcccctctcgtcggtgcgcctcatcatgcagggcaggaacgtgaagctgagcgacaagctcaaggagcacatcgaggacaaggtgggccgggcggtgtccaagcactgccacctggtccgggaggtggacgtgcgcctctccgcgcgcggcggcgagctcggccgcggacccaagacgtcgcgctgcgagatcacgctcttcagcaagcgccacggcgtcctgcgcgccgaggaggacgccgagtccacctacgccagcatcgacctcgccgccgccatcatcaagcgcaagctccgcaagatcaaggagaaggagacggaggtgcggcgcgacggcgacggtggtgcgggaggcgcctgggaagaggagctcccgctgctcgacgacgacctggtggaggccgacgaattggctgcggccgtgggcgcggaggacgagcagactgttgtcgccaaggtggtgcgcaccaaggtgttcgagatgccgccgctgacggtggaggaggcgctggagcagctggacaacgtgggccacaacttctactgcttcagggacgaggcaacgggccaggtcaacatcctctaccgcaggaaggaaggcggctacggcctcatcatccccaaggaggacggcaacttcgacaacaaggacaccgtcggcgttgcgcaaccaccaccacccgccgctccggagccgtccttggccgtgcacaccgccgccgacaacaactgatgatccttttctttttttttttgcttgcttgcttgctgctactgtaaaacaaactccacctagaactcgtcgacatctcatctccatcagttgcatgcattggcacattgctgtgtctgtgtctgtgtctgtgtcactctgtcacacacattactcacatagtattgctcaagtttaactctccttcatttcgtaccataccccgttcgttgtactggtggtattagtagcaattga

SEQ ID NO: 13278 - DNA, 1656 bp, Sorghum bicolor
  Clone ID: SORBI-28MAY03-CLUS9652_1
gcacgagggccgcacccatcaaagcttcctccttattccttctccccgctgctcgagaggaggcgagccaaacccagcgcgccgccgcgatggcctcccctgacgcggaacagccggcgccgacggagcccgagcggtggcgtgacctcgacatgctcctctcccgccccgggaacctcgtggaggcctccttcgatcccagccccggcctgcgagacctactggggagcctcgtggaggttttggttgtgggcgcgggcgggctcggctgcgagctcctcaaggacctggccctctccggcttcaagaagctgcacgtcatcgatatggacaccatcgacgtatccaacctcaatcgccagttcctcttcagagttcaagatgtcgggaagtccaaggctgaagtagcagcgaagagggttatggagcgagttaatggggtgaacattgtccctcatttttgcaggattgaagataaagaaatagagttttatagtcagttccacataattgtcctcggtctggattcaattgaagctcgaagctatatcaattctgtggcttgtggtttcttagagtatgactcaaacgacaatccactcgaagagacagtcaaacctatggtagatggtggaactgagggcttcaagggacatgctagagtcattatacctggaaaaacaccttgctttgaatgcaacatatggctttttcctccacaggttaagttccctttatgtaccctcgccgagacaccaagaactgcagctcactgcattgagtatgctcacttgatcaaatgggatgaggttcatcctggaaaaccttttgatgctgatgatgcagagcatatgcagtggatttattcagaggctttaaagagagcagagcttttcggtatttctggtgttacatattctttaacacagggtgttgtcaaaaatataatcccagccattgcatcaacaaatgcaattatatcagctgcttgtgcattggaagccttcaagcttatttctgggtgcagcaaaagtgtgtcaaactatctcacgtacaatggtctggaaggaactcacattaaagtaactgagtttatcagagacaaagattgccttgtatgtgggcctggtacccttattgagctggatacaacatctactctttcagatttcatcaagatgcttgaagagcaccccacgttgcggatgtcaaaagccagcgtgacccacgaaggtaacaacctgtacatgcagtcaccggaggtgctggagcagatgacacggccaaacctgagcgttcccatgtttgagctcctcaaagaggtcccatacaccactgtccatgccacgggcatggcagagaacaacgggaagaaagtgtcctcattgaggaagctccgtgtggccttcaagggcatcgaagaagcctccaagatggatacgaccgtgagctcatgaagccgtcgtcatcctgttgctaatttcaagtctcccaggaaagatgaggattaaccccaatgtttttgggacaggttaagtgtagttttcaagcgccataatatatacaaattgaaatgtgcgcttgataatgttcaaacatgaagaaatttaacgattagataataccgtggtttgtgagaatcgacttcattcactt

SEQ ID NO: 13279 - DNA, 1245 bp, Sorghum bicolor
  Clone ID: SORBI-28MAY03-CLUS9714_1
accgggcccccccgcgtcgtaggcgtagcaaaatcagcaaggcaaaaacgaagcagaggccagggacgcgccagcgcgagcgataaggcacactgccatggccgccaccacggcgtactccaccgcgcttctcggcggggcgcgcctcccctctgcaagaggagccgccgcaccgccctcctccctcggcctcctcccgctgcggtctccgctccctctccggctccaagtccaagattctgcgccgccgaggctgtcgctgctccgggtgaaggcctcctccgatgactcctcggccgccagtggggacgagctcatcgccgacttgaaagccaagtgggacgccgtcgagaacaagagcactgtcctcacctacgccggcggcgccgtcgtcgctctctggctgacgtccgtcatcgtcggcgccatcaactccgtgcctctgctccccaagatcatggagctagtcgggctcggctacaccggatggttcgtctaccgctaccttctcttcaaggaaagcaggaaagagctcgccgacgacatcgagtcactcaagaaaaagattgctggttcagagtaaaatgttgttctcttgaatttttttggacgattctttcgagaacacgcgttgttgcctcctgtctagactccagagtgctacttgtctttgcactttgaataccgtatgtatgtacttgtgtcccagtagcgaggtttgtacgatgatggagtctaccccgggcctcccctccccgagtgcttgctgctaggcgggcgcggccccgccggttggttcgccttcccctcccttcgcttcccggatagcccgctcgcgcccgcccaccccatcccgtctccctgggactgggttgctcgttccgggccgaggattgccagcgtagctggacaaggtaatggttgctagcaggccgaggtgtttgctagcttagctctcctcttccgagagaattagcatttggactcggccgaggtgtttgcaagcaagcacggagaagtcgtaatccttgatgatggtgtttgctagcttagctctcctcttccggcttctccgtgcttttccctccctggctaaatcactgctgccacagtggttacaggcttgaaattgacaacatcaatagcaatttgctttgatgatatacctatttattcgttatatatcctgctcgacgatgatattctgagttcaaaatgcagtagcgtatgcatttactcgtgtgt

SEQ ID NO: 13280 - DNA, 1163 bp, Sorghum bicolor
  Clone ID: SORBI-28MAY03-CLUS9237_1
gccggccgggccgggggacgcgaaagatcgcaacgttcaggcaggcctctcaaggcaacctcgtcggtgttcgatccgccgtcgccgccgcgctacgccagttgcccaggtcttcttcggtgccttctccggcgacaagcaaccgccagttaccatggcagcgatgaatagtgatttgggaggcttaggtggcaggcctgcaaacccacaagcaaatccttttggaactgccttgcatggtgctggatcaggattgatccgtactggactagaagcatacggggggaggattatagattcaagttctgaatttatgcagagcaatataacacaatatttatccaaccctcagtactactttcaagtcaacagccagtatgtgaggaacaaactgaaggtcatcttgttccctttcttgcacaggggtcactggacaagaataactgaaccggtaggaggaaggctatcctacaaacctccagtccaggatatcaatgcaccagacttgtacatccccttgatggcatttggcacctacattatagttgctgggtatgctttgggtgttcttggaaggtttacccctgaggcgctgaccctacagttctctaaagggatacttggctggtttctgcaagtcatgctcatcaaatgtctgctgtactccgtctgcagcagtccctgggcagcagtgaagctccattgctggacattgtggcatatgctggatatggtttcgctggcacttcccttgcaatgctggcccgcatcttctggagctatctgtattacttcatcatgccatggttctgcatctgcacgggagtcttccttgtgaagaccatgaagagggttcttctgggcgggccaaggagctacgagagacaccccagccggaaccactacttcctgctcttcttggcggttgtgcaattccctatgctgttctggctcggcaacatcagtggctgatctatgatcctatggtcgggccacgaacatcatttctgagaggctgctgagcagaatagacatgtggtacttcttacttgctgatgtatcttaggttatcgtggagatggtacagaactattagctgtggatatctgggcaagcaaatgaaaagacgcgagtacctccgtttcgtggagaagcaaataaga

SEQ ID NO: 13281 - DNA, 429 bp, Sorghum bicolor
  Clone ID: LIB3476-060-P1-K1-A10
gagcaatataacacaatatttgtccgaccctcagtactactttcaagtcaacagccagtatgtgaggaacaaactgaaggtcatcttgttccctttcttgcacaggggtcactggacaagaataactgaaccagtaggaggaaggctgtcctacaaacctccagtccaggatatcaatgcaccggacttgtacatccctttgatggcatttggcacctacattgtagttgctgggtacgccttgggtgttcttggaaggtttacctctgaggcactgaccctacagttctctaaagggatacttggctggtttctgcaagtcatcctcatcaaaggtctgctctactccctgggcagcagtgaagctccattgctggacattgtggcatatgctggatatggtttcgctggcacttcccttgcaatgct

SEQ ID NO: 13282 - DNA, 513 bp, Sorghum bicolor
  unsure (1)..(513): unsure at all n locations
  Clone ID: LIB3476-061-P1-K1-B6
cccacgcgtccgagacgagcggcgacgggccgcccctcgccgggcgacgagcacagcgacctgttaccatggcagcaatgaagaccgatatgggaggcttaggtggcaggccgacaaatcaacaagcaaatccttttggaactgccttgcatggtgctgggccaggactgatccgtactgggctagaagcatatgggggaggtttttagattcaagttctgagtttatgcagagcaatataacacaatatttgtccgaccctcagtactactttcaagtcaacagccagtatgtgaggaacaaactgaaggtcatcttgttccctttcttgcacagggtaaagggctgatgaccttttgtttatctctgcaggattttgcatattgtgcttttgtgaagtctcataatatatgcctgacctttactgtctttcttaaaggtcactggacaagaataactgaaccagtangaggaaggctgttctacaaacctncagtccaggatatcaatgca

SEQ ID NO: 13283 - DNA, 763 bp, Sorghum bicolor
  Clone ID: SORBI-28MAY03-CLUS12605_2
cagaagaaaatgttaataagtgatttcgctcaccttcttccccagctacagagacgtggtggacagcacaagaagttccgcctatcaattcttatccagagtcacctattacgctcatgtttgcttcaatgggtgccctcttcggttaccggtaacgttcctattccccatcttccataattgaagtcctacataacaactgcttgtggcgcagctaggtgccgccgataggtcgttcgagcgttcccctcaatttcgtctcccacaatgtttgtaccttattcctataaatcaatctcttcgtacctttctgccgctcgaataagcaagcctggagaggatgtataggaaaaacctaacatactgaagttcttgatactagtatgtaaaaacgttaattatcatctctttgaacatgcaacgaaaaatactgaatggttgctcatgctatgtttagtttaccgtagaaagatcgtagcacttttgttggttattttctataatgcggcaatatttcgtagttgtttcaggaggctatgtttgttgttgataaagacaatatttgtgctatcgatagatatgagtattatttagtattggccttagtatgctgttgaaagtatttgattattacatgtataggtgaatattatggaaatgtagagcattatggttattatgtttatattgtgtgtatttcattggacagcttctactggtgctggcgtcgatggtttcgataagcatgatgggtcatattgtc

SEQ ID NO: 13284 - DNA, 730 bp, Sorghum bicolor
  unsure (1)..(730): unsure at all n locations
  Clone ID: LIB5052-012-A1-XP1-H1
gccggccgggttggggaagccgccgccgccaccactactgtcatccgcatcgggaccccggtctccatcccagccatcgacgtccatcgcatggcgactcccgccctttgccgcagccaccgatgccctccacaggaacctggccgcctcccctgaggatatctggagccggtgaatcctacatcgaccccaacacccctcccgcatcggccgcaagcaggagccgccggcagcaccctctagcgtcgaccgcaagaagcacaagcaaaaggcacagatctggtggtaccttgtggctggacttgagacaagtgctagaacgtgtgactaggagaagcaggacagtatggatttttagatcccgttgaacaaatgcttgtataatctccacaagtttatctggacattgaagactccatattgtctcatgagaaggttactaaaggcagcaaaaatctgaggcgtttggtgaggctatctcttaattgcggcaatatgaccaaggtgctcatggtggctattttcgttagtgataaaagatttagttgttcgagcaaatcatacgagttatatgttgtacaagccaatgtctagttttgtaggtacttgagtgtagcatggntattgtcttagtatttcgtgtgaaatattgtacaagtataaatggtgatagttttaatgaaaatgatgagcaatatttgtcaaaaaaaaaaaaaaaaaaggcccctag

SEQ ID NO: 13285 - DNA, 513 bp, Sorghum bicolor
  Clone ID: LIB3478-046-P1-K1-C6
cccacgcgtccgcaaggtgattgcgctccccttcttccctagctagatccacgccatggggacctcaggaagctcccccagccagatccatgacagaagcaccgacgacgcacatgtcgacctcgacgagtgccctatctgcttcctggtaaccatccttttccccatcttccccatctacagttctacctaaccactcctcgccgcgctgctacgtgccggcgctggggcgtccgtgccctcctccaggttttgtctccggcgatgtaggtacccaactccgccagatcagtcgcctccgcctttcctcccgccggcagcaacagccctgaggaggaggcaccggtcctaccgctcctccaggagttcatgattgaggcattgagaacgagctcaaagcatattcaaagttaaatcatattagccattgcatgagtggttaacttgaattcatattaactcaatgcctcaataaaggtacgtttaattcatatagctcaaagcattctcgag

SEQ ID NO: 13286 - DNA, 440 bp, Sorghum bicolor
  Clone ID: LIB3480-007-P1-K1-D3
ggcaggctccctccctccttagctctccctcgacgtcgagctcgcaaatccggctaccccctccctccctctccactcagatccggtgtaggtacagcgagctccctctcccttggtggcgcgtggctataagtgtgcgagcgggcagatccggcggctgcttccctccctttctccctctccgctcagatccggcgcaggtatggcgagctccctccctccctctcgctcggcagcatgtgcgggctcagatctagcgcacgtatggtgagctccctccctctccctcggcagcgtgcatgggcggccacatccggtagcaaccccttgcttcggccagcgctacgatggtggacacgatctagcgcagtggattcccccaagtgtggtttgctcagtttgccgatttgtctgggatgcttaattgcctagtggtcata

SEQ ID NO: 13287 - DNA, 363 bp, Sorghum bicolor
  unsure (1)..(363): unsure at all n locations
  Clone ID: LIB3478-052-P1-K1-D6
ctcaactntaatcacaagttgtttgtattatatttagattctcatgctctactagttggcctctcaaaaatatatgcattgaactagttaactagtctcaaagcttggtgataaatagatattcctttttagaatctttgctagcaaaactgacttatcttatattcatttgattttcaggtagcaaaactgcaaaactgacttttctttgctagcaaaactgatttgctagcagacgcttgatgaggctatgcgtgaattgcggcaagaggatcaaggtgctcatggtggctattttcattagtcatgatagattntgtgtgcgagcaaatcatatgagttgttgctgtataagccaacata

SEQ ID NO: 13288 - DNA, 1384 bp, Sorghum bicolor
  Clone ID: SORBI-28MAY03-CLUS14328_1
tccatctcatcgacaccccctccgcctccgctctccttatcccttcccttcgcataaacccccgccgccgtgaccccgcccgcccgctcgccgccttcccctcgcagcgacccggccctcgctctaggttttaactgccggccccgcgtctccaggtaaagggaagggagaggatggcgtcgccgataccgcgcgaatgggccggtctgcagcagtttccggcggccacccagaccaagctgcacgagctcctcggcaaactcaaggaggaggatgtgagcacattaacaattctggtgatggggaaaggtggagtggggaagtcatccactgttaactccatcgtcggggagagggtcaccactgtcagcgctttccagtctgagggtctgagaccaacgatgtgctcgcgcacaagggcagggttcaccttgaacattatcgacactcctgggctcattgaaggtggatacattaatgagcaggctgttgacatcattaagagatttcttctaggcaagactatcgatgttctcctgtacgtggatcgcttggatgcgtatagaatggatacactggatgaacaggtcataagagccatcaccaattcatttggaaaagatatttggcgaagatcattggttgtgttgacccatgctcaactctcaccacctgatggaatcgactataatgatttctttacaagaagatcagaggcacttttgcgatacatccgctcgggggcaggaatcaacaaacgagaatatggggatttccccctgccaatagcattagtggagaacagtggaaggtgcaaggctaatgaacatggggagaagatacttccagatggaactccgtgggttccaaacctgatgaaagaaattactgttgtcatctcaaacgggagcaagtccattcatgttgatcagaagttaattgatggtccaaaccctaacaatcgctggaagatgttcataccacttatccttgctgtggagtacttcttggtagtaaaaggaatccggagggcgatccatgcagatatcgcaaacgggaaggtggatgactgggagcagcgttaccgggacttggtgggaagcagggaccccgtagagcagaaaggttctacctcccggaaccgcaaagcctaagttggtgtaccagaaaggattttattcatgttgtgacccactcgatctgctgttccttttcctaattctgtgttgggggctttatagagttcgctggtactacttgaaaaagactgctcgtgttgtagttgataaaaatatgttttccattttatgatgcttggccctcttcgcaattttgaagatgttatcgaatacctgctattttattgtctttaatcttatatggc

SEQ ID NO: 13289 - DNA, 1672 bp, Sorghum bicolor
  Clone ID: SORBI-28MAY03-CLUS14530_1
atatagagcgccaggcaggcaggcagtcaggcagtcaaaccctcctcctcctccgctccgtcctggcgtcctccctccccgctcacgcaaaacgcaaaccaccccgcccgccccccgccaccgtcggcagcaacaactactttcctttcgtcctcgtccgtcgcgccccccacccgctcctccactcaccacaccggacggatccggatgtcgtctccgcccgcgcatccattccacacccgcaattccgcagcaaacgctagcagcagcggcggcggcggcagcggttggtagccgcgcgatcgagacggcgggtgacctgccccgtcgcggtcgcggtcgcggggtatatattaccaccaccaagattccaggagacgaggaggcgccgatccgtagcggcgccgagggcgacatcgaggagccgctggtctcacgccgcaccgagacaatggcagaccagttagggttttacactattagatcccatgggatgatattggcaagattgcacatgtatgactggataatacttctcctccttgctgtcatagacgggctgttgaatttaattgaaccatttcaccgttttgttggaaaagacatgatgactgacttgagatatcctatgaagggcaatacagtgccattttgggctgttccactgattggaattatactgccttgggccatctttgttggaatttacttcaaaaagaagaatttttatgatttgcaccatggcatactggggattctatactcagtgctcataactgcagtgattactgatgcgattaaggatggtgttggacggcctcgtccagattttttctggcgctgtttccctgatggaaatgatgtttatgataacattacaactggtgttatatgcaatggagtgaagagcgtaatcaaggaaggccacaagagcttccccagtggacacagttcatggtcttttgctggtttaggcttccttgcatggtacttagctgggaaaatcgcagcttttgatcgcaaaggacatgttgcgaagctatgcattgtgtttctgcctctccttactgctgcacttgtggctgtttctcgagtggatgactactggcatcattggcaagatgtatttgcaggggctcttataggtcttacagttgcttcattttgctatctgcaatttttcccgtatccttttgatggcgatgcttggtggcctcatgcatacacggtccaggtagcggaggaacggaacagcagacatgcaaactcgtacagtgtgagaccaaccgagatcgaaacagtcaatattccaggccacggtgggatgaccctaagagatactctaaacgatgtggagtctggcagtggcaggagattgtgagatgataccgttggagctgcttgcatatgtatacaggtagatgtatttgtagagctgttgactgctgctgccaccgtgggttgcttagacgggcttggcagtaaattacttggtaggtgttgtttcttctgacaatctttgggtttcctttgtgtatacttgttgagtcaagagttgtggttaaagtttgttggcgtacactctttgtagtcagcttggtcagcaactatgatgatcttatcagatgtgcagggtaaatgggtttctcagtcgattgtggattgtgctctt

SEQ ID NO: 13290 - DNA, 974 bp, Sorghum bicolor
  Clone ID: SORBI-28MAY03-CLUS148_1
gcccgcggccctcaaaccacagccactggagcttcaacaacctacgatttccacttcctcccccgctcgccgctccgatggccgtcgccgaagtggcgattgaggttcccccgcagcagcagccggcggcggcggcggcggcgacgcgggagccggcggtggtgccgagagtgctccagtacctgtacctcgcgagtgcgtgggtagcctgcgcgggcgtggccgccgcgaccgtcgcgcgccgggccttgggcgactcttccccggtggtctgggcgctcctcaaggtctcgatcggagccctcgtcttccccgcgctgctcatcctcatcttcgccgtgcgggtcctgcgcgccatgcttgcggcggggttcagacggtcgctccgcacccacgccagggagattcagatccaagccaggaagatgtttggagcgttaacgtggaaggcacttcaggaccctatcgtgcttgcgtggctcgcatctttccttttcatcctcctgcttggagcaagtgttcttgtgtttgtggggcttttaccaatggaggaatctcgcagggaaaggattggttatgtgctctctgatgtgggggtattgggtgccatgtcaatgtattgctttatcattatacccagttttgcgctgaagctctggaggggcatgtagggtggcgatgccacacaaggcacagcactgcgatatctgaggcaaagatagatggagaaggcacaaaagatcaactagtagttacaggcttatagtaaagaccctgaattctgctgatgtctctggcgaagccagctaatgtttcagagaaataattatctcttgcagacttactgttatacctcaatacctggtgatgtgtgtgtaatgtggtcacagtgggtatggctaccctaagccctctcagaacataagtacctcttggacatctgtgccgtcaaaggaatatatactagttgattc

SEQ ID NO: 13291 - DNA, 1126 bp, Sorghum bicolor
  Clone ID: SORBI-28MAY03-CLUS1063_1
cgaagccagggttgcagtcctatctccaccgaaaccatccgattcttctccaaagccaagaaaccgacgagaccatcatggctgctggcagcacggccaagaccctgctcctcggcttcctccttgctctcacggcgacctcgacgccggcggcggccaccacgctgacgctccacaacctgtgcccgtaccccgtgtggccgctggtgaccccgaacacggggttcccggccatctccgagaacacgggccgcctcgacggcggcgggcgcgggctcgtctccttccgcttcccggacagcttctgggcgggccgcgtggtggcgcgcacgggctgcagcagcagatccggttcgccgccgtcctcgtcctcgtccggctgcgagacggggagcacgccgccggcgacggtggtgcagctggtggtgcacgcggaagggcaggacctggcggcgtacagcgtgagcctggtggacgggttcaacgtgcccgccgtggtgagcccgcaggcagtgggcggcgggcagtgcccggccctggggtgcgcggcggacctcaacggcgggtgcccgcgctcgcagcgcgtggtcggggcaggcggcggcgtggtggcgtgcaagggccccgcggcgtacttcaaggagcggtgcccgctgacgcgcaccacggccaccgacgtcgagcccgtgccgcagcggtgcttcgcgcccggcgagctcaaggtcgtcttctgccagtccgccatggtgaacaacaacgacgccgccggcgagcccgggcgcatccgcaccgtcgtcgtcgcggacaactagagctagtagctatatgtgctatagccgccggccggtggtcggtcactgatcagttgaagggaggagatgcatgccggccctctggccatctgattagtgtataataaaggtagttaactaggtaattaagcgcgtgtgtcactagtaagactgtgtatgtgtatgtgtatgtgtgtgttactacttactagtataagttggcattggcttcgttgccaagtgtccggccggcaggtatgttttcgggtggccacacgtgttcatgtcttttgtcatatgtcatgtgccttgttgagtttgctggattaaaaact

SEQ ID NO: 13292 - DNA, 1554 bp, Sorghum bicolor
  Clone ID: SORBI-28MAY03-CLUS10736_1
gcacgcgccccgctcttgttcagaggggagggagtaaagcaaacagcggtgggcatggtgggcccaggaggagcgctcgccgcggccccgcgcctcctcgtgctcgtgctcctctccttcctcgccggtggagcccgcgcatccccggccacagacgcgctgcgccgcgtctccccgctcgcggccgccggcggcctctgccagcagctgctcctgccgcagggctacccgtgcaccgagcacaccgttcaaacggatgatggcttccttttgtctcttcagcatattccacatggcaaaaatggaataccagataatgctggacctccagtttttcttcagcatggtctttttcagggtggagatacatggttcataaactccaatgaacaatcacttggatatatccttgctgataatggttttgatgtttggattggaaatgtccgtggcacacgttggagtaaaggccactctactctctctgttcatgataagcttttctgggaatggagttggcaagaccttgctgaatacgatgttttggcaatgttaagctatgtatatacaattacacagtccaaaatttcatatgtgggacattcacagggaactatcatgggtctggctgcgtttacaatgcctgaaatagtaaaaatgataagctctgctgtgcttctttgtcccatttcttaccttgatcacatcagtgctagttttgttcttagagcagttgccatgcatcttgaccagatgcttgttgctatgggcatccatcagttgaacttccggagtgatatgggtgtccagattttagattcgctgtgtgatgatgaacatttggactgcaacgatctgttatcttcaataacaggtcaaaactgttgtttcaattcatctcggattgactattatttggagtatgaaccccatccgtcatcaacaaaaaatttgcggcatcttttccagatgatcaggaaaggcagtttcgcaaagtatgactatggatggtggggaaacataaggcactacggccagcggcatcctccctcattcgatctaagcagcataccggaatcactgccaatatggatggggtatggaggccttgatgcactggctgacgtaacagatgttgagcgcaccatcaaagagttgagatccacgccagagctgctgtacattggtgactatggccacattgatttcatcatgagcgtgaaggcgaaggacgatgtttatgttgacttaatgaggtttctcagggcccagcagggaatgcacagtagttattaggacgcatcgtatgcctttaattaaatgtttatactatgatgacagtacgactatgtaaatacgtacatagcatagcttgtaccggccggcgacaagcccaaacagtcaattgcattgcatgtgtgtggtgtctggtgtgtggattgttctccatttgatgtactgctttctgagtacagtacatgtacatatatgtatgacgaaatatgtggcacaagcaatttggccacatatatgtaataccaaattttaccacgc

SEQ ID NO: 13293 - DNA, 1142 bp, Sorghum bicolor
  Clone ID: SORBI-28MAY03-CLUS99_1
cccagcgtccgaccagagcgaggccgcactcccccccgagtccactccgaccgcacgctccgcgacgcgatggccgcgctccgcctcgcctccttcaccctccgacccgccgccgccgccgcggcgtccgcctcctccggcgcgacccccgcggcgccccggtccgcctccttcgcccgcgcggcgcgggggctaccctccctccgcctggccccgccccgccgccgcggggacctcgtcaggccccgcgccgaggcagcggcggatagctacgcgtccgcgctgtcggaggtggccgtcgagaacggcaccctcgagcagacggtctccgacctggagaagctgcagaagatcttcgccgacgagaccgtcgccgagttcttcgacaatcccaccgtcccgcgcgaggagaagaccgcgctcatcgacgagatcgccaagtcgtacgagctgcagccgcacgtcgtcaacttcatcaacgtcgtcgtcgacaacttccgcgcgacgatcttgccggagatcgtcgtcgagttcgagaacatcttcaactcgctcacgggcaccgaggtcgccaccgtcacctccgtcgtgcagctcgagtcgcaggacctcgcgcagatcgcgcagcacgtccagaagatgaccggcgccaagaacgtccgcctcaagacacagctcgacccggagctcatcgccggcttcaccgtgcagtacggccgcgacggctccagcttaatcgacatgagcgtccggaagcagatcgaggaaatcacgtccgagttcgagttgcccgacgtcccgctcgaagtctgactggcttgaggcgtccatcctcgcccttgaagcttagctgctactgtctgacgcaatggcatgaatcaagcgggaatgtcggtcctgtccccttcatacctgcagatcaatggtggtggctccaaatctccaatacatatgaacggacattctttttttgcgtttctgttttccttctttttctttttggcgggaacctgtgtaattctttctccttttttctgtggttgacagacactgtaatatgtttaaaacactcactcatctatatatagctgtgcacctcttctctcaaaaaaaaaaaaaaggataaagtcgcggagatttgt

SEQ ID NO: 13294 - DNA, 607 bp, Sorghum bicolor
  unsure (1)..(607): unsure at all n locations
  Clone ID: LIB3481-057-Q6-K1-E3
gttcttcgacaatcccaccgtcccgcgcgaggggnaanaccgcgctcatcgacgagatcgccaagtcgtacgagctgcagccgcacgtcgtcaacttcatcaacgtcgtcgtcgacaacttccgcgcgacgatcttgccggagatcgtcgtcgagttcgagaacatcttcaactcgctcacgggcaccgaggtcgccaccgtcacctccgtcgtgcagctcgagtcgcaggacctcgcgcagatcgcgcagcacgtccagaagatgaccggcgccaagaacgtccgcctcaagacacagctcgacccggagctcatcgccggcttcaccgtgcagtacggccgcgacggctccagcttaatcgacatgagcgtccggaagcagatcgaggaaatcacgtccgagttcgagttgcccgacgtcccgctcgaagtctgactggcttgaggcgtccatcctcgcccttgaagcttaggtcctttctgctgcctctctctccatctgtatcattctctgattgaatgtttgaaatttgaatgaatggtgaatactgcataaaaaaaaaaaaaaaaaaaaaaaaaagggcggccgccctttttttttttttt

SEQ ID NO: 13295 - DNA, 817 bp, Sorghum bicolor
  Clone ID: SORBI-28MAY03-CLUS108265_1
gcacgagggacgacattaacggaagctaacgacgatcagaagaacaatggcagatgcacttgtctccagcaagaaggcgtcggcttcagcggccgtcgtcctcgcggtagccgtggcgacaatggcgtgcctctcagcgccggtggccgcgctggtgccgtacggtcgcgccggcggcgggctgttcgacctgatgctcctcgacgacccgttccgggtgctggagcagtcgccgccggtgccactgcccagagccagcctcgactcggcttcggtggcgctggcgcggtgcgactggaaggagacccccgacgcgcacgtcatcacggtggacgtgcccggggtgcggcgggaggacgtgaaggtggaggtggaggagaacagccgcgtcctgcgggtctccggcgagcggcgggccgacgaggagaaggagggcgagcggtggcaccgcgccgagcgcgcggccggacggttctggcgccggttccggatgcccgccggcgccgacgtcgaccgcgtgtccgctaggctggaggacggcgtgctcaccgtcaccatgcccaaggtggccgggcaccgcggccgggagccgcgcgttatcagcatcgacggcggcgatgtgggcggtgcggaggcggcggaggtcaaggcgtccaaggccgagatgtgattatgtgaatgtgacctgacttttggccggcgcggaagcggaagcttgttttcttttcgtgtgtgtcccgcgtgtgttggtcctgttgcttttgtaatatgtactgtatttactactcaataaaaaaacagtttttctcattttttc

SEQ ID NO: 13296 - DNA, 965 bp, Sorghum bicolor
  Clone ID: SORBI-28MAY03-CLUS108644_1
gctccgcgccgcatgcggcggcgcaagcgcgagcaaacagccaaaaaggaggaaggaaaggggagagagcagttagcttgagcgcgcgcgcgacagagtcgagtcgagtcgagggggaatcaccgccggagaatggggatgagcagggctccgcgacgacgggcgtccccatccgcggcggcggctgtgccttggctgcttctcttcgccgttctattcgtgggccgggcgacggcgcaaggccccggcgcgacgccgctgtccaagcacgcgtcgttcttcgaccgcaacggcgacggcgtcgtctccttcgaggagacgtacggcgcgtttcgggctctcgggtttggattcggcatgtccggcgtcagcgctgccttcatcaatggcgctcttggtagcaagtgcagacctcaaaatgcaacgtcatcgaagttggacatctacattgaggacatctataaggggaaacatggaagcgattcaggctcatatgacaccgaaggaaggtttgttcctgataagttcgaagcgatattcgccaatcacgcaaagactgtccctgacgccctgacatcggacgagatcgaccagctgctccaagcaaacagagagcccggggactacaccggatgggccggcgcagaagcggagtggaagatcctgtacagcctcggcaagaaccagaacggcctcctccacaaggacgtcgcaagaagcgtctacgacgggacgctgttccacaggctcgcgcccaactggaaacctctcgacaaggagagcgtgatcagggagaactgaaccgagaggaccgtgccatctgcgttctcttgcgttacttgttggtacaagcaaatccgattaagataaggactgtgggctctgaacatgttgtcaagcaacttgtaaagcggtgtgaacaagtgtgtatattaaattataactaagtacatcatcacgttacg

SEQ ID NO: 13297 - DNA, 1607 bp, Sorghum bicolor
  Clone ID: SORBI-28MAY03-CLUS11057_1
gcacgaggcgcacgaggtgataatggattctgactggaaatataatgatgaagtgtcacataaaagtggcaatgtcatggataaagccaaggtgtggcctgagtttcagtacagtgagatgtgcttcagtgataggattatcattgagctgagtgaagttggtgtatctattgaacctgtgcctgatcttgcacagagcgaggacgaggatattaatgctgaaatctgtaaattagaaggccaacttcataaagaggttgtggagaagaaaaacttgctattgaaactggatggcattgttacaactgcaaaagagtctcagcagagggaattctcacggcttgccatggatagacttctcctgagagcatatgagaaatatatggccttctatggtccaaatgtttcaagcagcaaaaatgttagtagagctggcagacatgctgctctaagttttgtcaaacgagtactagtgcgatgccaaaactatgaggaggcagggacaagttgctttgatgagcctactttcaaggatatgtttttgtcagcgacgtctcacagaagcagtccagatgctgcgtcacaagataataatacagcagtgaaaccagtccacagggccagtgcatcagatgcttcgcgaggaagcagtcacctgacggacctgtcatttgctaaggaggatccctggacaaacaatgtaaaacaaagggaattgttgctcgatgaggttgtaggtagcataacaggaggaactttgaaaacctcaggccttggtacttccctagtcagcaatacgaaaggaaagagaagcgagagggacagggaagggaaggggcacaacagagacagtcttaggtctggccgtccatcgtcatccaatgcaaaaggtgaaaggaagaataaaacaaagcccaaacagaagacggccaacatatctgctccttcaagcagtaaccctagggatctacagcttcctgccaaaataacacctcccagcagcggcaaggacaacacaacagcttcagctgctgctagacatgatgatccggcaaatgcttcaaatgacgctgaaatgccagacttatctaacctcgagctgccaggaatggacgttgactttggcggctggttaaatctggacgacgacgatggactccaggatctcgacttgatgggcctcgagatccccatggatgacatcaacgaaataaacctcatgatatagctgtacattttctttcatctcagcgggcccccatagaaaagctcatgatatagtgcacaggtaacatgtgattttctcacagtaaccaccaaaccagcagttttaacaccaggcctgttaggcttcacttagttttgataaagaaaaagtttatagagacctcttgacaatcccaacaaccgcatgttgtccctttttgtaccagcgtgtaatttgcctccctaccttgtaccctatggtcttctgtctgtgtagacgtcggtgtacatatctattttggtgcggtacaaggtagggaggctagttactccatttatcgaggtgtactccaaaggttgtatatatcagtaattcagtgtcaccatcaaaggggggcccg

SEQ ID NO: 13298 - DNA, 1486 bp, Sorghum bicolor
  Clone ID: SORBI-28MAY03-CLUS11327_1
acctcgatcgtcactttgacccggattgtgatcacgtttcaaattaactttttccaccatccaccagctccagaatctccaccgccgccaacacaagaatcgattccaaaagccttcgtcctgctgcctaattaatgcagtcccgtcgcgctcacgctcattttcctccttaaattttccgcaccaaattctctcgtggggcgcagaaaacacaagccaaagatcagaagagagcacgcggaggtcatggcggtggatccaagcgccgccgcgcaggcggaggccgcggcgcgccggatcgaggaggcggaggccttcttccgcgccgcgccgccgctccgcgaccgcgaccgcctcgccgccagcctcgccgacttcgtcgcccgccacgccgccgggagcggcggagtggtgtgcatcacctccggcggcactacggtgcccctggagcagcgttgcgtgcgcttcatcgacaattttagctccggccagcgcggtgccgcatccaccgagtattttctcaaggccggctaccctgtcatcttcatccatcgccgtgggagcaagcaaccttactgtaggtttcttccagaggattcctttctcgatctttttgagctcggtgaagactcggagatccaagttccacagtcgcattcctcggtggtaaaggcagcaattagcaattaccggaaggcaattgatgaaggccttcttctcaaactccctttcacaacaatttttgagtaccttcagttactacaaatggtagctatttctatgaattgcttggggcaccgtggaatgttttatcttgctgctgcagtttccgacttctatgttccatgggaaactatggctaaacataaaattcagtcagcaagtggccctttgaacatgcaactcaaccaagcccctaagatgcttttcatcctccggaaaaaatgggctcctgctgcattttgtgtatccttcaagctcgaaacagatcctaatattctcctacagaaggcagaaatggctttggaaaagtatggtatgaacgttgtggtggcaaatgaacttgcaaactacaaagatgtagtagtgatggtcacaagcagcaggaggacgaccgtgagcaggagcagcaaggaggaagacctggaactgcagctaactgatctcctggtgaagatgcactccgagcacattgcacagcccaatttgtaggaccgttgagagagcgaacgagatggtcacatcagacatggtggcgagtccacctggttcgtcatcagatgcccatcaatgtgctgcagcagattaataccaaagttataacccacgccaatacctgtaagttttttaacataacctagctaaagcaggtgatgtgatgcactgttcatgtggcgaagccgcgccatcctagctaattagctatcggctttttaataaacttgctgctattgagtcaaactgttatggtagaatcgccaattgg

SEQ ID NO: 13299 - DNA, 1164 bp, Sorghum bicolor
  Clone ID: SORBI-28MAY03-CLUS1683_1
cccctgcggcgcgcgcggggttctcgggcgtggcggcgtcggcgcccgcggccgcggcggcggtggccccaccggcggcgtgctcgcatcggtagagtatagatcggcaagatagggcaacagtgactggtctgcaggggagttgccgatgaaggtggttgccgatgaggagacagccgaatgtgactaagtccaggggtggtgacgcgttcatgccgatggtcagcgattatgcctttgccgatggccatgatgaggaggatcgccgatgattactggcaaaatctcgaggtctgcgattgcagccctggtagctgatgtcttctccaatgtggcagtcgctgagaactaagtcagtgaagtttcaactagctcatcagcaacaacgaagaccataacataggctttcatatctattcctgtagacgctagtagagcagagtatcaagatgctcctgcgaaagcacaagtcaaagaggaaaccttggcctcaaaacaagctaatgaagctgaagcggctgccagtaaatatgaagctgacacgaagaaggcacccttagaagatgcagctgctactgctagcccagtaaatgatgaacgagcctctctagagaacctgttgagtatacccaaagtgatcagtacggatttcttttgggagaagttcagcacacagcttgctgaagtgacgactcctcgaacctcgctacaaaaggaaccaaaggcacagatagccactgtgcgaggtcaggaaaaagcaaagaagctgacaccgcggattgccactgtgaagcccgccgcgcagaaagtgaagcaacaattgaagcagccagatcccaaaccagaagtgaggccagtgtttggtggcctcttcaagcaagaaacagtgtatgtggatgatgactaaaacaaggagagccaatttatcctctacgtgatttttcctgcaatataggaacgcttaaagctgtacaaaatttggctataagaacccatttgtctgtggatgaagaatgatcatgtgttacagaaccaaatgctggtacaaccgaactgatgtacacaggagcaaattgttttttttttgaaactagcaaattggttttcttgaagagtaagtttctcgagcccaatggcgaacatcatgcggaagtgctgggacgc

SEQ ID NO: 13300 - DNA, 1419 bp, Sorghum bicolor
  Clone ID: SORBI-28MAY03-CLUS17004_1
cccgaggggaggaggctctatccaacgtaaccaccaccatctctgtatcggcgagcagcagacacagacagaggaggaaggaggggagcctgggagcagcgaggcggaaatggggctccgcgtccgcgcctcatcgcttctgctatccctggctctcgagctcgtggtcgcgctcgtctcagtgtcggcgcagcaaaagttcgggatcaactacgggcagatcgcgaacaacctgccggagccgacgcaggtggcgagtctcctccagtcgatgaacgtgaacaaggtgaagctctacgacgcggacccgcgagtgctgacggcgttcgccaacaccggcgtcgagttcatcatcgccgtgggcaacgagaacctgcagaccatggcggccagccccgccgcggcgcgccagtgggtggcgacgaacgtgcagccgtacctcccggcccacgcgcatcacctgcgtcaccgtcggcaacgaggtcttctccagcaacgacacgtccatgatggccagcctcctccccgccatgaaggccgtgtacgccgcgctgggaggtctgggcctcggcagccaggtcaccgtgtcgtcggcgcactccgtgaacgtgctcgccaccagcttcccgccgtcgtcgggcgcgttccgggaggacctcgcggagtacatcaagcccatcctcgtcttcctcggccggccggccccgccggtcccctccttcgccttcccgctcgccgcctgcaaggcgagccccgggagcgtgtcgctgccgtacgtgctgttcgagcccaacccgggcgtgcgcgaccccaacacgggcctcacctacgacaacatgctctacgcccagatcgacgccgtgtacgccgccatgaaggccatggggcacacggacgtgggcgtgaggatctcggagaccgggtggccgtccaagggcgacgaggacgagaccggcgccacggtgcagaacgcggcggcgtacaatggcaacctgatgcagaggatcgccatgaaccaggggacgccgctcaagcccaacgtgcccgtcgacgtgtacgtgttcgcgctcttcaacgaggacatgaagccaggacccgcgtcggagaggaactacgggctgttctaccccaacggctcgccggtgtacgcgctcaactccgccggctccggcggcggttcgagtcccggcgggtcgctcaacccgtactacacgtccatgttctcctcctcgtccagatcggcggtgagcgcaacctttttgacagagagagtgatactattactgctgctgcaagcgattgtaatactgcgacaatcatattcattgtactgttagtcagtgataccttgtaatcttgtatacggaaatatgcaatttcaattcaaccatagggtaggcctagattcggcaatttggc

SEQ ID NO: 13301 - DNA, 865 bp, Sorghum bicolor
  Clone ID: SORBI-28MAY03-CLUS17180_1
gcacgagggtcggatcggatccgatccaaagcaagcagcagccgggaggagggagagccctcgcctccggcccccccagacgccaaagcaatccatcctcctctgctgctctcgtctcgctcgtcttcgtcttgctccagccgtcggatcggatccgatccaaagcaagcagcagccgggaggagggagagccctcgcctccgtctcccgcagacgccgcaccccgtccgtcaccaaagcaagaggaggaagacgaggatgtcggagtccaaggtgtacaccctcgaggaggtggccaagcacaacaccaaggacgactgctggctcgtcatcggcggaaaggtgtacaatgtgaccaagttcctggatgaccaccctggaggtgatgatgttctgctgtcttccactgccaaggatgctactgatgattttgaagatgtggggcacagcaccactgctcgtgcaatgatggacgagtacttagtcggcgaaattgatgcagccacaatacccaccaaggtgaagtacacgccccccaagcagccacactacaaccaggataagaccccagagttcgtcatcaagatcctccagtttttggtccccctggcaatattgggcttggctgtcgctgtaaggatctacaccaagtcggaatctgcctagtttgctgtcaatgcttaaatgaaagatcatgaactgaataagttagtgaggattgcatcgtgtaccagcatcgcctgtcattaattcagaaacttcagtctttgctgtcgaatggttgtgtgagacgtctattggtaaagtgagacctgaatggaattgatggctgttctcgtaaaaaaaaaaaaaaaaaaggccccta

SEQ ID NO: 13302 - DNA, 1418 bp, Sorghum bicolor
  Clone ID: SORBI-28MAY03-CLUS12497_1
attgtatcacttcggccaccggccgggccaccaccaaagcggacgctggagtgtgggaaaacccctgctggttcgtccgctcccgtcagatcggatcgatcactcgacgagacctctcacctcctccgccagtcgccatggcggcgctgctgctgcgtaggcttgccgggacccaccgcggccgtgtgccgctgggggccgccgccgccgccgcctgcggtggagccgcgctcttctacgcctcgtcttcccccaccgttgcgtacctggaggagaagggcgaagccgctgagaaagttgcacttaaccctgataagtggttagagttcaagctacaagacaaggcaacggttagccacaactcgcagttattcaggttttcatttgatccatcaactaagctgggacttgatgttgcctcgtgcctcatcacaagggcacctatcggtgaggaagttgagggaagaagaaaatttgtgattcgaccgtacacacctatctctgatccagattctaaaggatattttgacctattgatcaaggtttatcctgatgggaaaatgagtcagtattttgcaagtttgaagccaggagatgttctggaagtcaaagggcccattgaaaagctcagatacagcccaaacatgacaaaaacaaattgggatgattgctggtggtactggtataaccccaatgctgcaggttgtcagggctatcctcaaaaaccctgatgacaacactcaggtctccttaatttatgccaacgtgtcaccagatgatatcttgctcaaaagagaactggatagacttgccaatagctatcctaacttcaaggtattttatacagttgataaaccgtcaactgactggaggggtggtgttggttttgtatcaaaggacatggttttgaaaggtttgccaggccctgcggaggactctctgattcttgtttgtggtccaccaggaatgatgaatcacatatctggagacaaggccaaggatagatcacagggcgaggtctctggcattctgaaagatttaggatacacggcagagatggtatacaaattctgagaagacagtagattctgctgacatacacatacttgctgcccggcagcagtcaataaaacacacctgaactttttgttattgttgcagcgtctggctctgaactggaaacagttttgacttgtttccttttgtaataatgttcgtcagagaattctagttctaggttctgagttatcgctgagctgatggctgcagtgatctgcagatgccacgctgcgatgtttacgaaaaatcgagtatgctggcacttgagataaagctaccgatttctagtggacagttgcagtgaattctagcatgttggatgttggaacccacccatttggggcaatcattagcccttc

SEQ ID NO: 13303 - DNA, 1360 bp, Sorghum bicolor
  Clone ID: SORBI-28MAY03-CLUS12890_1
gcaagagcaagatatacttcgccatggagtacgtccggggcggcgagctcttcgcccgtgtcgcccggggccggctcaaggaggacgtcgccaggaggtacttccaccagctcatcggcgccgtcgacttctgccacagccgcggcgtctaccaccgggacctcaagccggagaacctcctcgtcgacgagcatggcaacctcaaggtgtccgactttggcctcagcgccctcaaggagtgccagaagcaggacgggctgctccacaccacctgcggcacgcctgcgtacgttgcgccggagatcatcagcaagaagggctacgacggagccaaggctgacatctggtcctgcggcgtcatcctcttcgtcctccttgccggctacctcccgttccatgactccaatctcatggagatgtaccgcaggatcagcaggggtgacgtcaagtacccgcagtggttctcctctgatctgcggcggttcatgtccaagctcctcgatcccaacccaaacaccaggatcaccatcgagaagctggtcgagcacccgtggttcaagaaggggtacaagccggctgtcatgttggcacagccgcacggctccaacagcctcaaggatgttcaggttgccttcagcaccgccgacaatgaaggtggcagcaaggtggagcagccggcgggcagctccgtgaagccgtcgagcctgaacgcgttcgacatcatctcccactccaaaggatttgatctgtcaggcctgttcgcggtggaccaagagcagaaggccagcaactcacggttcatgacccagaagccggcgtcagcgatagtgtcaaagctggagcagattgctgagacagagagcttcatggtgaagaaacaggacggcctggtgaagctgcaggggtccaaagaagggaggaagggacagcttgcgatcgacgccgagatcttcgaggtgacaccggccttttatgtcgtcgaggtgaagaagtcggcaggcgacaccttggagtacgagaggttctgcaacaagggcctaagaccttcactcagtgacatctgctggagcagccaatcagaggctccttcaggggttcagtcatcaccattgaagccatcctcttagtcgatcgtaatttaagtgcaatctcttcagagatgtggttgcaatccatcctctccctcctttttcttccctttctcaaagagctaggaccttgctcggttgagcatcaggctgtagggatctttgtgttcctttctgccagctttcttcttgtagtagcagttgttcagcatggaactcctgttcctttcaccaatagaagcacaatgatcagcactgtcaaccatttttct

SEQ ID NO: 13304 - DNA, 1708 bp, Sorghum bicolor
  Clone ID: SORBI-28MAY03-CLUS12979_1
gcccgtgcgccctgcatcctcagggatgctgagcctcgaaaagcagcgcagggcttgttagcgctgcccctcaacagaaggtgccaaccacttcagatttccgaaggagaccaccagctccatttctgcacaaccagcgcgtctactcccctctcctttcccccgcgcatctgctccgttctccggcgaggaatccggcgccggcgccgcctccggacagacttccgatggcgacgccacggaagccaatcaagcttacgctgccgtcccaagagaccaccatcggcaaattcttgacgcatagcgggacgttcaaggacggggatctgcgcgtcaacaaggacggcctccgcatcgtctcgcagagcgagggaggcgaggctcctcctatagagccactggatagtcaactgagcttagatgatctagacgttataaaagtgatcgggaaaggtaacagcggaaatgtgcaattggtccgccacaaatttactggccagttttttgctctgaaggttattcaactaaatattgatgagagtatacgcaaacagattgccaaggagttgaaaataaacttatcaacacagtgccaatatgttgttgtgttctatcagtgcttttatgtcaatggcgccatttcaattgttttggagtacatggatggtggttctcttgccgatttcctaaagactgttaaaaccattccagaggaccaccttgctgcaatttgtaagcaggtattaaaaggactgatacacttgcatcatgagagtcacattatacacagagatctgaaaccatcaaatatattgataaatcataggggtgaagtaaaaatatcggacttcgctgcgcgtccccttggtccgcctccccctcgtcgcgctgcgcgtgccggcccaggctcctccttggcgcccgctggattctctgccgagctgcgtggctccaggcgtgatatctggggtcgggggcgggtgctgcgggaatgtgcaacgggactttcaccaattccgcctcctcaaagcttttacgaacttcttgaagctgttgttgaacatccaccaccatctgcaccgtcagaagagttttctccgcaattctgctcgttcatttcttcatgtatccagaaggatgctaatgatagaaaatcagcacaagtcttattagatcatccgttcctcagcatgtacgatgacctgcatgttgatcttgcttcctactttactactgctggatctccactcgccaccttcaattccaggcaactctgaaactgaaagggctcgatggcaaatggcaggcagtttctcatctgctgaaaggactggactggtaaaccctttggtagtttatctgtgtagagctgtagtagcttactgacatgaatgtttcgagttttcccattttttcctcactttttggaccaggcttggggcgtgtaatgagatgcaatgatcttgtgtgtgacaagtgtgtgacaagtttgtgattggcgcgtggcatcataatacacacatgcatgatatatacatgtatagcattctaggatcaatgagcactgaagttttgcctgtctgtatatcagcagcacctttggctcttgtttgttacacaatgtattgccttcctcatgtactacaatggccaccttaattaaaaccctgtattggatcgaccattttctcatttggagcatgagata

SEQ ID NO: 13305 - DNA, 1034 bp, Sorghum bicolor
  Clone ID: SORBI-28MAY03-CLUS13129_1
gcacgaggcgatggaaactctagtatggtcttcagggagaggccatactattctgctccgcagaggaccaacataaatgccccccctgtcccaacacctcctggttcttctgatagtctacattttgtgcatggtgggtatgcccccagagcagcccctcctaacaccatcagcacatatcctgccccagcttttgcgacttctaacaacacggtgacagtcacccatgagcctgatatccctagctatcggcctgctgtccctagctacccgcctgctacctcagcagcagcatcaagtattcatgctgaagctgctacatctccaagacatctggggcatgtggctctaggttccggtggtagtgcaaggagtagaaggctgagggattcgtaccatgcttttcgtccactgattattgaagaaaataacttgagaggaccagcagctgagcggtttatgatgctggatgagttagttatccatgaatcgagagaagattctgatcctcactgggacatgagactggacattgatgatatgagttacgaggagctgctggctttgggagaacgaataggcaatgtcaacactggcctagctgatgaaaaactttcaagctgtgtgatggagataacttgctgcagctctgcccgtacccatggtgatactgagagcgcaagatgtgtaatttgcctggaggattacaaattcaaggactctatcggaaagctgaaatgcggtcacgactaccacgcagactgcatcaagaagtggctgcaggtgaagaacgcttgcccagtctgcaaagcttctgcggcagacgacagcggaggcaccgaatgaagcgccctcctgccccgccacattcagcccatctcaggcgaaactgtatctattggctgatctggtcctgctgtgtaaataatggtcctggaacggattatttgtgagctgaatttgaactcgacatctaaaatataatcctcaagctagttgctaattaatcgatggtagcatttcattcttttttc

SEQ ID NO: 13306 - DNA, 895 bp, Sorghum bicolor
  Clone ID: SORBI-28MAY03-CLUS14132_1
gccggccgggtcgggtctccgtgccacttggtgtgctcaaggcgaacgtaataaaatttgaacctgagctgccctcatggaagagctctgccattgcggacctcggcgtcggcgtcgagaacaagatcgctatgcactttgacagagtcttctggcccaacgttgaggtgctgggaatggttgggccgacgcctaaagcctgtgggtacttcctgaacctgcacaaagcgaccggcaatccggtcctcgtctacatggctgccggaaggtttgcccaggaagtggagaaattgtcggataaggaagccgtcagcttggtcgtttctcacctgaagaagatgcttccagatgcctctgaaccaacgcagtacctggtgtcacgctggggctccgacccgaactctctggggtcctactcctgcgacctggtcggaaagccggccgacgtgtgcgcgaggttctccgcccccgtggataacctgtacttcgccggcgaggcggccagcgccgagcactcggggtcggtgcacggcgcctactcgtcgggcattgccgcagccgaagaatgcaggaagcgcctactgacgctgaagggcatcccggacctggtccaggtcgcggcatgggaggagatggccggagctgtggctcccctgcagatttgcaggacctgactacctgagtgagctggatcagtgattcagtggctgccttggagtggtttgatgacgttgttgctgcttcctgacgatcgcgaaagtcctttatattgtgtaataatgttattatcttgaacgtgtgtattgtctggaataagtcaagatcgactgatactgaacttattacgttactccttcaaatacttaataataaattatgagtccttaattcaaag

SEQ ID NO: 13307 - DNA, 1088 bp, Sorghum bicolor
  Clone ID: SORBI-28MAY03-CLUS14288_1
gcacgaggaagatatcgagattgtgtacaggccgctctcagagatgtatgaagctgcagctgaagctgacgtggtgttcacgagcactgcatctgaaaccccattgttcacaaaagagcacgcagatgcacttcccactatttctgatgccatgggtggtgttcggcttttcatcgacatatctgtcccaaggaatgtcagtgcgtgtgtctctgaaattggctctgcacgagtatacaatgttgatgacctgaaagaggtggtggaagccaacaaggaagaccgtctcaggaaggcaatggaggcgcagacaatcatcactgaagagctgaaacggtttgaggcatggagggactctctggagaccgttccaaccatcaagaagctgaggtcatatgccgacaggatccgggcctcggagctcgagaagtgcctgcagaagatcggggatgatgttctcaccaaaaagatgaggagagctatcgaggagctaagcaccggcattgtgaacaagctcctccacggtccgctgcagcacctgaggtgcgatggcagtaacagccgcacccttgatgaaacgctcgagaacatgcacgctctcaaccggatgttcagcctcgacactgagaaggcgatcatcgagcagaagatcaaggctaaggtggagaagacccaaaattgaggacatgaagcaatttttcttaaccgtgtatacataccctccaatccgattccaatttttttgatcatttcacttactgagctcctcccctgcttgctgagacgtcaactgtgccgcacattagcgccatggcagcagctcattctgttgagatagagtggcaaattgtctctactccagctgcttttctttgtacattattgcttgagctgctgtgacaagagctccattcttcgtaatcttaagctatatactttattcggacgacaggaatctatcgatgtggctgatgttgtttcccctttggcattatacttgtaaggtttactatatgagaggattatctatttggcactgaaacaaataactcttcccatatatagcactccaaaatttgaacttcctt

SEQ ID NO: 13308 - DNA, 1080 bp, Sorghum bicolor
  unsure (1)..(1080): unsure at all n locations
  Clone ID: SORBI-28MAY03-CLUS9283_1
gcacgaggggcccgtcccatccatcgtctcgcgtctgcggcgtgcaggtgcaggtccagtgcgtcgcctctcgattcgattctttcatggatggatggtctccgcgccaacccttagcttcctccaaatccatcgatcgtcaccatcccgaccccaatcccagccccgccccgccccgccgatgatgcagcagcaccagcaagaggacgacccagcaccgccacccgcagtcgccgatcccgaccctccgccgccccccgaccgcggtgatgccgccgcctccgcctcccgcaacgcctcctccaagtacgatttcgtcaaggtcaaggtgtggctcggggagaacgccgaccactactacgtcctctccaggttcctcctcagcaggatgctcaccgtcaccaagattcctaatcatgtcgccatcaagattgcccttgagctcaagaagctgcttgtcgacaacagcctgcttgatgtctcccagagtgatctagaggctaatctattcaagcttatggaaaaacggggatatggcgaggactatataaatcgctataaaatgatgacaaggttccatcatcaaagggttccactagtcattttagtgtgtggaactgcatgtactggaaaatcaacaatcgctacacaacttgctcagaggctcaatttgcctaatgttttacagacagacatggtgtatgagctgctgcggacatcaacagatgcgccacttacttctgttcccgtgtgggctcgggattttaattcacctgaggagcttatcactgaattctgcagagaatgcagagttgtacgcaagggtttggctggcgatttgaagaaggccatgaaagatgggaagccaattattatagagggaatacatttggatccaagcatttatcttatggatgaggaaaagagagatggtaattccaggacggagaagacagtaatggattctgaaaatccaggcatctctgtagaaaggaagaccgaacaccaatccaaaaatggactagcagagaacagaatgaatcctacggaggacaacanaaaacttgtcaaaatcaaaga

SEQ ID NO: 13309 - DNA, 707 bp, Sorghum bicolor
  unsure (1)..(707): unsure at all n locations
  Clone ID: LIB5048-008-R1-XP1-G11
ggccggggttcatgggcggatgatagcgtatccatgtcttgcgggcgccgcgacttcaccccccggctgtccagcctgcgcacctccttggtattggattctgaagcaggcatgcgcgggggtgactgcttccccaggggcgccaacaggctcgcctctacggtgaaggattgctgtatgaatctggcaggcttggaaccttttgtcgacgaggcagagcggttggccaaggaggcggagcggatgcggtatctgcgggagaaggcacggcggaaggaacaacgcgatcgggagcggatggcggaagatcgcatccgcgacttcgatcccaagcaagggggcgaatacttcaccagactacaattcgtcgatctaacaaaattcgatctcgacgaggagtcgccatatggtccgatgagatttactgatgctgtctataaaagtaaggacgactatgagctgtgtgagggaatgaacattttctcagtgagaatagccacctctgatgttggcttcccaatccatgtgtacggcactgtcattgctcgagacagtttggacaaaaagtgtgtttatgtcttccgctgtgacagagatcattgccaactcatcaactctaaggatgaatctttggtcttgacaggtccgaaacggggacttgcgntgatagatgagaattatgtcgaaattgatctgaagataaggat

SEQ ID NO: 13310 - DNA, 484 bp, Sorghum bicolor
  Clone ID: LIB3476-060-P1-K1-F3
gcgtcgcctctcgattcgattctttcatggatggatggtctccgcgccaacccttagcttcctccaaatccatcgatcgtcaccatcccgaccccaatcccagccccgccccgccccgccgatgatgcagcagcaccagcaagaggaagatcgcatccgcgacttcgatcccaagcaagggggcgaatacttcaccagactacaattcgtcgatctaacaaaattcgatctcgacgaggagtcgccatatggtccgatgagatttactgatgctgtctataaaagtaaggacgactatgagctgtgtgagggaataaacattttctcagtgagaatagccacctctgatgttggcttcccaatccatgtgtacggcactgtcattgctcgagacagtttggacaaaaagtgtgtttatgtcttccgctgtgacagagatcattgccaactcatcaactctaaggatgaatctttggtcttgaca

SEQ ID NO: 13311 - DNA, 1175 bp, Sorghum bicolor
  Clone ID: SORBI-28MAY03-CLUS2139_1
tctctatagctgccagtaaaatgcccatacgaagtcaatttcttcgattagagatatagaaccccaaaaaggaatattgaagataaaaaaccctggtttttctttctggcgtccgaatatttctttcatccttttgcattgaaataacaaatggaaatcaaaataatatgattcaacctcagacccttttaaatgtagcagataacagtggagctcgaaaattgatgtgtattcgagtcataggagccgctggtaatcagcgatatgctcgtattggtgatgttattattgctgtaatcaaagacgcagtgcccaaaatgcctctagaaagatccgaagtaattcgagctgtaattgtacgtacacgtaaagaattcaaaggcgacgacggtataataatacgctatgatgacaatgcagcagttatcattgatcaaaaaggaaatccaaaaggaactcgagtttttggcgcggttgccgaagaattaagagaattgaattttactaaaatagtttcattagctcctgaagtattataaatactagtagacgagatatagatcaaagaaaaaattagtagattgtgtctcacgtatatgctttaaaatccaaaatgaaaagaaaagggaaaacatgttgattatagaaaaattaggaggaacctagaattagagtcttatgggcaaggacactattgctgatttactaacctctataagaaacgcagacatgaataaaaaagggactgttcgagtagtatccacaaatattaccgaaaacattgttaaaatacttctacgagagggttttattgaaagtgttcggaaacatcaggaaagtaacagatatttcttggttttaactttgcgacatcaaaggagaaagactagaaagggaatatatagaactagaacctttttaaagcgtatcagccgacctggcttacgaatttatgccaactatcaaggaattcctaaggttttgggcggaatgggaattgctattctttctacttctcgaggtataatgacagatcgagaagctcgactaaacagaattgggggagaagttttatgttatatatggtaatggccgcacctatagtacccaaattctatctcgaacttcctattttgaaaataaaaatagaaaaataggagaaaaatatatgcccg

SEQ ID NO: 13312 - DNA, 933 bp, Sorghum bicolor
  Clone ID: SORBI-28MAY03-CLUS21544_1
gcacgaggctctccacactgccatcgctctcctcacgctgctagaggcgcgtgagcaggagtaactgccatcgctctgtgcccagccgcgcgtctcgtcccttcgctcgctgctgctagctcgatcgtcggccggagccatgggcggtggtggcgcggcggccgtggcggcggcgctggtggtggtggtgctgtgggcgggcgtggcgtcggcggccgtgtacgaggtgggcgacaagaccgggtggaccatcatgggcaaccccgactatgccgcctgggccaactccaagaagttccacctcggcgacactgttgtgttcacgtacaacaagcagttccacaacgtgctggcagtgagcaaggcggactacaagaactgcgacgccaccaaaccgacggccacctggtccacgggcaacgactccgtcgtcctcaacaccacgggccaccactacttcctctgcggcttcacgggccactgcgccgccggccagaaggtggacatccgcgtcgccgcctcctctgctgccccttccgcgtcccccaccgccgcaccgtccccgaccccctccggctccaagccctccggcggcgccacggccgcgccgtcgccgcaccccaacgccgcgccgaaggccctctccgccagctccctggcagcgaccgtcgccgcgtccctgctctctctagccgcggccgtgcttgcatgatcagggtcatgtggtgtctgtcggctaggggacgttgcctttgtgaattgtgagggaccgtaccgtgtctgtggccgtatgagcatttagcacctggatctgtgcttgttttccctttttttttcccccgcctggtttcatgcactgctctgattctgtggatcctggtatgccatggggatttctgccggttgttaattaatttcctcatgttttgggct

SEQ ID NO: 13313 - DNA, 1064 bp, Sorghum bicolor
  Clone ID: SORBI-28MAY03-CLUS22679_1
gccgggaatatatgtcataccgtcaatccggagtcccaacactgcaagcgatgccatccttctctcactgcacgcaccgtccgcgcacggctcgccggccatcactcgcacaccacagcacgacaccatcggcccctggcctttccttccgtccccctgctaccccccgcgccaccgcggaaagtaaacccccgagatccagcgccgtcggcacgaccaccaggcctgcgctgagcagggatggggcggagaggggagccctactacgtcgaggcggcgccgccggtggacgtgaacaagaacacggagtggttcatgtacccgggcgtctggaccacctacatcctcctgctcttcttcgcttggctcctcgtcctctccgtctccggatgctccccgggggctgcctggaccgtcgtcaacctcgcgcacttcgccatcacttaccacttcttccactggaagaaaggaaccccttttgctgctgatgaccaaggcatctacagcagattgacatggtgggagcaaatggacaatggtcagcagcttactcggaacagaaagtttttgactgtggtacctgtggtgctgtatctgattgcatcgcacttgaccgactacaagcagccgatgtttttcctcaatacgattgcagtttttgtgctggttgtggcgaaattgccgaacatgcacaaggtccgcatatttggaatcaatgcagacatctgaggaccactgcaagaagtgcatggtcgaaatatgatgttatgaagagctacaccagaacaagcagtgtgtttctcaaagtcggcacaactgcctgtaatatatgtacagcagtacaggtttagaaagaactgtaaatgttactctagcatacaaggtttgcctgcagactgctctgtgttgttgccgttgctgctttctttttggtttcattggaagtggaaacggtaacttcggtaaacaaccgccagcatgtggataagtgtgtagcagttggtaagttggaaaactgtgtagcggatgctgtttggtatttggtaagatggaacccataaatc

SEQ ID NO: 13314 - DNA, 480 bp, Sorghum bicolor
  Clone ID: SORBI-28MAY03-CLUS2077_2
cgtccgggtactaatgttctgtgacaatctgtcactcatttgttctctggataacagaaatcaacccctgagattttagggcccgtttctggaacatgcctttggatattacttatttcatttcgcatttgcagtcatactgggaaatcacttcagatgactaccttgcatacattgggaaatatgttgttggccttggtccgtggaaagatactattgttccagcttcaggaaactacttgatgccacctagtgatcttgtcgcacgggcacatgcccataatctccaggtacatccatacacgtacaggaacgagaaccagttcctgcacttcaacttccatcaagatccctacactgaatacgatttctggataaacacagtgggggttgatggactgtttacagatttcactggaacccttcaccggtacccagaattgacatccccgcacccgaaggatgaaacttgaaatagcc

SEQ ID NO: 13315 - DNA, 1646 bp, Sorghum bicolor
  Clone ID: SORBI-28MAY03-CLUS2077_1
aataacgatgaggaagcgatggcgtgcccgaaagaaaaagcgggggttgtagtcctacgggcgggcggaggagagagcagaggggcgctcagcacggagcgaggtgccgcgcgccgtttcctcttctgcccgctgaaaccggagcatagcaagctcgctcgctcccgtatacagcggggagacgggagggactccagggaagtggaggaagaagagtgtggtctacaggggtaaagaccgagggagcaccgctgcaccatgcgcccttctctctattgtgcacctctttttcttctgctactattacatttggcgtttgctaggcctctctttcctctaccgagtaagacaaagtatgaagagaagaagccaatacagacatttcgaccatataacattgctcatcgtggctcaaatggggaaattcccgaggaaacagctgctgcatacctgagagctattgaagaaggggcagattttatagagtctgacatccttgctagcaaagatggaaccttgatttgttttcatgatgtaacgcttgacgatacaactgatgttgccaggcgtaaggaatttgccaatcgaagaagaacctatgaagtggagtggtttaatgtttctggatggtttgtagtggacttcacgctggaggaacttaaaacacttaaagtgaagcagagatactcgttcagagatcaaaaatacaatggtatgttttcaatcatcacatttgaagaattcatttcaattgccctagatgcagacagaactgtcggcatctatccagagattaaagatccagtttttatcaacaagcatgtcaagtgggctgatgggaagaagtttgaggacaaatttgtggataccttgcttaagtatggatacaaaggtcaatatatgtcagagaattggctgaagcagccattgtttatacaatcctttgctcccacctccattgtacatgtatcagatttgattgactctccgaaggtatttttgattgatgatatcacagtgagaacacaagacacgaaccagtcatactgggaaatcacttcagatgactaccttgcatacattgggaaatatgttgttggccttggtccgtggaaagatactattgttccagcttcaggaaactacttgatgccacctagtgatcttgtcgcacgggcacatgcccataatctccaggtacatccatacacgtacaggaacgagaaccagttcctgcacttcaacttccatcaagatccctacactgaatacgatttctggataaacacagtgggggttgatggactgtttacagatttcactggaacccttcaccggtaccaagaattgacatccccgcacccgaaggatgaaactgcaaatagcctcctagtaaaaattagtcaaatgatctcagcatatgaaggtctctgaccactaaaatgttgctgaaaatttgttcgtactcttgttaattggtctgcaaaggttgaataaacgacttgtttttggtggggacttgttagcagtagcacgagtcatactctccattaaagcccttaatccccaggacaaattcctagagtgggacaagttgttttaaggtattgtgggaataaatgcctagtttacgatagaaaccgtag

SEQ ID NO: 13316 - DNA, 1660 bp, Sorghum bicolor
  Clone ID: SORBI-28MAY03-CLUS15384_1
gttttctctgcatgcatgtgccacgtcgtcccagctagctggagcagcagtgaccgccgccggtgccagcaccagcagagcacaccaggcaattcattccctcgcccccacgtcgcgcggcaaccggcaaggcacccgcccggcccgatccctacctggagggaggaccggaggtcgcgactcgcgagggcgagacgtgcatgggtgaccacgagctgcacacgaacgcacgcacgcaacgcgatctcccaaccaaccttcatcaatccatcggatagcatacatacggccggaccacccatgacccatcaaccaatcaatacgcctactccaactcctactcctactgccaccggtcgtctcgctcagctcgccaccgcaaggagctttgctgttgctgacgacctcgcgcacggcggggtgcccgagccatgcctataaatccggggcagagcacgcacccaccccatccataccgtatcactcgcctcccctgcctccgatcctctcccgcctccctgtcgcacacgacgtcgcacacgcggcagctagctgcacgatcttcgtcgtagctagcgtagcacagacagacgacgaccgacgagatggcgcgcggcggcggtgcggcggcgctggtggtggtggcggccttcgtcgtggtgctgtcggtgtcggcaggcgtggcccgcgcggacttcgccaaggaccgcgccatgtgcgcggacaagctgatgggcctggcgacgtgcctgacgttcgtgcaggacaaggcgacggcgcgcgcgccgacgcccgactgctgcgcggggctgaagcaggtggtggcggccagcaagatgtgcatgtgcgtgctggtcaaggaccgcgacgagccggcgctcgggttcaagatcaacgtcacccgcgccatggacctgccctcgctctgcagcaaccccgccaccttctccgactgccccaagattctggggatgtcgcccgacgcccccgaggcggagatcttcaaggagtacgccaagaagcacgagggccagaacggcaccaccatacctgcagctgcaaccggtgccgcggcgaccgggaagagcacgagcgcggcgccgacggcggacggcgccgggaggcagccttgcgcggtcttcttctacctcgtgtcggcgctgttcgcctccgttgcggtcctgctgggctgacagccgcggcaacgcagcgcgtgcattcatggcggcaggggatggaggtactcctgcacggactagaaggaagaagcccggagacataactgaagaaaagcgatgagcaaattaaaggacacgagtgttcttattttttttcttctgcttgtagtttttttaaaaaattttgtggggattgtgagacgtcctcggcttgtgctgacggagcactagcgacgcagctgttgggctgcggccttccagcctggggatttttaatgtggtggccagagactgtgtctagctgtctgtctgaatttgatgaatctgatccattggcgcactgtatgcttggtttcttttcagtttttatttatagttcgtcttcttgcttaaagtcagcttgtgtaagcaacatgcatgtaactacaaggaccttgactgtttatgctaaagaaacagcttcatctttgggattttcgtat

SEQ ID NO: 13317 - DNA, 881 bp, Sorghum bicolor
  Clone ID: SORBI-28MAY03-CLUS15359_1
ccggagtaagaggcctccacatgtaaaaggcggccgcggctgctctctcgtctctcctgtgtcctatcgcgtccgccgccttgccctccccactcgcgcgacaagcccgcaggcgaccccgccgagcggcgtccggcggcgaccatggcggacgacgactacaacgagatggacatggggtatgaggatgagcccccagaggcagagattgaggagggggctgaggaggagcttgagaataacaacgaggacaccccggatgatgtggtaggggcagaagctgaagacaaggaacaggaaaagatagcacgtgcacgcaaaacaacaaagtatatgacaaagtatgagcgtgcacgcattcttggtacgcgtgctttgcagattagcatgaacgctccagttatggttgagcttgaaggggagactgatccgcttgagattgccatgaaagaattgagagcacgcaagatcccattcacaatcaggcgatatttaccagatggaagctacgaggactggagtgttgacgagcttatcgtggaggactcctggaaacgtcaagttggtggtgaatagcgctatggtgctcaggtccaagtcctatgtttacatgcaaatcttctactgggcggtgaaaattacaactagcggcttgcgcacaatagtggctgcagtggtgaactattctgcgtaatgcttgtgtgaccttgctcttgtactttcgattttggaatgatgcagccgtactgtatctccgtcatgtctgacatagcaaggttcatgagcttgttttgatcctatcaattggggctggaagcaataattggaaactgattccacctaaaaaaaaaaaaaaaagggcggcgctcgcgatctagaac

SEQ ID NO: 13318 - DNA, 614 bp, Sorghum bicolor
  Clone ID: SORBI-28MAY03-CLUS13790_2
ccggggttatcccggcggcggcggcggcctggaaggcgaaggaggaggagcagtagcagcaggcggcgccgaggagcggcttcccaccccgagcttgtaaccatggtgaacgttcctaagaccaagaagacctactgcaagaacaaggagtgcaggaagcacactctccacaaggttactcagtacaaaaagggtaaggatagcctagctgctcagggaaagcggcgttatgaccgcaagcagtcaggatatggtggtcagaccaagcccgtcttccacaagaaggccaagaccaccaagaagattgtgctgaagctgcagtgccagagctgcaagcactactcgcaacacccgatcaaaaggtgcaagcattttgaaattggtggagacaagaagggcaagggaacgtctcttttctaaatctactagtaacatatttggatgctgaagttgtagggtttatactgttcttaaaactagttctcaaatattgatgttactagtatactagtacttaaagcagaccatgctatgtatccaaattccaaccctgacatctgctttgagtatattgggccgagttttggctaaatgaagttttttagttcgaacca

SEQ ID NO: 13319 - DNA, 951 bp, Sorghum bicolor
  Clone ID: SORBI-28MAY03-CLUS13790_1
gcacgagggaaacttaccaggtccagacatagcaaggattgacagactgagagctctttcttgattctatgggtggtggtgcatggccgttcttagttggtggagcgatttgtctggttaattccgttaacgaacgagacctcagcctgctaactagctatgcggagccatccctccgcagctagcttcttagagggactatggccgtttaggccacggaagtttgaggcaataacaggtctgtgatgcccttagatgttctgggccgcacgcgcgctacactgatgtattcaacgagtatgccggccgggccggggccgccgccgccaccactcgctgcagctctcgaccggatagggagcacgccgcacaagcccttccggcctcctttccgccgccgccaaaatggtgaacgttcctaagaccaagaagacctactgcaagaacaaggagtgcaagaagcacactctccacaaggtgactcagtacaagaagggtaaggatagcctgtctgcccagggaaagcgccgttatgaccgcaagcagtcaggatatggtggtcagaccaagcctgtcttccacaagaaggctaagaccaccaagaagattgtgctgaagctgcagtgccagagctgcaagcactactcacagcacgcaatcaagaggtgcaagcattttgagattggtggagacaagaagggcaagggaacatctcttttctaagtttatcatcaccaatgtgtgtgggtctactactgttctaaagactttttgtcaaagtagttctgaaagcagaccatgctatgtatccaaattccaatgcctgacatttgctctgagtgttggtcgacttttggctaaatgaacttttgtagcttgaatcgtcattaatacagttaaaaaatcgattttattctgccaaacctaaaaaaaaaaaaaaaaaggccccta

SEQ ID NO: 13320 - DNA, 545 bp, Sorghum bicolor
  Clone ID: LIB5051-008-A1-XP1-B11
ctgtgcggcgctcaggcggcgggtccaaactacacgcccagcgaccctcgatacctcaccgcccttcgacgaccgaaataccgtcaaaatggtcaacatcccgaagacgcgcaggacctactgcaagggcaaggactgcaagaagcacacccagcacaaggtcacccagtacaaggctggcaaggcttccctcttcgcccagggtaagcgccgttatgaccgaaagcagtccggttacggtggtcagaccaagcctgtcttccacaagaaggctaagaccaccaagaaggtcgtcctcagattagaatgcacccagtgcaagaccaaggcccagcttgcgctcaagcgttgcaagcacttcgagcttggtggtgacaagaagaccaagggtgccgctcttgtcttctagatgtgtgcatttggtcaaggcgctagggatgatgatggagcggtatgtgcatgtagcttcatcgagtatatgatcctcgagagctcggaaataaagcttcgttccacccgaaaaaaaaaaaaaaaaaaggccccta

SEQ ID NO: 13321 - DNA, 731 bp, Sorghum bicolor
  Clone ID: SORBI-28MAY03-CLUS15601_1
attccgatgactgatatgaacatgagagctgacccttcacgaggctaccctgggagaacatatcgattttacactggcgatgtagtgtatggttttggatacggtttaagttactccaaatattcgtatagcatcttgtcggctccaaagaagatcaccatgtcgcgttcatcagttttggacattattagtagaaagccttcatacataaggagggatggactagacttcgtgaaaactgaagatattgcatcatgtgaagctctggcattctctgttcatgtcgctgtttcaaatcatggtagcatggatgggagtcatgctgttcttctgtttgcgagatcgaaatcaagcgttccgggctttcctatcaaacagctggttgggttcgagcgtgtccacacggcggctggcagtgcatccaatgtggagattagcgtcgacccttgcaagcatatgagcgcagccaatcctgaaggcaaaagggtactgttattgggtgaccatgttctgacggtgggtgatgaagagttcgaattattcattgaactctgacagggatgtaccaagccttaccatttacggatctgaaatttggaataatctgatgaataaaacttgtaaagaaacacgctgtaaagattcatcattgaactggatgcaagtacagtaaacatgctgtaaagattcatcattgagttggatgataatacagttgcagccattgcggt

SEQ ID NO: 13322 - DNA, 1105 bp, Sorghum bicolor
  Clone ID: SORBI-28MAY03-CLUS1237_2
tccggtcgccacgcgtcggggacaccatgtggtactatgctaccaccgtattggaactggaacctataagtgccacactcttctatttgcatgagaaaaaaaatgaaactacgcagggaaaacccaagttcttgctactcagtgatgaattgcttcagggctgtattctcaacagttttgagactacaaaatgttgcttcagtgttacaattcaacagatccatttatttttggatatttccaacttcatgcgcttacagaaatcggttttgatatacgtcctgagaaacacactacttacattcagctgggcaacctatgtgttccctcctatactcaaacaaggaatcattcatgcaattaagcactaccatgatttgagaacttgatgtaggattttgtattggttcttgggtcaagaaaggagattcctaatcctgccggcttcggcgcgctctgcgatacctccggatcaatagaggcatcaatgaaacactgagccacatcgggaggttcaggaaacctgcaaggaggattgatgcagtgaatgagcacctaagcaaaggagtggatgtgtgtccgaaccgccaaatgtacctgcaaaacagaccaactacgcttgtggaagcgaagatcatttctggctttccaaataaaccacagatatgtggtgatttgcactaaaatatccaccggaatttggggtgtaattatctacgccaagcagtgttgaaccccatcctgttcctgtggcaaagcagaagagagcaaaggagttttggcagagaaccaaactgctctggcaaactcatagtggaagaaaaggtgaacatcattttcaggaaatccacaaagagcacaatctttttcaatatcagtgagggcatttgcatgctcaccagtagcaatggctctcctaataagtctccaaataaaagttttaatcacaggagagatatttttgcatttccacaccctcttaagaatgttcatgttctcctgggtaatgcttctgggaccttgatggagaagttgtaccctggacaaattgttaagataatggaaggcatttttggcagtgcaatccccgtttttggcgggttcc

SEQ ID NO: 13323 - DNA, 705 bp, Sorghum bicolor
  unsure (1)..(705): unsure at all n locations
  Clone ID: SORBI-28MAY03-CLUS1237_1
cgtccgctcaccttcaaatatagcccaagatatggtatctgaactaagcggactctaagagtgtagtgcggctgaattattatttcaattctggtaccacgcanggaaaacccaagttcttgctactcagtgatgaattgcttcagggtacatatgcttcagatatttccaacttcacacgcttatagaaatcggtaaggaacttcacttatctttttgacatgctgcttcttttataggctgtattctcaacagttttgagactacaaaatgttgcttcagtgttacaattcaacagatccatttatttttggatatttccaacttcatgcgcttacagaaatcggtaaggaacttcacttatctttttgacatgttgcttcttttatagactgtattctcaacagtgatattactatatagatttgagactacaaaatgttgcttcagtgttacaatccaacagatcccaaaatttttttgccatacttgcagtgaatgtcctataggcaatagaagaagcttgcgatttgttcacggaagcagacaagtgtaacacagcccaccttccaaattcagttccaactgtagctagatatggatctgtcactacactattctccatgtcattgatgttcatttggagacccttgctaaatcatcacataccacgttcttagttgttccattgctagatacatttgt

SEQ ID NO: 13324 - DNA, 509 bp, Sorghum bicolor
  Clone ID: LIB3476-033-P1-K1-E1
aatatatacctatgtacccccatatataactaaataaaaatatacattttaaacatttatttacctctgttataattcttatttcagcgtatatatctaacatattttacccgtatttaaaaacttctgtgtgtccactaacgcgcgcgagggcgcgcgccttgcactagtagttctgaagcaacagcagccgcaaaagcaagagccgcagcttccgccatcaccactgaagaaatattatttatttgtagcttgatgtaggattttgtattggttcttgggtcaagaaaggagattcctaatcctgccggcttcggcgcgctctgcgatacctccggatcaatagaggcatcaatgaaacactgagccacatcgggaggttcaggaaacctgcaaggaggattgatgcagtgaatgagcacctaagcaaaggagtggatgtgtgtccgaaccgccaaatgacctgcaaaacagaccaactacgcttgtggaagccgagatcatttctg

SEQ ID NO: 13325 - DNA, 246 bp, Sorghum bicolor
  unsure (1)..(246): unsure at all n locations
  Clone ID: LIB3476-008-P1-K1-C10
gcgtatcgatgtccaaactgaatgtatggtagaatagatggttttatgctactcttaaaattttttgcttacctatgctatgctgtcaggtgaacatagacgaaaggataaacacttangctgcatcattccatagtcagttgtgcaaagtggtagacaccatgttggttaactattgactaaccncaccgtattgtgaactgtgaaacctattaagttgccaacactcttcctattttccatgag

SEQ ID NO: 13326 - DNA, 1080 bp, Sorghum bicolor
  Clone ID: SORBI-28MAY03-CLUS16011_1
ctactggaaacccgcgtctcgagagagacggagaccggagacgcccacgaggccgtcctccgccgcgacgcgccatggatcgcgcgcagttgctcctcgtcggactcccggccttcctcttcttctccgacctcactcacatcttcgcgccgccgcctccccacctccgccacccccatcaccaccctcctcaccaccaccatcacccgcatccgccgcaccatccccacccgcacccgccgcatcatccccacccgcctcaccaccacccgcaaccgccgcaccaccaccagcaccccgacccttctgcggcaatcatacaggagccacgtgtggatggggctggattcggcagcacggtggagctgcaattctgtgcctcctgctcgtataagggaactgcggtgaccatgatgcgcatgctggaaacctcatttcctggcattcatgttatcttgcataattatcctcctccattccccaagcgtgtactcagcaaagttgtcccaattgttcaagttggagccattgcaacaataatggctggtgaccatattttcccaaggcttggaatggttcctcctccatggtactactcacttcgcgccaatagattcggaaccatggcaacaatctggctatttggcaactttgctcagtcctttctacaaagctctggtgcctttgaagtttactgcaatggagatttggtattctcaaaacttgctgagcagaggttccctagcgagttcgagttgcgggagcttattggcagcagactgcctgagtctccatttgggaggaatctggggaaaaccttgacttagatgacgaccccagaaatcaaagctcagaatgccacaattcaatctgttgcttttaaggtattattagtaggtagtaactatttggtgttgatctatcgaggatgcacacttgtctgtaaacacaactttccagcttgtataatggatctacggatcacctgacatgagaaggtgaccaaagtactacaaactgtgtgatgacaatgggacggtaaggatattatgatggcctggtagcttctgggagatttgt

SEQ ID NO: 13327 - DNA, 1700 bp, Sorghum bicolor
  Clone ID: SORBI-28MAY03-CLUS1606_1
gcacgaggctcggcctacgcggctacgcatcggcacagtcggcgcgcttgaggcctcgcgagtcgcgactcgactctccctcctgtttcccggccgtcccctcccccaccaatccaactccaattcgtcctccccatcgacgcctcgaggttgccgcgcccggcccaacgcagcagcgccgcggggagggagctggcggtaaggagaagggatccgatcgggaaagtatgagcttggtctccggcgcccctcgccgtcgagctcgaatcgggagataagaagaatctgctgggggggagccccatagaagatggcctcgcatccgcacccgcaggaggataaatcagaccgccacagcgccggcgccggcgcgtcgagggagcaggagcggcggccgtccaaggcatggggaatcctcatcttcggcctcatcggcgtcaccaccgccagtttcgccattactcaagttcgcagaagcgtggactggttctacactcagttgaataaagtgcagacaacatcatcttggaggtatacaagtaatagctcaagtcgtggaagtttcagtgaggaaactaagaaaagatattatcagcgaatgcagcaggaatatgaagaggaacaagagagagttcaaagaataaggcatatgcaaagtgttttcaacagagagaggaataaatttagacgaggttatgaaagctggagggagaatggccctcctggtggctacaattacatccctcgggatgattggtattggcagactgatacttctcactcggaacataaaaatagacggacatacacaccggcgggacctagggtttatcctatgtcgcatcactatgcagttcttggtcttgacagatcacgtgcgacgccatatacagatgcagaagtgaagactgcttttagaacaaaagcgatggaagtccatcctgatcaaaatcaagatgatagagagggtgcagaagagaagttcaaggaggttgtcaagtcttacgaagcaattaaattggagagaaaaaatggtgtaagttgatgcagacttccaatgtgatcggtcatgcgggaaagactgggatcagttgtaaactgccttgtatatgtaatcagctgttgccggcagcttgatgaaattgtatcggctgttgctgttgagggcctgtgccctgtagcacgagttccatttatgagcttgtgcgatgtagactaggataggttcaaaagatgtgtttttgttctcatttagccactagcttgacgtcctcacgtgcataaatgccataaacttgacaagtggactggaccacaagggcgagcacttttgttgccactgggagttgtattcactgctcaatacctggtgatttccttttcatttggtggaaactgatacctgatccgaaaaataactgaacatagcatagtgttcatttgtctgccgtattgtgttcatttgtattttgtaacgatgcatcattgtcaagagatctattcttggacttcagcgcatttagaacaccgttgaacttaagtggggataattcatacggtgggttatagttaagtccagtttggtacaatgaactgtcttttttgctaaacactttatgggtgaaattgtttttcttgtcttataaagacatgaattgggatgaacttgaaaaaagtagcttatcttagcttcatctccc

SEQ ID NO: 13328 - DNA, 617 bp, Sorghum bicolor
  Clone ID: SORBI-28MAY03-CLUS2386_3
cccacgcgtccgccgcaccttcatcgaggtggtgttcgagaaccccgagaagagcatcgacaccttccacatagacggctacgcattcttcgccgtcggcatgggcccggccaaatggacgccagcgtgccggagtacgtacaacctgctggacacggcgagccggcacacggtccaggtgtacccgaggtcgtggacggcggtgatgatgacgttcgacaacgcgggcatgtggagtatccggtccaacatctgggagaggaattacctcggcgagcagctgtacatcagcgtcacctcgccggagcggtcgctcagggacgagtacaacatgccagagaccagcctgcgctgcggcaaggtcgtgggtctgccactgccgtcgtcctacctcttcgtctagagcatcggccggccgccggttccccttcaccacgatggccgcgcacggtgctgtacacaaattaaaaaggagtaatttgtgctccaccccaagctcgtttattctctcgtcccgtcgtcgtcgtccgctttgttttcgctttctaccgcgaggaataataacaccaaccaaaaaggggctcaagactggatcagtgtgggcaccattcacttac

SEQ ID NO: 13329 - DNA, 520 bp, Sorghum bicolor
  unsure (1)..(520): unsure at all n locations
  Clone ID: SORBI-28MAY03-CLUS2386_2
ttcgccagcggtaccgatccgcaggttcgacccacgcgtacgggcctgggcagcggtcgccggaggcgagggtgacgtacaacctgctggacgcggtgagccggcacacgatccaggtgtacccgaggtcatggacggcgattatgctgacgttcgacaacgcgggcatgtggagcgtccggtccaacatctgggagcgctactacctcggngagcagttctacatcagcgtcatctcgccggagcactcgctgcgcgacgagtacaacatgccggacaacgacctccgctgcggcaaggtcgtggggctgccgctgccgccgtcctactccgccgcgcgctaaaatgaccaagcaggcccccggcccctcgtgttcggattcctgtgtgttgctcctgaggaatttcttttgctttggcgaaaataattaagtagccgggccgcgcgtgcgcccctcaaaaaaaactctaacacaaaagaaaaaagacgaaagaagcgtagggaggggaaggggaacaa

SEQ ID NO: 13330 - DNA, 1278 bp, Sorghum bicolor
  Clone ID: SORBI-28MAY03-CLUS2386_1
tccgcgccgagttccgcaccttcatcgaggtggtgttcgagaaccccgagaagagcatcgacaccttccacatcgacggctacgcattcttcgccgtcggcatgggcccgggcaaatggacgccagcgtgccggagtacgtacaacctcctggacacggtgagccggcacacggtccaggtgtacccgaggtcgtggacggcggtgatgatgacgttcgacaacgcgggcatgtggagtatccggtccaacatctgggagaggaataacctggcggacaacctgtacatcagcgtcacctccccggggcggccgctgagggcggagtacaccatcccgcggacaaacgaccaagccggcacgcggcccgtcgtgttcggattcctgtctgtcgctcccgtctaaagcatcgcccgttgccgggttccccttcttcctccgattgcccccaattccgacgcgtcatcgccgccatggccgccgcgggcaagctcctcctcctggccgccgccgtcctggcggcgtccctcgtcgcagacgcgcgcccgtgcggccacgcgcagacgctcctcgtttccttctcctccgtctccaggcccaacccggaccccagcaaccccacgccgctcaccaccaccgtcgtcaccgtcctccgcgtccgccgcctcggcccgcaccagatccgccgccccgtggccctccccgccgtcgagccggacgtcgctgcctcgtccgtccaggaccgcgccaaggacatcctcgtcgtcgtctccggcctcctcttcggcttcggctgcggcgccctaaccgccgcctccatgtacctcgtctggtcgctcctcgcctccacctgcgcctccggctacgacgacgacgtctacagcgacgacgaggaccagctgtctgactccgagagccccaagaaggccggctacgtcatcatccacgacgccgacgagtacggcgccggtaagaattagggctggggatgcgtcttcggtcttaccgggggcagccaaaggattcgtaataacattgcatgattgcttggaattgtgcagtatacactgtaactgtatgcacctttttatgtgtgtcgcgtctgtctgattctctctatgtatgtcgtttgggggaaaggaaatttaagttatgaaatggatatgttcttgatgtgttcttaaaaaaaaaaaaaaaaatgatactcgccttgttactgaaaaacatggatcttctttggctaccacggtttacaaaattgtggtgtagtgatcttcct

SEQ ID NO: 13331 - DNA, 1477 bp, Sorghum bicolor
  Clone ID: SORBI-28MAY03-CLUS256_1
gcctatccgactccctgcttcaggcacgctcatcttccccgctccagtgctccaccgatcaggaattcattcagaactcacggccaccgcctgctccttcctcgataaatccagcctattattatccaaaccatctcccgtctgatccgtcgccgtcgaggagtcgactcgtctatccacaggcaaaagaagtaaaataaaaaaagaaagagtatctagcggggagcgtcgccggcgatgctctgctccggccgcatgctggcctgcaacggcctcttgcccggtcggctccggctgccgagggccgacgcctaccgcctgcgcccaccagcgctcgcgcggaggtggagcgtcgcggcctccgctgcggcgtccggcggctcatctgacctcccatcgtcgtcgtcttcgccgcctaccccgccgttcggggtcggggacgaccaggccgctgcatcacctgggttttgcatcatcgaagggcctgagacggtccaagattttgcaaagctagacttgcaggagattcaagataacattaggagccgccgaaacaagattttcttgcatatggaggagattcggcgattgagaatacagcaaagaataaagaatgtggaactcggaatttcagatgaagagagtgatcgggagctccctgattttccatcatttatccccttcttgcctcctctgagtgcagctaatctaaaggtctactatgccacatgtttcgccctcatagctagtataatggtcttcggtggtcttcttgcaccaatcctggaacttaaacttggtctagggggcacatcttatgaagactttatccgcagcgttcatctgccgatgcagttgagtgaggtagatcccattgtggcatctttctccggcggagcagttggagttatctctgccctaatggttgttgagataaacaatgtcaagcagcaggagcataagcggtgcaaatactgtttaggaaccggatacctggcatgtgcccgctgttcaagcacgggtgctcttgtgctcactgagcctgtgtcaacattcagtgacggcaatcagcctttatccgcaccaaagacagagagatgcccgaattgctccggctcgggaaaggtgatgtgcccaacatgcctctgcactgggatggccatggcaagcgagcatgacccccggatcgatccgtttatttgaggcgcactgtagtccaggaactgttgtagcgtgtggaagactggaagtggaagatgctttgtagataatagtatcgacaaatgactcacagataggccgaatcgtgaaatttgaatcgacattgtacttgtacggcacgaataggatgagctgaagagtgcagagaggtgttatgttgcaaagtaataattcgcgcgtcactgtatactactactagaacgtcttttttcatccgacactaatgactcaaatctcatgatgaatttggtcacgc

SEQ ID NO: 13332 - DNA, 820 bp, Sorghum bicolor
  Clone ID: SORBI-28MAY03-CLUS25694_1
acccccccaatcttcctcattcactcctaccaccaccagaggtccaaaagcaaaccaaggccaagaacgaaggaagatggctctggtcgggcaggtggcgacggtggcgcagctggtgggcgtggacgcgttcagcctcatcaccatgatcgcagaggcagcacaaacagtgcggcggaaccgcgccgtctgccggcagctggcccgccgcgtcgagatgatcggcggcctgctccggcggctgcacgaccaggacacgcagctgatgcagcttccggagacgaggacacccgtggaggcgctggaggagacgctccggcgggcgtacctgctcgtgcgctcctgccagcgccgcgggtacgcgtaccggtgcttcatgggggcgcgccacgccgacgagctccgcgaggtgcagggtgagatcggcttctacctccagctcttcccgcttgtcagctatgtggatgcaacgctcaactgggtcaggcatctcaacaacaagcaggcctctcatgacacttctttccaagaggcacttatggtaagaccatgtattgtgccgttcctgtttgcctcgtgggatggatgctgcttagcaattgttcagggagtatgcatgccttggtatatggtacagcacacacacggtttacagctcctctgataatgtttcctgatgtgtgtatctgtgatttttttcatgtgttactgcagggttcgaaacacattactgacttaactccttctcgtcttatcttactaatgcataacaatgatttggctagcaccttttcatcggtaacagcaagctagtttgcaa

SEQ ID NO: 13333 - DNA, 1612 bp, Sorghum bicolor
  Clone ID: SORBI-28MAY03-CLUS2586_1
ggtggacactttcgccttctcattcaaccatccctccgaagcagacaaactcccatccttctccctctcccttgtccgtatgcgtgcctgggtttgaattttcttttaaaataaaaatggaagagaggcatggcggccacggccaccctgtagcgcagccttctcctcccgtctcctacctccgtcttcagcggcgcagccgtccccatctcagtttctgcgcagaagaggaggtcatcatggcagccaagaggggcgagggtgcaggtctcggcggcggcggcggcggactccaagaacattttggtgatggggggaacaaggttcattggggtcttcctgtccaggatccttgtcaaggagggtcatcaggttacattgttcactaggggaaaggcacccataactcagcagttaccaggagaatccgacgcagagtacgcagagttctcctccaaggttcagcacttgaaaggtgacaggcaggacttcgaattcgtcaagacaagcctggctgctaagggatacgatgtcgtttacgacatcaatggacgtgaggctgtgcaagttgagcctatcattgacgccttgcctaacctggaacagtacatctattgctcatcggcaggagtgtacctgaaatctgacattcttccacactgtgaggttgacgcggtggaccccaagagccgtcacaaggggaagctggagacggagagcctgctgacatcgcgcggcgtgaactggacgtccatcaggcccgtgtacatctacggcccgctcaactacaaccccgtggaggagtggttcttccaccggctaaaggccggccgccccatccccctccccggcgccggcaaccagatcacccagctcggccatgtcaaggacctggcaagagccttcaacctggtgctgggcaaccccaaggcgagccagcagatcttcaacatctccggcgccaagtacgtcaccttcgacggccttgcgcgggcctgcgcaaaggctggagggttccctgagccggagctcgtccactacaaccccaaggacttcgacttcggcaagaagaaggctttccccttcagggaccagcacttctttgcgtctgtggagaaggcgatcagcgagctcgggtggacgccggagttcgacctcgtcgacgggctcaccgactcgtacaacctcgacttcggccgcggcacgttccgcaaggcggctgacttcaccacagacgacataatcctcggcaagaagcttgccaccacccgagctcttatctgattctgatacctccccatatcccggtgtcgtgatcggggctgttggtgagcggataactgtatgtcatatggctaagggtcagtgcacgcagctgctagggtgccaatatgtacgattgctggctgcaaatgcgggaaaaatgcatgaatggaaagatgatctcaattttttgtctgcaatgatgcgcgtacccttgtacatatagagaacttatggtacgaccacgggtacatatcagctctttccccatacctctgttcgcttgtcttatatgagtatatttttagctagtcatattttttctcataataaatcagcgattatgctt

SEQ ID NO: 13334 - DNA, 1055 bp, Sorghum bicolor
  Clone ID: SORBI-28MAY03-CLUS26673_1
gaaagtccaaaaggtcataggtcacggaatcaactgtttcgtcaacaggcagttaatctataacttccctgaggaactctttgctgacgctggcatacttgcaattgagcatgctgactttgagggaattgaacggctagctcttgttactggtggtgagatcgcatcaacttttgataacccagagtctgttaagcttggtcattgcaaggttattgaagagattatgattggtgaggacaggctaattcatttctctggggttgcgatggggcaggcttgcaccattgtcctaagaggggctagcgagcatgtacttgatgaggctgagaggtcattgcatgatgccttgtgtgtgctgtcccagacagtaaatgatactcgtgtcttgtttggaggcggatggcctgagatggtgatggccaaagaagtagatgaacttgcaaggaagacccctgggaagaaatctcatgctattgatgctttctcgcgtgctctgcaagccatcccaacaatcatagctgataatgctggtttggatagcgctgagttgatctctcagctccgagctgagcaccacaaagagaactgcactgctggaattgatgtcatcacaggctccgttggggatatgcaaaagctggggattcaagagtcgttcaaggtaaagcaggccatccttctgtctgcgacagaggctgctgagatgatcctcagggtcgatgagatcataacatgtgccccgcgcagaagagaggataggatgtgattaggcacgctgtttctcaatgtagtgggggtgcttgttaccctagttttgaggggtgttatggttcaggggcattcaggttggtcagatttcgattgttttttgcccctaaacaactgggacttgttatttggttgtaacaatcaaccttaggcttgtgttctagattctcatgctgtaccatttggtagctaagtacgtcgtacgatatgcttgtgccatctgcctctacatgtttttgctattcctttttttgacgtaagaatgagctcgtcttttttctggg

SEQ ID NO: 13335 - DNA, 640 bp, Sorghum bicolor
  Clone ID: SORBI-28MAY03-CLUS17399_1
ctgtgcgccgctcgaggccggccgggccgggatcacaatacagttctttcagtaaccttcaataggctacccaagaactagcaaacatggcaaaacttccgagcttgttcttagtcctctcttctatagtagccatatccgtcgtaggctctcaggctgatggaggttgtgataatgacctccaaagcctgataactgaatgcaagcggtacgtgatgtttccaacgaatccaaaggtccctccttcagatggttgttgtggtgtcatcaagaaggtaaatgttccttgcctgtgcgccaaggtcaccaaggagattgagaaggtcgtgtgcatggagaaggttgtgtatgttgctgagcaatgtaagaggccatttgagcatggcttccagtgtggaagctacaaggttcctagaaaatgaacggatcacaagagggaagtgctggacgtagtccttagatctcaacagccatagctgatctaccttccgatggatgtacaatatgaggtcatgttgagactaatataaggtgtaagagctccattgatgtatcgaaaatattctgagctaataataaagccttccccacaaaaaaaaaaaaaaaaaaaaaacctaaaaaaaaaagacccctaccccta

SEQ ID NO: 13336 - DNA, 1052 bp, Sorghum bicolor
  Clone ID: SORBI-28MAY03-CLUS18120_1
gccggcccggcctggacctccgaattcatggatccattcacccccatcccctgcgcaccaccgctcgagctcgaacaagccgcgcgcgcgcgcgtcgcgtgtgctgtccgaccgccatctcccaagcctgctggcctagctagctagctagcaggtacatccacgcaatggcgatggcgacgcggcggtcgtgggctgtggcagcgctgcttgtggcgttggcggcggcgtcgctactgctgccgtcgccggcgatcgcgcagcagccgtcgccgtcgccgtcgccaacggcgggcggcgggatggactcggcgtgcatgaactcgctgctcaacatgtcggactgcctgacgtacgtgaccaaggggagcacggcgcgtcggcccgacacgccgtgctgcccggagctggcgggcctcgtggactccaacccgatctgcctctgcgagctcctctccggcgccgccgactcgtacggcatcgccgtcgactacgcccgcgcgctcgcgctccccgggatctgccgcgtcgccaccccgcccgtctccacctgcacagccttggggtatgacgtccgcgtgggcccagctgcagcgcctatgtcggggtcgccctcgcccatgtcaggcatctctccctccggggagggcccacagttcccaggaacatcgccggtggcctcgccgccgtcctcgaccagcaccgcggcgcggcgctcctccgccgtcagcagccacctcgtgaccctcgccatgctgccgctggccgccgccgccgccgtcagcgggatactgctctagatctatgatttttccctttggtctcaacattatttcccacctggacattcgtatatgttgtttattactcctactctgcgagtatgttctatacttgtattctatgctgccgctcgatcttctgttgtactccgtacgtataccggccgtgggatgggctttagccttgttaattaatttctttgccagctgagatgagatatattactggtcggccccatcatgtgtaatgtacgtgacattatatacgta

SEQ ID NO: 13337 - DNA, 1267 bp, Sorghum bicolor
  unsure (1)..(1267): unsure at all n locations
  Clone ID: SORBI-28MAY03-CLUS2055_1
gcacgaggcttaanagctcttgaaatctacagaagagctggccaacaggctgggagtctgtctgatttctacgagaattgccggggtttagaactagctaggaattttcagtttcccactctgagggagccaccacaaacatttcttgcaactatggaggagtatgtgaaggaggctccacgcatggtcccagttcgggaacccctggaacttcctgagaggcttcttcttacatacaaacctgaagaatcagaggaaattcctgagcctgctcctgttgaagaggagaaggcaccagttgaagaacctgttccggtaccaccagttactgaagtggtttcatctcctcccaagactgaggtggccgatactggtgacttactgggcttagacgatccaaatcctgctgtatcagctatagaagaaagcaatgcacttgccttggctattgttccaacagatggtgcttcaacaactagtaacactgcatttcaagataaggggtttgatgctacaggatgggaacttgcccttgttaccgcaccgagcaacacaacttcatcttcttctgttggtcaattgggtggtggattcgacaagctcattttggacagcctttatgatgacggggcctacaggcagaggcaacagcaacagctgtatggttcagcagcacctaatccattcatgacaaatgatcctttcgccatgtcaaaccaagttgctcccccaccatcagttcaaatggctgccatgtctcagcagcatccgcagatcccaacgatgatgcaaccaaatccctttggaccacctatgcagccacagatgagcatgggtcctgcaacaaacaatccctttctggattctggcttcggggcattcccagtagcgaacaatggccatcaacaacacaacccatttggcagtgcccaacttctgtaggctacatagttaaacaagagcaaatttgtgccccagcaaatgcgatttttgtgtgattatatcatgcattgtgcttggccattcttgtatgcaacgcatgtattatgtattggcttcaccacacggggagctatggcgtgacccaacccttgttgtaaagaaattagtgacctgtgtaacatcagatatatgtcaataaacagtaggcaatgttattataattaaaaacaaaagagcggtggtatgtaggaattttcaatattgtatattccatgctttttttggtaacccattcccgtggctgtttgattgccacctttttttt

SEQ ID NO: 13338 - DNA, 1069 bp, Sorghum bicolor
  Clone ID: SORBI-28MAY03-CLUS2046_1
gcacgagggagaagcgaagctgtcttctaattccgtcgagtccatagcttttgctcttcatctctcatgatcacaatgcttgcagctagttctgtagtgaacagcaaccttgcttgctcatcaaggatatcatcctgttcggatttcacatctggccattcatggcgtcccatagaggctgtgaaactccatcgtcgtgctgtgagctcaatacgtataagttgtgctgctactaaacctgcaaagactcctgctgaagaagaatggaaagttaagcggcaacttctagcggaaaagcgggtacgcagtgttgatgtgaaggaagcactgcgccttcaaaaggaaaacaactttgtaattcttgatgtcaggccagaagcagagtttaaagaggctcatccacctggtgccatcaatgtacaaatatacagattaatcaaggaatggacagcatgggatattgcaaggcgtgcggcgtttgcgttttttggcatatttgctggaacagaagagaatcctgaattcatacagagtgttgatgtgaaggttgggaaaaatgcgaagataattgtggcatgttctacaggagggacactgaagccaacgcaaaatttccctgatgggaagcaatctcggtccttgatagctgcgtacctgttggtcctgaatggatacagcaatgtgtaccatctggaaggagggctttacacatggttcaaagaagggctacctgctgttgaaggagaagaatgagaagggagacttattacgacatagtgttcacatgctggtgactggagttgcgaggagatttctcctgccaatgcgatgacctgccagtgtgatgatgtcctagatttctcgtggcgcctttgttgcccgaactgtcagtgttttatacttgagtatgacaattcgatgactattagctttgaccaataaagtgagcagaagcatagtttcgtttggatctcgagcttaaactatcttcttctagtgatagagctgctgaatgagattttctttgggttttgtttgtcccacccaatgatgttttgctagtttgttg

SEQ ID NO: 13339 - DNA, 773 bp, Sorghum bicolor
  Clone ID: SORBI-28MAY03-CLUS1888_1
tgtgctgcggcgctcaggcggcgggcgggccgtctatttttatcaccgcttctcctgctggttccgtccgccttctttcccggcctcccgtccccggcggccagccggccgtcctgttcgtcgtcagcggagggctaagctccctctcgggctcggccatggcgacgccggacaaggggcaggggcgtccgctgcccaagtttggggagtgggacgtgaagaatcccgccacgtccgagggcttcaccgtcatattccagaaagcccgcgacggcaagaagactaccggcggccccgggaacgtccgcgcaggcataccgccggccttcaggaacggcgatggcgccgacgacggcgggtacaggcctgacttcaaatacggcgacagcagccagcacacgccgcccaaacgcatcaagaagaagtgggccttctgtggctgctgattcttcatagctcgctgctgctgccgctgactccaaaggagaatgatcgtgccgcacctgaagcaatccaggatgggagcgccgggacagacgggaaaacatttcagccatgcatgctgtttcgccttgcttttacctttttgctcgtttctaccgaggaacagtagttccatcgggatcggaacgagctagcaacatggcttgtaactgaaacctgcaaatgttcttgatgaaatgaaaccgtcgcgtcatttgtttcaaaaaaaaaaaaaaaaaaggtccctagaaagggaaaaaacgatctgaatataaaaaagggggaaaggg

SEQ ID NO: 13340 - DNA, 715 bp, Sorghum bicolor
  Clone ID: LIB5121-003-A1-PF1-A5
cctcctctatttttataccgcttctcctgctggttccgtccgccttctttcccggcctcccgtccccggcggccagccggccgtccccttcgtcgtcagcggagggctaagctccctctcgggctcggccatggcgacgccggacaaggggcaggggcgtccgctgcccaagtttggggagtgggacgtgaagaatcccgccacgtccgagggcttcaccgtcatattccagaaagcccgcgacggcaagaagactaccggcggccccgggaacgtccgcgcaggcataccgccggccttcaggaacggcgatggcgccgacgacggcgggtacaggcctgacttcaaatacggcgacagcagccagcacacgccgcccaaacgcatcaaggtgctgacacgtggacgtggacctctggtggatcgcagaagaagtgggccttctgtggctgctgattcttcatagctcgctgctgctgccgctgactccaaaggagaatgatcgtgccgcacctgaagcaatccaggatgggagcgccgggacagacgggaaaacatttcagccatgcatgctgtttcgccttgcttttacctttttgctcgtttctaccgaggaacagtagttccatcgggatcggaacgagctagcaacatggctttgtaactgaaacctgcaaatgttcttgatgaaatgaaaccgtcgcgtcatttggtg

SEQ ID NO: 13341 - DNA, 442 bp, Sorghum bicolor
  unsure (1)..(442): unsure at all n locations
  Clone ID: LIB5047-002-R1-XP1-G4
gccggccgggctgggctatttttatcaccgcttctcctgctggttccgtccgccttctttcccggcctcccgtccccggcggccagccggccgtcctgttcgtcgtcagcggagggctaagctccctctcgggctcggccatggcgacgccggtatccttcgttctcttataccctgcctggctgcttcatttgcttccatctcctctcctgtctggcgcgtactcgatcgatctatccatatgcatgcatgccgttgcgttgcgttgcaggacaaggggcaggggcgtccgctgcccaagtttggggagtgggacgtgaagaatcccgccacgtccgagggcttcaccgtcatattccagaaagcccgcgacggcaagaggactaccggcggncccgggaacgtccgcgcaggcataccgacggccttcaggaacggtgat

SEQ ID NO: 13342 - DNA, 1110 bp, Sorghum bicolor
  Clone ID: SORBI-28MAY03-CLUS1945_1
ccggggcccgcaacttttgcttgtcacgacggaggcccgccagatccaggttcctgggcgacctcctccattccggccctctcgtccttccatctccggcccgttcctcgtcggcgcacgagcacccaaggtccccggactgcgttcacctctgctctcctttttcttctcctgttcgacaactgtggcgtccgccgctgacgccgtaagctaggtgcccaggtcttcgccggcgacgagcacccgccactccaccaggggatgccccgggcttaattgaatgggctctcttctcaccaggactggcgcatggctccaggccaagatttttgatcccgtgctgcaggtcatcagaaggggagcagaacccaaggaactggccttctctgctgcccttggtgtcacgattgggatctttccaatatgtgggaccactgttattcttggcgctgttgctgtagcaatgttgggaagtcgttgcaatgctgttactgttatggttctaaatttggccgccactccaattgagctaagcttgatcatccctttcttgcgcttgggggaaaccatcactggcagtggccacttcgccttgacggccgacgcattgaagaatgtcctcactggtcatgcctcaaaggatgtgctactgagcatcgtccgtgcgatgctgggttggctcgttgctgcaccatttgtactggccgtgctatacgttatttcgttcccttgtttcaaggttctggtcaacaggtttggcggcattccttcgagccccaggaccccaatcaaggcggtgtagctagtgtggcatgctgaatgctcctgaaattgtgtacaccaaattctttgtgatgccgtcgggttgagatgggttccagcatcatgttgctcggccatcccaggcactggcgaataaatacgacttgagaggcatgtgtcctctgtaattctgtatgctgacttgataatcatatagtgggatgtgtatttatgaatttatttacagtcttcaaataaagctacgaagtacaaagggcacggaccactgtgccggccttcccattgtacggcatgggctgtgttcagctaaaaaaaaaaaaaaaaaaa

SEQ ID NO: 13343 - DNA, 375 bp, Sorghum bicolor
  Clone ID: LIB3478-006-P1-K1-G3
ccatgtcctactgtcctgtactgctccgcgccctgccactgctcccttcaatcaactccggtaccaccaggggatgccccgggcttaattgaatgggctctcttctcaccaggactggcgcatggctccaggccaagatttttgatcccgtgctgcaggtcatcagaaggggagcagaacccaaggaactggccttctctgctgcccttggtgtcacgattgggatctttccaatatgtgggaccactgttattcttggcgctgttgctgtagcaatgttgggaagtcgttgcaatgctgttactgttatggttctaaatttggccgccactccaattgagctaagcttgatcatccctttcttgcgcttggggg

SEQ ID NO: 13344 - DNA, 540 bp, Sorghum bicolor
  unsure (1)..(540): unsure at all n locations
  Clone ID: SORBI-28MAY03-CLUS1720_2
gccgcgcgctccacctgggcgtcaacgtgaagatgatcaccggtgaccagctcgccatcggcaaggagaccggccgccggctcggcatgggcaccaacatgtacccttccaccacgctcctgggcgacaagaacagcacggtgaacggcatgcacatcgacgagcccatcgcccacacccgactcgtggaagctcgacgagatcttcgccaccggcatcgtgctcggaacctacatggccatcgtcaccgccatcttcttctacctcgcccacgacaccgatttcttcacggccgtgttcggcgtgcagtcgatcaaggagaacgacagggagctgatggcggcgctgtacctgcaagtgagcatcatcagccaggcgctcatcttcgtgacgcggtcccggagctggtcgttcgtggagcggtcgggacacactccacgggcctcaaccagctcgccaccttctacgacgtttcacctactncgagctcaccgagcaggccagccaaagtcgctagacttgtggagctgcttacactca

SEQ ID NO: 13345 - DNA, 1693 bp, Sorghum bicolor
  Clone ID: SORBI-28MAY03-CLUS1720_1
gcacgagggcaaggagagcgccggcgagccgtggcagttcatcggtctcctgccgctgttcgacccgccgcggcacgacagcgcggagaccatccgtcgcgcgctccacctgggcgtgaacgtgaagatgatcaccggcgaccagctggccatcggcaaggagacggcgcggcgccttggcatgggcagcaacatgtacccgtccaccaccctgctgggcgacaacaagggcggcgagatgggcgggctgaacatcgacgagctgatcgagaaggcggacgggttcgcgggggtgttcccggagcacaagtacgagatcgtgaagcggctgcaggaccggaagcacatctgcggcatgaccggcgacggcgtgaacgacgcgccggcgctgaagaaggcggacatcggcatcgcggtggacgacgcgacggacgcggcccggagcgcgtcggacatcgtgctgaacgcgtccgggctgagcgtgatcgtgagcgccgtgctcaccagccgcgccatcttccagcggatgaagaactacaccatctacgccgtgtccatcaccatccgcatcgtgctgggcttcctcctcgtcgcgctcgtctgggagttcgacttcgcgcccttcatggtgctcatcatcgccatcctcaacgacggcaccatcatgaccatctccaaggaccgcgtgaagccgtcgccgacgccggactcgtggaagctcaaggagatcttcgccacggggatcgtgctcggaacctacatggcgctcgccacggcgctcttcttctacctcgcgcacgacaccgaattcttcagcgagaccttcggcgtgcggtccatcaaggagaacgacaaggagctgatggcggcgctgtacctgcaagtgagcatcatcagccaggcgctcatcttcgtgacccggtcccggagctggtccttcgtggagcggcccggcgcgctgctggtgatcgccttcctggcggcgcagctggtggcgacgtgcatcgccgtgtacgccaactgggagttctgcaagatgcagggcatcggctggggctggggaggagccatctgggcgttcagtgtcgtcacctacttcccgctggacgtgctcaagttcgccatccgctacgcgctctccggcaaggcctggaacaacatcaacaacaagacggccttcaccaaccgcaccgactacggcaagggcgagcgggaggcgcagtgggccaccgcgcaaaggacgctgcacggcttaaaccaggccaccggcaccttcgaccttcttcggcgacaaccagggctaccgagagctgtccgagctcgccgaccaggccgccaagcgcgccgaggtggccaggctcagggagctgcacacgctcaagggccacgtcgaatccgtcgtcaagctcaagggcctcgacattgacaccattaatcagagctacaccgtgtaaactcaaactcaggtttcttttggattagacacatacatacacacacatattatttgtaaagattcgttcgtattttcatttacaccgggaagatttctaactgtcctcctccctccttgtaagttgctcctgtaaactcttcctgaattcatggcgcgtcgttgtagcaatcaccacttcctccctgtgaatgcccacaggccacagcgtgtcttggtgaaagcatgtatgattattac

SEQ ID NO: 13346 - DNA, 1351 bp, Sorghum bicolor
  Clone ID: SORBI-28MAY03-CLUS14874_1
acattccactcacccccccaccgcacacctttccgatcccatccctctccagcctccgccctccgctcgccgcgcttccgcttcctccgccaccaccgccgggatggctgcgcgctgcccctacttcgccgtggaggagtcctcccgcggcatccgctcgggggagtccccggccgcggcgctccgccggatcctcgcgacgcccggtgcgcaccaggcgccctgctgctacgacgcgctcggcgcgcgcctcgtcgagcgtgcggggttccagattgggttcatgggcggtttctgtgtttctgccgctcgacttggcttgcctgatgtcggcctcatttcctatggagaaatgatagaccaagggcgtctcatcaatgaagctgtttcaatcccagtgattggtgatggagacaatggttatggaaactctatgaatatcaagagaaccataaaagggtatatcaatgctggttttgctggaattatgcttgaggatcaggtggcacctaaagcatgtggacatactgaaggaaggaaagttatatcaagggaggaagctatcatgcacataaaagctgctgtagatgctaggaaggagagtggctctgacattgttattgtagcaaggtcagatgctcgccaagcaatttctcttgatgaagcattatggagggtgaaagcatttgctgatgctggagcagatgttctgtttattgatgcccttgcttcagtagaagagatgaaagcattttgtgctgttgcaccagaagttccaaagatggcaaacatgttagaaggtggtggtaaaactcccatattgagccctgctgaacttgcagaaattggtttcaggcttgcagtctatcctttatccttagttggggtatcaatgcgtgccatgcaggatgctctagttgcgataaaagacggcggtgtacctccacctagcatcttgccatcttttcaggagatcaaggatacattgggtttcaaccgctattataaagaagagaaacaataccaagtggacaagtgaaggaagcaactgacgtctgatcttgtggattcagccggatcgtttccatggcttaattgccagcggacatgatgcagaaccagtcgtatttatgttgagttgtaaacttgtatcgaaagctgtgtagcgcagtatcctgtagaacacatatatatggttttctctgcttccgttcctgctctgctgtggtttcagtaatcccgaacttgtggttccagtctaataataaaacaggccagcttggggctttcgttatgccagggcactctttaccccgtcactgtactaggggcatttctccggaaatcacca

SEQ ID NO: 13347 - DNA, 740 bp, Sorghum bicolor
  Clone ID: SORBI-28MAY03-CLUS29638_1
gactccgtcgaggcggcggagatggcgcagacgctgcgcgactgcgaggcgcccgcggccaagggcgagaagaaggcgtgcgccacgtcgctggagtccatggtggacttcgccaccaccagcctcgggaccagccacgtgagggccgtctcgaccgtcgtggccaaggagggctcgccgaagcaggagtacaccgtgaccggcgtcaagcccgcggccggcaccggccacgacggccgcctcgtggcctgccacgcggagccgtacgcgtacgccgtgttcgcgtgccacctgacgcagcagacgcgggcgtactcggtgtcgatgctcggcagggacggcacggccgtggacgctgtcgcggtgtgccacgccgacacgtccggctggaaccccaagcacatcgccttccaggtgctcaaagtgaagcccggcacggtgccggtctgccacttcctgccgcaggaccacgtcgtctggacccgcagcggctgaggctgctggatggctgccgtttgctctcgtcgcgccgcctgatggagtgatggtttcgttttcattgtattctagtagcctctgggcatactgtttatgtttccagtatagtgcttgatgtttgtatggatggtgtggccagccagtatcgaccacctgcttagattctgttgtatagttctaaataaacaggcatgtctttacggttactgctctgagcctgaacaaacttctgttgatccccg

SEQ ID NO: 13348 - DNA, 1233 bp, Sorghum bicolor
  Clone ID: SORBI-28MAY03-CLUS2990_1
tggccgggagaggtagattagataccacacagagtcagagagagggagggcgggagcgcgactcggtggggatggctttgctgcagagccagagccgcctgcccggcattggctgcagcagcagcatcgtcttggcaagagcgagggtgcagcagtgtctggcagcggcgtcgcactcacgcgcgcccctcctgcgagctaatggcggcaggaggagcacgacgggcctccccacctcctcctcctcctcctttaaggctggcaatgcgatcagcctcagccggcggagaataagggacctgcgcgtcgtcgcggaggcggccaccgcgggggcggccaaggtggtcacgccggcgtcgtctggcggcgtcagcgtcagcgacgtgctctggccttccgccggagcgttcttggccatggcggtactgggaaaaatggaccagatggtggcgttcaagggagtatccttgacgattgcgccccttggagcagtctgctgcgtgctttttagcgctccaggctcccctgcagccaagaaatataatatgttcgtcgcccagattggttgtgcggtgttccagatggtggcgttcaagggagtatccttgacgattgcgccccttggagcagtctgttgcgtgcttttagcattcatgaccatcacgggtgcctcacatccaccagctgcaagcttgcccctcttgtttatcgatggcccgaagtttcacaatctgcaactttggtacgcgcttttccctggagctgcaggctgcatcgtcctttgcttgattcaagaggtggtgctttacctgaagaagaacttcaagttttgactcaagcagcttgactctatggattcttgtggcagcaattagattaattattcaatcatgcaccataaattacattgcctgcatttacgagaaagttgcgaaaatgaaggtttactgtctcctgtcttggttaaagaagaaagaagactttcctagtttccttgataccttgtgcttatcaaaatgcagaggatacagatgtgtacataccattgtctcatcaaatggagtctgacaaattgtacacagcggattcttgacaattgttttttcaactggtaggatcaaccctgtaatgtaattgtgcaaactgaaaaagccaggaatactttaggataacctctggctatctgaagggagataacccatttttttagaacagagttgcagttgcatggcc

SEQ ID NO: 13349 - DNA, 1634 bp, Sorghum bicolor
  Clone ID: SORBI-28MAY03-CLUS30252_1
tgcgagcgaacgcggacaaatatatcctcgctcgtcagtcgcagctactccgccgccgccgcaactccgcacggccaccaccttcttccgggctccagcgatgtcggcggcgatcagaggagccgagttccccggcttccggggcgcggcggcgcagctccccaggtcgcggatgctcgggaggccgatccgggtggcgccacccgccgcggcccagccaggcggcggcggcgcgtccgcgggcagcatacgcgccgtctccgcgcctgcgaagaaggatgcttctgaagttaagcgaagcaaggttgagataataaaggaaaagagcaattttctcaggtaccctttgaacgaggagttggtctcagaggccccaaatatcaacgagagtgctgttcagctgatcaagtttcatgggagctaccagcaaactgatcgggatgtccgtgggcagaagaattactcatttatgctccggacaaagaatccttgtggaaaagttccaaaccaactttatttggctatggatacactagctgatgagtttggaatcggaacactccgcctgacgaccaggcagacattccaattgcacggagttcttaagaagaacttgaagactgttctcagcactgtcataaagaatatgggctcaacattgggcgcttgtggtgatctcaacaggaatgtacttgcacctgcagcaccttatgtcaaaaaggatatcctttttgctcaacaaacagcagagaacattgccacacttcttacaccacagtctggggcttattatgacctgtgggtggatggagaaaagataatgtcagctgaagagcctcctgaggtgacaaaagcccgcaatgacaactcacatggaacaaacttccctgactctcctgagccaatttatggcacccaatatctgccgaggaagttcaaggtcgcagttaccgcggctggtgataactctgttgatattctgaccaatgacataggtgtcgttgttgtttcagatgatgcaggagaacctattggttttaacatctatgttggtggtggcatgggaagaacacaccgagtggaaactacattccctcggctggctgatccgttgggttatgttccgaaagaagatatattatatgctataaaggccatcgtcgtcacacagagggaaaatggaagaagggatgatcgcaagtatagtaggatgaagtatttgattgaccgttggggaatcgacaagtttcgggctgaagttgaaaaatattacgggaagaagttcgaaagtttccgaccattgccagagtggcagtttaacagctaccttggctggcaagaacagggtgatgggaaattattctatggagtgcatgttgataacggtcgtgttggtgggcaagcaaagaaaactctacgagagataatcgagaagtataatttggatgttagtattaccccaaaccaaaatcttattttatgtgggattgatcaggcatggagagaacccattactacagctcttgcccaagctggcctgctggaaccacaggatgttgaccccctgaattaacttccatggcatgccccgccttgccactatgccctttggcacaaacagaagctgaacgggg

SEQ ID NO: 13350 - DNA, 1641 bp, Sorghum bicolor
  Clone ID: SORBI-28MAY03-CLUS70299_1
tactgcgaagccgccacctccacctctccacccaacaacaaattccatagacgccggccattctcaccatccccacgaagccaaacccaagagcaccaccagagcagagagcatcgtcgtcgtcgtcgtcgtcggcggcggtcgggcaggcaagcaagcatggcggggttcaaggtgacgcggatctcggagggtccggtgaagccggcgtcatcgacgcccgaggagacgctgccgctggcgtgggtggaccggtacccgacgcaccgtgggctggtggagtcgatgcacatcttccggtccggcgcggacgctgccccggccgtgatccgcgccgcgctgggcaaggcgctggccttcttctacccgctggcggggcgcatcgtggaaggggaccagcccgggtgccccgccatccggtgcaccgccgacggcgtctacttcgcggaggccgtggcggactgcagcctcgaggacgtgcggttcctggagcggcccctcctgctccccaaggaggacctcgtcccttaccccggcgacgaccgctggaccgtcgagccgcacaacaccatcatgatgatgcagatcaccaagttcacctgcggcgggttcgtgatgggtctgcggttcaaccacgcgtcggcggacggcatgggcgcggcgcagttcatcaacgccgtgggcgacatggcgcgggggctgacggagcccaaggtgctgcccgtgtggcaccgggagaagttccccaacccgaacatcaagcccggaccgctcccggagctccccgtgctggcgctggactacgtcgtgctcgacttccccacgccctacatcgacgacctcaagaggcagtacaaggcgcacagcggcaagttctgctcgggcttcgacgtgctcacggccaagctctggcagtgccgcacccgggcgctcgccctggaccctgccaccgaggtcaagctctgcttcttcgccagtgtccgccacctgctcaagctcgacagggggtactatggcaactccatcttccccgtgaagatgtccgcgccggctgagaaggtgctcgcctcctccatcttggaggtcgtcgacatgatccgggaggccaaggacaggatggccgtcgagttcttccgcttcgccaaggaggagacggaccaggacccgttccagatgaccttcaactacgagtccatctatgtctccgactggagcaagctcggcttctccgacgtggactacggctttggcccgcccatgttcgccggcccgcttgtcaacaatgacttcattgcctccgtcgtcatcctcaaggcgccgctcccgctggacggcaccaggatgctcgccagctgcgtcaccaaggagcactccgacgagttcgcccgtggcatgaaggaagacctgccctgaataacactttgatgttgcttatcatacagctgatccatgatgagacggggaaactgagatgaatggtgacataaagatgcttctgtttggttaatgttgttgttaattttggttgtatttatttgtcactttatatcttggtcaatacagtactactttagacagcaaattcgatcttaatttgtaccatttgatatgagacagagacaataaaaagggtatacttcc

SEQ ID NO: 13351 - DNA, 748 bp, Sorghum bicolor
  Clone ID: SORBI-28MAY03-CLUS67555_1
agcagagcggcggctggatccgcgcgctgctggaggaggccgagaacgagcgcatgcacctcatgaccttcatggaggtggcgaagccgaggtggtacgagcgcgcgctcgtcatcaccgtccagggcgtcttcttcaacgcctacttcctcggctacctcctgtccccgaagttcgcgcaccgcgtcgtcggctacctggaggaggaggccatccactcgtacaccgagtacctcaaggacctcgaggccggcaagatcgagaacgtccccgccccgtccatcgccatcgactactggcgcctccccgctaacgccacgctcaaggacgtcgtcaccgtcgtgcgcgccgacgaggctcaccaccgcgacgtcaaccactttgcatcggacatccattgccagggcatgcagctgaagcagtcccctgcgccgatcggataccactgaggctgtttgtgctctgctgaattttgcatcgctaataagcaaatgagtgttttttgtcttaagggaaagaaataatgcttatgagtactactactgcgattaggatatattttccaaccagtgaaaccattttattttatgtacgcctcactgagtcactgtcgtctttatcagagcaagcttactctacatatctatgtacatatctttgagtgtgacaggtgcttttctggcgttccggaagttcctttgttcttcatgtagtacaatatatgcatagctcgtatcttgtttgcaga

SEQ ID NO: 13352 - DNA, 1545 bp, Sorghum bicolor
  Clone ID: SORBI-28MAY03-CLUS7432_1
ctctccttccacccctcctcgccgccgcagacgaccgccgccgccgccgctgcagcgaacccttgcgaatcttcgttgtccgggctgtggggggcaggcatggcgctccggaggctgctgcaggggagtgtcctgccgcgggtaaccggcagggctttggcaccggccgtggcgccgttttcaacggagtccggggagaccatccgtgccacgctctttcccggcgatggcatcgggccagagatcgccgagtctgtcaagcaggtattcaatgttgcaggggtaccaatagaatgggaagaacactatgtcggtacagaagttgatcccagaacagagagttttttgacttgggaaagcctggagtcggtgcgtagaaacaaagttggcttgaaaggacctatggctacacctattggaaagggtcatcgatctttgaatcttacattaaggaaagaacttgggctctatgccaatgtcagaccttgcaacagcctcccaggctacaagaccagatatgatgatgttaaccttgtgacaattcgtgaaaatactgaaggagaatatagtggtcttgagcatcaggttgtgagaggtgttgtggaaagtttgaaaattattacccgccaagcaagtttgagagtggcagagtatgctttccattatgccaaggccaatggccgggaaagggtctctgcgatccacaaagccaatattatgaggaagacagatggtcttttcctcaagtgttgccgtgaagtggctgcgaagtaccctgaaattcaatatgaggaagtcatcatagataattgctgtatgacgcttgtgaagaatcctggtctttttgatgttctagtgatgccaaatctctatggtgacattattagcgatctatgtgctggtttgatcgggggcttgggcctaacacccagttgcaatattggtgaaggcggcatttgtctggcagaagctgttcatggttctgctcctgatattgctggcaagaacctcgcgaacccgactgctcttatgctgagtgctgtcatgatgttgcgccacttgcaattcaacgacaaagcagaccggatccacaacgccatccttcagaccatcgctgagggaaagtacaggactgctgatcttggtggaaaggcatcgacatcagagtttacaaacgcagtctgtgaacacatctgagaatcggatgtgattctttccttctgattgttttgtcttcctaattttttttgtcgcatatggagaggagctttagctttaagaggttaactggcagcacctcaaacttttgtgggtgtttaacacggtttgagaccgtcaaataattttgtcacatttcttgctgttcagagattctttcaactccggaaacgagtctataattgtctgtaataatcaacagcagcattatagcagtaagtaaggtctatttcattcacgttcttgaaatattgggccaactggttggaatgccagttagggcatgttaaaccttgttttccctttatgctgaaaagaaccaaattc

SEQ ID NO: 13353 - DNA, 1238 bp, Sorghum bicolor
  Clone ID: SORBI-28MAY03-CLUS8065_1
gaattaagtgcccaacttggggagctattcgaggaacaccaactatacagaatactcgtgaacctgggaaaagagttggtccaaaacttgcttgtccttcgttttgccaaccgcttgttcttgcctctttggaaccgcgacaatattgataatatacagatagtattcagggaggactttggaactgaagggcgtggaggatattttgaccaatatggaatcattcgtgatatcattcagaatcatttactgcaggttttctgtttggttgcgatggaaaagccggtctctcttacgcgtgagcacatcagagatgagaaagtcaaggttctgcaatctgtgaaccctattaagcctgaagaggtagtccttggacaatacgatggctacaatgattaccctacagggccgcccgactctaatgccccgccttttgcttcccctgttccgcgggttcacacggccttgtgcgaaggttttcctttaattcttaaagctggtaaagcattgagctcaaggaaagcagaagttcgggtgcaattcaaggatgttcctggtgacatttttagaaataagaggcaaggaagaaatgagtttgttatacgcctccaaccatcagaagccatgtacatgaaactaactgttaagaagcctgggttagaaatggctactgaacaaagtgaacttgatttgtcatatggtatgcggtaccaaaatatcaaaattcctgaggcatatgaacgccttatcttggatacaataagaggagaccagcagcacttcgttcgcagagatgagctaaaggctgcttggcagattttcactcctttgctgcacgacattgacgacggcaagctgaaggccctcccatatgaacctggcagtcgaggccccaaggaagcagacgaattgagcgcgagagttggatatgtgcagacccacggttacatatggataccaccgacccttgcatagaagagaatggccggttccatggccttataggaattgtgtgtatctaggaagagtgccctacaataaagctgcgcatatatattgcccatttcgctatatcacacggcgttgtaataatgttctgctgaacatcccaattacgatatgaaataaaaatgcatgttccattcagagggtgtttagttcccttttcatccaaaaaattatgggttttggtttctcattttgtataatgaagctaaatactatgtaaaattttggca

SEQ ID NO: 13354 - DNA, 1119 bp, Sorghum bicolor
  Clone ID: SORBI-28MAY03-CLUS8933_1
gcacgagggtatcttcgagggattaatgccggaagatctgaatatttatgtcacaacagcctcaaatccagttgaaaatagttggggaacatactgccctgggatggaaccatcaccccctcctgagtacattacctgtttaggtgatttgtacagtgtttcttggatggaagatagtcaaacccacaatctaaagaaggaaaccatcaaggatcagtatgaagtggtgaaaacaagaacctcaaactcgaataagtacaaagagggttctcatgttatggagtatggtgataagaccttcaaggatgagaagcttttcctttatcaaggttttgatcctgctaatgccaacatcgcaaacatgctgctttggccaggcccaaagggtgcagtcaatcaaagagatgctgatcttctcttcatgtggaagaggtatgagcagttaaatggggagtctgtagagaagctgagggctctcatagagattaaagaaactgttcaacataggaagcatcttgacagcagtatcgatttcattgggaggcttctcttcggatttgagaaagggccttcaatgcttgaggctgttagagcctcgggtctaccattagtcgatgattgggattgcttgaagaggatggtgcgcattttcgaatcccagtgtggttcactcactcagtatggcatgaagtacatgcgagcatttgcaaacatttgcaacagcggtatatctgagatgaaaatgagggagtccagcatcagcgcttgcagcagctacaactccgcgaggtggagcccgatggctcagggacacagcgcttgatgctaagatcaatagcagaacccccgaggtctgctgccccctccccctgtgtgcgagctcgtatcatctggggaccgtgtgcacccatgattacttgtatatatcatcatgtacttatgttcgtagtacctatgtaaagtaatgccaagtctgatcttcatccaactaccgaaatgattaagatcagatgtgaatggtgttgcgatggatgatcgcaaggtaggccatttatcagtggaccaaaaatgatgacccaaatcaaggtagtgctcctctgatagcccatatctattgct

SEQ ID NO: 13355 - DNA, 1525 bp, Sorghum bicolor
  Clone ID: SORBI-28MAY03-CLUS9159_1
gcacgaggccgcccctcggttgcgccaacggccggaaccctaatcctctcccaggcggcggcggcgctgccccccatccgcggccccgcggcaaccagaatccagatcgaggatgatcaatcaccacaaaaatagtgcattttggaaagctgttcaatagaggcatggaattagatcctggtcataccccgtcttatacatggtcttcctgatgagattgctctcatttgcttggcaagagttcctaggcggtatcataatattcttaggcatgtctcaaagaggtggagagcactgttatgcagtgaagaatggcacttgtgccgcaagaggaataacttggacgagtcatggatctacgtaatctgtagggaggcaggcatcaaatgctatgtattggctccagacccttcaagtcggtgctttagaatcatgcatatcattgaacccccatgctcagggaggaaaggtgttaccattgaagccatagcacaagggctatttcttctgggtggttgcaattgtgtacatgatgctacagatgaagtatattgttatgatgcctcctcaaatcgctggagcgcagcagctccaatgcccacagcaaggtgctattttgtatccgcgtctcttaatgagaaactgtacgtaactggtggatatggtttgacagacaagtcaccaaattcatgggacatctatgacccggccacagactcatggtgtgcccacaagaacccaatgctcacccctgacatagtaaaatttgtcgcactggacgaggagctggtgaccattcaccgggcagcgtggaacagaatgtactttgctggcatatacgacccgctggaccgcacctggagaggcacggaaaacgaaatcgctctctgctgctccagcccgacagttgtcgtggatggaacactgtacatgctggagcaatctatgggcacgaagctgatgaggtggcagaaggacaccaaggaatgggccatgcttggtaggctctccgacaaggtcacaagacccccttgcgcactcgtggccataggcaggaagattcatgtgattggaagagggctgagtatagtcacagtcgacgtggacacagcagcaagagtagatgggttcctggttaccacttctataggcccattggtggaggaagacttgacgccggagaggtgcatggtgatcaccatctgaaggtggcatcggagcttgatgctgatgccgagtgtatgttgtaactgacaatccacattggccgaacatttggctagtggggatgactcatgcacatatatactgtgatgtgaattcaataagggttcatacagccaataattagttaggccatgttttggttcctcatttgtgctctttctcgactgctggctgtaagaaaaatatttaccttttttttgttacctgatggatatctgaactgaacatagctgatgggattggaaccccctgcgaatgcgatgcttgttctggtatattgtccaaaaaaaactcgagg

SEQ ID NO: 13356 - DNA, 1872 bp, Sorghum bicolor
  Clone ID: SORBI-28MAY03-CLUS9137_1
ccgtcttcccctcgcgcctgctgcatccctcttccctccgcctcctctctctctctcttctccagacgactgttggccccgccgccgccgccgccctaggccaggtgcggaggctttccttggtctcttcgccggcgacgagcacccaccaagtactcccaccccttctcttcccttcccttatgctgtgcgaagcagcgaaaccctaacctaatcgccggcgacgagcacccaccaggtcgtgtgtcccaaaacctctctgttgctgcattgaagcttgaaatgtcagcaccgatgcccatttcccggcttgtttcccatgtcatccttgatttggatggcaccctcttaaacacagattccgttgtaagtaaggtggtaaaaccatttcttgtcaaaaatgggaaaacgtgggacagcaagaaagcttacaaggtggtgcaacataaaagctcttccaggagctactcggctgctaaaacatttaaggagtaatggggtgcctactgctttggcttcaaactcaccaagatctaacatagaagccaaaatttcatgccatcaaggatggaaagagtctttctctgcaattgttggtggagacgaagtagagaaagggaagccatccccagatatgtgagacatcatgttgcatgatgccatcatctctgatactccatgtttgcttaacttgtttttttctttttatttccggctgtctgttgtgatggtattcaagatttttggaagctgcagtgaagagtgaagacattacctttaacattgtaagtaatgaggatgctaggccaggtattacagctggtaaagctgcagggatgcatgtcatagctgtaccttcaatacccaaaaagactgctgagttcagttctgctgatgtggtgatcaattccctccttgatgtgaggcctgagaaatggggtttaccaccatttaatgattggattgaagataccttaccaatagaaccgtggtttatcagtggaccagtgatcaaaggatttggccgtggttctaaagtactaggaataccaacagctaatttacctgcagagaacttttctgatgtagtgtccgagtatacatctggggtatactttggctgggctggactttcaacacgtggtacatataagatggttatgagtgttggctggaacccatattttgacaatactgagaagacagtagaaccttggttgcttcataattttggtgaggacttctatggtgaggagctgcgccttgccattgttggctacataagacctgaggccaactttccttcgcttgagagcttgatagagaggattcaagaggatgggagaatagcagagaaggcactagacttaccgatgtatgccaagtacaaagactcaccatatctgagaaatactttgcagctgggaagtactaatgatgatagccaggctgagctgaattccaagtgacaagcccctgcagttggtcactaaataagttgccggttattgttctgttcgcgatagagtgaaatacacttgtattacgattggactcttgttgaccttataggcttatacgcagttctttccaccttttcagaaccagtgttcctcaaagaacagttcattcgttgaggagaaaatggtggttgcactatatggttgttcctcaaagaggggtgttataccctttctaaagaaaatgacgggatgttgaaaggtgaatacagggatacttcattcgttgattactgaattgatgcattcgagattgggaagatatcacttgtactagtttaagttaagaaacagtaaaaagatacttaatattctttcttaatgaaatgatgcacagctctcttgcattgtc

SEQ ID NO: 13357 - DNA, 425 bp, Sorghum bicolor
  Clone ID: LIB3476-058-P1-K1-F1
aagctgcagctattgttttagaagactatggactcccttactctacagaagagttcctctcaatgattactccagtgttcagtgaacagtggtgcaacataaaagctcttccaggagctactcggctgctaaaacatttaaggagtaatggggtgcctactgctttggcttcaaactcaccaagatctaacatagaagccaaaatttcatgccatcaaggatggaaagagtctttctctgcaattgttggtggagacgaagtagagaaagggaagccatccccagatatatttttggaagctgctaaaagaatgaacgccactccttcaaattgcctagtaattgaggattccttgccaggtattacagctggtaaagctgcagggatgcatgtcatagctgtaccttcaatacccaaaaagact

SEQ ID NO: 13358 - DNA, 875 bp, Sorghum bicolor
  Clone ID: SORBI-28MAY03-CLUS3513_1
tccgcaatcaccaatcaggagagaagtgaagctagcattcaacaaaggaagaagcgagcgagctgacaaaatcgactgaccatccatccatggctctggcgccggcgcctctccagtgcttcctcacgggcagcagcagaccggtgtgcacggcgacgccgcccaagcacgcgaggaggccgtcgaggatctcgtgcaaggcgtccggcgacgacaaggacaaggtcccgtcgggagggaatgatcttggggtcaagctcgggaagctggccatggtcgcgctggccgccggcgtgctggcgctcggccccgtcgacggcgccttggcggccaagtccggcggcagggtcggcgggcaggccttccggtccgcgccacgatcgtccggccctcggataaacaactccaggacgaacatctacatcaacccgccggtggcgccgcctctgggcggatacggctacgggagcccgttcttcggcggctacggctacgggtggtcgccgttcagcttcttcgcgcccgggccgagcgtcgccgtcggggtcggcggcggcttcgacacgctcgtcctcttcttggtgctgggcgccgtcgtcggagctgtcaggcggtttctcaacaggaacaacgatgattacgacgactactgattatcaaagctagatgatgtagcgaatgtcatccttcaccttcatgtgtaatatatggcgagattttttttttcgtgtggaatcctaggaacagagtgtactgatgcatcaggaagtgtatgtaataattttgttcagtgaaatgtaatgagaataacatctatagttagggacagttacaaaaagccaaatactataagcatcgatcgagccatttactcc

SEQ ID NO: 13359 - DNA, 1840 bp, Sorghum bicolor
  Clone ID: SORBI-28MAY03-CLUS335_1
gagccgacgcaacagccgtaccatctatgtaggcaatctccctggggacatccgtgagagggaggttgaggatctcttctacaagtatggtcgtatcttggatatcgacttgaaaatacctccaagacctcctggatacgctttcgttgagtttgaggatccacgtgatgctgatgatgcaatttatggccgtgatgcacgaggctttgatggctacaggttgcgcgttgaattagctcatggtggtagaggtcagtcttattcttatgatcgttcaagcagctatagcagtgcacgccgtggaggtgtttctaggcgctctgatttccgtgttatggtcactggtttaccttcatctgcatcgtggcaagatctgaaggaccacatgcggcgcgccggcgatgtctgtttctctgatgtataccgtgaggctggagaaactattggaattgtggactatacaaattatgacgatatgaaatacgcgattaggaagcttgatgactcacagttcaggaatgcattttcaagggcgtatatcagggtgagggagtatgatgccagatcacgaagcagaagccgtagccggtcgtactctagaagccccagttacagcaggagcaggagtccaaaatctctttctcggtcaccctcacctgtggatgaaaggtatgtgaatctatgtcaataagaaatgtacatttgtgaaactgaaagtgctaatattgtttaaagaaaacggattgacaaataaatggtgaaaccaatcagatcttgtcctgaatcatctttaacgtattctgcagtgcgcctgataggactgacagtaagaaaatgtgaagtgaatcttgtggtgttattaaaacaaatgtctactattaagttcaatgactccgtataaatgaaccttaatttataagtttgtgtttttgtctaacaatgctgccatcttagtaaaaattcctatggtgccttctgcatatggctctttgtagccattttcttgtcaaggttcacactagccaaagaagttgacattaacaacaaaattcaatatacaccttgctttgtttgcttatttgcattccagttatgacctaattaccttataggcttaaaaactatattattctcggagtattaagcataaacaccagaatgttgcagcttccctcctgtttcagttcattcattcatctgctgtggaacgttgcctctttatgcacatctcaagttgccagtttagctttaattgcaattttgtatcgcagattagagtgctactaatgcatcattaagtaatggaatttgtttctggtaccttttgcagatcgctatcaagatctcgatccccagtttcttctccttctcatgccagatctgcgagcagaagcacatcccgttctcggtctcctgtgagatccgattgaacttgggagcccttgaagcagtgagcagctccagggagaagaaaggaacttgagaacatgccgtgccaaaagatacttgagaacaccaatggtccaagtgattatgttgttgccgctgctcccccacatttgggaggtctcttctatttagacggagcatttaataattattatattacattatattgctaaagagatacttattatgcgtagcataccggtgtagactgaacttgtttgtcctcggtttttcttggctcctggaactcggttttatcatttgtttacaagagacttgttttatcattgtacccatatagcaaaacctataggtgtagtaggagtatgctgtatgcgtctatgttcaattggtcgcatgtaaacctggatacgccacagttgttgggttc

SEQ ID NO: 13360 - DNA, 648 bp, Sorghum bicolor
  Clone ID: LIB3481-052-Q6-K1-D8
gcgttcgcgtggcaagaatctgaagaccacatgcggcgtgccggcgatgtctgtttctctgatgtataccgggaggccggagaaactttggaattgtggattatacgaattatgacgatatgaaatatgcgattaggaagcttgatgactcacagttcaggaatgcattttcaagggcgtatatcagggtgagggagtatgatgccagatcacgaagcagaagccgtagccggtcgtactctagaagccccagttacagcaggagcaggagtccaaaatctctttctcggtcaccctcacctgtggatgaaagatttggccatgcggtgatctggggactgcattgatataatattggatgttttgagaatcggagtggatggtttgggactttggatagtagagctggattgtgatgcatgtatgacaagtgggccacgaccagtcctaggagcaagataggactgacagtaagaaaatatcgctatcaagatctcgatccccagtttcttctccttctcatgcaagatctgcgagcagaagcacatcccgttctcggtctcctgtgagatctgattgaacttgggagcccttgaagcagtgagcagctccagggagaagaaaggaacttaagaacatgccgtgcca

SEQ ID NO: 13361 - DNA, 1851 bp, Sorghum bicolor
  Clone ID: SORBI-28MAY03-CLUS35563_1
gcacgagcacgagccgaaaaagaaacagagaagagagggagacagagtcctcactcccacactctcactcttgtcttccagtccctcccagcgcctttcttggatcgcgaggaaaccactcgggaaaattttgcaattgtagagaaccgtatcgaccgtcgacgagggtgcatggtgttggccatgggtcacggcagggaacagagacgagcagggaggcagcaatggaggcgctcgtccccccgctcattgatcctgctctcgctgtaagatagtcccgcggtgccctctctgaatttcactccatcgaactcgacatgaagcggccacgcggcggcagtccgtcctccctcgctgcgatgaccaatccggatggtgatggttacggcgtggtcgggatggaggcggcggacgcggacgccgacgcggacgaggagatgatggcgtgcggcggcggcggcggggagaagaagcggcgccttagcgccgagcaggtgcgcgcgctggagcggagcttcgaggtggagaacaagctggagccggagcgcaaggcgcggctggcgcgcgacctcggcctgcagccgcgccaggtcgccgtctggttccagaaccgccgcgcacgctggaagaccaagcagctggaacgcgactacgccgcgcgccgccactcctacgacgcgctgcggcacgaccacgacgcgctccgccgcgacaaggacgcgctcctcgccgagatcaaggagctcaaggcgaagctgggggacgaggaggcggcggcgagcttcacgtcggtcaaggcggagccggcggcctcggacgggcctccccccgtcggggtggggtcgtccgagagtgactccagcgcggtgctgaacgacgcgggcccgcccgtgccggaggcgcagcctgtgccggaggtacagggcactcttcttgacgacgcgccgtgcgccgtcgtcgccggcgcctcggcggcggccgcgaaccatggcggggtgttcttccacgggagcttcctgaaggtggaggaggacgagacggggctcctggacgacgacgagccgtgcggcgggttcttcgccgtggagcagccgccgccgatggcgtggtggaccgagcccacggaacactggaactgatgaaccgaggccggcggatgatgatgccgtccgaccgcagcgtaggctcgggatctgggccgccgaggggtgggggaataaagaattcagagcgaaacacgggggctattctgcaaattttgtaaaatggagttgtacccgccctctttttgtcaattctcgcgcgttttagcagtactgtagtagtctaggaaccccagtcgagctcagtacaaccctggttgcgtttggactccagtgcaaaaatgcaaggaaaagctagacatgagaccaaaactgatgcagaggagagatagggacagtgagaagagtgtagaggaagagctgagcgaggtaggaaggacagtctgtacgtcactgttagtgggcccagggccacgtgaaagtcaggcattgttggcgccccattgaccgccggacttgtcagtgacgcggatcggcgacgtgaacgtgtctggcccgtgcgctccccccatgggctatatgggcccatggcctcttccgcgaaagcgtggctcctccgtcgacctgttgtgcacctctgtatctgattttttggaagctcaccgctggatcgctggcctctagcgccaactgagccgtggcccgtgagaaatggcgatcgcttatgtgctctcttgctcaaaagcaactggccgtgagatccttctcgtgtcctgttcgaccgagtagactttcactagatgatttt

SEQ ID NO: 13362 - DNA, 621 bp, Sorghum bicolor
  Clone ID: SORBI-28MAY03-CLUS26813_1
gcgaggatgcggccgcccccgcgggcggcgtggacaaggtggaggagaagctgaaggagatgtggcgaggatgggggcaaggatgcggcagcagccgcgaacggcgtggacaaggtggaggagaagctgaaggagatgagcacgggcggcgatcagcaggtggttcagggcgaggcggtggccgccaagaactgatgggagagggatgatgatcgatctcggccgccgccgtacgtgcacggtgcacctacctagctatagctacaccacccaccgggccggccggcggccatggccatttatttaaagttactatatactgtgtccaccgcattcattcgtccacagcaatcaccaccaccatacgcatcgtcagaggaactgaagaaaaaaaaaactcagaaattgaagaggaggagaagatctctactcatgtatccatcggagacgacgacgacgagcgagatgggagagctcgctcggtcgtctgatacatatgtgtcatccattctgaataatccacgcatgtaccgtacgtctgttatttaatttttcttttataaacttaattactgctgctgttgtttacctaaagaaagtagtagcatgcatatgctgtcc

SEQ ID NO: 13363 - DNA, 1468 bp, Sorghum bicolor
  Clone ID: SORBI-28MAY03-CLUS27156_1
gcacgaggagcggacggagtattttccagaatgaagtcctccccctcattgaagcttctggcgtgctttatacgatgcaagaaaccaagcatcgccttcatgctcaagagattgcacattcacttgatcttaggaagtatgatggcatcatttgtgttagtggagatggtgtgatggtagaggttgtcaatggtctcctgcaaagggaagactgggaaacagcaataaaagtgcccccggggatcattccagcaggtactggaaatggaatggcacggtctctactgcatgctgctggtgaaccattctctatatctaatgctgtgtttgcaatcatcagaggtcataaacgtgcacttgatgttacttctgttgtgcaaggaaagacaaggttctttagtgtcttaatgcttacatggggtctggtggctgatgttgatattgaatcagagaagtataggtggatgggaagtgctcgccttgacttttatctactactccgcgtgctgaacctgcgacggtacaatgggcgcatcctttttgttccagcaccaggatatgaagaagttggtgatcctgtggatcaaactaccggttccgaaacaaacgggtttagcacgggcattcaagaagacgtagcaactgacagtaatggtgaaacgcgtggctatgttggcccgtcggtcaaagaatccgatcttagatggagatcgctgaacggtccgttcgtttcagtctggctcggcaatgttcctttcgccagtgaagatgccatggcagcaccaaaagcagagtttgcggatggctacttggatgctgccataatcaaggattgcccacggcgggatgttgtcggccttttgttccagatgaaggacggcgcctacgtgaactcgccatgcgtggagtacttcaaggtgaaggcgatccggatcgagccgggcctgcgcgtgggcagcagcaccaagggtggtatcatcgactcggacggggaggtgcttgcgaggggcgatgatgggtcccactcccgcgccggcgacgagccggggcacctgatggcgtacggcccgcccatccagctgacggtggaccaggggctggccaccatcttctccccgagatgacgattcttctccctgttctccactacactactgtctgcgagtaatttccttcgtttgtagaatcatgtgcttctactgtatatgtaaatatactcacaccccactccagtggatgagcaatgagccgagagggacggatcctggatctccgtcgataaattgttttcttttcacggccccagcccacatggctgccgcttttagtgctggcgcgagaaatgagaagtgggcagttcataatctttttttttattgttggccgtgttgttgattgtcacttgtacaaacagttggactgttttcctgcaaacttgtgcttccatctaaaaagaccttgacactct

SEQ ID NO: 13364 - DNA, 1600 bp, Sorghum bicolor
  Clone ID: SORBI-28MAY03-CLUS27267_1
gcacgagggagtattccgatccaccaccgaaccatccagaagcagccgccctcctgctctaaaaaaagctctcgtctccggtcatcccttccgacccccccacaccacgaaacctcgcgcagatccaaacgaatccgagcccgtccaaaccctaagccccgcctccctctcccccctagcccaactccaccgcgcaccccatggcgaagtacggcgagggcgacaagcggtggatcgtggaggagcgcgccgacggcaccaacgtccacaactggcactgggcggagcgcgactgcctcgagtggtcccgcgcgcggctctcctccctgctcgcgggcctcaccgtcctcgacggcgagggcggcctcacgctccgcaccgtcgcgctcgacaagctcgacggcgaggcctacgtcaacatccgcaagggcaaggtcatcccggggtacgagctctcgctcaccctctcctgggaggccgaggccgccgccgccgcctcggagtccggagccgtgaaggtcgccggcgccgctgaggtcccctacctcgccgacgagaacgccgacgaggaccccgagctccgcgtcaccgtgcgcggcgacgagacgcccctcgcgcgccgcgccaaggacgccttcctcgcacgcggcaaacccatggtgctcgagaagatccgggagttcgtcgctgccatggccaagggtggaccggccaaggacgagctggagtccaagaaaactcccgcgaaggtcgcccctgcagcgcctggcgccgccccggcgaagaaggaggaggtggtggctcctgcgccggctgcggagaagaaaaaggccaaggggaaggacaaggaggggttcaagaccattgagatgacggagaagttctactgccgctcaaaggacatatatgagatcttgatggatgagaacaggtggaaagggtttacacagagcaatgcgaggatcagcagagaggttggaggggaatttagcctctttgatgggtccatcactggcatcaacgaggagctgcaggaagggaaactgattgcacagaagtggcggtttggaagctggccggacggcttgtactcctcggtaaggttgacgtttgatgagcctgagtctggagttacaatcataaagctcaaacaaaccgatgtgccagaggaagacaagtatgggaactcaactgtggtagagaacacggagagaggctggagagaactcatattccagcggatacgcggagtgtttggttttgggatctaaagaatctaaagaggcaacttggcatgaagttggatttcaaatttttatggggtcaggcctgaatgccatagcaatccaatgttttactcacccagtttttccatgtccttaaaacacaaaactctgcatatcatgggggtttaaaaacaactgttattcatcgcgttgtaacgatccttgctcccaatttctggtgttaaatgagtcaacgttgatctttgctgatgctggtggggttggtcctcttgttgcgtgattaaaaattggacattattgtgtcagtgcgaagcgttttagtggctatatatgttttcgtgcttttggacttc

SEQ ID NO: 13365 - DNA, 1440 bp, Sorghum bicolor
  Clone ID: SORBI-28MAY03-CLUS27438_1
tctcgagcttttccctcgctcccgtctccctgcgctcttcgccgccgccatggaggacgatgatgactgccctcctctcgccgtcgagctgccgccgcaggtgccgtcccctccggcgcaagctccctcggatgcctcgccagttggcgtcaccgtcatcactggctacctcggggccggcaagtcgacgttagtcaattacattttgaatgagcaacatgggaagagaattgccgtgatactaaatgagttcggggaggaaattggggttgagagggcgatgatcaacgaggggcaaggtggtgcacttgtcgaggaatgggtggaactggccaatggatgtgtctgttgctctgtaaaacacagtctggttcaagcacttgagcagcttgtgcaaagaaaggatagaatggatcatatattacttgagacaacaggattggccgatcctgctccacttgtttccgttctttggctagatgatcaattggagtcatcaattagactggattctattattacggttattgatgcaaaaaacttcagggttcagattgatgagcacaaaaactcttcctcattccctgaagcatttcatcaaattgcatttgcggatgttgtgatattgaacaaaattgacctagtggaagacaatcttgaggatttggaaaaacatattcatgatgtgaatgctctggttacagtggtgcggtctgtccgttgccaggttgacttgaatgaagtatttaaccggcaagcatatggtgtgaaggattcttccctgctgcaagaactgctcgactatagtaaatcagtgccacctagtcgccgtcatgataacaatatttccaccttgtgcatctatgagcaggagtctgttcacttggcgaaggtggagtcgtggcttgaagatcttctttgggaaaagggacctagcatggacatctatcgctgtaaagagtttttatatgtccctaattgggcatcagtgctctccatgctgcttgtagggtctgcttgtgctgtttttccgtatcggatttccttgcacactgatactcgcccgtgcttctgtgtggtccctcgccgcaagtgggtcctcaacgggcggcgagtctcctgttgtctcggcctccgctgattttctgcgtctgtgggccttcctcagtggggcttgcccctctctctgccaggtgtatggggtagccttacaggtcaactggtttcatggctgtattatcatgtcaagtgcttttccgacgcaccatggtaaaatttttctgcagagcttgtttcttcggttttgtcgaagaggcatctgtccaattacgggacgttctccggtgaagtattccagttttgcttgtatgatcagaaagacgatcacctttttttacatgaaatagaaactgcgatgcgttaggcgaattttgctcggtg

SEQ ID NO: 13366 - DNA, 2139 bp, Sorghum bicolor
  Clone ID: SORBI-28MAY03-CLUS2813_1
gcacgaggctcaacttaattttgctgcagctcaatctatgcaatccacgcagcacaagccccagcatggagaaacaaaatctgttgctggggattcatcctcgacacccattgctggagacaggcacggggagaaatcaacttctaccaagtatcccggtgattcacagcagcattcactgtccttcaccaggtcagaaagcaagaattatgtgcctcctttccttagtggcagcacaaacgaaagttcgtcccgcaccctgagccttattggaacagaatcttcaaatgcatttatgggaagcaaacccacaaattccaacacccctgcctctacaccagctgcagcttcgcccagcatttctcagcagcagcagcaacaccagcatttccttcagatgcaagtgcaacagaagcatcaacagcatcagcagctgattcagcaccaccatctgaatcggcccagatctgctgcaccaagtacgcaaaatagtgcaggtcggtacccagacggtctgaacatggcaagttttcagaatctgatgtacccatctagtgctgctcaagggggagttcaatccccccagttgaaggcatcctcagggagaggggcaccttcatctactgctacgactccccctgctgccccaccctctaatttgattgtgatgaagaacagtggtctccaccagcaacaagcaaaagttcctatgcaggctctctccactcctggtcaccaaccccagagttctttaagcatgagttcatcaaagatggggccttctgtgactaacctttctactggaggggatctatctcgatcttcgaatgcccctgttgcttctggttcaccatccaattcggtctccaaaagtactggaggcagcccacctgccacaggaaatgcaaagggtgttcagcagcctggccagttgccatcaccgcagcagcagtcagccaagaactctgcttcaacgtctggctccaagtccactgctacgaatcatttcagtatggctatgccatctatccttggccaacagcctaatgcatcacctggttctaatccggggagcaagcagcagtcacatatgccgccatcatcaatgaaacagccgccgttcctgcaaggccatttcttcatatccaacaactatgctcctcaggctccaggagcaggtggtgctgccgccctaggcctctacccgaagcgaccaggtgacaagacgcagcagcaggcaccacacacacagaatgccttggcagcggcaacccagtctgcaggtggcatgccacacacccacatgtccgcggcacaattgacttttggaacaatgccgatgcctttaaaaccctcaagtgaccagaagcctgctgctggaaaataaacagtccagacgaccatgcatcggagtggtaatctgcatcggcaagctaactgcttattcaggggaagcgcaaatggcagccacacctctccggttctttagaagagaagcaatcacagcaacagcggcagctcgaagaacccgcttggctgctgtggtgatcaggaaggaaggccgctgcgcaccagttccatcggagcagaagccttgctaacctaaaagagtattcggattttggaatggttgatgggagtgatacttttgtgtagtttggctggttgtcctcccatgggttaaaggccggaggaggtgcatagaatctgtctcttagcccgttttttatgcatggatggatgtccaaagctggtttctctgtctccatctttcatgtagctttgcttttttttttttttttggttctcagctttaactggaggaggaaagattcaattagaatgcagatcaggtaactttgttatgcagttggtgctcccattatacattgtctgtcgatacactgtgcttggattgttttagcagctaaaagaggagcaaaatatctatcccaagtagaataggatccagccatgattggggtggtggtgagcatggagtgacccgcttctgggtttgttgttgtaagtagctttgggggaaaggaaatgaatgaatgaaagtgcctaattatggatgctgttgaaaaaaaaaaaaaaactcaaaaaaaagaaaaaaaacaccacaaaaataaaaat

SEQ ID NO: 13367 - DNA, 1020 bp, Sorghum bicolor
  Clone ID: SORBI-28MAY03-CLUS2866_1
gcacgaggctcgtgacttctcttcccctcctcgtctcccgatcgattgcttcctccctccaccgacgcggaggggaagcgcagcccagatcgccggaggcgagcggcgacctctctccagctccgagaagccgcagcagggaggctcgtggaatcagtagccgtttctggcagtggcagcagggcgcaccatggaggggatgagctggagaacggcgtgctgtttatcggtgctctgcgccgtgctgctgctcttgcgcccggccgagggcatccgcttcgtgatcgacagggaagagtgcttctcgcataacgtggagtacgagggggacactgtccatgtctccttcgtcgtcatcaaggctgacaccccgtggcattacagcgaggaaggcgttgatcttgtggttaaggatcctaatggcggtcaagtccgtgattctcgagataagactagtgataagtttgagttcatagttcagaagagaggtgtccatcgcttctgcttcacgaataaatccccgtatcacgaaactatagactttgatgtgcatgttggccatttttcatatttcgagcagcatgccaaagatgagcattttgcaccacttttcgagcaaatagccaagttagacgaggcactttacaatattcagttcgaacagcactggctagaggcccaaactgaccgtcaagcaatattgaacgaaaacatgagcaggagggcagtacacaaggcactcttcgaatcagcggcactgatcgcagccagcgttatccaagtctatctcctgcgccggctcttcgagcgcaagctgggaacgtctagggtttaagactctgctagaagccaactcccccttgtggccaccatgatcataaccgatacacctgtaatcgaatggttgctagatcagctaatactgcttgtttgtggactttagttacatgtaatcttttgtgattccacagatgacaactcttcgagtttaaaccgtcaatttagccttcgttttgcctc

SEQ ID NO: 13368 - DNA, 886 bp, Sorghum bicolor
  Clone ID: SORBI-28MAY03-CLUS29602_1
gcacgaggagacaacactcatctgctggtagctagctagtaccgcagctgacgtacgtttccggcaaaatccaagaaaataaagcaccttggtgagctagcgagcgagctagtagtttgacgacgacaatggcgtccggtcaggagagcaggaaggagctggaccgcaaggcacgcgagggcgagaccgtcgtccccggcggaaccggcggcaagagcgtcgaggcccaggagcacctcgccgaagggcgcagccgcggggggcagactcgcagggagcagctggggcatgaggggtacagcgagatggggaagaagggcggtctgagcagcacggaggagtccggcggcgagcgcgccgccagggagggtgtcgacatcgacgagtccaagtttaggaccaacaagcagtcctagacgcgtgcgtccctatacgcactacgtacgcagcgctcgtatctgtctgtcagtgtaccttgtggctgtcgtagctagtactgtctatttggagaagtagcagaataataataatgtagggtgcctcagcatgcgtgtaggcgatcatgcatacgtacatgtacgtgtgtatgatcatgtgcgtgcttcgagaagggttcagttagttcctaatcatgtcagtcgtcaaagttcagttagctcctataatcatgtcagtcgtacgtcaggggaaggttcgcttcatcaggctttgtagtttgctagcctgtttgtttctatgcatgcgcgcgtgtccgcctctcgacaagtggccggttgagcatgcatgcatagtcctctgttaaggacgctttgtatccatgtttccatggctcctaaataatcagtaatgtaaagctagtttggcggttccctcgtcatttctgcgg

SEQ ID NO: 13369 - DNA, 765 bp, Sorghum bicolor
  Clone ID: SORBI-28MAY03-CLUS41780_1
cagtaaaggagaaaattccaagtgagaatgcccccacaaatgctgctccagtacttgctatgaggcgcaagaagaatgttcatgaagatgtgaagcccttggctgtcacaaacttaaatgcctttgaaatcatatctttctccacaggatttgacctctctggtctatttatcaaaaaggagtgcaaaaaggagacaagattcacttctgataagcctgctgctgccattatctcgaagcttgaagatgttgcaaaaatactgaatctcaggataaggaagatggataatggtgttgtcaagattcaagggaggaaggagggaaggaatggtgtccttcagtttgacgcagaaatatttgagatcacggcatcctaccatctcattgagatgaaacaaacaggcggtgattcacttgagtaccagaaactgttggaagagaacatccggccagcactgaaggacatagtctgggcctggcatggagatgatcaacagcaaaagtagtagtacctttggatgtctcagttttgttcctaaaatttgttagattttttagctcggagtgattctgttcgacatgtgtatgttcttttttagtaattgcattctttctctttctgtgaaccattctgttgcgcgataattgttgagaggctgagttgtccagtcgttccattctgaaaactgtttctgtcctgtaatgtgtaatggttgtccctatcaataatgaaataattgcatttgatcctttaaaaagggttgg

SEQ ID NO: 13370 - DNA, 652 bp, Sorghum bicolor
  Clone ID: SORBI-28MAY03-CLUS4074_1
caccacgcaaacgagctcgcacggaggcgtccgggccgcggacggacagatgcgaatcgcccccatccatttctcaccagaagcgaagccggagcccggaggcggaggagcggaggaggaaggcgatctcgagcaagccggaggcggagaagatgaagacgttcgacccgtggcctgtcttcttccgccgggagtggaggcgcaactggcccttcctcacggggttcgccatcaccggcttcctcatcaccaagatgacggccaacttcaccgaggaggacctcaagaactccaagttcgtccaggagcacaagaggcactgacgaaccaggtgaaggagttgtgccagaattcagaaatgcctgtttggccagccaattctgttatgcttttgaatgaaaagaaatagacccctctttttcgtttttcttaatcgaaatgcttgcactctatgttccactttttatgtaataagatgcaaatgatttgaaccaacagcaatcagcttctgattttgaaatatagatgagccccctctgtttcgttttttaactctaaaaatgcgtgaactctatgctccatttgtaatgtaataagaggcaactgaattgattcaacagcaatcagcttctgattaagatacataaagttt

SEQ ID NO: 13371 - DNA, 524 bp, Sorghum bicolor
  Clone ID: LIB5047-003-R1-XP1-B7
gccggccgggcttgccgaaggagattcccattcgcccctcattatctcaccagaagcgaagccggaggcggaggagggaggaaggagatcgcgagcagccggagccggagccggagccggaggccgagaagatgaagacgttcgacccgtggccggtcttcttccgccgggagtggaggcgcaactggcccttcctcacggggttcgccatcaccggattcctcatcaccaagatgacggccaacttcaccgaggaggacctcaagaactccaagttcgtccaggagcacaagaggcactgaccgaccaggtgaaggagttgtccgaatttcctgtggacagccagttatgttatgccgtttgaatgaaaaattagccccctctttttcgttttttaaatctaaaaatgcgtgcactctatgctccatttgtaatgtaataagaggcaactgaattgattcaacagcaatcagcttctgattaagatacataaagtctaaaaaaaaaaaaaaaaaaggccccta

SEQ ID NO: 13372 - DNA, 943 bp, Sorghum bicolor
  Clone ID: SORBI-28MAY03-CLUS42255_1
gcacgagggtggatgctgctgggtcatcacgagctggatttacacctcatgttattacagttcaagctggggaggatgtgtcatcaaagattatgtcattttctcagcatggaacgcgtgcaatttgtgttctttcagcaaatggtgccatatcaaatgtgacgcttcgtcacactgctacatcaggtggaactgtaacatacgagggtcgatttgagatactatcactgtcaggctcattcctcctggtggagaatggtggtcagcgtagtcgaactggaggactcagtgtgtccctggctggtcctgatggtcgtctgttgggtggtggagttgcgggacttctcatagcagcttcaccagttcagatagtactgggaagcttcaattctggaggcaaaaaagagtcaaaaaagcatgctccttcagaacccacatcagtgccactgaaggtcgctccgaccaccgggatgggacccaacagccctccttcaagaggtacattgagcgagtcatctggtggcgctggaagcccaccaccactgcatcaaggcatggctgctagcaataataaccaaccgccgttcctgtctagcatgccttggaaatgagtttgcatcctcttgaccaattccaggcatataccattatgagcgaactgcctcccggtcaggaatgcaggatgtagcaatttgcggttcagtagcgctcgttctctgagtagctcttatgtagtataaatcagaagcttgagtaggaagagaattgcatctggtaaatttgtagctcctattgtaggtttcaccctgaattcctgtgctaggtgtattgagctgtaaccatgtgatcctttgagcgttatcaaatgttatttagttaaatgttctaccaaggcatgtggatttgaatcagaagtttcttatatgaatttgttgtttgcgcc

SEQ ID NO: 13373 - DNA, 689 bp, Sorghum bicolor
  Clone ID: SORBI-28MAY03-CLUS30755_1
gctcgcggctgatattgattcaatcaagcaccctgaaccagttgctgacagtgctgtatcagagtatccaatgggtgaacaaaatcctgagaaatgaaatggatttgagggcagcagagtttcagtcacgtgatggtggatggcatatgatgatggacgtgcaggaagcacttggaactggtcggaccattattgtacaaacggtttgaggatcatatgtgggttttctgttctacattgttggaggaaggtggtcccggaccatgcatttgatggagcctcaaagattcaacttgtctcatgaagatgcttaggtttgatctgtaacataatttaatggtggtttattgctatgtgcctgtagccgtgtaatctgtgggctatatcgagacgcaaaattcagaaagtagtcttccttctcaaagtagtcttccttctcctttcttcaaccacatagtggggttctggttgtgtcaccctggtaaataactgataggtgaataggtgatatctggtctggctacatgtccattgctgtagttggtgctatttgtacgaaaattttggctcaaaatgcagtcagttgattgttgtcatatttagaacttgtttcaaatttgtgtaaactgtaaactaaagaatatagcttctatttgtcccaggtacttggtgcttataattcatatgtt

SEQ ID NO: 13374 - DNA, 754 bp, Sorghum bicolor
  Clone ID: SORBI-28MAY03-CLUS30380_1
gcacgaggccaccacccaatctgaaatacagcaactcgcagtcgatcgagacatgaagcactcgagcagcttgtgtttgctcttcctactggagcacaaccgcacaacaccaccacccaatctgaaatacagcaactcgcagtcgatcgagacatgaagcactcgagcagcttgtgtttgctcttcctcgtggcgctctgcatcagcctggcctgcggcctggttcaggcacaggtcctcttccaggggtttaactgggagtcgtgcaagcagcctggaggctggtacaacaggctcaaggcccaggtcgacgacatcgccaacgccggcgtcacgcacgtctggctgcctccaccctcgcactccgtctcgccacaagggtacatgccggggcgcctatacgacctggacgcgtccaagtacggcacggcggcggagctcaggtccctgatcgcggcgttccacggcaggcgcatccagtgcgtggcggacatcgtcatcaaccaccggtgcgcggagaagaaagacgcgcgcggcatctactgcatcttcgagggcgggacgggcgacggccgcctggactggggccccggcatgatctgcagcgacgacacggagtactcggacgggacgggccaccgcgacacgggcgaggcgttcgcggcggcgcccgacgtcgaccacctcaacgagcgcgtccggcgggagctctccgcgtggctcaactggctcaagtccgacgacgtcggcttcg

SEQ ID NO: 13375 - DNA, 1263 bp, Sorghum bicolor
  Clone ID: SORBI-28MAY03-CLUS33223_1
gtgcaacagcaacttcttcaagaagataggagaagggaattacactgaggtttaagaatggcgagtgcacaggcaatggggcaaggagaacaagatcacttcgttctgaagagcggacacaccattccagctgttggtctaggcacttggagggctggctcagataccgctcactctgttcagacagccatcaccgaggctggatataggcatgtggatacagctgctcaatacggagtagaaaaagaggtcggtaaaggacttaaagctgcaatggagggtgggatcaataggaaagatttgtttgtaacgtcgaagttatggtgcacagagttggctcctgataaggttcggccagcacttcagaaaacactcaaggatttacagctggattacctggatctctaccttatccattggcccttcagactaaaagatggggcgcacatgcccccggaagctggggaagtgctggaattcgacatggaaagagtgtggagggaaatggaaagccttgtgaaagatgggctagttaaggatataggtgtttgcaattacacagttaccaagctcaaccgtctgatgcggtcagcaaatgttccaccagcagtatgccagatggaaatgcaccctggttggaagaatgacaagatttttgaggcctgcaaaaagcatgggattcatgttacagcttactctccactgggttcttcagagaagaacctagcacacgaccccgttgtcgaaaaggtagccaacaaactgaacaagaccccagggcaggtgctcatcaagtgggccctccaaagagggacaagcgttattcccaaatcgaccaaggacgaaagaatcaaagagaacatccaggtgtttggatgggagatccctgaggaggacttcacggtcttgtgcagcatcaaagatgagaagcgcgtgctgaccggagaggagctcttcgtgaacaagacccacgggccgtacaagagcgcatctgaggtctgggaccacgaggactgagctccgctgccgctgccgctgccgtgctgccggatgcctccacctgatgaacccaaaaataaaaggatcccgacgccgatgcgcaacagcgcaaagcagcactcacccctctgtctgtcacctcgcgtgcttttgtgaaaagcagcagcctcgcacaagaaagatgcagaagagttgtgcaacaaccctcctgtactgtaccataaactgaaataaggaaaaaaaaaagcggtgcagtttgccgtg

SEQ ID NO: 13376 - DNA, 886 bp, Sorghum bicolor
  unsure (1)..(886): unsure at all n locations
  Clone ID: SORBI-28MAY03-CLUS33337_1
gcacgaggcgcgcgccaagccaacaaggatttccgtgcgtctccaggaggcatctcgatcgccaggtatagctagctacttgcaagaggctggaagagtagttaccgcaatggcgcagccacagccaagaagaggagacgaagggctccaggcgcaggggggcaacggcaaggccccggcggcgcagcaggatcccatcaaatatggcgacgcgttccctgtcaagggcgagctggcggggcagcccatcgcgccgcgcgacgccgcggccatgcgctccgccgaggacagcgtgccgggcgtccaggtcccgcaggagagcggcggtgggttcagcgccggggccttcatggagtccgccgccgcgtacaaccaggccgtcggtgccgtcggcccgggacaggcgagtgccgccgttgccaagcacggcgtcaacgtcacccaggacgccgtgcccggtggccgcatcgtcaccgagttcgtggcaggccaggtggtaggccagtacgccgtcgctgaagcagcgccgccctcgccgcagcagcaggagcaggatggggcgggtcacaaggccgccggaaacgaaggtggtgcaggacacggcgacggaggagcgcccggtgggcgcgccggtgccacggcggcgaggcgggactaagatggataggccgaggcttcaattttatcatcgtgttcctctggtcttgtatatataacatgttcctgtgaatgagctctcgcgctactatgctatatatgcaggcagcagaccttgtgtacggtggtttttggttatgtatgtgaaactgcgtactatagtagaataagaatgacgagtcatgtatccatccaaatnccaagcaagcgaatggcaatcagcagttct

SEQ ID NO: 13377 - DNA, 1823 bp, Sorghum bicolor
  Clone ID: SORBI-28MAY03-CLUS33649_1
gcccgcgccccccccccgccgcgagcactcctctcccccaatggcgacggcacccgcacccctctcgctccccgcccgccacgctccctttccctccccctcccccgccaccccgcaatggccggcctcctcaacctccagtcgacgcttctcccctcggcgtccgcgctgcgccgccgcgcgggcgcgccggggccgtcctcgtcccgccgccgatgccgtgtcgaggccaagatccgggagatcttcatgccggcgctcagctccaccatgaccgagggcaagatcgtctcctggaccgccgccgagggcgaccgactcgccaagggcgaccccgtcgtcgtcgtcgagtccgacaaggccgacatggacgtcgagaccttccacgacggcttcctcgccgccgtcctcgtccccgccggcgagtccgcgcccgtcggctccgccatcgcgctcctcgccgagtccgaggaggagatcccggtcgcccagtcgcaggccgcctccttctcctccagctccccctcgccgccgcctccgcaagaaactgctgctcaagaagagtcccttccgccgccgccacctcctaccccaccgccggtggcagtctctgctcccgcgccgccttcgccagcagcacaaggcggggggcgcgttgttgcttcgccctacgccaagaagctcgccaaggacctcggcgttgatcttttctccgtcacggggtcaggccccggcgggcgaattgtggccaaggatgtcgagtctgcgcttgctgcgcccaagaaggccgtaccagcgactgctgcacggccggatgtgccattgggagcgccgggaccattcacgacaatgcagggtgctgtcagcaagaacatggtggagagccttgccgtcccgacattcagggtcgggtacaccatcacgactgatgctcttgatcagctctacaaaaaaattaagtcaaagggggttacaatgtcagcactattggctaaggcgacggcaatggctctggttcagcatcctgtagtcaactccagctgcagggatgggaagagcttcacatacaacagtagtatcaacattgctgtggcagtggccatagatggtgggttgattacaccggttcttcaagatgctgataagcttgacatttattcattgtcaaggaaatggaaggagttggttgataaggcacgagcaaagcagttgcagcctcatgagtacaactctggcacgtttactctttcgaatcttggtatgtttggagttgataggtttgatgcaatactgccacctggaactggagcaatcatggccgttggggcatcagaaccgaccattgttggtacaaaagatggtagaattgggatcaagaaccaaatgcaggtaaatgttaccgctgatcatcggattatttatggagctgaccttgctgcttttctgcaaacacttgccaagataattgaggatcccaaggatcttacattttaaatgtgccaagtgattgtctttccttaaggcgatcacaatcgggtgtttctcacccatcagtagatgtgtagtatgtcttctggtaatgtgaattagttgatttaagctgtcaccaatgtcagcatcaggtaactttccctcgctggttacctgatcatcattggtttcttcaataaattctttttttttatctttcttaattcaaataggtgtgtaaggatgggtatatctaccattttaccagagttttcatggatagtcgattttgttgagcacatcaatttaccgtgacctgagatacaaagaatgaaatgtaccttgtaccaccc

SEQ ID NO: 13378 - DNA, 2234 bp, Sorghum bicolor
  Clone ID: SORBI-28MAY03-CLUS34293_1
gcacgagggtgaaataaacacagaaaatccactaggccttcagggtgaacttgcgatagcatttggagagctacttagaaaactctggtcatctggtcgaacttctgttgctccacgtgcatttaaatcaaaactttctcgttttgctccacagttcagtggatataatcagcatgattctcaggagctacttgcgttcttgttggatggtctgcatgaagatctgaaccgtgtaaaaaagaaaccatatattgaggcaaaggatgctgatggccgtccagatgatgaatttgctgaagaatgctggaattaccataaagctcgaaatgactccataattgtagataggtttcaaggtcaatacaagtccacattggtgtgcccagtttgtaacaaaatctcagttacctttgacccatttatgtatttgtcgctgccattaccgtcaacagttactcggatgattactgtaactgtattcagtggtactggagatgttcttccaatgccttacactgtgactgtacaaaaaaatggaaactgccgagatcttactaaagcccttgctgatgtttgctgcttaaaagattctgagacattgttgcttgcagaggtatatgagcgtcggatctaccgttacctaacaaatccaattgagggacttcatagtataaaagatgaagatatacttgttgcatataggctccctgttggttatgaaaaacttttgaggttggagatcctgcatcggagggcagacagatttcttgtggagcctcagtttaatatcaacaggaagctcattgggtgccccattgtgacttgtattccaaatggttctactggaaaatctgatatttatgcggctgtatctgctgttttggttccatttgtacgagcaaaagcacatagccctgatgtgtctgctgtcaagttaaatggcaatgggccaagcctggatggtattgtactgacggataatggcaccaccagtgaggagggtctctctatatcaagatcaagtgaggatgataatgcagctgtcgatgagcttttaccgttccagctttcattgactgatgaaaaaggaagtataagaaatgctatagacacggattctaatcgtggtttaggactagttattagggttttgatggattggtctgagaaagagcatgggatgtacaatattgattacatggatggacttcctgaagtcttcaagcctggttttatgtcaaagaagacccggcaagaagcagtcaatttattttcatgcttggatgcttttctgaaggaggaacccctagggcctgacgacatgtggtactgtcctgggtgcaaggaacacaggcaagctagcaagaaactggacttgtggaggttacctgagatattagtagttcatttgaaaaggttctcatacagccggtatatgaagaacaagcttgatacatttgtgaattttccaatccatgacctcaatatgagcaagtatgtgaagctgacatcaagaggtgaccagcaccccatgtatgaactctatgcagtaataaatcattacggtggtcttggtggtggacactattctgcatatgcaaagctagtagaagagaacaactggtatcattttgatgatagtcatgtttcctctgttaatgaggatgagatcaggacgtctgcagcatatgtgcttttctaccgacgagttggaggttcaagtacggtggcaaatggtggtgcagtcgacattgaaatggttgattcgatagagatgtagttaagcctatgagtatatcatgtggaccgagatatggagctcagaagagttcttctggaatttgcatgtctgctctgggacggaatattcgtgtatcgagccactgatattttgatgcatggcagagaagtgtggtcgaattagcaatgttagcatatggatatgcatttcatatgactcagagttccagatattctgtgaccaacccttttgagtagaactgatcccgacaggtaattgagaaaatgacctgatttgaaaattttgctgataggcagatgcagctcttggggtctacaattttaattggtgtggaaggtctgtgctgtagccaagggattgcaactggaaaaaatgatgtaacaatgctgcatattctttttgcctaagctacagctgtgctacagcagttttgattactgttgccttttgttataaaattctcttatcatca

SEQ ID NO: 13379 - DNA, 1278 bp, Sorghum bicolor
  Clone ID: SORBI-28MAY03-CLUS35042_1
gcccgagcgcgccccctcgtccccgcccttcgcgcccgctccccaaccatgcacatgcccccccccggcacgtggttcctcgccttcccgcccccgaccaactccagccagcccgtcctctcctacaccctggccccccgccccaagcagaggacctccgccaggacgctcccctaggcacctcgtcgccgccggacctctggcacactcccgcccacccaaatgccatcaatccgtcgtccgccacacacgcagggcgcacccaatgatggcgtcgtcagagagctgctccacgacatagacctggacgcgagcccccccctgccccgtgccgagctccacgctctcatcatcggtatcaactttgaggaggttgaatttgacaggacagatgcggttgacaaggtcatggctgacttcgatacgtcccgcaacgatatcgttgaggaggaggagtttgtgcaggggatgaagaaatggctcaacgagttcaagcgcaacatgcccgcgggtggcgccttctccagcaagttcaatgaataccacgagaggacacggcaggagcacgaccagctgattgacaggtccgatgaggcggtggagagcgtggagaaccctgggtggtgcatcaccaaggctgtggcactgctgctactgggtgctgccatcgcggccgcgttcgcagacccgctcgtggacgctgttcacaacttctccaacgccacacacatcccgtccttcttcatctcgttcatcgccctcccgcttgcgaccaactccagcgaggccgtctccgccatcatcttcgccagcaggaagaagcagaggacctgctccctgaccttctccgaggtgtatggcggggtgacgatgaacaacacgctgtgcctcggtgtgttcctggcgctcatctacttcaggaacctgacgtgggacttctcatcggaggtgctcatcatcctgctggtctgcgtcgtcatggccctcttcaccagcttccggacgacgttcccgctctggacctgcctcgtcgcctacatgctctatccgttctcgctggtcatcgtctacatcctcgactatgtctttggctggtcataggctcctcgagtgaacacgacctgattggaacacctggtttttaacagccgccggtgtttctgtttgaccttcttgtaattttgactcctgtgaagctatctgtccagactttctcatgtgatgtaatcatgttctacttgttctgtttccttgagtatccaaagcacgtacttcgtc

SEQ ID NO: 13380 - DNA, 1898 bp, Sorghum bicolor
  Clone ID: SORBI-28MAY03-CLUS4611_1
gtgtcaaagcctccgaggcgcggcggccacgacgcggtcgccctcacgcgcaccgaccgcgcacacaagtgacacgcccgcctcctcccaccagaaacccgcgaatcaaccccgaatcccgatcggccggcggcgcgggaggcgatgccggagaaggcggtggacgacgtcatggaggccgcggtgggggcccacttcagcggcctccgcctcgaggcgctgcgcctctccacctccgccccctcttccccttcctcctcccccgccgccgcggcgcacgcgcactccaacggcgccgtctacgcaaacggcaccgccgagctcccctcccctgccgctgcccggcagccgttcgtcatcggggtttctggagggacggcgtcggggaagacgacggtgtgcgacatgattatccagcagctgcacgaccaccctgtcgcattcgttaaccaggaacttttggtgtgcatgggaactgtgaaagagggacagtccgtgaatattcctatatatgattttaagaatcacaggcgatgctctgaaaaatttaggaaggtcaatgaatcagatgtcatcattttggaggggatcttggtttttcatgatcagagggttcgtgatttgatggacatgaaaatttttgttgacacagatgctgatattagacttgctagacgtataaggcgtgatactgttgaaagaggtagagatgttacctcagtgcttgagcagtatgttagatttgtcaagcctgcatttgatgcttttgtcctgccttcgaagaaatatgctgatgtgatcataccaaaagggggagataaccatgttgcaattgatctaattgtgcaacatatccacacaaaacttggtcagcataacctgtgcaaagtctacccaaatgtctttgtcgtacacacaactttccagatacgaggaatgcatactctcattcgtgacaagaacattactacacctgactttgttttctactcagataggctgattcgtctggtggttgagcatggtcttgggcatttgccatttacagagaagcaggtggttacaccaacgggatctgtttacatgggagttgacttctgcaagaagctctgtggagtgtctattgttcgaagtggcgaaagcatggaaaatgcactgcgtgcttgttgtaaggggataaaaataggcaaaattctatttcatcgcattggagataatggacaacaactcatataccataagctgcccgtggatattgctgaacgtcatgttttgcttttggaccctgtgcttggtacaggcaattcagctaatcaagccattgagcttcttatgaggaaaggagttcctgagcagcggatcatttttctgactctcatctcggcccctgaaggcatccattgtgtgtgcaagcgcttccctgatttgaagattgtaacctcagagattgatagcggattgaacgatgaatatcgtgtcatcccaggacttggagagtatggtgatcgatacttcggcacagactaaccgattactgaggctggtgtagttagcagtgtaaaaagacacacaagttagagctgacattaccgtggcagagatatactggtgtttggttggttatggtatactggaagcaaacgtggataggtttctggtaggtgctgaaaccgtgtggtctgtccattatcatatgattcggtacacaaaccgttgtttccgttggttgtgaaacacattgggttttgcattttgaggctcctagctgaagggcctcctcctcgtcacatatactgttatacagaggcctgtgaaatgtatgactaaaccctgtttcccggcatcaaacagttgccgtgcgatctcggctgtgattggaatgaaattcaaaggttggg

SEQ ID NO: 13381 - DNA, 1313 bp, Sorghum bicolor
  Clone ID: SORBI-28MAY03-CLUS4789_1
gccggccgggttcgggaagtccggggagccgcgtctttcttccggttccagcacagcgcggcatcagccgcatatctcctcctcctgtcgcccgccgccgccccccctgtccgcttcagtccgacgccgaacaaggggagggacaagtccgtgcggtgtgcgccatgtttaagaagttctcttcagaagatatatctggacagaatcaagttaaggcctctgtacaacgaaagattcggcaaagtatcgctgatgagtaccccagccttgaacctttgctagatgacttgctcccaaagaagtcacctatgattgttgttaaatgccaaaatcatctgaatcttgtagtggtgaataatgtccctctatttttcaacatccgtgatggtccttacatgccaaccctgcgtcttcttcatcagtatcctaatatcatgaaaaagttccaagtggatagaggcgctatcaaattcgttctatctggtgcaaacataatgtgtcctgggttgacatcacctggtggtgccttggatgatgaagttgaggaggaaaccccagtggctataatggctgaaggcaaacaacacgcactggcaattggttatacaaagatgtcagcaaaagacataaggaccatcaacaaaggaattggcgttgacaatatgcactatctaaatgatggcttgtggaagatggaacggctcgaatgagaagaatcctgaggggctcataacttgcggcagacggtattgatgagatatataaaaaaaccagcaggactatctgcacagatggtgtcgtttaaaaagatgaagtactaagaagctttatttaccggagacaagttgagtttactccgatcctttggtgttggaatgcatgtcagaagcaggattatgaatgctgtgttcagcgctttagattggcagtgtgttggtgcgcttttcacaagttgtagcattttcagcaaaacaatttaccctcaaatggaagcaagggaggaaatctataacgacccgcaagtaatttgatcttacagtttgttttgggtttcaatctcctccacggaagtcgggtacgacctggcttacctctttcgctctcatcagaattcggcacgaggacagaaagactgcgctggcgtgattaggattcctgctgtgaaggccatgtggacgaggatactattcatccttcctcccacatctgatacatgtggcatggtaggaatcccccctgttccagctgacactatgattgttgtaactttgcccaaggaaacaaccatcgaagcatcatgacagttgtgtgct

SEQ ID NO: 13382 - DNA, 1240 bp, Sorghum bicolor
  Clone ID: SORBI-28MAY03-CLUS36802_1
aagcaccccccgccactttcttccttccttcctctctgctgtgtgcttgtgtgtccaagaaaccatcaccccggaaccgaccatggccaccgccgacatccgccgctccatcgcaggccagacacgcttcgccctccgcctcaccgccgcgctctcttcgaccgccgccgcggctcccgccagaaacaccgccttctccccgctctccctccacgtcgtgctcagcctcctcgccgccggcgcgggccatgccacgcgcgatcagctgctcaccgcactcggaggaggcgatgggccggtcgcagctgagatcctgcacgcgctttccgagcaggtggtgcagctcgtgctcgccgacgggtccggagtcggcggtccgcgggtcgcctttgccgatgctgttttcgtcgatgcgtcgctgaagctgaagtcggccttcgaggaggtcgccgtcggaaagtacaaggccgagacgcactctgtcgacttccaggaaaaggctgcacaagttgctggtgaagtgaactcctgggtagagaaagtgacctcaggtctaatcaaagagctgctgccaccaggatctgttgatcagaccaccaggctggtgctcggcaatgcactctatttcaaaggagcttggactgaaaagttcaatgtggctgaaaaactgagctctgagcctgagttcatggaggagcatatcccgacgaggaaggttccggttgggcagttcaaagtccccaagttcaaggtttcctttgggttcgaagcatccgatctgctaaaaggattggggcttgagctaccatttagctcgcaagcagatctgtcagagttggttcatttgccagcaggacagaacctgtgtgtttcatccattttccacaagtcgtttgtcgaagttaacgaggaaggaacggaggccgccgccgcatctgctgcagtggttatgctctgttcattcaggatgcccacggatttcgtcgcggatcaccctttcctgttcctgattcgtgaagacacaactggtgtgctgctgttcgttggtcatgtggtgaatcccctgcttgctccatagaccatagttctgaactgctgacgctgcgatcccatcccttgcatgctgactacaatatagcgacatttggtcgtgtgtatgcataaataagtggcttgatcgatgtatgtcaggttgtgcgatgatacactgcaataatcaatatacatggtgcctgttact

SEQ ID NO: 13383 - DNA, 1212 bp, Sorghum bicolor
  Clone ID: SORBI-28MAY03-CLUS37138_1
gcacgagggttactttgccattagcccgcacggccgcacccccttcgtatttctctagctccactcctgctcacggcggcggtggcgtcgtcggcggagggcgggtcgtcggcggaggcggagatggcgtccgtggccgcggcagagggcgcggcggcggcgctccgctcggttctgtcgcgcgcgcagcaggcggcggcgcgggcggggcgcgctccggggtccgtgcgcgtggtggcggtgagcaagaccaagccggtccccgtcatccggggcgtctacgacgcgggccaccgctgcttcggcgagaactacgtccaggagctcatcgacaaggcgcctcagcttcctgaggatattgagtggcacttcattgggaatctgcaaagcaacaaagccagggccctacttgctggagtgccaaaccttgatatggttgagagtgtcgatcgtgggaagattgctagccgtcttgatcgagtggtagctgacttggggagaaaaccccttaaggttttggtccaagtcaacactagtggagaagaatcgaaatttggagtagatccatcaggatgtgttgaactagcaaagcatgtcaaattgaactgcccaaaccttgtgttctctggtttgatgacaattgggatgcttgattactcatcgactcctgagaatttcaagacactggccaactgccgtgaaggggtgtgcaaggagcttggaatacccgaagagcagtgcgaattgtctatgggcatgtcagctgacttcgaacaagcgattgaaatgggaagcacgaatgtaagagttgggtcaaccatatttggtgcaagagaatacccaaagaaaaactagagtgcttatacattcctgtcgcgatggcacagaacatgtaggagtctgcaactgttccaaatttgatgatgcatcatatatgtgcagttgtgcgcccattctactcagctgaaaacattttgacaactttttggctgaagtattaataaggatgctgttgtgccattgtctgcttctgttaataaaagcatgcagaccacataagcatcgattgtattttgacaacgactgagtggttcctcattagcctttcattacttgcagatttagctgtgtacttggagtgtacactgtctgcagattttgttcaacagttaccgtcatacccagttgattcagaaagtgtacaagcgactc

SEQ ID NO: 13384 - DNA, 1119 bp, Sorghum bicolor
  Clone ID: SORBI-28MAY03-CLUS39035_1
gcacgaggccatcatctatctaccccctccacccccaagcagaaggcggcgctggcgaagcagctgaacctgaagccacgtcaggttgaggtctggttccagaaccgcagagccaggacgaagctgaagcagacggaggtggactgcgagttcctgaagcgctgctgcgagacgctgacggaggagaaccggcggctgcagcgggaggtggcggagctgcgcgcgctcaagctcgtggcgccgcaccactacgcgcggatgccgccgccaaccacgctcaccatgtgcccctcctgcgagcgcctcgcctccgcgcccgccgacgaggcggtggcgggccgtaccgccgcgcccacagggccctggggccctctccccgtgcggccagtgttcgtcgacggcccggcccggaggtcatgatcgatcgacagacaatggaatgagatggacgcgcttgctaattgctactgctagccaagtagctagtgctaattagggttggatctctcttttttttttgccctttttattatacctgcagcttagtttaggtttttattattagtcctatataatctttgctgttttcgcactgttttgtttgctgaaaatagataacgatatgatgtcttgtgtcttgtattcataagtcataataactcataaatgatagatgccatggtcttactactttgcaatttgcatctacatgcacacgcccccccccaccaccctcaccatgtgcccctcctgcgagcgcgtctcctcctccaacgcgtccaacgccaactccgccgccgctgaccgcaaggcgggcgccggcgtcgccgacggtggcgccatcgtctgccaccgcccgatcgccgtccggccgcagcagtcatgactccatgacccagccgatctcgatcgaggcactagtacgtagtagtagctgctacactagctatagctagctagctgttcacccggccgtccgtacgtacgtgtaagccaacaaaacagtacgtctgctctgccgcatttattcgatcgtgcaaacgactgtttcctcgttaatctctcttgtctctgtagtaacaaccctctgttatgacgactcagagcccaggtattatt

SEQ ID NO: 13385 - DNA, 1847 bp, Sorghum bicolor
  Clone ID: SORBI-28MAY03-CLUS3635_1
tcacttgtcttgctgtcccctgccgcgctacctgctttggtttcttagtagtttctaaaaacctctcccgacatccttccgacacatccgatgtgacacccaaaaaattttcgttcccaatctaaacaggcccttatttcaaattctagcaaagatggggcggcatactctaattattacatcaacacagttgcctgaaagtcctccgcctacgttctggagagttgcttaaacatcctcctcaagacagactggattgataggcctgccacccttgggatgcgatactgcctcgcggtctctgcagggttactcgcctttataatccctcttccgactataattatatcactgcctctatcgtttatgacagaaaagggagtgttatattgttgcccaaggccatctcctccagcagccatctgaactccaggagtggcatggataaacgctgggctcgacggtgctggtgaccaagatgcaggatttactgatataaatcctattacaaagtcaggatgttgctcagcgatctttacagccgctgcggtgtgctctcctccagcctgtcatccagctgccctactccaagtacagatacttagaaagtactatggtagtgttgatcaagttacatgtgaaggaaggctagggcttcaaaacttaaattggtgtgcacctttttgaactttttagaatttggatctttggcccttgtatgattcaattcttatgtttgtacatctacatacaggtgcaacaacgttctatatcttcatggcgttccagaggatgcgaagtgaaaagatgtgagatccatgttagattgaacacattcagtcttttatttttgtgctatatatattcttattttatagaaacctattgtctttttaactttttccgtgacgttagcatgggcataccactagtagtagtatggtgggagtggagagtataaacaacttggcacagaatagttcaataatttgccttcatctcaagactccaggcttacgaacatcccacttacatctccatcacgggtacatgcacacacagcgcctccgcccaattacagtttggatcttattaaattattatatagactcatactaacctgattactactagtgattatgtagagcctagactagaggcgccttgttgttcaaaggaaattattattcttaggccctgtttagttccccacccaaaaatttttcatccatcccatcgaatctttggacacatgcatggaacattaaatgtagataaaaaaataaactaattacacagtttagttgagaatcgcgagacgaatcttttaagcctagttactccatgattagccttaagtgctacagtaacccacatatgctaatgacagattaattatgcttaataaatttgtcttgcagtttcctgacgagctatgtaatttatttttttattagtttctaaaaatccctcccgacatccttcccacacattcgatgtgacacccaaaaaattttcagccccaatctaaacaggccaagcatgctgatcgtcgtcatggcgctccgccggcggcgtcagcgtcagcagcagcaggcggtttacacgcgtagatttttgtgcatgttcggccagtgtatggctggccacgaggcacggaaggcgtgccgccggggatcaaggctccatagctcccctcccctagccctctccctgcggccacgtggacaacgtccatggtagagacgacgaggaacgccatcaggaacaccatgcaaagctgctgcctccccatcttctcgatctcttcctgatcgatttcctctgctacaacttgtcgctcgtgc

SEQ ID NO: 13386 - DNA, 796 bp, Sorghum bicolor
  Clone ID: SORBI-28MAY03-CLUS39064_1
tccggccctgggggctccggcctcctgtcattggctgcttcccattgttggcgagtcagttaggtgttgggttttttgatgacaagctgggggcactctgcatgcaatggttggaagataaggtctattcaatcagagatgctgccgctaacaacttgaagcgccttgcagaagagtttggtccagagtgggcaatgcagcatataattcctcaggtgctggagaagatcaacaatccacactatttgtaccgcatgacaattctgcaggctatctccttgctagctcctgtcatgggtgcagaaatcacttgtcaaaagctgcttccagttgtcattaattcttcaaaggacagggttcctaacattaagttcaacgttgcaaaagtactacagtcacttgtaccgatcctcgatcaatctgttgtggagaagaccgtgaaaccatgccttgttgagctcagcgaggaccctgatgttgatgtaagatactatgcaaatcaggcactgcaggcgtgcgatcaaatgatggtgtcaagctaactagtcttcttgtattaattatttagagtttgatgttccatagtccaattttggattacctgtaatttggcctttagattgaagaagagttccgtctagcctcagtaacagatcaacactgccatgctgataaatggacggtccctgatcccttgttcgttgtgttattaatgttgtataattgagcaagacacaacacgtttctatgtgtgtttacatggcagattgaactttactgtctttcccagtttaaa

SEQ ID NO: 13387 - DNA, 603 bp, Sorghum bicolor
  Clone ID: SORBI-28MAY03-CLUS3883_2
tttcaaatttaaagaaaataaaaggaccatagcttggttccccttattattcagtatttcagtgcaacatcaccggcataatgtacataatttccggcaatctaattggttgtcgttccttcagctccgagcgcgtagcagaagggccggccatggatggtcatcaggttgcactccgcctccgacacgagggtcggtgcgagctcaagctgcccgccccaagagcatggcggcgtgtcctcgccgccgcccggcatgccgtccatcatgatcctcagcgcaccgcaccggcagtagggcacgatcttctccagctccgtgcagcacctccccttgagcaccggcagggggacgaaggggccgcggccgaggccgcaggtccggcgaaccaggtacgtgcggcagctcgggagagggttcagcgggatgaccagtcctggctcgcaccagttagtcctggcagccatggcgccgccgacgacggacagcagaaccgccgccgccgagaggaggatgatgtagctggacctggtggtggacgccattcctgctcctccgtgtgttttcaattttcttgagtaaagatgccggggcccggccggc

SEQ ID NO: 13388 - DNA, 650 bp, Sorghum bicolor
  Clone ID: SORBI-28MAY03-CLUS3883_1
gatcgagaacaaccaaataacatcctttttctctcaacacctaggtcactttcaaattaaataaaataacaagagagacagcttgttccccggccttattattcattgcacacaccggcatatacatttacgggaacctaatcggatgttgttgttccttcagctccgagcgcgtagcagaagggccggccatggatggtcctcaggttgcactccgcctccgacacgagggtcggggcgaattcaagcagcccgccccaagagcaggtcggcctcatctcgtagccggtcatcatgctgtccagtgccgtcctcagcgcgctgcaccggcagtagggaacgatcttctccagctccgagcagcacctctccttcagcaccggcaaggggacgacggggccgatgctgacgccgcaggcccggcgaaccatgtacgtgcggcagctcgggagcgggttgagtgggatgactagccctggctcgcaccagttggcagcggcggcggtggcggcgaggacggacagcagaaccgcagccgagaggaggatgtagctggaggacctggttgacgccattcctgttcctccctgcttcagatcaaattctttgtgcaaataaaaggtcccggcccgccgcctgagcggccccca

SEQ ID NO: 13389 - DNA, 1691 bp, Sorghum bicolor
  Clone ID: SORBI-28MAY03-CLUS3991_1
aaaaaaaaaaaaaactactccgctctccccgaacaaaatccagaagctccccaaccccctcctccattcctccaaatcgaagcctagcctagccaagcacgccgcgcagccgccgccagtagcagcaggaggagcaggggcagggacaggggcgagacgagatggtggggacggcagccggcgccgcggagggtgcggtgcggcggtgggtggatgccgccggcgggcgcctggtcctggacggcgggctggccacggagctcgaggccaacggcgccgacctcaacgacccgctctggagcgccaagtgcctcctctcctccccgcacctcatccgcaaggtccatatggactacctggaagctggtgcaaacattctaatcacggcatcgtatcaggccactattcaagggtttgaatcaaagggcttttcaaaagagcaaagtgaaaacttgttaacaaagagtgttgagattgcactggaagctcgtgagatgttcttgaaggaacatttggagaaatccattcctatacagcatcctattctggttgcagcatctatagggagttatggggcttatcttgctgatggctctgagtacagtggggattatggtgaagctggtacaaaagagttcctgaaagattttcatcggcggaggcttcaggttcttgctgaagcaggccctgatttgattgcttttgaaacaatccccaataaactggaagctcaggcatatgttgaactccttgaggaatgtaacataaatatccctgcatggctttccttcaactcaaaagatggagtgcatattgtgagtggggactcagtaattgaatgcactactattgctgacaagtgtgcaaaggttggtgcagttgggataaattgtacacctccaagatttattcatggactgatactctccattcgaaaggtcacggacaagcctattctgatatatcccaacagtggtgaaagatatgatggtgaaaaaaaggagtgggtggaatccactggtgtatcagatggtgattttgtttcttatgtaaatgaatggtgcaaagatggggctgcgctcatcgggggctgctgcaggacaactccaaacactatcagggccatacaaagaactctaaaccaaggcttcaactagcagcacttacctgtagcgtagagctgtgctctactcctgatgagctcctcctagcagtaccttgaactatatacctgagattccttaaccagtgaaccaatataatgttgcattttcgcttgcaaatgagatgtgctgcacctatgtttgtaaataatgttgtatttctgggttctaagatatccaacttggaggtacaaccggtgaagggtgaggaagcagcaacaatgatagagttctactactgaggaaaaactacttgcggctgagttaatgaagcttagtaggtaccactattaagcgtttaaagagtttgtatgaccgttgctctggagatgttatcttcaataagtgcttatgttactgctagttccatatgtaagttatgtttgataaacctgcatctcctgaaacgaagatcttattacttatgttactgttagtgtgagctgtgtttgtaaattttgtttgacaaacctgaatctcctgaaacgaagatcttattactcccttaccaatcaaaaagttcgtttt

SEQ ID NO: 13390 - DNA, 1764 bp, Sorghum bicolor
  Clone ID: SORBI-28MAY03-CLUS40350_1
ctggagttctctctttatgtgatcatccagctctgctggataaaagcgaaactcatgctttgtacagttcagatgctatagagagagcatggcaaattctagagaagataccaggtagagcgacaggagcatatagccatagtcagggcgtaaaaggtttacgtgatgaaattgctgctggaattgctgcacgtgatgggtttcacgcaagcggagataacatcttcctaacagatggagcaagcccagcagtgcacatgatgatgcagttgctgataagttctgagaaggatggcattctctgccctattccacagtacccactgtactctgcatcgattgctcttcacggtggttcccttgttccttattaccttgatgaagagacagggtggggactcgaggttgatgaactgaagaaacaactggaggaggctcgatctaagggcatcactgtgagggcgcttgttgtcataaatccagggaatccaacaggacaggttcttgctgaggaaaaccaaaagaaaattgtcgaattctgcaagaatgaaggacttgttcttcttgcggatgaggtttaccaagaaaacgtatatgttgaagataagaaattccactcattcaaaaaaattgcacggtcactgggatacactgatgatgatcttcctttggtatcattccagtcggtttctaaaggcttctacggagaatgtggaaaacgaggtggttatatggagataactggattcagtcctgaagtacgggaacaaatttacaaggtggcatcagtaaatctatgctccaatgtttcagggcaaattcttgctagccttgtaatgaacccaccaaaggctggggatgaatcctttgaatccttcatgttagagagggatggtatcctttcatcattggctcggcgtgcaaaggctttggaagaagcattcaatagtttagaaggtattacatgcaataaagccgaaggtgcaatgtatctgttcccacgccttcatttaccccagaaggcaattggagctgcccaagcagctggcactgccccagatgcatactatgctaaacgcctactagaagccactgggattgttgttgtccctggctctggttttggacaggtccctggaacatggcacttcagatgcacgatactgccgcaggaggacaaaataccagcaataatatctaggttcaaggagtttcacgagaagttcatggatgaattccgtgattgagtatccatcacctgcgtccatctcactcttggcataccatcagtttcctgccagaaggcatcctgtaatttttctgttgaaataataaggttgtcaattggtgtcccccactcatcgtcctatggatgctacaaccaaacaccatcctaacttctgttacaggcagatcctatgaaaccttacagaatctcgggcactgcatatcatgcttctgtttgccttgtgagaagtatatttaggctgctaggttctgagccctgatgtgtacaaacatacccgaattttgagaagttgaaatgtctcggcgcatccggaaattctgccttgtgtcgaggcggagaatctttactgtccaggtgatctgtttggtgactggctgtctgttctgcttctgcccatttgacattgctacaggtatagacaccattaggagcgtcagcctgtaaggttcgaacttgcatctactcctactgttctcccagatatgactattgcatggagtggagattttgttaga

SEQ ID NO: 13391 - DNA, 1351 bp, Sorghum bicolor
  Clone ID: SORBI-28MAY03-CLUS55851_1
gccccgcggagaagcccctgctgccgcacctgcgtctccatcgtcccctccgcgcggtccttcctcccccacgcccccgcccccgcccaccgggtcggccggtgcgtgtgtcccgtcgccgccagcgccgccccccccgtcgccccgccgctcaggctcctgtgcctgcggggggtcccccgggcctcgctgcgccccccggctgccgacgccgccccgcccgtccatgccggcagcggatgacgtcacctgtggcggcgtctccgtctcggtcaacatgctgcagctatccatccactgagagcggccgagttgagctccccgctcagctccaatggccactactgccgcggccgcagccgcagccagtgccttctcccacggccacgggcggagccggaggtgtcccccacgctcgcgctcgcgggccaccgtcgcacgctgtggtctcctactacctgttcccaggaggaatgtgctgtcgacaatgctctccacttcgacgatcctgctcttgggtccgagacagatcaccttagcagagacatccggtggcgcattcagggagtacatcgacatatttgatggctacactttcctgtacccgaagagctggatccaggtccggggagctggcgcggacatattcttcagagaccccttcgtcctcgacgagaacatgtcggtcgagatatcgtcgccgtcgtcgtccaagtacatgagcgtcgaggatcttggccctccggagaaggctgcagagaaggttctgaagcagtacctgacggagttcatgtccaccaggctgggcgttcggcgcgagtccaacgtcctgtcggcggtgtccaaggtcgctgacgatggcaagctctactacgaagttgaggtgaacataaaatcctatgcgagcaacaacgagctggccgtgatgccgcaggacagggtgcagagcctggagtgggaccgccggtacttgtcggtgctcggcgtcgagaacaagcggctctacgagctccggctgcagacgccggagcaggtgttcatgcaggaagaggaagacatcagaagagtcatggactccttcagggtcatcaagacggcgtagctaaatattgcaatggtttgtctattgtagagtgcacatgttttttgtatagctgatgcaatacctctgtccataaccttttgtatcggcagagatgttcatattcaatgtaccttgtttccaaatgttgcaaagtctaatcagtttccattcatgtctagtgggaaaagccagttccaaatgaaatgtatgtgctgaattcatatcaaggtatcacaaataaaatatagaaccaatcagttgctttgg

SEQ ID NO: 13392 - DNA, 922 bp, Sorghum bicolor
  Clone ID: SORBI-28MAY03-CLUS59005_1
gctgaggacggccaaggaggaattcgagcaaaccaaggcagctgcagctgcagcagagaccaggctatctgctgttgtgaaagaagcagaagcatctgcagcatcagagaggctagcacgtgaggcggttcaagctttgcaagaaagcaaagaggcaagagacactacggattctccgagacgagtggtgcttcctctaagcgagtactatgaactcagcaagagagcacatgaagctgaagaacaggcaagtgagaaggtagcagaagcattggcacaggtagtgttggcaaaggaatcagaagcaaggagcctggagagactaaaggaaacatccgaggaaatggatgagaagaaggaagaacttgaaattgcattggagagagccgggagggcgaacgaagggaaacttggtgcggagcaggaactgaggaaatggagagctgaccatgagcagcgccgcagagctcatgaatccacgaaacgcgcggtgaatcctttgaatggtccgtctagagtatttgttgaacagaaggatccacatcacaaggagcaggaatccaaggtacatatgtcgggaagtagctacgagggctttgttccaaaccaaaagttgcagaggaagaaatcgctgttccctctgatgggctcggttctatccaggaagacccgggcacagacgtgagataaacgagatcctagacacctgggactttgtcattcacattgctgtacattggtgtaataagctgtttttttgcctggtcttctttggaaagagctttttttttgtttaaagcttgccagctggtgaaagtgtaatttaatttgtcagtataaaaacacagtgggcacattggaatacgtttatatgattttttggtaacttattaggtctacaatctacatgaagaaattgtcc

SEQ ID NO: 13393 - DNA, 720 bp, Sorghum bicolor
  Clone ID: SORBI-28MAY03-CLUS6048_1
gccggccggtttccgggatcccttccccactacgcagttcggctaccaaacgaaaaccctagccgccgccgccgtcgctgctcttcgtcgagatgggaggcaagtgcccgcaccgcaaggtgaagaagcgccgcctctcgcacaagacggcgcgccgcggtaagttcctcctcaaggccgacgatgccgtctacgacgagctcgtcaagctggccgaccagggcaaggacgctgaaggcaaggagctccccgtcgacgaggacctcccaggcatgggacagttctactgcctccattgcgatcgctactttgctagtgaaagtgtgaaggatgaccactaccgctcaaagcgccacaagaaaagggtcaaggtaatgtctgggccagccccacacacgcaacttgatgctgaacttgctgctggaatgggaaagcctgacaatggcctgaagcttatgtccatgtgaaggaacctcttgttattagtacttgttccgtgttttcgttgctgtcgtacatctgaagctgctttgctcagtattagcagagttagtagatggtttttattgtgcacaagacttttgaaaggtggggcttgatcaggagggggagttggttttagagaggtgtcaggggtcaatgtttgtatcatgaaatcatttaccgacccatactagtaatgatgatgtctcgtatcatttggccccaaaaaggccccta

SEQ ID NO: 13394 - DNA, 1367 bp, Sorghum bicolor
  Clone ID: SORBI-28MAY03-CLUS5448_1
caggtaatatctggtaaacaatatgctggacctgaggttgatgtatggagttgtggagtgattctttatgctcttctttgtggaactcttccatttgatgatgagaatattcccaacctgttcaaaaaaattaagggaggtatctacacacttccaagtcatttgtctgctttggccagggatttgatcccacgaatgcttgttgtcgagcctatgaagagaatcacaattcgggaaattcgggatcatcaatggttccagactcgccttcctcgttacttggcagtgcctccaccagacacgacacagcaagccaaaatgatcgatgaagatacacttcgagatgttgttaatatgggatttaacaagaaccatgtgtgtgaatcactgtgcagcagacttcaaaatgaggcaactgttgcatattatttactattggacaatcgatttagagcaactagtggctatcttggagcagattatcaagaatcaatggacaggaatttaaatcagatggcgtcgtccgaatcatctagttctggtacgaggaattatgttccaggaagcagtgatcctcatagcagcggtttgcggccacattatcctgttgaaagaaaatgggcgcttggactccagtctcgggcccaccctcgtgaaataatgattgaggtcttaaaagcacttcaagaattaaacgtcagctggaagaagaatgggcactacaatatgaaatgcagatggctcccagggtttcctgaagtccatgacatgttagatgccagcaacagctttcttggtgactctaccatcatggataatgatgatgcaaatgggaggctacctgctgtgatcaagtttgaattccagctttacaagacgaaggaagacaagtacctcctcgatatgcagagagttactggacctcaactcctcttccttgacttttgtgcggccttccttaccaagcttagggtattatagtgctctgtttctcttcggattggtgaaaaaactaaacatagggctctaccatgtgcagtttttcactgaggtgatgaataaacgaaagcatgtaaataggaacctttttctcgtctttggacagcaaacatgtttgagtgactggtcttgtgttaagcgcctgaatgttgcctgttaacttatcctagatgtatacttaggtttagtatattgctgtctgcatggacattgctgtttctgcaatcagtggcaccgcagatggcgatgcagcagtgcaagctattatggatttttttttttttgcaagatccggcttttgttcgccttactgtacatagctatggtgtgttgcacttgaaaattttgcagttgctgatattttcttg

SEQ ID NO: 13395 - DNA, 413 bp, Sorghum bicolor
  Clone ID: LIB3476-006-Q6-K1-C9
ggcaactgttgcatattatttactattggacaatcgatttagagcaactagtggctatcttggagcagattatcaagaatcaatggttagtacacattaacacctgggtgtttgaaccaaaaaaagaaaaaaaaaatcttgagggtttctttgatctattgatgtttgaatagttgcctctccaggacaggaatttaaatcagatggcgtcgtccgaatcatctagttctggtacgaggaattatgttccaggaagcagtgatcctcatagcagcggtttgcggccacattatcctgttgaaagaaaatgggcgcttggactccagtctcgggcccaccctcgtgaaataatgattgaggtcttaaaagcacttcaagaattaaacgtcagctggaagaagaatgggcactac

SEQ ID NO: 13396 - DNA, 888 bp, Sorghum bicolor
  Clone ID: SORBI-28MAY03-CLUS4371_1
gccggccgggatgccaggactcttcccagctcgtcgtcttcttttgtcgtcgtcatcgtcctcccctccacactctactgggcgcgtagctacagctagtgtggactggagatcgatccgtccggccggtccatctgctggacctcgattgatttcttcttacctagggacatccggggatgtcgacccctgcgaggaagaggttgatgagggatttcaagcggctgatgcaggaccctccggctggaataagtggcgccccgcaggataacaacataatgttgtggaatgctgtcatatttggacctgatgataccccgtgggatggaggtacgttcaagctgactctccagtttaatgaagaatatccaaacaagccaccaaccgtgcggtttgtttctaggatgtttcatcctaacatttatgctgatggaagcatatgcttagatatcctgcagaatcaatggagtccaatatatgatgtagctgctatactcacatcaatccagtcattgttgtgcgatccaaacccgaattcgcccgctaactctgaagctgcccgcatgttcagcgagaacaagcgagagtacaaccgcaaagtgcgggaagtcgtggagcagagctggacggcggactgatgcgttccgctgcgctgcgcagctgctcactgcgcccgcgccccgcatccgtccattccataccccccccaaaaaatatggcgagatgtttgtgcttgtaactaaagccgaattcagctgttaatgctgttctcatgtgctaagacgcttctctatcatggctagatcggtggagattgttctgtctcaaatcaactttttatcttgtgctggatctggaatacaaacttaattactcttgcaatgtgcc

SEQ ID NO: 13397 - DNA, 1626 bp, Sorghum bicolor
  unsure (1)..(1626): unsure at all n locations
  Clone ID: SORBI-28MAY03-CLUS3919_1
ccttaggttggctgatttgggtccggtatggagtgtggcccctccacgtcgccgtgctcgtttttgcgcgtgcaccagcccgccccccaaccccacccagcgcgacgaagccgggggggcgatcgctccagcgccgccggcgatctcaccccccggggagccgccggcggtacctcgctctctatcccggctcggcgaacccccaggcctcaggtctaagtaggacgagaggctatgtgagttatccaacaccgccagtaaatgttctggcaggcaaggtaaacacatcgatgcaatgaagcctgttgtaggcaaagcaagaaaattgaaggatcttatgataaaaagtgacaataggatatgtgctgattgtggtgcacctgatcccaaatgggcatctgctaatattggagtgtttctttgcttaaaatgtggtgatgttcatagggcacttggacctgacatttcaaaggttttgtctataactttggatgattggtctgatagtgatatcgactctatgcttgaggttggtggaaactcatatgcaaattcaatttatgaggcttttcttccaaaagatcacccaaaacccaaaccagattcaacgatggaatataggacaaaatttataagagctaagtatgagacacaagattttttgaagccaagtttgcgcatttcatcaagatcatcttttaaatctaccacttctgtgaagagtgtagataacaatttctctagcacttcaaagaaggatgtctctgaagatacaagagaattttgtggagagctgaatattacagtggtgaaaggtactaacttttacagtggtgaaaggtactaacttggccgttagagacatgctaacaagtgatccatatgttattttaacactcggagggcagacagctcaatcgacagttaaaaaaagtgatttgaatccggtatggaatgaagtgcttaagatatctgttcctcgaaattacggacctctaaaacttgaaatatatgaccctgatatttttcttcagccgatgatatcatgggtgaagcagagatagatctccaaccaatgatcacagccgccatggcctttggagatacttcacgtcttggtgacatgcaaattgggaggtggttcatgaccaaagacaatgccctgatgaaagatagcacagtgaatgttgtggcaggcaaggtaaaacaggaggtgcacttaaagctgcagaacgtagaatcaggtgagatggagttagagctagaatgggttccgatcctctagactaatgataactcccctgatctgtctaaaagtctatcctgaagatacatcgatgttttcaagctgtccacttgatggtcttggtcattttttctggatgcttgaatctgttaaaaatgtcattgtagaatatcctggtgtaactgtcggttatactcacagcctttcatttcccgccctttggtaacttgttgtcatgccttgaaagtactcgttgtctcttgattgttgttgtattgccccattgaaaggacctgtcttataagaactgacaattatagctattcgggcnaaaaaaaaaaaaaaaaaaaaaaaaaaaagggcggcccctcgcgatctag

SEQ ID NO: 13398 - DNA, 347 bp, Sorghum bicolor
  unsure (1)..(347): unsure at all n locations
  Clone ID: LIB3480-021-P1-K1-B3
caaagttcttagggtgtttccttgaattcagtcacatgacagtccctacatcccaaaataactgcccatctcacttttctaatggccagagcattgagaaagtagcaaagacaaaagctgctggccattagcgacatgaaattaatacacataatctctatgtccaggaaatatatgaccatgatattttctcagcggatgatatcatgggtgaagcagagatagatctccaaccaatgatcacagccgccatggcctttggagatacttcacgtctnggtgacatgcaaatngngaggggttcatgaccaaagacaatgccctgatgaaagatagcacagtgaatg

SEQ ID NO: 13399 - DNA, 775 bp, Sorghum bicolor
  Clone ID: SORBI-28MAY03-CLUS44053_1
ccctggttcaagcgctcgctcagcgtggactcccagctcgggggcctgctgggcggccaggcggagcgcgagctggcgttccaggccccgccggcgctcaacgccttcgacatcatctccatgtcccccgggctcgacctgtcggggctgttcggcgagagcaggcgcagccgcgagaagcggttcatgaccacggcgtcgcccgagcagacggtggagcggctcgggcacgccggcgccaagctcggctacttcatggtggggaagaagggagtggagcgcctgccgctgggcggcctgtcgggtctcgtggccatgtccatggagatgtcggaggtgtcgcacgagctgatgctagtggagctgaggctggagggcggcgacggcgacgaggccgatgcgttcgggtgggaggagctccgggtggagctgggcgacgtcgtgacagcatggcacgtgtgcgaagaaggttgattcgctcgcaagaggaggaaatgcgatatcgagaagcaggatcagaatcctttcgtgtaggagatcgaggggaagtgtatgtatagtagtacagtaaagtgcgtatcatgtacgtagaattagttggctaggacgcactgaagatgtgtgatgttgtaactagattggtaggttcaatcaatctaatatgtgatgtttgggaattgggatgatagttgttgtcaaattaattagtactagaccttgttcaatttatgtgtgatgtttgacaatttcagtctctacagtctaaacggcactc

SEQ ID NO: 13400 - DNA, 1355 bp, Sorghum bicolor
  Clone ID: SORBI-28MAY03-CLUS4450_1
tactggaccgggatcagcagccccacactggcccacgcacgcggacgcggccacgcgctctgcgccaccaccagccggccgttcccggctcgccgccgccgttgcgccctcgcgctcacacctccgccagctcaggtccatcgagcggaggaacccatggcgccctccccgctgctcgtccggccgccggcgatggcgaattcaccccttccgcctccccgatgcgcggccgcggtggcagcggcgccggcggttcggacggctcccgcggccccactctctaggctccgtaccaagtgtaggttcgccgcatcggatgtgagagaagactactcttccaccccgatagatattgtcgctgatgtgaagacggagaagattgtggtgttgggaggaagtggattcgttggctctgcgatctgcaaagctgctgtcgcgacaggcattgaggttgtgagcttcagcaggtcaggaagaccagcttactctgatccctgggttgatcaagtcaattggctagcaggagatgttttctatgcaagatgggatgaagtattggttgggtctaccgctgttgtgtctacccttggaggatttggcaatgaagaacaaatgaaaaggataaatggtgaggcaaatgtcatagcagtaaacgctgcaaaagaatatggagtgccgaaattcattttaatctctgttcatgattacaatcttccatcctttcttcttacatcgggttacttcactggtaagagaaaggcggaatctgaagtcctttccaaatacccagcctcaggtgttgtgttgaggccaggcttcatttacggtaaaaggaaagtaaatggctttgaggtaccgctggacgctgttggacagccattggagaggctgctctcctctgttgaaaatttcaccaaaccattgaactcactgcctgcctctgacctaatccttgcaccccctgtgagcgtggacgatgttgcctatgcagtaatcaacggagtcgtagatgacagcttctttggggtgttcaccattgaacaaatcaaggaagccgcagccaaggtaagagtgtgagccttagggtcttgttccccagtgtatgaaggtattataggtgggaagttcataaacccagcagtaactaaaggtcctttgttcttcctttctccctgaatcttttaccatagtcaatagttcaaaaagtgcagcattttttttctgctggaattttctaacatttatgacttaagagctaacaaaatatgtagtaccgtgggccacagaattgttacgttggttcacatggaggttagcggcatgagctcacaatcttgtgaatgtgacattagacc

SEQ ID NO: 13401 - DNA, 697 bp, Sorghum bicolor
  Clone ID: SORBI-28MAY03-CLUS44398_1
ccagcaatgaactttactgcttctgttgaggatcctatcatgaatctgcactctgaccagggaagtaactcctttggctgctcagacttggcatgggagaatgataccaagacaccagacatcacatccattgctcctatttccactattgctgaaggtgatgagtctgcatttgtcaacagcaattcaaacagctcaatgttgcctcctgtcctggagaacagtgctgttgatttcactgatgggctgacagatttagaatcctatatgaggtttcttctggatggtggtgcaagtgattcagttgatagccttctgaaccttgatggatcacaagatgttggtagcaacatggacctctggagctttgatgacatgcccattgccggcgatttcttctgaggaatttgaagcttggccataggagtatgtacatagggactaggggaataaagactatgggagattgggaagcacctgcttggcaccttggggtagcatatgctcgtgtctagctcagatgcaaaagttgcattctgaaactctttggttatcgacctgttccctattttaactatctctgtatgagagccatttatgagactgaaccattttgttttcctttctttcgtttgttacaatatatggttttaactttatgatttatgaatatgtggcaaaacatgcctttatagcc

SEQ ID NO: 13402 - DNA, 595 bp, Sorghum bicolor
  Clone ID: SORBI-28MAY03-CLUS45126_1
tcgaccacttccacaagaagcctgttgtaccgccgaagcctgagccacagccgaaaccacagccagagagccagcctccaacaccgacgtacgggtcagcaacgcccacaaacgggtccccaactcctgtgagcaaccatgctccgcacatgttccatcacttctacaagggtcaccatgaccaccacttcttcgactacttccacaagaagcctgtgccaccagagcctaagccagagcccaagccgcagccagataaccaccctcccgtgccaacgtttggctcgcctcctccactctaccacgctccggccaaacattgagtccgttttgttgccttgaaatgatgggtacctgataatcttgcatgatattgcactactatgtattggtatctgaagaataatggttgtgatacaagtgtgagcgagagactctttttatttttcccaagacacaagtgtggactacctagagtcatggactcatggttatccatctttcagctgcaaatgagtgtttaaatttattgtaatattatctgaatgagtgtatgttgggacaagatgtgtgctttatcgttggtttcactttc

SEQ ID NO: 13403 - DNA, 1242 bp, Sorghum bicolor
  unsure (1)..(1242): unsure at all n locations
  Clone ID: SORBI-28MAY03-CLUS4586_1
ctcgcgttaaccggtcccgagtcgcttgtccccctcccaagttctcacaaacgcaaaccccaatctcgccgtcaccgcccccaatccaccccatctcgccgccgccgccgcgatgtctcgccgctatgacagccgcacgacgatcttctcgccggaggggcgtctctaccaggtggagtacgcgatggaggcgatcggcaacgccgggtcggccctcgggatcctggcggccgacggcgtggtcctggtcggcgagaagaaggtgacctccaagctcctccagacctcccgctccgccgagaagatgtacaagatcgactcccacctggcgtgcgccgtggccgggatcatgtccgacgccaacatcctcatcaacaccgcccgcctccacgcccagcgctacgcgctctcctaccaggagcccatccccgtggagcagctcgtccagtccctctgcgacaccaagcagggctacacccagttcggtggcctccgccccttcggggtctccttcctgttcgccgggtgggacaagcaccacggcttccagctctacatgagcgacccatctggcaactatggcgggtggaaggccgctgctgttggggccaatagccaggcagcgcagtccatgctcaagcaggactacaaggacggcttgacccgcgaggaggccgtcgcccttgcgctcaaggtcctcagcaagaccatggactccaccagcttgactgccgagaagctggagctggccgaggtgtttctgcagcctggcaccggggatgtacagtaccaggtgtgctctcctgaggcgctggggaagctgcttgcaaagtctggcctgacacagccaacacccgacgcataatgttctggtttgctgtggcttgtgatgcctactactgctcttagacatggtttaagcagttatgcttctgttgtgtgaacctaaatattcgatgattatgtggtctaaaattttatgttgagcatccttgatctgttaatgtttcatctgtaacagtggattgccttgaactggttgcaaattgttgatttcgatctgctctacttggttattatcgcgattagggagcatgtgattcaacggaacagggaaaattaggttcagatctgtgacagtttaaggcatctggatgataccgactgtgctttgaaacatggcaaaaatttggagtgcttatgtgctccagtaactatgacattttaggcctctnnnaaaaa

SEQ ID NO: 13404 - DNA, 892 bp, Sorghum bicolor
  Clone ID: SORBI-28MAY03-CLUS45375_1
gcacggcgcagccgctcctctctctgtgtctcccccaccctctgttccttcccctccccgatctcccccaatccgaccagaccagcaggcaccttcgactcgaccggagcaggcgaggcggaggcggatatggcgctgcgacgggcgctcctcagatcggccgagatctcccccgaccgcaaggctgcaattgagtacttccattctttatcaagggcacagcctgctcgttctctcaatggtgctggcagatcatttagcacccaggctgccactacgtcaagcacaccacagcctccacctcccccaccccctccagagaagactcacttcggtggcctcaaagatgaggatcgcattttcaccaacctctatggtctgcatgacccttttctgaaaggtgcgatgaagagaggtgactggtataggaccaaggatttggtgattaagggggcagactggatagttaatgaaatgaagaaatcaggtcttcggggtcgtggaggtgcaggttttccctctggtctcaaatggtcctttatgcccaaggtttcagatggacgcccttcttatcttgttgttaatgctgatgagagtgagcctggaacttgcaaagatagagaaatcatgcgccatgacccccacaagcttctggaaggatgccttattgctggagttggaatgagggcatcagctgcttacatctacattagaggtgaatacgtgaatgagcgtctgaaccttgagaaagctcggcaggaagcatatgcagctggacttcttggtaagaatgcttgtggatctggctatgattttgatgtgcatatacattttggtgctggtgcgtacatctgcggtgaagagactgccctactagagagccttgaaggga

SEQ ID NO: 13405 - DNA, 1396 bp, Sorghum bicolor
  unsure (1)..(1396): unsure at all n locations
  Clone ID: SORBI-28MAY03-CLUS7638_1
cgccgctcgacccgcccttctgttcctgcttccctgccttctattcctcgctcgtcaagccaccaacaaccaaatcgaattcgtctcctcctcctcctcctcctcctcgccgccgccgcctgagggcaaacaagcgagcgctcccgcggatcccccacccggcccccgccgcgcgcacacgtgaagacgacgaacccctcgtgaatggtgggagcccgcgcgacgtcccccgcctcgcagccgcagccggagaaggcctccttccgcggcttcggttgctgcatgcagggctggtaccaccgctgcatcggcctcgacccctgaacccctcgctccctccttctgcttgcttccccgctccggccgccgcttctctgatttgatttgacttgattcgattcgatcggttcccctcccgtcctggatctgttcctcgagagcacgccagcgcgcgagattccttcccttcccttctccgaggaaacaaagccgatcgctcgctgagctccgccgctgctgctgatggccgtcgcggtgccttcgtcgctgccgatgaagctctggaggacggagccccgcggcaagtccgccgccgcggggcccgacgagcccgtgcgcgtcctggtgacggtcaccgtcctcgggagcgccggcccgctgcgcttcatcgtgctcgagggcgacacggtcgccgcgctcatccgcgcggcgctccgctgctacgcgcgcgagggccgcatgccgctgctcggcaccgaccccgctggcttcgtcctctccaccgccaacggcggatccggcgccctcaaagaagacgagaagatcaccttcaacgggtgccggagcttcctgctctggcagaagactgcggtccagggtgccgccaagggcgccgggcacgacgctctgacggctactccaagcccaggcaggaagggcagcagtggcttcaaggctactccaagccctggcaggaaaggcagcggcggctggaaggctggcctgaacaagttcctcctcagcttcagcatcaaggtgtgatccatgcatcaacgaaagcaggaggggtgttcttggggttccgcaccgcaccacaataaaattgcattggttaattcttcgattggcaaagtgtaattcgtcgtgagtttgagtcgattcgagtcggttgctttgttattcagctgctctgtttccaagttatcaggtgttcatttgagttgcatcaataatcaatttgttcgtgctggccagttacatcgtggatgaattgtcttaagttacatcgtggaccagttgtctgaagtgtccanatgcacacgtgctgtccagttacatcgtggatgaatcgtctcaactgtcaaaaaaaaaaaaaaaaaaagccccctagggccgc

SEQ ID NO: 13406 - DNA, 1024 bp, Sorghum bicolor
  Clone ID: SORBI-28MAY03-CLUS636_1
cgaccacgcgtccgccgcccaaaatcacacaccactgcagtctgctgaagaaggaatagccggcagcaatggcagcagcttcttcatatttgccgccagtggtgacagcggttctgtttctatgggtcttctttagctgtgggcatgtggaggcaagtattcattttggcaacatgactgctcttcaaaagcacgttgaatttttcgaccggaataaggatggcattattacaccttcagagctcttccgaggatatgttgcacttggatgtgatgccgtatttgccagaaaaaaagccgcatctatgagtgctggtgttggtccaaaaacaagccctgttggtgcaccactgcctcatttatccatatacgtacaatatatccataaagcaatgcatggaagtgatacaggtgcatacgacgctgaaggaaggtttgttcctgcaaagtttgaagaaatattcacaaagcatgcaaaggtcaggccagatgcgttaacgtatgaggagattgaggagatgattctagcaaatcgagatccattagacccacaatcgtggtctgcaccagaaaaagaatggggactgatatacaagcttgcaagtgataagcaaggattccttcataaggactctacaagaggcatatatgatggaagtgtgttttacaagttggagaaactgaggatgtctgcaagatgtgatatgtgatggagttcaacatttagtcaaatgcaatgagacataataataaacacaaaagtgtatatatattaggcaattaagagattgttatctgaatcagatattatattgtacagttgttgtgatttttgtgttaggccttcgagtatatggaccaatatctttgataaatagtaaagtatatggcccaatattttgggtgttccctgaagaatgatatataagcatgtaagtggtcttatgcttgagttcccaaacccaaaaaaaaaaaaaaaaaaaaaaaaaaaaaaaaaaaaaaaaaaaaaaaaaaaaagcggacg

SEQ ID NO: 13407 - DNA, 557 bp, Sorghum bicolor
  Clone ID: LIB3481-029-P1-K1-C10
cgtccgcggacgcgtgggcggacgcgtgggcggacgcgtggggtgacggaatgccgagttggggcggcattttcatattttgaatgtcgataagccctctctatcgccattttgtatgtcgatatgcgtttacaattttgcttgtattttgattcatatgatttccatagctgtccactaaaatactattatccaaaaaaaacaaattcataaactcatatacgtatacaaatgagattgatttgttgattcacatgtaatagtaggaaacttaaattctccctgctttttcttaaaaagattcattgcaggatgatgcaccactgcctcattcatccatatacgtagagtatatccataaagcaatgcatggaagtgatacaggtgcatacgacgctaaaggaaggtttgttcctgcaaagtttgaagaaatattcacaaagcatgcaaaggtcagaccagatgcactaacggttcgaggaaatggaggagatgattctagcaaatcgagatccattagaccctcaatcatggtctgcacctgaaggagaatgggg

SEQ ID NO: 13408 - DNA, 1444 bp, Sorghum bicolor
  Clone ID: SORBI-28MAY03-CLUS8378_1
gaagccgcgccgcgacgagcgaagaaggaaggaagcggcgcgcctgctgcctcgccttcctcccatggcgccgccgctcgccgccgtctcatcgacgtcgcccctgttctctccttcctcatcccgccccctccgccgccgccatgcgcctcctccttctgtctccttccaaacgcggggacgctcgcccgcggcggcgccagccgagtcctccggcagcccgcttctcgaggtgcgcgggctcaccgcatccgtgaaggagactgggcagcagatcctcgccggcgtcgacctcaccatccgcgagggcgagattcatgcgattatggggaagaacggctccggcaagagcaccctcacaaaagttcttgttggccatccgcattatgaggtaactggaggtaccattctcttcaagggtcaggacctggttgacatggagccagaggacagatctctagcaggcctttttatgagtttccaagcacctattgagattcctggagtcagcaattttgattttctgctcatggcagtcaatgctcgcagagaaaagagtggtctaccagcattggggccccttgagttttactcagttgtatcgcccaaagttgatgccttgaagatggacccaaagttccttgatcgcaatgtgaatgaaggttttagcggcggtgaaaggaagcgtaatgagatattgcaactttcagtcattggagcagatttagcgcttctggatgaaatagattcaggattagatgttgatgcacttgaagatgttgctaatgcagtgaatgggcttttgacaccccaaaactctgttatgatgattacacactaccaacgtcttttggatctcattaagcccagctatgttcacatcatggaaaatggcaagataatcaagacaggtgacagttctattgccacacaaattaatgaaggtggctttaaatcaattgcccttgtatagcgtgaaagtagcaggtcaaataactgaaatggcttgttgggcttgttcaccagccactagcctacttgccagaacagagtgcctactgcttggggtttacactactactgctttcaggggtagcacatactgaattcagtaaaaatttcgagttacccggttcgaccaggcatgtcttttgaaggtggggagctggatacaccacctcctctctgtaagcatctttggatcaagatatattgatacaagtagtcatacatagggatagcatatcgtgcgtgcatacaaggtccaaattttgtacgtttgaatattacttgtttcctcaggcctctggcaatcaagactggtgctgcatgctacttttgtaacatttttttagcactgtcacagatgttcagacctggaaagcaattcagttgtctccaaaccgttatatagcattcgaaatttgaaacttgtcattactgt

SEQ ID NO: 13409 - DNA, 1292 bp, Sorghum bicolor
  Clone ID: SORBI-28MAY03-CLUS46_1
gcacgaggacctgagtgctctgctctcgctggagcccgtggtgcacgctcatggaggccgccattcccaatcccagtgccctgaaaacaaggatcgccgtggtcaccggcgggaacaaagggatcgggctagaggtttgccggcagctggccggcgacggcgccaccgtcgtcttaacagccagggacgagacgaggggcgcagcagctgcagagaagctcagggaagcagggctctccaatgttatattccaccaggtcgagatcacggacgatccgatcatcgctgggttttttcagctcctggcgagtcgcggtgggaagctggacataatagtcagtaacgcgacaaggggcgcagccgatgaagtgaagcacacagaagccgggccctccaacgagattttgcacaaggtggagaatccgggtcaaaggctcgtagccaggttgactggggtccgcaagacttgttttgggaagctagacatagtgaaaaccaactcctatagcgtttagcatgtgattgaagcctttcctgctgacagtcaagcaagctaggaagagatcagtgtcatggtctcctccgaatttggtctattaatgctaatcgacaacgaggagctctggcaggagctgaacgaagtcgagaagctgaccgaggagaggctggacgaggtcctggccaccttactacgtctcttccaggccggcgaggtggaggcgagtgtgaaggtctcctctttcttggggtagatgaggctaatcaacaacgaggagctaaggcaggagctgaacgatgtggagaagctgaccgaggagaggctggacgaggtgctggccacgttcctaagagacttcaaggccggcaaggtggaggcgcgtgggtggccaatggctttctcggcgtacaaggtggccaaggtggccatgaacgggtactcgaggatcctggcaagaaggcaccccgaactgcgcatcaactgcgcgcaccccggctacgtgagcaccgacatgaccatccacaccggacccctgacgcccgaggaaggcgcggccaacttggtgaaggtggcgctgctgccggaaggcggcccgaccggcgcatacttcgcgtggggagtggaggcgtcctttgtgtgaaaaagcaccatgcatcgttaatgttctgttcgttgttctccaactgcctgttatcaacgtttactgctgactcctttattcctctctaacgcttctgatacataagtcatagttgaaaatactgttcgctgatttgttgtgtgagaaaaaccc

SEQ ID NO: 13410 - DNA, 392 bp, Sorghum bicolor
  unsure (1)..(392): unsure at all n locations
  Clone ID: LIB3481-001-Q6-K1-G12
cgtccgtcccaatcccagtgccctgaaaacaatgattncgcgtggtcaccggcgggaacaaagggattgggctagaggtttgccggcagctggccggcgacggcgccaccgtggtcttaacagccagggacgagacgaggggcgcagccgctgcagagaagctcagagaagcagggctctccggggggggttccatcanctggagattactgatgctccgagcatcgctcggttggctgagttcctcaagactcgttttgggaagctagacatactgataaataatgccgcacttggtgctgacgaatacatacaaaatacatatacatgtncaaaaagnaatgaaaaattcatgcgtatatgttacaccaatatcctttaatatttcatta

SEQ ID NO: 13411 - DNA, 1009 bp, Sorghum bicolor
  Clone ID: SORBI-28MAY03-CLUS4793_1
ccgccggagcgcaagacggagctggcgcgcaagctgggcctgcagcctcgccaggtggccgtctggttccagaaccgccgcgcccggtggaagaccaagcagctcgagcgcgacttcgaccggttcaaggcctccttcgacgccctccgggcggaccacgacgtcatcctccaggacaaccaccgcctgcgtgcacaggtggtgtcgttgaccgagaagctgcaagagaaggaggcgacggagggcggcgccagcgctgccaccgacgccgcggcagcgttgccggcggtggacgacgtcaaggcttccttggccgatgacgtcgaggagccaacagaggcggcggcggaggaggaggaggcggcgttcgaggtgcaacaggtgaagtccgaggacaggctgagcacgggcagcggcgggagcgcggtggtggacacggacgctctgttgtacggcgccggttgccggttcgccgcggccgttgatagcagcgtggagtcctacttctccggtgccgaggaccaccactaccacgactgcgggatgggtaacgtaaaccaaggtaagggaggagggatgaattcctatgaattattatgttgtatggagaaaagatgtagctactaagggtaagaagaagttgacgctgccgccgcgttcttcgccggacacacccaccaccaagaggatcaatagagggacggcggccagatcagctggtggatgtggaactagcagacgacaatcttcccgaggggatcgaccgtcaaatcaaatcttgtgccaaacaaacaatcgtgccgtaaatttcttttcgcaacttaagcctgtaatggtgaattcctagctattattatgttgtatggagaaagtgtatgcatgcatggtagggtaaaattgggtaattaatattgttaatcccaatcactcgtggcgttggagaagatcaatagagttgtgggagaaataagtgcatagaggcaagtactctttttatggcacagtgcct

SEQ ID NO: 13412 - DNA, 1344 bp, Sorghum bicolor
  Clone ID: SORBI-28MAY03-CLUS4798_1
agcttgcacacgtacctgcgcgctatactagtagcgcgcggctccactgcaccccactccacccaccacccaccgctcacgccccgccacctcctcctcggattcgccgatggagaagatgctccacgcagcccccgtccacgcgacgctcccggagtgcttcatcttcccgtccgacaagctcccgcaggccaagtccacctccggcgcggtctccctgcccatcatcgacctgtccctcggccgcgacgaggtccggcgcgccatcctccatgccggcaaggagatcggcttcttccaggtggtgaaccacggcgtgtccctggaggcgatgcgggacatggaggcggtgtgccaggagttcttcgcgctgccggcggaggacaaggccgggctctactccgaggacacggggaaggcgacgcggatctactccagcaccatgttcgacacgggcgccgagaagtactggcgcgactgcctccgcctcgcctgctccttcccggacgtcggcgacagcccccgcggctggcccgacaagccggccaggctccgggaggtcgtcgagcggttcacggcgcagacgcgcgggctcgggatgcacatcctccgcctcctctgcgagggcctgggcctccgcccggactacctcgacggcgacatcagcggcggcgacgtcgtgctccacgtcaaccactacccgccctgccccgacccgaccgccacgctcggcctcccgccgcactgcgaccgcaacctcctcaccttgctcctccccagcatggtccgtggcctcgaggtctcctacaatggcgactggatcaaggttgaccccgtcgccggcgccttcgtcgtcaacttcggatgccaacttgaggttgtgacgaatgggacgctgaagagcatcgagcaccgggtgatgacgaacctgggggtggcgaggacgacggtggccacgttcatcatgccgaccacggactgcctcatcggccccgccgcagagttcctcagcgacgacaacccgccggcgtaccgcaccatgacgttcggagagttcaagcgcatctacagcgtcgtcaagctggggttgtcgctcaacctcaccacgaatctcaaggacgtgcagaagcaggtctgatccaattaattaatgtaggatcggagtatatatgcaaccaataaaattaagtcccttgttagacctcacttgcagccatagctaattaatagctagctggggagaagatgcatgtagtctgtgttaattatgttgttactgtctacccggacgtcatgttgctgatgatatgaagcaatgaataaaaatgacaaatatgtgtgtac

SEQ ID NO: 13413 - DNA, 1142 bp, Sorghum bicolor
  Clone ID: SORBI-28MAY03-CLUS4956_1
gcacgaggccccaccccacacgctccggctctccgggttgtctctctctttctttcttgatccagatccggaccggaccgatcgggcaccgatccagcccgtccaatccaaaccacccttcctcttcctcctctcttccaccaccaccagcagcaggcggcagcagcagcgacctcgtcgtcgtcgtcctcaattcgatcaaattcaaaatcccccccgtgcttgctgactgctgtattggactccttgcctgccgccccgccgtggttgctctgtactgaactcgattcctcactcctgccccgtgctgtgcttgtcgaccagacggaccgcaggagatccatccataaaacaaaaacaaaattagcatcatgtcggatatgaaggactccaatgcgcctgctgcacttgatggaaatcctcaacctatggaccaaactgaagacaattctatgccctcagctcagcaacaggaagaagcaatcaagaagaagtttggaggactaatgcccaaaaagccaccactcatctcaaaggatcatgagcgggcctactttgattctgctgactgggctctaggaaagcaaggtgtggccaaacccaaaggaccgctggaggcacttaggccaaagcttcagccaacacgccaacagcagcaacaacgcgcaaggcgctccatttacacttcgtcagaaaacgaggacggagatggtgctggtgctgaggagatgagcatcaactgaagtggagtggaatctgtaggacgtgggtacggttgttgcagaatcgcagcttgctttggccattgccagaattgattgctgagtaagtcgtcagtatatgtcaagtgttgtattttgctttgcaattgaagggcagagagtgattcatgtctatacagtttcatgtatgactgctgggttattgagttcaacattggatatgcatgatgggatggcctattatgtagtgtatatatataaattactgcatagtacgtgttcgcgtgaacttatgagcactacttttcagtttcagaatagtgttttttttttctctcacaatgtattgttgaacatctatttgttattagtgattattatggatggtgttgcgttggttaaaaaaaaaaaaaaaaaaaa

SEQ ID NO: 13414 - DNA, 1126 bp, Sorghum bicolor
  Clone ID: SORBI-28MAY03-CLUS5126_1
cccacgcgtgcaccagcaccgccgcacgcgcacacaccgcaccctacccggcgagctcgttgccgtgcgctgctctccgactgctctccgctgccgtccgccgcgcagctagggcctacacacccggcggcggccatggcggaggagctggtgctggacacggcgatccgagactgggtcctgatcccgctatccgtggttatggtcctcatcggcgtgctccgctactttgtctccaagctcatgcgctccccgccgacctccccgtctcccgaccccaagctcgttaaggaagggcaggtggtcatcagggcgaggaacctgaggaccaacgcgcagttcataccgggcaaggctttcaaggcacgcaaggtttattacaccaacgaggaaaatggattacttcatgttccaaaggaagaggcgcagaaggctcaggcagccatgttttcagatccaaacatggccatggacatgatgaagaagaatctatccatgatagttcctcagacacttacatttgcatgggtgaactttttcttctcaggttttgttgcagcgaaaattccctttccattgactcagagattcaggggaatgctgcaaaatgggattgacctgagcactgttgatgtcagctatgttagcagccgttcatggtatttcctcaatttattcggcttgaggggtcttttcagtctgatccttggtgaagagaacgcaactgatgatgcacaaaagatgatgcaaatgggcggtggatttggatttaatccaacaatgagtttgggtgcagagaaagacagcctggatatcatccagcatgactgggctctacctaagatggagaagcacgcagaagatgtgttgaaaaagttgctcaagaaataacatgaacggttgtgcttctgggaagcagtactctgcgtcttccagtttttgttgtagcctgtttgagtgaccagaaactttacacatttctaattgtattatttataactggccacgataacactcttagaaattggagacctagttcacaagaacttcggttttgtggttcttatataagtagaaaaaaaaatgtaattctgtaacttctcctgatatttaagagcgttgtttc

SEQ ID NO: 13415 - DNA, 1485 bp, Sorghum bicolor
  Clone ID: SORBI-28MAY03-CLUS50400_1
ctctcccccccccccacccgcctcttctccacgacaacctgcgattcctaacgactcctacaagcggcccacaacccccagccagcaacatggcaaaccctaggagcgccgtggccatcatcggagcagccctgatgctgcagcagaacaagccgacgccgatgctgcccccggccctgcagcagggaggaacatattgagcagaagggagtactatggtgcaggattgcatcagcacaataggtatgagtgcttgcatcccctctggtgaaaagaacgtcctgactggtatgaggctgcacgatagctggcggcagaaaacaccaagcagtaggtaaaaatttatgagtcgtcagaaggccctgctcatgcctcgaaagagtaccagaatttggtacagaagaaacccaagggaggtgctccaatgctagactgggggtgtgttttaactgtgcgtggtcttcgtggtctgtgggctcgtgcatcgaggcagtcacttgctgtcattagagggtcgtgtcgtgccatcagactctggctgggtaccgccccagctgcggaggaggcagctagggcctttgatgaggcagccagagcaatgtatggagacctggcacgtactaacttccccagaccgcatgcagcaacctatgcccaggctgctctagtatcgacctcttccaaggctgctccaatggctgttggagctctttggcctggtacatcatgcgagtcgacaacaacatcaaaccactctgatatcgcatccacctcacacaagcctgaagcctccgacagttcgagctccctaaaggcagaatggccagaagctttggaggctggatcaagctgtatccaagctggcacacccagtgtagctgacaaggtctttgggacgctggaacccatcacaaaacttccagatggtggtgtcacaaatcttccagatggtggtgtcataaatcttccagatggtggtgatgattgttttgatattggtgagatgctgagtatgatggaagctgatccacataatgaaggtggagctgacgttggcatggggcagccctggtgtcttgatgggctggattcgagtgtcctggagagcatgctccagtcagagccagagccattcctgatgtccgaagaacaggagatgtttcttgctggcttcgaaagcccatcaagtttcttcgaggatctggagcggctaaaatgattttttgatgtttggccgttgatcctcatttcacttcatggctgagcttgtgaagaagtggaaggcaaacactgccagaactgataagaggcttgctctagctattctaggctttattcctctgtaatagttctcttaggcatgaaaactcggtttgcttcacaatttgagagaaccacatgttatgtaagaccagaagtgttgatgtaaatagttcccactttgtggaaggacaataaagaaaaagggcatttgcttttcgtttt

SEQ ID NO: 13416 - DNA, 632 bp, Sorghum bicolor
  Clone ID: SORBI-28MAY03-CLUS5379_1
ctactggcgcgcatcagcttccctcgctgcacactctagagagtagagaaagagaaagaggaagtgaagtgggataaggagagggggtgctcgtctgctcgtccgtcagtggcaatggcgttgtggaacggtggtggtggagcctttccggcggcggccgtgctggtggctgcggccgtggcggcgctgctgggcgccggggtgggcgccaccaagttcgacgacgtggtgcagcccagctgggccaacgaccacatggtgtacgacggcgacctcctcaagctccgcctcgacgccaactccggcggaggcttcgtgtccaggagcaagttcctgtacggcaaggccagcgccgacctcaagctcgtgccgggtgactccgccggcgtcgtcaccgctttctatctgtcgtcggccggggacaagcacaacgagttcgacttcgagttcctgggcaacgtgaccggcgagccgtacctggtgcagacgaacctgtacatcgacggcgtgggcaacagggagcagcgcatcgacctgtggttcgaccccaccgccgacttccacacctacgccgtgctgtggaaccccagccaggtggtgttcatggtcgacgacacccccatccgcgtcta

SEQ ID NO: 13417 - DNA, 1286 bp, Sorghum bicolor
  Clone ID: SORBI-28MAY03-CLUS5388_1
tggttcttctcatttttgctcccctggcaataccattgaagatgactttattcccaaagaaaaaacgtccatcagattcacactctccaacaaatgataatgatgcacgaggagcacttttgccttcttcctctgaatcaaaccttggtaatcttgaagaagatgattcctttgacattgatattctcttagccgagggcgaaggggctataaagccgaagagaagaagaccaagaaggggagaagatttcaggtttcgtgaagcaatactgaaggccgatttctggcttctctttgcaatatgctttgttgggattggatctggaatcactgttgttaataatctagcacagataggaattgctgcaggtgctgtcgacacaaccatctcactctctgtcttcagtttctgcaatttttttggccggctgggaggtggtgctgtttctgagtatcttgtcaggtccaggacacttccacgaagtgttctgatcatatgcacccaagtagtgatgataattacatacctgctctttgcattgggtcagcttgccacactttacgtctctgtcgccttactcgggatatgttatggtgccctgctgtccgtgataatctcaacctcatcagagctcttcggactaaagcactggggaaagatattcaacttcatcatattggcaaatccagtaggcgcatacctgtttaacacccttgcgggatatgtctacgatctcgaagtggcaaagcagcatgccacaacatcagggtcggatattgcatgccatggccctaattgcttcagactcacattctgtgtcctctctggcgcggcttgcttgggcacattgctgagcgtggttctcacagtgagggtccggccagtgtatcagatgctctatgcggggggatccttcagccagcccaggaactctggacattgagggacgacgatacggagctgtagtgttctctgcatctacattaaatccatatgatgtctgaatagtttgataatgatctattgtaattcatgagcacgcaccttatttcagtgctctgtgttctaattttgggtcccttttggtctactatgaagagggggcgatggtcacgtgcagctatttgtaccagatgctcgtgctgttgctccaggttaatgtgctgaggcctgaattttaggtgtgcataactgaaatccctacttatgtagaacgctggtgcttgtatattgataagactctgcatctttctccaaatctgaaataaactgcatctcaggtctt

SEQ ID NO: 13418 - DNA, 1249 bp, Sorghum bicolor
  Clone ID: SORBI-28MAY03-CLUS1117_1
cgctcgaggccggccgggccgggatcccgcgcctctctctctctctctctcggtcgcgttcgctctcgcggagatcggagagaagcggaggaggcctcagccctagcgccgccccccatcgccgcatcagccatggcgctggccgctcgcctcgtctcgcgctcccgtcagctatattcggttcaagcagcttttggaaatggaggtgccactcaagttcgctcctttgcagctccagctgaccgtcctcctgtcagtggtgatgatctcctgaagggcatattctttgaggtaaagaaaaagtttgagacagctcttggtgtccttaaaaaggaaaagatcactattgatccagaagacccagcggcagtttctcgttatgcccaagtcatgaagactgtaagggaaaaggcagatcttctttctgattctcaaaggattaaatataccattgagaccttcaccaagggcatccctgatgcacggacttacttgaatactcttcaacagatcagaataaagagtggtcttatagatcatcttggaattgagcctttgatgatggaagctcttgagaagattgagaaggacattaagaaaccacttttgaggagcgacaagaagaacatggccaccctcttggcagagtttgacaagattaacaaaaagcttggcattcggaaggaggatcttcccaagatcgaggaagagcttgaattggaaattgccaaaagcgagctgagtgaacttaagaaggaatgtgttgaagcaatggagactcaactcaagagggaggagtttcaagatgaggagatgcctgatgtcaggaaattggacatcagaaacttcctgtagacctgatcgacgataatctttgaggcattgcaaatcgcccaacctgtgatttttctttggttttggtttcaagttgaccggtgctgtaagctacacctatgaatgctgcttcttccctttttgtaataaaaaactgcaccgaggtacaaagacagtcgagttggatttcttcttgcctttctgttgctctggactctggtggccacagcaacaatgagatgtccttgtgttatagtagatgaacaagattatgatacgaggcattcagtcaaatgatgatacatggtatttaaccgttattttgatctctttaatatggcttaaaaaaaaaaaaaaaaaaggcgactataaagatcaatttcagttttaaaaaaaaaaaaaaaaaaggccccta

SEQ ID NO: 13419 - DNA, 1157 bp, Sorghum bicolor
  Clone ID: SORBI-28MAY03-CLUS1137_1
gcacgagggaaggttttgacttactctgctcaagacagcacttacaaggtgtttgatttgaaaaactacacactactgtattcggtgtctgataagaatgttcaagaaataaagatcagccctgggataatgctattgatttatacaagaacaagcagctcggttcctctgaagattctttccattgaggatggtacagtcttgaagtccttcagccaccttctccatcgtaacaagaaggtagatttcattgaacagttcaatgaaaagcttctggtcaaacaggaaggagagaatcttcaaattcttgatgtaaggaacttccagttgacagaagtgagcagaactgagtttatgactccatctgcctttatctttctgtatgagctgcaactgttcctgacattccggaaccgatcagtagcagtttggaacttccgaggtgaactggtgacctcatttgaagatcacctgttgtggcaccctgactgcaacacaaacaacatatacattacaagtgatcaagatctcattatttcatactgcaaagctgactcaactgattcatcttcagaggaaaatgctggctctataaatatcagcagcatactgactggcaaatgcttggcaaaaataaaccctggaaattcaagcaagcaaaagaaagcatggaggttccagaatacagtctcggaggcccttgaggacattacagctctgtactatgacgaagatcgtgatgagatctacactggcaaccggcatggccttgtccatgtgtggtcgaactgaaagctgaaactgtggtggccttcacccacaggcacggtgatcttcacctgtatgtgtattaacagctagtacctcacgtggcggggggcatgaagaggacccccagccaccaggtacgtatgcgatgcttcatttttgaggcaattcttatttatctcagcatgccaagagctctctagatacattcagaaatcagaacccaccagatttgttgtagaattggcaactgtgcgttttcgctgtagcatgtagcttttgggagtgccgatgatgtccctccctcaactcggccacagagcgagttcaagtgtaacggatgttccttgcaagtaatgaaattcattcgttgagttctcatttcgttg

SEQ ID NO: 13420 - DNA, 1273 bp, Sorghum bicolor
  Clone ID: SORBI-28MAY03-CLUS10471_1
ccgcttcctcctgccccccgcccccgctgctgctttccgcccccggatcgcgccgtgtttgagccggggcccacgggtcgccgcgtcccctctccccgcacagcagcagcagcagcagaggatggaggcgggcctggcgctgcagacgcgggccgcgggcttcggctccggacggcgccggggcggcctacagtcgcccatcgggagcctgagagtcgctgatccggcgggagctgcggttgccgcgggcttcggctccggacggcgccggggcggcctacagtcgcccatcgggagcctgagagtcgctgatcccgcgggagctgcggttgccgtgcgggctcgcgggtccaagcccgtcgcaccgctccgtgccaagaaatcgttcggaggtcatgaaaacttgcataactccgttgacgaagctctcctgttgaagaggaaatccgaagaagttctgttctacttgaacgggaggtgtatttacttagtaggaatgatgggttctggaaaaagtacagtggggaagattatgtctgaagtcttgggttattcgttctttgacagtgacaaattagtggagcaagctgttggaatgccttcagttgctcaaatattcaaggttcatagcgaagccttctttcgggataatgagagtagtgtcttgagagatttgtcctccatgcaacgattagttgttgccaccggcggtggtgctgttatccgaccagttaactggaaatatatgaagaagggcctatctgtttggttagatgtgcccttggatgctcttgctaggcgtattgctaaagtgggaactgcctctcgtcctctcctggaccaaccatctggtgatccatacacaatggccttctctaagctcagcatgcttgcagagcaaaggggtgacgcttatgcaaatgcagatgtaagggtttctctagaagagattgcatctaagcaaggtcaccatgatgtctctaagctgacacccactgatatcgcaattgagtcacttcataagatcgagagcttcgtcagcgagcacactcctgataatccagctagcgactcgcaagctgagtcgcagatccaaaggatacagaccttgtagaaccttgatccttttgtttgtaccgtagtgtaccacctagagcatcgttgagttatttgttcgttgcattgtcacgagggaggagaaaacctgaagcatttcttgttataagctgtaaaggaatggaataagggagataaatccgaagtgtaccgttgg

SEQ ID NO: 13421 - DNA, 968 bp, Sorghum bicolor
  Clone ID: SORBI-28MAY03-CLUS5878_1
gccggccgggctgggggcagcgaggcagccagccagccagccttccccctcccaagccctatcctttccccacctcccgggtctcccgcattcctatcctctcctctcctcatccgcgccgccgccgccgccgccgtagtcgccgccgccgcggcttcccctcctcccccgagccaagatgaatgttgacaagctcaagaagatggcaggtgctgtgcgcactggggggaagggtagcatgcgcaggaagaagaaggcagttcacaagactacaaccacagatgacaaaagacttcagagcaccctgaaaagaataggagtgaacaccattcctggtattgaagaggtcaacatctttaaggacgatgttgttattcagtttgtgaatcctaaagtgcaagcttcaattggtgctaatacatgggtggtcagtggaactccacagacgaagaagcttcaagatctgcttccatccattatcaatcagcttggtcctgacaacttggacaacctgcggaggcttgcagagcaattccagaagcaggcccctggtgcttctggtgcagaggctggtgccagcgcaggtgctgctcaggacgatgatgacgacgttcctgagcttgtccctggagagacatttgaggaggccgtggaagagaaaaaggaggaggcatcataattttgctacaggcctactgttgtgaagtgggtataagtgaagcgttaccattagaagagacctgttgagaactctgacctaccttatttgtgcctgtggtccggttatgtcgtgaacgagaatttggtaggatgtgctggtgggattttacatgaagtacgcctctcttttttcacgcatatatctcccttgcttttgtgtggtaaaggtcttgttaatggtaaaggccacacttaaaccaaacaaaggtaccatgttccccgaagatgaattccagatatcagttctc

SEQ ID NO: 13422 - DNA, 694 bp, Sorghum bicolor
  Clone ID: SORBI-28MAY03-CLUS66869_1
cctactggaattgaagaactgtactaatcaatcaaatagctagcaaacatgaattaccctccctcttcttgttcatcatctcgtatatccctggtgcttctcctagtgatcaccgtgctcacaaggagtagcatcgttttagctacctctgatcgttactatgccaatagtgctgaatactatggtgatggaggtgatcatgagctgctgatgatggagaggttccatgcctggatggcagctcatggccggtcatacccgacggccgaggagaagctccggcggttccagatataccgtgacaacgtcaagttcatcgaggccataaacagggacaccactaagaccttcacctgcggcgagaaccagttcaccgacctcacccaccaagagttcctcgccaggtacaccatggccagccatgattcggtgccactggacctctcgtcatcagtgatcaccacccgtgccggcgatatcaccgagagtgattctggcacgacgatgcaagtggaagacacagatctgccggaacacgtcgactggagggagcaagacgcggttacgcctgtccagaatcagctccagggctgccatgcttgctgggtgttcgcgtcggtggcaacgatcgagagtgccaacaagatcaagaacggggatctcctaaagttgtcggagcagcaaatcgtggact

SEQ ID NO: 13423 - DNA, 1396 bp, Sorghum bicolor
  Clone ID: SORBI-28MAY03-CLUS67447_1
gcacgaggcacagttcacactcgcgtcgcgtgcgggcgtgcgcgcgcgtctctctctcgctctctcctttgattccgcatatatatctccgctttgccagcccgccgaaacgtgagtcgtcgagagagagaagctagctagctagctagagataaaaccagccggctgctgcgggcgacgacgacgagcatggcggcgatccggcaccggacggtggaggcgaacggcatctcgatgcacgtggcggagtcgggcgccgaaggggaccccgcggttgtgttcctgcacggcttcccggagctctggtactcgtggcgccaccagatggcgcacctggccgcgcggggctaccgctgcgtggcgcccgacctccgcggctacggcggcaccgccgcgccgaccgacgtcgcgtcctacaccgccttccacgtcgtcggcgacgtcgtggcgctgctcgacgcgctcggcatccaaaaggtgttcgtggtgggtcacgactggggcgccatcatcgcgtggtacctgtgcctgttccggccggaccgggtcacggcgctcgtcaacaccagcgtcgccttcatgcgccatgtcttcatccgcgccggcgcctccgccgtcaagcccaccgactacttctgccgcaactacgggcccacctactacatctgccgcttccaggagcctggtgtcgcagagaaggagttctcgccggcgaccgcccggtacctgatgaagccgatcctgtgcaaccgcttcacctcctcggcggcaggcggcgagaagccagcagacacggcggcgcccgccgcccccgtcgaggaaccgctgccgccgtggctgacggaggaggacgtgggccactttgtgtcggagttcgagcggacgggcttcacggggcccatcaactactaccgcaacatggaccgcaactgggagctggcggcgccgtgggcggacgccaaggtgcaggtgcccaccaggttcatcgtcggcgacggcgacctcacctaccactacccgggcatccaggactacatccacaagggcgggttccaggccgacgtaccggggctcgacagcgtcgtcgtcatccccggcgccggccacttcgtccagcaggagaaggccgacgaggttagccagcatatctacgacttcatctccaagttctgatggatggatcgacgaccatcgtcagcttggctgctgtctgctgaaaactgaaatcaacctcgatcatgttgccaatttgttttgtattttgaatttaaattaacaataagtgtatgcacaatacgtgtttttaattatttgtgacttcgatatggagtgagttgttccaagtttcagcgtacatacattgtatgatcgatgtgaaatgaataaaccagtattc

SEQ ID NO: 13424 - DNA, 1517 bp, Sorghum bicolor
  Clone ID: SORBI-28MAY03-CLUS6825_1
gcacgaggccgtgaaaaaaccctgaccgccgctactgaaccacgatttttttctcactcagcccagggttccgggcgcgggcggcgatggacggcggcggcgcgggcgcgggcgtgggcggctccgagggggagctctcggcgcaggagacggcgctctacgaccgccagatccgcgtctggggcgccgacgcccagaagagactaagtaagtcgcccgtgcttgtgtgcggcatgaacggaaccaccatcgagttctgcaagaatattgttctagctggagttggagggtaatccttgatggatgatcatgtagtcacagaagatgatctgaatgcaaattttctaattcctcctgatgagagcatatatggtggtagatctcgagccgaagtttgctgcgagtctttggtagatttcaatcctatggttcgagtttctgttgaaaagggtgatccatcactaattgatggagaattccttgacaagtttgacattgttgtacttagccgtgcatctcttaaaacaaagttgtttattaatgaaaactgccgaaagagaagcaaacacattgcattttatactatagattgcaaggattcatgtggtgagatatttgttgatttacagaagcatagctatgttcagaaaaagcctggaggatcaactgaacaacaggagttgacatatcctagtcttcaggaagctatctctgtaccgtggagtaatctaccgaagaagacatcaaaattatacttcgccatgagagtactggaggattatgaattatctgaagggcgcagccctggcgaaacaactctttctgatatacatgcagttttggctcggaggaaggatatgtgtgataaaatgtctttgaatgagtctcgtattcctacaactctcgtggaacgactgctagcagctggaaagaaggaacatcctcctgtatgtgctatcctaggtggtattcttggtcaggaggtgattaaatcaatatcctgcaagggtgatccagtcaagaatttcttctattttgatgtggctgatggcaaaggtgtcatcgaggatatcccaccacctcctgcaaactgatgaagcgctcagcagcctaactaccaactcgacttggttcactaatccttgtacccacttggcattgaacatgtagctacttttagatttatagccatgtgaaaaaggcaagttgatttaacccagatgtttaggaattgtatcaagcatcaaccgtgactgtatgcaccaacaatttcaaggtgaagtctggatggtttctccatgctttttgaggtgaaggatttcctttgttgtccctttacccttttgtcaaatctggtagcagtggttgggggaaaatgaagtgagaaagttatgttctagctgtgaagcgacgattctgaaagttcgaggatcaaaatggccagagttttggccataaaggcttgataagactctttctggattgatcatacctgtgtactcatgtggcatgtttca

SEQ ID NO: 13425 - DNA, 1248 bp, Sorghum bicolor
  Clone ID: SORBI-28MAY03-CLUS6942_1
gcacgaggcaccgcccggccctcgccggcggcttaaaccctagttcccattccccgtcgccgcctcagcgccgccgccgatggagttctggggtcttgaggtcaagcctggatccactgttaagtgtgagcctggacatggctttatcctgcacctttcgcaggctgctctcggggaatcaaagaaaagtgacaatgccttgatgtacgtcaaagtcgacgatcagaagcttgccattggaaccctctctattgacaagtttccgcaagtacaattcgatttggttttcgataaagagtttgagctgtcgcacacatcaaaaactaccagtgtgttcttctctggttacaaggttgagcagccaatggaggaagacgaaatggatcttgattctgaagatgaggaggagctggacgttcctgtaatcaaggaaaatggcaaagctgatgggaaggagcagaaaagtcaagagaaggcagttgccgcagcttcaaaatcaagtcttgtttctaagaaaagcaaggatgatgatgattctgatgaggatgagactgatgattctgattctgatgataccgatgattctgatgagggtgagggattatctcctgaagaaggcgatgacgatgattcaagtgatgaggatgatacaagtgacgatgaggaggaagaaactccaactcctaagaagaagccagaggcaggcaagaagagacctgctgaaaattccctgactcctctttctgataagaaagctaaggttgccacaccgtcagcccagaagacaggtggcaagaagggcgccgtccatgtggcaactccacacccagcaaaaggcaagacccctgcaaacaatgataaatcaaaggagaagtctccaaaatctggtggctcggtcccttgcaaatcttgcaccaagactttcaacagtgagatggcacttcaggctcactcgaaggcgaagcatggtgccaagtgagtcgcaggtacaactgagtcttcgaaggcgaagcatgggaggtttaagtgagtctggaaaaaatgtcggtggaagtaggcctggccttgttttgtttagagactagtggctatgtgattgtggtagatgcagcaaaacaaggctgtggtgtgtgaactttaatattctgggttgcccagctggtagtatttggatttgtgttgtgctgcgaattgatcgttttttcgccttggtgatatagtagcatggtcctttgtcgcattggctca

SEQ ID NO: 13426 - DNA, 1108 bp, Sorghum bicolor
  Clone ID: SORBI-28MAY03-CLUS6980_1
gcagctccgtctccggcggccccccaagagcgcgcggcgaggatgaacgtgaagggcggcggccggattccggtgcccccgccgggggccagcgcgctggtcaaggtggccgtgttcggcggcgccgccgtgtacgccgccatgaacagcctctacaacgtcgagggtggccaccgcgccatcgtcttcaaccgcatccagggcatcaaggacaaggtataccccgaagggactcactttatgattccatggtttgaacggccaatcatttatgatgtccgcgctcgaccgaatcttgttgagagtacttctgggagccgggatcttcagatggtgaaaattggtctccgtgtcctcacaaggcctatgccagagaggctaccacatatctacagaactctgggagagaacttcaatgagagagttctgccttcaatcatccatgaaacactgaaagctgttgttgctcaatacaatgctagtcagctgatcacacagagagagactgtgagtagggagattaggaagatactgactgagagggctcgattcttcaacattgctcttgatgatgtctctatcacaagcctgagcttcgggaaggagttcactcatgccattgaagccaagcaggttgctgcacaggaagctgagcgtgctaagttcattgtcgagaaagctgagcaagataagagaagtgcaattatcagggctcagggagaggctaagagtgccgagctgattggtcaagccatagcgaacaaccctgccttccttgccctgaggcagattgaagctgcaagggagatctcccacacgatttcgtcctccgccaacaaggtgttcctggactccaacgacctgctgctcaacctccagcagctgaatgtgtcgagcaagcagaagaaatgatgatgtcacattttatgcccccccctttcgtctgagttattattacagttagcagtggatgcctttgtaccagccttatctgatgtggaatttggcgagtatgtgctcgaaggcaagcaaagctgggcagggtttgtttaaacttgattatagcttgaggaagttcaataaagaccaaattttgttatttttattt

SEQ ID NO: 13427 - DNA, 889 bp, Sorghum bicolor
  unsure (1)..(889): unsure at all n locations
  Clone ID: SORBI-28MAY03-CLUS6939_1
gccggccaggtccagacacaccaatggatctcagacacctacctctgtctccactacaacgagtgcagtgtccacccagcccagctctagcctgctgcagtgcaagagcaagatggtcagcagaggtgctcgtcggccatcggcgcggctcctgctcctctccctggggcttgtgctcctctacttcacctcagtaagcagcgtcggcgttgctgcggcccagaaaacgtggtgcgtggccaagccgtcggcgtccaacgacatcctgtctctgaacctcgactacgcgtgctcccaggtgagctgcgccgtgatccagaagggcggaccgtgctactacccggacagcctggtgtcccgcgccgccgtcgccatgaacctctactacgcctccattggcaggcacccctggaactgctacttcaacaactggaaccgctacttcaacaactgatccctcgtggtgcagtccgatccaagctatggctcctgcaccatatatatatctattcagccctccctctctgttcgtagccctccctctcccctcggttgggttgcgtaataattgtgtcgcgtccgccataattgtgtcgcggtactactgatgacttatactgacgacgaggaagaggaggaggaggagtgtttgccgattgtggaggcggcggcgcagactaaactactgatgattgactgatgcagacgagagagatccatcgtgcccggctgcatttttatgcagattgctggtttttctagtctagagtgcccaatttaccaaatgcagatttgtttgtgatgtgttgtgccccggtagccgcacgtgttgtagtttgacagacatttggagatttacaagaaaaaaaaaaaaaaaaaaggcccctan

SEQ ID NO: 13428 - DNA, 1709 bp, Sorghum bicolor
  Clone ID: SORBI-28MAY03-CLUS1506_1
cctggttgaggtcaagaaggaattggacgatctgagagacaagctgcagcccctgaccatgaagtacaggaaggagaaggagaggatcgatgagatcaggaagctgaagcagcgccgcgaggagctgcagttcagcctgcaggaggccgagcgccggatggacctggctcgtgtggccgacctcaagtacggcgcccttcaggagatcgacgccgcacgaggcaagctggagagcgaaactggggagaacctgatgctcactgaaaccgtcggccctgaacaaattgcagaggtggtgagccggtggacgggtattccggtgacccggcttggccagaacgacaaggagaggctggtcggcctggctgacaggcttcaccagagggtggtcggccagacggaggccgtgaacgccgtcgcggaggcggtgctgaggtcaagggccggtcttggcaggccacagcaacccaccggctccttcctcttcctgggtccgaccggtgtaggcaagaccgagctggccaaggctcttgccgagcagctgttcgacgacgagaacctgcttgtccgcatcgacatgtccgagtacatggagcagcactcggttgctcgcctcatcggagcaccacctggctacgtcggccatgaggagggtggacagctgactgaacaggtgaggaggaggccgtacagcgtgatcctcttcgacgaggtggagaaggcccatgtcgccgtgttcaacaccctgcttcaggtcctcgacgacggcaggctgacggacgggcaaggcaggacggtggacttcaggaacaccgtgatcatcatgacatccaacctcggcgccgagcacctcctcgccgggatggtgggcaagaactccatgaaggtcgctcgcgatctggtcatgcaggaggtgaggaggcacttccgccctgagctgctgaaccggctcgacgagatcgtgatcttcgaccctctgtcccacgagcagctgaggaaggtggctcgccttcagatgaaggacgtggccgtccgccttgccgagaggggcatcgctctggccgtcaccgacgccgcactggacatcatcttgtctctctcttacgatccggtgtacggcgcgcggccgatcaggaggtggatcgagaagagggtggtgacgcagctgtcgaagatgctgatccaggaggagatcgacgagaactgcacggtgtacatcgacgccgcgccggccaaggacgagctggcctacagggtggaccggagcggcgggctggtgaacgcggagacggggttgaagtcggacatcctgatccaggtccccaacgacgccgtcaggagcgacgccgcgcaggccgtcaagaagatgaggatcatggaggaggaggacgaggacggcatggacgaggagtgagcgagagcagcgtgcaggtcgccggccggaggacgcggacatgcgacccggccctggttcggtggcgtcatcgtccagtgtcttctgaaatctgaataagcgtgtagataagtcgtgaacgtgtgaagagtgaagacgatgttgttttctgagttttaatttaatgacgttcttgtaacgcgactgtttgtcaagcatctgcgatggaatggatgaaagaacggaaatgctaaacaccacacgggtgttttagcacttgtgccaaaaaaaaaaaaaatccgagggggggccccgg

SEQ ID NO: 13429 - DNA, 806 bp, Sorghum bicolor
  Clone ID: SORBI-28MAY03-CLUS15402_1
ggacgccgcggctcctcttcacttccagagtccaccggctccgatcccaactcccatggcgctctccatctccacgcccacctcctcctccctcgtcccggcctcccgtcaggtggtcaggttgacttcgcggtcggcaaagcctgcgactttcagcctccggaggccgcctctcgccgcggcggccgccgctggcaacgcacccacgtccccggtcagcgaggtcgtcactgagctcgacgcggtggccggcttcagcgagatcgtgccggacaccgtcgtgttcgatgatttcgagaggttcgcacccacggcagccacggtgagctcgtcgctgctgcttggaatcgctgggctcccagacaccaagttcaagagtgcgatagatactgcgctggcagatggtgagtgtaacgcattggagaagcctgaggacaggatgtcctgttacctcaccaaggctctggcaaacgttggcgctgaactagctcatcaagtccctggacgcgtttcgactgaaatagatgctcggttggcttatgacacccagggcattatccacagggtgcatgaactgttgaatctatacaaccagcatgatgtctcaactgaccgcctgttattcaaaattcctgctacatggcaaggcatagaggcctcaaggttgcttgaatctgaaggagttcaaacacatctaacatttgtttacagtttcgcacaagcagcagcggcagcacaagctggtgcatctgttgtacagatatttgtggggcggttgcgggattgggcaaggaatcactctggtg

SEQ ID NO: 13430 - DNA, 1487 bp, Sorghum bicolor
  Clone ID: SORBI-28MAY03-CLUS16028_1
gatagcttgcagtccggcgggtccggtacagatagatacctttcatcaagacttgcacaccacataaacaagacagaaggaactacatcttttttatattctttataacgctatatatatagctctatggcctaacctaacctagcagaatgaataattgcagcagtatagtaatattgtatgattgtatatgtatactcatcaatccaaggaagaagcacaaggagcactcaaccaaccaccagccaacacagactcacatggaggctgtgctgtgcccagctcactccttgctgagctggcacatgcaccaacagctaaggaattctctcccaggggagaacaagaatctctcatatggtctataccacagccccggagcccctaaagccccaattggcttctcagccaactcttttcctttgttcttttttctgcgtgcttgcttataacaattgactgactgactgactgacaaacttaatatcacacatgtgtgcatgaacaagagaggaacttaggcccaaaaaaaaaaccaaaaaagaactacaaaaaggtacccacatcttagtagatacattccaaccctgcatgaagttgcagtagttgtattttttttgttgcagcagcagcagcactctctcactcaccacaggattttacaaagcggaaaactggctcggcatcgtcttggatgttgtctcagaggcctcctcacctctgctcctgatgctggtcgctgtctgctgctacctctcgcctcaacctcagaccagtaacaccttgcctacccttccaccttgcggcggcggtggcgctcatcccggcggcggccgacggcttgcagtccggcgggtcctcgaagagcgacctggagaggctcttgtgagccaacccgatgtcgaacaggatgaccccgggttcctggtcctggacgaggatgcccttgacggggagccagacgaagagctcctcctgggagaggccctccacgccgcggagcgcgcccttgctgaggttgccgcggaccacgttgtcgaagtaggccaggtcgccgttgtcgtacgtggcgtagcacggcgccgacagccgcgcctccagcaggccggtcgattcgtccagggtgtacgactccacgccgcgcgggagaagtcctccgggaaggccgtgatccttgaggagttgatgtatcgtgttgcctgcgccggcgaaggagacaccgtccctcggcgccgcgcgggaggacagtgcgggccgcagcgcggcgagagacaggatgcacacgagcgcgagcacgggaatcgggcagggtagacgcgggagctttgccatggaagaggtccgcggcgcggcggcggggagggcaggtgtggggtgagaggagaaggcggaggcggaggggaggagaacgaggggagaggaggttttaggggagaaatttaatgggatttgaaactgtgcgacaaaccttacggaaaatccagtag

SEQ ID NO: 13431 - DNA, 825 bp, Sorghum bicolor
  Clone ID: SORBI-28MAY03-CLUS81582_1
aggaccgcctgttcccgcgcccggacccgacgctgaacgccaccttcgccggccagctccggcggacatgcccggcgaagggcaccgaccgccggacgccgctggacgtgcgcacgcccaacgcgttcgacaacaagtactacgtgaacctggtgaaccgtgaggggctcttcacctcggaccaggacctcttcagcaacgcccgcaccagggccctcgtcgacaagttcgcgcgcagccagagggacttcttcgaccagttcgccttctccgtggtgaagatggggcagatcaaggtgctgacgggcacgcaggggcagatccgcaccaactgctccgcacgcaacgccgccgggacgacgatgctgccgtggtccgtctccgtcgtcgaggaggctgcagatgagagcctcggcgtgttctagaactaggtgtgccggccggcgtctgctggctgccgtggttagctacagctagccttacgtacgtggtcggtcggtgtctacgcacgtggtgcctaatggagttggcaggatgcagctactagcactggactgcatgcatgcatgtagtgcagcagctagcgcgccaccaaagcactgcaccttaattagctttgagaaataaaagtggccatggcagaaaatcagtctatatatactgtgcaagtgtgcaggtaccgatggagctttacttttatatcttcaaggccctgcttgtgagttgtaattataatactaggatcccccgtgctcgttgttttagtgtttgttaacagagatgcagcgcgtgttagtctcaacagagagagcagagatacttccc

SEQ ID NO: 13432 - DNA, 1213 bp, Sorghum bicolor
  Clone ID: SORBI-28MAY03-CLUS86008_1
agaggggaaaagcttgttgctggttggcttgctacagaagccgcgtgcggagcaaggagggagaggggagagggagagagagagagagagagagagagagagagagagagcaagcgggctagcggtggcagccatggcagagcagcacagggaggagtcgggcgggtcagtgctggacaagatctcggacaagctccacggccgcgggagcggctcgtcgtcgtcgtcgtcggactcggacgacgagcactcgtcggcgacggccgccgtgaaggccaagatctaccgcctcttcggccgggagaagcccgtccactccgtcctcggcggcggcaagccggcggatctgtttctatggaggaacaagagaatctctggtggggtgctcgcaggcgcaactgccatctggctgctgtttgaggtcatggattaccacctcctcaccctgctatgccactgcctcatcctcaccctggccatcctgttcctctggtccaatgccacgactttcatcaacaagtctcctcctaacatccctgaggtgaagatcccagaggacctggctgtgaatgttgcacgttccctgagatatgagatcaacaggggatttgctaccttgagggagatcggccaaggccatgacctgaagaaatttctgattgtgattgcaggactatggatcctttctgttcttgggagctgctgcaatttcctcaccttgtcctacatagtttttatggtattgtacactgtgccggtcctgtatgagaagcatgaggataaggttgatgcttttggtgagaaggccatggtcgagctgaagaagtactatgccatcttcgacgagaaatgcctatcaaagattccgaagggcccattaaaagacaagaagcaacattagaagagcacaatcagacaagggtctgcggtgatttatcatgtcttttgatcattacttgtcggttttgaaggatgaatgtgattccatgtctccatgtgatggtaaatacctggacgtgttctagtgtattagtgtggtcagtagcaatgtgctaaattatctaaggttacgcagaattgtgttatgaattcccagtttaacattaccctccttggaagtggtggttccctcggtgtttgtaatatatatctagtgctatttcataaccggacctagggctacgatgaattgtcctcgctggttattgataaa

SEQ ID NO: 13433 - DNA, 1318 bp, Sorghum bicolor
  Clone ID: SORBI-28MAY03-CLUS8901_1
acttcatcgcagcgtcacgtgtgacacagtccgttcggcctcctcgcacgcccccaaatcccccagctgcgcttccaaagccagcagccggcgggcccctctacaaaagcaggcggcttgcgcgtgcgcgacgggcagcagcacctgcctctgcctgagccagtacgcctcggtgagcagacaagcgatggcggccacggtggagggggtgcggcaccggacggtggaggcgaacggagtgcgcctgcacgtggcggaggctgggcccgaggaggccggcgcccccgtggtgctgctcgttcacggcttcccggacctctggtacggctggcgccaccagatggccgccctggcggcgcgcggctaccgcgccgtggccccggacctccgcggctacggcgactccgactccccgcccgacgcgtccagctacaccaccttccatgtcgtcggggacctcgtcgcgctcatctccgacctcggccagccccgggtgttcgtggtggggcacgactggggcgccatcgtggcgtggcagctgtgtctgctccggccggacctggtgcgggcgctcgtgaacctcagcgtcgtgtaccacccgcggcggccggagatgagcccgctccagaccatcagggctgcctgcggcgaagaccactacatgtgccgcttccaggaacctggtgttgctgaagctgagtttgctctgtatgacaccaagtatgtgtttaagaagacattcggcatgcgcaagccagctcctcttgttctacctaaggacaagagcttctttgattcacttgattcagatggaacttgtcctccatggctatcagaggaagatatttcctactatgcagaaaaatttgcgaaaacaggctttactggaggacttaactactacagatgcatggacaggagctgggagctttctgcaccatggactggagctcagataaaagttccgtcaaaattcattgttggggacctagacattacatacaacgcccccggggtaccagactacattcacaagggtggcttcaaggcaagcgtgccaaatctagaggacgtggttattatggagggagtgagccacttcctcaaccaggagaagcctaatgaggtctctgatcacatctgcgagttctttagcaagttctgatatgtatgtataaggaaaaatgtcaaggagcaattatatgcttctgagctacttttatgtcaaatgcggttgccagtgtcaccatacaaatatatatgaatctaaataaaattcgtctgtctctgatcaaaattttgaagatcttcacttgtc

SEQ ID NO: 13434 - DNA, 744 bp, Sorghum bicolor
  Clone ID: SORBI-28MAY03-CLUS92261_1
ccttccctactgcaatcgatgttgttgtccatctcgttgcattaccatggctgtccaccatgtattgtctctcacccaaggccttctcttgcttctttctttttatgttgctgccgtagtgtctgatacttttcgtcacgaactatcccacaaaacaaaccaacatcatataccatacaacctacagccagaatacttccccaatgagcggctctatcaagcctaccttgtcatccagcgtttcaagagcactatcactagtgaccccaagaacgtcacagcaacctggactggccatgacatctgcggcgagaagacctacctcggcttctactgcgcaacaccatcagggttagccgagaagcagacagttacgacggttcttttgaatggatttagcctgcgtgcgcccaagttgcagggcttcatcgatcagctcccggatatcgcggtgttccatgctgcctccaacaactttggtggagatatccctcaactcgacaggctgccttatctgtaccagctaagtacagctaactacgatatccaacctttgctgccctctggtagtcgcggcgaagttatgacgggagctagcgcaggatctggcaaacaacaatatccagtattatgcataaaaacattttttaattttacatttcacatcgtagctggaaatgccacttcaggaggactcattccaggcattccaaatccaaaaattccgggcattccgagctttac

SEQ ID NO: 13435 - DNA, 1094 bp, Sorghum bicolor
  Clone ID: SORBI-28MAY03-CLUS9776_1
ccacgacgcgcccctgcccgggggcggccccctgggccggcacaggcacccgccccgccgcgcggggctggtgcgcggctccccgcggccgccgcccgcggtccgggaccaggcccccggccccgtcagggaggggggcgcgccccgcccccccgccggccgcggcgggcccctcccactccccctccgccgggaggggggcggtcccctgatgttcacgatgtcgtcggagaggttcgtgaagatccagagggaggcgccgccggagttccagcagtacctcgtgcaggtgaccaaataccaggccgcacagaactgcaagacgtggatcgtgggcaaggcactgtcgccgcgcgagcagcggtgggcgccgtcggggacgcacttccaccagttcgtggtgccgcccatcatcggcttccggcgagactgcacctacggcaagctcgccgccatgaggctccccaaggacgtgcagggcctgggctcctgcgagtacacgatggagcgcggggtggtgcacgcgtgccacgccggcggcgtcgtgcacttcctcgaaggatgggaccaccacgaggtgggcgccatcgacgtcgaccggatcgacgtcgtctggaacgccgcgctcaagcacggcctcgcgccggtgtgatatatcggactggtcgtcgtctcgtccagccggcgccgcccgcgcgcgcgtttcatggcacagcagctattaggccaacagacagccccacgggctaccgtggctattcttgtagtagtacttactactgtccaatgggaattgggacgacgacggctcaaaatgtacacgcgcgtgcatcgacgatctctgacggcaggatcgacgggttattatttatataaaaagttacttgcgaataactgtaccataggtgcaatgcggcagagtatatagtaccaatatactcctagtatgtatgtgtacgtacgaatactgcaatatggcccgaagcatgggcttccgttccttagaaaatagaagaaatcacgttggtctgtactgcccattgggttctccagtgacgttggctagtccaaacggcccacacaaggacagcttt

SEQ ID NO: 13436 - DNA, 814 bp, Sorghum bicolor
  Clone ID: SORBI-28MAY03-CLUS9868_1
ctggtgtcactttttagtaacagaaaagtcagagcagatactgctatgactggagagatgactctaaggggccttgtattaccagttggtggtgttaaggacaaggtacttgcggcacatcgctatggaatcaagagagtaattttacctgaaaggaacttgaaggacttatcagaggttccatcaccgattctctctggcatggagattctgcttgtgaagcgcatcgaggaagtactcgaccatgctttcgaaggaggatgcccacttagatcacgctccaagttatagcacccaactcgcctttgatatggatatttgcttcggaggatcatcgtcacagtaccacgcgaatgatcaacagtgagagtaagagcctagctctcttgccagcacaggtcttggcacgccctctttcgttaggcttcgcatccggaatgtgtatactggtcagaattcggagagcagtgagaagatctgctcgttcctctgctgggattccctgcatattttttgcgacaccagctgttgatctttatacacagatgcaagacaaatctgggaggaacactggttggttcctctgtcgataatatgggtgtatatgtaatctattccagggaaatatagctaaaacgaggttgtcaaatcaaaactaaagagattgagaatcatcatacgtcctttggggttgggtgacttcagttaattaatatatatcatatataggtcgaaaccacttgtgtaacaaaatatgtgtacaacatatttacatctctttaatatccaccctgagtcaaattgtgagtcatgg

SEQ ID NO: 13437 - DNA, 1093 bp, Sorghum bicolor
  Clone ID: SORBI-28MAY03-CLUS10152_1
tactgggagtgtccagtggacacgagtggagcggagtaggacacgaggtggttccggccggcccactcgcagaatattacaccgccactcgccttccctctcctcccttctccgccacgagtcatccgccgcagccatgggcacggaggcggagcatcaggacagcagcgtccaacacgatggcgtcgtggtggtgcccgcgccgcgcccgcgcaaggggctcgcctcctgggcgctcgacctgctcgagtccctcgtcgtgcgcctcggccacgacaagaccaagccgctccactggctctccggcaacttcgcccccgtcgtcgaggagaccccgccggcccccaacctcaccgtccgcggacacctcccggagtgcttgaatggagagtttgtccgggttgggcctaatccaaagtttgtccctgttgccgggtatcactggtttgatggagacgggatgattcatgccatgcgtattaaagatggaaaagctacctatgtatcaagatatgtgaagactgctcgcctcaaacaagaagagtattttggtggagctaagtttatgaagattggagacctgaagggattttttggattgtttatggtccaaatgcagcaactccggaaaaaattcaaagtcttggattttacctatggatttgggacagctaatactgcacttatatatcatcatggtaaactcatggccttgtcagaagcagataagccatatgttgttaaggtccttgaagatggagacttgcagactcttggcttgttggattatgacaaaaggttgaaacattctttcaccgcccatccaaaggttgacccttttacagatgaaatgttcacatttggatattcacacgaacctccatactgtacataccgtgtgattaccaaagaaggagctatgcttgatcctgtgccaataacaataccagaatctgtaatgatgcatgactttgccatcacggagaattactctatttttatggacctccctttgttgttccgaccaaaggaaatggtgaagaacagtgagtttatctacaagtttgatcctacaaagaaagctcgttttggt

SEQ ID NO: 13438 - DNA, 1287 bp, Sorghum bicolor
  Clone ID: SORBI-28MAY03-CLUS17969_1
gcacgagggaaaaaaaattctgcgaccacttcccgttccccgccggagccgcttcacccccagatctgccacgcaccggagccgcttcaccaccagatctgccacgccgccggagctttcctttcgccgtccctccttcctcgccgtccgggattttcagcgatgggagggaggatagaggcccagaatgagaagatgggcaacgcttacctagcttgaagaccacacgtgatcttcatggattcagccaacatctattatgcaatcaataaaagtgtggtggaagttatagtttatgctagaggagaactcatcacccaatgcggcactattgtcgcttgcaaggatagatctgcttatgtagtgacagatgcacgattggtcagtgagcatctgggaaggaggagaatagaggtgaaatttccagatggacaaatatcaattcccacacccaaccaatttaatcttcataatggtattcttggtatttactgtagtcccaatagtcagtttgatcgcactaaagtagatgtgattgaagtttgtgaggaaggtctcaattcattggataccgtttatgtgtatgatggtgttaaaggcatgatgactccagggactgtgacgcaaattgatgcacattcgtttagcatcaccaacatagcaagtgacatgacagaatatggagcacccgttcttaacaggaatggaattcttgttggtatgtgctattcatttgagtatcatttgtctgccaaaagtatcctcgcaatagcaaatgcaatcgagaggagtcaaaatagacccttcacgagcgttcaagctgctttagatcatatatataacactatctgaactgaaagccattcaaaaggcgttcatttgacatgtattatatgatcatcatcgatgggagagtttcatcctataacactggcccattggcttgtgtaggccgcgtggcatggcactggcattgtgcttcttttgtgaagtctaatactctgatgccttgatggcggtgtggtagtacatgtgtgactgcgaacctgggagcactagcctttatctctgttcttaatttgttgtcgaacctgggagctttagcctttatatctgttcttaatttgttgtcctgtaaccttgggagctttagcctttatttatgttggaatagccaaattgaacccttatctttcgtctcaggttagtccttcaactcttgaaatagctaaattattccctcaacttccgattttagttcaattccatccttacgctgatgtggct

SEQ ID NO: 13439 - DNA, 1809 bp, Sorghum bicolor
  Clone ID: SORBI-28MAY03-CLUS1838_1
gcacgaggcgcgcccctcgcccccgcccccgcagccccgcacctcgccccggcccttccgccgctcccgacccccccgcccccgccgccgcccgcccccgcgcgtcccctcctcttcctcgtcctctccctcgcgatgccgccacgtgccggccagcgctcgccgtctctcaacgcgcagcgcctcaacgtgcggcgtgctcgtggcgcggtggcactcccgggctgcagcgcggcaccgcccatccccggccaggacgcagggagggtggccacggctgccggctgccagcgcggccgtcctctagagctccttccttcctctcctccctgtactccgcgtctgctcatgtgctacagcaatccctaactgtctctgctgcaggtcatgtccgcccagctctcgctcccgtcggtggacctgtgttcttgtgtggagactctcgctggctacaggagcggcgctgcggcggctgtgtgaacgacgagctttggccattgcaggcagaagcgcccccagggcctaatgttattggatttctgctaggatcataaacacataacaggagcgtggccacacaaggcccgcgttcggaacatcaaacgacctcgcgcttctgcttcgctatcatcgtggccttctctcaccatcgttctctccacgacgtagcgcctccatcctgtatctacctggatggtcaccactatgcaaatcttacagtaattaacgactcagagattcaatccatcagtgcccacatagaagagagagcagtgattgcaaggcttccacagtcagcaagagatatcatagggcacaaagacttaaaggatgtaatccaggaagaacttcagattaatatcaaggtagaagatatctcacagtacaactcagattacattatcatgctagactcatccagtacaaagaccatcctccttgacagaggatttctcaaggttggttccttcatacttccactgatcccatgggacagaagttatggttcaacaattctccctcttcagacccatcttacagatgctcacaacctaaatccccattcactcatagcatccaacagtcaacacctaaccatttatatatatgggcttccacctcatctctgttgtgagttcatagtacgccagctccttaagaaaatatgcattgtccacaaaatagcatttacgccagcaaacctgacatattcagtggatgcttacggatcagatatgtctataccggagatcacacatataggtgtcaaaaaagaaacacataatggtagtattatcagcatctggccattatggtatgaagtcattacagaggacatgcatcccaaccaacatgacctatactatttagaaaacactgacaactttcgaggagactctgatcttgacagtgagcaccataaagaggtccaaaaacagtactatgaccttcaagatggaaacaaagagaccacttcccagttaaatgaatacatcgccgggtattcagatgattcagactgggaaccatatgtaccatgatcaggtaccttaagcaccagggaacacaaacatatttggctagcacacttcaagcaaccaaggatcatattctgcgagtctggagcatatacacataatattattgctactatataatgcttgcatcctgtacataaacacatgtcatatttctgtttatgtaatatcgttgcctactcaaaccaagaaactatccaatacttaatgcatccatcctgtaaatacctacagatgtaatatgtttttatacatgtcgcatatataaata

SEQ ID NO: 13440 - DNA, 816 bp, Sorghum bicolor
  Clone ID: SORBI-28MAY03-CLUS4836_1
aggaggcggcggcggcggcggcgggtgcggaggaggaggaggcggcggcggcggcgggacgcgcggtcgttgccctgtggacacgctgaagttgggcgtgtgcgccaacgtgctgaacgggctgatcaacgtgaacctggggacaccgccgaggacgccgtgctgcacgctgatccaggggctggcggaccttgaggcggcggtgtgtctctgcaccgcgctgcgagccaacatcctgggcatcaacctcaacctccccatcaacctcagcctcctcgtcaactactgcggcaggcgcgtcccctcgggattccagtgctcctcctgatctatctcatctcatcgtcgccatgcatgcatgcatgcatgcctgcctctcgtcgtctctccatcgtcgtcgtttcccgatccatggatatatatatatgcacacgcccgcctgcaccaggccggccgggctaaataataattatatgatttctcaggtctcagcaacaagtacaagctaagctactagtacacatcgctcttcgttcatcgctttcattttgttttgctttgctttgttttgggtgtgtttcttcacgaatctgctatcatcgtcatgcgcatgcatgcatgcatgcatgcagcatatatatgttcatcgcgcgcgtcttcctgtgtttgtgttggatcgatcatcgatggatgtatgatcgatcgtgtcaaagaggcctagctggcaggacccgacacgacgatggtctccatctatgaatataaataccattattaaagtgtgctaagcaaaaaaaaaaaaaaaaaaggccccta

SEQ ID NO: 13441 - DNA, 1012 bp, Sorghum bicolor
  Clone ID: SORBI-28MAY03-CLUS5429_1
gccggccgggtccgagaaaaaaaaacgagcggagaacgccgcttccggtcctgttcgcggctcgtgatttcgccgccggagagccgagggagagggagcgagatggggttcgtcggagacacgatggagtcgatccgctcgatgcagatccgccaagtgctcacgcagatcatcagcctcggtatgattgttacctctgcgttaatcatatggaaggggttgatagttttcacggggagcgagtcaccagttgtagtggttctctctggtagcatggagcctggatttaaaaggggtgatatcctgtttttgcatatgagcaaagatcctattcgcacgggagaaatagttgttttcaatgtcgatggtcgtgaaattccaattgttcaccgtgtgattaaggtccatgaacgtcaggacactgcagaagtggacatcctcaccaaaggtgacaataattttggggacgaccgactattatatgcacatgggcagctttggctccagcaacatcacattatgggacgtgccgtgggctaccttccatatgttggctgggttacaattatcatgactgagaaaccatttattaagtacctgctgattggcgcattgggcttgctggtcataacgtcgaaagattagagatgccaaacttcagtgccatgtagattttgctcttatggtgcaacagcagaggtcagtggcttcgcagcgttaagagaagccgttctgttccaccatgtatcaaacgagaagaattctttatctactgtgagggcacctgcccactaattggatagtcggttctcatccagcattcatctttttgtagttgtgccatagctaatgagttgaatcagtcgtcggtggttatattcgatgaagataactcttcattgcagccttgcaggaaacggcgctagactatttgcaatgggagtaaaatgtagcagcggccatctgggtctctaaacttccaaaattcatagccacgtaaacggaaacggag

SEQ ID NO: 13442 - DNA, 498 bp, Sorghum bicolor
  Clone ID: LIB5047-007-R1-XP1-H10
gccggccgggtctcgcaggagaatagttgtttttaacatcgatggccgtgaaattccaattgttcaccgtgtaattaaggtccatgaacgtcagggcactgcagaagtcaacatcctcacaaaaggtgacaataattttggggatgaccgacttttatatgcacacggtcagctctggctccagcagcatcacattatgggacgtgctgttggctttcttccatatgttggctgggttacaattatcatgactgagaagccatttattaagtacctgctgattggtgcactgggcttgctggtcataacaacgaaagagtaaaggtgtcgacctccatcatataacttgctcttatggtatgaccgtatgagcaatgaacttagggggagctgttcgatttcatgatgtatcaaacaagaattttccttgatatgttataagagcaatagagcatactcactaatttaatataaaaaaaaaaaaaaaaaaggccccta

SEQ ID NO: 13443 - DNA, 979 bp, Sorghum bicolor
  Clone ID: SORBI-28MAY03-CLUS56862_1
cactcttgggccggcccttcgcggctccttctcgacccatccattcaccgtgtgccctctgctacggttgtgttgtgcaggcgtcggagggtttcctaagaatcatagggctcaagctgctggtttcgtcgcgttctgcctttctcctctggacggttctccgcctatttccgcggctttggtccgtgggatgggcgcgcaggtccgtcgctcctgtccatcgggccgcactttttgggggcatattttcgtacccagcagaccagaagagtccaaacggaaaactacgtgctctgtgagttcatttccccccgtccaacctgcaggataccgctggaggggaagatttcttcagtcaacaaagggactgccaaaaactggcatcggaccacagcaaaatttgtggagaaatgctaatatcctcaggatggttcatcgcctaaatccttgagatatattggaagtatggttgctgatgtccatcgtaccttactatatgggggcatatttttgtacccagcagaccagaagagtccaaacggaaaactacgtgttctgtatgaagtcttcccgatgtcattcctgatggaacaagctggaggccagtctttcacaggaaaacaacgggcccttgaacttgctcccgctaaacttcacgacagatccccaatattcctcgggagctacgatgacgtggaggagatcaaagcactgtacgcttcagagtcaaacaatgcttgatctttctgtctgaggacactcgcggtcgcagagatcaaagcactgtatgcttcagagtcaactgcttgatctttaaattaaattataataaaaaagttgtaaaaacagcactgcttgatctttctgcccgaggacaagcgcatcagacaagcgcatcatccacattgtaattgtattcatcagatatttattgtgttcttgccatctacgtaaaaatccattctacggccggttacgg

SEQ ID NO: 13444 - DNA, 1604 bp, Sorghum bicolor
  Clone ID: SORBI-28MAY03-CLUS5447_1
gcgtcgctcttgctctcagctgcccagtcccgtcgccggcctactcctcgtcaccatcgtcatcagcttcacggccgtcgtctcctactctgcccgtgtgtcagcgccgccgccgacgaccgccgccaagccgatcgaggtgtatgcggcatgcagcaagacgattatgcccaagaggtgcagcgtgaagctatcaaacttcgccaagaccttggcggagacgaaagcgataatcgccgggcccgagctcgccgccgcgaagctcaagagcgattcctgcatcacggagtgcgccaaggtcgtcgacgaggccacgtccaaagccgccgccgcgaaggcggacgaggaagcgctcaacgtgctcaatgggtacctcaacgagaaagtcatgtacagcgaagggccgatcggcccctgcgagtgcccagccggctcggcgcccacgggcacgagcgctacggcagcagcgcgtctctctcttcctcttccggtgctcgtgctctccgccctccgcctccctcgcgcggaacccaggcggcccccgccgcagccgcagctacgcaaaggcgaatggtggcacttttacattacctatgctagtttgcctcatgctatatttccaaaatggtgaagctcactatgatagcacgtgtcactgatggccttccattgtcagagggattagatgatggtcgggatctgaaggatgctgacttctacaagcagcaagcaaaactgttgttcaagaacttgtcaaaagggcagcatgaggcatcaaggatgtcaattgagactggaccataccttttccactacatcattgaaggccgtgtgtgctatttgactctgtgtgatcgttcttatcccaagaaacttgcattccaatatcttgaagatctcaaaaacgaatttgagaaagtcaatggcagtcaaattgaaactgctgcaaggccatatgcatttattaaatttgatgcattcatacagaagaccaagaaactttatttggattccagaacacagaggaaccttgccaagctgaatgatgagctctacgaggtgcaccagatcatgactcgcaatgttcaagaagttctcggtgtcggtgaaaaactagaccaggtgagtgagatgtcaagtaggttgacctctgatactagaatctatgcagacaaggcgaaagatctcaatcgccaggccttaatacgtaagtatgcccccgttgctattgtgattgggatagtactgatgctcttttggctgaagaacaagatatggtgacttggtgcatcccgtgcttcctgagttgcctatgttgatcctggttcaaaagatgcttcgatggcttatcccgcatctgccgattcaagcgagtactttagctgtcaaaagcaaaaccgtggtagtagatattcttggaattgcgcatttctattgacctgatctgcatagcagtatgatagttttcgtgagcgcaccatgtaagcgtcggaaatttattcaggttgctgacacacttaatgccatgtgttgtgacactttgagcacaaattatttatttaacatggcgggtgtgctgctggagcctggaggcaggcttttcc

SEQ ID NO: 13445 - DNA, 349 bp, Sorghum bicolor
  unsure (1)..(349): unsure at all n locations
  Clone ID: SORBI-28MAY03-CLUS4878_3
agcagtacgagcccgaggcagcactgctttcatcgatcggcagctgccccacgggaaagatgaagaaggagcggagccgatccaggaccatagatgatgaggacccgctgcggcagagcctgcgccgaggcgacgacgtggccccggccccggccacggccgcgccactggtcgacatgacggcgatggcgccgacaacggcgttgaagaagatgaaccacgccgcggcggggctgagccacggcgacagcagcggccaccgcgacagtagtagcgttagaagcgccatccgaccgagctctgctcgagtactgtgtttgcttcagctcagcngagctgcaggcccggc

SEQ ID NO: 13446 - DNA, 1344 bp, Sorghum bicolor
  Clone ID: SORBI-28MAY03-CLUS4878_1
cccgccgccgcgccccccgccggccgctccggctccgtgcgggacgcgggccgcgtgcgcgccccaggcaggccgggctgctcgccggcgtccggacgccgccgtgcggcagctgctgcaccaagaagtacgcgagcctcgtgcagatcccatggagggtgttctgcaagaaggggtgcaacgcggacggcgacacctgggacgagtgcataggaaaatgtactgaaatatgctacaaagatccggtgttagaagatcgccagtggagcgcctatattgatcgatctccagggcaggatagttactctttggagtgcttcaatgcttgtgtgtctggctgtggatacaggtttgatgtcccaacggagaaggtcgaagagatcaagcccaataggccgtccaagccgccagctcctgaacctgatgtgaaacggactaagggtccagattgtactgaagatgtgccgtgcacatcggcctagaatctagccccgtttgtgttgacgtgcctctccctaaattttgtaaagctgatgtgcttctccatgttgtatacctactcgacctaatttctctctttttttagtcaatgtgtttggaactttagctactaaagtgactaaaatttagctagctaaaatttagcaagggagtctaaagaaaaacaatgttccaaaattgtgtgtcagaggatatgtccgtctgaacaacggagcgagcaagcacatcatggcagccgcggcgtgcacgccggctaccgcgccgccgtcggggagcccagggcgtgggtgtggctgaggatggagttgagcctctgcagccggaggtcctcccggaactgccggatgaacagctctgcgcgcgcgttcaactccgccttcccctccagcgccagctcccctgctttcgataccctccgccagtccgccaccaccaccttcgctgctggcttcttcttcttgttctccggcgtcggcaacgcagcaggggcagccgtggcagagcctgctgctgctaatggcggcggcggcgacgccgttggcttcgcgcgatgccgctgggctagcgcgtacgcctcgtccaagctgatggactcatcatggtcttgctccttctctctgccctgtcctcctcctcctccgacgacgacggtggcggtgcgggaggcgcgtcgtcctccgctgttgccatcgccacaggcgcgccggctgttgcagccaccacctcctgtggattgcgccctcgtgcgccgtgaaaggtgatggcctggctgaaggtttgatggcctgatgaggaatgcgccaatgtaatgtacccaagtaatggagtcagagtttctactcc

SEQ ID NO: 13447 - DNA, 469 bp, Sorghum bicolor
  Clone ID: LIB3476-001-Q6-K2-C4
atggaactaaactattttagcttcttttagtcaatgtgtttggaactttagctactaaagtgactaaagtttagctagctaaaatttagcaaggggatccaaacagggcctaaatgtaattgatcctctcagggatgatcataattattattgatttgatttgcaccattatttggagagcagacactccatttccaaatgccccaactctgttggcatcaccctaggagcatggttggctcaggctctaagcagaacattagttgagttggtcacgaatcatggactgtatttcaactaacttgtcatggtaatttttcaactcctccaatcctattccctcaaagtcgccattcatcatgcgcaccagttttggatcaaaattcttctcccgggccttcagctcctcacctcggagttttgaagcctctatctgtttcttcagctttgctttctttttcatgaaatg

SEQ ID NO: 13448 - DNA, 683 bp, Sorghum bicolor
  Clone ID: SORBI-28MAY03-CLUS6197_1
gcacgcggccaccgcgccagcccccgtaaacaccaaagccaaaagaggcggcttgcccggcctgcccgtcgccttggcccttggtgccgcgcgccatggccggcaccaagagcaaatcgtccaccaaggccggctcgccgctcctcggcaagtacgagctcggccacctcctcggccggggcaacttcgccaaggtataccacgcgcgctgcctcgccggtggcgaccccgtggccgtgaaggtgctggacaagccggagctgtccgccacgggcatggcggcgcggctcctgcgcgaggtctccgccatgcggcgcctgagccaccccaacgtgctccgcctccacgaggtgctggccacgcggtccaaggtgtacctcgtcatggagctggccccgggcggggacctactgtcccgcctcgcctccctgccgtcgcggaggctccccgagcacgcggcgcggcgcgtgttcctgcagctagcgtcggcgctcatctacagccacgcgcgcggggtgttccaccgcgacgtcaagccgcagaacgtgctcctggacgccgacggcaacctcaaggtgtccgacttcggcctcgccgcgctcccggactcgctccgcgacgacggccacctgcacacggcgtgcggcaccccggcgttcgcggcgcccgaggtgctccgccgc

SEQ ID NO: 13449 - DNA, 1203 bp, Sorghum bicolor
  Clone ID: SORBI-28MAY03-CLUS629_1
cacgtcccattgccttgcatctggcgacattatgatttcttgccttggggacaaggaggggacggcagctggcaatggcttcctgctgttagattcagagtttaatgttaaagggcgttgggaaaagccaggtcacagtcccttgtttggatatgacttctggtaccagcctcgccacaagacgatgatcagttcgtcatggggagcccctgcagcattcaggacaggtttcaatcttcaacatgtccaggatggcctgtacggaaggcatctgcacgtatacgactggcctggtggtgagctcaagcagacacttgatctaggtgacactggacttcttccccttgaggtgaggtttttacatgatccatcaaaggacactggctatgttggctgtgctttgacaagcaacatggtgagatttttcaagaccgcggatggatcatggagccatgaggttgctatctctgtgaaaccattgaaggtccggaactggattctgccagaaatgccaggattgataactgatttcgttctctctcttgacgaccgttatctgtacttggtaaattggcttcatggcgatatcaggcagtacaacattgaggatcctgcaaaacctttcttggctggacaagtatgggttggtggtcttcttcaaaagggcagtgatgtcgtctatgtcactgatgatggtcaagaagaacagtataatgtgcctcaagtcaagggtcatcgacttagaggtggaccgcagatgattcaactgagcttggatggcaagaggatatacgtgaccaactcacttttcagccgttgggatgagcagttctttggggatgattttgtcaagaagggctcccacatgttgcagatcgatgtcgacaccgagaaaggagggctggctatcaaccccaacttcttcgtagattttggcaccgagcctgatggtcctgccctggcccatgagatgagatatcctggtggggactgcacctctgatatatggatctgaggtcaaggatttgggataacaggctgctgtagattcccgctgttgtatgcactgtaattaacatggtatccgtgcagtgtttcatcttgtattgtgactactgccagtgtaataaggcatggtttcatgagaactttagattaataaagaagtctcgattctaaaaaaaaaaaaaaaagggggggccc

SEQ ID NO: 13450 - DNA, 1288 bp, Sorghum bicolor
  Clone ID: SORBI-28MAY03-CLUS24598_1
gcacgaggcctcctcccagctactacctgttggaaagagaggccgatcgatccatcctgtcagcagccatgacgaacggctacctgttccgtgagtacatcggcgcgcagtccaccggcgtgcagttctccgacgtgcccatcaacgccttgctcagcttccacttcatcctctccttcgccatcgactacacgccggtggggcagcagccgaagccggtgccgaccaacggcgtgttcagcccgttctgggacactggcaacctgaccccggccgccgtggccgccatcaaggccgcgcaccccaacgtcgccgtcatggcggggctcggcggcgacagcgtgcaggacatcgtcaaggccgtcttcaccccgacctccgtcgactcgtgggtgggcaacgccgtggcgtcgctcacgggcatcatcaacacgtacgggctcgacggcgtggacgtggactacgagcacttcgccgacggcgccgacgtcgacacgttcgtcgagtgcatcggccgactcctgacgcagctcaagcagaagatgcccaacatcgccacctccatcgcgccgttcgaggaccccgtggttcagaagtactaccagccgctctggagcaagtactccggcgtcatcgactacgtcaacttccagttctacggctacggcgccaacaccgacgtgcagacgtacgtcatgttctacaacaaccagtcggcgaactaccccggcggcaaggtcctcgccagcttcaagaccggcaacgtcaccggactgctctcgccggagcagggcatcagtgcggccaaggagctgcagcggcagaacaagctgcccgggctgttcatctggtcagcggacagctccaagcagagcagctacggcttcaagtacgagacggaggcgcagcagatcattgccaaccactgatctgccggatcaggacttggcttaacaaggggtcacactttttatattacaataaataaataataaacctctcaggtcaacaacaattacttgctggttaaattaaagaggttggtgttgattcaatgatcagaataatggtgactgaaaaaaatgcaagtttaaggaacttaataagcttgttgtttgcgtgcagtattattaagagtgaaaaccagtatatccacctcctgtgtttgggttctgcgaagcactggagcattactggaaattcgtagatctcatcgagattttttatataaatatttatccgacactataaaaaatgatttttcaaatacaacaagctttggtacgtg

SEQ ID NO: 13451 - DNA, 1787 bp, Sorghum bicolor
  Clone ID: SORBI-28MAY03-CLUS25306_1
gcacgaggaccgtcgatagcgggggtggcggcgccgtggcggcgggggcggcggttgggatgccgtcccagggaacggtgccggtgcggcggcggtgcgagggcacggccatgggagccatcacgcttgacctccgccccggcctcggcgtcggccccttcaccctcgggatgccgatctccgatgcgtttgcgcagatagagcgccagccaaatatctacgacgttgtccacgtgaagtacttcgacgaggagcctctcaagctggactttgtcattagctttccggaccatggatttcacctacgctttgatccttggtcgcagagactccgtcttgtagaaatttatgatgttaagagattgcaattgcgatatgcgacagctttaattggtggcccgtcaacattagccacttttgcagctgtgtatgcactctttggacctactttccctggtatatatgacaaagagaggggtatttatacgttgttctacccaggtttatcctttgcattccctattcccagccaatatacaaatctattcaccaatggggaagtggcagatttgcccctggaattcccagacggaacgacccctgttacttgccgggtttgtatatacgacagctcgacagatagcaaggtcggggttggatctttgatggacaaagcagtggtacctgcactgcctgcaggcagtctgtatatggaggaggtgcacgccaagcttggagaagaactttggttcacaatagggggccagcatattccttttggtgcatcaccacaggatgtctggactgaattgggtcgtccttgtggtatccatcagaagcaggtggatcaaatggtcatacactctgcatcagaaccccggcctcgtacaacactttgtggtgattacttctacaactacttctcgcgtggaattgatatcttatttgatggacagacacataagataaagaagtttgttttgcacacaaacttccctggtcattcagatttcaactcatataagaaatgcaactttgttatatatgacgctgaagctgaaggtacagttcagcctggtaatgtctcgaaaaattgcataacgcctagtacaaaatgggaacaagtgaaggagatcctcggtgattgtggccgagctgcaatccagacacaaggctccatgaacaatccatttggatcgacttttgtatatggatatcagaatattgctttcgaggtgatgaaaaatggatatattgcaactgttactctcttccagtcatgagtgtgctacatgtgttgctgctctgaatttttgctgcatagacaacaaagctgggtaacctacagaaagaaggtgtacttgtgcttcagcgcagcagcaatttcaagccgaagccaactctatggagccttctgacgatgcttggtttatggaatgcgatgcagcctcccagtcgatatggattaacaccgtggcatgtaattgtgctgtagatatgccgctcattgtaccagaactaactgtactctgtgacctcaccttgtgtacataaatggtctttatttgttgaaagaaaatgtatatacatactgccatgtggtcgcctaatggaacgttgtttcttagttgaaaaaaaaaaaaaaaaaaaactcgagccgccgccaaggcctccacggccttcgcccacaagaaggagctcgccgcgccggcgcccgcgcagcaccgcgcgggctcgagccgccggaccaagccatgccgcgtgcgcgccgtcgcctcgcctgcgcg

SEQ ID NO: 13452 - DNA, 1163 bp, Sorghum bicolor
  Clone ID: SORBI-28MAY03-CLUS26043_1
ccctcgcgcctcccacacacttgcccaaccacacatgcacatgcgcgtggtcctccccctctcccctctccccttccccttccccttgcttgtatagttgccattgccaaccacctccttcctcggcccctctttcttgccgtttctccaaccaacacccaagaaaccacccgcgaccgacgtcggacgatgaagagggaaggccggcagcacggcaccgtccggatcagccgcagcaaggtgctcaagaccaccgccgacgccgacgccgacgccgagtcggcagcagcggtggcgttcgcgctggcggcgacggagaagaaggcggcggcggggaagccgacgaacgcgtcgaggagcacgggcaagtgccgtcgtccccggtgcgcggggtgccacgcgcaccccgtcaccaaggcgcgggacaaggccaagggcgcgcacaagctccgcgcctgcgacgtcgcgctcaaccaccgcctcgtgtcctggcgcgtcgtcgacgaccagggtagcggcgtccccgagtacaggggcaagtccgcatcctccctgctggcctacctggccggcggaagtgggaacagctggcacgaggacgacgacgacaccagcgaaggcgggatcggagcgcccgaagccgggctctctgacctctacgacctcttcgtcggccgccgcgccgacgccgaagccgaagccgatcctgatccggcggcgcgtgatactgatttagatgatgtaggagagattcaagcaattggagagccggggctgctgctggacggcgatgatggcaaggaagatggggatgagaaggaagaagaagacatggggttctgcatggtcggcatcaccatcgcggtggagttctccgacggcgaggaggactggatcgtggtggaggaggtctgaatctgacccacaatctgaatcccatctcgtcgaattgggaattggaatctcgtcgatttcgatttgggaattcaatgccaaattgcgaataagactcgcccatcctctgtcggtggtgtgtatgtgtatatactactactgctctgttaattgcttgtgtctatgtgcatatggtgactgttaaactgattgtggtcatggattattccctgattcaaaaacatcaatgaatttttcatctgtgaatg

SEQ ID NO: 13453 - DNA, 1446 bp, Sorghum bicolor
  Clone ID: SORBI-28MAY03-CLUS14_2
tcgacccacgtccgtacttcttggtcctgacgacggtgcgttcagaccagtgacgacgacgttgtgaggagagggcaaggaagcaaacctgccagggaggtggcgatggagaggtacgaggtgatcaaggacataggatcgggtaacttcggggtggccaagctggtccgggacgtcaggaccaaggagctcttcgccgtcaagttcatcgagcgggggatgaagattgatgagaatgtccaaagagagatcatgaaccacaggtcgctgaggcatccaaacatagttaaatttaaggaggttgtgctaactcccacacatttggccatagttatggaatatgctgctggcggtgagctatttgaaaggatctgcaaagctggaagatttagtgaggatgaggcaagattcttcttccaacaactgatttcaggagttagctattgtcattcaatgcaaatatgtcatagagatttgaaactagaaaacactctcctggatggtagtatagcacctcggctaaagatatttgattttggttactccaagtcctctgtgttgcactctcaaccaaaatcaactgtcgggacaccagcttacattgctccagaggtccttgctagaaaggaatatgatggaaaggtcgccgatgtttggtcatgtggagttactctgtatgtgatgcttgttggtgcttatccatttgaggaccccgacgaaccgaagaatttccgcaagacgcttactcggattctcagtgtccaatatgcggttcctgattttgtccgagtttcaatggagtgcagacatctgctgtctcggatctttgtggcgatccctgagcaacggataaccatcccagagatcaagaaccacccgtggttcttgaagaacctgcccatcgagatgaccgacgagtaccagatgaacctacagctggttgacatgaatggcccctcgcaaagtctggaggagatcatgaccatcatacaagaggcccggaagcccggtgacgggctgaagcattcgggacagctccctggcctggggagcatggagctggatgacattgatgtcgacgacatagatgttgaggacagcggtgactttgtatgtgccttgtgacgtggttcaagctgtctcggcgctgttgctgtcacgggactctcccccacccttctggtcttgtgttctactgttattccatcttgtttcagcgagctccgagctcccattttgttgttgtaatatcacatgttttgcgtaatcaaggtagtcacgctgtggataaataatagacgttattatgtcatgtattcttgctgaattcttgttcaggtcctgtgtttgccctgtatgaactgggcagtttcatgagtgcctcagcctgatcttttgatctgctgcatgtagccaatgtgttttttattattattattttactag

SEQ ID NO: 13454 - DNA, 918 bp, Sorghum bicolor
  Clone ID: SORBI-28MAY03-CLUS14_1
ccgggacttcgacccggccggccctatcaaaagcccccttccacaccgcactcccgtgaccttcctccccttcccctcctctgcccccaccgcccgcttccttctgccttgctccgttgcttcctcccaccacagtccactccactcgccggccctgcagctcagtatttgactgagattggtggtggagctgctagcagctcgactcgcttgctacttcttggtcctgacgacggtgcgttcagaccagtgacgacgacgagttgtgaggagagggctaggaagcaagcctgccagggaggtggcgatggagaggtacgaggtgatcaaggacataggatcgggcaacttcggggtggccaagctggtccgggacgtcaggaccaaggagctcttcgccgtcaagttcatcgagcgggggatgaagattgatgagaatgtccaaagagagatcatgaaccacaggtcgctgaggcatccaaacatagttaaatttaaggaggttgtgctaactcccacacatttggccatagttatggaatatgctgctggcggtgagctgtttgaaaggatctggaggacgttatccatcggatggatgtgctgaatcctcagacgatgaaccagtgccagctgctcccatcatgttgcagagtcttatgggcaaggtcactacaaaaacctctccgagtctgaaaggcagtacttcgctaatccgaatacatttattgctaaagcttctttacactcgatagatccgttgttaagcagtacttttgacaggacaatcgtgctgtaagagcatctttaagggactttgcacatgaattttgcatttggtggtggttgcaaaaatctcaactcatttgcaaagtcttaaaattagcccactcccaaagaccttgcatttagacctgc

SEQ ID NO: 13455 - DNA, 763 bp, Sorghum bicolor
  unsure (1)..(763): unsure at all n locations
  Clone ID: LIB5049-001-R1-XP1-B9
gccggccgggctgcgcttctgccttgctccgttgcttcctcccaccacagtccactccactcgccggccctgcagctcagtatttgactgagattggtggtggagctgctagcagctcgactcgcttgctacttcttggtcctgacgacggtgcgttcagaccagtgacgacgacgagttgtgaggagagggctaggaagcaagcctgccagggaggtggcgatggagaggtacgaggtgatcaaggacataggatcgggcaacttcggggtggccaagctggtccgggacgtcaggaccaaggagctcttcgccgtcaagttcatcgagcgggggatgaagattgatgagaatgtccaaagagagatcatgaaccacaggtcgctgaggcatccaaacatagttaaatttaaggagtgctcattttgctacagtgctcattttgccaaaaaaaaatttggaactaaacaaggcctcaatgtgcatcaggaggacgttatccatcggatggatgtgctgaatcctcagacgatgaaccagtgccagctgctcccatcatgttgcagagtcttatgggcaaggtcactacaaaaacctctccgagtctgaaaggcagtacttcgctaatccgaatacatttattgctanagcttctttacactcgatagatccgttgntaagcagtacttttgacaagacaatcgtgctgtaagagcatctttaagggactttgcacatgaattttgcatttggtggtgtttgc

SEQ ID NO: 13456 - DNA, 840 bp, Sorghum bicolor
  Clone ID: SORBI-28MAY03-CLUS16354_1
tgagaaacagggtgagcagaatgatgccccagcagcggatgagaacaaagataacaaggattctgctgcaaatgaggaggaagaaaaggaagaggacaaggagatgactttggaggaatatgaaaaaataaaagaggagaagaggaaagcactacttgcattgaaggctgaagagagaaaagttgaagttgataaggatctgcagtctctgcagccactttcaaacaagaaagaaaatgatgaagttttcattaagctgggttctgacaaggataaaaagaaggaaattgctgagcgtgatgagcgtgccaagaagtcggtgagcatcaatgagttcctgaaacctgctgaaggagaaaggtactatggtggccgtggtcgtggaaggggtggccgcggggagcgtggtggttttagaggtggatacggagggggatacaatcgtggccctgctgctgctccatccattgaagatcaagctcaattcccaagccttggtgggaagtgaagggtgtgcagtgtcaccgagcattgcattgtctgctgttgtcatctttaaattttgtccgacattaaaattctgtgccacgatttaaacggaacaaataatgatgttgcatgtggctttctttcattatgtggtacgtgacgttgtataccggagtttatcagatttagcctctaattttgtaggctagctttatcattttgttgaagatcgacaatcctagcttgtttgtcacctgcttgccttcgttttcatctttgtccagtatgcgatatggctttttgtgtgtgatgaggctgttcgtatattgaaaagacatgaaagtacttgga

SEQ ID NO: 13457 - DNA, 878 bp, Sorghum bicolor
  Clone ID: SORBI-28MAY03-CLUS16485_1
ccgggaaaaaaagatccaaccaggtcgttcagccgcagattagcaggccgcctgcgctgacaagctccccctttcccctcagcctcctctccggtgtacggctccgacgagatggccgccccgctccggcggagcctcccctcccttggccgcgcgcttctcacgccggctccggcgcggatgctctccgcggaggcctccgatgccctcgtcgagatcaagcctggggagatcgggatggtctccggcatccctgaggagcacctccgccgcaaggttttaatttattcaccagctaggactgcatcccagcaaggttcaggcaaagtcgggaggtggaaaattaactttttgtcaacccaaaagtgggagaacccgttgatgggatggacatctactggggacccatatgctaatgtcggtgaagcaggacttacattcgacagtgcggagtcagcaaaggcgtttgctgaaaaacatggatggaattatgtggttcggaaacgccatacacctcttctgaagcctaaggcttacgctgagaacttcaagtggagaggccctccgaaggcggagcaagcatgaggtcaagacctctattctgtgagcctgacattgggtccacgttgttttccacctgagctctagacctctagtctgtgagcctgacattgggacgacgttattttcctcctggacagcctttgctttcaatcgtgtccgttgtgaaagtacgagctagaatatgcatctatcaaacctgtaataatcatgatctgcaatcaaacaaaatagtatccttccaaaacgtttgttcgtggatgatgacattgtatttcaatcctgtgtgcttgcttggctggtatcttaaaagagac

SEQ ID NO: 13458 - DNA, 1356 bp, Sorghum bicolor
  Clone ID: SORBI-28MAY03-CLUS17319_1
atgggccgggcctcctttagctcgtcgatcacttgatattttttacagacgggcatatatataaacatacacatacagtcgatgacttaatatttttccacgacgggccggggcatatatataaagtataaacatacacatacagataatggcttcctctagccctcatcatcgtgcagccgtcgtcgccggcgtgctgctggtggtggcggccgccctgtgctcccgcggcgccatggcgcagctgaccgcggactactacgactgcacatgccctgacgcctacaacatcgtgaagaatgtgctcatcgaggcgcacaagtcggacgtgcgcatctacgccagcctcacccgcctccatttccacgactgcttcgtccagggctgcgacggctcggtgctgttggacgccttgccgggggtggccaactctacggagaaattggcgccggcgaacaacaactcggcgcgggggttcccggtggtggacaaagtgaaggcggcgctggagaacgcctgccccggcgtcgtctcctgcgccgacatcctcgccctcgccgcagagctctccgtcgagctgcccgggcgcagaaagtgtgccgtcccccttcgacaacctcaccgtgctgcagcaaaagttcaccgccgtcggccttcacaccgtcgacctcgtcgccctctcaggggctcacacatttggccgggtgcagtgccagttcgtgacgagccggctgtacaacttcagcggcaccggccggccggaccctacgctcaacggcggctaccgggcgttcctgacccagaggtgccctctgaacggcaacgggtcagccctgaacgacttggatcccacgacgcccaacctcttcgacaaccactactacaccaacctcgaggtgaaccgaggcttcctcaactccgatcaggagctcaagtcctcgccgccggcgcagggcgtcacggcgcccatcgtcgaccagttcgccagcagccaggacgccttcttcgacaacttcgcgcagtccatgatcaacatgggcaacattcagccactcacggacccctccaagggagaagtccgctgcaactgccgagtggctaattaatattaattaacacgacgatagctggaaatgatgggtgaatcgatcacatcagcaagagtactgatgatatatatggactctatatatgatgcacatcgatcagcacctcatttcgtattgctgtcaacttcaattcatagttgtttataaatgtgcaataaagaggaactcaatttctcctgcaaaaaagaagcatatatcactgtatcgtcggttgctttgcaacatctatatatatgttttctttgtt

SEQ ID NO: 13459 - DNA, 1069 bp, Sorghum bicolor
  Clone ID: SORBI-28MAY03-CLUS1739_1
ccgggcgtctcatcattttcccctcgtgcgctctctcgaaccttccaaagcccccgaaccctagtgagctcggaaccctagccgcgcgcggatctcggcttgcttgccccctcctccacgccagccatggatgacgacttcgagatgccgaccgccggcgccgacgagatgatgggcgacgacgagatgggcgacttcggcggcgatgagggcccggtgttgaaggtgggcgaggagaaggaggttggcaagcaggggctcaagaagaagctgctcaaggagggcgagggctgggagacgcccgaggtcggcgacgaggttgaagtgcattacacgggtacactccttgatggaacaaagtttgactcaagccgtgatcgtggagatcctttcaagttcaagcttggacaaggtcaagtgataaagggttgggatcaaggcatcaagaccatgaagaaaggagaaaatgctgtttttaccattcctccagaactggcttatggagcatctggttcaccgccaactattccaccaaatgcaaccctgcagtttgatgttgagctgctttcatggaccagtgtcaaagatatttgcaaagatggcggcatattcaagaagattcttaaagagggggagaagtgggagaacccaaaggatcctgatgaagtacttgtgaaatatgaggcccgtctcgaagatggtactgttgtatccaagtctgagggggttgagttcactgtaaaagatgggtacttttgtcctgccctggccaaagctgtcaagaccatgaaaaaggcagagaaggtgctccttacagtaaagccacaatatggatttggcgagaaaggtagaccagcagctggagaggaaggtggtgtgccaccaaatgccactctgcacattgaccttgagttggtttcgtggaagactgtcacagaaattggtgatgataagaaaatccttaagaaggttctccaggagggagaaggttatgagctgtccaacgagggtgccgttgttgaagtcaaaattaccggaaagcttcaagatggcacagtgtttacaaaga

SEQ ID NO: 13460 - DNA, 890 bp, Sorghum bicolor
  unsure (1)..(890): unsure at all n locations
  Clone ID: SORBI-28MAY03-CLUS18133_1
gccggccgggttgcggccggccgggccgggctcttgcttctccaactccccaaaccctagccttgctgcttgttgcggcggcggcggagatggccaagtctctgcgatccaagcgggagaagcggctgcggacgttgcgccgggagatagcggagcccttctacgataagaaggaggccgccaagctcgccgcgcaggccgccgcccttgctgctccaccgctccaggtccgcggccccccgccgtcgcaggatgccggcagctcccgtggcgctagctcggcctctgctatggatgtggagatgtctgatgaagggaacaacaggtctaaaaccttgttgaagccacttggaaccattagcaagaagaaagtacagctccatttgaagatcaagaaagacaagagaaaggctaggaagaaggggaagttttcctttaagaagtagaggcgtagagtcttattgtcttataaatcatgcagttttgtttccagtttgaacaatcaatgtaacgtcagtcatgtgcacctaagtccattcttgggtcgcctactaatattatgatgaaatgatgagtatgcaaaaagatagtggtgacctatcagctgtttctgtttcactggtataaatgttaagtactgaaattgctgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13461 - DNA, 980 bp, Sorghum bicolor
  Clone ID: SORBI-28MAY03-CLUS1791_1
gcacgaggcttttcttttctttttttccctttccgccggcggaaaacaacctgagtcgccgccgtctccgttctcgccgtcccctccgactccgatcctcgacgccgacgcacccaccggaaccctcctcctcagccgtcgctatgtcgatcttcgagtacaacgggagcgccgtggtggcgatggtggggaagaactgcttcgcgatcgccagcgaccgccgcctcggcgtgcagctgcagacgatcgccaccgacttccagcgggtgttcaagatccacgacaagctctacatcgggctctccgggctcgccacagacgcccagacgctgtatcagcgactggtgttcaggcacaagctgtatcagctgcgggaggagagggacatgaagcctgagaccttcgccagccttgtctctgcgctcctctacgagaagagattcgggccatatttctgccagccagtcattgctggacttggagatgatgatgtaccatttatttgtaccatggactgcatcggtgccaaggaactagcaaaagattttgtggtttctgggacagcgtcagaatctttgtatggtgcttgtgaatccatgtacaagccaaatatggaacctgatgaactattcgagactatatcccaagctctgaattcttcagtagaccgtgactgccttagcgggtggggtggttatgttctgattgtgacgccgactgaagtgaaggagcgtgtgatgaagagcaggatggactaagtcctgccttatgtagttatttaggagattgtttcttcattcggcctgccctgccctgtactacggcgtacagaattcagaaaacctgtgcactacatttcttcctgacccctgctttgcttcacttctgcccggcgtcctgctgtgcgggtgctgcccctgctcttttccttggctgggcttgtggcccctcggttatggtataatcgacatacctgtttg

SEQ ID NO: 13462 - DNA, 667 bp, Sorghum bicolor
  unsure (1)..(667): unsure at all n locations
  Clone ID: LIB5049-008-R1-XP1-D1
gccggccgggccgggacttttcttttctttttttccctttccgccggcggaaaacaacctgagtcgccgccgtctccgttctcgccgtcgcctctcctgccgccgctcccgcaggccacatcagcgccaaccatgtcgatcttcgagtacaacgggagcgccgtggtggcgatggtggggaagaactgcttcgcgatcgccagcgaccgccgcctcggcgtgcagctgcagacgatcgccaccgacttccagcgggtgttcaagatccacgacaagctctacatcggactctccgggctcgccacagacgcccagacgctgtatcagcgactggtgttcaggcacaagctgtaccagctgagggaggagagggacatgaagcccgagacctttgccagccttgtttcagccctactctatgagaaaaggtttgggccatacttctgccaaccagttattgctggcctaggagacaacaatgagccatttatatgtaccatggattgcattggtgccaaggaactagcaaaagattttgtggtctctggtactgcttcagaatcactttatggtgcttgtgagtccatgtataagccaaacatggaacctgaggaactgttcgagancatctcacaagcattgcaggcgtctggtgatcgtgactgcc

SEQ ID NO: 13463 - DNA, 742 bp, Sorghum bicolor
  Clone ID: SORBI-28MAY03-CLUS18156_1
cggccgctcaggcgccggccggtaccggacgcacaccccgctcgagccgccgccgccgtcgcatcccgcagcgaaccctagccctcctcagcggcggcttggagctcccccagccatgacgttcaagcggaggaatggcggtcgcaacaagcacgggcgcggccacgtcaagtacatccgctgctccaactgcgcaaaatgctgtcctaaggataaggctatcaagcggttcttggtgaggaacattgtcgagcaggctgctgtgagagatgtgcaggaggcttgtgtgcatgatggatatgttcttcccaaattgtacgcaaaggttcatcactgtgtctcatgcgcaatccatgcgcacattgtccgtgtccgctctcgtgagaacaggaggaaccgtgagcccccgcagcgtttcaggcgccgggatgacggcccaaggccaggacagggcccaccgcgcccagggggtgctgcacctgcagctgcccctgcagccgctcctcgtacctaagttcaggaatgcgtttcagggcttagttttgtcacctatgggataatggatttttcctgttttgagaaaccaatgttactgtatccccttgatgttaaacttgtagtacaatttgtggttcgacccgttctcactctttgtgctgttaagttctcttccaacttgatatatgttgccatacgaagctatgaagattctggttgcttgttgcaattgcattttgttttg

SEQ ID NO: 13464 - DNA, 1354 bp, Sorghum bicolor
  Clone ID: SORBI-28MAY03-CLUS30876_1
gcacgagggcgggtcgggccgcccctggtaccgcagccccgcggctatgcagccgggcgaggttggcgactttgctgcgtgcggggctgcccactgcggcggggcgagccgactcccgcgcggtcccggccgtccccctcacgcccccgctggcccctggcttcccctccgcgctccgtgtcccggtccttccggcgccagctgccgcttcggctggtgcggccggtccggttgctgccgcggcggagctactggagccggcccgtgaccctgctgggcttcccgccttcgttgtataggctggcttgtctccttcatggggcgctttggtgtatggcccgcccggcggcggcacctcttcggtggccttggcatttgccacggggggccggcccgacttcattagtgtgaagggtcctgaactgcttaccatgtggtttggtgagagcgaggctaatgtccgtgagatttttgataaggctaggcagtctgctccatgtgtcctcttcttcgatgagcttgattccattgctactcagagaggaagcagtgttggtgacgcaggtggtgctgctgatagggtgttgaaccagctgcttactgagatggatggcatgaatgctaagaagactgttttcatcatcggtgcaactaacagaccagatatcattgaccctgccctgctgaggccagggcgtctggatcagcttatctacattcctctacctgatgagcaatccaggctccagatcttcaaagcctgcctcaggaagtctcctgtggctaaggatgtcgacttgaatgctcttgccaaatacacccagggtttcagtggtgcagatatcactgagatctgccagcgtgcgtgcaagtatgctatcagggagaacatcgagaaggatatcgagagggagcggcgcaggaaggacaaccctgaggctatggaggaagacgaggtagacgacattgctgagatcaaggctgctcacttcgaggagtcgatgaagttcgcccgacgcagtgttagtgatgccgacatccgcaagtaccaggccttcgcccagacactccagcagtcccgtgggtttggcagcgagttccgtttcccggaccaaccgacggcagctgcgggatctgctggtgcggccgatccttttgcatccgctgcagcagcagctgacgatgatgacttgtataattagtttagcagtcctgtgacgcttcttgagtactttccttcgttatatatgcttattatatatattaatgttacacttatgtgtaagacacgggcagtggctgtacctatacagttaagttaatattttattagtataggtccttaaatcgtgca

SEQ ID NO: 13465 - DNA, 1268 bp, Sorghum bicolor
  Clone ID: SORBI-28MAY03-CLUS3162_1
ctactggtttggtggtgcgcaggcgaatccaacctgaatcggggtcgccggagatcaaactgctttattgttggagatcaaattgctctctaggatggcttctagctagcacaagtagcttcatctcatttcctgtgagattgatcatgacttctgtgtgtcttttgcatggttgcagcgaggtgtaggcggacgctggaattattctaatcttgttattaggatcataaacaaaatattgtgactatcatatgttcttctgccacaaagttatggcacaacagcgtttcgttctttccccacgtcttgcaggaatggaatcatttcctgttaaagtttttgttcgtgcgcctatcatctgtgttgaaccagagttctcttcgtccttcaggaataaaataccgccttctgcaggcccgaggcggacctccacgaaaccaccaccagaccacgagcacaagaggtcaagaacctgacaacctgtacgaggagaggaggaggaggaggagatggccggcgccgagggcgagaggtgggtggggctagcgacggacttctcggaggggagccgggcggcgctgcggtgggcggcggccaacctgctgcgcgccggcgaccacctgctgctgctgcacgtcatcaaggagcccgactacgagcagagcgaggccatcctctgggaatccaccggctccccgttgattcccctctcggaattctctgaccctattatcgcgaagaaatatggagcaaagcccgacatagaaaccttggacatcctgaacactacagctacccagaaggagattatggtggttgtgaaagtcctgtggggagatccacgtgagaagctctgtcaagttatccatgacaccccgttgagctgcttggttataggaagcaggggccttggcaagctcaagagggtgctcttgggaagtgtcagcgactatgtcgtgaacaacgcaacctgccctgtcaccgtcgtcaagtcatcaagcaccgaaggttgatctcatcaccgaaatgcctgaatgtgttgttataataaagatggttggcctgatgaagaacatgcactagtttcttgctatctgaaacatgttgaaccaggcagttctattgtaataatagataaactaccttatgaaggacatggttgtgtaatagcactgtttgccagagtagatgtactatgcttttgttgctgtatgagtgatgtttatatctttgaggttttgaagaagtggatcctattattcttctgc

SEQ ID NO: 13466 - DNA, 2050 bp, Sorghum bicolor
  Clone ID: SORBI-28MAY03-CLUS32224_1
tgggtattctcccccctgctaaagacccagcaggcatatagatcggtcctcgtcaagccgccccgaaggtgattcacgggtgcaccgctgcactttgccggccagctcgatcagggggaggcccgacgaagacgtggcagcagaggtccgagtccgatccatgggcgaggaagcagcggccgcgcccaccgtggcagcagcggcagcgacaggaaccggcggcgccccgccgcacctgctcctgatctgcttccctggccaaggccacgtgaacccgatgctccgcctggcgaagcgcatcgcggcgaaaggtctcctggtgaccttctcctcggtctccaccgtcggcgcgaagctggccgcgtcggcgggcgtgtcggccggcggcgacggcgtggccgtgggccgtggccgcgtccggttcgagttcctcgacgacgaggaccccggccctgacctggacgacctcatgcggcacctcgccagggaaggaccgccggcgttcgcgaagctgctggcgcggcaggcggcggagcgcaggcccgtggcgtgcgtggtggtgaacccgttcatgccgtgggcggccgacgtggccgccgacgccgggatcccgtcggcggtgctgtgggtgcagtcgtgcgcggtgttctccctctactaccaccacgtgcacggccttgtcgagttcccgcgcgaggacgaccccgacgcgcggttcacgctgccgggtctccccgagatgtccgtcgccgacgtgccgtcgttcctgctgccgcccggcccgtacaagctgctggtggacgcgatcatcgcgcagttccgcgccatcggacgcgcgtcgtgggtgctcgtcaactccttcacggagctcgagcgcgacgtcgccgcggcgctcccgggggtgactccccgcccgccggagctcatccccgtcggcccgctcatcgagctcgccggcgacggcgacggcgcggtgcgcggcgacctgataaaggccgcggacgactgcgtggagtggctggacgcgcagcccccgcggtccgtggtgtacgcgtcggtgggcagcgtggtgctgctcaacgcggaggaggtcggggagatggcgcacgggctcgccgccacggggcgaccgttcctgtgggtggtccggccggacacccgggagcacctcccggaagggttcctggacgccgtggccgggcggggcacggtggtgccgtggagcccgcaggacagggtgctggcgcacccgtccacggcctgcttcctcacgcactgcggctggaactcgacgctggagaccatcgcggcgggcgtgcccgtcgtggcgttcccgcagtggggcgaccagtgcacggacgccaagttcctggtggaggagctcaggatgggggtccgcctccgcgggtcgccgctgcggcgggacgccgtgcgggaggcggtggaagcggccgtggccggggccgaggcagacgccatgctcgccagcgccaggaggtggagcgccgcggcgagggaggccgtggcgcccggagggtcctcggacaagcacgtccaggcgttcgtggacgaggtggcacggcgagcgtgtggcgtgcaagcggctaaggtcgtgccgccgccgccgccgtcgtcagagactccagactcgtagagcaatcagcagtcaccagttaagagagtccgaagctgaaagcgagtaataatcctgcatgttgttacagtttcaccgtgtgatagtacgaaccgaattttgcttcttctttttaccgtgtgttgacgacgacgcctttttgtttttgtgttggtcgagtgtgcatggaacattccaaggtgacacgtctgtctgctggtttgggctttggggtgtggccgcgcaaaaggcattttatcgaacttgatcgatctttatcgatcttcgaatattttcatctttctatttcttatttttccattatcaaaaatagagcggaactagctcttttgttgaacaagattgaagggttgaaagaaacacagagcgattttattaaaaaaaaaaaaaaaaaag

SEQ ID NO: 13467 - DNA, 1754 bp, Sorghum bicolor
  Clone ID: SORBI-28MAY03-CLUS3315_1
aagtgtgagatgtttgaggatgctattcttgttgattggcatcaatctttattggacgtagatggaatttaccatcatttcgagtgggctattggaacagatgaaggaaaatctgatattctaaactttgaaaatgtgggcatgaatgggcaagtccacaggaaaggccttgatctttgatcagtttgaagactattttgttacactgagagcatggaggctggatggccgctgtacagaattctgtgtgaaggcccatgccttgaagggccagtcatgtgttcacaggaggctaattgtcggggatggatttgtgacaattaccaaaggtgaaagtattagaagtttctttgagcatgctgaagaagcagaggaagaggacgaagatgatgtagtggacagagacagcaatgaccctgatggtgatatcgctcatccacagaagcatgctaagagccctgaactcgcaagagaatttctcctggatgctgctgcagtgatcttcaaagaacaggttgagaaggctttcagagaaggcacagcgcggcaaaatgcacatagtgttttcgtgtcccttgctctaaaactgttagaagaaagggttcatgttgcttgcaaggaaataattacattggaaaaacagaccaagcttcttgaggaagaagagaaagaaaaacgtgaagaagaggagcgcagggagaggaggagaacaaaagaaagagaaaaaaagaatagaagaaaagagaggctgaaaggaaaggacagagataaggaaaaaacactggttcggtcaaaaaaatcagatgatctttcaccattttctctgtgcaaccaagcagcaccaaatgataatgagtctcaggatgttctggacttgagatattcagatattgaagaggaagacaatgttgtggtcagggaacactatcctgattcctctgctgatcaatcttcaagcaaggacagtgatgaacgaagcaatgagcatgaatgcagtgcaacagcagaatttgttccctcagattgtgatggctcatttgcatgtgatgagtcaaaatcatcaagaaacctgagatttagaagagacttccctcaagataaagatgctagttattggtatgaggattgccgtgatgactctggagatactcaatggcagtctagggagaggatcagaaataacactagaaattacaatgctgtatttaatgcaaataaccgaacaagagacaggtacaacccctgcagctgtggccatcaagaagactacagatatttttccacagcaactagatcaagtagggatacaaagatgtccaggaaaacagtggctgagaaacccaggttgcaataccgcaggtgctatcctctggatagcttcgctgtgtcaaatggaggacgtgttggtggtacaccaaacaagagcccaggtccaaagcaagtatgggagccaatggatgcaagaaagaagatagggaatgggaatagtgctactgggcctgctgatggttcagatcaagtggaatgctcaaaggatatcagtgaatgtgaaaagcttgaggtagtgtgtgaaacacttgctgaaatctgttctgagatatctgcagaagcctgtaagtcagacacagatcaaccatgcagacaaggtgagaagaatcagtctgcttgcagcgatggatctaaatgcgtggataagccaacttgctgcttgacaaaagacactggtaggacaacaaacttaaccagttcggaca

SEQ ID NO: 13468 - DNA, 1532 bp, Sorghum bicolor
  Clone ID: SORBI-28MAY03-CLUS184_1
gtgtcttcatcaaagaggcataccaggtttattggtcgagctgtgttaaggggattcatacggggcagatggtcctcaaagtcgcccgggccgccgatgtgtatcttgctggaacagtcatgttgatttttgggatgggtctttacggtctcttcatcagcaacgcttgcacgagggttccttctgcatctgaccgtgcgctgagtggatcgtctctgttcgggatgttcgctttgaaggtacttgtcagaatttgaaatctcaaacacttttttatgttctgttggtacgtaccttttcaaatatatttatcaagccatattcagcactcatgtttcatgtctcaagtattgttgcttattctgaaaaatcagattaaatccattttcagtcaactgctcgtttcattcaacagtttgtacactgcttactggcaagtgaattactcattcatactactccactactactgaaaattttagactacttatagtcccaaatagtttataagtttagttgatagcctggtatcatttatcagtatcctatatgcttttgttggagacacacatgcaggagcaggaccttcaaaaaaaaaatacagacatgcagtacctcgaatgccgtcccattgcttattctgcatgctcttcagtctactgctgaattcagattaactccactactagggaaacattcagacgaccggcaactgaaacaaacatagcaactgcacatgaactcatagcatttcctactcctggtttgagaactgcactcgtcatttctactgtttcttcaaatttgataaacagtaataaggcacatgtatgggggaaaaaatcctttggcaatacgataaatcttttgttcatgcaggaacgcccgaagtggatgaagatcacctcccttgacgagctcaagacaaaagtggggcatgtcatcgtgatgattctgcttgtgaaaatgttcgagagaagcaagatggtgacaatagccacggggctggacctcctcagctactcgatttgcatcttcttgtcgtcagcttctctgtacatactgcatatgctccacaagggcgaccctgaggactgaggagagtgcaatgccaaatttgtaactccttaacattgtgaccagatcagatttgttgtagctattgaaggaacttgaaattttgtgttcgattatcgatctcctaacctctgatttctgcatgatcatagcatagtcgtcacttgcttcagttaaaacaaaagagatactggtcactttggttcagctgccatgtgccccctggaccaaaatgtcagtgggaaagggtgtcacctgacatgccctttctaaggttctggtcctgaactcagactaccaaagaaattaggttatgttttctctatggtctgtatatactatggttttatttcggagtgattgaggaaactttcatttttgttaaaaaaaaaaaaaaaaaaaaaaaaaaaaaaaaaaaaaaaaaaaaaaaaaaaaaaaaaaaaaaaaaaaaaaaa

SEQ ID NO: 13469 - DNA, 1351 bp, Sorghum bicolor
  Clone ID: SORBI-28MAY03-CLUS195_1
tctggctccttccttcggctcctcctggacctgtggccgcggccgcgctgctggccttgactttactctcgattcgtgggcatggcggcttcgccggcttgtgctccggtcctcgtctccggccccacgctccctccgcagcccgttcccttccgctgctaccgggcccaaaagccttcctccgcgtcgtccacctcctggcgcccgcgccgcaggcggttcgttccggttgcagctgcctccacccgcacctcccctgcggccgctcggggcctcgacgccgacgacttccgccacccgctcgacaagcagaacactctgctgctaagagcgattcctgggctcaacgacatcggcaaagctttgttaggacccgtctcggagcaagttatggtcctccagaacattggaacatcagttctcgtctccccaaaccagcttccagatctccaccaactgctggctgaggctgcaacgctcttgaacacggaagctcctgacttgtacataaggcagaatcctgttccaaatgcttacaccttagcaatcaatggcaaaaaaccattcattgtcgttcacacaagccttgtcgagctgcttactccaaaggaattgcaggctggtttggctcatgagctgggtcacctcaagtgcgatcatggtgtatggctcactttcgccaatatactcacaatgggagcatacactgtccctggttttggcatggttgctggcttcctggaagagcagctatacaggtggctacgtgctgcagagctgacttgtgacagggcagctcttcttgtggtgcaagacccaaaggttgtcatctctgttctgatgaaattggccggaggatgcccatctcttgccgaccagttaaacgtggatgccttcttggagcaagctcgttcctacgacaaagctgcatcaaacccagttgggtggtacatccggaatgcacaaaccagagagctttcacaccctttgcctgtgatgcgagcccgagagatcgatgagtggtcaagaagccaggagtacaagaccacaatgcaaaaaatgcttcagctggggctaaatagggtatagttagcggcgacacatacgaaaaggactgtagtgtgtgtagcttgtgtatggaagggaatgcatgtatttggagaaggctggtgcagctggaaaacagatacaagcatagacatatactgtatatatttttacagttgaatttagtttccttgtatatgctctctttttctttctttctttttgtcactgtacaatattgtaactagaattgaatgaataaaagtttatttgggttgccggataactggaaggatccgcatga

SEQ ID NO: 13470 - DNA, 1224 bp, Sorghum bicolor
  Clone ID: SORBI-28MAY03-CLUS19581_1
caagcgcgcggctcacccgtaaaggaagtgaaaaatatgaaattgatggtcaagtactggaagtatccatggccaaacctttggcagataagaaacctgatcattcacacaggtctggaggaggccctaactatcctcttcctccctatggtggtggtggtggttacatgggagatccatatggtgcttatggtggcggcggtggtggtcctgcatacaaccagccaatgatatatggcagaggaccagcaccggcaggaatgaggatggtgccgatggtgcttcccgatggtcgccttggttatgtcctgcaacaacctggtggaatgcctcccccgcccccaccacggaggggtggcgaccgaagagacagtagcagaggcggcgaagggcacagccggcgatatcgcccttactagctttgccctcatgtgcgctctactcccatcaccgtgtgaagcatttgttaacttaatgagatgagctaggagcgtgtgttcttgttccagtataaggtctgcaatggcacgatgcttgtaccatctgtttcttctagtaacttgattttatccatgcagcgcatgtgacttgagactctgtctttgcctccttcaccgaccaggacgcggcgcagcgtgccatcgaggatgtgcaagacagggagtacaaggggaggactttgcggtgctctctgtcgcaggcaaagcacaggctgtttattgggaatgtgcccaaggggctgagcgaggaggagctgaccaacattatcaaggggaaggggccaggtgtcgtcaacattgagatgtttaaggatcagcatgacccgaaccgtaaccgtggctttctctttgttgagtattataatcacgcctgtgcagaatatgccagactgaagctttcatcacgaaacttcaaggttgatgggagccaattgactgttagttgggctgaacctaagggtcaaacagatccttcatctgcagctgcacaggtgaagactatatatgtgaagaacctacctgagaatgtttctaaagagaagatcaaggatctgtttgacaaacacggagaggtcacaaaaatcgttctgcctcctgccaaggctgggcataagagggattttggctttgttcactttgccttctggcacctgtgttagtgaactgatgaacgaagtgcctgtgaactctgaaagctttgtttagagtgattattttgcttctc

SEQ ID NO: 13471 - DNA, 1346 bp, Sorghum bicolor
  Clone ID: SORBI-28MAY03-CLUS20166_1
ctactggatccagtccagaccctccctgtcgttgccacttgcacgaggcacacgtccaccctcccagacacccccatccgccggccggatcatccttatatacgccggcggcctagctaacacggccacccggaactatctatctcctcgtcggcggtcagttgagctacaaaacttggcaacaagcttagctagctagttgcaagcagcagcgccaatcaatcgatcgatcaaggacgacgacggcggcgaacggatcgatggccacgctctcctcctgcagccgcctgagcagcggcaccggcgccgcggctatccaccaccggcagccgacccgtgcgggtgtcgtcgtcgtcaccagccggcggagctcctccgccagcgtccgcgccgccgccgccgccacggcggcgccggctgccgtagagcagcaggacaagggggtgtcgctgccgacgtgggcggagttcgagctcgggcgggcgccggtgttctggaagaccgccaacggcctgccgccctcgccgggcgaagggctgaccctgttctacaacccggcggcgacgaagatggccccgaacgacgtgttcggcgtggcgttcagcggcggcttcaaccagcccatcatgtgcggcggcgagccgaggcagatgacgctgcaggtccggggcaaagccgacccgcccatctacaccatcaggatacgcgtgccgcagcacgccataagcttgatcttctccttcaccaacggggccgagtgggacgggccgtacacgctcaagttcagggtcccaaagccatggcagaacaagccgctgagcttcttcaacgagggcctggcggacgagctcaacatggagggcgcctgcgaccgggccatctacccggacgagaacatcgccatcaccagctgcgccatggacggctacctcgaggaagggggggatcggtgcaagctggacatcgtgagcgggtgcatggaccccggctccgacatgttcgacccgctggccaccgtcgacgacggctcctgccccctcgagtctgattccgaggaatgaagccatgaaggagcttcagttcaatcctaggacacaaatgtctgtgattcatacagtttatcagcatgcaaatgtctgtgatgtttgtcatcatgtgatacatcaagcatattatacgtgtatatgtatttaaccagactaccagagtaaacaaaaaaaataacgcattgctgagcaagatgatctcatacttgcactagtggagttgtggatacttggtatcaatctttgcaaactctgatacaaaccagtttaaacagagcaaaatgtaaggccaaatatgcc

SEQ ID NO: 13472 - DNA, 1424 bp, Sorghum bicolor
  Clone ID: SORBI-28MAY03-CLUS2286_1
ctcggctcgcgcctgcggcggcggcgccccggggcgccctcctggcggcccacgccggcgccctcctgcccctccggcggctccccggcctggcggacggtccccccgcgtggtcccccacggtggcgcgctccctccccccctggggatgcctcgcctggcggtgtgacccaccgcttcggccgccacgggttcccggttgcgctctcctggggggtcacgcgcctcctccgcgcgacactcggggggtgcgccccggctcgggccccgggggtccccgggggctcggggtgccccctcttctgcagcgacagggagtacatcataggtcgcaggatatgggcatctggaaagacgttttactgtgtcaccaagggtgtgcctcgaccctctgttccaagacataacaaacctcgacgtgtggacttatactactctagctggtgcatccgtccagttgaatcaaggaaaggcgatggttcaatgactgcatgtgaggtgctcttattccatcacgaagatctggggattccatgggagattgcaaagcttggtgtccggcaggggatgtggggctgcgtcaaaaggatagagcctggccttcgggcataccaagttgcaaggaccgctggagagcctatttcgaaatgtgctgccatggcacatgtcaccaccaggttcaatgcggatgagctcattacagaagagaacacagagggcagttcatccaacaacacagaggtcgagaagccaaagcactggacaaacaatatacccaaggttctcatgataggcggtgccgtcgccctggcttgcacctttgacggtggattgttgaccaaggccgtcatattcggcacggcgagaaggtttgcagggccaggagggccaggaaggcggtaggtggatggagctggttaccgtagagcaatgccacccttgtcatgtagcaaagctatgcgtggaagtgccccaaacaatctttttgtagcaatacattgcagaggacggaatgccgtgtctagatgttcagtgtagacatcctcatgctgcagataaggtggtgtgctcatattaggtcagttgagaaaatagatcctgcacattccagaaaaggaaatcggcggaaagatccagcgacacagaccggacatacatctgttgctgcagtcgccgcgggttagagccagctggttaggttagaactatagcattattttgaggacaagtgtgaagagttggtaaagagaacagccgtatgatgtaagatgtactaggttcatgttacaaaatacactgctgtttagtagttaataacaagaacaagaattctgccttttgtacctatgtggcatctatttgctcgtccggtcttccctatggatactagacgttgaccttttgacaaaaaaaaaaaaaaaaaa

SEQ ID NO: 13473 - DNA, 769 bp, Sorghum bicolor
  Clone ID: SORBI-28MAY03-CLUS23285_1
gcacgaggggcacgaagaaggttccagtgactgtggagcagggctgccggaggtagcgagatggggaagaagcggcagctgatctgcctcgcggccgctgtcgccgccgcggccatcctcctgacagcgtcggccaagaagtccggcgatgtcaccgagcttcagatcggcgtcaagtacaagcctgagtcatgtaccctgcaagcacacaaaggagacaaaattaaagttcattatcgtggggcactcactgatggatcggtttttgattctagctacgacagaggtgacccgtttgaatttactcttggaaatggccaagtgataaaaggttgggaccaaggattgctaggtatgtgcgtcggtgaaaagcggaagctaaagatacctgcaaagatgggttatggtgagcgaggctccccaccgaagattccaggtggagcaactctgatcttcgacactgagcttatcgccgtcaacggaaagacatctggcggtgcaaagacagaaagtgatagcgagctctaatacaatgcattggagagtttcagctccggggtgtagcagcgtcactcattagatgaaagggttgctggcaatttaggttttacagatgtgacaaaaacaagtcaggttttgcccaatggtctatgtaaccgactgcatatgtactctggaaacagtttccttttgatccgtatgaaaactcgatttgtctaagctaccatggtttcaacattacagcctgtttgggctgttgctgcatcga

SEQ ID NO: 13474 - DNA, 992 bp, Sorghum bicolor
  Clone ID: SORBI-28MAY03-CLUS2300_1
gccggccgggccgggaagatttcccggcccgaaaccgaaagacccgcaccgctgcagcacctgcgtctcttcgtcttcggcggcgcgcggcggcggcggcagcagcggaggaggtcgaggagatgctgtccggcgacatccccccgaaccagaccatctacctcaacaacctcaacgagaaggtcaagaaagaagagttgaagagatcgttgtatgccctgtgctcacagtatggaaggatactggatgtggtggccctgaaaactcaaaaactgagggggcaagcatgggtggtgtttagcgaaattacagctgctaccaatgctttccgtggattgcaagactttgatttctacggcaaaaaaatgcgagtacaatatgcaaaaacaaaatcagattgtattgcaaaagaagatggtacttatgctcctaaggagaaaaggaagaagcaagaggagaaagctgctgagaaaaaacgacgagcagaagaggcacaacaagctggccccaatgcttctgctgcacaaagcaatggaactggctatcaagcgtctcgtctgggcaaggtttcacaagagccacctgctcctccgaacaacatcctcttcatccagaacttgccagaccagaccacgagcatgatgctccagatcctgttccagcagtaccctggcttcagggaagtgcggatgatcgaagccaaaccaggcattgcttttgtggagttcgaggatgacagccagtccatggtcgcgatgcaggctctccagggcttcaagatcaccccagagaaccccatggctatatcctatgccaaaaaatgagaaccccccacggaatccctgtactctgtaagattttccgttctgcctttcagaatcaatccacagtatctactttccggccatgtatttttggaaagcacttgcttaaattagaagtttaactcttgccacttttaaatcaggtttggtcctcagtctttttatgtt

SEQ ID NO: 13475 - DNA, 1780 bp, Sorghum bicolor
  Clone ID: SORBI-28MAY03-CLUS2365_1
ccattcgtcaaatcggcgcgggggacgacagcgaccgccattcctcctcccgactcccgtcctcccgtcctctcttcactccgacgcctctccctgctgctgctaccgctattgggagaggggcggtccctctcgcgcgcgacgccgagccttcgtgaccgggacaggctactaattcatagcgcaccaccccccggcgcgtcctcggcctcgctagcggccagcggattactggtggtgggcagcgcttgtgtgttgtgcagtccgtgcgtctgctcgcgggcgagacccctgcggccggcggcgatgggccaggacctcgtcgagatccaaccgcgcgagctccagttcacctttgaggtgaagaaacaaagttcatgtgttgtccacctaatcaacaagtctaacgaatatgttgctttcaaggttaaaacaacatctcctaaaagatactgtgttcgaccaaataccggggttatccttccgaggaaaacatgtgaattcatagttaccatgcaagcactccgagctgctccaccagacatgcaattaaaagacaagtttttggtacagaccacagttgttccttatggtacatctgacgaggaactggttcctgcttttttctccaaagaaactggcagatacatcgaggaaagcaaattaagagttgttcttgttagtgcataccaatcccttgaagagcaaccgactaatggaattcatgacaccgagccagctgttggaattcctgtacagaaggagatgccaaatatagagaatcaagtgccagatgtttcaatagaagttcctgcccctctggcacaagctccagcaattgtgactgggataccttcacctgtcgaagagactccaggcctgacagaaattcctgtgccactgaatgaagcaccagctgtgttggcagaatctccttccgctcaaaaagacccctctgctattacagttgaacatgcctctactgttacaattgaacatgcccctgctatttccattgaatcccctccttcaaaacaaagcgttccagtttttaaggaatctcctcctttgaaacaaagcgttgcagtttttaaggaatctcctccactggaggaaactactcctaaagaagctgttatgctaagtgaccgaggacttttcaatgtgcaaaaccatcaattatctcatgtaacagaagatgttcagaatatgaaatcaaagctcaacaatcttgaattaaaattggaagaggctgaaaagatgataataaggctaagagaagagagcagaagtaccacccaggagcgggataagctacagcaagaaatggtattcctaagaaagaagggaaccccaaggagtcaagtgggtttccccttgctctttgtggtgtatgtggcgcttcttggtacctcactcggttacctgctccgaatatgagttccgaactctaaaaaaagttcagcagctgggatgcttcttatgcggcaagagaattgaatggcagttgagctccaaaatgttggagaggtgaatttattattagcattattagttcagaacttcatatggttttgcacataacagcaatgccaaactaccagttgcctgtgtatagaacagtttcttttttttcgcgttgtatagaacccacccaaaagatgcctgctgccttgtagattaacatgggattcttccatctgcctgagcttttcttttacagtttgctggattcgcttgtcctgaatcagaattgatctatttacacctggtttcgttc

SEQ ID NO: 13476 - DNA, 2394 bp, Sorghum bicolor
  Clone ID: SORBI-28MAY03-CLUS3915_1
ctactggaaaatcaaaaggaaccaacaccaacaacaaccagaatatcgccgtcgcgagtcgtcgtcgatctctccgccccggccgcgccgcggaatctgacctctctctctttccgagaaccgggcgcccttacatccgcgccgccacgtgaatcgccgtcctgagccctcgcggtctctcgtctccccgtgcgagaggacgccggcggcagcggtggcaggggggaggaggaccggaggcggcaccagggccttgcgcccagagggcgccggcggcgggcctgttctcggcgtcgcgtggggaggtccgcgggggaaggcccggagtagccgcgggaagcacgagtgaaatcatgagctcgctctgtcctttcgcgcgagccaccaatggtggtggcgtatgccctgtgaaatctgataagagcaacgctggggtgtgccctgcaaaatctgacaagagcatcagcggcgtatgccctgtcactgggaaggatcatggtagcgagctcaaggaaagtagtgaccatggtgaggaaaagagcactgatcctcgtgttgtgccagcaaaatgcccatttggctatgactccaacatgttcaagcttggtccgctcagctgcattgtctgccaggcactgctccatgagagtagcaaatgcaagccgtgtgcccataaattctgcaaggcatgtatatcacgctttaaagactgcccactatgtggtgctgatatagagggtattgagcctgatgctgagcttcaaactcttgttgatcgcttcattgatggccatgccagaatcaagcgatcacatgctaaaggggatgtagaagcagcaggtggcaagaataaagtcatatatgaggatgtctccatggagagaggagcttttctggtgcagcaagctatgagggcttttcgcgcccagaacattgaaagtgcaaaatcaaggcttaccgtccgtgcggatgacatcagggaggagttgaaatcttcagaagctaacctagacttatgttcacagcttggagctgtattaggaatgcttggggactgctgtcggaccttgggagatgttccttcagcaatcacttactatgaagaaagtgctgagttcctctcgaaaccccctgcaaaagatcttgagctggttcatactctctctgtttcactaaataaaattggtgaccttcgctactatgatggcgatcttcaatctgcaagaaactactatgcccgttcattagatgttcgcagaaatgcagtaaaagaacactctgcagtggcttctcaggtcattgatctagcaacttctcttgccaaagtcgcggatgtggatagaaatcttgggaatgaaagtgcagcagttgagggttttgaggaagcaattcaatgccttgagaagttgaagctggattctgaacaagctagccttgaacagcggcgcctttcggttcttgacttcctacacaaccaattggcagataaataagacatggtcttctcctaagaattcaccaataacagatgtcttctcatggtaatgttcaactccactacttaaggctccctttggaaggagctggcctagaagcagcgatcagtatgtgtgtttaccaccgtttgaaacttttgtcacggcacaaaataagtactcatgcactataaatgtatcatatatatatgcccatcgagtactcttgatgattgccgatatggtttggtagtctaagcactctaggttgtcaatgtcagcctggagcagcgcgtaagatgtaacttgtgggaagttccatctcgctttaccgtgtcatgtgtgaacacttatcctgttgtatattgacaataaggcagggagatgccaatcaaaagcatgtctgttgtttcttttagaggagattcccaggtcaagctgtttgcatattttaggtgcgtctctggtaaatctgggtcagaaacccaaaaagtcagaaagaattcgtgtcttggtataaccatgtattccttgtgagagacggttgtttgactgcatgccaggtcttcgcctggcgcctggcgatcgcagatctgtcgctggtgcaaatttgactcgtgaagaatacagtggcgcacgttttgcctgtccacttttgatttgctcttttctggaaggagtccgtgactgattcagcctatattgcaagtgctcgtctgcaggctatgttgaatgttttagcactgaacagattcgtctgtactgagtactgactcatactgatgtggtcgattactttcgctgcgctcgattgttcgcagctatctgttcctcctgggcatctgatttagggggtgtttggtttccttcggtaaactttaccgtccgtcatatcaaatattgaatacatgcatacagt

SEQ ID NO: 13477 - DNA, 1059 bp, Sorghum bicolor
  unsure (1)..(1059): unsure at all n locations
  Clone ID: SORBI-28MAY03-CLUS2935_4
cgtccgcggacgcgtgggcgctcgccaaccaaggatgccagctgctgcttacggcgtcgcttctctccccgtcgcgagcgcggtgccgggcgctgaaagacctccgatcgacacccagccccttctccatggcgcgctgcacgtagaactgggtcgtcatcgacacgctgcgtcgtcaccatgcattctgccgacaagcggngcgccatggctcgaatccggcggcctccctcagtcttccctcagatctcacaggtacggcgagctccctccctctccctcggcagctaatcaacgatggggtggttggccttcttctcccttggtggatccatgccacagtggccagatcgacaacatggtggtggccacggcatcgagcgggcgggctgcacgggtatgttcgtgtgtggtactcagcagattggctgctgactccaggtgaccaagcctncctcaatccctctcctccaacccctgagccccgatgcctggcctcagatctggcagcaacgatatggggaaggtctctgctggatctgaataaggtatgttgtttccctctgccatgtgcaattggattggtgcatgatttgtggtacattaagtttggtgccactatactgtgtgatctgtcatgtttggtttctccaacgatgcagatttccctcaaattacagagtataagattctcaaactgctggagcatggtgatgtcgcttcccctcatctaacatagaaatctgaatcaggaggcattataaggcccatatctaaaatttgattccattccgtgcttgatatgtgttgctgccaattcacttactaaactaagtagatatgtgttgctgccaattactgctaactaccaaacctactactgaactaagttgccagttgccttgctaccaaacctgccttggtcagtcttggaaatgttgatatgtgtaccaacactctgtttntattgtagataactngatgcctngttccttgcctacggttttaattacctacatactctcatggagaaaactacatgntgtattttcagggaga

SEQ ID NO: 13478 - DNA, 1293 bp, Sorghum bicolor
  Clone ID: SORBI-28MAY03-CLUS2935_2
gccggccgggctgcgattgcttgcgaaaaaaaaaaaaaaaaaaaaattatccccacgcctctgctcctgccgccgcgagtcgcgagttgcgagcgcggtgcttctctccccgtcgcgagcggggtgcttctctcccagtcgcgagtcgcgagcgcggtgccgggcgctgcaagacatccggctgacacccagccccttctccatggcgcgctacacgtagaagtgggtcgtcatcgacacgctgcgtcgtcaccacgcgtactgccaacgaacggggcgccatggctcgaatccggcggcctccctccgtctcccctcagatctcgcagggtgctggacaacttgaaagactatgttgtatgagctgtcgtcaacgcagttgatcatctgggtactgttgcctacaaattgacagatcttttcgaacagcaagcttctgaggtgtcaacttatgaactgaaagttgcacgcctgaaccagcaaatcttgtcacatgccaagtctacacagacaaagaaggcatcaggcagtagcaaatgatggcagcaaacataaaacaccacaagcactatatcctacctagtcagtacgagctaaagatctccggcgcctgcacgactatcggcagactctgcggcgcatttcaagccatgtcattatcccttgataaaaactctttcctggcatctgtcttcagagaacagcaccaatgcaaacacacaaataccgacatttgccctactgggatcagcaccatcaacacctgcatcaggtaaggagcggtctgcttctcctatgcgcaggcctctgcagtttaacaggagcaccagttctgatgctatgcaaaaggttggcactaagaaccaatctggtgtaaaggaattttcaacgtttcattccttcgacaaccctaaaggtcgtgcaatccaaaaggcccctgttggcactaaaagcatgctagcggctctcttcatcaaacacaaatcatcgaagatgaaaaagatcgcagttcgttgacaagctcacgtttgattggggtgacatcactgtaaattgcatttcgtgcaggaacggaagcctgttattgtacatctggcctatcgctatgtgttgggtatgctgatggtttagattctgagtattctgtagtcgtatttcatttcagaatatatcatcttgcagatgaccgaaatgtaatgatttcacataagctcatacaacatcctcgtcgtgtaatgctgcctgaagctttggcatttagcataaataaatgcattttggaaatagcctttc

SEQ ID NO: 13479 - DNA, 832 bp, Sorghum bicolor
  Clone ID: SORBI-28MAY03-CLUS2935_1
gccggccgggccgggatcatccccacgccctccgctcctgcagccgccgcccaaccaaggatgccagctgctgcttacggcgtcgcttctctccccgtcgcgagcgcggtgccgggcgctgaaagacctccgatcgacacccagccccttctccatggcgcgctgcacgtagaactgggtcgtcatcgacacgctgcgtcgtcaccatgcatactgccgacgagcggggcgccatggctcgaatccggcggcctccctcagtcttccctcagatctcacagggtgctggacaacttgaaagactatgctgtacgagctgtcgtcaacgcagttgatcatctgggtactgttgcctacaaattgactgatcttttcgaacagcatggccagatcgacaacatggtggtggccacggcatcgagcgagcgggctgcacgggtatgttcgtgtgtggtactcagcagattggctgctgactccaggtgaccagtcctccctcaatccctctcctccaacccctgagccccgatgcctggcctcagatctggcagcaacgatatggggaaggtctctgctggatctgaataagggagacaactacagagactgggaccatgatgcaatggattttttgaaggagtgtcaccatacagaaaaaagttcaagcctatgcactagctactagaatgctattgtaatagatgtgaaggtcgataaggacctattttgtgtttccttgtgataatcagaacatgttatgttaatgtactggaaatttgagtactaaattgttgggctatatgtgattttcattatatgatttgtgatggac

SEQ ID NO: 13480 - DNA, 603 bp, Sorghum bicolor
  Clone ID: LIB5048-001-R1-XP1-D10
ccgggatcaaaaaggagaggactccgggaacggccgacagcgtgcatccgcctcctcagctccgcctctcccgcactgcctcctgcaccatctctcccctcgcatcgcagcctccgcctcccgccgtcgttcctggccgttggccttcttctccgacaccggctacgctcgtgaagagggaggaggagccgcggcgttcgtcccactgccccgcacctcccgttcagtcggcgagcgatggcgcgcgtaaatccggcagcgcgtaaatctgccaacgaacggggcgccatggctcgaatccggcggcctccctccgtctcccctcagatctcgcagatccggcgtaggtgcggtgagccgcgggattgtgccatcgcccgctgcccagaagagagataggactccgattttcattgacttcgtcagcggcaaatcatatctattgctccttctcctcctggtgctggacaacttgaaagactatgttgtatgagctgtcgtcaatgcggttgatcatctgggtactgttggctaccaattgacagatcttttcgaacagcaagcttctaaggtgtcaaattatgaactgaaagttggacgcct

SEQ ID NO: 13481 - DNA, 991 bp, Sorghum bicolor
  Clone ID: SORBI-28MAY03-CLUS3966_1
gccggccccggccaccccgtcgctctgtgtgtgtgcccattccccactcctcccgccggccacccccaaaagaatcggaaattacaacccggtccacgggtcggatccccatccccacccaaaccaaatctaacctcctcctcctcgagctcgctcgtcggccagcgatggggatctcgagcatgccggagccgcgggacagcctgctgtggtacctggtggtcaacacggtgatctcgatcacggcgctggcggggctggtgcgcaaggcgctggtgttcctggacctccaggacgacgacgccggggaccgcctcgtggcgtcagcgcccggcctgggcctggcggaccggttcctgagggcgttccggccggcgctgtacggggtgctggtgtcgacgtcgacgacgtgcagcgcggcggaggcggacggcgacgactgcagcgtgtgcctgtccggtttcgtggccaaggccgtggtgaaccgcctcccctgcggccacctcttccaccgcgcctgcctcgagacctggctccggtacgagcgcgccacgtgcccgctctgccgcgccaacgtgcccctcccgcccgaagagacgcccgtgctccgctacccggagctcgagtgatccggtccccctcctccggcgagcggtgaccccccgccgggcggggctcggggtcgggctcggccgtcgcgcgcctcggctgtgtgctgcaagctccgtgtggccttccgtgtgtgtgcgcgtagcaaaaaacaaagtataggagcagtagtagtagagttgctgttgctttccccccctttccctttcccttctcgttttgtgttttttttttccttgtttttcttcttttccccatttctcttcttgttgtttccgtgctgtcgctgtagcgtgtaaatactgcagttcgcacttcgcagcagagagtagagtgctcccgtggctgtgctcatggtgtagcactttttacgagactcagc

SEQ ID NO: 13482 - DNA, 1232 bp, Sorghum bicolor
  Clone ID: SORBI-28MAY03-CLUS2710_1
ctgtcggccgcacgaggcccatccgcagtcatcagtcagcagccgcccccctcacacgcctccgctctcgctccgcccacgcttccctgccggctctccgatctccagggcttccgcggctgggaggggcccgcgggggcggctcccgtggtcgacgccgagtacctgcgccaggtcgacagggcgcgccgccacctccgcgccctcatctccaacaagggatgcgccccgatcatgctccgcctcgcatggcatgatgctggaacttatgacgtgaagacaaagaccggtggtgcaaatggttcgattagatatgaggaagagtacacccatggctcaaatgctggtttaaagattgccatcgatctccttgagcctatcaaagcaaagaatcccaagataacatatgcagacctttatcagcttgctggagtggttgcagttgaagtgactgggggaccaactgttgagtttattcctgggagacgtgaccaggcggtgggcccccgtgaagggcgtctgccagatgctaagaaaggtgcaccacatctgagggacatcttttatcggatgggcttatcggacaaagatattgtagctctatcagggggccatactctgggaagggctcatcctgacaggtctggattcgaaggtgcctggacaaaggagcctcttaagtttgataactcatactttcttgagctgttgattgaggaatctgaggggcttttaaagctcccaactgataaggcactgttatcagatcctgagtttaggcgctatgtggacctttatgcaaaggatgaagatgccttcttcaaggactacgctgaatcacacaagaaactctctgagcttggcttcacgcctcgcagcacagcatcagccaaatcagaccttccaaccggtgctgtacttgcacagagcgcctttggggtagcggttgctgcagccgtagtcatcgctggctacttgtacgaggcttccaagaaggccaagtagatcgcaaagttgttctttgcttagcaagtatgaagatcgaataacaggatcatagaaatgaggtactcggacaatgtttcgaaaacataacatccccttcatgtttacactggtttcatgatttacaatgatatggagatggcatagcctactattggaagtaaaaaaattctgtgtaatgatgcatttggaacttactgtgaaagttgacagtaggaattgcgttt

SEQ ID NO: 13483 - DNA, 890 bp, Sorghum bicolor
  unsure (1)..(890): unsure at all n locations
  Clone ID: SORBI-28MAY03-CLUS18675_1
ggcgggcatcgcattccagttccccacctcgtcgagatatcgctccggtcggaagcaccaatatcgctccggtcggaagcaccagggcggcttcaggatgtctggcgaggaggaggagaacgccgcggagctcaagatcggcgaagagtttctcaaggccaagtgcctgatgaactgcgaggtggcgatcatcctggagcacaagtacgagcagatccagcagcactcgtcggagtcggacccgtcgtcgcaggtgtcgcaggtgttcgagaagtcgctgcagtacgtgaagcgcttcagccgctacaagaaccccgacgccgtgcgccaggtccgcgagacgctcagccgctacggactcgccgagttcgagctctgcacgctcggcaacctctgccccgacaccgtcccgtccctcaagtccggcggcaggttcgtcggagacgccagggacgagaagatcgagaagatgctcaacgacctctccctcatcaagaagttcgagtagagtagcgcccagggtgcgtggagtagcgcccagggtccgtgccttctcttcgaatatcatcgagagacacttcaggttcatgttcttgttagctcgatgtgctattcgattgttagcttgatgtgttgatagatccttgatgtattgatggaaccttgttggcgtgttctctaattcatgataatacttatatgtgtggttgatgatatagactgtctgaaattctacacgagaagccatggccatggccatgccctgttctgttcttcagttcctccagctgtaaggactcttgtaatcaagagagttcaaagatcaaacaaaatgtactgattttcttgctattgttgagcttcacaaaaaaaaaaaaaaaggcccctan

SEQ ID NO: 13484 - DNA, 693 bp, Sorghum bicolor
  Clone ID: LIB5050-010-R1-XP1-D3
tcgcgaacgaattccagttccaacctcgtcgagatatcgctccggtcggaagcaccagggcggcttcaggatgtctggcgaggaggaggagaacgccgcggagctcaagatcggcgaagagttcctcaaggccaagtgcctgatgaactgcgaggtggcgatcatcctggagcacaagtacgagcagatccagcagcactcgtcggagtcggacccgtcgtcgcaggtgtcgcaggtgttcgagaagtcgctgcagtacgtgaagcgcttcagccgctacaagaaccccgacgccgtgcgccaggtccgcgagacgctcagccgctacggactcgccgagttcgagctctgcacgctcggcaacctctgccccgacaccagcggcgaggccaccgcgctcgtcccgtccctcaagtccggcggcaggttcgtcggagacgccagggacgagaagatcgagaagatgctcaacgacctctccctcatcaagaagttcgagtagagtagcgcccagggtccgtgccttctcttcgaatatcatcgagagacaattcaacatcaagatgtgctactaaactttttttttctttttcttacaattgttcaggttcatgttagcttgatgtgctgctactcgatctccatcatgatgtattgatggaaccttgttggtcgataattcaagatactact

SEQ ID NO: 13485 - DNA, 686 bp, Sorghum bicolor
  Clone ID: LIB5050-012-R1-XP1-B8
ctgtgcggcgctcaggcggcgggtttccaataggttccagttccaacctcttcgagatatcgctccggtcggaagcaccagggcggcttcaggatgtccggcgaggaggaggagaacgccgcggagctcaagatcggcgaagagtttctcaaggccaagtgcctgatgaactgcgaggtggcgatcatcctggagcacaagtacgagcagatccagcagcactcgtcggagtcggacccgtcgtcgcaggtgtcgcaggtgttcgagaagtcgctgcagtacgtgaagcgcttcagccgctacaagaaccccgacgccgtgcgccaggtccgcgagacgctcagccgctacggactcgccgagttcgagctctgcacgctcggcaacctctgccccgacaccagcggcgaggccaccgcgctcgtcccgtccctcaagtccggcggcaggttcgtcggagacgccagggacgagaagatcgagaagatgctcaacgacctctccctcatcaagaagttcgagtagagtagcgcccagggtccgtgccttctcttcgaatatcatcgagagacaattcaggttcatgttcatgttagcttgatgtgctattcgattttcatcatgatgtattgatggatccttgatgtattgatggaaccttgttggcgataattcaagttaataac

SEQ ID NO: 13486 - DNA, 1120 bp, Sorghum bicolor
  Clone ID: SORBI-28MAY03-CLUS28638_1
gcacgatgtgaaggcagacgccgaaccataaacaaaaggtgaacaagaccaaacccaagccaacgaatctcccgaatctcccgttcgagaggtctccgcgtcgtcgggcccgctccgcgtgcgacgccggcatatagggtttcgccggcgacggcgatggacccaccggctgggggctccgatcgccggcgccccggtcgcaccgtcgcgcaaggatgtgcattatggctcttatgcgactgcaaatcaggtacctgctgctgccgataggtctccctttcgctccgactcgaggcctctgccgttgtccagtcccgccctgccctggcggcgcaccacccgtccgcgggtcccgcgccgccgtgggcggcctcggcccttgtgggccgcctcgccgctgccgccgctgtggacggggaggtttcgatccggatccagggcggccctccagttgttctgactgcaagcggtaaaatcctaacatacccatggacaagctataacataaggagaactcgagtggaggtccttttctgttatcatgtgaaatcatcttcctcaatgttgagatcaatgtgagaagcgttcagacagtcacatgacagtgcaagtcgttatgtttgtatatatcttcaagcaaatagtttacagtgctttttagttgcaacagtggtaaaatgtttccagcaaactgctttcagagcctatagaatcctgccggacaaacgatttgaacgttgaggtcgggtgagaccgacagctgtaggcctcatgtaaaactctggtattttttttgcacatgtgggcttacctgggtgtaactgaaatttgaaagtgccgcccgcggcttgcacgtgtttggcgtatattggtggtacaggaatgatgatcttctcagacctttgttcatgcttcctccaaaagatataccaccattctggcatgcaatttttgtcatcatggtcaatgatacaacggtccgccaagcagcaatggctgtcaaatgcatgctacttctatactacaagaactgcagaggtcgtaactaccgtagacaggtacttgctgctggtgatatgtgtgccatttgccaggaaaagatgcatgtgcctgttctcct

SEQ ID NO: 13487 - DNA, 1187 bp, Sorghum bicolor
  Clone ID: SORBI-28MAY03-CLUS2879_1
gcacgagggacgacgtcacgcgttcaccctccaatcgacgaccttgcccgaggcttccttcttcttcttcctcgatcctcccccaaccccaacgtcatctcagatctctcctgtcctctcctctccccagaaggctcctgtacaagtagcaggcggctgcctgcagcaggcaggcaggcaggcagcagaagctgcacatccatccattttcttgctgcagagatcttctcgatcctgcatcgtcgtcgtcgggtcgatcgtctctcgcgcgtagagtacacagggaatcacactctctgatcgatcgagctagctaggaagccaataacccatggctacgccggcggtgaaggtgtacgggtgggctatctcgccgttcgtgtcgcgggcgctgctggccctcgaggaggccggcgtcgactacgagctcgtccccatgagcctccaggccggcgaccacctccgcccggagcacctcgccaggaaccctttcgggaaggtgccggtgctccaggacggcgacgacctcaccatcttcgaatcccgagcgatcgcgaggcacgttctccgcaagcacaagccagagctgctaggcaccggcagcctggagcaggcggccacggtggacatgtggcttgaggtggaagctcaccagctgagcccgttggcgatcgccattttggtagagtgcatcttcgcgccgtacctcggccgcgagcgcaaccaggcggccgtcgacgagaacgtcgagaagctgaagaaggtgctggaggtgtacgaggcgcggctgagcgagagcaagtacctcgccggcgacttcctcagcctcgccgacctcagccacttcaccgtcatgcactacgtcatggccaccgagtacgccgcggtggtccaggcattgccgcacgtcaacgcctggtgggagagcctcgccgcgcgcccggcggcgaagaaggtggccgagttcatgcccgtcgacgtgcccgggtcacccaagaaattacaggagtgagatgatgaacagtactgtgatgtgtgtgtgtgtgctagctgtggttaattacgtacttttatctcatgtgtacgtacgtggtgtatgtctctgtagttggtgtatttcgctgcttgattccgccatagaataacacagcggtgtgttggaaattcaatgtatttcatcacagttt

SEQ ID NO: 13488 - DNA, 930 bp, Sorghum bicolor
  Clone ID: SORBI-28MAY03-CLUS2853_1
gcacgatccaccgaagaaactcacggcctgcacgctagatcagcgaaccaaacatgagtcatccgcccagcagtctcacatccagagccatccatcagagaagcacctgaacgaccatggcctcgccgctgctcaagccacactctcacgtcgccgccgccgccgccctgcactccgcgaggagatcagccgaccgccacggccgctgccccgcgacagtacacctcgccggcaggttccatgaccacgggcgcagcaggtccggccgttctaagagatccggttcagcgaaggtgagcgccttgccgtcgctggaggtggtgccgctgatggtgacgatggtggagcacgtggacatgtcgcgggactacgtcgtgaccaagtccatctggcatctcagcgacgcagcgctcaagagcgtctataccttctacgccatgttcacggtctggggcgtctgcttcttcgcgtccatgaaggatcccttctacgacagtgacacgtacaggagcgcgggtggagatggaaccgtgcactggtactacgacaggcaagaggacctggaggcgtctgcgagggaggagctcctgcgggaggagctgctggaggagattgagcagagggttgggggcctcagggagctggaggaagtagtcacaaagtgattgattatactatacgggtgttacaatcagttctctaatatgaacttcgttagcaaataagttcagacttctttactgtcctcctcaagtctgtataatggccccaattgacgcctggatgatcgaactctgcgctgctgccgtgcaatagtacgatacatatacatacgattcaaagaagaaaaggatacatatacatatagtttgtttttttaacggaaacaggaggggagtgcacccctactgcatgttattaatataaaaa

SEQ ID NO: 13489 - DNA, 1053 bp, Sorghum bicolor
  Clone ID: SORBI-28MAY03-CLUS28833_1
gcacgagggccagtagcccgtgccgtgtgggtgtggctgtgggtgcgcgttctccccagtcccccacctcgccgccttttccccgcgtgctctctctctcggcgacgaccgccgccgcccttcgccaggttcccagggcttcgtcgggcccttctccggcaacgagcaccgacaagattttgtttgtaaagattgtgagagcaccattcacttttcattagtgaagttcaacacttcaagcatgagtagctctcaccgtgtgaagtggaatgaggacaatctgtatgaaattgagtcaaacaaaccagtcaggcagaagataacagagccaaagacaccatatcaccctatgatagatgatgatgggtcactgtcgccaacacgtcctttcgacaaatgtctcgatgagactgtccaggctgaagctatcttaacagccttaaatggtgtggcttcttcaagcaatagcaattcaaaggatgacggttggggatcgtcagatgatgatacagacgcaatagaacaagatgatgacccagaagctgacacaacaagattgagtttcaaggagcatcgccgtgcccactacgatgagtaccgcaaagttaaggaactgatgagcactggatcccttactgttgaggaggctgatgaggataacagagctgccaccagctccgaatacaaaggtgtggggaaaagagcagcgaacgacgacatgaagtcctcaccgcaaacatgagagttcatatgaatgttctgattcctcttatttacaaagctaggacagcccttcgtggccgaagcatgcagtttgcctaagtaagctaacagtgcttcgtgtgtgctggatcagtgatttggcattgggtgctttattgtatcattgtatgtgcaatacagttgctactcttgttttgttttgttttgagatgcttgtgtgccaaaatggctttgatgaccgagaattgtagtggagttggctgtttggtggaatggtcgtttgctccatttggttggtgactcaacttttcaattgagatactatgtttc

SEQ ID NO: 13490 - DNA, 1110 bp, Sorghum bicolor
  Clone ID: SORBI-28MAY03-CLUS29644_1
gcacgaggcaaacacgagacacttactagctagcagcccgtacgtgcgtgctacgtggtgttccggagaaatcgatcgacatgagccagggccagccgaggaggccgcagcagggcgaggacctgcagcagcacgcgcaggagcagcccgtcaagtacagcgacgtgctggacgtgtcaggcgagctggcccagcggcgcgtggctcccagggacgccgcgctgctgcaggccgcggagcagtccgtgctcggcgggacgcagaggggcggtcccgccgccgtcctgcagtccgcggcgacggtcaacgcgcgcgcgggccacgtgggcagggcccagatcacgggccccgtcgccgacgccggcgccaccgtcgtcgaggccgagctcggaggccgccgcgtcgtcaccgagtcggtcggcgggcaggtggtgtcgaagatggtgaccccgccgcacgtggcgatgacggacccgccgggcgcgctggacaaggacgccgtcacgatcggccgcgcgctggaggccgtggtcgcgatggctggggacaggccggtcgaccagagcgacgcggcggccatccaggtcgcggagacgtgcgccaccgggtcccacgccaccatccccggcggcgtggccgcggcggcgcagtcggcggctgatcagaacgcccgcgccgtgcgcgacgaggacaaggtcaagctccggaacgtcctctcgaacgcgagggagaggctgccggcggacaagggggcgacgcgggaggacgccgagagggtggtgtccgcggagatacggaacaagctggacatgacgaccacgccgggcggcgtggcggacgcggtgactacggcggcccggctgaaccaggagcgcccaaggccataggtcgtgtggccttatcccaagtggagcacagggaacagcggaagaagcatgccatgagaagactcttctgcgtgcagacgagcgcgtgcagttgtaatgagtttatgactactactacgttaagcaacaccacgtccgctttcaaaactttcttgtaaaaatacgcgaatgacactctgtccgcagtgtgtagcaataaaaacgttgcgaatcaagttccggt

SEQ ID NO: 13491 - DNA, 648 bp, Sorghum bicolor
  Clone ID: SORBI-28MAY03-CLUS45208_1
tggaccgcacgaggccatttcatacgtaacacaggtagctagctgatgtgctggacgtgtttcccaagcatggaggctgtgccacgcagaacagtcctcggcgcttgcgcggtggccgtgctgatggcgatcgccgtcgcgaatgctgggtccgccgaggcggcgtcggtcgtcggcctagccaagtgcgcggactgcacgaggaagaacgtgaatgctgaggcggctttcaatggtcttaaggtggcgatcaaatgcaagaacagcaagggtgagtacgagagcaaggctgtcggcgagctccaaagcaccggcgccttcagcgtccctgtctccgtcaacctcgccggctgcgtcgcgcagctccacaatgcagcaggcacgccttgcccggggcaggagccgtcgaggataacgccgttgtctgatggcacctttgttgccatcccggccgggaacacgcaacaggcgtcatctgcggtgtgtgcgtcggtgacaatctgcggccctgtcatgaaatatttccacgagcactttcacaagaaggacaagaagcctgagccgtcaaagcccgaaccagagccagagcccaagccacagccagaacaccagcctcctacagcgacgtacggatcagcaacgccatcc

SEQ ID NO: 13492 - DNA, 1019 bp, Sorghum bicolor
  Clone ID: SORBI-28MAY03-CLUS4610_1
gcaggcggggaggggtcagccctgcatacttgccctcgccgcaacctgcagctccgcaccgtgccctcccccaacagccccgcgtgctcggcgagggaggcatggaactagcaatattctcctcaaagtatgtcgaatccggtgaggaaggacccaattggatttaggggcagcttcagctgcagcgagcgcgagcgcgggactgggcgactgcagagggcgctcgaccgctcctctctctcttcaagttgaagtggaggcctatcttgctcaaacaactgaagatcggtctggatccaaagactccagttgaagctatagctcatgttctgcccaaatcaactttccttttcaatcttggcttggcgtccaaatatatgaaggatatagcttaaagctacagcgatgaagaagcgtgtgctggaactgatgttctgcatgtagctgatgttctgaagacgtttgagatgttttatgtagcttatgttctatagatatttgaggttctgtgtgtcttgaatatgatctgtatgaatttatgcttatttttttatattgcttttttagtcctgtttaaattgcctgtgaaattttgattaaaaagggtgagagcttatttgattctagttgaatgggctatatggcacagcaatcacaacgtgattccttcacaggttgaagtggaggcctatcttgctcaaacaactgaagatgggcaagatccaaagacactagttgaagctatagctcatgttctgcccaaatcaactttccttctcaatgttggcatggagtccaaatagatgaagaaagatgctaaaactgctgcgatgaacaagcgtgtgcaagaactgatgttctggatgtagctgatgttctgaagacatttgagatttttgatggagcctatgttctgcagatatttgagattctggatgtgtaacctatgttctgcattcatttgtgcttttggtgttgtattgtagtttgagacctgtataaaatgcctgtgatatttt

SEQ ID NO: 13493 - DNA, 1091 bp, Sorghum bicolor
  Clone ID: SORBI-28MAY03-CLUS46709_1
gcacgaggtaaaaccccagcccacccaacccaagagcggaaatggatctaaaccagttcgtcccctcgcagaactcggcgctgaccatggactcggcggagagcacggccgccgccgccgcgcgcgcgcccaacggagccgcccgggccgtcgacgactacgacgacgacgacgatgccgtccccgaggtggccgcctgcatatcggcgatgctcgacctcgggggcagcgtggagagcaagcgcctcttcctggcccgccgcacagcgctggagatgctccgcgaccgcgggtacgccgtcccggaggacgagctcgcccgcaccctcccggagttccgcgcctggtgggaagacaagccggagctcgaacgcctcgccttctccactaccctcgcctccgacccatccagcaaggtgaaagttgtgttctgtccacctgaacctgtcaaaatcgcggctatccgggtggtatatactggagttaaagatgagaacttgtccagactgattctgatcctccagggcagaataatgtctaaagccagagaagctatcaaggagatctttccatataaagttgacacgttccagatcacggaactactggtgaacatcactaagcatgccctcaagcccaagcatcaagtgttgactgctgaggagaaagccaagctcctgaaggagtacaatgtggtggattcacagctgcctcgcatgctggagaatgatgctgttgctcgctattatggactaggcaagggaactgttgttaaagttatatacgacagcgagcttaccgggaaccatgtgacataccgatgcattttctaaggggcccatgcatttcggtggatgaggtctcataagcagtttgtaaaaattacctctcagaggggcaggtgatactgttctgctagggcagtgtaaacccctaataatgtaggatgaagcttgctgtaagatattggtaaaaccatcttgtgccaagttacctaagtgcttggtattaagcttggaagcagtaagacaactaattttttagtaagtcatctctgtcaaaaaaaaaaaaaaaaactcgagggggggccc

SEQ ID NO: 13494 - DNA, 1375 bp, Sorghum bicolor
  Clone ID: SORBI-28MAY03-CLUS32377_1
gcgtctcgtcctctctccctctctctctctccttctctctcctcttcgattcccaatttgaaggctgcccaagcccaacccttgcgccggtaggcggcggcggcgaggatagagggttccccgaggaggaagtgatggcggccacggctaagtacaatcggagcaacccggcggtgaagcggatcctgcaggaggtcaaggagatgcagtccaatccctcacccgacttcatggcccttcccctcgaggaggacatcttcgagtggcaatttgctatccttggcccgagagacagcgagtttgagggtggaatctatcatggcaggatccagctaccctcggattatccattcaagccaccgtccttcatgctacttacgccaagtggacgctttgagattcagaagaagatttgtttgagcatatccaattaccaccctgagcactggcagccttcatggagtgtccgcacagcgttggtagccttgattgcattcatgccaacgaaccctggtggggcattgggctcactggattacaaaaaggaagatagacgagcacttgctataaaatcacgtgaagcgccgccaaaatttggctcctcagaacgtcagaaactaattgatgagatccatgagcaaatgctcagtaaggctcctcctgtcccccaagcgctaccaaatgtgccaaacgaggagtctaaccaattacccacacctaacgcttctggtgagcatgcagacaaggtagatgaaggtgacaacacatctgggtctatgtcaggctcgttgagtggccttcctgtgcctgaatctgaatcgggggttgcagaaaacactggtgaagcctcagctgttgaggttgccaaccatcatgtgcctgaagcgagccatagagagaacattccaacagttccttcgtctctgcagaatcctgctgttgcgatccagaagccaaagcatgacaggctgttgaccttggctgcatttgggctgactcttgctattatggcacttgtgataaagaagttcttaaaaatcaatggcttgggcggtttcattgagggcaagttctgagtagggattgtgcataagttggatgtaagagatcactcattcctcgtactgagcatatgctataagctatataacaccctaagatttgtaaatggctgttgtttagttataatagatgaaatcaaaatgggacagtactattaataccccattgtatgtagtacacttgatggaaaattgccggagttttgaagcagctgatctaatgtatatgtttgctacagcgtgcactttgtaaaaccggaaccctcaattctcaatctccctctggagggttttgattaagaatttcatgaaac

SEQ ID NO: 13495 - DNA, 1312 bp, Sorghum bicolor
  Clone ID: SORBI-28MAY03-CLUS3543_1
cctactgaggtccggtgcattttccaactctaaactaggcaaacaccagcgaaagtctcagcttctccgaggaagggggcgaaattgctcaagcagcagcttcacttggggccaaacagaaatggcggcttcttgcgcctccaccctcccttcgctctccttcgtttcctcctcttccagttcatcccgccgattcaggcgctctggtgtggtggccatggccagcgttgggcagaaggtgtatgcgcccggtgtggcggtgtcggagggcaatggcgggctccagaaaatcgacctcaaatccccgcacgggagcgaggctgagatttatctgtttggagcatgtgttacttctttcaaagtccctaatggcaaggacctgctctttgttcgaccagatgctgtgtttaacgggcagaaacccatcagtggtggaattccacattgtttcccccagtttggcccaggtcccatgcaacagcatggatttgcacggaatgtgaattggtctatcacagattcagaagtcacggaaggagatccagctgtaactttggaactgaaagatgactcttatagtcgttctatgtgggatttcagcttccatgcactgtacaaggtttccctgcactctacaagcttgtcaacaactctagaaataataaatacggatgtcaagcctttctcattcaactcagcactccacacttatttctctgcttccatagctggtgtttctgtgaaaggtctaaaaggttgcaaaactctcaataaggatcctgacccaaaaaatcctttggagagcaaagaagagagggaagaggtgacttttccaggattcgtcgactgcatctaccttggtgcaccaagtgagctcatcctggacaatggattgggtgacaaaattgccatcgcaaattcaaattggtcagatgcagtcttgtggaatcctcacttgcagatggaggcctgctacaaagattttgtctgtgtggaaaacgccaagattgaaatggtacaactggagccaaaacaatcttgggtggcagaacagaaaattgaactagtctgaagaccttgcagcaattgcatcaagtagagtgagatgcaaatggtgctcccccaatgtaactcttcatggccgtgtcatcacaatagctatacatgtgatgttttctgctaataaaaagaataaatgatgcaaatcatggtttttttgccgcagtctcttgatgtgtactgaattgcaaatgtatactttgaactgcatggactctgttgaaatgggagtgcccattttgatctccgaaaa

SEQ ID NO: 13496 - DNA, 905 bp, Sorghum bicolor
  Clone ID: SORBI-28MAY03-CLUS36204_1
gttcagcagcgcgcagaccctggagcgggagtcgatggcccaccagaccgcggcgctggcggcgcgcgcggcccgcgcctccccggtcgggcgctgcaggccgcagatcgtgaccatgaccgccccggccgtgggcgggtccgtcacgcactgcggctggaactcgacgctcgaggccgcgggcgccgccgtgccgatggtgacgtgccccccgtacgccgaccacttctacaacgagaagctggtggtggagctgctcaaggtcggtgtcggcgtggggtccaccgactacgcgtcgaagctggagacgcggcgcgtgatcgacgggatggcgaacgcggtcgcgatcgtgatggtgatcggcgagggcgcggtcgcgatgcgggtgcgggcgaaggagctggcgctcagggccaagcccgcgctggccggggcgggggccgcgtccgcttatgacggtcgcgtacgggtcgtgctcgtggctctgactagctcgatctatgtctgattcagaatacaatactactctcagaatgttcagagtgaacatggaagagcctttgtcaggggggccttcttgccccacagatagaacgtacaggcacgttgtccgttccgcttcccggtgaattctccgcccttttaaagtgtgatggctcacggcttgtacacagaggcaatacgagagaaggccaaggagctcggggagaaggccaggcgtgcggtggccaagggtgggtcctcttacgatgacgtcggacgcttaatggacgagctgatcgctcgtaggagctccgtcgatgtttgatttggtgaggcgctttgtttctttgtaaaataattccctctaccgggatgtcagcgggccattgattatttctcttgttctatgctcctcaaagcgg

SEQ ID NO: 13497 - DNA, 591 bp, Sorghum bicolor
  Clone ID: SORBI-28MAY03-CLUS36289_1
gcgcccgccgcccccgggcgccccgcccaacaaggctggcgcggccaaggacgcggcggcggagaaggcggaggcggccgccaagaaggcgcaggagtctaaggaggccgccaaggggaaggctacggagaaggcggcgtcggccaaggacgcggcgtgggagacggtggagacggccaaggagaaggccagcgaagggtacgagagggtgaaggagaaggcgagggagacggcggacacggccaaggagaggctggaggaggtgaaggagagggtcgctggccccagcgccgacgccgacgccggcaaggggaagcaccggagggcggacgcagacaagtaccggtcggaggatgagctgtgagagagagacctcgccggcgccggcgttggatgatgtttgcattcagtgtcgaggatgtttccagcgtgtttaaagctctactttttttcacacagatctgtacactctctttagtcttctgtttcagccacgaccatgatgctgttcctgctctgtagtataataatctgttgacgtgtacaaaagcttcccacaaaatttgagttacgtacaacttcttgttattc

SEQ ID NO: 13498 - DNA, 1498 bp, Sorghum bicolor
  unsure (1)..(1498): unsure at all n locations
  Clone ID: SORBI-28MAY03-CLUS382_1
aagcagcgcaaacccctaccctctctcgcctctcctctccctatccatccccaaaataatccccacctcccgctgctcccccgcctccgccgcccgccatggcctccctcgcctcggcctcaacctcactcctcttcccgcaggccacctcatccaggagccgcgtccggctctccacctccctgggcttctccgcgcagccggcgcggctgcggagccgggcggcggcggcgggcgggcagcggcgcgggcgcctgctggtggtgcgcgcggcgaggggcaagttcgagcgcaccaagccgcacgtcaacatcggcaccatcggccacgtcgaccacggcaagaccaccctcaccgccgcgctcaccatggtgctcgcctccgtcggcggcagcgcgcccaagaagtacgacgagatcgacgccgcgcccgaggagcgcgcccgcggcatcaccatcaacaccgccaccgtcgagtacgagaccgagacccgccactacgcgcacgtcgactgcccaggccacgccgactacgtcaagaacatgatcaccggcgccgcgcagatggacggcgccatcctcgtcgtctccggcgccgacgggcccatgccgcagaccaaggagcacatcctcctcgccaagcaggtcggcgtccccaagatcgtcgtcttcctcaacaagaaggacatggtcgacgacgaggagctgctcgagctcgtcgagctcgaggtccgcgagctgctcagcaactacgagtacgacggcgacgacgtgcccatcatcgctggctccgccctcaaggcgctcgaggccctcatggccaaccctgccctcaagcgcggcgacaatgagtgggtggactacatcttcaacctggttgatgaagtggataactatattccagtcccacagcggcagaccgacctcccgttcttgctcgctgttgaggatgtcttctccatcaccggtcgtggtacagttgccactggccgtatcgagcgtggcaccgtcaaggttggtgacacagtcgatatcgttggaatccgggacacccggacctgcaccgtcactggtgttgagatgttccagaagaccatggatgatgccatggctggggacaatgtcgggctgctactccgtggtatgcagaaggacgacattgagagaggcatggtgctggcaaagcccggctctatcacaccgcacaccaagtttgaggctgttgtgtatgtgcttaagaaggaagagggtggccggcactcacctttcttccctggttaccgcccacagttctacatgcggacaaccgatgtgacggngagtgtgactacgattatgaatgacaaggatgaggaggcgaagatgtgcatgcctggtgaccgtatcaagatgattgttcagctcatccagcctgttgcttgtgagcagggtatgaggtttgctatccgtgaggggtggaagaacgttggtgctggtgtcatcaacaaaatcattgagta

SEQ ID NO: 13499 - DNA, 1521 bp, Sorghum bicolor
  Clone ID: SORBI-28MAY03-CLUS38328_1
gcacgaggatctccgcccgcccgcccgctggcccacggacatgtggggcccgccacgccgtccgcggagccgccagccgatccctcctgttatttatccccggcccccggtccccgcacgcgcctgcacacacacacacacacacactccgcagcgcaatccgcacgcccgcgcggcagccgcagacgccttcgcctcgaccagagagagagagagagagagagagaggggtcgggatggccgccgcggtggtcgacgacgctgggatggacgccgtccagaagcggctcatgttcgaggacgaatgcattttggtggacgagaaggacaatgttgttggccatgagtcaaagtacaactgccatctgatggaaaagattgagtctgagaatctgctccatagggcattcagtgtgttccttttcaactcaaaatatgagctgctacttcagcaaaggtccgcgacaaaggttacctttcctttagtttggaccaatacctgctgcagccatcctctgtaccgtgagtctgagcttatccaggaggactaccttggtgtgagaaatgcagcacagaggaagctactggatgagctgggcatcccagcagaagatgccccagttgaccaattcacccctcttggccggatgctttacaaggcgccatctgatggaaaatggggggagcatgagcttgactacctgctgttcatcgtccgggatgtgaaggtgcagccgaaccctgatgaagttgctgacataaagtacgtgaaccgcgaggagctcaaggagctgatccgaaaggctgacgccggcgaggacggcgtgaagatctccccctggttcaggctggtggtggacaacttcctcatgggctggtgggaccatgtcgagaaaggcaccctcggcgaggctgtggacatggagaccatccataagctgaaggagtgagattgcgccggccgtctctgatgagctcaccgcctgttggtgctgctgcactgcatgtttatcagttatcgctcttacccgcggaaagtgagcttgactctgtgttgtgttgccggggtggccgacgtatcgttgtggactgatgatgagttttgcggaggggtttggtcttgtttgttttgttcggtgacagagttgcgcgcaggacgcttgtttaacccgtgcttatacatcgtctaagtaaacagcaataagtgggacatccgtaagctgtttgtgttttcaataggctaggattattctcttgtaagaggttgtctgtaactgctttgcgattagtatgctactgcaggtctgctgcagttccattgctgcttatgtttttggcaggaggtcgatgcttgtgcgacctaggctagcggcggcgtgacgctcagatagtcagatgtggtgcggcccgtggagatacgggtgattgggaggtggatggctgttgcatgttggctctgcttcttggtctttttgcttgtgactggacctccttcattttttttaatttaatgaaactata

SEQ ID NO: 13500 - DNA, 807 bp, Sorghum bicolor
  Clone ID: SORBI-28MAY03-CLUS38376_1
caacttcaagagtgtcaaggagaaagtgcatgacaactcttcagtttctcagaggtcagctttggtcatcaatggtaagctccaacggacaagaggtagaggtttggccacgcataacctggagtccacgttggggtctcaacttcaagagtgtcaaggagaaagtgcatgacaactcttcagtttctcagaggtcagctttggtcatcaatggtcagaacgtcttccttgaaggcctctcgttggacggcactctcattgtcaatgctatcgatgaagcagaggttaaacttaccagtcatgtacaaaataaaggctggattatccagcacgtcgactacaaggacacctcggagaaggaagagataaggatccgtggatttaagttggagaagattgagcagctagaggtgaactacacggaaccaggaaagcatagcttgagtgcatgaaacaaagcattcttgatttgcttgattgaccagtagcttcctaccaactggaaatagttcacatctggattgcctcccagattcggggaggcgctgaaactgttattctccttcccgagtataataaggagcaaagtgcttcaccaatcactcaacattctttatgtatatctgtacttgtatagtattagtaccctcgttcatagccaatcttttttctccccttctgtgtaatcagagttgattatttatttggtgtctgatgtttatgttacaatattgaattttataaaacttggcactgaatcaagcaagtgtggcagtacgtgattagtgttaaaaaaaaaaaaaaaaa

SEQ ID NO: 13501 - DNA, 1713 bp, Sorghum bicolor
  Clone ID: SORBI-28MAY03-CLUS5814_1
gcacgaggaacatactcaggcctcaggaccgagaacttgacttgctgattgtaatactgcctgaccggcacggggctctttacggggatctcaaaaggatctgtgagactgatcttggattggtctcccaatgctgtctgactaaacatgttttcaaggcgaacaagcagcagtatcttgcaaatgttgccctgaaaataaatgtgaaggttgggggacggaatacggtacttgttgatgctttgacaaggagaattccccttgtcagtgatgtaccaactattatctttggtgctgatgtgacccatccccatcctggggaagattctagtccttccattgcagctgttgttgcttctcaagactggcctgaggttaccaagtatgcaggattagtgagtgctcaaacccatcgccaagaattgatacaggatcttttcaaagtatatcaagatccccaaaggggatctgtctctggtggcatggtcagggaacttctcatttctttctggaggtcaactaaacagaaaccaaaaaggatcatattctacagggatggtgtcagtgagggacggtgcttcccccttgtcagtgacaggccgaccataatatttggtgctgatgttacccatccacatcctggagaagattccagtccttccattgcagtccatgttgcttcacaagactggcctgaggtcaccaaatatgctggactagtgagtgcccaagctcatcgccaggagctgactggtactgtggtggactcaaagatcggccatccaactgaatttgatttctacctctgtagccatgctggcattcagggaacaagccgccctgcccattatcatgtcctgtgggatgagaacaaatttaccgcggatgggttgcaaactctcaccaacaacctgtgttacacgtatgctaggtgcactcgctcagtatcaatcgttcctcctgcatattatgctcacctggcagccttccgagctcgcttctacatggagccggatgccgctgacagtgggtctatggcgagtggtgctacgacaagccgtgccccaggaggggcacgcaacaccagggctggtcctggatttgccgccctgcggcctttgccggccccctgggtagccatgccggcattcagggaacaagccgccctgctcattaccatgtcctgtgggatgagaacaagtttacagctgatgagctgcagactctgacaaacaacctgtgctacacgtacgctaggtgcactcgctccgtgtcaattgtgcccccggcatactatgctcatctggcagccttccgagctcgcttctacatggagccagatacctctgacagtgggtcaatggccagtggggcccgtgggcctccaccaggtggggcacgcggcatcagaggggccgggagtgttgcggtcaggcccctacccgctctcaaggaaaacgtgaagcgtgtcatgttttactgctgagctgcattcaccaaggaatcctggagtattccatgtatccgcactgtttcggtgatactatcggacactgaatttatgcattaagacttccagttcattcaagtgatctggggattttatgtacgcttgttttgtattcgtgatgttgtgacgctgcagttcgaggagctttagtactgtgatgtgtgaactatttgttgccaagttgtaaccagccatacttagtg

SEQ ID NO: 13502 - DNA, 321 bp, Sorghum bicolor
  unsure (1)..(321): unsure at all n locations
  Clone ID: LIB3476-011-P1-K1-B5
cggacgcgtgggtgcagcagttgaagctcgtgttctgccaccaccaaggcttaaataccatgatagtggccgagagaaggatgttttgcccagagttggccaatggaacatgatgaataagaaaatggttaatggtggcagagtcagcaactgggcatgtattaacttctctcggaatgtgcaagatagtgctgctaggggtttctgtcacgagcttgcagtcatgtgccaaatatcanggaatggatttgctcttgagcctgtgctcgctccagtgactgcaagacctgacatgttgaaaggcgttaaaggccgtatcag

SEQ ID NO: 13503 - DNA, 1173 bp, Sorghum bicolor
  Clone ID: SORBI-28MAY03-CLUS59634_1
aaaaatcggtcgcagctcacaagctcacacttaacagcacgctcaccactgagcagcaaccagcgccatggggagcgccaccatgccacgaagtttcgccacgccacgcgcgccatgccgcagcctccatacgctcaggtgcaggtgcaaggctaccggcggcgccgaccgccgcgacgtgctcctcggcctcggcggggcggcggcggccggcctcctcagctcgtcgttgtcgagccgcggcggtgcgctcgcggcgcccatcccggcgccgaacctcaggaactgccacccgcccgacctccccgacacggtgagcgacatcaactgctgcccgccgggcgcggggacggcgatcgtcgacttcacgccgccgccgacggtcgggctccgcgtgcgcccggccgcgcacctggtggacgaggagtaccttgccaagtacgagaaggccgtggcgctgatgaaggaactgccggacgacgacccgcgcagcttcacgcagcagtggcgcgtgcactgcgcctactgcgacggcgcgttcgaccaggtcgggttcccggacctggagatccagatacacaactgctggctcttcttcccgtggcacaggttgtacctgtacttccacgaaaggattcttgggaagctcatcggcgacgacaagtttgcgctgccgttctggaactgggacgcgcccggcggcatgtcgctgccggcgatctacgccaacaagtcctccccgctgtacgacgaaaggcgtgaccctgctcaccagccgccattcacggtggacctcgactacgacaggatcgagcaaaacatcccaagagctcagcagatcgatcagaacctgatgatcatgtaccgtcagatgatctccggtgccaagaagaaggaactcttctttgggctgccttaccaccagggcgaccagccagacccaggcgcaggcaccgtagagagcgtcccgcacggcccagtacacttctggagcggcgacccgagccagccgaacaacgaggacatgggcaacttctactccgccgcgcgcgatccactcttcttcgcgcaccacggcaacatcgaccgcctgtggtcggtctggaacggcctccgcgccggcaacaccaacttcaccgaccccgactggctgaacgccagcttcctcttcta

SEQ ID NO: 13504 - DNA, 1380 bp, Sorghum bicolor
  Clone ID: SORBI-28MAY03-CLUS5900_1
gcacgaggccccacgcttccgcagcggtccagccccaccgtgtccgccacgcccatccccaagtcccaagtccaagtggagcagagcccgccgtaccaatcgcctccccagatcggcgacccacccggaggcggaggaggaggcggcgatggcgtcgtcgcaggcgaacctcgacaagatgcagctccgccagagctaccgcaacgtctggcacaccgacatgaccaacgccatccaggccgacttcccctactgctgcctcgcgctgtggtgtggaccttgtgtgtcgtacatgcttcgcaaaagggctctttacaatgacatgtcaagatatgtctgttgtgctggctacatgccatgcagtggaaagtgtggcgagagccggtgcccagagttctgtcttgcaactgaggtgtgcctttgctttggcaattcagttgcatcaacccgcttcttgctgccagatgaattcgacatacttacgtctccgtgcgtcatctgcatcattggcttcatgttctgccttcaacaagttgcttgcatcttctctatagttgcagctattgttggcagcgaggagctttcagaggcttcccagatccttaactgtctgtctgatttggtctattggacggtttgtgcctgtatgcagacgcagcacaaagtcgaaatggacaaaagggatggaaagttcggcccaccacagcccatggcagtgcccccagtgcaacaaatgtcacgcattgatcagcctatgccgcctcctgctggatatgcaccacaaccagcatatgggcagccttatggtggctatccacctcctgctggtcaaggttatccgccagctggatacccccagggcggtggataccctcctgctcaaggctacccacagggtggtggataccctccacctgctcaaggttacccccagggtggtgcatatcctccgcctggttcttaccctccacaaggttcgtaccccccagcacagggctcctaccctccagcacagggctcctaccctccagcacaaagctaccctggcaagtaaagagcacacgacaggagagatacctttgctaggcaaccaaatatcgtgaacatgtaaacagtaggactgctgtagagctataggttattttgacaaattcttgctactgctcagggtggtattcggtgaacaatgtttctattttctacggtcaactcatcaacggcttgtgttgatcatatcgtgttgagtttatcattcttcgaataaggaatggcagtgaattggaaatttcatctgtatttgaatttggtgacaacggacgtggagattgttgcttgtctgttttcgataaataattggagcttgtctgagtcatgttaaac

SEQ ID NO: 13505 - DNA, 1138 bp, Sorghum bicolor
  Clone ID: SORBI-28MAY03-CLUS402_1
gcacgaggctcggctcggtacagccccccactcaaaaaacgcctttcttctcccggtccgctcgtgcgctctttcgctcggcgacgattggacgaggacgaccgccaccgccgccgcccccaggtcctcgccgggcccttcgccggcgacgagcatccaccaggctcagaaacatcgctgacatccacctgcaccacagtagttcagtagagtagccgtcggaacccacacacccgcgatggcaactgctcctgcaacatcctccgtggctacgaactccccctgcctgcggctgcctagcatgcccctgaggcgtgcacctggcgccatctcgttcccttctcgcccatggccagccacactgacctcatgcactggattgtcgcggcgctcagacgtggtcgccgccgcagggcaccagaagttgatgggatctttgaccaacaacgaggggctcaggtttggggtggttgtggcacggttcaacgaggtcgtgacaaatttgttactgcagggtgctctagaaactttcgagcgatactctgttaaagcagaaaatataacagttgttagtgttcctggaagctttgaagttcctataacggcacaaaagcttggcaaatctggaaaatttgatgcaattctgtgcattggagctgtgattagaggtgacacaacccactatgatgctgttgcaaactcagctgcatcaggtgtactcaatgctggattatctgctggtgttccttgtgtatttggtgttctaacctgtgaagacatggaccaggcgctaaaccgtgctggtggcaaggctggaaacaagggtgctgaaactgctcttactgccattgagatggcctctctgttccggcatcacttaggctgacactgtgtgtgttctgatctctatacacaaggcgacagcatttcttcctatcaagagttttggctaatagagcttttgcgctgcggctggaataattatttccaaatctgttggtccggtgctgattggttgctttgctttctttctatgaaatttgaaaagctcatgagacatgtttgtaaacctgacaccatgaataattgtcaccaatagtgaaatacgatcaagaataaagttgcactagtgtttgta

SEQ ID NO: 13506 - DNA, 1047 bp, Sorghum bicolor
  Clone ID: SORBI-28MAY03-CLUS4156_1
gccggccgggctgccgggcttttttccgttggcccaccacccatcgccctcgggtgaggacaccgggatcccgcggctcgcgcacgagcaccacgaactttcttctccgccgtcccactacacctcccgtcgcgccgccgagcgacggcgcgcatccgcctcctccgctccgcctctcccgccgccgccctgcctcccgcgccgtcacgcctctcatcgccgccccgcctccctccgtcgtttctggctgcggggcttcttctccgtcgccggctacgcgcgtggatccagggtcagcggcgtccgtcccgcgtgagaagggagacggagacgggagtttgtcatggcatcaaagcgtatcctcaaggagctgaaggacctgcagaaagatccccccacatcatgcagtgccggtcctgctggtgaggacatgtttcattggcaagcaacaattatgggaccacctgacagtccctatgctggcggtgttttcttagtgaacattcatttcccgccggattaccccttcaaacctccaaaggtttctttcaagacaaaggtcttccatcctaatatcaacagcaatggaagtatatgccttgacattctcaaagagcagtggagccctgctttgacaatttctaaggtcctgctctccatctgttccctgttgactgaccccaacccggacgaccctcttgtccctgagattgcccacatgtacaagacggaccggccgaaatatgagtcaacagctcgcagctggacgcagaaatatgcgatgggctgacgattaccttctgctcatcccctggcgattctcgtgcggtctcaagaaacgttcatgggcgtcattgtttccttgggtttgttgctggtcgtgtgtatccctgatccatctaggatcctattgtagtcggtgtcggcctaccatcattgccatccatagtgaggtggctggacatgcttttgcctatgcacctatgcttgctgggatacctccttccgggtcggtgctatttggtaaatgttcatcgaagacgttga

SEQ ID NO: 13507 - DNA, 669 bp, Sorghum bicolor
  Clone ID: SORBI-28MAY03-CLUS41703_1
cacacacggccgagtataagactcccttgcatttttagcacaccagcacagaagcaagagagaggtactccatagagcagagatggcgaagcactcggctgccatgtgcagcctcctagtgttggtgctgctctgcttgggctcccagctggtccaatcccaggtcctcttccaggggttcaactgggagtcgtgcaagaagcaaggtgggtggtacaactacctccgggggcaggtggacgacatcgccgcaacgggggccacgcacgtctggctcccgccgccgtcgcactcggtggcgccgcaggggtacatgcccggccgcctctacgacctcgacgcgtccaagtacggcacccacgcggagctcaagtcactgatcgcggcgttccacgccaagggcgtgcagtgcgtcgccgacgttgtgatcaaccaccgctgcgccgactacaaggacagccgcggcatctattgcatcttcgagggcggcacgcccgacagccgcctggactggggccccgacatgatctgcagcgacgacacgcagtactccaacgggcgcgggcaccgcgacaccggggccgacttcggcgccgcgccggacatcgaccacctgaacccgcgcgtgcaggaggagctctccggctggctcaactggctcaagtccga

SEQ ID NO: 13508 - DNA, 1299 bp, Sorghum bicolor
  Clone ID: SORBI-28MAY03-CLUS4180_1
gcacgaggctcgcaggcttcgcaaggcggccacacgccgatacctccaccaccacccgctccgtcgcctcccccaccggccacgccaccatgctgccaccggccgcgcgcctcgcggcccgccgccttctcggcctcgcctccgcatctgcgtcggaagccgccggccgccggctagcttcgtctccgatcgctgccgcaggctactccgccgccgcctctaggggctccgtctccagcaccaggcccttctccacggctcttaactaccaccttgattcgccggagaacaagccggacatgaaatgggagttctcggaggcgaatatgaagaaggtcaatgagattctgtctcactatccaagcaactacaagcaatctggtattattccgctgcttgatcttgcacagcagcagcatggtggatgggtgccagttgcagccatggatgctattgctaaaatcgtcgaagttgcaccaatcagggtatatgaagttgctaccttttacacaatgtttaaccgcactaaggttggtaaataccatcttttggtgtgtggaactacaccttgtatgattcgtggttcacgcgaaattgaagatacattgttggagcaccttggagttaaacgaaatgaggtgaccagtgatggtttattttctgttggagaaatggagtgcatgggttgctgtgtgaatgctcctatgattgctgtggctgactactcgaaaggctcagagggttacacatacaactactatgaggacctcactccgaaacgtgttgttgagattgttgagatgctgagaagaggcgaaacaccccctcgaggcacacaacacccagagcggaaaaactgtggccctgctggggggaacaccaccttgctcggagagccgaaacctcctccatgcagggatctggatgcctgctaggtttgcttcggagcattacgagcacacaaataagttggctcgcactgtaaggtgtgcaaactgcaaacagcagaagggatgtattatttgcattctgaagctttcttgtgtttcacagtgaaagcttttctaacttttatatcctgcaccatcagagaaacagtaaattgatagacaataagatgttttttgatctgatgttcagtggcaaacgctttgtattttgcaaccggtgaaggagctgaacctgtggcaactggaagaatcgaccaccgtgcaatgctgttcattttgttttattattaagtcttgttgttagtcattgaatgatgagatcatatacttgatatatctcgaattttgc

SEQ ID NO: 13509 - DNA, 1381 bp, Sorghum bicolor
  Clone ID: SORBI-28MAY03-CLUS4248_1
gcgcgcgccacgacccgtcggctccccagcagcccagcagcactcggcgccccggcgcgccgccgcacgacgggccggcggccatgagaggtttcttggagtcccgtgggttccttgcttgctgccgcggcgccggcggcctgcatcgcactgctacagccgtctgctctgtgcccgttcgacggcctcacgccggcagatcgtcaagaactggcaatcttgagcaatacaactcatgctgcaggtccctgctccaagaagcttcgcatggctgctacttcaccggacgacgtgaggcttctgggtctcctgaggagagccagcatggacgacgacaataccatcataatgaccttcacgaacaaggcgtggacggcgccggggtcgctcatggacctcttcctcgagagcttccgcgtaggcgtgaggacggagccgctcctgaagcacctggtcatcgtcgccgtcgacggcaaggcgtacgcgcggtgcacgcaggtgcacccgttctgctaccacctccgcgccaggggcgccggcgtcgacgactacgcgtcggagcagtcgttcatgtcgaagagctacctggacctgatgtggcgccggaaccggttccaggcgcgggtgctgcagctcggctacagcttcgtcttcacggacatggacatcctctggctgcggaacccgctgctgcgcgtgcccgtcggcgccgacctcgccatgtccgccgactacttctacggcgacaacccgtacgacctgaacaagacggccaacggagggttcgtgtacgccaaggcgagcgccaggacggcggcgttctacgacggctggtacgaggcgcggagggagcacccggggaagaacgagcaggacgtgttcgatcaggcgaagcacgcgctggcggcgcggcacggcgtccgggtgcagttcgtggacacggcctaccttagcggcttctgcgagctccgcaaggacttccacgtggtgtgcacggtccacggcaactgcctcttcgggctcaaggacaagctccagaagctcacccaggtgttggacgagtggaagcagttcagggccgacgccgcgcggatgggcagcaacaccaccgcgctcacggactgatgaatgaattgctagcatagcagccgcggccctacgtccgtgtgatctttctcaacatgcatgtccgtgtttcagtacaggagaaaaacaagcttcgcacaacaaaccgagcaatacattgtttttttttcccgatcagtatcatcatagtaggattctatgggattggattttttttgcagatttgttttgtgtataacaggctaacagcggatccctttagaatctgagaagatacacagtacgtcatgatttg

SEQ ID NO: 13510 - DNA, 1438 bp, Sorghum bicolor
  Clone ID: SORBI-28MAY03-CLUS4274_1
ctgcagcggcaataactcccgctgcccaccggctcacctgtccttcaataccaaattcaatccggccagtggttggcccgccgctgccagatcgaatcggactctcaatacatgcagcccaccaccgagacgccgaagctatatttcatgccatctgatctgattcgatgcgtgtggcgtctctgcttttactagatcatcagtagtacccagttcaggagcctggtcagagcacatccaggcgtcttctccctcctcaccgcggctccggcgatggcgggcgtgggctcggcgttgcggcggctctacctctccgtctacaactgggtcgtcttcttcggatgggcgcaggtgctgtactacgcggtcctgacgctgcgggagagcgggcacaaggccgtctacgccgccgtcgagaagccgctgcagttcgcgcagacagccgccatcatggagattcttcatgggctcgtagggttggtgaggtctccggtctctgcaactcttccacagattggatccaggctgttccttacgtggggtgtcttgtggagttttcctgagacccagtcacatcttcttgttactaccctggtcataagctggtctatcactgagatcatcagatactctttctttggaatgaaggaggcatttggctttgcaccttcctggttattatggcttaggtacagcacctttatgttgttgtatcctactggtatctctagtgaagttggtctgatctacattgccttgccttacatgaaggcatcggagaaatactgtcttaggatgcccaacaaatggaacttttcatacgattacttctattcgtctattcttgccctcctgatttatgttccaggaagcccgcacatgtaccgttacatgctctcacagaggaagaaggcactatcaaaggccaaagcggcttaatgctgctcaagggctctgtagatggtttgtgtgatgtcgaaatgtgcctcacggctcaagttttcgacatttccggtagaatctagtgattggggatattattagaatggagctcttcatatgaactgccccaatcatttcagctatcagccgttgcatggttaaattgtaatttgttccgaatcgccctcaattgggcgagtttccatgttgattatatggcaatgtgtttcacatccttctctcatctggtactgtgttctcttatttgtagcaaataatgtatgattgttgtgctggaatcatttcagctatcggctgttgcatggttaaattgtaatttgctccgaccgacccccaattgggtgaatttccatgttgattatatggcaatatgtttcgcatccttctctcatctggtactgtgttctctacttctcttgtttctagcaaacaatgtatgattgataatctagtgccatgaacattttcatgctct

SEQ ID NO: 13511 - DNA, 931 bp, Sorghum bicolor
  Clone ID: SORBI-28MAY03-CLUS43591_1
cgcactcagagcacgtcgggcggctgtcccatcccagctaaagcaaaaccaccctcgatcgagcccgagctgatcatcattcctttcacgacgcaaagaaggcaccaagaagaatcccctccatcgacgacgaaggggcgatgacgatgaggccgctgccgcagaccgtcgtccacctcctcccccccgtcgccgccgtgctcgcgttcgcgctcattggctgcctcgtgggcggcgccagcgcgacggtggtgacgacgtgcagggcggcggcggacagcgacgcgcgcgtggactacggcttctgcgtggcggagctgggcatgcaccgcgagagccccgacgccgacgtctggggcctcgccaaggtggccgcgctgacgggcgtcaacaacgccgacaacgccgtgtacgacatcaaggccctgctgctgctcgccgccgacgacggcgccaagagcaggtcgccgccgccggacggcccgacgcgcgcggcgctggagaagtgcgggaggctgtacgactccgtcgggttcgcgttcgccgaggcggacgacgagatcaacaaccgccgctacgccgccgggaagggcaaggtcgcggaggcggtgtccctcgcgcgccagtgcgacgacgccctcgccaaggccgccgccgtcccgtcgccgctggcgcagcacagctcgtacaacgtgaggattgctaatatctgcaccgccatcaccaacctcatcaagtgaatatactgctgtagtatatagtactgtaattacaggaacaggagcactcactttggtgcatccagaataaataacgtggtcgatcggcctgacaggtgacaggactttaaagtttgtataccttttgaaaactttgtacaaataatgaaaaaaaaggagttctgcgtcgagtaaagttctccactctcccc

SEQ ID NO: 13512 - DNA, 2015 bp, Sorghum bicolor
  Clone ID: SORBI-28MAY03-CLUS44387_1
acaacgaggcatacaatacaattcatttcccaacagatcaatcatcctctacatgttacatcacctcgcctgtcgcgtttttataagccttagaaaagagatgcgccgcgcgcgcggtggccatctagctatcgctggtagtacatatcagcaccggaccggccctctgccttgaggttgcgtgtattgttctttgtgggcgtgggcgttgatggcgtcaacggcatactcgcggccatcgaagccgcctgggccggcggccggcgagaggaaaggaccacggctggccaaggagctcggcaggatcgagcccaagaagctgggcatcgggctggtggccggctgctgcctcgcgctgctcacctatctctcctttgcccggctatttgccatctactcgccggtatttgacagctcgtccctgttgttgaagaacacgccgccggcaacgacgacggtgccggctacagaggcgctgccggtgcagcaaaagacccaagtggaggaccagaaagatgctcctgaccctgagctggacccgaacatgccaaacttaccagaggtcacacaaaaggatcaacaggaggaggccacggcgacaaagccagccggtgccgtcacagaggccaagatcacctgcgacgagaacggcgttgaccagggcttcccgtacgcgcgccctcccgtgtgcgagctcgccggcgacatccgtatcagccccaaggagaaagccatgtacttggttaacccgtccggcgccggcccgttcgactccaacggggagaagaagattcgcccgttcgcccgcaacgacggcttcctcctcccaggcgtcgtggaggtcaccatcaagtccgtgtcctcggccgcagccgcgccgcagtgcacgcgccggcacgacgtcccggtggtggtcttctccgtggccgggtacacggacaacttcttccacgacaacacggacgtgctgatcccgctgttcctcaccacggcgcacctgaaaggggaggtgcagttcctcatcaccaacttcaagcctgcgcggggcaacaagttcacgcccctgctgaagaagctctccaactacgatgtcatcaacttcgacgaggacaaggaggtgcactgcttccgggcaggacacctcgggatgtaccgggaccgcgacctcatcatctcccctcacccgacgcgcaacccgcacaactgctccagggtcgactacaaccggttcctccgccgcgccttcagcctgccgcgcgacgcgccggcggtgctcggggcggagaccagcgccaagcctaagatgctcatcatcgagcggaagggcacgcggaagctgctcaacctgcgggaggtggccgcgatgtgcgaggcgctcggcttcgcggtgaccgtggcggaggccggcgctgacgtgcgtggcttcgccgagagggtgaacgcggccgacgtgctcctcgcggtgcacggcgccgggctcacgaaccagatcttcctgccgacgggtgccgtgcttgtgcagatcgtgccctgggggaagatggactggatggcgaccaacttctatgggcagccggcccgcgacatgcggctccggtacgtggagtactacgtctcggaggaggagacgacgctcaaggacaagtaccccagggaccactacgtgttcaaggacccaatgcgcatccacgcgcaggggtggcccgccattgccgagatcatcatgaagcaggatgtcatggtaaacatgacaaggttcaagccgttcctgctcaaggcgctcgacgagttgcaggagtagctggagaagggtgattccctttggatagcctttgtatggctcgatgcggacagtttggatagggcgataggccagcacagatgcggtacaggggacttttcgtttttttttctttttctttgtcattaaatcaactaaaattttttattttcatttggggctgtttattaacacgtcgttgtgcaatttggaaagagctataaattactccttc

SEQ ID NO: 13513 - DNA, 675 bp, Sorghum bicolor
  Clone ID: SORBI-28MAY03-CLUS67034_1
ctgggtgccaagaaagtcttcttgcttgatccttgatccattcagaactcggtcagatgtcactgggccaagccacgccactaatccgaggctccgatcccagctagcaagctagcacagccattgagaactccccactgcagtcaggagcagaagctgcgccgccgttgcaagctttgccggcaatggaggccgccgaggacgtcgtcatcgtcggcgctggactggccggcctcgcggcggctctcggactacacaggaaaggggtgaggagcctggtgctggagtcgtcgccgtcgctgcgggcgtcggggttcgcgctcaccatctggaacaacgccttccgggcgctggacgtcctcggcgtgggcgacaagatcaggaagcagcacctgcagttgcagaagctacgtgtcatgccttctgctaccggagaaatcgcacaggaagtggacctcacgcaacaggggaaacaacgagggcccaacgaaatccgttgcgttaggcgggacctgctgctgcaggccttggaggaggagctgccgagaggcaccatccgctactcctccaggatcgtgtccatccaggacgacggcggcgtcaaggtcctccaactagctgacggctcagtcatcggacctcacgcgcccgtcgggtgcgacgggatcaattccg

SEQ ID NO: 13514 - DNA, 669 bp, Sorghum bicolor
  Clone ID: SORBI-28MAY03-CLUS67167_1
tctgtgcaaatcaaatccaaccaccgcacgcgtcgtgtcatacgtgctctcatacaacgccaccttcgccctcagtgcacagcacacactaccccacccagagcaacaccgacgatggctccccctgccaatgcccaggagcagccgcagccgcaggtgcagctggtgggtggccgcaaggtggtggacgaggtttccggctggctgcgcgtgctggacgacggcagcgtcgaccgcacctggaccgggccaccggaggccctcccgctgatggagccggtggcgccgtacgcggtgccgcgagacgggcacacgctccacgacctgcccggagagccgaacctgcgcgtgtacctccccgaggcgaagggggagaccgccggcgcgcgcctgcccgtcatcctgcagctccacggcggcggcttctgcatctcccacccgtcgtggctcatgtaccaccacttctacgcgcgcctcgcgtgcgccgtccccgccgtggtggtcgccgtcgagctcccgctcgcgcccgagcgccgcctccccgcgcacatcgacacgggcgtcgccgcgctccgcaggctccgctccatcgcgctgtcggccgaggacggcgccctcgatgacccggcggcggccgcgctcctccgtgaggccgccgacgtgtcccgg

SEQ ID NO: 13515 - DNA, 747 bp, Sorghum bicolor
  Clone ID: SORBI-28MAY03-CLUS67641_1
ctactggatttccaactgcgacccacgtcaaaacaggtggcccaaaaaaaaattatttccaaactgcaacccacgtcaaaacaggtggcccaccaacgattcacttcccccatcccaggcggcggcgatcgtaaattcgcaacttctcccacgcggcgatcaacgagcgatgatgagctccagggccggatccatcctcctccgccacgccggctcccgtctattcaccgcagcggcggtctcaccggcggcggcctcgaggccattgctcgccggcgggagcaacaacggtgtccaggcagtcatgttacgcctgatgtccacgtcctcccccgccgccgcctcggaggcgaaggacgaggcagccaaggcctccaaggagggaggggacaagaaggcggtggtgatcaacagctactgggggatcgagcaaaacaacaagctggtgcgggacgacggcaccgagtggaagtggacttgctttaggccatgggagacgtacacggcggacacgtccattgacctcaccaggcaccatgagcccaagacgctgatggataagatcgcctactggaccgtcaagtcactacgcttccccacggacatcttcttccagaggcggtatggctgccgggcgatgatgctggagaccgtagcagcggtgcccgggatggtgggcggcatgctgctccacctgcgctcactccgccgcttcgagcagagcggcggctggatccgcgcgctgct

SEQ ID NO: 13516 - DNA, 759 bp, Sorghum bicolor
  unsure (1)..(759): unsure at all n locations
  Clone ID: SORBI-28MAY03-CLUS4849_1
gcacgaggccgacctggccgcccccctacatttctattcccctctcgagcccaaaccctaaacctaaacctctcacccgccgccgccgccaccgtcaccgacagcaccaccaccaccactccctccgccgtcccggggctccatcccaccgccgccgacttccacctcggattgaagcaatgtcgtcggacgatgaggtcagggaggagaaggagctcgacctctcctccaacgacgtcgtcactaagtacaaggctgccgccgaaatcctcaacaatgctctgaagctggttgtgtctgagtgcaaaccaaaagccaagattgttgacctttgtgagaagggtgactctttcataagagagcaaactgggaatgtctacaagaatgcaaagaggaagattgaaaggggcattgctttcccaacctgtgtatctgtgaacaacacagtctgccacttctcaccgcttgccacagatgatgcagttctggaagaaaatgatatggttaaaattgatatgggctgtcatattgatggctttatcgctgtggtggcacacacacatgtaattacaagtgggcctgtcacaggaagagcagctgatgttcttgctgctgccaacacagcagcagaagttgctgtgaggcttgtgagacctgngaagaagaataaggatgttactgaagcaatccagaaggttgctgctgcttatgattgcaaaattgtggaaggtgttcttagccatcaactgaaacaatttg

SEQ ID NO: 13517 - DNA, 1330 bp, Sorghum bicolor
  Clone ID: SORBI-28MAY03-CLUS447_1
cgtggccgccgctggggtagccccgatcccggcgccgccacccccgcttaaaccctagagcggcggcggcgatggctcccaagcgctcggctccacctccgcccccggttgcctcctccgaggagaccgcctctggttcgggctccgaggaggaggaggaggaggacgaggaggagatcgcccactcacctcctccggccgctcacaagagcattgctccgccgccgcagaaggaccaggaatccgaagcgtccgatgaggatgaagatggcgaggaggaggaggaggaagaagaagaagaagaagaagacgagaaggccaaccgcgtgatcccttcttcggccaccaagaacccgcctccgccgccgccggctcgcgaggaatccgagacctccgacgaagaagaggaggaggaggcggacgacgagatgccgcagacgaagctcgctccaactcaagagatggaggcgaagggcgcaaagcggccgagcgcgctgttccagcgcacctggtcgacggacgacgagttccgcatcctggaggtcctcgctgcgcaccgcctggagcacggcaggctgcccaaaatagacgtgctggccaacgccctcgctggcaagctcgacaacagtggctgcagcctccccgagctccagaggaaggtgaagagtttgcagagcaggaacatcaaagcggtcaagaagggcgtgctgccgagcaaggatgaagaccgccgtctcttcgacctcttcaagaacgtctggcccgttacgaaggtggcacctaccaaggtggcgcctaccagtggtgctggtagggagcctgacgagatgtgtgagctgtacccataccttgcggaggaggtgaaggcgcttcagaaggcacacccgggcatgttcaagcgggagttcgcgatgatcgacgatagcaaggcccgtgcactggacgagaagatcaagaggcagaggcatgcacagatgagactgcatctgcgtcgccttgacctgaccaaggaagtgaccaagacactcatggacctggctgagtgatgggatggactgggctgaacaataggcattctattttatggcattcaaatgcattgatgcgagattaccagcaaatgttgtatcatatactgttgcattgtcagtgttaagtcaggaagtgcctggatgatgttcagttattcttctgttttgttgttggttctgaacttggcaggataacttcgaagtctaaattttgtcagtcgccgcgctggtgttctggtattccgttgtgtttggggcagtctgggctctcgcggcttgcggataatatgttattacta

SEQ ID NO: 13518 - DNA, 378 bp, Sorghum bicolor
  Clone ID: LIB3476-002-Q6-K2-A2
ccgaagggtccgatgaggatgaagatggcgaggaggaggagcacgaagaagaagaagaagaggaagaggaagaggacgagaaggccaaccacgtgatcccttcttccgccaccaagaacccgccgccgccgccgccgactgacgacgagttccgcatcctggaggtcctcgccgcgcaccgcctggagcacggcacgctgcctcaagcagacgtgctggccaacgctctcgccggtaagctcgacaacagtggctgcagcctctccgagctccagagtaaggtgaggagcttgcagacccggtacaccaaagcggtcaagaagggcgcgccgccgagcaagggtcacgaccaccgtctcttcgacctcctcaagaacg

SEQ ID NO: 13519 - DNA, 1034 bp, Sorghum bicolor
  Clone ID: SORBI-28MAY03-CLUS5403_1
ttatccatccagctacccataaaaggcgacctgagagccgagagaagccagatcgagccagcgttttctcttctggcagatcgaacttgtaccaacagctaaatcactactagcagcggcggactgcaggagtggacgaacggacgacgatggctgcgccagcgccgcatcaggggcaggggcagcagggcgaccaccaccagccgaagctgcagaaggtgatggtggcggtggacgagagcgagtgcagcggccacgcgctggagtgggtgctgcggaacctggcgcccacgctggcgccgccgctgctggtgctcaccgtgcagccgcacttccccctcggctatgtctccgccgcggcctttggcgcacctctgggcaccgttcctccggtagctccggagctcatcaagtcgatgcaggagcagcagaggcagctcacgcaggcgctcctcgacaaggtcgtggccatctgcgctgagcatggggttgctgtagagacaattgttgaggtaggagatgcaaaagagatgatatgtgaggcagctgagatgaaaaatgttgatctgctggttcttggaagccacagtcgtgggccaatacaaaggttgtttcttgggagcgtcagtaactactgcgtacaccattcaaagcgtccagttcttgttgtgaagaaccaaggctgaaggttcctgttcctgaacaaatcaactccctggtcgtcctaattatgttcggggtatttatcaacaaatatgtaagaagtattactttagccaaacacattggcaaataaaatagcttgcttctgggagggccgaggatggcaaaggaggggttccttttttttccttgtcagtttgtcttgcttccggactggcatatatacgttatggtctcgcagggttgtaaataagaactagtatgaactttgtgcgtgtttatgcttgatggcagttattctgttatggcctggctgctcataaacatctttggggtactctcaaaatatattcattttcccattgattccc

SEQ ID NO: 13520 - DNA, 968 bp, Sorghum bicolor
  Clone ID: SORBI-28MAY03-CLUS4823_1
gcttatgtctatgacatgcgtaacaagctctacgacaagtacagtgattttgtcacacccgaggagaaggaagggttgattgcaaagcttcaggaggttgaagattggctgtatgaagatggtgaggacgagacaaagggagtctatatttctaaactggaagagcttaaaaagattggtgatccaattgaggcacggtacaaggagtggacggaaaggggttccgctgtagatcaactggtgtactgtatcaacagtttcagagaggctgccttgtcgaatgaccaaaagtttgaccatatcgacgtgtctgagaaacagaaggtcatcaatgagtgctctgaagcagagaactggttaagagagaagaagcagcagcaggatgccctaccgaagcatgctaacccggtgctgctcgtatcggatctgaagaagaaagctgaaacacttgaccggttctgcaaaccgatcatgacaaaaccaaagccagctccaaagccacagactccaccaccacagactccaccgccacagcctgaaacccaagcgcctgagcctcaaacaccagagcaacaacaaagcgggtctggcgcagctggcgagcccgggagtgagggaggtgtgcaacaggcctctggtgagcaaatggacatggacaagcctgacgagtcagctggtgccgcggcataagtttggtttccatctctgccttatgatcgatcaaatttcttttattgtgtctggtaggtggatgagtttaaggctacactagcgttctcccaagcgatttcgttttggggggtgttggacagttaggttgaggtatgcgtcttgtccagcgttgttttggtctggactgaatccgaatagaaacgttgcatgatcgaattgtaccattggaatctcataatcgaatgttgtggatgattcgaccaaaggtatatttacatgtttacttgatggccttt

SEQ ID NO: 13521 - DNA, 1009 bp, Sorghum bicolor
  Clone ID: SORBI-28MAY03-CLUS550_1
gcacgagggattagttcacccggaaaaccgactcgctctcccgaggcccggtcgataccaccaacgctgccaccgactcatacactacaataacccgaccatctacagtagttttacagattttcggcttaatgcgccacgaccccctaggatacagtgagcccgtgactgtgcatcattgcccatagcctgtggcgccttccacggtccccattccggatcagtctctcggctgccacagggccgcgtcccctccgcgtctgccggttcccctctccgctcttcccccgccgagatatttcccgagactctgagagcggagccacctcctcctggccatgtcgctgctcgccgtcgcctcctccacccgcgccgcggcagtgcggccgctgtgcgcctcggcggcctcggcgggcgtggcagtgcggactggagaaactgccacgaggacggatgcacaaccaaggttgcttattccggtggtacttgtgatgatgtataacagatggaatgggatattagttccggattatggtttcatgcaactgcagttaataccaatgcttgttgggttttttacctataagattgctacgttcgctcaagcaatccaggattctatacctgcagttggaaatcgtgaaggttgaaaagtgtccttgttgtatataaacaaaggtgatagccctgatccctggtcagtggtcacccagatagtaaggtctgtatagaagaatcttgatctggtgtcatcaccaagtagatgagatgctcgttgaggatgccatttgaaaatctttagtgcttaactataatgttttgcgcaaatgttctgacgaaaggtggtgcaaggtgatgttaccacgttcattccatattgcacgcagatcatcaatgtataaatttacggctccaaacttttaccacaatgattaattaacacaattgtatgattgaattcacatttagcactgaatgcaaattatgcaggctgcaagtacactcattt

SEQ ID NO: 13522 - DNA, 923 bp, Sorghum bicolor
  Clone ID: SORBI-28MAY03-CLUS459_2
tgctgctgcatctcgggaccaactgaccaaattagtaaaatttgcaaaggacaatgggtccatcattgtctatgattctgcttatgcgatgtacatatcagatgacagcccaaagtctatctttgaaattcctggagcaaaggaggttgctcttgagacagcgtcattctcgaaatatgctgggttcactggtgtccgtctaggttggactgttgtccccaaggagctccttttctctgatggacatccagttgctaaagatttcaatcgcatagtctgcacttgcttcaatggtgcatcaaacatttcacaagctggtggtttagcttgcctctctccagagggtctgaaggctatgcatgatgtgttggcttctacaaggagaacactgaaataattgttgacacatttacatcacttggattcaacgtgtatggtgcgaagaacgctccttacgtatgggtgcacttccctggccgcaattcgtgggacgtgtttgctgagatcctggagaaggcgaatgtggttactactcctggcagtggatttggaccgggtggcgaaggctttgtgagggtcagcgcattcggacacagagataacatcattgaagctgcaaggagattaaagcagctgtacaagtgagcgcagaagcgagaagctgcggacagggcagctgcagagaagcacctgaagcacctgcagaggttggggctgaggaaagcgcccgagcctgaagtgcccgcggaggttgggcctctggtgaacgagtgacctcaccagccactgtgcgtaatggtgctgctaacaacactgcagccctgtaggccacaaaataatcttccactgtgaagagcttgagcgtggccttgtatcatggcagcttttcaccttgttgtacatagttttaagtttctcatcac

SEQ ID NO: 13523 - DNA, 1194 bp, Sorghum bicolor
  Clone ID: SORBI-28MAY03-CLUS459_1
gcctctgggttcgttcgcgaagccccccttcctctcctcacatccactcctcccttcccttcaccgaccgaccgaccgaaccgaccccggaagctctcgcccggtcgcctccctcctcccgatccccaccgccatggccgccgccgccgcgtcgtcctcctccgagggtccggtcgccgtcagcacctgcgtatccctcggcgaggcagcggcggctccaggcggcggcgaccgggcggcggcggattgcggggtgtgcgccatctgcctcgacaggatagcgctccaggagacggccctcgtcaaggggtgcgaccacgcctactgtgtaacctgtattttgaggtgggcatcctacaagcagaaccccctgtgcccacagtgcaagcatccatttgaattcctcagcgtgcatcgctctctcgacggctgcctacatgactacctgtttgaggagagcgtttgccttctcctgagggccgcttggtttgaacctctgatcgtagaggctcacgaagagcccctggaagatgaagagttttttgaccagcagtaccaatacgatgacgatgaagatgatcttgatgaggaatcttattacatgagcaggtcctcgagcattcctattggtaccaggagatggggggacaatgggtacatcagaggaggttcgaaggaggcggggccagtcaacactgatgcttctgctggtccatccaggaccccgaagaagaagaaagagaaaactgcgtcgtcgtcttcggcgtcggtgtccgtgtcaggttcgggatcagggtcagggtctgtgtccaaggatgtcgctggaaggcgagcgaagagggcgcagaagcgagaagctgcggacagggcagctgcagagaagcacctgaagcacctgcagaggttggggctgaggaaagcgcccgagcctgaagtgcccgcggaggttgggcctctggtgaacgagtgacctcaccagccactgtgcgtaatggtgctgctaacaacactgcagccctgtaggccacaaaataatcttccactgtgaagagcttgagcgtggccttgtatcatggcagcttttcaccttgttgtacatagttttagtttctcatcactgttttagatccagcacagaaatgcagatgccgtctgcacgactgatgcagcaatgaagttttatctcgttcttgt

SEQ ID NO: 13524 - DNA, 896 bp, Sorghum bicolor
  Clone ID: SORBI-28MAY03-CLUS5589_1
gccggccgggctccgggacgaccaccacagcagcagcaagtgagaagacttgtagtcgaggagctggggagcaagcaagcaagaagagagccgagagagctaagctagcgcgcgatggcgaggtcttccaagatgatgatggcggcggcggctctgctggccctggctctggccgtggcgacgaccgccgaggcgaggaacatcaagacgacgacgacggcggcggcggcggagaagaaggcggacaacgacgcggtggtgcagccgcagaccttcccgcccttcgaccgcctcggcggcggcgcgtccccggcgttcggcggcctccccggcaccggcagcagcattcctggcagcagcattcccgggttcagcctgcccgggagcagcggcggcagcagcatgcctgggttcctgcccggcagcggcagcatcggcagcatgcccctcttcggcggcggctccccgttcagcggcttcggcggcatgcccggctcccccaccgccggctccgtccccgagcacgccaacaagccctgaactccgtcagtcgccggcgtggtagtagagtgatgctactatagtacgtcgtcgtcgtcgtcgtcatcgtgcgtgcgtgcgtgcatgcatgcgtggttggttggttgcattggtttcccctagctacatacgagcagttcttgtgttctagctagctatagctcgtgttctagtactgcttttagttacctgcatgcattattggagagctggatgtgttccatttgttgtttgcttcattattagttctgtctatgtgagacatatggtgtttagctgttggtgatgactggttgtagtagtggtggtgatgttcttgaggcatgaataatgctacatgtgatgtgatgtttgtg

SEQ ID NO: 13525 - DNA, 1385 bp, Sorghum bicolor
  Clone ID: SORBI-28MAY03-CLUS5887_1
gccggccgggctacgctgttcgcctatcccctcgatcccgcatcacagtcaccgggaatggcgacgctcaaggtcccagccactgtccctcccgtcgccgatgactgcgagcagctccgcaaggcattccaagggtggggcacgaacgaggcgctcatcgtctccatcctcggccaccgcgacgccgcgcagcgccgcgccatccgccgcgcctacgccgaggcccacggcgaggagctcctccgctccatcacggacgagatctccggcgacttcgagagggccgtgatcctgtggacgctggacccagcggagcgcgacgcggtgctggccaacgaggcggcgcggaagtggcagccagggaaccgcgtgctcgtcgagatcgcctgcacgcgcacctccgcgcaggtcttcgcggccaggcaggcgtatcacgagcggttcaagcgctcgcttgaggaggacatcgctgcgcacgtcactggggacttccgcaagctactggtgccacttgtaagtacataccgctatgatggaccagaggtcaacacaaggttggcacactcagaagccaaactactccatgagaagatccatcacaaggcttacagtgatgatgagatcatcagaatcctcaccactaggagcaaacctcagctgcttgctacattcaatcattacaatgatgcatttggccaccgaatcaacaaggatctgaaggctgaccccaaggatgagtacctcaaaacactgcgggcaatcatccggtgcttcagttgccccgacaggtactttgagaaggtcgccaggcaggccatagcggggctaggcacagacgagaacgccctgaccagggtcattaccacccgcgctgaggtggacctgaaactgattaaggaggcgtaccagaagaggaacagcgtgcccctggagcgcgccgtcgctggggacacctccggcgactacgagagcatgctcctcgcgctccttgggcaggagtgatgagccgtggtgcactgttgcgtctctgaccggcgccgtggtgtcgttcatgatgataatcagaataaacctggtatgcctagctgtaccagaggtggtttcttcggacttcggtcctggtattacagcttgcatagcagtggtgataaataagttactgtgttttcgacgaatgaactcaatgtttagctacgtgggcactaagtcgtgggacctctgttgcatatgttggcagagacgcagagacgttatatcatgagaaacagcccgggagctccagtgaccatcatagtgtaggcgactatggcggtatgcctttgttatctgctgctttattgtccacaggggtgcatatacataaactgtactcgtctcgttcgctg

SEQ ID NO: 13526 - DNA, 1789 bp, Sorghum bicolor
  Clone ID: SORBI-28MAY03-CLUS9535_1
gccggaaaaagggggaaatcccctttcccccaggctcctctccgctagcacccaacagccagctgctcgggctgctgccgctcgcctgctcccaatcccagcgacccagcctcccagagtccatgattccccagcagtcagcatccagccagcaagcagcactcactgcacgtcaaggcggccagcggtgaggggcgcgactaccgactacgaggccgcgaacacgactgccgacggcgaggcagcgagcgcgactgtggcactgcgctgcgcgaggccgcgaccctcgggccccagcaggccggcaccccgcgaccgcgagggcatgggctctgctgcgcggtgtttcgccaggttggttgatagctggtcaccattggcatccattgaacgtttcgatatcgagaatgaccagagcggatctgggtcagccatgggtggtgatggtgcgttgggcgacaagcggcgctctgggtccattggtttatatgattcttcgaatgatagtgcaaatcagacgctgggtaagcggccacgcttccaaacggactccgacaatccccaagttgagccctgggaagaggaagatttccgtcgttcgcctgattctacgtataggcgaggatcgacttattctgttcgtgaacggctgcttgggagcaagggcacagcagaaaggtctctctatgcgaagcttgacagggctgagaatgctagtaggagatacggcatgggctctggaatgggtggtttcgctgggttgggtgataggcgcggcgctgggtcatccatgggtcgtttccctgggttcaatgacaggagcggctctgggtcagccatgggtggttttggtgcgcttagcgacaagagcagctcagggttcattggtttatatgattcttcgaatgatagtataaatcagacgctgggtaatgtggcacgcttccaaacagatgatgacagcagcgaagatgatcagtgggaagaggatgattttgacttcaggcctgatgtgacgtataggcgaggatcgacttattctgttcgggaccttgaccttacaagacctgcagccgcaaagaatcctcctagaccacagtttgaaacaactacagcggaggttttgaggaaggctgattttaggaacgttagattcctctcccactttcttacggaagctggaattatcatcaagagaagccagacccgtataagtgcaaaagctcagcgtaagattgcaagagagatcaaaaccgcgcgtgcatttgggctaatgccttttacaacaatgggtagaagaccattcatctttggcagaagtgcggaggagcactattcagaggaggaatatttcggctttgggaggcagagggatagtgagcctgttgaggataatggggacgaggagccaaatgtggaggctgcataacattttggagtatccttttccaagtgttcgtgttctctgccggcctcattcaacataatgctcctttttcgtcttcagagcatagcgtagctcagcttaaataaaactgtaacatcgcacttattctgtacacttatgtcttgctcacctgtgccgtcatagcaaaatatccccagcttgatatcctcctggttggagaccatatatgcaatatgaaatggaacatgggatcagtgctttcctgtgcgctgggaaacttaggtagttgtactgatttcaattttctgttggatattggttgttgggctgatgccaccgacagatcatgaattcatgtgctggttgttgacagcttcattt

SEQ ID NO: 13527 - DNA, 1152 bp, Sorghum bicolor
  Clone ID: SORBI-28MAY03-CLUS9670_1
ttttttctcgcccgggagccgcaattccatcctgctgttcgcatcttgaggtaggcgatgatacatgaggaatttgagatctcttgatctggaatctgtgttcttggtgtcgggttgcacgtgggggagctccgcgtggggcgcggcacggtcgttggctcggcgctcctgcctcctccccctcaccctccgcccccgccgtcctcgcgcccattttctcgcccgggagccgcaattccatcctgctgttcgggttacatactcgtccaatagaacaattctacatccgatgatcgtacttcctgaggtagaagcataccgaagcaagagtcgagcggtgttgaattgaaatggaaggcaggatgacaagtttggaagccgccatgaaagcttcttcgtcaatggcaagcagcatggcaaggaatgctgaccctgaccatcagactctccgctccaattcagtggagcagttttattttccaagacctggccaatctttgccaggcattcctccattctttgggcctccctcctccagtttgtatcctcctaatgacaatgaagctaaatttggcagccagtttgaatcaaatccttcacagaatacagattgggacccgcaggctatagtgagcaacctaaccttccttgagcagaagatcaaacaggtaaaagatattgtgcagtccatgaataatcgagagaaccaagtagctggtggttccagtgagctagcggcaaagcagcagctcataaccgctgatctcactagcattataatccagctcatatctactgctggttccctgctcccttcaatgaagaacccacttcttagcagcaatccggcagtcaggcagctcggcaacactcttggttctcctatgggctttggcatgaatgctaatcagcgaccaagtgtagacagcaagactgatattcctgacacaggaaaaacttctgattatgatgaactgatgaatagccttaatactgctcaagatgaaagagatgagctgatcaaatgcccaaatctctgtggtggtgaagggtctgaaccgactcccatggaggaccatgatgtgaaggagagtgatgatggtggtgaggggagagaatcttcctcctggttcatatgtagtcttgccattg

SEQ ID NO: 13528 - DNA, 2283 bp, Sorghum bicolor
  Clone ID: SORBI-28MAY03-CLUS9699_1
atcccgactccattccggcaccaaccctagctcccgaagggccggaggtgcccaatatcaacggaccaccggaacagcaacagtagcggggcgccggtgccgtttccttcactcattccgcccctgagacgtacccagatctacaagctactccagtcgacttccataaattcgactcccgcgattccaccttggagttggaccggccgtttttgcttcctcgccgaaaacagaatatccgatcaggcgtagtgttcttaggcttcgctgcccctactacgtcttcgccgggatcggtccatggccggcgccgagcgcgcggaggcggtcgctctggaggaagggctcctcgctccggaggaatccaaccaagtagtatacactggagatggatcagtcgacttttcgggaaatcctgttgtcaaggaaacaacgggtagatggaaggcatgtccattcatattaggtaatgaatgctgtgaacgactggcctattatggcatctccacgaaccttgtcacttacttgacaaaaaagctacatgctggcaatgcctctgctgctagcaatgtgactacatggcagggaacttgctacttgactccgcttattggggcaatcctggctgatgcatactgggggaggtattggacgattgcaacattctccacagtatacttcatcgggatgtcaatactgactctttcagcatcagttcctatgctcatgcctccatcttgtgaaggatccttttgcccacaagcaagcccttttcagtatactgtatttttccttggtctttatctgattgccctgggtactggtggaattaagccttgtgtctcatcctttggagcggatcaatttgatgatacagatccagctgagcgaatccagaagggttctttctttaattggttctatttttcaataaacattggtgctctcatatcaagcagctttctggtttgggtgcaagacaatgtaggatggggactgggctttggcattccgactgtattcatggggctggcaatcataagtttcttctctggcacatcactttataggttccaaaaaccaggaggtagtcctattacacgagtatgccaggtgattgttgcctctttgcgcaagtggaatgtgcctgccccagaggacagctctctcttgtatgagctacctaatggggtatcaacaattgaggggagtcggcaaatagagcacacagatgaactcagatgtttagacaaggctgctacagttaccgaagttgatgtgaaaatggctgacttcagcaacccatggcggatatgcactgtcacccaggtggaagaactgaagatactagtaaggatgttccctgtctgggcaacaacaatagtgttttctgctgtatatgctcaaatgtcgacaatgttcgtggaacaagggatggtgcttgacccatcgttgggttctttcaagattcctccagcttcactgtctacctttgacaccctaagtgtcatcgtatgtgtcccgatgtacgattacattgtggttccaatagccaggagattcaccggcaacgagaggggctttacagagttgcagaggatgggcattggcctggtcatttccatccttgctatgtcggtcgctgcaatcctcgaaatcaagcggctagcagttgccagggaagcacacctggtggatcagaatgtcccggtcccactgagcatattctggcaaatccctcagtatttcctgattggtctagcagagattttcacattcatcggagcgcttgagttcttttatgaccagtcaccagacgccatgaggagcctctgcagtgcacttaatcttctcactactgcgggtgggaactatctcagcacgttcattttgacaatggtcgcgtactttactacgaggggaggtaaccctggatggattcctgacaacttgaacgaagggcatcttgattacttcttctggctccttgctggcctcagttttctgaacctgattgtatatgtcatctgtgctggcaaatacaagggcaagaaggcagcttgagttgtgaaggtcaggaactggacggctcgccatgtttccttggacacttattaacttcaacaatctgtatatatgtttcccacattcactctagctgaagcaacgatctgtaattgttgggaagcttttatttctcattttactgtactaaattgattttacattcgtacttccactttctgtatatattgctgaatatatggacatctcacttttcgc

SEQ ID NO: 13529 - DNA, 1684 bp, Sorghum bicolor
  Clone ID: SORBI-28MAY03-CLUS9612_1
acggcacggcccctctgtccatcctctgctctcctctcgccggcgcccgcgtcgctcgagtagcagtcagcctcagccatggccgcggaggcggagcagggcttccgcccgctggacgaggcgtccctgctcgcctacatcaaggccacgccggcgctctcttcccgcctcggcggcggcggcagcctcgactccatcgagatcaaggaggtcggcgacggcaacctcaacttcgtctacatcgtgcagtccgaagccggcgccatggtcgtcaagcaggcgctcccgtacgtgcgctgcgtgggggactcgtggcccatgacgcgggagcgcgcctacttcgaggcctccacgctgcgggagcacggccgcctgtgcccggagcacacacccgaggtctaccacttcgaccgggccatgtcgctgatggggatgcgctacatcgagcccccgcatatcatcctccgcaagggcctcatcgccggcgtcgagtacccgctgctcgccgaccacatgtccgattacatggccaagacgctcttctttacctccctcctctataacaacaccacggatcataagaacggagttgctaagtactctgcgaatgtggagatgtgtaggctcacggagcaagttgtgttctccgacccataccgtgtctccaaatttaatcggtggacctcgccttatcttgacaaagatgctgaggcagttcgacaggatgacgagctcaagttggaagtagctggactgaaatcgatgtttatcgagagagctcaggctctgattcatggagatctccacactggttctatcatggtgaccacaggttcaactcaagtcattgatccagagtttgggttctatgggccaatgggttttgacattggagccttccttggaaacctgattttggcatactacgcacagaatggacatgctgatcaagcaaacgatcgtaaggcttacaagaaatggatcttgaagacaattgaagagtcttggaatttgttccagaaaaagtttgttgaactatggaataaacacaaagaagggaatggggaggcatacctgcctgatatatacaacaactcaaagcttgtgagcgttgctcagaagaagtacatgacaaacctattccatgatagtcttgggtttggttcagccaaaatgatcaggcgaatagttggaatcgctcacgtcgaggatctcgagtcaattaaggatgccagcaagagagcagagtgcgagcgtgctgccctcagttgtgcaaaggagatcctcaagggaagacgccaatttgagaccatcgagcaagtcattgagcatattcaatcgtttgaccaggactgagaaggcggcagtctatttttgcgcttaaggagacatactttcgtcaattaacccacacatacctgagtatcggtgaatcgtctgttttgaagcaccggttgtttgtgttttctgtattgagattatatgatgaaaaggtgcccatttgtggtctgatagtttggactgtgtacactaccagagtaagatcttattctgccataggccccttggttctgaataatgaaatgtacgagatttctccgtgactatctcagtacatttagatgcttgtattttaccaataatttttgttatgatggtcctttggcaagtactgccttgttat

SEQ ID NO: 13530 - DNA, 688 bp, Sorghum bicolor
  Clone ID: SORBI-28MAY03-CLUS5999_1
aggggctcggcgaccgtgcctcatctcgttcgtctcgtctcaggtctcagcgaccctacgagagcccccgtcccaactccaccacctcgcctctccgcggcgcgagcgagggcgacgccggccgcgacggggttccgcccgaccgcggcgtcggcgggaacccgggcttcgctccatctcctcactctcttcatctcttcgatcgcttttgacctgtgaaaatggcggatgaactacgctctacgtctgtggtccagaaggtccatgggcagtctgtgttgttgagcagaatctcttcctactctgccatgaacaaccccgtattcaacaatgcctattctgcttacaatgtgccccagaggtcatattatgggatgaatgcaactgttggactctcatctgtcatggcaccatctcctgtcttcgcgtctgccccaaaagagaaaggcttttctggatttatgattgactttatgatgggtggggtttccgctgctgtctccaagacagctgctgctccgattgagcgtgtcaagcttttgattcagaaccaggatgaaatgctcaagactggcaggctttctgaaccctacaagggtattggggactgctttggtcggacaatcagagatgagggttttgtctcactgtggagaggaaacacagctaatgtaatccgttacttccc

SEQ ID NO: 13531 - DNA, 953 bp, Sorghum bicolor
  Clone ID: SORBI-28MAY03-CLUS649_1
gccggccgtggcacgagggaacgggaaggggaaagtaaagaggcggtttgtcattgaagacttcccgaaacccaaactaacccttccaattccaatccaagggtgcgaggagagctgctagccgccgccgccgccgccaccgccgcagccgccatgtcgggaggaatcgcgcgcggccgcctcgccgaggagcgtaaggcttggcgcaagaaccacccccacggtttcgtggcgaggccggagacgctagccgacgggtcggcgaacctcatggtctggaactgtaccatccccggcaagcaggggactgattgggaaagtgggtactacccacttacccttcatttcagtgaagactacccaagcaagcctcccaaatgcaagttcccacagggttttttccacccaaatgtttatccttcaggaacagtctgcctctcaattctcaatgaggatagcggttggagacctgctatcactgttaagcagattctagttggaatacaggacttgcttgatcagcccaatcctgctgatcctgctcagactgatggttatcacctattcatccaggatccagcagaatacaagcgacgtgtccgtctgcaggccaagcaatatcctgctctggtctgaggatgttggcatactgagagatccatgatccatcctgcacatccacatagtagtcgcaacatgttaaaattattatggtctcgttttggatttgacaagatataagttgtctggaggattgcccagtgtaaacctgaaccttttatgatgtgtggggggtccggtattggaagcaaaaaccgattcgtttactgctgtaagtgctgcagccactgatattatgtctacttaacttaaactatttggtgtgttggtagtctatcttgaagacaaatgttatgtctgttatcaaagaaggttatctaatgttttcaaaa

SEQ ID NO: 13532 - DNA, 1857 bp, Sorghum bicolor
  Clone ID: SORBI-28MAY03-CLUS651_1
gcacgaggggctgaagcgccggcggcgaaagcacgagatccactccccggtcaagacggtggtggtggtggttatggagaaccgcagcttcgaccacatcctcggctggctcagccgcacccgccccgacatcgacggcctcacgggccgcgagtccaaccgcctcaacgcctccgacccctcctccccggagatcttcgtcaccgacgaggccggctacgtcgactccgaccccggccacggcttcgaggacatccgggagcagatcttcggctccgccgacacctccgcggtgccgccccccatgtccggcttcgcccagaacgcgcgcggcatgcacgagggcatgccgcagaacgtcatgagcgggttcaagcccgacgccgtccccgtctacgcctccctcgccgacgagttcgccgtgttcgaccgctggttcgcctccgtgcccacctccacgcagcccaaccgcctgttcgtccactcggcgacatcccatggcctcaccttcaacgcccgcaaggacctcatccatggcttcccgcagaagaccatctttgacagcctcgaggagaacggcttgtcttttggcatctactaccagaacatcccggccacgctcttctaccagagcctccgccgcctaaagcacctcgtcaagttccaccagtacagccttaaattcaagctgcacgccaagttggggaagctgccaaattatgtggtgattgagcagaggtactttgattgcgagatgttcccagcaaacgatgatcatccgtcacatgatgtggcaaggggacagaggttcgtgaaagaggtgtatgagacactgagggccagtcctcagtggaacgagacggccctgattatcacatacgatgagcatggcggattctacgaccatgtccctacaccggttgtcggagtgccccaacctgatggaatagttgggcctgatccatactacttcaagttcgaacggcttggggtgcgtgttcccacctttctcatctcaccttggatcgagaagggcactgtgattcatgcaccgaatggtccacaggaaacctcgcaatatgagcattcatccattcctgcaacagtaaagaagctattcaatttacattctaactttctgacaaagagagacgcatgggctgggacctttgagaactaccttaaaatccggaaaacaccaagaactgactgtccagagaagctgcccgaggtgacaaagtcactgcgaccatttggtcccaaggaagattcatctctctcggaatttcaagtggagttgattcaacttgcctcacagcttaacggtgatcatgtactgaacacgtacccagatattggcaggaccatgactgtcgggaaagctaaccgctatgcagaggatgctgtcgccagattcctggaagctggtcggattgctttgagagctggtgcaaatgaatctgctttggtgacgatgaggcctgctctcaccagcagggcctcattgtcctctggtttatcatcagagctctaatagatcgttccacagtgcccaatgtaatgtggtaagagagcctaccccttggtggtgtagtgcaaatatgacactatagcatcatgtaacagacagcatggttttgtaaatagaagtcatgatcatgatattggacatctggattctgatacagtatatgtcaaagtccccttctggataatgtgtagtagggatttctaaagcattgtggaattgtacctattcagtctgtactgtacctgcttgtcaagcagttgaactgcactttggagttatgtataatatgctacttattaaacaatatgtttgtgccctcaaatctc

SEQ ID NO: 13533 - DNA, 1567 bp, Sorghum bicolor
  Clone ID: SORBI-28MAY03-CLUS6510_1
gccggccgggcggggaagcccccggccgtctcgatcccagaatccgagagagagagctccacaggccaggtccccatcgccgcggcgcctgccccccctgctcccgcccggtagtagcctcgccgccgccgctgccgagatggggttcgtctccttcgtcgggagggtgctcttcgtcgccgcgttcctcctctccgcctaccaggagtttaatgaattcggtactgatggtgggccagcagctaaggcgctccagcccaagttcaatgtgtttgtcaaaaacatctctgctcaactaggagtagctgtgccgcacattgagctgaagcatgtgattgctgctacaattggtcttaagggtcttggaagtctcctttttattttgagcagctctctcggtgcttatctcctgttgttttaccttgctttgatcactcctatcattcatgacttctacaactacgatatggagaaggcagaatttgcgcagctctttgggaagttcacccaggatgtggctctgattggagctctcctcttctttctgggcatgaagaactccatcccgaagcggcagggcaagaagaaggctgccaaggcgaagacgaactaaggctctttagatagttgcacgccacaggcggtgtcgaggagacaggtctatttgaagcaagctgcgatgcagtcaatgccatcgagctgcgcttttacatgtatcagattccattttgcggggcacggcccgaacgaaggtgtgagcggcggattaggcgactagattgcacaattatgtacttgcgattggtttgttgaactaggttgccaattgttaatcttatctatttgatttatctttgcaaaaaaaaaaaaaaaaaaaaaactcgagactagttctctctctctctctccacagttcaagcaccgcctaccaagcaaaacgaagcagatcaaaaagactgcccgccgagcagaggtgaaagtgtatcagttaagtgcatcatgcgtcattccaagccgccggtgaaacttgccatgcttttactatttccctcgcggctttgttgcggtcttgacaacatccgttgctcgacactccatgagaacagagaagatcttcgcgcactgctagatttcaagcaggggatcaacgatccatatggagccttaagcaactggacgaccaaaacccacttctgtcggtggaatggtgtgaactgcagctcgtcacgaccatggcgagtcacgaagctcaacctcactggccaaggcttaggtggcccaatcagttcatctcttggaaaccttaccttccttgagactctcgtgctatccaaaaataaccttattggccccatacctcttcttaacaagcttcaacacctgaagacccttattcttggtggcaactctttacagggtgttatccctgatgcacttacaaactgttccaacttagcctatctagatctctcggtaaacaacctcacaggtcctattcctactagaataggctttctttccaagctagtagcccttgcacttgaaaataataatctcgacggggtca

SEQ ID NO: 13534 - DNA, 680 bp, Sorghum bicolor
  Clone ID: SORBI-28MAY03-CLUS66844_1
cgaaaaatgcggcggcggcaccctgcaagaggcattcaaatatgtgcagaagaacggaggaatcgccacggaggaggaatacggcgcttacacggcgaaggccggcagctgccatgccggcaacgtccgtaaggccgtcaggattcagacctacgatttcttgccgagagagaacgagactgcactggctgagaaggttgtccagcagcctgtcgccgtcctgttcgatgctcacgatccagccttcgcatactataaaggaggcatctactccgggggacagccacgcacacgctacgtgctcaaccacgccatggccatcgttggttatgggaagaacgagagtacggggcaaaagtactggatcgccaagaattcgtggggtaccggctggggagacggcggctacgtgtacatagcgaaggacatgcctgacaaaccccagggcgtgcaagggcttgtggccaagtatccctggtaccctattgtgtaggagtgagtacatactcgtataaaaacgacgaagggcgttcgtcatccatatctccgtaggacataatacatattatgtgtcgagaataaaagacaatggcacatcatggtggacactatagacatctcaggtgtcattggagctaatatatgaatcaataaataaacaaaatgttcttatggtatct

SEQ ID NO: 13535 - DNA, 1443 bp, Sorghum bicolor
  Clone ID: SORBI-28MAY03-CLUS6672_1
tgcttgccatgtacgtcctctttttatttttgtttttcttttgtctcctcgcatttaaagcatcgaggccgaatcggacctccagttctcgagacgagtcgtctccatctctctacgcacctaacaatttcggcagggcaggacggcttcttcctcctcgccttcaccttcgccgcctgcgcggccgggacccgtcgcaattgggcttgtaagttctagttcttcatgtcaactaccaatctgaggcggcgactccatcatggagacgttgatggaaggaaaaacgagcatgttgacatatccagtgctgattccctcaatgaacctctattagggaagtccagtggtgacaattttggatcagcggtgtatgatcctagaagacaggacctgtgggatgatgatagaaagaaagaacaactacactggtcatttcttttctcaaacttgattgcacaatgggcgcaatggttagcaagcattattgtaagctctggatctatctttggtagattattccccttctcttcagagaaccaaatcaatccagtatatcttagccctctacaggaacaaaggctgaataatttaagacgcagattgcaaatcccttttgatggctcccgtattgaacatcaagacgccttgaggcaactctggcgtttagcttatcccactcgtgagattccacccctcaaatcagaattatggaaggagatgggttggcaaggcaatgatccatctactgatttcaggggtggtggactcatatcgttggagaacctcatctttttcgccaggaactaccctaattcatttcagatgcttctgagcaaagtgcaagggcagagatcagattgggagtacccttttgcagttgctggtatcaacatttcattcatgctggtccagatgttggatctaaaatcaagtattccatcttcaaagtacggaattcgtttccttgaattgcttgaacgggatgagaatgtgtttgaccacttgtactgtgtggcctttcggctgcttgatgctcagtggcttgtgaaacgtgcctcctatatggaattcaatgaggtcttgaaatcaacaagaactcaactggagcgcgaactggttctagatgatgtgctggaggtgaaggacctgccgtcatacactatgttggatgagtaagttaaagccgagctgttgaacttgcacggtggagaactgactaagctagtgtgatggctaacagtataacgatatgtgtccgatcctaaatgcttaggtggcccactttgcttgtctaccttgccgcattttcccacttgttgtatgtatattgaggtcttttgaggcgttatatataattcctttgtaaatattgtgttgtttatatgttgcctttcggacatgctggttccaaggaaataaagcaatcggtctcatattcattta

SEQ ID NO: 13536 - DNA, 280 bp, Sorghum bicolor
  Clone ID: LIB3480-055-P1-K1-D7
ggtgaaggacctgccgtcatacactatgttggatgagtaagttaaagccgagctgttgaacttggacggtggagaactgactaagctggtgtgatggctatcttgaaatcaacaagaattcagcttgtctactttgccgcattttcccccttgttgtatgtatattgaggtcttttgaggcgttatatataattcctttgtaaatatgtgttgtttatatgttgcctttcggacatgctggttcaaggaaataaaacaatcgatctcatattcatttttc

SEQ ID NO: 13537 - DNA, 1316 bp, Sorghum bicolor
  Clone ID: SORBI-28MAY03-CLUS66974_1
aacacacccaccacacccaccgccgccgaacaagtactactagcaccaccctaaagcagctcctcctcctcctcctcatcctcctcgccttcctcctcttcgtcttcttgatccccagctccgtcttgttgcccccagctcggcctcggatcatgtcgtcctctgcttccgactctgcctcgtccgcggcgccgttcgagaagcccagggccgtggtcaagaagctcctcgcggagtcgcagcccgaggggcagggcgcaaccgtccgcaggagcatcggcaggcatgaactccggaacctggttcccttcctcatgctcgacgagttctcagtctccaagcccgccggattccccgaccacccacacagaggattcgtgaccgtcacctacatgctcgagggcgccttcacccaccaggacttcgccggccacaagggcaccatcaaaacaggcgacgtccaatggatgacggcggggcgcggcatcgtgcactcggagatgccggcgggggacggcgtgcagaaggggctacagctctggatcaacctctccgccaaggacaagatgatcgagccgcggtaccaggagctggagagcaaggacatcagccgcggggagagagacggcgtggaggcgcgcgtcatcgccggggaggccctgggcgcggcgtcgcccgtgtacacgcggacgcccaccatgtacgtcgacttcaccatgcgccccgggtcacgcctccaccagccggtgcccgaagggtggaacgccttcgtctacgtcgtcgacggcgagggcgtgttcgggcgggacaaggccgcgcccaccgccgcgcaccactgcctcgtgcttggacccggcgacgggctcagcgtgtggaatcggtctgacaggccgctcaggttcgtgctcgtcgccgggaagccgcttggtgagcccgtggtgcagcatgggcccttcgtcatgaactcgcgcgccgagatccagcaggccatggaggactactactatggcaagaatggattcgagagggccagccagtggagctcctcctccgcctgatcgtgatcggcgaggcaatcgcaccaaatctaatctcacgtgcaaaataaacatttttaattcaatttcttggcttgtacgactggccatttgtttgttggggaaggctagaacgttccacactctgattttgattattcttttttctagcaaccattgtactagtagtatgtcatttattagtgtggtgaatcggtgattgaaataaacagtgtggaaaattgatagtatcaataaagtattattgtattattagta

SEQ ID NO: 13538 - DNA, 1544 bp, Sorghum bicolor
  Clone ID: SORBI-28MAY03-CLUS10631_1
actgcaaccgcagcgtcccccgtttcctcctcgctcgaacacccccaagaggaagcgagagaaggatggcgtccctggcgcagcacgtcgcgggcctcccgtgcccccctctatccggcgcgtcgcgccgtcgccccgcggcgcagaggcggcctccgtcggcgctggtttgcgggacctacgcgctgaccaaggacgagcgggagcgggagcggatgcgccagctgttcgaagacgccgccgaccgctgccgcaccgcgcccatggacggcgtcgccttctcccccgacgacctcgacaccgccgtcgagtccaccgacatagacaccgagatcggctcgctcattaaaggaacagtatttatgactacctcaaatggtgcatatatcgacatccaatcgaagtctactgcttttttgcccttagatgaggcatgccttcttgatatcgataatgttgaagaggcaggcattcgccctgggttagtagaagaattcatgataattgatgagaaccctggtgacgaaactttgattctgagtttgcaagcaattcagcaagaacttgcatgggaaaggtgccggcaactacaggctgaagatgtcgtcgtcacgggtaaagtaattggtggaaacaaaggaggtgtagtagctcttgtggaagggcttaagggattcgttccattttcgcaagtgtcatcgaaaactaccgctgaagagctgcttgacaaagaattgcctctaaagtatgtagaggtcgatgaggaacaaggcaggcttgtcctcagtaatcgcaaggcaatggcagatagtcaggcccagcttggtattggctcagttgtcttgggaaccgttgagagcctaaaaccttatggtgccttcattgacatcggtggaatcaatggccttctccatgtcagccagattagtcatgaccgtgttgcagatatctcaacagttctgcaaccaggagataccctcaaggttatgatactgagccatgatcgtgaaagaggccgagtcagcctttctacaaagaagctcgagccaacacctggtgacatgatccgcaatcccaagcttgtctttgagaaggctgatgaaatggctcaggtattcaggcagcgaatagcccaagccgaggcaatggctcgtgctgacatgttgagattccagccagagagtggattgaccctcagttcagagggcatcttaggaccattgtcgtcggacgcaccttcagaggattctgaacccacagatgaatagaagcagttgacgaagtgcaccagatttgagatatgtgatggcagttcatcatacttatttttcttggagggaaggcatgacaaaagcatgttctgttcagatcgtttccccctttcagttattcttgtctcagtgtgtaggaaatctgaaaatgtaagaaggttctgaagacgccggaaagaaatgtaatttgcgtcccttgtgaagctatccgattcttgcaggaaccccaaagtatagtttgaccgtgaccgtgagtgtatattttgtaacgcg

SEQ ID NO: 13539 - DNA, 2294 bp, Sorghum bicolor
  Clone ID: SORBI-28MAY03-CLUS11066_1
gcacgaggcagactttaactgatgccttgcatctccatgggataaatattaggtacctgggcaagattgcaggcatggtcaaacatttaccacacttacgggatttgttttctgctgagataatagttagatctgcaaagcatgttatcaaggatatactgaggcaaagtttggatcatgatattgggccagctattgctcatttcttaaactgtttcgtggggaaagttttaggtgcttccacaaagggtagtcttagcaatgcgcagtcaaaaactctgaagggtcatgaaaatagccaaattcagaagtcctctaaaggccataaactgagcaatgctgctgcttcaagaaaaagcttatcagcttattcccatctaacctccgatggaatttggcttagcattaaggaatttgcaaaatcaaaatatcagtttgaagtgccagatgatgcaaggctttcagccaaaagggtagctgttctccgcaatctttgccaaaaggtaggaataacaattgctgcacgcaaatatgatctggatgcttcgactccatttgaagcctcagatatgttaaatctccaaccagttgtcaagcattctgttccaacctgtacagacgcaaagaatcttatggaagcagggaaagtcaggatggctgagggaacattgaatgaggcatatgcattgttttcagaagccttttcactgcttcaacagataactggacccatgcacaaggatgctgcaaattgttgccggtaccttgctatggttttgtaccatgctggtgatacagccggagcaattgtgcagcaacatagggaactcattataaatgagagatgtcttggtcttgatcatccggacacggcccacagttatggtaacatggcgttattctatcatgggctcaatcaaactgaactggcactgcggcacatgtcccgcacactgttgttgctaagtttggcgtcaggacctgatcacccagatgttgcagcaactctcataaatgttgcaatgatgtaccaggatgccagcaatatgaatactgctcttaggtatcttcaagaagcccttatgaagaatgagcgacttcttggccctgaccatgttcaaacagctgtgtgctatcatgctcttgccattgcattcagctgtatgagcttatataagctttcaattcagcatgaaaagaagacttatgatatactggtaaaacaattaggggaaaatgactcacggactaaagactcagaaaattggttgagtacttttaagcttcgagaagagcaggtcaacgcccagaagcagaagggccagggagctaatgcatccgataacgctgttaaattcttgaaggcaaaccctgcatttttacaagcaatgaaggctgctgcgatacaatcaggtgatgggtcagcaaatgtcaacaggtcgctcaatgcggcagtagttggagaaggtgtaccacgactgagaggagtggatgagcgagctgctcgagcgactgcagaagctcggaagaaagctgctgcaagaggtcttaatgtccgtaatggccctgcggcaaaccatgcgtctgatgaactagctcagattctcaaactcatcaacgctgcttcaggttcttccacttctgcctcagccaaaactgaggaatctgcctctgaagggcaggcaacaaatggatctgttcaaaacggaactgcaactgaagcgatagctgtggataccaatggcccatctgcatctgctaagtccactgttaacacaccagttggattggggacaacattggagttgaagaagcagaaatcaaagcaaaagtcgtagaaaacctgtgcctggaattttttttggcaacagttttggattttaggttgatttgggtttttaccttttataggattgccacgttcacgtggtggaagagttcatttatttttgttggaggttcttaggtgggttcaataatcattacaagaaagaagaccagaccattgtttcgaatcatcattgacagaccactgatgagataatggctaatccttaagctaataaatctgtagtcggtacagttacctgtttaaaatttttgtgcaagattagtatgctaatttgttgcccaacaaagaaatattactcttatttctgttgagcttttagtgcttctgttggtgtcagcagaactcttctgttcgtgtgcgtgcagggtttctccagctccaatttgtgactgttcgattgtattttcattttaaggaacctactgtgtatgtgcagttgtga

SEQ ID NO: 13540 - DNA, 1278 bp, Sorghum bicolor
  Clone ID: SORBI-28MAY03-CLUS11656_1
caagaatcccaccactccactccaccacctctctcacctccagcagcagcagcagcagcacagccaacaaccgcaccgcagcaagaaccaaccaacagcgacgaacatagcgagggagccaatggtgatgacgacggcggcgcagcagcagcgccgggacgcggaggcggagctgaacctccccccggggttccggttccacccgacggacgaggagctggtggcgcactacctctgcgcgcgggcggccggtcgccgcccgccggtgtccatcatcgccgaggtcgacctgtaccgcttcgacccctgggacctccccgagcgcgccctcttcggccgccgcgagtggtacttcttcacgccgcgcgaccgcaagtaccccaacggctcccgacccaaccgcgccgcgggctccgggtactggaaggcgaccggcgccgacaagcccgtggagcacaggggcaggacggtcggcatcaagaaggcgctcgtgttctaccacggcaagccgccccgtggggtcaagaccgagtggatcatgcacgagtaccgcctcgccgacgccggcggcgcccgcgccaagaagtccggcaacggcacgctcaggttggatgactgggtgctgtgccggctgtacaacaagaagaacgagtgggagaagatgcagcagcagaaggagaagaaggagatggaatcggaggcgtcgctctcgcactccgacacgcggacgccggagtcggagatcgacgacgacccgttcccggagctggcctcgctgccggcgctcgacgacatggtgggtctagccccggccgccggcgccatcctgcccaaggaggaggtggaggacttcggcgaccttggcggcgacgactggctcgcggggatcaacctcgacgacctgcagatgcccggggacgccgacttctttggcaacatgctgtcgccgatggccgccaagatggagcaggacgccggcttccccttcttctgagatcctctgcgactccgaggacggattcagctcaactgtgtatagttcagatttcttcaggattcagagaaaacaaacaaaaaacaaattctgctaatatctggttgtagtggtgtagtgcagaagtagcagtatgctggtcagttattaagattgaagttcattgtagtactctactgatgctcatcacttgagctgtgataagtgacaacattctttcgtttgtgctctgcaaattcttcaatgctcagaatatattattcagatgggtaatgccaattccg

SEQ ID NO: 13541 - DNA, 3024 bp, Sorghum bicolor
  Clone ID: SORBI-28MAY03-CLUS8396_1
ccgggccgccccaagcctacccgcagccgcaccccggcgccccccaattccgctctctccctctctccctcttcccccaccgcagcagcaggcgagcgcgaggcggaggccgaggcggaagaggagagatggagtcggaccagggcaagctcttcatcggcggcatctcctgggaaacgacggagggagaagctgagcgagcacttctccgcctacggcgaggttacgcaggcctccgtcatgcgcgacaagatcaccggccgcccccggggcttggggttcgtcgtcttcgccgaccccgccgtcgtcgaccgagcgctgcaggacccccacaccctcgacggccgcacggtcgttgtgaagcgggcactctcgcgggaggagcagcacgccgccaaggccgcgaaccctagcggtgggaggaacactggcggtgctggaggaggaggaggaggcggtgccggcgatgcaagtggtgctcggaccaagaagatctttgtgggcgggctgccctctactctgactgaggatgggtttcggcagtccttccggaccttcggcagcgtcactgacgttgttgtcatgtatgaccagaacacgcagcgcccgcgtggcttcggattcatcacctttgactcggaggacgcagttgaccgtgtgctgcacaagaccttccatgatcttggtgggaagctggttgaggtgaagcgtgcattgccccgtgaggcgaaccctggtggctctagtggtgggcgttctgggggaagtgggggttatcagagcaacaatggccataacaccagctctggtagctatgatggtagaagtgatggtggcaggtatgggcaggcccagcagggcagtggtggctatcctggctacggtgcaggaggctatggtgctggggcagctggatatggatatggtgctaaccctgcagttggatatggaaattatggagctggaggatatggaggtgttcctgctgcttatggtggacattatggaaacccaggtgctgctggttctggttaccaaggtggacctccaggctcaaatagaggaccttggggcagtcaagctccatctgcatatggaactggagggtacggtagcagtgctggctatagtgcttggaacaactcttctggtggtggcaatgctcccagtagtcaagctcctggtggacctgcaggctatggaagccagggctatgggtatggtggatatggaggggatccatcgtacgctagtcatggaggatatggggcttatggaggacgtagtgatggtgctggcaatcctgctactggtggagcatctggatacagtgcaggctatggaagtgggggcgccaactctggctattcaagtgcttggagtgatccttcacaaggtggtggatttggcggttcagttaatggaggtgctgaagggcaatcaaattatggcactggctatggcagtgtgcagcccagggttgctcagtaaagataggcattttgagtgtctgtgaaatgaaccagtgcatctgggcagtctatgtattgatctgtcattccagtctctctgattgctctctgcattctgaagattgcccatttgctggttaaatcagtatttctccgggttggaatgcttgatcctttagtggcttactactagaacttcctagtcaataagtagctataatgtggagtagcagtatcttgcggaatgcttttattaatttttacatttagctttatccatctgtgtgctttgccatgagtggagtttcaggttgctccatctctagttataagctagagtagcttgactgcttatggacaaaattatctagttgtacctctattctaaagatcatatatttgtgtttgacggtagtatttatgctggatcttgctctacctatattctgggatgttctatatttttggtggttgtattgacatgtggtattatcaacattgatggtttgaaacagatgcaaaccctgaatttatgcagtcatagttgcttgatgctgtagctgcttctaacagtatgttcaactgtagtgcaagtgtttttatgtagctggaatggtacattctccaagtatatcatcaagctatgaattccatccatttggccctagatttcgatattttccaagcagcagtaagcttattagcagcaagattgtagcgccaagtttctgaggttgaatgggatgacattcctttttagagatgcccgcgcgacgtctttgttatctcgcgtctgttaatggctggacactctgtgtctacttcatgcgctggcgttacgggtccatttcggggtgctgtctgcatccaagccacccgctgttccgtctgcttctgttgggtcttgtgctgtgccgcacgatagtcgtcgactcggctgctgtcccttccgcttcctggccgggtgctcggccccccccccgcctccgtgccgcaaggggtggcttgtctgcatactggtgatcattgatgcttgtgatatagcaatgccccaatgtataggcggctcctggtacgaccggcttcctttcgtggcccagctggtcctccccggtcaacacgcgcctgccacggggctaccgcatcctacgaagcccactcgggccctttggcacggtatcccctggtgctcttctcttgggagagctacacctccattttattctccattgatttgtcggcccagttatttctagcctgccctccggggaattttgtaaatggatgcatttcgaatgacgagcatttcattgtctcgcacttggtcgtgtttcgagagttctggtatctctgatttgattcaatttcatgtaaaataaacactggatggttgtttgacttgtttcttatagtgagcggctttgctgctcgccgtctcccttctctggtgacctccagcttctccgttgcctatggcattggagcgaaggggaaccaggatctggtggctggtcctagcatcctacatctaggttggtttgattagtttcta

SEQ ID NO: 13542 - DNA, 1388 bp, Sorghum bicolor
  Clone ID: SORBI-28MAY03-CLUS853_1
gcccggggccctccggcccccccgtcccggctccccgttcccctcgcgccgcccgcctccccgccgcgttcgtggtggcgccaggcgcaaggtgcgggtccccgccgcccgccccggctcctccgtgccccccgccccctccgcgccaaatcgctctcacccggttggctgccgccccgccatggatttggatctgtggatctccaaggtcaaggagggccagcacctcgccgagcacgagcttcagtctctctgcgaatacgtgaaggagatcctcatcgaagagtcgaacgttcaaccggtgaacagccccgtgacggtttgcggtgacatccatgggcagttccatgacctgatgaaactcttcgcgacgggggggcacgtcccggagacgaactatattttcatgggtgattttgtggaccgtggcttcaacagtctggaggttttcaccatcttattgctactaaaagcgaggtatcctgcacacataacccttctgcgtggaaatcatgaaagtaggcagttgacacaggtttacggtttctacgatgagtgtcagaggaagtatggcaacgccaatgcatggcggtactgcactgatgtatttgattaccttacactatcagcaatcattaatggccaagtcctctgtgttcatggtggtctttctcccgatgtacgtactattgatcagatacgaacgattgatcgcaattgtgaaattccccatgaaggtcctttctgcgatcttatgtggagtgaccctgaggagatagagacatgggctgttagtccccgtggagcaggttggctgtttggatcgcgagtcacggcagagttcaactttgttaatggtattgagctagtttgccgggctcaccagctggtccaggaaggcttaaagtacatgttccaggagaagggccttgtaactgtgtggtctgcacctaattattgctacagatgtggcaatgtagcttctatattaagcttcgatgagaagatggaaagagatgtcaagttcttcacagagacagaggagaacaaccagatgcgaggcccaaggactgcagtcccatatttcctctgacttcagttgtacaattttagaagtcaatatttaaatctgtaagggttaaagatcaatcagatgtgtttattgttgtaggttcagatcatagtgcaatctgatgcattcgatttctgttttcttttgaccacatgtacaatagaccatcgggagtgtcatatcttcctgtattcctaaagtgactgtcaaagttttgtttatgatttagtttgcgtgctattcattttgtactgcgcttgcattgtgcagcagatgagtcacgcttggcatagcgctaatctcatttgagatcgtt

SEQ ID NO: 13543 - DNA, 1605 bp, Sorghum bicolor
  Clone ID: SORBI-28MAY03-CLUS807_1
gcacgacgcgagtccccagtcctgcccgcggccctgcgcgccgtggccgcgtgtgcgggtcgccgatagcctggaggcctcatgcgcgcaccgcgatcaagagggttgagttgcgggcagctctcggttcacgctctcgctcactactgcccgctgctccgccgccgctcggtcggccgtcgcgggcgtccccaatccgcagctttggtttttttctcgctagtccttcctcattgctcggccggggtctcttctttctcgttcgccatttcgagacctcaatacagagattccgaatgagattattacatgtggtattctttcaagcctgcagtaattcctacatcactgcctttctgttattctttcaaatggcacactgccaaagcacattgcaattggtgtgcattgtaaccgtcgatatgccctattcagatgcatgctagaaagcctttcatatgggctggtgccctagcacattgcatttattatggatggcaatcatcgaattgataaattcagaagcatgcaacaaggagctggtcacagcaagtgtttctctgctcttattgcaagtctgctgtactgctatgaaatggatgtgaagtacatcactgtttacgcattcagcattgacaattttaaaagggacccaagtgaggtggaagccttgatgcagttaatggaggaaaaaatcaatgaactattcgagaaccgaagtgtaatcaacaagattaactgtaagatcaacttttggggcaacttggacttgttatgtgaaccagtgaggttggcggctgagaagctgatggcgagcacagctgggaacacagggctggtcttttctgtctgcatgccatacaactcaacttctgagattgtaaatgctgtcagtgaagtctgtgcagaaaggagggaactgttgcagagtgaacatgctggcgagtgtaatggtcacgctgcaaataacggtgtgcattcagagatttcagtggcggatttggatcgccacatgtatagcgctggctgcccagatcctgatatcgtcatccgaacttcaggcgagactcgactgagcaatttcctcctgtggcagacaacgtttagtcacctgcagaatccagatcctctgtggcccgagttctctttcaggcaccttgtttgggctatattacagtatcagagagcttacccttatctagagcagaacagaaagctggctaagaagcagttgtgattccatgttattttgaaggagataccaggagggttatgaacatttcaagctgtacaaaacttccccttccattttccctgaaatgggaaatgcaaagaagaacatagcataaaacattatgaacagatcacaagcctcgtgtggttgccatcgtaactatgtaactcatctgagctttgtaaaagtgctgtgagtccttgatctatagtgtccctggtgtaacatgctgtacgagaacgttcctttgttttcgatgacacaaagcttcaaagcacccatgttccacataagtctggaaaacccacaaccaaaaaaaaaaaaaaaaaagggcggccactcgcgatctagaactagtccccacgcgtccg

SEQ ID NO: 13544 - DNA, 511 bp, Sorghum bicolor
  Clone ID: LIB3478-055-Q6-K1-D6
tctccctcaccttctgtggatctgaagacagagaagtctaatgagatgattacaagtggtgttctttcaagccttcagaatttcctacacaagtgcctcatagctatcctttcatatggcccaatgccaaagcacattgcatttattatggatggtaatcgtcgatatgctaaattcagaagcatgcaacaaggagctggtcacaggatgggtttctctgctcttattgcaagtctgctgtactgctatgaaatggatgtgaagtacatcactgtttacgcattcagcattgacaattttaaaagggacccaagtgaggtggaagccttgatgcagttaatggaggaaaaaatcaatgaactattcgagaaccgaagtgtaatcaacaagattaactgtaagatcaacttttggggcaacttggacttgttatgtgaaccagtgaggttggcggctgagaagctgatggcgagcacagctgggaacacagggctggtcttttctgtctgca

SEQ ID NO: 13545 - DNA, 1765 bp, Sorghum bicolor
  Clone ID: SORBI-28MAY03-CLUS7910_1
aaaacccttccttctcggcgtctcctccgattccttcctctcctctcgcccctctccatccgctcccaccgtctcgtctagggttttgccccaaaccctagccccccaaatcccccgctccatggacgtcgagggcgaggtccccgccgcggcagcggcggcggtggcgaacggtctgggcggcgcggaggaggcctctgcagcgccggtctcggccgagcagctggacgtggaggcttacgcggcgcaatactcgggccggacccgcctcgcgcgcctgctcttcatcgcggaccggtgcggggtggaggcgatgcagctcgaggcgctgcggatggcgtacgatgagatcaagcgcggggaggacgtgcagctccaccgggacgtcgccgccaagatcggaggccgccttggtccgcgcttcggcctcgaccaggcgtggatcgacaccgtcacccgccgcgccgatcagcgcaaggagaagctcgagaacgagctcaatggatacaggactaacctgatcaaagagagcatcagaatgggctacaatgacattggtgatttcttctatgcccatggccaactttcggatgccttcaaaagctacatcaggactcgggactattgcaccacttccaaacatatagttcagatgtgcatgaatgtgattctggttagcattgagctcgcgtaatatgcacatgtttcaaactatgtcagcaaagcagagcaaaccccagactctctggatcctgtcattgtcgccaagctgaaggcagctgcaggattagccaacttggaaacaaagaaatacaaatttgctgctcgtaagtttgttgagacaggaattgaactaggaaacaactactctgaagtcatagctcctcaagatgtagcggtctatggtgcactttgtgcacttgcttcttttgaccgttcagacctgaagagcaaagtcatcgacaatatcaacttccgtaactttctggagctggtgcctgaagtaagggagctggttaatgatttttatgcaagtcgctatggatcttgcttgggtcatcttgagaagctaaagcctaacctgctcctggatatccatttgcatgagcatgtagagactctgtatatggatattcgccacaaagcgatcatacagtacacacttccttttatatctgttgatctcaacttgatggcaactgcctttaagacttctgtctccatgctggagaaggagctggctgcactgattactgagaacaaaatacaggcccggatagactcccacaacaagatcctctacgcaaggcatgctgaccagagaaatgcaactttccaacgtgtccttcaaaccggcaatgactttgagagagatgtcaagtccatgcttctgcgggccaacctcctcaagcatgattacattcagaaggcgagtggaccaaggaagatgtaacttgcgagcattgcttctagacacggcttcctgcatagtacctccttttttttggaagaattgttctggacgtagaaggtgcatgcacggtctcgtctaggtggctgaagattgtctaaatgcctcgccctcttctttttggtttctgaaagtatggatggttgagcatctggagatgtgatgatctgtcatgctcattttgtgggcaagatttagttttgaactcttaaatgctttggaggtggtacatatgagtccagacaaaactgattggtggttcttggaatttttaacttgtcgcgccatatgttc

SEQ ID NO: 13546 - DNA, 653 bp, Sorghum bicolor
  unsure (1)..(653): unsure at all n locations
  Clone ID: LIB3481-060-Q6-K1-E5
gntttttatgcaagtcgctatggatcttgcttgggtcatcttgagaagctaaagcctaacctgctcctggatatccatttgcatgagcatgtagagactctgtatatggatattcgccacaaagcgatcatacagtacacacttccttttatatctgttgatctcaacttgatggcaactgcctttaagacttctgtctccatgctggagaaggagctggccgcactgattactgagaacaaaatacaggtaaatctcaggagttgctcattccgaaatttgtgtgcatcttgttcacttgcttctaagtgaaacctttgcaggcccggatagactcccacaacaagatcctctacgcaaggcatgctgaccagagaaatgcaactttccaacgtgtccttcaaaccggcaatgactttgagagagatgtcaagtccatgcttctgcgggccaacctcctcaagcatgattacattcagaaggcgagtggaccaaggaagatgtaacttgcgagcattgcttctagacacggcttcctgcatagtacctcctttgttttggaagaattgttctggacgtagaaggtgcatgcacggtctcgtctaggtggctgaagaatgtctaaatgcctcgccctcttctttttggtttct

SEQ ID NO: 13547 - DNA, 1355 bp, Sorghum bicolor
  Clone ID: SORBI-28MAY03-CLUS855_1
catcccatcccatcccatcccacatcgagtactcccccagtccccctttcgccttcgtcctccgatcccagatctcaagccccgccgcagaacccaagccccaactccacgatgaggccgtcgctgctgagatccacgtcccagctcctccgccgccggagctactcctccgcatccgggcagcctgagcggaaggtggccatcctcggcgcggcgggcggcatcgggcagccgctgtcgctgctcatgaagctcaacccactcgtctcgtcgctctcgctctacgatattgccggcaccccaggtgtcgcggccgacgtctcccacatcaactcccccgccctggtgaagggcttcatgggagaggaacagcttggggaagcgctagagggctccgacgtggtaatcatcccggctggcgtgccgaggaagcccggcatgaccagggacgacctcttcaatatcaacgctggcatcgttaagaacctcagcgccgccatcgccaagtactgccccaatgcccttgtcaacatgatcagcaaccctgtgaattcaactgtaccaattgctgctgaggttttcaagaaggctgggacatatgatgagaagaagctgtttggcgtgaccacccttgatgttgttcgcgccaagactttctatgctgggaaggctaatttaccagtaaccgatgtgaatgtccctgttgttgcccgtcgtgcgggtatcaccatcctgccattgttctcacaagccacccctgcaaccaactcattgtctgatgaagacatcaaggctctcaccaagaggacacaggatggtgggactgaagttgttgaggcaaaggctgggaagggctctgcaaccttgtccatggcgtatgctggcgctgtttttgcagatgcatgcttgaagggtctcaatggagttccggatatcgttgagtgctcttttgttcaatctactgtaacagagcttccattctttgcgtccaaggtgaggcttgggaagaatggagttgaggaagtgcttgggttgggcgagctgtcggactttgagaaagaagggttggagaagctcaagagcgagctcaagtcttcaattgagaagggtatcaagtttgcaaatgagaactagacaaggccattttgcagattatagcaccaattgagacctgtagttaccggatgttctgatttcattctacccttttctgccccttttgtgagggagtggaaggatctaagctctcgtacaataaaaaacctggtggcttttattgccaggcaacatatagcttgcgacatagcgatgtcaagttttgaactgaaccagtcgtttatgagctttctgccttt

SEQ ID NO: 13548 - DNA, 1178 bp, Sorghum bicolor
  Clone ID: SORBI-28MAY03-CLUS860_1
gtcgaccacgggtgcgcccacgcgtccgatttgattttattgatggatatgttaagcctgttgtagggagaaagattaactggatgaaggcagggatcattgagagtgatctggttctaacagttagtccacattatgtaaaagaactcacttctggcccagaaaaaggtgttgagttggatggtgtccttcgcacaaagcctcttgaaactggaattgtaaatggcatggatgtttatgaatgggatcctgcaactgataagcacatcagtgtgaaatatgatgcaacaacggcacctgaagcaagacctctcaataaagaaagattgcaagctgaagttggattgcctgtggactcgagcatccccgttataatttttgttggccgtcttgaagaacagaaaggatctgacatactcattgcagccattccagaatttgtgggcgagaatgttcagataattgttcttggcacaggaaagaagaagatggaggaggaattgacgcagctggaagtgaaatatccaaacaatgctagaggcatagcgaaattcaatgttccattggcacatatgatgtttgctggcgcggacttcattattgtcccaagtaggtttgagccctgtggtctcattcagttgcaagggatgagatatggagtgatccccatctgttcatcaactggaggacttgttgacacggttaaggagggtgtcaccggattccacatgggttctttcagtgtcgagtgtgaaactgtagacccagcacgaggcacagcagtagcgtcaactgtcacacgagccctgaaacagtatgacacctcggcattccatgagatggtgcagaactgcatggcgcaagacctgtcctggaagggacctgcaaagaagtgggaggaagtgcttcttggcctcggagtcgagggaagtcaggctggcatcgatggcgaggagattgctccacttgccaaggaaaacgtagctactccctgaggtttggtgcctcggaaatatgtgttgatgataggaagcatcttctaggatcctgacctggtggctggcgagatgttgagtcagacaccggcaaaaccaccagtttcgcctctactacttcatttgtaatataatccttgacgttctaaaaatgccatgcccctgatttaattttatccatgc

SEQ ID NO: 13549 - DNA, 1233 bp, Sorghum bicolor
  Clone ID: SORBI-28MAY03-CLUS9167_1
gcacgaggcaataatgtcacagtaggtaaatgcctcaagatatttgcctttcttttacttccgggagatcgccaagggtacgagcgcattcgcatcgcttcgcctccgccgctcgcgatttcggccgcctacgccgccgcccggggagatggcgggtctgggaaaggcgatgtacgcggtggggttctggatccgggagaccggccaggccctcgaccgcctcggctgccgcctgcagggcaagtacttcttccacgagcagatttcaaggcatcgcaccatcatgaatatctttgacaaaacccctcatgttcataaagacgcatttgttgctccaagtgcatcccttattggtgatgttcaagttgggccaggagcttccatttggtatgggtgtgtcttaagaggggatgcaaacaacatacaaattggatctgggaccaatatacaagacaattctcttgtgcatgtggctaaatctaatctaagtgggaaagtctttccaacaatcattggcaataatgtcacagtaggtcatagtgctgtgttaccaggatgcacagttgaggctgaggcttttgttggcatgggggcaaccctattagatggtgtcgttgttgaaaagcacgggatggtagctgctggagcccttgtacggcagaatactaggatcccttgtggagaggtatggggagggaaccctgccaaatttctgaggaagctcacagatgacgagatagcttttattgcggaatcagctgccaactattccagtctgtccaaggtgcatgctattgagaacgccaagcctcttgaaaagattgagtttgagaaggtgttgcgcaagaagtttgctcaccaggatgaggagtatgattcctcgatcggcgtcactcgagaggccccaccggagctgacgtccccaaatccagcccaataaacctctgtttttgtttctgttttctctttggcgccttaatcattttctattggacagtgctggatcgttgatcggggcattgttccatgactttggtgtttatgtttacttttcctccccaataatcttgggtcgagcgatgttataaagctggccatgcacttcttccagattctgtattcggtatgcttaagatgtgctccctggaaagacagacccactaaattgacagaaatgcattgttttgacaggtaacatgcactgaattaaatatttcattacctttgaaggct

SEQ ID NO: 13550 - DNA, 1219 bp, Sorghum bicolor
  Clone ID: SORBI-28MAY03-CLUS15102_1
gcacgtgcacggggctgacctgccggaggaggcagaggaggatagggaggcgatgacgacggcgaggaaggcagcgtgcgtgctggcggcgtgggtgctcgtcgccgcggctctgtccgacctgggctccgcccgcgcacccctgggcagcaagccgcagcgggagttcgactacttcgcgctctccctgcagtggcccggcaccatctgcgcctccacccgccactgctgcgccagcaacggctgctgccgctcggagccgctccagacgttcacgatccacgggctatggccggactacgacgacgggacctggccgtcgtgctgccgccgcacccaattcgagctggacaagatattgccactgatggaggtgcttaataagtactggccgtccctctactgctccaaatctggaacttgcttcagcggcaagggactcttctgggctcacgagtgggagaagcatggaacctgctctgcccctgtggttcaggatgaactacagtatttcaccattgcccttgacctctacttcaagtataacgttacagaaatgctgtcaagtggaggaatacaagtttcaaatggtaaggaatatgcactgagcgatgtcatcgataccatcaaacatgcttttgggggatcaccacaaattgtttgcaagaatggttcagtccaagaacttaggttatgcttcgacaaagaattgaagcctcgtgattgtcttactacttctttgacgaatggaagtgtatcaaaaagcaagcactgcccacggtacatcaccttgccaacatatgatccccttgtgcttgccaattcaactgtagaaatcatgtcacagttcgatgaatttgtggtgcctactgctctttatacagcctaaggtgcaactatcacagtggagcatttcttggctgtgatgaaacaaatgtcttcagcaccaccgccgtggctgcatctcttgcataattatgatagcagaaggtgcttgcgtgagcacctagatccagggaaattggtccctggaatattcaaccatttgtacatgcacacttgaaagagaattgtacttttttaacctggaaatttataagctttatgtaaccttgaaggttggatattgtcaatgtatacacaaaatctgtagctggagggtgccattgttttaaggtctccggtgtcagttttttgatgtacaatataaaaaaaaaaa

SEQ ID NO: 13551 - DNA, 893 bp, Sorghum bicolor
  Clone ID: SORBI-28MAY03-CLUS15954_1
gccgggccggccgggctcgcacttcctccggcggcggcaactcgacgaccaaccgcgccaccctgccgcggcagccatggtgcatgttagcttctaccgcaactatgggaagactttcaagaagccaaggcgtccgtatgagaaggagcgactagatgctgagctgaagctggttggtgagtatggcctgcgctgcaagcgtgagctgtggcgcgtgcagtatgccctgagccgtatcagaaatgcagccagggagcttctcactctggatgagaagaacccacgccgtatctttgagggtgaggcgctcctccgccgcatgaaccgatatggtctcctgggtgagggacagaacaagctcgattacgtgcttgcccttactgttgagaacttcctccagcgccgcctccagaccattgtcttcaagaatggcatggccaagtccatccaccatgctcgtgtcctgatcaggcagcgccacatcagggtgggaaggcagctcgtcaacatcccctcgttcatggtcagggtcgaatcagagaagcacattgacttctccctcaccagccctctgggtggcggtccagctggaagggtgaagcggaagaaccagaagaaggcctcaggcggtggcgatgatggtgaggacgacgatgagtaatgccatgtaggatcctgcgacagcaattggttgaaatgtgagatggacactttaggtgtcgtggctaaatttttgtggtcttgaattcagaaatcctactatggtagacatttttgcaccgcactactgacactcttaatttcaagcattggcatcgtatctggacaccatgaattgtgtattctagtttctgtggctgttggtcgtttggcatcctagtttcaaactgaat

SEQ ID NO: 13552 - DNA, 948 bp, Sorghum bicolor
  Clone ID: SORBI-28MAY03-CLUS17028_1
gccggccgggccgggaatgcacacctcactcactcacttatccactgcaaataattagaacagcacacaggatatatggcctcctcgtcttcctccttggtcctccttgcagcggccctccttgcgctagtagcctcatggcagcaggccatcgcctacgatcctagccctctccaggacttctgtgttgcagacaagaactcgcctgtgcgtgtcaatgggtttccttgcaaggacccaatggccgtgaccccggacgacttcttcaacgcagccatgatcatcgacaagcgcagggacaccaacaacaaggtgggatccaacgtcaccaacatcaacgtggagagcttcccgggcctcaacaccctgggcatctcgctagcgcgcatcgactacgcgcccctaggcgtgaacccaccccacatccacccccgcgccaccgagcttctcaccgtgctcgagggaaccctttaccttggcttcgtcacgtccaaccccaataggctcttctccaaggtggttaagaagggtgatgtctttgtcttccccaaagccatgatccacttccagatgaacctcgaccatgagaagccagcgacggccttgtcatcgctcagcagccaaaaccctggtgttattacgatcgctagcgcggtgtttggatcaaaaccaccgatctcagatgatgttttggccaaggctttccaggtggaaaagaaactcatagactggctccagtctcagttctgggataccaactactagtggttatacatgttgcaccaacacaagcgttacgtacatgtgcgccctatatatgtattgaataaattgcatgtggaggagtaatacttattattatgcgtgcgtgggagctgccagaagtatgtttgattgtattgtcactatctaatatacagaaaataagatttcattgaaaatctaatt

SEQ ID NO: 13553 - DNA, 563 bp, Sorghum bicolor
  Clone ID: SORBI-28MAY03-CLUS15072_2
taggggccttttttttttttttggataacaaataaaccatactcatcaccaaaaaaagatacaaaccaccaggggcgtctgactttaattcaaagcactataaaccatacttccatagcattagggctaaatagttcagaagtacaatgcttttcaggttcttgatggcaaaatccagacttagttggcagcagcagcactcttctttggggcagcctcagtcccttctctgaagttgctcttgaaacggcgaggcacgtgtcgcatgtacctcatccttccagtaccagttgtcttgcgcctgatggccttaatactccagttatacttgcggatgcgagcggcggggtagccgcaggaggagcaggtgctcttctggaggtggaagctacggcggccgcagcggatgcagagcgtgtgcgtcttgttccggcgcttgccgaagctgcccgtacccttccccattccttccttgctccgagcggctagggttcgaggcggaggcgcggcgtggtcgggtttttttttttttggccggcttcccggcccggccggcccctcga

SEQ ID NO: 13554 - DNA, 635 bp, Sorghum bicolor
  Clone ID: SORBI-28MAY03-CLUS15072_1
taggggccttttttttttttttttgcacaactgttttcaagcgatgacaattgcatgagcagggataacaaataaaccatactcatcaccaaaaaagatacatcataccaccagggggtctgactttaattcaaagcacgataaaccagtactttcatagtattacggctaaatagttcagaagtacaattcatcaatcaaaaagtcccaacttctagcttctgaggttcttgatggcaaaatccagacttagttggcagcagcggcactcttcttcggggcagcctcagtcccttctctgaagttgctcttgaagcggcgaggcacgtgacgcatgtacctcatccttccggtaccagttgtcttgcgcctgatggccttcacactccagttatacttgcggatgcgggcggcggggtagccgcaggaggagcaggtgctcttctggaggtggaagctgcggcggccgcagcggatgcacagcgtgtgcgtcttgttgcggcgcttgccgaagctgcccgtacccttgcccatttccttgcttgctccgctcggctagggttcgaggcggaggcgcggcgtttgtcgagttggagggggtgggggggagccggcccggccgccgcgagcggccg

SEQ ID NO: 13555 - DNA, 428 bp, Sorghum bicolor
  unsure (1)..(428): unsure at all n locations
  Clone ID: LIB3480-032-P1-K1-G8
cttgcttgctccgctcggctagggttcgaggcggaggcgcggcgtttgtcgagttgggcaactgcggaaacgtttgagagtacctgagcaaagaattgaacctcgagggatcaaaataaaagcagacttagagtataaggagcaaccagtggggattgtggataacaaggaacgggtaacccgaaacagaattgtcagaacatataaggtggtgtggagtcatcatgacgatagggatgccacctgggaaacagaggattactngaaaacagtttatccaaaatttcataagaaatggttagtaacccaaaatctcgggacgagatttccctaaggggggaagggcttgaaccccctaggtgttangcatgcatttagccctaccacaacatgcataagcattctcatcaagcatatctagatcgcga

SEQ ID NO: 13556 - DNA, 679 bp, Sorghum bicolor
  Clone ID: SORBI-28MAY03-CLUS10074_1
cctctatttgacatttccacggaccaccctgccacttactacgaagacatgcaacgtgctgtcttctgcctctgcccattgggctgggcaccatggagccctcggttggttgaggctgtggtctttggctgcattccagtcatcatagctgatgatattgtgcttccatttgcggatgcaatcccatgggaggaaattggtgtctttgtcgaggagaaggatgtcccaaagctagacacaatcctcacgtcgatgcctatagatgacatcttaagaaagcaaaggttacttgcaaatccatcaatgaagcaggccatgctgttcccgcagccagcgcaaccaagggatgcgttccaccaaatcctgaacggccttgctcggaagctccctcacccggagggtacgtacttacaacctggcgatcagcatctcaactggactgccggacctgtgggagatctgaagccgtggtagagaagagaagagctgtcttcttggataagctctgccatgagcacctcctaggactaatgcgtgcttcatgaaatacgatgtgatcaaaatgctgtgtgctttaggtgcaaaaatacaccttggccgtgcctagtccttatgagaatgatgtaacttattcatttctgatataaatgaaatggtatttatcttgctttcaaaaaaa

SEQ ID NO: 13557 - DNA, 1708 bp, Sorghum bicolor
  Clone ID: SORBI-28MAY03-CLUS10239_1
tcctccacctccctcccttcctccctccgcccatccatccaccgcctccccacaataacaaaaaaaaaacccctccgaatccgcctcgcgtgccccgtcctcctcgtcgccggcggagccgcccgccaccgcccacctatcgccggagaaggagcgccgcggggagcttttccaccgccgcctcccgtctgactgacccctccgagatcggcggcggccggccatggcggtcccgctcgtgctcgtcgtgctcccgctcggcctgctcttcctcctgtccggcctcatcgtcaacaccatccaggccatcctatttgtgacaataaggcccttttccaagagcttctaccgtcgggtcaacagattcttggctgagctgctgtggcttcagcttgtctgggtggtcgactggtgggcaggtgttaaggtacaacttcatgcagatgaggaaacttaccgatcaatgggtaaagagcatgcacttatcatatcaaatcatcggagtgatattgattggcttattggatggatattggcccagcgttcagggtgccttggaagtacgcttgctgtcatgaagaagtcatccaagttccttccagttattggctggtcaatgtggtttgcagagtacctctttttggagaggagctgggccaaggatgaaaagacactaaagtggggtctccaaaggttgaaagacttccctagaccattttggctagctcttttcgttgagggtactcgctttactccagcaaagcttcttgcagctcaggagtatgcggcttcccagggcttaccggctcctagaaacgtacttattccacgtaccaagggatttgtatctgccgtaagtattatgcgagattttgttccagccatttactatacaactgtaattgttcctaaagattcacctcaaccaacaatgctgcggattttgaaagggcaatcatcagtgatacatgtccgcatgaaacgccatgcaatgagtgagatgccaaaatcagatgaggatgtttcaaaatggtgcaaagacatttttgtggcaaaggatgccttactggacaagcatttggcaacaggcactttcgatgaggagattagacctattggtcgtcctgtgaaatcattgctggtgaccctgttttggtcattcctcctgttgtttggtgccatcaagttcttcaagtggacacagctcctatcaacatggagaggtgtagcattcactgccgcagggatggcacttgtgacaggggtcatgcatgtcttcatcatgttctcccaggctgagcggtcgagctcagccaaggcggcacggaaccgggtcaagaaggaatgaaaatggagggtggagatgagatgctggggtttattattgccgaccttcaaaagggttgcagattgaattcatattaatgtatacagcaccaaaattccagacattgatatgctctcaaataggatgctctgctcctcttgtatttgtatgcaggaaagaattgtagggagtttattttttcccccgctcttttgggcagaggaattgtagcacatgaacttgatgttggtactttgctctgtcagacatattctggaagcctttcagtagttcatttatcagtaatgcttgcatctttaatccatgtagttgtgcaccttgtctgtcactcatcacaatgtggttatgtggggattgtaa

SEQ ID NO: 13558 - DNA, 1345 bp, Sorghum bicolor
  Clone ID: SORBI-28MAY03-CLUS10326_1
ctactgggctgtcctagaaatgtgccaaacccgtcgtctcgtcttcccctcccggctcccggttccggccccgctcctcccaaaatcccccaaaacctgacgcgctggagggccgatccgcggctccccgctgcctgatccgagccggctcctcgcccccgccggggatccaagtgggatggggtacttgagctccgtgatcggccaccccaccgatggatcctccgtcagcggcggcggcctcagccagaatggtaaatttagctatggctatgcaagctcccctggtaaaagggcatccatggaagacttctatgagacgaaaattgactgtgttgacggtcagataattggtctttttggagtttttgacggtcatggtggtgctaaagtagcagagtatgttaaagaaaacttgttcaacaatcttgttagtcatccaaagttcatgagtgatactaaggttgctatagatgatgcttataaaagcaccgacagtgaattcttagaatctgacagtagtcaaaatcaatgtgggtcgactgcatcaactgctgtacttgttggtgatcgtctctttgtcgcaaatgttggtgactctagggctatcatatgcagggaaggaaatgctatccctgtttcaaaggatcacaagcctgatcaaactgatgagcggcagcgtattgaagaggctggaggtttcgtgatgtgggcaggaacatggcgtgttggtggtgtacttgctgtttcgcgagcttttggtgacaaactcttaaagcaatatgtagttgtggatccggagatccgagaggaagctgtcgatgacacacttgagtttctcatccttgcaagcgatgggctgtgggatgttgtctctaacgaggaagctgtcgcgatgaccagatccattcaggacccagaagaggctgcaaagaagctcttgcaagaggcctacaagagggagagcagtgacaacataacttgtgtcgttgtgcgcttcttgcgcgggcaaggtagtagcggatacgcttaaagcatagcaataaaattactgtacgcagtggtgtgagctatgatatacatgcctcgattgattttccaaggttgaatggagaaaggtaggatacttgtattatgacgatgggttgaactgggaaatgtgtgtaccctatatatatgttaggttagacactaagtttgctggccgtgtttcaccctagtttgattttgatgtttgggtcagaagatagtgttgtattgttgtggatggaaaaaaacacgataaaattgtcccttggtttgaaatgtatctgtcagtatactactttccccttgcttgactctc

SEQ ID NO: 13559 - DNA, 1623 bp, Sorghum bicolor
  Clone ID: SORBI-28MAY03-CLUS102_1
ctactggatgcaggacagctccagtccaggtccatacatacctgcactgcaatgcttgtcttgaccgaagcttccccccccccccggccagttcgtggtgctccgcgcccgccggttccgcagcgcctgccaccccgtgctccccatctcagttcagcacctgcaagctagctagccttcactcaagcatcacaaaaccctactactgccaccttcagcacctgcatagatacatatatacaaacacttcacaacaatctatctgctcgatcgtcttcatcaattcccaagccaataatcaacaatggtggttcccgtgatcgacttctccaagctggagctggacggcgccgagagggcggagacactggcgcagatcgccaatggctgcgaggagtggggcttcttccagctcgtgaaccacggcatcccgctggagcttctcgagcgcgtcaagaaggtgtgctccgactgctaccgcctccgtgaggccggcttcaaggcgtcggagccggtgcgcacgctggaggcgctcctcgacgcggagcggcgcggcgaggaggtggcgcccgtggacgacctggactgggaggacatcttctacatccacgacgggagccagtggccgtccgacccgccggcgttcaaggagaccatgcgcgagtaccgcgccgagctgaggaagctcgccgagcgcgtcatggaggccatggacgagaacctcggcctggaccggggcaccatcaaggccgccttctccggcgacggccggcacgagcctttcttcggcaccaaggtcagccactacccgccgtgcccgcgcccggacctcatcactggcctgcgcgcgcacaccgacgccggcggcgtcatcctgctgttccaggacgacaaggtcggcggcctcgaggtgctcaaggacggccagtggaccgacgtgcagccgctcgcgggcgccatcgtcgtcaacaccggcgaccagatcgaggtgctcagcaacggccggtaccgcagcgcctggcaccgcgtgctgcccatgcgcgacggcaaccgccgctccatcgcttccttctacaacccggccagcgaggccaccatctcgccggcggcggtggccaccagcggcggcgaggcgtaccccaagtacatgttcggcgactacatggacgtgtacgtcaagcagaagttccaggccaaggagccaaggttcgaagccgtcaaggcggcggcgccaaagtcatctccagcggcataaataaatgggggtggaaatcgaaaattttaatatattataaataattattaatttatttgttggatataacagctgaataaataataatataagtataataaatacgggttagcacttgtggtgtttcactgtgtttaactttagtggcatggcatgatatattgttgtagcaataagtttgttgagttttaatcctatagatatagaaaagaaaaaggtgtgtctagtctttggtgtatagagtttattgagcacatgcatatccaagtattgggttttttcatgtacttaatgtgatagtggttgtatgtaagagttgtaccatcatttttcgaatgcaataaagagtgtgtttggcatgcctccgt

SEQ ID NO: 13560 - DNA, 416 bp, Sorghum bicolor
  Clone ID: SORBI-28MAY03-CLUS892_2
cgtccggttatattgcctctttttattattgactgtggaactaaatcggtatgttatattgcctctttttaattattcatgctccgttacatacgtctacacctgcataacctattttctgatttcatacatagacacctgctccagcagctgtcccagatgatacacctctaaaggatcttatcaccaagtcgccaacaggaacatcacacgctcataggaaactgtttcgagaaaacactctcactgaaaaggaaaccatagcggaacaaaatttgaacgcaaacggaatcataaggataaccacaatggtccaattgatccactactgcaggcaaaagaaaaaaaagggagatacttgaatttagatgatctagaccaagagaacaaaaggtcgatacttgaatttagatgat

SEQ ID NO: 13561 - DNA, 1671 bp, Sorghum bicolor
  unsure (1)..(1671): unsure at all n locations
  Clone ID: SORBI-28MAY03-CLUS892_1
cagcaaattgctactgtgtccaattccaaagggtttagtggtctaccaggaattctgtgcctggctcatatgttgggatgcctgattccaaaagggtttagtactctaatggaaattttatacctgccagatatgttggggatagttttggaagcgtgtctctattaaagcttggtttcgctcagatatattggggatagttttggaagtgtgtctctattaaagcttggtttggctcagagaatgcctagcagacatgctagatgggattccttgtactgaatcttgtcgtacaatgttgctaaactagaaatatatgtctaccattttcaaagcaaaatttgtcaataaatcttattttttgtattttttcagtaagtgcttatatttagaaggtagcactactcagacatttatttagtttccagaatattttttgtcaaaagagcatccataaattcaggtggagcactaaaattgttcccattttggataattaactttcgcaatgaatccatggtcagtgcatttcattttgctgcctgcttacctctagatttagtcattcgggcgtgggcacaaattcaagattcatgattttggagtgaaggtagcaaatgtttttgcaggattggcactacgtattaaagtcaggatattgaagaaggcactatcttgttaccttgcagcagaccggttttttaagcccactgaagctagcagtaccagctggtctactttccaagaagtttatcttctcagttaccctcaccgaacactcatatacctctagcggctgcacagattgttccagttccagtaaccagttccatacaaccagcaagttcacttggtactccagagtacgcagcctgaaccacagcctgtatcctttgactgtggaactaaatcgacacctgctccagcagctgtcccagatgatacacctctaaaggatcttatcaccaagtcgccaacaggaacatcacacgctcataggaaactgtttcgagaaaacactctcactgaaaaggaaaccatagcggaacaaaatttgaacgcaaacggaatcataaggataaccacaatggtccaattgatccactactgcaggcaaaagaaaaaaaagggagatacttgaatttagatgatctagaccaagagaacaaaaggtcgatacttgaatttagatgatccagaccaagagaacaaaaggtcttgctgcaaaataaccaagaaactggtttcgagacccactgattgtataaggcattgcagtattagttagttgagactgtccaagactttcgtaagcttatgtactcgcttctaggcttgtccagtgtatattattcaggctattatgctttgatctcctggatattacttaagatgcccaggtcctgtccaaaatttatatgcctatctattcatgtacttgcaagaagcatatatgctacccgtactaatatactcctagtatgcatggaactcacctgctccagcagctgtcccagttgattcgcctctaaaggatcttatcaccaagtcgccaacaggaacatcacacgctcataggagactgtttcgagaaaacactctcactgaanaggaaaccatagcggaacaaaatttgaacgcaaacggaatcataaggataaccacaatggt

SEQ ID NO: 13562 - DNA, 765 bp, Sorghum bicolor
  Clone ID: SORBI-28MAY03-CLUS10445_1
gccggccgggccgggaccaccagcagagatctcgtgctcgccgctatcaattcgttccttctccacagcaacacatccgccttctagaaccttctcgccgccgccgccgccgccaccacccgtcgaagcgaagcaaagcaatggccggagtcggatcgaaggccctcgccgtggtcgccgtcctggcggccgtcgccctgtcggtggccaacgcggctgatgcgcccgcgcccagccccgtctccgccgccggcgccgcgtcggcgcccttcgccgcggcactcgtcgcctccgccgcctccttcctcttcgccgccgtccgccactgagccgatgggggcctgatgcctcgtgcctgccctgcctacctacctagcagtacttccaccaccgccgccttcgccgcctagatctatttattattattggagtgttattcagtagtagtagtagtagggagagatttcttcgtagctctcgtgtcgtcgtcgcattttggtcggatctggtgtgtccttggtggaggttgggtttctaccgtatcgtggtgtgtgtgtgtgtgtgtgtcggttgtgtgatctgatgatccccccttgtagatactctgctttcatctcgccgtgatcgtgagtggtgattctgtctggttgctactgatatattattatttcttcttattattattggtcccataaaagacattggaaaaaaaaaaaaaaaaaaggcccctattctctcgtatcagaaaaaataaaaaggccccta

SEQ ID NO: 13563 - DNA, 994 bp, Sorghum bicolor
  Clone ID: SORBI-28MAY03-CLUS10835_1
tctcgcgcggcacgccacacacgcttcgttctctacatactttcggctgcattaattcgccaacaaaatggcagcttcttcttccgtgacgaccgtcggcggcagcttcctcgccgccctcgccctcctcgccgtagccagcgacgcggcggtgttcacggtggtgaaccggtgcccctacaccgtgtgggccgcgtccgtgccggtgggcggcggtcggcggctgaaccgcggcgagacgtggcggatcacggcccccccgggcacgacggcggcgcgcatctgggcgcgcacgggctgccagttcgacgcgagcgggcgcgggagctgccgcacgggcgactgcggcggcgtgctgcagtgcacggggtacgggcgcgcccccaacacgctggcggagtacgcgctgaagcagttcaacaacctcgacttcttcgacatctccctcatcgacggcttcaacgtgcccatgagcttcctccccgacggcgggtccgggtgcagccgcggcccgcggtgcgccgtcgacgtgaacgcgcggtgccccgccgagctgaggcaggacggggtgtgcaacaacgcgtgccccgtgttcaagcaggacgtctactgctgcgtcggatcggcggccaacaactgcgggccgaccaagtactcgaggtacttcaaggggcagtgtcccgacgcgtacagctacccaaaggacgacgccaccagcacattcacctgcccaaccggaaccaactacaaggtcgtcttctgcccgtgaccgtgaggctgaagatgaccggccgggagtgatcatgcgaatgcgacgaagaaataaaaggatcgatcgaggtttgtgtagtaagctagtagtgtgctcaactggagcaaaaataaataaagccaacaattaaacgcgtgtgatttctatgtcaccaactcagtatatatagtcaccatatataatgaagcatactgaagttgtttcttaaaaaaaaaaaaaaaa

SEQ ID NO: 13564 - DNA, 1137 bp, Sorghum bicolor
  Clone ID: SORBI-28MAY03-CLUS1927_1
agatttcaaggttttcaatacagcaaaagcatgctcaaggaagaggttgagaggtacaagaagttcgcagatcgcttggagccctttattgctgataccgtgcatgtgctaaatgaatctattcagcagaagaagaaaatcctggttgaaggtggacaagcaactatgctggatattgattttggtacttatccatttgtgacttcttctagcccttcagctggtgggatatgcacaggcctagggattgctccaagggtgattggtgacctgattggagtggtcaaagctacacatcaagagttggctctggccctttcccaactgaactatttggagaggaaggcgatcgccttaggaaagctggaatggaatttggcacaacaacgggtcgcccaaggcgatgcggctggcttgacattgttgcacttaagtactgctgccaaatcaatgggttctcgtcacttaatctgaccaaacttgatgttctgtccgggttgtcagaaattaaggtgggtgtttcttatagccgacctgatggacagaagctgcaatccttccctggggatcttgatacccttgagcaagtacaggtcaactatgaggttctgcctgggtggcaaactgacatttcgtctgttcgaagttacaatgaacttccccaagctgcccgcctctatgtggagaggatagaagagcttgttggtgttcccgtgcactacattggtgttggacctggcagagatgctctcatatacaagtaaaagcaacttcatttggtccttcattgggcagaaaaatctagccctaaccaggccttgagcatttgcacttcgttgccatcgtagctgtgatacggtgaagtcactgactggttgagtgatgtaatgtgcgcaataatcagaaccttgtcctaaaacagccactgcgacatcagctaaggcgaataagggaaggatgagtcatttgcactatgtctgacaccaattgttcggtggttcatcatatatcttgcaccgtgtttgactccaccaatttttaggtggttcatatattttgtactaataattgtgagactaatgtgctatgaatctcaactgtataccttgctgatgcatgccttgggtttattttata

SEQ ID NO: 13565 - DNA, 1456 bp, Sorghum bicolor
  Clone ID: SORBI-28MAY03-CLUS20239_1
gccggccggtccggggttcgtccccaagcgagagcatgcatactttgcattgcaattaagctaaagatcgactcagagagaccatggcatcctcacgtgcctactctctttccgtgccgttgctcctcctcgtgataggagtatgttgttgcatcagtgaggcattgcccatcggccatcaccccgtcgacccgacctgtcctccggagccggcggcgtcggcggccgtgccgtcgtcgtcctctagctacggcgagcccgagccacgccggcgccggtgccagccgccagcgccgcacatcccggtgcccgtgttcccctacgacgtcgacccgatgcagttcgcgctgaacctggagttcaccgaggccgagttcttcctgcacgccgcgtacggcgtggggctcgaccacgtcgcgcccaagctggcgctcggcggcccgccgccggtgggcgcccggaaggccaacctcgacgaggtgacgtggcgcatcgtcgcggagtttgccctccaagaagttggccacatcagggctatcgagcgcacggtcggcgggatccctcggccgttgatagacctcagcgcccgcaacttcgccaggttgatggacaaggcgtttgggtaccgcctggaccctcccttcgatccctacgtcaacagcctcaacttcatgctcgcctcctacgtcatcccctacctcggcatcaacggctacgtcggcaccaaccccatcatcgacggctacgagacaaagaagcttctggcagggctggcacggggggaggcggcgcaggacgcggtgatccgggcgcgcctcttcgagcacctcggcgaggccgtgccgccgtacaggaacatcacggtggcggagttcacggaccgcgtgtcggcgctgcgcaacgagctggggcggtgcggcgtcaaggacgaagggctgacggtgccccgcgcgctcggcgccgagggcgccatctgcaccaacgtgctctccgccgacagggactcgctctcctacgcccggacgcccgccgagctgctcagcatcctctacctcaccggcgacgagcacgtgcccggcggattctacccggagggcggcaacgggaggatcgccaggtcgtttcttgccaagccacacggacacggtgctgctcacggggtgcctggaaactagctaagctctgtcgtctgtggccatcagtgtcacgggtagcgtattggtactagtatctacgactacgagtgctgcgtgcaagaattccaatttaagcgattgtatatcagtgtgtatattcggagctgagctcatcgatttgaaccaagtgtcgcgtgcacaaacatgctgcaactggagcatatatatatgttggatgaacttgcaaaattagtttcataactaatggtggattaatatctacataaacatgtgaatgaacttgcaaagtttcataaata

SEQ ID NO: 13566 - DNA, 1033 bp, Sorghum bicolor
  Clone ID: SORBI-28MAY03-CLUS20246_1
gccggccgggctgggaatactgcacgaggctcgatcgatcgagctgaacgtagacagagaaacaataatggcttccgtcctccacctcctcccgctcgtcgtcgtcgtcgtcttcctcgcggcggccgctgccgacgcggccaccttcaccgtgaccaacaagtgccagtacaccgtgtgggcggcggcggtgccgggcggcgggcagcagctggacaacgggcagacgtggagcatcaacgtgccggcgggcacgacgggcggccgcgtgtgggcgcgcacggggtgctccttcgacggcagcggcaacgggcagtgccagactggggactgcggcggcgtgctgcggtgcacgcagtacgggcagccgcccaacacgctggccgagttcgggctgaaccagtaccaagggctcgacttcatcgacatctccctggtggacggcttcaacgtgcccatggactttttgcccgccggcgacggctccgggtgccccaagggcgggccgcggtgcgacgccgacgtcacgtcgcagtgccccgccgcgctgaaggccaccggcggctgcaacaacccgtgcaccgtgttcaagaccgacgagtactgctgcaccggctcggcggccaacacctgcgggccgacggattactccaagttcttcaaggggctctgcccggacgcctacagctaccccaaggacgacgccaccagcacatacacttgccccggcggcaccaactacaacgtcgtcttctgcccatgattccaatttccatgagctccatcgagctgaacgtacgtatgtagttgacccacgagacgtgaaaaataaataaaactagcacaaatatatgaataagttatgaataacttgtgcaagaacaattgatacaccatgctccacgtagcatgacatggtatctagtacacacgtgagtacgtacgtcggacatttctatgtatcctttaattccattgttctagtttcaaggttggcatgcaattgaatattgtgcaatgatatatcagatac

SEQ ID NO: 13567 - DNA, 674 bp, Sorghum bicolor
  Clone ID: SORBI-28MAY03-CLUS959_3
cgtagacatgaacggatccatggcaagcgcctgcgccacctccaggcccctcgcctcggcgccctctgcatgcccgtccaacaagaccacccctgccggagtcgaacccgctgagcttcaaggcgcaggccgccatccaccaggcctactgcgacagctactacagctaccaccggtcgtcgtcggcggcgaagaaggacggcgtcgaccccgccttcgacgtccacttctcgtggatcttcgcgccgtggcaccgcatgtacatctacttctacgagcgcgccctcgggcagctcatcggcgacgacaccttcgcgctgccggctgggaaccctggtgctcttttcaagggctcctttatcaacccgctgtgcgaccccaaccggaacatggccaatgtcgacgccctagtcgacctagactacctgagccacaaagatgacaagcccatcgatttcaagggcccaaaggacgaaaaatacaaggatcttgttaacaggaacctgtgcaccatatacacccagcaagtacgtaagggcccggagtcgttccttgggggagaagtactgcacggccatcgagggccgcggcagcgcgggtacgctggagagtatggcgcacacggccgatgcacgttctgggtgggcaaagccgacgacgaagcccctgcgacg

SEQ ID NO: 13568 - DNA, 808 bp, Sorghum bicolor
  Clone ID: SORBI-28MAY03-CLUS959_2
gcaacgtccaaatccagaccgctgtagtctcgtagacatgaacggatccatggcaagcgcctgcgccacctccaggcccctcgcctcggcgccctctgcatgcccgtccaacaagaccaccgccggctcttttcaagggctcctttatcaacccgctgtgcgaccccaaccggaacatggccaatgtcgacgccctagtcgacctagactacctcagccacaaagatgacaagcccatcgatttcaagggcccaaaggacgaaaaatacaaggatcttgttaacaggaacctgtgcaccatatacacccagcaagtacgtaagggcccggagtcgttcctgggggagaagtactgcacggccatcgagggccgcggcagcgcgggtacgctggagagtatggcgcacacggcgatgcacgtctgggtgggcaagccgacgacgaagccctgcgacgccagcaccggcggcgtgctgagccacaaggacggcgccttcaactgcaacaacgacatggggttcctggggacggccggcaacgacccgctcttctactcgcaccacgccaacgtcgaccgcatgtggcacctctggtccacaaggctcggcggcgggcagggcatcacggacacggactggctcgacgccaccttcgtcttctacgacgacgtcaagagcccccggaaggtccggatcaagttccgcgacgtcctggacacgcgcgacctcggctacacctacgacgccgagtacgacagggacctgccgtggctgcggcccaagatcacgaagctggtgccgcacggcaa

SEQ ID NO: 13569 - DNA, 1058 bp, Sorghum bicolor
  Clone ID: SORBI-28MAY03-CLUS959_1
cgcacacgacggtgcacgtgtgggccggcaggtcgagccccaaggctccggcgacctgcacggtggacggcggcggggtggtggcgcacgacggcaagccgcactgcaacaacgacatggggttcctgggcacggcggggagggacccgctcttctactcgcaccacgccaatgtcgaccggatgtggcacctctggtccaccaagctcggcggcaagggcttcgacgacgcggagtggctcgacaccagcttcgtcttctacgacgacgtcaagagcccgcggctggtgcggatgaagttccgcgacgtgctcgacgtcaccaacctcggctacacctacgacaaggagtcggaggcggcgctgccgtggctcaagagcaagcccacccggttctcgtccggcaacgtccaaatccagaccgctgtagtctcgtagacatgaacggatccatggcaagcgcctgcgccacctccaggcccctcgcctcggcgccctctgcatgcccgtccaacaagaccaccgcagattcggcggcgccagcaccggtgtcgtgcagagccacaaggacggcgccttcaactgcgacaatgacatggggttcctggggacggccggcaacgacccgctcttctactcgcaccacgccaacgtcgaccgcatgtggcacctctggtccacaaggctcggcggcgggcagggcatcacggacacggactggctcgacgccaccttcgtcttctacgacgacgtcaagagcccccggaaggtccggatcaagttccgcgacgtcctggacacgcgcgacctcggctacacctacgacgccgagtacgacagggcctgctggggctgccccgccagacacgaagctggtacggcaaggagagcccgtcgggacgtgatgctcaacggcctgaccggtgtgcccgccgggctcgcctggtaccctggcgtggcgtccggtgcagattcgtcgacgacttcgccgtgcacggcggcggacaaggtgaaacgagatggtcctgcagtgcacggacacggcgaatcagaagccct

SEQ ID NO: 13570 - DNA, 2132 bp, Sorghum bicolor
  Clone ID: SORBI-28MAY03-CLUS13342_1
aaaaactagacgcacgcggcttctttttcccgattttcgttttttcttttctcttggattggattcaccctgctcaaaacttcggcggcggcagtagcggcgccggcgaccttctccatgaacacggtgtcttcgctgtctttggtgccgcacctgctcattaagccctccatcgcctgcttctccagaaagggcgttggccgctatggcggaatcaaggtgtacgccgtgctcagggaagacggagctgagttcgccaagaacaacaacctggaggccctgttccatgtggatgaccccgggccgaggtgccccatcaagaagggcaagttcctggatgtgaacgaggcactcgaggtggtccgattcgacatccagtactgcgactggagggcgcgccaggatctcctcaccatcatgcttctccacaacaaggtggtggaggttctcaatcccttagcgagggagttcaagtcgatcggaaccttgaggaaagagcttgccgagctgcagcaggagctggaaaaagctcacaatcaggtccatctatctgaagctagagtttcatctgcactcgacaagctagcgcatatggagaccctggtgaacgacaggctattgccaccagatggagcctccggtacttccacagccgagtccacttccctggttccaagcacatcgtccaccgcccatgtccgagccaagaaacagccacgtcggagtcttaacgtgtccggcccagtgaagccgtacaatcccagcctgaagaacttctggtacccagttgccttctccagtgatctgaaggatgacaccatggtgccgatagattgtttcgaggagcagtgggtgatattccgaggaaaagatggaaggcctgggtgtgttcagaacacatgtgctcacagagcttgcccactgcatcttggttcagtgaacgagggtagaatccagtgcccttaccatggttgggagtattcaactgatgggaaatgtgaaaaaatgccatcaacaaagatgctcaacgtgcgcatccagtcattgccatgctttgagcaggaaggaatggtttggatttggcctggggatgatccaccaaaggctacaatcccttctttgctgcctccttcaggatttacgattcacgcagagatagtgatggaactaccagttgaacatggactcctcctggataatctcttggaccttgctcatgctccttttacacacacatccacctttgccaagggctggagtgttccaagcttggtgaagttcttaacacctgcgtcggggctccaagggtactgggatccttacccgatcgacatggaattccgaccaccgtgtatggtcttgtcgaccatcgggatctcaaagcctggaaagctagaagggaagagcacccagcaatgttctacacatctccaccaactccatgtctgcttgccctcctctaggaataaaactaggctgctgtaccggatgtcactagactttgctccatggctcaagcacgtaccgctcatgcacctgctgtggtcacatttcgcagagaaggtgttgaacgaggacctacggcttgttcttggtcagcaagagcgaatgatcaatggcgccaacatctggaactggccggtatcatatgacaagctcgggatccggtatcgattgtggagggacgccgttgagcggggctctgaccggttgccattcagtaaccaagccgagagtggatcatagccggtagtctctttcttcctcgtcgcattttttcgcgagacgacggacggccagaattagttaccatggcgtgcgtctctgcgcggccagatgctgctgtgccttgaaggattctctatctggaaggtgaaagctgatggagaggatgatgggaaacatcatggtctcttctctggtgtagcaatgtacactagcgacggcatcgtgggatgcaattgtgatctgagattgatgtcttttttttttctctctctctcttcttttttttcacccttttgtgtaaagattcagcaaatgttactctgtcaaagcatgtataatcatactaccaactacggagacatgttcatatgagaaatggcagtcgtctaatcgagttgcacatt

SEQ ID NO: 13571 - DNA, 1055 bp, Sorghum bicolor
  Clone ID: SORBI-28MAY03-CLUS1309_1
gccggccgggccgggaccattcaccaaccaaagtccagtgtctccatcgcggctgccacgcctctcgcgcacgcgcaggacgaccaatggcttccaggaagttcttcgtgggcggcaactggaaatgcaacggcaccggcgaggacgtgaagaagatcgtcaccgtcctcaacgaagccgaggtgcccactgaggacgtcgtcgaggtggtggtgagcccgcctttcgtttttctgcagcaggtcaaggggctgctgcggctggacttcgctgtcgcagcgcagaactgctgggtgcgcaagggcggcgccttcaccggcgagatcagtgctgagatgctggtgaacctgcaggtgccctgggtcattttggggcattctgagcgcagagctctgttgggtgaatccagtgattttgttgctgataaagttgcatatgcactcacccaaggtctcaaggtaattgcttgcattggtgagacccttgagcagagagaggcaggaacgacaatggatgttgttgctgcacaaacaaaggctatttctgaaaaaatatcagattggacaaatgttgtgttggcgtatgaaccagtttgggctattgggaccggcaaggttgcaacccctgctcaggctcaggaggttcatgatggtctaagaaagtggcttcactccaatgttagcccagcagttgctgaatcgaccaggataatttatggagggtctgtaaatggagctaactgcaaagaacttgcagctcaagcagatgttgatgggttccttgttggtggagcctcattgaagcctgagttcgtggacatcatcaagtctgccactgtcaaatcttcatgtgcctagtgttttgactttgaatgcacccggaggcttgtagtacataatgctgctgcacttttaaagttattgccattttaccatcttgttttggtactctagctccagtgcatcgtttgtgtatcatgccaatgctcatctgatgcgtatgtgctgtatcacccttatgtactcttggaacggcataatgaaccgtgctattct

SEQ ID NO: 13572 - DNA, 1327 bp, Sorghum bicolor
  Clone ID: SORBI-28MAY03-CLUS13484_1
gcacgaggaagccttcagagatgcggggctgcaattctcgaaacagggtgctccaggtactcaagaaaattctctgttggataacactgccagaatagagggatggttagctcggtttcctatgtttgactgggttggtggtaggacttcagaaatgtcagctgtgggtttacttccagctgcattgcagggtattgatatcaaggaaatgctagctggtgcagctttaatggatgaggaaacccggaccactgtggttaaagaaaatccagcagcattgcttgcattatgttggtattgggcaacagaagggataggcaaaaaggatatggttgtacttccttacaaggatagtttgttacttttgagtagatatttgcaacaacttgtcatggaatctcttgggaaagaatttgacctggacggcaacccggttaatcaaggtctaaccgtatatggtaacaaaggaagcactgaccagcacgcttacattcagcagctgagagaaggtgtacacaacttctttgttacttttattgaggtcttgcgtgacaggcctcctggtcatgattgggagcttgaacctggagtcacatgtggtgactatttgtttgggatgttgcagggaacccgttctgctctttatgcaaatgaccgggagtctatctctgttaccgtgcaagaggtaactcctagagctgttggagcactggttgcactttatgaacgtgctgtggggatttatgcttctttggttaatatcaatgcctatcatcagcctggtgttgaggctgggaaaaaggcagcaggagaagtattggctcttcagaaaagggtgctgactgtattaaacgaggccacctgcgagaaccctggtgagccattgagtatagatgaaattgcagatcgctgccattgccctgaagatattgagatgatctacaaaataatccagcacatggctgctaacgacagagcacttatagcagaaggcagctgcggctcacctcgcagcgttaaggtgtacctcggtgagtgcaatgtagacgaagatatgcaggccgcatagattcctggtctggaactgtgtaaaattgttggaataaatcaggagcaacacgataacgatgctatgcatgggtgttgctgatgtgccattagtttcttgtttggtgttgtttgcacacgattgccgcaacgatgtattttagaatttgtttttttttgggtcccttaaatacagaaggtgcttgaacacgattgcagcaacaaatgtattttagaatttgatttgttttttgtgggcccttaataataataataaaac

SEQ ID NO: 13573 - DNA, 1008 bp, Sorghum bicolor
  Clone ID: SORBI-28MAY03-CLUS12895_1
gccggccgggccgggatggatgtgatgttgttgggccgggcactcaacacatatccacaaacaactggagaagctcaactcgccgacggatcggaaacaatggcgagccgccagccgcggccggtggacgcttccctgagatcgctgtcgattgcatctgcgctgctgacatggagcgtttgctgtgccgcggtgagtgtgagggcactacctgaacctgacggttgtagctccaactccaacatgacagaactccagatgcatgtgtcattcttcgacaggaacaaagatggcatcctcactcctcttgaaactttccaaggatttgttgctatcggatgtgaagttgctttctccaccgcggctgcatcgacaattcatactgctctcgctcctttgaccaaccctcctggtgcactgccaccttacataaatatctacgtggagtacatccacaaagcaattcatggaagcgacaccggcgcctacgattccaaaggaaggtttgtccaggcaaaatttgacgaaatatttaagaagcatgctcatatcagaaaagacgccttgtcgctcttggaggtagaagagatgctcacagtcaaccgggacgttcttgatcctgcatcatgggctgctgctgaggccgagtggcagctgatctaccagctagcccacgacaggtatgggtttcttaccaaggaacgcgcgaggggcatctacaacggcaagatcttcgttgagcttgaggaacgcatcagcaggagacctcttcacagcaacgcatgatatctatcattaatttggcagctgcagcaacttgtatgcttcacatgatcacaattaggcagccgtggtagtagcatcttgtatactggaatggaacctgatttctacacgactttactactggaaactgaagatttcctgtcggttaccaaaccgacaggacaatgccatttaccgacagaaaaaatagtttttatttttccctgttggggacccgacaaa

SEQ ID NO: 13574 - DNA, 589 bp, Sorghum bicolor
  unsure (1)..(589): unsure at all n locations
  Clone ID: LIB3480-060-Q6-K1-E10
ctggagaagctcaactcgccgacggatcggaaacaatggcgagccgccagccgcggccggtggacgcttccctgagatcgctgtcgattgcatctgcgctgctgacatggagcgtttgctgtgccgcggtgagtgtgagggcactacctgaacctgacggtggtagctccaactccaacatgacagaactccagatgcatgtgtcattcttcgacaggaacaaagatggcatcctcactcctcttgaaactttccaaggtgtgatctcacttctcagctgcgcgtgacctgtatggaattatccttttttttgttcatctatttctgtaccttggacgacacacaggatttgttgctatcggatgtgaagttgctttctccaccgcggctgcatcgacaattcatactgctctcgctcctttgaccaaccctgtacgctctctctccttggctctatccagtgagcaaatatttgttatcagaattcagaactcgcagtgcttcattcttaccgttgcagcctggtgcactgccaccttacataaatatctacgtggagtacatncacaaagcaattcatggaagcgac

SEQ ID NO: 13575 - DNA, 407 bp, Sorghum bicolor
  Clone ID: LIB3478-050-P1-K1-C5
tggcatcctcactcctcttgaaactttccaaggtgtgatctcacttctcagctgcgcgtgacctgtatggaattatccttttttttgttcatctatttctgtaccttggacgacacacaggatttgttgctatcggatgtgaagttgctttctccaccgcggctgcatcgacaattcatactgctctcgctcctttgaccaaccctcctggtgcactgccaccttacataaatatctacgtggagtacatccacaaagcaattcatggaagcgacaccggtgcctacgattccaaaggaaggtttgttcaggcaaaatttgacgaaatatttaagaagcatgctcatatcagaaaagacgccttgtcgctcttggaggtagaagagatgctcacaggcaacccggac

SEQ ID NO: 13576 - DNA, 1612 bp, Sorghum bicolor
  Clone ID: SORBI-28MAY03-CLUS1303_1
gcacgcggtgtcgtgtcccatctttggtgcggatcttcaccgtccgcgccacatgctggtggaggtgctttccggggatgctgcaatccccgtggagatagctgatttcgtcacaggacttggattgactatcttgaggggtgtgatggtaatgcgcaaaagtaaaatctgggcaagatttactgttgaggcgaaccgggacgtaaccagaatggaaatctttctatcacttgtgcgcttgttagagccaaattgtgacggcagtggagctgcagagaacgctaacaacatgaacatgcctcttggtttggtgcgccaacctgtcatcccagcaacaggccgcatccaatgagactatagagcaaaccctcaagcatcttccaagtgctaagagcaggagctcagctaacttctgccatgactagcatcaccaatatgccaggcaccaccagctttcctgaaacatcttaatctgtgcaaatgtggcatccttcacgagaccagatcgccgaaatggaagacggaaaagaaggcaagagtgatcattaggcagtgttttgtttgtatgatcttagtttgtttgttagttagtcatgtttggtcatatattagtggattttttgtactgttattcagaatggaaattcttgggttggtttatttcacacaacaaaaagatggaatacctcctcgggaagaccattaagcacatgcttttcttgcaaagcgtgacaaagcatgcagacaacctcaaggacacaaatgaatctaagattcttggtggtgagaatgggccgctcttgggcggcctcgtcggtggcgcgtcgtgggccttggttgtgcgttggctggctctgtcatctcctatctttgtcgaggctcgcgtgcggcctcgtcagatgcttgtggagatgctctgtgaggatagaggtatcttcttggagatagctgactttattaaaggactaggattaaccatcttaaggggcgttatggaagcacgcaaaaataaaatctgggcacggttcactgttgaggccaacagggatgtgactagaatggaaatcttcctttccctaatgcgcttgctggaaccgagttgtgacggcagtggagcaggagagaatcctaataacaacacaaaaatgccgcttgggattgtgcgttatcctgtaatccctgcaacaggtcatcttaggtgagccagcaagcgcaaagatcacaggagccatctttgaaatgctaagagcgggggtcgacccacttctgccatgactagcattgtcaacccaggacgagctggaatctcgtgacggcatccagtgcatcgtccctgcagtgtgcattcagaaagcctaacagtagacgggaatggagacatggatagttggttcggcggatgatcattagaagatcgatgttttgactgtataatcttagtttctgtttgttgctgatgcctttgccttttgttcttctgcatattagtgaattttgttatgttactgctgctgaatggaaattctgagttgaattgtaggccttgttctggtactgactcgaagtcggagctctcttttttacccaagtgttccctgtgtgattactaatg

SEQ ID NO: 13577 - DNA, 450 bp, Sorghum bicolor
  Clone ID: LIB3476-054-P1-K1-H6
tacgacctcacgcgtacgcgtaggagtggaaaacaccagcactgccaaaggaccggcagcttattcaggatcgtataaaggagctccgggaactcgtacctaatggggcaaagtgtagcattgatgcattgttggagaagaccattaagcacatgcttttcttgcaaagcgtgacaaagcatgcagacaacctcaaggacacaaatgaatctaagattcttggtggtgagaatggtccacttaaagactacttcgaaggtggtgcaacttgggcctttgatgttggtagtcaatctatgacatgtccaatcattgttgaggatcttgagcggcctcgtcagatgcttgtggagatgctctgtgaggatagaggtatcttcttggagatagctgactttataaaaggactaggattaaccatcttaaaggggcgtatgggaagcacgcaaa

SEQ ID NO: 13578 - DNA, 1051 bp, Sorghum bicolor
  Clone ID: SORBI-28MAY03-CLUS14987_1
gccggccgggccgggatcccaaactgcaagaacgcaagacagaagcgagtaccagaaaagaaaaggaaaaaaaaaaaatcccaaacccgcaacggccatgtctccactgctccgccgcgtccttctcctcgccctcgccgccgccgtcgcggccacggcgtccgccgcgtcgctgaacggcgcggcgaacgacctgctccccaagtacggcctcccgaaggggctcatcccggactccgtggcctcctacagctttgacgaggccacgggcgccttcgagatccacctcgccagcacctgttacgtccacttcggctcccacctcgtctactacgagaggaccataacgggcaagctctccgagggcgccatctcggacctctccggcgtccaggccaagaagctcttcctctgggtctacgtcacggggatggtcgcgcaccccgaccagggcaccatcgagttccaggccggattcatctcggagtctctgtcggcctcgatgtttgacgatgtgcccacctgcggttccagcgtcggtgcgcagctgcgcggcgcggctggggtgatcggggagcttgggctgctccccgttgcgcaggcctgaacctcgagttgagaatccacactcccagagaaccgcaggaccgcccttccagtttgctgtcgcctgagcactagagtgcaagacgttctgctgcggtgtcttctgcctgtaccagtatctagttgtaatgttgctcccggtctcaaatggacatcgatggatgctctgtagaaatgtatatccataatatgctgttaccgaacctgcgtaggatgtaggcagagagtctcttgtactcccggatccggatcatcatatattcatgtcatcgcgtgtggaaccatgaactgccccagaagtgtcgcggcacgggcttgtctgaaaagccatggcctttgagcttgttggctgtctgaaaagttatggcccgttcgttaatttattatgagagaagaaaaaaggaaaaagtctacttttccttccctaaaaaaaaaaaaaaaaaaa

SEQ ID NO: 13579 - DNA, 1283 bp, Sorghum bicolor
  Clone ID: SORBI-28MAY03-CLUS13728_1
gcaccacacacagaatgatgatcatggctctctcccgtgccgccgcgtcgtcgagagggttcttcttcgcgctgatgcttgtcgcgtgctgcagcctcatgctgcaggcggcggcggcggcgggcggcggcgcggacggcgtcgtcgtcggtgctgatggtgacaataagctgatgatggaccggttcctccgctggcaggcgacgtacaaccggtcgtacccgacggcggaggagcggcggcggcggttccaggtgtaccggcgcaacatggagcacatcgaggcaaccaaccgggcgggcaacctaacgtacacgctcggcgagaaccagttcgccgacctcacggaggaggagttcctggacctctacaccatgaaggggaggatgccccccgtccgccgtgacgccggcaagaagcagcaggccaacttctcctccgtggtggacgcgcccaccagcgtcgactggaggtccaggggcgccgtcacgcccatcaagaaccagggcccatcctgctctagctgctgggcattcgtgacggcggcgacgatcgagagcatcacccagatcaggacagggaagctggtgtcgctgtcggagcaggagctgatcgactgcgacccgtacgacggcggctgcaacctgggctacttcgtgaacgggtacaagtgggtgatccagaacggcgggctgacgacggaggccaactacccgtaccaggcgcggcggtaccagtgcaaccgctcaaaggccgggcagcgcgccgccaggatctccaactacaggcagctgccgcagggcgaggcgcagctgcagcaggcggtggcgcagcagcccgtggcggcggccatcgagatgggcggcagcctgcagttctatagcggcggcgtgtggtcggggcagtgcgggacgcggatgaaccacgccatcaccgtcgtcggctacggcgccgactcgtcgtcgggggtcaagtactggctcgtcaagaactcgtggggacagacctggggcgagcgcggctacctaaggatgcgcaaagacgtcaggcaagggggactctgcggcatcgcgctcgacctcgcatacccgattgtgtgatcgatcgagggttcctgaatcctgattcttactatatacacacacatgtagcaacggtgctgcattatataatgtattgtatgtatatgtaaaagccagcagctggcacagggccaaaagccaaattaccaccatatgaaatattatgggccttaatgctatgtgaaaaaaaaaaaaaaaaaa

SEQ ID NO: 13580 - DNA, 1108 bp, Sorghum bicolor
  Clone ID: SORBI-28MAY03-CLUS9861_1
ggctcacggcgcggccgactggcagtcgctcaaggtcacggcctcacaggtgactcacgaatcgagctacaggagagggaagcttcaggaaacgaagccgagaggagcgaaccttctggttcgtctgcgctgcgtatcaagatcacagggttgtgcttgaatcgcgggcgttgggaacccatccatggcgaggaagatgcttgtcgacggggaggtggcggccgtcgcggacgccgggcagtacgactacgatctgttcgtcatcggggcgggcagcggcggcgttcgcggctctcgcttcgccgcctccttcggagctaaggttgcgatttgtgagctcccattccaccccatcagctcagagtggctaggaggacatggtgggacgtgtgtgatacgtggttgcgtacccaaaaagatactcgtgtacggtgcatctttcggtggagagtttgaggattcaaagaatttcgggtgggagattaatggggatattaacttcaattggaaaaagctgttggaaaataagactaaagaaattgttagattaaatggagtatatcagaggatccttaccaatgctggtgtgacaatgattgaaggggcaggcagtctagttgatgctcatactgttgaagttagccagcccgatggttcaaagcaaaggtatacagcgaagcacattttgattgcgactggtagccatgctcaacgtgtcaacatacctggaaaggagctggctattacatcagatgaggccttgagcttggaggagcttccaaagcgtgctgtaatcctcggtggcggatatattgctgttgaatttgcttctatctggagagggatgggtgctgaagtagatttgttttatcgaagggagcttcctctaagaggttttgatgatgagatgagaactgttgttgcaagcaaccttgagggaaggggaatcaaattgcatccagggacaaatctgtctgagttaagtaaaacggctgatggcataaaagttgtaactgataaaggagaagagctcattgcagatgttgttctatttgcgacagggcgcacaccaaactcccagagattgaacttgcaagctgcaggcgtc

SEQ ID NO: 13581 - DNA, 1223 bp, Sorghum bicolor
  Clone ID: SORBI-28MAY03-CLUS2447_1
cccgccgcggcgccgccctcccccccaccgcctccgccggacggggctcgccaggcgtccggcctcttcctccctccctcccaccacctcctctctatccatccatccatctgctgccgtccccctcccgctgcgtgcgagaggcgcgccaccacaacggcgcctgagttcgcctttcccgtccgcggcacctccgctcctcccacggtttctggaggacaattctttgttgtttagcgttcctcaaaagtaaaaagggtaaatgggatcagaaggaccttcagttgtcactgtccatgttactggatttaagaagttccatggggttgctgagaacccaactgagaaaattgtgaccaatcttaattctttcttggaaaagcgagggttgccaaaaaatcttgtccttggaagctgtacagttctcgaaacagcaggacagggggcacttcccacattatataaggttttagagtctgctattgcagacagaggaactgggtcctcggcacagggacaagtaatttggatccactttggagtcaacagtggtgcaacaaggtttgcccttgagaaccaagctgttaatgaggccaccttccggtgtccagatgagttaggatggaaacctcagagggtccctatcgtgccctctgatggaagcatctcacggacgagagagactaccctgccagtgaatgaattgaccaagtcgctccggaagataggctacgacgtggtgccctccgacgacgctggtcggtttgtatgcaactatgtgtactaccattctcttcggttcgcggagcaacacggcatcaaatctctgttcgtgcatgttcccctcttcttgacgatcgacgaggaggtccagatgcactttgccgcttccctcctcgaagtcctcgcttcctcctccaactagcaacagcagttcaaagatcagcgtttggattcctatctcaaggatggatgtaaagctggatgcaggctgaataaggtggtgtggtcattggcgatagatgttgatcttgttccagaaggtgtgttcggaaaaaaaaaagggaaattggtgcatagagtcagacactcggtgtatgttcgtgtggacgtgtggccaatgcggcttgtatgccatcatcagtcaagcgatgtaaacatgcctgaaaaaaattggggacccggatttcaataagattttagtcgctgggggcagacgcata

SEQ ID NO: 13582 - DNA, 2156 bp, Sorghum bicolor
  unsure (1)..(2156): unsure at all n locations
  Clone ID: SORBI-28MAY03-CLUS24640_1
gcacgaggatcagaagagaacacctgcctctcttcagtttgttgccgtctctctgtcctcttcacgcaactcctctcctatcttctctctccctcgctcccttcgcatcgcgttgccaccgaaccctcccgccatggcaaggccaccgcaggaggcgatcgataccttcatcagcatcacgggggcggacgaggccgtcgccgtacgcaagctcgaggaacatggtggtgaccttaatcgagcaataaattcacatttcaatgatggagatagcatatcgaatggaatcagtcaaaacaccatgcctgctagtcatgatgatatgatggacctggatggaccacttgataatacatttcaaagacctttgttcccgcacgaggcccatgacccttttgcgctaatggatccaaattttcagcgccagttttttgacagagttggctccactgatggtgtcagtcatggaccgctggtttcgcaccctagagaggcgagagagattcctattgaagttaaagatagtgatcctcaaacaggtccatctggacaggctcctgttattgaggatgttactggaaatgagtctttaaatggccctgaagttcctgaaactatcataattgatgaggaggatggaggattgttatccgcaccatctgctccacatgccagtattcctagcattacatcttctgtgccaactgctcctccattggttcatgttaatgactatgatgatgacatagaagaggaaatgattagggcagcaattgaagcttcaaagaaggattctgaagcactggcaaatatagtagagcaaggaggagaccagcatcaagagggagtgaacttggaggaacattcttctgataaagcaggcatgggaaccacagatggaatagtcgagaggcaaggaccagcttcaggaaaggctggaacgtctaggcaaccaatagatgaagagggcttccaagaggagactgaagatgtagaggaacaaccgttagttagacgccgttctcggcgtgtcccttctgagaacaccgaactagcacaaatagtgcacccaggtgctagccctgttcggaacgatcgccagtataacaatggagatgatttcccatctgagtggggcggcatttcttctgaggaacatgatgaagctgtcatgcttgaggctgcaatgtttggtggagttcctgaaggaccaacatatcctttctccatgccttctcacagaagctctacttattatcccccaatagctcattctccatcaccagcattaactgaacagcggttattacgagagcagcaggatgatgagtaccttgcatcgctacaagctgatcaagaaaaggagttaaaggccttacaggaggctgagctccgtcgcctagaagaaactgctgcgagagaagctgctcttgagaaacagaagcaagaggaggaggaaaggcgtaaaaagcaacttgaggaagaggagctagagtccagtctcgcttccaagcaagcatcattaccatcagaaccgcctccagatgcagagggtgccgtgacagttgtagtccgcatgcctgatggtagtcgacaggggcgtcgctttctcaaaactgataaacttcagttcctatttgatttcttagacattgggaggacttgcaagccagggacctacagattggtgaggacatacccaaggcgtacatttaccgacagtgagggcgacgtatcgttcagtgatctcggcctaacaagcaagcaggaagccctgtttctagaacagatcacggcgtagaggggataagtgttaggcatatggttagagataccacagctggagtcggaggttttacatcttatacttgcaccttttgccagtaaaaacttcaaagtctgtcaaatggttgggttggtcgaagaaaaggttaaaaaaaattcttttgtggcgccatgtcgtgacgcattgcgctttgcatgctgcgcgttatatatgcatgttatgtcagggtaaactgtggacggcatggggccaatttatgtatacaatgtgataacgtatacctacttatgaccattcgtttcattgagtcctgctgtgcaagagtgattctgtatatactgttggttctgtgaatcaaagncgatgctgc

SEQ ID NO: 13583 - DNA, 963 bp, Sorghum bicolor
  Clone ID: SORBI-28MAY03-CLUS25255_1
gcacgaggcatattgaggtcgatagaagtggaaaaattcccatgttgaggttccgagaccgcgaatcatatgcacagaataagaccaaagagtacgatgccattgcaatgaagtaccttacctatgttcttttcctacttgtgatcggtttctctatctattcacttaagtatgaaaagcacaagagctggtactcatggatactttcttccatgacaagttgtgtgtacatgtttggtttcattatgatgtgcccccaattatttatcaactacaagctgaagtctgttgctcatatgccatggagacaaatgacctacaagttcctcaacactataattgatgacctttttgcatttgtcattaaaatgccaatgcttcatcgtctctcagttttcagagatgatgttatcttcttgatatacctctatcagaggtggaaatatccggttgacaagaagcgtgtcaatgagtttggcttcggaggcgaggacgaaccggcagcccagggggctctggaaggaagtgcagcccagccaacggaggctgaggccgaggacaagaaaaccaagtgatctccaatctttggatcatccaaatatagcacacctctcagcaacacctgccctcccagctggcatgaaatttctttgctgaactgaatgctggactcttgcggtcttgccttactgagatgctgaccataagataagatgtgtaacaggggacacaatagtctttgcctagggcagcgggcgaacagacacactatcacaattacgtttccagtttgtcttttagcagccattactaggtgatatgcttggttgattggtttttgtacaattttgtgcattttattaaaaaaatacataattggttgttcgtagtttcataatgacatgctttgctctaataatgttgcaacgagtccactagtgagtgcactggtgccgttccctc

SEQ ID NO: 13584 - DNA, 672 bp, Sorghum bicolor
  Clone ID: SORBI-28MAY03-CLUS25840_1
cacaacaaacaccacgccgcccaaaccgacaccgcctccagcgccggccgccgctacactctgatctgaccccatggacgcgacgcaactgaaccggccaatggacgcgacgcgactcttccttggcgcgctcctcctcctcctccccgccgcgctcctcctcctgctccgcgcgcggggcaggcgccgcctcccaccgggcccgccgtcgctgccgctgctcggcagcgtggtgtggctcaccaactcgcccaccgagatcgagcccctgctgcggcgcctcttcgagcggtacggccccgtcgtcgcgctccgcatcggggcgcgcctcttcgtcttcgtcgccgaccgccgcatcgcgcacgaggcgctcgtcgaccgcggcgcggcgctggcggaccgcccggcgctcgcgtcggtcaggctcctcggcgagaacgaaaacagcatcacccgcgccagctacgggcccgtgtggcgcctccttcgccgcaacctcgtcgccgagacgctgcacccgtcgcgggtgaagctcttcacgccggcgcgcgcgtgggtgcgacgcgtgctcgtcgagaagctcggcgagcccgggcccgacgccgcgccgccccgcgtcgtggagacgttccagtacgccatgttctgcctcctcgtgctcatgtgccgcgg

SEQ ID NO: 13585 - DNA, 1307 bp, Sorghum bicolor
  Clone ID: SORBI-28MAY03-CLUS17604_1
gccggccgggccgggatcgctcgtgtcctccttttcttcctggttcctctccgtcgccggtgctcccgcttcctgtctccctccccctgcgagcgatcgtgaggggatcgggatggcctcccaccattccgagcccctcgactccgccgccgccgcagacgccccctcagataataacccagaattaccatgccccccttatcatatcgttaccaaacctggtcaactcccggtcgagtttcttgaaccctcagctgcccagaagttggtaattggatttgactgtgaaggtgttgatctttgtcgcaatggtgctctctgtatcatgcagcttgcattccctgatgctgtttacctagttgatgctattgagggtggaaaagaacttattcaagcttgtaagcccgcacttgagtctgatcatatcaccaaagttattcatgattgtaaaagggacagcgaggctttgtattttcagtttggcatcaaactgcataatgtgatggatacacagatcgcttattctctgatacaagagcaggagcaggaaggaaaaaagaagacatctgatgattacaattacatatcttttgtcagccttcttgctgataaacgattctgtggcataccatatcctgaaaaggaagaagtccgtacccttctaaggcaggaccctaacttttggacaattaggcccttgtctgatatgatggttcgagctgccacagatgatgtccgcttccttctcaatatctatgagaaaatgatggaaaagttaagcaaagtatctttgtggcgtctggcagttcgcagtgagctgtactgtaggtgcttttgcttaaacgacaaccagtttgcagattggtcacctcttcctcctgtccctgatgacattgaagctgatgtttatgttcctgaagttgatatcctatcagtcttagatgtgcctcctgggaaaatgggacgtgttattggcagaaaggggtcaacgataatggctgtgaaagaatcttgcaatgttgaaatccatattggtggtgctaaggggcctccagacagggtgttcatcattggaccagtgaaggaagtcaggaaagccgaggccatcttcagaggccgaatgctggagttctagagatgttaccctttgtgacccatgtttcaactgctttatatcttttgaatgaacgcaaaaggggggaaatatacaaaaagtgcgtgcggtaccgtggatcccttgactgtccgtgaatcgtgaaaacaaaaataaaggatttcaacttggcctaaaaaaaaaaaaaaaaaaa

SEQ ID NO: 13586 - DNA, 549 bp, Sorghum bicolor
  Clone ID: SORBI-28MAY03-CLUS1749_1
tgtgcggcgctcggccggcggccgcgggatcaggtccaaagtgacattaagcttcaagcagtgttagttgcaacagagctactagtaagtagcacacaacaacgacaatggcttccctgaaggcctcgaagcccgccggagttgcagcgcagggcaaggagccggcacccaagctcagcgagacggcgacgaagccgtccgccgccaagagcggcggcgtcaagaaggctgagcagaagccccgggaaaccaaaaagaaggtgaagagcagcaaaccggcggcagccaaaaagtgacagtgtgagatgtagtggagcttcttcgcatgagtgtcttcatgctatgttattatgaattataaatccagtccttcctttcttgtgtcttccatgtgacggtgtgtgcgtccctatgtgtgatgactgatgaattaatactacaaataagacgttgtaactgtgtcatcgccttcttcatcctttgccgcttcatgttatagtaatgatagtcatttttccagcataaaaaaaaaaaaaaaaaaggccccta

SEQ ID NO: 13587 - DNA, 474 bp, Sorghum bicolor
  Clone ID: LIB5052-004-A1-XP1-F9
gccggccgggttcgggaggtccaaagtgacattaagcttcaagcagtgttagttgcaacagagctactagtaagtagcacacaacaacgacaatggcttccctgaaggcctcgaagcccgccggagttgcagcgcagggcaaggagccggcacccaagctcagcgagacggcgacgaagccgtccgccgccaagagcggcggcgtcaagaaggctgagcagaagccccgggaaaccaaaaagaaggtgaagagcagcaaaccggcggcagccaaaaagtgacagtgtgagatgtagtggagcttcttcgcatgagtgtcttcatgctatgttattatgaattataaatccagtccttcctttcttgtgtcttccatgtgacggtgtgtgcgtccctatgtgtgatgactgatgaattaatactacaaataagacgttgtaactgtgccaaaaaaaaaaaaaaaaaaggccccta

SEQ ID NO: 13588 - DNA, 561 bp, Sorghum bicolor
  Clone ID: LIB5052-008-A1-XP1-D10
gccggccgggctgggaggtccaaagtgacattaagcttcaagcagtgttagttgcaacagagctactagataagtagcacacaacaacgacaatggattccctgaaggtctcgaagtccgccggagttgcagcgcagggcaaggagccggcacccaagctcagcgagacggcgacgaagccgtccgccgcctagagcggcggcgtcaagaaggctgagcacaagccccgggaaaccaaaaagaaggtgaatagcagcaaaccggtggcagacaaaaagtgacagtgtgagatgtagtggagcttcttcgcatgagtgtcttcatgctatgttattatgaattataaatccagcccttcctttcttgtgtcttccatgtgacggagtgtgcgtccctatgtgtgatgactgatgaattaatactacaaataagacgttgtaactgtgtcatcgccttcttcatcctttgccgcttcatgttatagtaatgatagtcatttttccagcataactacttgttctagcatagtgttctgaaaaaaaaaaaaaaaaaaggccccta

SEQ ID NO: 13589 - DNA, 673 bp, Sorghum bicolor
  Clone ID: SORBI-28MAY03-CLUS18483_1
gccggtgccgcaggaaaccacgcaccatacccgaccgtgagagctgaaatccactgctgatcactacagcatcgccgagcgtgctctagctagatagaagcgaggagacaaagatggagaacaacggcaacaggcagcaggcgccgccgccaccaccaggctacccgacggcggctgcaggcgcggaggagcagggaggcaggaagggacgccgggggaagacgacctcgcgtggggagaaaggcttcatcgaaggatgcatcgcggcgctctgctgctgctggatctgcgagatgtgctgcgactaggcaggcatgcacgccgcagcacgctccggcagtccggcggacaagagagaattgctcagctgtgtacttgttgtttaatttcggtgtagtaaaggagcttattagcttataatttgttaataactgtggtgagatgatacatgcgcgctagctgcctgtcttttatttgtgctgtaggtagtacgtgtacatcccgtactgtaccgttacttgtgctgtgtgtgtatggagtggagaaggtggcgttggtgatctatatacgtgaaccttctaggtgctacacgtacttgaaaatgtctcatccaatcactctccatgaattattatcgaaaaaggaaaaaaaatccactctccacgtgtgttcc

SEQ ID NO: 13590 - DNA, 613 bp, Sorghum bicolor
  Clone ID: SORBI-28MAY03-CLUS16849_1
ccgggagtctcggtcggcatcagcatcagtgatcagcaatccctcccctgcctttatagtcgccgcgcggccgtgctcctgctcctgctcctgctctaccacctctctctccggcctgcatcatccgcttcaagcagcagggcagggcacgagcctcaagggatggcggactgggggcccgtggtggtggcggtggtgctgttcgtgctgctgtcgccgggcctgctgctgcagctgccggccaagggcggccgcttcgtggagttcggcaacttccagaccagcggcgcctccatcttcgtccacgccatcctcttcttcgcgctcgccgccatcttcctcatcgccatcggggtgcacatcaccacagacccttaaacctcttgccctccctgccggatctttcttgtttaccatatgcctaatcctatatataactacgtactcctacgctttattatgtcagtcagtgtctgtatcagcaccccctgtgcatacaactagcaagtgtttctatggctgtaatctagttgttcaatgaagcagcagcaaacctgattgtttactttcagaaactgcagccgatgcttaaaaaaaaaaaaaaaggccccta

SEQ ID NO: 13591 - DNA, 329 bp, Sorghum bicolor
  Clone ID: LIB5121-006-A1-PF1-A11
atttcaccaggacggggtcgacgggtgaacactacggcccgtggcctaggtcagtggccctcattgcactttggagggcgcgctggcctaccatctccccaagagggagagtggacgtcataatttgtggtagagggggtacgcgttcgcgcggcccctgccatataactacgtactcctacgctttattatgtcagtcagtgtctgtatcagcaccccctgtgcatacaactagcaagtgtttctatggctgtaatctagttgttcaatgaagcagcagcaaacctgattgtttactttcagaaacttgcagccgattgcttactttc

SEQ ID NO: 13592 - DNA, 675 bp, Sorghum bicolor
  unsure (1)..(675): unsure at all n locations
  Clone ID: SORBI-28MAY03-CLUS18785_1
gcggcgctcngacgcgccggccgggagctgtcccctgtgtcgccgctgagaagaaggaaccggagcgatggagctctctcgcaagctcttcacggccgtcctcctcgtcatgctgctgctcgtggccacagagatcgggccggtggcggtggcggaggcgaggacgtgccagtcgcagagccacaggttccgcggcccctgcgtgcgccgggaaaactgcgccaacgtctgcaggaccgagggcttccccgacggcaagtgccgcggcttccgccgccgctgcttctgcctcacgcactgccgcaactgattcgatcgatcggccgggggagcatgcatgcatgcctgcccggcggcgagtgcatgcggcgggcccgtcgttttcgatctctgttgccgtgtcgtcgcgcgttgatcgcgagaaccgtccatgaataataagaagaagtgtgtttgtgtggtttgtttttggacctttttgtcagctggtgtcacaagttatatttgtcgtttgttgagtcgtggatcgatcggtctatagtagtgtgtgccgcctctgcgtgctgctagctgctgtttcctctgttcttcccctcaatgtttcggtttctccatatcaatgcgttgagatctactcctaatataagagaaaatttcaagttccctatctccaac

SEQ ID NO: 13593 - DNA, 576 bp, Sorghum bicolor
  Clone ID: LIB5050-005-R1-XP1-G10
ccgggattcagctgtcccctgtgtcgccgctgagaagaaggaaccggagcgatggagctctctcgcaagctcttcacggccgtcctcctcgtcatgctgctgctcgtggccacagagatcgggccggtggcggtggcggaggcgaggacgtgccagtcgcagagccacaggttccgcggcccctgcgtgcgccgggaaaactgcgccaacgtctgcaggaccgagggcttccccgacggcaagtgccgcggcttccgccgccgctgcttctgcctcacgcactgccgcaactgattcgatcgatcggccgggggagcatgcatgcatgcctgcccggcggcgagtgcatgcggcgggcccgtcgttttcgatctctgttgccgtgtcgtcgcgcgttgatcgcgagaaccgtccatgaataataagttgttgagtcgtggatcgatcggtctatagtagtgtgtgccgcctctgcgtgctgctagctgctgtttcctctgttcttcccctcaatgtttcggtttctccatatcaatgcgttgagatctactcctaatataagagaaaatttcaagc

SEQ ID NO: 13594 - DNA, 1631 bp, Sorghum bicolor
  Clone ID: SORBI-28MAY03-CLUS1924_1
gcacgaggctgggctggaggttctacgtattataaatgagcctaccgcagcatcgctagcatatggttttgagaaaaagaacaatgaaacaattctggtttttgaccttggaggtggcaccttcgacgtttcagttcttgaagttggtgatggtgtttttgaggtgctgtctacatcgggtgacactcaccttggtggtgatgactttgacaagagaattgtcgattggctcgctggaaacttcaagaatgatgagggtattgacttgcttaaagataagcaagctctgcagcgattgacagaagcagcggagaaggcgaaggcgcgacggtcatctttgacccaaacaaacataagcttgccttttattacagctactgcagatggccccaagcatattgagaccactcttaccagggctaaatttgaagagctatgctcagatctccttgacaggctgaggacccctgtggacaatgcccttagagatgcaaagttgcaattcaaagatattgatgaggttattcttgtcggtggctcaactagaataccagctgttcaggagcttgtcaagaaaatgacaggaaaggatcccaatgtgacggtcaaccctgatgaggttgttgcacttggagcagctgtgcaggctggagttttgtctggtgatgttagcgacattgtccttcttgatgtgacccccttgtcccttggtttggagacactgggtggtgttatgaccaagattatcccacggaatacaacattgcctacctcaaagtcggaagttttctcaacggctgctgatggccagactagtgtggagatcaatgttctccaaggagaaagagagtttgtgagagacaacaagtctcttggtagcttccggcttgatggaatccctcctgccccacgtggtgttccacagatcgaagtcaagtttgatattgatgctaacggtatcctttctgtcactgctgtggacaagggtacagggaagaagcaggatattacaattactggtgccagcactctgccaaaagacgaggtggagaggatggttgacgaagctgagaagtttgcaaaggaggataaggagaagagagatgccattgacaccaagaaccaagccgagtcggtcatctaccagaccgagaagcaactgaaggaactaggggacaaggtcccaggtgaagtcaagggaaaggtggagtcaaagctgcaagagctcaaggatgctgttgctggtggctccacacagacgatgaaggatgccatcagtgcattgaaccaggaagtcatgcagattgggcagtccctctacagccagcagggtgccccaggcgcaggacctgcccctggtgctgatgcttctgctggctcagctgagaagccaggcgacgaaggcgatgtaattgatgcagattttactgacagcaagtgaggtgctgggtttcgatggaggcggatcgctgggggccgttttgctgcgagggaggcatttgtttccacaaggttgtgtaggatgtgggtgtactttttggtagattggcaccttgtttcctttggactttggacgaaggtgagttaggcactgtcaagtgaatatataataggcctttttcttctgtttc

SEQ ID NO: 13595 - DNA, 896 bp, Sorghum bicolor
  Clone ID: SORBI-28MAY03-CLUS29896_1
agtccgacaagacggacgaggcggagctgcagcgcgccgtggagcgcgcgtccgcgctgctccgcccgcacggcgccgccgtggtggagtacaccagcccggccgacaccgagaccctccccggccgctgcctcgtctactgggagctcctgaccaagggccccgcggccggcgccggcgccgcggtggacagggagacgctggacaggtgctgcctcgagatggaggaggcgctgaacacggtgtacaggcagagccgcgtggcggacggctccatcggcccgctggagatccgggtggttcggccgggcaccttcgaggagctcatggactacgccatctcccgcggcgcgtccatcaaccagtacaaggtgccccggtgcgtgacgttcccgcccatcatcgagctcctggactcccgcgtcgtgtccacccacttcagccccggcgctgccgcactggacccccggccagcgctcccactccgactaagaccaggccggggccggccggagaggcgtgtccgggtccggcgcgcttaattaattgcttcgtatcgcagacgtagaatgccagtgaacttaaatatttgttagtttcggaattttgaggactgtcagttattagcggcgccgtgagggtaacttgatgtggtgagagttggaatcactccaaggctgagctgatcagctgaagcaacagtcgacgcatatgtaggagtaggggtttttagtcgggtggtaatggcactattttctttatcacttagcactacggggcgcgcgtgatatgcatgatgccgttgctagtaggtagtacaagtactagagttctactatcccaacaagggaatgtgagtattattaacgtgccaagatgttagtattccttaaaaa

SEQ ID NO: 13596 - DNA, 680 bp, Sorghum bicolor
  Clone ID: SORBI-28MAY03-CLUS30142_1
tctggactactggaagcaacacagcaagcagcagaaaacatctcctggccttcaagccgtccctcctcaagagtcccaaaccaccctcaggcaggttccacagctgctagctagcgtttgcaagcagtagtagtgttcaatcgaggcaatggcggtgatggccgaagtagtgtcgaccaccggcgcggcgctccggagcccggcctcgcagccgccgccgccgccggcggcggccgcggtgaaggacgctgacgctgagaagctccagttcatcgaggagatgacctccaacgtggacgccgtgcaggagcgcgtgctgggtgagatcctcgcccgcaacgccgacaccgagtacctcgccaagtacggcatcaccggcgcttcggaccgcgccaccttccgcgccaaggtgccgatggcgacgtacgaggacctgcagccgtacatccggcgcattgccgacggcgaccgctcgcccatcctgtcggggcacccggtctccgagttcctcaccagctccggcacgtccgccggcgagcgcaagctcatgcccaccattgaggatgagctcaaccgccgccagctgctgtacagcctccagatgcccgtcatgaacctgtatgtgcctgggatggacaagggcaaggctctccatttcctcttcgtcaagtcggagacga

SEQ ID NO: 13597 - DNA, 998 bp, Sorghum bicolor
  Clone ID: SORBI-28MAY03-CLUS30270_1
atcgcagtcgccgcacccggcgccaacgaagaggaggggctaaaacggaaaagcaccccggatgacaaaaatttcccactccactcgagttagaaccctagcggcaaaacctttgctccgtcccgccgtccgcctgctcccgtccccgccgccgccggcgccgccacccggtatccgccgaggaggtcgccgcccgggaggctgctcgcggcgccgcgctctctcccgcgccagcgaccttcgccctccccgcccgccgccatgatctgcgcgatctccggcgaggtgccggacgagccggtggtgtcgaagaagtcggggctcctcttcgagcggcggctcatcgagcgctatgttgaggaccatggcaagtgtcccgtcaccaaggaggacctcaccatggatgatatcgtgccggtcaagaccaacaaggtcgtgaagcccaggcctttgcaggctgcaagcattccgggactccttgggatttttcagaatgagtgggatgctctcatgctttctaattttgctttggagcagcagcttcacacagcaagacaagaacttagtcatgcgctctaccagcatgacgctgcctgccgtgttatagccagattaaagaaggaaagggatgaggctagagcacttttggctctagctgagagacagattcctgcatcagttccaggagctgctcctgtagctgttgtttccaatggaaaaagagcaatggaagatgaaattggccctgacgggaagaagattcgtcctggtatcaaccctgtcatgattgatgaacttacagagtgtaataccatgctttcagcacagcgtaagaaaagacaggttcctccaactctggcaccgatcgatgcactcgagagatacactcaaatctccagccatccccttcataagacaaacaaaccaggcattttgtccatggatattcatccttcaaaggacattggtgcaactgggggtatcgatacaaatgcagt

SEQ ID NO: 13598 - DNA, 1364 bp, Sorghum bicolor
  Clone ID: SORBI-28MAY03-CLUS2146_1
gcacgaggatgggattcaccttggaactgagatgtgcaagaaaattcttgctactggcattaagactttgcacctttacacactaaacatggacaagtctgctataggaattttgatgaatcttggattaattgaggagtccaaggtttcaaggccattaccttggaggccggcaactaatgttttccgtgttaaagaggatgttcgacctatattctgggccaacagaccaaagagctatcttaaaaggacattaggttgggatcagtatccccatggacggtggggtgattctcgaaacccatcatatggagcacttactgaccaccagttcacaagaccacgtggacgtggtaaaaagctccaagaggaatgggctgttccacttaaatctgtggaggacattagtgagcgctttacaaacttctgtcaagggaaactcacaagcagcccatggtcagaattggatggtcttcaaccagagacaaagattattgatgaccagttgcgtccgattaaccagaagggtttccttaccattaacagccaacctgctgtaaatggagagaaatccgactcgcctactgtcggttggggtggtcctggaggctacgtttatcagaaggcctacctcgaattcttctgcgcaaaagagaagttggaccaactaattgagaagatcaaagcattcccttctctcacttacattgctgtgaacaaggatggagaatcattctccaatattgcaccgaacgccgtgaatgctgtcacatggggtgttttccctggcaaggagattatccagcctacagttgttgatccagcaagttttatggtttggaaggacgaagcatttgaaatctggacacgggggtgggcttgcctgttccctgagggcgactcatctagggagctactagagaaggttcagaagagctactacctggtcagcctcgtcgacaacgactacgtccagggggatttgtttgctgccttcaagatctgatgatgctgttatgctctgtgttgttgtatggctgaatcacaatattcttgcttccccgactacaggtctgatcgcatgtgaaagcttctgttcatttgagctcgggggagtccgctagtcttacttttcctgatttcttttggcttactggaaccatacgatatatcaataagaaatgagttgtgttcactttacattttctccatgtgcaaatggcgcaatgggtagttttaagatgtaaaattcgtcctccaatacaggttggtattgtatcttagttagaaggatgcgctgcccgcgttgcgctgtatttgtgcttctgcttggtggaaataagattgatccaattctgatgttc

SEQ ID NO: 13599 - DNA, 2075 bp, Sorghum bicolor
  Clone ID: SORBI-28MAY03-CLUS20777_1
gcaccacgacggcaccgggtcattcaaggaggagagtaacctggtgtccgagctccccaaccttgagcgcacggcgctcgcgcagctcaaggagctcgtcgccgccgcgctcgccaacggggagttcaacctgccgccgccgccaccaccgccggcagccaaggtggagccggccaagaaggaggagccgaccatggaggaggctaaggaagaagctccagcggcggccaaggaggatgagcccaaggctgaggaggcagtcgccgaagagcccgtcaaggaagaggccaaacctgaagagcccaaaacagaggcgccggcggaagtagcagcggccgaggaggctaaggatgaggcacccgcgccggaagagcccaagactaaggctcccgcgccggaagagcccaagactgaggctcccgcgccggaggagcctgccaaggaggagcccaaggcagaggcggcggcggaagcggtcgccgaggagcccaaggccgaggcggctaccgaggagaccaagccagctgagccggagcccgaagagaagacggtcgccgccgccgaggcggtggccaccatcgcggtggccgccgtcgccgcccccgccgccgccgccgccgcggccgtgccgccggcggcggccgccctggcgcaggcggccgcgccggagcccgtgctgatctggggcgtgccgctggtgggcgacgacgagtgcacggatacggttctgctcaagttcctgcgagcgcgggagttcaaggtgaaggaggccatggcgatgctcaagtccgcggtgctgtggcgcaagcgcttcggcatcacctcgctcctcgacgccgacctcggcctgccggagttggagaacgtggtgttctaccgcggcgccgaccgcgagggccaccccgtgtgctacaacgtctacggcgagttccaggacaaggatctctacgagaaggccttcggcgacgatgagaagagggagcgcttcctcaagtggcgaatccagctgctggagcgcggcatcctgtcgaagctggacttctcgcccagcggcatctgctccatggtgcaggttaccgacctcaagaactcgccgcccatgctcggcaagcaccgcgccgtcacccgccaggccgtcacgctgctccaggacaactaccccgagttcattgccaagaaggtgttcatcaatgtgccgtggtggtatctcgctgcaaacaagatgatgagcccattcctcacacagcgcaccaagagcaagttcgtttttgctagcccagccaagtcagcagaaactctattcaggtacatcgcaccggagcaagttcctgtccaatttggaggcctcttcaaggtggacgaccctgagttcaccacctacgacattgtcactgagctcactatcaaaccatcgtcaaaagaaaccattgagatccctgtcaccgagaactccacaattgtatgggaactccgggtgctcggttgggaggtgagctatggcgctgagttcacccccgacgctgagggtgggtacactgtcattgtacagaaatcaaggaaggtgcccgctaacgaggaaccaatcatgaagggaagcttcaaggtaggcgagcccggcaaacttgtgctaactgtgaacaaccctgcatccaagaagaagaagctcctttacagatcaaaggtgaagagcaccagtgaatgagtgtgaggtcgctgctagctgccggggtcctacagttaaacgatctaccacagttcatctcagcatgatagaagagaggagaaaccttttggtttggttcgttaatttattgggttttgctggttttggtgcacattctacattttgttttaaaccaaagtgagcttgtttttgtgatagtagatgggagaagtataatgccattgtgacaggatggttgttgatgagggcaggggaggccaaaatgtgggaaggaaaggctggagaatgtctgctcctctgtagatgtgtctgtacattgcatctcttggattctcgttgatatgttacttgtcgcatcattattcaaaaaaaaaaaatctgcaggccccta

SEQ ID NO: 13600 - DNA, 2198 bp, Sorghum bicolor
  unsure (1)..(2198): unsure at all n locations
  Clone ID: SORBI-28MAY03-CLUS2216_1
cctactggatctctccctcgccccctgtgcccgcccccgcctcacacacacgcacccaccccacagcctacagcgctcccttctgctgcctgcttgccccggcgcccgcctctcctcgagctgccgccgcgcgcgcgcgcgcccccgcccgctgctcgttcctcccgcctgcttggctcggcgagccctgccagcaagaggttggtgggcggcgcggggatttgtattggaggagccgaggagggtgcttggccgcgaggagatcgggggcgcgggagggtggccgcgctcggttcagcgggatcacttggcgcggggcccatgccgtgagcaaaagccaagcttttgttgcccgggggagagatcttgcacttgccgcggaagtgaagccggcggtgcggtcccgagccgagcggcgcccgccccccgccgccgccgccatggccggcagcgacgaggtcaaccgcaacgagtgcaagggtgcggtgccgatccacacatgggtgctcatctccaacttcaagctggcgtacaacatgctccggcgggccgacggcaccttcgaccgcgacctcgccgagttcctggaccgccgggtgccgcccgacgcgcgggcccaggagggggtctcctcgttcgaccacgtcatcgacacgtccaccggcctcgaggtccgcatctaccgcgccgccgccgccgccgctaacaacaacggtggcgcggccgcggtcaccctgcccatcctggacttcctcgccggcgcgccgtccccggacccgttcccggtcatcctcttcttccacggcggcagcttcgcgcactcttcctccggcacggccatctacgacaacctgtgccgccggttcgtgaagctgagcaaaggcgtggtggtgtccgtcaactaccgtcgcgccccggagcaccggtacccgtgcgcctacgacgacggctggacggcgctcaagtgggccatgtcgcagcccttcctccgcagcggcaggggcggggacgcccgcccccgcgtcttcctgtcgggcgacagctccggcggcaacatcgcccaccacgttgccgtccgcgccgccgacgccgggatcaacatctgcggcaacatcctgctcaacgccatgttcggcggcacggagcgcaccgagtcggagcggcggctggacggcaagtacttcgtcacgctccaggacagggactggtactggaaggcgtacctgcccgaggacgcggacccgggaccacccggcgtgcaacccgttcgggccgaacgggcggcggctcagggggctacccttcaccaagagcctcatcatcgtgtcgggcctggacctcacctgcgatcggcagctggcgtacgccgagggcctccaggaagatggccaccatgccaagctcgtgtaccgtgagaaggccaccgtgggtttctacctgctgcccaacacggaccactaccacgaggtgatggaggagatcgccgacttcctcagggctaacctctagtacatactactacgacatcacagctgcctgcctgcctgcctgctgatcataagactcatcgaccagtggtcgtctcagacacaaacttcaacctcttgttatagcaagaagatggtaagcttgacttatagttgtaccgatctgctctcctcctccgccttatactgctgctgctgctgcttgggggtaatctgctgaattccggcgacgacggcaaggcattgctgctgtccatggccaagtggtgcactcaaaaggacagccagctccatatttctgatctgatgataaaagctctagtaggaaaggaatcacggtgactttttgtttcgtcgtcgggtgaaagtcgttctgctgatcaacaaagctttgatgatctgcgtcctggttgatggagagaagcctattatttngccttcaatcaccctccctccctccctccctccctccccggagggaattcatcatctaacattctgtgtacagtggtggactgacggaccaacaaggaggtggacggcctttttgttgttgctgtgtttgatgtattactactagtagtttttttctcatcttttctggattggatgctgcctacccctcactctatgatgaatctattatctatctacccatgttttgtgaaacatgtttccaatctactaggcaatccctgaagaaattgtgct

SEQ ID NO: 13601 - DNA, 1700 bp, Sorghum bicolor
  Clone ID: SORBI-28MAY03-CLUS2258_1
gccccacgaccgccgtcaccgtcaccgccgccgccgatccccagctatctcatggcggcctccgcgtcgtccctccttgcagcgcacgcggcctcatcctgcgcggccatctctccccggctcccgcgtggagctccggccgccgcctccgtcccctcgccgtcgcgtcactcctgctatcccctccgcgcttcccctgcgaggcgccatcggagccgcttcgtagccagcgccgctcccacgatgcagcctccggcggagtccagggtctccacggtagtcgatgtcgacctcggcgaccgtagctatccgatctacatcggcgcaggcctcctcgacgagccggacctgctgcagaggcatgttcatggtaagagggttctggtggtgaccaacacgaccgtcgcgccgctttacctggagaaggtgacatgggcactcacccacaacaacccgaatgtttctgtggagagcgtgatcctgcccgacggcgaaaagtacaaagatatggacacgctgatgaaggtgtttgacaaggcagtcgaatccaggtttgaccgccgatgcacatttgtagcactgggtggtggcgtcattggggacatgtgtgggtttgcagctgctgcattcctccggggcgtcaatttcatacagataccaactactctgatggcccaggtggattcatctgttggtgggaaaaccgggattaaccacccactagggaagaacttgattggggcattctaccagccacaatgtgttctaattgacacagatacactgaacacattgcctgacagggagctagcttcaggcattgctgaggtagtaaagtatgggctcataagggatgcaccattctttgagtggcaagagaagaacatgctgaaattgttagcaagagaaccaaatgctttggcctatgctatcaagagatcatgtgaaaacaaagctgaagtggttgcacaagatgagaaggaaagtggtctacgagcaacactaaacctgggtcacacatttggccatgctatcgagactgggcttggatatggagcatggctccatggggaggctgtcgcagctggaacagttatggcagctgatatgtcttaccgcctggggtggatagatgagtccctaaaaaatcgtgtggttgacatactaaagcaagccaagcttcccatcgcacctccagaggccatgaccgtggagaagtttaaaaacatcatggctgttgataagaaggtagctgatggtctgttgagactcatcctcctgaaaggaccactagggtgctgtgtctttacgggggattatgaccggaatgcactcgatgaaacccttcatgcattctgcgacaactgatccatctcagttttggacttcacttctgtatgatagtactactaggctatgtatcgatcagagaaaagattgcgatgtacattagcttctaccattggtatatttttgtcaggaataatggtgtaattgctcatgtgttggtttgagtttgtagagaaccatggctaatcaactgtgattagttgttctcagtagtaataaagaagcttcactacatccatctctatagattctgttaatgtcaggtgacaatactcttgtagcggttgaaacctgcttctgtgtcaatcaaattattatgactccaaaaaaaaaaaaaaaaaaggccccta

SEQ ID NO: 13602 - DNA, 1192 bp, Sorghum bicolor
  Clone ID: SORBI-28MAY03-CLUS23733_1
gcacgaggccggcgctgctcacctactactggcggatgaagatgcccgagacggcgcgctacaccgcgctggtggccaagaacgccaagcaggccgcggccgacatgtccaaggtgctccacacggagatcgtcgacgagcaggagaagctggaccagatggtcaccgccgagagcaacaccttcggcctcttctccagggagttcgcgcgccgccacggcctccacctcgtcggcaccgccaccacctggttcctgctcgacatcgccttctacagccagaacctgttccagaaggacatcttcacggccatcaactggatccccaaggccaacaccatgagcgcgctcgaggaggtgttccgcatctcccgcgcgcgggcgctcatcgcgctctgcggcaccgtcccggggtactggttcaccgtcgcgctcatcgacgtcgtcggacgattcgccatccagctgctcggattcttcatgatgaccgtcttcatgctcggcctcgccatcccctaccaccactggaccaccgccggcaaccacatcggattcgtcgtcatgtacggcttcaccttcttcttcgcaaacttcgggcccaacagcaccaccttcatcgtgccggctgagatcttcccggcgcggctgcgctccacctgccacggcatctccgccgcctcggggaaggccggagccatcatcggcgccttcgggttcctgtacgcggcgcagaaccaggacaagagcaaggcggacgccgggtaccccgcgggcatcggcgtgcgcaactcgctcttcgtcctcgcgggctgcaacatgctcggattcgtcctcactttcctcgtgccggagtccaagggcaagtcgctggaggagatgtcaggtgaggctgacgacgccgaggaggaggccgtcggcgcccgcgcggtgcggccgtcggagacccagatggtatagaatcgaacgcgttcacacgggagctggttcttcttcttcttcttcttcttcctgcacctgcacatggggagacttgtgtaggcgcttcagttcaattgtgtttttgtttctccatgtatgcaagtcaagtcgcacctctgtttcgctgtccaggagtagttcgtatgtggtgcaggtgcatgtgtgttatgtacttattataggcgggaaagtaagtgaacttacactcgttaccc

SEQ ID NO: 13603 - DNA, 1028 bp, Sorghum bicolor
  Clone ID: SORBI-28MAY03-CLUS2400_1
acgcgtccgcccactgcgtcggacggcacgaggatcacgcgcgactgaccggccgggagcgcacggcgagctagaactagaatggccaccacagccggcgccggaggcgccgggaagctgaagctgctgggcgcgtggccgagccccttcgtgaaccgcgtgcgcgtggcgctgcacctcaagggcctcgagtacgagaacgtggaggaggacctcaccaacaagagcgaccagctcctcgcctccaaccccgtccacaagaaggtgcccgtgctcctccacggcgacacgcccgtctccgagtcactcgtcatcgtggagtacctcgacgacgccttccccggcgccggccaagccctcctccccgccgacccctatgaacgcgccgtcgctcgcttctgggccgcctacgtcgatggcaagttgcacggcatgatggtgaaggcgatcctgggggcaacggaggaggagagggcggcggcgacagcggacgcgttggcagctatggaaacgctggagggtgcgttcgccgagtgctccggcgggaaagagttcttcgccggcgacgagcccgggtacctggacgtcgtgctggggggcttcatcggctggttgcgcgcctgggacaaggtgggcggcgtcaagctcctggacggcggccggaggaccccgcgcctcgccgcgtgggcggagcggttcgccgcgctcgacgtggccagggacgtcatcccggaccccgaccacatcgccgagttcgccaaggtgctgcaggcacgctccgcggcagcagccgccgccggcaactgagctcgatcacaagtgaatgctgctctgccttcctgagaagtcatggtttgtttggctggcgaggataaaacatggtttgttcactgaaatagctcgttggcttgccatctgttttagcaaaagtatgcatgcttgttatttattcataataattgatcgatgaacattggctcctgtgtcgattcgttcaagaaaaaaagcagataattcattgttcgggt

SEQ ID NO: 13604 - DNA, 1738 bp, Sorghum bicolor
  Clone ID: SORBI-28MAY03-CLUS2420_1
agcgagacagccagccagcggggcagctgagggagaagcctatcttctatcaccagtcacctcggggccccgaggcgaggggaagaggaagcggaggggaggcaggaatcgccccgccccgccccgcccgcgcccccccaatccgtccgcctgccgcggcgacgggcccacatgccgaccgcctacagcctccgcgcgccgccctccgccgcgcagcagcgcctaaggctgcccctaccgcagcccccgccgccgctgccgttttccccggcgggtggaggggcagcacgccggaggagggctgttggggtggcggccgcgtccgcgtcgcccttcgacgagctgcacgcgcgggggaggcccgtacgtggaccctccaagaaatccatgctctggaacttgatccaggatatagagcccctggacctaagtgtcattcagaaagatgttgctcctgaaacggttgatgcaatgaagaggactatttctggcatgttgggtctgcttccatctgatcagttccgtgtcgttgttgaagccctttggaaccccttcttcaagttattggtatcttcaattatgactgggtatactctgcgaaatgctgaatacaggctttcttttgaaagaaatctagaactgtctgaagaagttgcagaatgccctaaaagtgatgtcactgaagataatcatcataacatcaatttgggtagacctgtcactatttttagattatcagaagaagacatgcctcgggaccctggaaaaactgatgaagaatcatcatataaaaatatgggagaagagctcggcgacttaacaccacaggcagaagagtacattattcagatgcaatctcgtttggatgccatgaaaaaggagttacatgatctcaggagaaagaattctgccctacagatgcaacagtttgttggggaggaaaaaaatgacttgctggactatttgaggtcactaacaccagagaaggttgctgaactatcagagtctacatgtcccggcgtgcaagaagcaattcattctgtggttcatggtctgcttgctactctttctcccaagatacactcgaaggcccctccactgctagataacacttctggtggtgtcctaaaccttgggggtgaggatgatgaccgtgcagaacttgttgagaatgcttccctcccatttcagcccctaatatctgttccccgtgattaccttgcacgtttgctgttctggtgcatgctgctgggtcactacattcggggtctggaataccggttagagcttactcagcttctgcgaatatccagtgacgtgggttctttctctggtggtgatgatcatgttgtttgagggtaccacgtttactgatcttcctcaccgggaagaatggaaagacctggccaagaaatggccaaatggcagagccgcagaggtggccgttacactgcgctccctgtcaaaaggatgcccctaatacaagggggcactgctgagctatatagttctagttcctgtaaattcagaaaacagtagctcgggtgtaaagctagtgttacatatgcacgtgaactactttctttttcttcctttgatgttgtgccgtataacaaagaatctggtggttcgttggtgttcatctcgtggtagcatgataggcatccttgtattgtagttgtatgtatctggtggttgtgattgttgtccaatgtccatttaattcttgtgtctcttc

SEQ ID NO: 13605 - DNA, 927 bp, Sorghum bicolor
  Clone ID: SORBI-28MAY03-CLUS3812_1
cgtccgagagaataatcagccttgtccagaagctacccagaatattcagaacaaagtgcaaagtagttccaccagaagctgcaagaaggtccataagcaaggcagtgccctcggcagatcgattgatctaacaaagttcacttgctacgatgagctgattgctgaactggatcagatgtttgactttgatggtgagctgaagaatccatgcaaaaattggctggttgtctacactgacaatgaaggcgatataatgctggttggcgatgacccctggaatgaattctgcgacatggtccacaagatcttcatctacacaagggaggaagtggaaaggatgaacccaggtgccctaaactcaaggtccgaggatagtctgtctgactcgcagggaagagggttggcttccaaagagccgccccgaggtggcccgtctacttcgactcccaattccgagagctgctaatttttccagtcagtgaggtcttttgaagtggtggatgaagcagacaaaagcatcagagtgaccggaagaatgagaaaagggacgagtcttgtagtggtgtagtaggtactttgtgtgtatgcctccgggtaagccccgcggtactcagtttgtagatggtgcttgtcctggtggtgccagtttcccgttgtaagctaagtttttgggtgtgccctgttctaggggtaagttattgtagcagagcaggacagaccgagagagcaggcaagaaaccgctggtgcgcctgcttggccctctttttccttccgaagccctgtaaatagccttggccctgaatcgtagtaatgtattgtcgacagccgtacttactcgctcctgactgcgtgtgtgtttggttgagttgtgtatgtcatgcaagagtttgtatacagggttgaaggtagcggatctgctacatggt

SEQ ID NO: 13606 - DNA, 470 bp, Sorghum bicolor
  unsure (1)..(470): unsure at all n locations
  Clone ID: SORBI-28MAY03-CLUS296_2
ccgtccgccaccgcggaacggatcactcactgctcctcatcactaccactacccgggatacacttgtttaaaaagcctagagacagagagggggtgtgcctctgcctcctccttcctccttcctcctcttcgtcctctcgcatcggcatcgcatgccatgccctcgtcgacctcgagatcccacaccgcgccgccgtcaacttcgtcaccgagctcttcacctccggcacgctgcggcagtaccgccggaaacacccgcgggccagcgccgccgcggtccggcgctggtgccgccagatcctcgagggcctcgcgtacctccacgcgcgcggcatcatccaccgcgacctcaagtgcgacaacatcttcgttaacggtagccaggggcaggtcaagatcggcgacctcggcctcgccgccgtcgtcacccgccgccgncgccgncgnggtaacgcggcgagctgcgtggt

SEQ ID NO: 13607 - DNA, 2156 bp, Sorghum bicolor
  Clone ID: SORBI-28MAY03-CLUS296_1
cgtccgctgctcaagtcgctccgccaccgcgccgtcatgcgcctccacgcctcctgggtcgacgccgacgccgccgacgcgcccgcgactaccgcgcccacccggccccgccgcgccgccgtcaacttcgtcaccgagctcttcacctccggcacgctgcggcagtaccgccggagacacccgcgggccagcgccgccgcggtccggcgctggtgccgccagatcctcgagggcctcgcgtacctccacgcgcgcggcatcatccaccgcgacctcaagtgcgacaacatcttcgttaacggcagccaggggcaggtcaagatcggcgacctcggcctcgccgccgtcgtcacccgccgccgccgccgcggtaacgcggcgagctgcgtggtgggcacgccggagttcatggcgcccgaggtgtacgccgaggactacgacgagcgcgccgacctctactctcccgcacgcgggcgtcctggagatggtcaccctcgagtacccttacagcgagtgcgtccaccccgtgcacatctacaagaaagtcacctccgggatcaagccggcggcgctgtacaaggtgaaagaccccgcggtgaggcggttcatcgacaagtgcctggcgccggcgtcgtggcggccgagcgcggcggagctgctcggcgacccgttcctgcagctggaagacgacggactctggtacggtgacgacgacgacggcgcggactacagcaccatgtacaactacctgcaccagccggcgtgcctggaccaccaccaccacaactccggcagcaatggctccacggcgagcaacggggtggtgtccaatggcgtcggcggcggcgacagatgggacgacgacgacgactctgaggacgacgacgacgatggcagcatgttccaaggcatcgaccagctgttcaacgagcacgaggacgacgacgacgagctgcacgtcgctggcgtcgacatcaccatcaagggcaagaggttggaggacggaagcatcttcctccggctgcgcatcgccgacaaagatggcacagggagggtccggaacatctacttcccgttcgacgcggacgcggacacggcgctgagcgtggccaccgagatggtggcggagctggacatcaccgaccacgaggtcacccacatcgccgagatgatcgacggcgccgtcgccgcgctgctgccgcactggaggccaggccctggcatggacgacgacgaggacgacgactatgacggcggcggcggtacggacgcgtcaggcgccgctggccgttgcaagaactgccggtccagcgcgtcctcggccgggtcactggacgactacatgtcggcggcggcggcggcgcggcgtggctgccggtgcgcggagatgcacggccggtttgaggagatcacgttccaggccgacgaagagcaggtccggttccagggctctgggtgcagctccgacgatggaggcggccaggctgagcagtgtgccgccggagacggtaagctcgaggacatcgtcaatggcgtcacgctggatggcaccacggaacgttcagaccagccttgacctggttctctcacaggagcgaatcctgtttactgaaaatatcaccaccgatcgtcacgtgtcggcatgggatcagagcactaatttgcttgctggtactgaacgagaattgctcatgtcggtgccgccaccatgatcagggatatcttcaccagcagttagcaagccaaagttactgtgacagaggcacagagctgtattgctcactgaaaccttccaagagcaaattctgtactgatgactgatgagcaatggtgttgatgtttgatgtgcccttatgaccgcgtaaatctacagttcccaaattggtttcgtttgcttggttctcctgtttcaaattcaaaggcgaatttggtaggcaagaatctggaaaaaaaaatctgaaatgtcatcagggcagcctcactgcttgtttgtagctttggttgagtatacagtggttaagatgggtatagcttgaagttttaacaggcaggtgcttcactaatctgaatctagccctttgtttttcactgtaaaccagttttgtggagttcataaagaatatatatatatatgaataagtaatcaagaaagttgc

SEQ ID NO: 13608 - DNA, 1342 bp, Sorghum bicolor
  Clone ID: SORBI-28MAY03-CLUS4057_1
taagggcgccgcacgtgggcggcggggaggggtagcgaagcctgggcagccactcgccggcctccaagaaaccgtcacgatctgttcatctgattgccgccgactttggtttcattattttctgttttcgcggggaaccaattcgatttagtttccggagaaggaagagtaggatgcagtgggcgggtctaaggtcgcaggcgccggttcccacggcggcgtggacggggccgaggccaagaatcgcgaggtggccgcagggtagattcactgcagcgcgccgggcgctggtggcgtcagcagcggcctcggacgctaattcgagctcgaattcgccggggagggacgaggagagggaggaggtggtgcagagggagaagaaggagaaggcggtcgcgtcgctgctgatgaggagccagaagtacgccatgctaaagcagcagctcgccgtggccgcccaatttgaggattacaaggaagcagcgaggctgagggactcgctgaggtcgttcgaggaggaggagcccgtgctgcgcctccgcaggttgatgaagaaggccattgacgaggagaggtttgaggatgctgctaaatacagagatgaattaatgattttggctccacactccctcctcaaatgttccagcgatgcaactactttgggcataagagttcaagtcaggagcgtctatattgaaagccggagccagccattgaaaggccaattcttttttgcttatagaattagaatcacaaataattctcagcgccctgttcagcttctcagaagacactggattgttacagatggaaatggaaggacggaaaatatttggggagttggagtagtgggagaacaacctgtcattttcccgaagactggttttgagtactcttctgcatgcccattgagcactccaaatgggagaatggaaggtgactttgagatgaagcacatcgacaaggctggatcatcaacattcaatgtcgcaatcgcgccattctctctgtcaattcttggggacgacaatgatgttctgctctaaaccacactgagatttaaactagacacgcaaacacaaatagttactgttagcgatgtagttttgagtgtgcaaggtacaggtgaaactactagggttgaccgatggctggagccaagtgccctggtgcaaggtcaggcacagtttgctggaatgtagaatctggaccatgcgagtgtcaattatagaggcacaataggatatcctatcaattgtacagcgtggaactatagagcttgctatcatgtaattcctctgttccaaattacaaggtattttgtttttttctcagataaaaa

SEQ ID NO: 13609 - DNA, 1867 bp, Sorghum bicolor
  Clone ID: SORBI-28MAY03-CLUS39688_1
aaaactcctccccacgtcacccttccgcccgccggcgagtcgcagctgttccctcgcgagtcaacccccttccgccctcccccggacaccgcatcctccccaatccccgttgcgacaatggggcacgggttcgcattcctgtgacccatttggttgcagagcttcaagggtcagcggagggaactagaaaaaatttgttcagaacagcccacgagaaaaggcataccagtgttcaggtcatcaaggcttgggatgatttcacgactgctctgaaagccaaaaggttgatcttggctgcatggcgtgttgaggaagaagtagaccaaggtgggtgagaacggagaaaagagggactcggatctgcaataacgttgttaaatacatttgaccagcccgatcttcctgaaggtgctctgtgatttacattttgatgcagaacgaaaaaggcctcattgtgggccctccgctactggtttcttgggttgcgaggcttttcgaatccagtctgagcgccccggttgcaattccccacccaagtgagcctgtcctgtgtccttacctccgacttcagttcacatgccatcactactggcccaagccatttattccgtcatgtattcgtgtttggatgttgcaagaatgagcagccactctttaatgtactggcgtgctgtgttgctaaaaggggcatactgcttttgcgactaaagaagaggcagatgaagaggttctccaaatattggaactgtacagaaggatatatgaagaatttctagccgcgccggtgtccaaagggaggaaaagcgagatggaaaaatttgcaggtggactttataccaccagtgttgaggccttcattccaaacactggtcgtggcatacaaggcgcaacctcacattgtcttggtcaaaacttcgccaagatgtttgatatcacttttgagaatgagaagggtgttagggaaatggtttggcaaaactcttgggcctacactacccgttcgattggagtgatggtgatgacacatggtgatgacaaaggcttagtattaccaccaaaggtggcaccaatccaggtaattgtgattgcagtgccttataaggatgctgacacaactgccataaagggagcctgtgaatcaactgtttacacactcaatgaatctgggattcgagcggatcaggacacccgtgaaaattactctccaggttggaagtattctcattgggaaatgaaaggtgttccattgagaattgagattggtccaaaagatctggcaaacaaacaggtgcgcattgtccgccgggacaacggtgcaaaggttgacattcctgtgaccaatttggttgaagaggttaaagtattactggatgagattcaaaaaaatctgttcaaaacagcccaagaaaagagagatgcctgtgttcaagtcatcaaaacttgggatgaattcacaactgctctaaataacaaaaggttgatcttggctccatggtgtgatgaggaggaagttgagaaagatgtgaaagctcggacaaaaggggaactcggagctgcaaaaacattgtgtactccatttgagcagccagaacttccagaaggtaccctgtgctttgcatctggaaagcaagcgaagaagtggtcgttctggggccgcagctactgattgcctgtgctgggagtcttttcggattcagttctagtgaatcatgtagcttcggagtttcagatacaaatctgaaaatctatttacattgtgttttacatcgacttgcagttctcttgtcattggcaaaagccatttattccagcatacattgctattcgagtttggatgttgcatgaatgagaagatctacattcgttt

SEQ ID NO: 13610 - DNA, 1742 bp, Sorghum bicolor
  Clone ID: SORBI-28MAY03-CLUS27436_1
ggccggcgccacggacgccggcacgtccccgctgtcggcctactggctggtgccgcagtacgcgctgcacggcgtggccgaggccttcacctccgtggggcacctcgagttcatgtacgaccaggcgcccgagagcatgcgcagcacggcgacggcgctcttctggctctccatctcgctgggaagctacgccagcacgctgctggtggacgccgtgcaccactggagcgcaggccccggcggcgccaactggctgccggacaacatcaatcacggcaggctggactacttttactgggtcgtcaccatgctgcaggtcatgaacttgatatactacgccatttgtgccaagcggttcaggtacaagccagtgcagctccataagaaagaggaggaagaaagcggcaaggcacttgtggagctgcaagagaaggtttgagcagcgtacactttcagctacgtgcaggtacatgtcttaaggtagaaagaaagtgcttccactactccattagtgctaggaagattgtcagacactccctagctaatactatatgtatgtgagcatctgtattagtcaagtagatcaaggaatgcagggagttgttcaggcaagcaacatcactcagaaattgtcaatggtcacttgacagctttgtgaatgacgttaatgcatactcgtactgtataaagactctgtttgtacattagggtcatgaacacagagattgttcaggcagccgtctttgaaagtgttcaagccaaattaagcaacaaatttctcagtgccaaaaaagtttccatctgaatcctggcgtaacttacagattattaagattcagacttggacacttggtagtaggaaacaggtttgcactcacaatctgacatgaatttccccaagcagagctttccaggtaaacagtacggtgcattaggtgtcgcctctgatctttaatcgcagtagtagtacacaaatagaccgtccaagaacgcgcgggcgagacgcgaacctgttgcgggacgggcggatcagacggtgaacttgatctcgaacccggcggacggatcgacgggctcggccggggacgggacgacggcggtgacggtggcggctgggggcccgacggggaggcggcgggttatcatgtcttcgatcttcgcggggtcgccggagaggagggcctccacgctgccgtcgcggcggttgcggacccagccggcgaggccgagcgactcggccgtggaggccgtccagtcgcggaaccccacccccgtgacgcgccccttcaccaccacgcggacccccttccgtgcgggctccggctgcggcgccgatggcggcgtggaggaggcgtccggatcggcggaggaggccatggccgcggtggtggtggtacacggtggtggaagccctcgtgcctggagacggccgagacggccgaagcaacgaactgctggaactggaaggttctggaaagccggcctgccctagtagggcaacccaagcccggcccaataaatttcatgaaaccctgctcggctgggtcaagctcgcagcccgtggcagagggtgtgatgggctacggttgtgggctaggcccgtgcggttaccttcgtttccgcccagggctttctccagctgcttgtgcttcctcggtcccgcctagcatttctgcccgttgtccgccccccttcttcatgtacttcctcggtcccacaaataaatgcatttttttgactgc

SEQ ID NO: 13611 - DNA, 2095 bp, Sorghum bicolor
  Clone ID: SORBI-28MAY03-CLUS27779_1
gggctgcaggaattcggcacgagggcggaggtcgggacggattccggccggtgaggaggtggtcggggggaagtgcatgtgagatccgatggcgcccgcggcaccggcggccggcggcggcggtggtgcggaagcgggatgcggaggaggcggagggaaggacccgctgttcgtcgagctgtggaaggcctgcgcggggccgctgtctagcgtgccgccgctcggggagaaggtctactacttcccgcagggccacatcgagcaggtggaggcatcgacgaaccagattgctgagcagcagggcacgcccctctacaacctgccatggaagattccatgcaagctcatgaacatcgagctgaaggctgagccggatactgatgaggtgtacgcccagctcaccctgctccctgataagaagcaagatgagaatacatctacaacagtggagaatgaggaggcagaggaggaggtggtgcctcatgcgccaccaacaaatgagggacctcggatccattccttttgcaagacattgaccgcctcggacacaagcacgcatggtggtttctcagtgttgcgccggcatgcagatgagtgcctcccaccattggatatgagtcaacaccccccaaatcaagaattggtggccaaggacctgcatgggattgagtggcggttccgtcacatctttcgaggtcagccacggagacacctccttcagagtggttggagtgtttttgttagcgccaagcgtcttgttgcaggggatgccttcatatttctcagaggtgagaatggggagttacgtgttggggttcggcgtgcacgcacgcgccaaaccactatcccatcttcagtcatatcaagccacagtatgcatcttggtgttcttgcgacagcatggcatgcagtcaacactgggagtatgttcactgtctactacaagccaaggactagtccagctgaatttgtggtctcgcgagataggtactatgaatcactgaaacgaaattattcaatagggatgagatttaagatgagatttgaaggtgaagaagcagcagagcaaagattcactggcacaatagttggaataggtgcttctgatccatctggttgggctgactcaaaatggcgttcccttaaggtgagatgggatgaagcttcttctgttcctcgtcctgaaagagtttctccttggcaaatagaacctgctattagcccatctcctgtgaaccctcttccagtcagattcaagaggtctcgttcaagtgttaatgcttcaccatctgacgtgcctactgtatccagagaagttgcttctaaagtcatggcagagtcgcaacaaagtaatctcccaagggccttgcacaatcaaggaaggacacaattgacaggtcgataccatgatagcagtgatgtgaagactgctcaggatcttaccatgtggtcttcaggaactgagcagcagagaaacaatattgctgcccagacaaagcgaagtctggagggatggacgcaatctagaactcctgaaggttacaatcagctgttctcggcatttcaaccactgaaagatacacataatccactttgtactttccctagtcaaatatctgggactcgctcaaatacctgggacacagccgatgctcgttatccagcccaacaagccaatcacaacatgttacatggcacatggccttttatgcctcatagcagtggttttaggacgaatcaacagaattatctagtgatgcctgaagctgcaaagtttactgggaaatcagctttcacttcacttcagggccatggcactgatcagtgctccacaggctggtttggacatattgagtcaagttcccgcacagaccatgcatcgtcaagttcgatcaggccccagcctttggttattggtaatgatgttcagaaaaccaaaggcacttcattcaaactatttgggattcctcttggcagcccggaaaaatctgaacctctggtatccccaccaagtgtcgcatatgacgggaaacttcaaacttctccatcagaaaaagggaatcagctagacatagttggagtggataattgttct

SEQ ID NO: 13612 - DNA, 944 bp, Sorghum bicolor
  unsure (1)..(944): unsure at all n locations
  Clone ID: SORBI-28MAY03-CLUS2573_1
gccggccgggtcgggaacaaacccggcctggggcggaagccagacagctcctgcttcctcctggtcaagtcttatccgcctctcgtcaccaaccgcgtgcgctccacgcctcctccaggtccaggaaagcgagagcttctgcataagatcaacgaatcaaagcgtgatcagctcggtgccgatcaaacttcaacaaccaagtttcatgtctgatctcgacgtccagcttccatctgcctttgatccgtttgctgaggcaaatgctgaggactctggtgctggtcccggaacaaaggattatgtgcatgtgcgcatccagcaacgcaacggcagaaagagtctgactacagtccagggactgaagaaagagttcagctacaacaagatcctcaaggatctcaagaaggaattctgctgcaatggtactgtagtccaggatccagagctaggccaggtcattcagctccaaggtgatcagcgcaagaatgttgctactttcctagttcaggctgggattgcgaagaaagagaacatcaagattcacgggttctaagggacctgtaaatgcttgtaccctatattgtgcgcctccacatattgggaagcttgaagcagcgacaattactagtcattgctttcttatataagaacataagaactattgttctactgtcaattgtgtcttgcttgatgcaagttgtgttttcgtctcattgttatgtgcggtcagcatatgtgtatggcttgtactatgggttattgccaacttaataaaagtactttgtgtttggctataagcgctgatgtttgtctcgtgcnnnaaaaaaaaaaaaaaaaaaaaaaaaaaaaaaaaaaaaaaaaaaaaaaaaaaaaaaaaaaaaaaaaaaaaaaaaaacccccaaaaaaacacaaccactccaaaactaaaaaattcacacaaatag

SEQ ID NO: 13613 - DNA, 439 bp, Sorghum bicolor
  unsure (1)..(439): unsure at all n locations
  Clone ID: LIB3481-011-Q6-K1-F3
cgtccgggcaaatgctgaggactctggtgctggtcccggaacaaaggattatgtgcatgtgcgcatccagcaacgcaacggcagaaagagtctgactacagtccagggactgaagaaagagttcagctacaacaagatcctcaaggatctcaagaaggaattctgctgcaatggtactgtagtccaggatccagagctaggccaggtaatatgcgagagcaatgcgtttaaagttcacaaaaatggtacctgctggttgtgggtatactgatgatgtatttgtcctctgcaggtcattcagctccaaggtgatcagcgcaagaatgttgctactttcctagttcaggtattcanaatcttcaaagctgaacagctgaatactggtttaacagactgataaaatgttccgctgtttatactgatgatgnnattattactt

SEQ ID NO: 13614 - DNA, 995 bp, Sorghum bicolor
  Clone ID: SORBI-28MAY03-CLUS28185_1
cttcagtatgctgtcaatgcagctttccttgcttctttatacagtgattatcttgaagctgcagacacgcctgggtggtactgtggacctaatttctacaccacagaagtcctccgcaagtttgccaggtcacagcttgattacatccttggaaagaacccattaaagatgagctacgttgtgggttttggaaacaagtacccgaagcgccctcatcacagaggtgcatcaatacctcataatggcgtcaagtatggatgcaaaggaggttacaaatggagggatacaaaaaaggcaaaccctaatatccttgttggagcaatggtggctggccctgacaggcatgatggctacaaagatgtccgcacaaactacaattactcagagcctactcttgcagcaaatgctggtttggttgcagcactgatttctatatctgatatcaaaactggacggttcggcattgataagaacaccatcttctctgcaattcctccaatgttcccaacacccccaccaccgccatcagcatggaaaccataaagagacagacctctgaatattttccaaagcatcaaatagggaagtggagcaaacatatgatcatttggtacagcaaaggccaggaacaggaaagcggacagcataagcttatagagcttgtatttctgtacccgtatgacagatcagtataaaatcctctgtcaaacatagatcggaagttgtgtgcatcgcgtgaagctaatttttgggggtgttgttgctattggcattccagctcatgtgtgaagttctttttgtagaaatggcacctttacaaattattttataggagtgacttttcatcatagtaaagaatttgtgtgacagtatactcttgcttcacttttgatccctgttattttgtatttaaaaaattccctatttcagagggagacatgttcactaagttctcagacattacaagggaattgcaaaagcacgaataggaaaat

SEQ ID NO: 13615 - DNA, 1063 bp, Sorghum bicolor
  Clone ID: SORBI-28MAY03-CLUS28733_1
gcacgaggcctcaagcccctcggatcggatccggtccttcccgtgttccattcccaacggcgcacaagatgaagctgtccatgcagtcgctcgccaggaagctgtccctgccgtccccgacgaagcgggacgccggcggcgagggcgggaagaagaacaagaagcgctccctgtcgcgcggcgagacgccgtcgttcgcgtcgtcgtcctcctcctcatctgacgacgcgctggcgcggtcctccacgccgcgctccgtgctcccgccgccggcagcgccgctggagatcccgcggcgggagctggaggccgtgctgcggcgcctgggccacgccgagccgtccgacgccgagctcgacgccgtggccgccctcgccgcgcagcctccgcctgcggacggcgacggcgatgacctcatggaggcgttccgcgtgttcgacgccgacggcgacggccgcatcaccgccgaggagctccgcgccgtcctggagggcatcctcggcggcgggcccgacgcgtgcagcctcgacgactgccgccgcatgattggcggcgttgacgccgacggcgacggattcgttggattccaggacttcacgcgcatgatgatgaccgccaccgccgacgcgcggaccttcttgtgatctgtccgtcggttcagccgtccggctcctccgtccccgtccctctcccccaagcatcaccacggccctgatgcgcgccggagatcatctaatcaaccacggcagccggcgagcgagacgcgatgccgtcttcttccttgtgtcaaagaagagccttttcggcgcgcaggatgataggctaccacctcatctactactagtaggacaggagtgctccattattaattaattattctattataaagtgcttgcttgcttgctgctaatccatgcacgattaggaagagaaccctctctccgtcgtgcatgcagcttgtacaattaaaatccgctcgaggtcgacctcgacagtgagtagtgactggcatgcatatgcctcgttctttcaattttttctatttgaaattcatttgaatcct

SEQ ID NO: 13616 - DNA, 2008 bp, Sorghum bicolor
  unsure (1)..(2008): unsure at all n locations
  Clone ID: SORBI-28MAY03-CLUS2934_1
cgggnccgcacgagggtccaccacctgccctgctcgggtgctctctttcttcccattctccagccgccgcggcgacgcgcagacctagcactaccagagaaacacccgagatggcgatggctctgcgccgcctcgcgggcgtgtccggctcgccgtcggcctccgctgccgcggccgcgctgctactccggccggcgctgacccgcccgatctccaccggcttccgcgaggagcgcgacaccttcggtcccatccaagtccccaacgacaagctgtggggcgcgcagacgcagaggtcgctgcagaacttcgacattggcggggagcgcgagaggatgcccgtgcccatcatccgcgcttttggcgtgctaaaaaaatgcgccgctaaggtgaatatggagtatggtctggatccaacaatagggaaggccataatgcaggcagctgaggaggtcgcagagggaaagttggatgatcacttcccacttgttatctggcaaactggcagtggcacgcaaagcaacatgaatgccaatgaggtaattgcaaatagggcagccgagatccttggacacaagcgcggtgagaagtttgtgcacccaaatgatcatgtgaataggtcacaatcttcaaatgatacatttcccactgtaatgcatatagcagcggccgttgagctcgaggcgaggtttatcccaagtttgcaacagttgcatgattcacttcattcaaaaactgttgagtttaaagacataattaaaattggacgtacacatacccaagatgccaccccgttgactcttggccaagaattcagtggttacactacacaggtcaaatatggaattgaccgtattaattgtacattacctcggatgtaccagcttgctcaaggtggaactgcagttggaactggcttgaacactaagaaaggatttgatgtcaaaatagctgctgcagtggctgaggaaacaaacctaccctttgtgacagcagagaacaagtttgaagctttggcagcgcatgacgcttttgtcgagagcagtggcgcggtaaatacaatttctgcatctcttatgaagatagcaaatgacatacgcttgctaggaagtggtcctcgatgtggtcttggtgaactaatcctaccagaaaatgagcctgggagcagcattatgcctggaaaagttaatccaacccagtgcgaagctctgacaatggtttgtgctcaggttatgggtaatcatgttggtgttacagttggtggtgcaaatgggcattttgaactgaatgtttttaagccaatgatagcagccggattgcttcgatcattgaggttgttaggggatgcatctgtgtccttcgagaaaaattgtgtcaggggaattcaagcaaaccataagagaatttcacaacttttgcatgagtctctgatgttggtgacatctttgaaccctaaaattggctatgacaatgctgcagctgttgctaagaaagcccacaaagaaggaaccacgttgaagaaagctgcattagaccttggagtattaacggagcaagaattccatgaacttgttgtcccagagaaaatgatcggtccttctgattgataaccccatgttcattatgtttctttaaagcattcaggttgccacatccggagttctggtggtttcctgtgatgccaacttaatgattctagtgcacccgtaaataaaccaaataatttttcatatggtcattaggtcctctccacactggagaaatgatttttgcatggcggatggtacctgagaaaacaattgtacgcttgttccaataggacaatagggcactttgatggatgaggcaccttccattctcctggcatcggtcaagcttttgttgccaggtagctaatgctatgtaataagtgacatggcaaccatgtctagaaactatttgcattggtctttgacaagtggaagtagaaatatacccgagttttagttctttttaccgattttgagct

SEQ ID NO: 13617 - DNA, 1006 bp, Sorghum bicolor
  Clone ID: SORBI-28MAY03-CLUS29565_1
accgccgtggcgggcaaggtcaagtcggccggcacggcgacgcccggggtcggcgcgcagcaggacacgacggccacccccggcgccggcgggcaggacaagggtgtcaccgtcacggggtacatcgccgagaagctccgtccgggcgacgaggaccgcgcgctcagcgaggcgatctccggcgccgtgcagcggcgcaaggaggacgtcgggggcacggtagcgcagcgcgtgccggcgcccggccaagtgatcaccaaggcgcgcgaggccgtcacgtcgctcaccggcggcaaccgggtctccgagaccgtgcagtcaaccacagccacaggggaagacgtgaaggaaggctacgcggcggaggcgcctgtgatccgcggggaggagatcggcggcgcgaagctgaacacgaataccatgtgatgaagtgcggctcatggacagcacggcggctcggtgtgaacagtgtgattattgtggcaggtttgtgtacacgtgaatggtgtggtttgccctgtggactggagtcgaagctggaataagcgtgctgctttgtgttcaccgtggcgcgctctggttttacatcttgtgtgattgtgtatccacatttccgcaggttgtatatgtttgtatgtatgtaatatgtgtatgtgtatgtgtatgtgtatgtgtatgtgtatgtgtatgtgtatgttgaaaaatatgttctgtttttgttgcgttggtacagtctcacttgtcgcgtgctgcatttaaatgttctgtttttacggtgctggcaaataagagcaatctatttagatagattaatctgaatggatgaatttatgaatgggtagtgtctagctttgaattttaatgaacttattttggtgcttattgctaaccctattacttacacattagtcggcgttgagcgtctgtacatggtagcacacggggtacgatgtttgtacaggtagaattaaagtgatacgagacgatatgttcataccttcgttct

SEQ ID NO: 13618 - DNA, 1914 bp, Sorghum bicolor
  Clone ID: SORBI-28MAY03-CLUS463_1
atttcccgacctcccaactcgcgagcgagtcgaggctccaacccacagcacatcacaggaggaggaggaggtggacgcgcccgccaccgcccaccatggccatggcgacggccctccgcaagctctccgccaacgcgctgcgccgccagccgctctcccgcatgacgccgctccactacatggcgtcccttccggcgacagaggagagatccggaatcacctggccgaagcagctgaacgcgccgctcgaagaggtcgaccccgagatttttgacgttatcgagcacgagaaggcccgccaatggaaggggctggagctcatcccgtcagagaatttcacgtcggtgtcagtgatgcaggcagttggttccgtcatgaccaacaagtacagcgaggggtaccctggcgcaagatactacggtggaaatgaatttattgatatggctgaatccttgtgtcagaaacgtgctttggaggctttccgtttggacccagcgaagtggggagtgaatgtgcaacctctatccggttcgcctgccaatttccaagtatacactgcgctcttgaagccacatgaaaggataatggctttggatcttcctcacggtggacatctttctcatggttaccagactgacactaagaagatatctgcaacctcgatattctttgagacaatgccttacagattggatgaaagcactggattgattgattatgatcagttggagaaaagcgctattcttttcaggccaaagttgatagttgctggtgcaagtgcatatgctcggctatacggttatgaccgtatgcggaagatatgcaacaagcagaaggcagtacttctagcagacatggcacatatcagtgggcttgttgcagctggtgttattccatctccttttgattatgcagatgtagtgactaccactactcacaaatcactccgtgggccacgtggagccatgatcttttataggaaggggttgaaagaaataaataagcaagggaaagaggttatgtatgattttgaggacaagatcaatgctgccgtctttcctggtctgcaaggtgggcctcataatcataccattactggcttggctgttgcgcttaaacaggcaactactccagagtacagagcttaccaagagcaagttatcagtaactgtgctaaatttgcgcagagcctgactgcaaaaggatatgaactcgtctccggtgggactgacaaccatttagttctggtgaatctcaagaataaggggatagatggttcgagggtggagaaggttttagaaagcgtgcatattgcagcaaacaagaacacagttcctggtgatgtttcggctatggtaccaggaggcatcaggatgggaaccccagctcttacgtccagaggatttgttgaggaagatttcgctaaggttgctgacttcttcgatgcagcagtgaatctggctgtgaagattaaggctgcaacgacaggtggaacaaagctgaaggactttgttgctactttgcaatctgatagcatccaagctgagattgcaaagcttcgccatgatgtggaggaatatgcaaaacagttcccaacaattggatttgagaaggagaccatgaaatacaagaactgatatctgaatggcaagcaagcaaccgttgcaagatgccacgacgattattgggagtttaaatgggggaagatcatgtaaacataaactcatggtgtgatggcatcttatgttaaaaagagatattggcaatttacagcatgtggaactttcgtcaatggctcatattgtagatacataccgtgagatcctatactgatgctatatattgacccctttctggacaaaaatcaacaattttgtagattttttttaaatttttttaatgaattcttatata

SEQ ID NO: 13619 - DNA, 679 bp, Sorghum bicolor
  Clone ID: SORBI-28MAY03-CLUS48548_1
gcacgaggcacacacacactatagctcgctcacccgccatgcatacacgcaagagcctaagcctacgcacgcacgcctactccatgtaccggcgctggcacgacgaacacgccgctgcatgtcaagttcctcatgaccacgcacaggctcgtcgtcaacaacttcctcgtcgtcgtcgccttgcccgtcgccgccgccgcggtcccgcggtcgaccccccctgaggaggtgctcgcgctggtgcgggagatccggcctgtccactgtctgctggtcctgctcctggccgccgccgtcgccaagctgtggcgcatgggccggcccaaggacgtgtacctcgtggagtacggctgcttccggcccaagccctgcttccgagcgcccttcgcgacgtgcctggagcacgcgcacctgatgccgtacctggtggacgaggagagcgtcagcttcgccatccgcctgctggaacgctccgggctcggcgaggagacgtgcgtgccggaggcgtaccactacatgccgccagaccgcagcctcgaggcctcccgcgacgagacggagctggtcatcttctccgccgtggacgaggtgttcgccaggtcgagcgtgaggcccgaggcgatcgacgtgctcatcgtcaactgcagcatcttcacgccctcgccgccaggtcgagcgt

SEQ ID NO: 13620 - DNA, 1453 bp, Sorghum bicolor
  Clone ID: SORBI-28MAY03-CLUS5245_1
gcacgagggtggtggttgtccattgcaaagctggtaaggcaaggacaggattgatgatctcaagtcttcttctgtttctaaagttctttcctactgctgaggagtccattgaatactataaccacgagggatgtgtagatggaaaagggcttattctcccaagtcagattagatacgtgaagtattttgagcgcatcttaacttacttcaatggtgaaaatcagccaccccgaaggtgtatgcttagaggctttcgtcttcatagatgcccctattggattaggccatcaattacagtctctaatcacaatggtgtacttttttctacaaagaagcatccaagaacaaaagaactaatgccagaagatttctggtttagtgcaccaaagaaggggattatggtttttgcattgccaggagaacctggcttagccgaggtagctggtgatttcaagatccagtttcatgatcgacagggagatttttactgctggttaaatacaacaatgatggagaacagggtgactttgaatcccactgatcttgatgattttgacaagagaaaattgccatcacctgggttccaggttgaggttgtcctggtagattacgatggctcgcaaccaccaaaaccaaaaccagccactggacctgctgataataaatctgatgctgattcatcggctagcacggtcgcgaaagaaaataatgctgcacctgcagaatccaacaagggaactggaagcaatgataaagatgaagtgttctctgatagtgacggggaggatggatcatccaagggaagaaaggagaagattgccagcggcggtcaaaacagtgtaaatgctgcgaaaccatctgaaacaagcaacgtgcagaaggaggtatcagctgctgctagtagactggataaagtagctataaccagcgaacaaggaaccacaaaggcacctgatgcatctctcaaaactgaagtcagcagcaagaccagctccctaaccacagcaccacctacagctgctgacaattccagcatgagcgaattcaaggcgattgcagcagatgcatcggtgttctcgttcggagatgaggaggattatgaaagtgagtagtgcttctatgggtatttggtttccgttgtacagtttggtgccctctaggacccccatcatagaatgccagtttgaagcagctggtaagacaagtcgaaagaagttaattcatccttgtgtttcgtctccaccgtagcagtgtcatcagtctgatgttgtacccagatgaaacttgttgtaactcaaccagggctgaacgaaccttgttcatacctctcctatttgtttacagaaataccttgtacacgaacttaaacagcgccaatttacttttattgagaattaaagtgcgcgtaattcatttcagcttgttttgatttggatagtaaggatttgaagtc

SEQ ID NO: 13621 - DNA, 1616 bp, Sorghum bicolor
  Clone ID: SORBI-28MAY03-CLUS31307_1
acaaccgccccagcgcgccgttgactgactttgctcgcgtcgccgcctcgtcttgagtcgagtcatctcgcttccctcgtctcgatccagatcccgtgttcccgcgggttcattcgtttatatataatcttcaaaaaaaagccctgcagctcaagcttcatcccgcgtcccgccagcaatttcagattttcagctcctctggttcttcacttcttcagtctctttctcgagcttggatccctcaagtgttctccaggtacaggcgtacagctacttcaatcgtcagaaatggccactgatgccagtggaggtggtaagcctagtcttctgagtactttaccgaagcaactaccagcggattttctgaaagaaattacgaacgggttccatgctgaccgaaaactgggtcaaggtgcatttggaactgtttacaaggggtttctgcaagatgggcaacccattgctgtgaagaagctctcagataattccccagtggcaactgacaaacagttcaagaacgaggttgggaaccttatggccatccagcatgagaatatagtgaggttgtatggctactgtcatgaagcacagaagaaagtgatagagcacaatggaaggtacattcttgtggatgtggttgagagcatgctctgctacgaatacgcgcccaagggaaacctcgacaagtgtatttttgatatgtcttctaggcctaattgggcgacatgcttcaaaataatcaagggcatctgccagggtttatatttcctacacaagggaatggacaggcctattgttcatctggaccttcagcctgccaacatattgttggatgataacatggtacctaaaattgcagactttggcctgtcaagactctttggtgaagaacaaacccgaataaatacaataaatgttgtgggagcaaaagggtatatggctccagaatatctgtacagaggagaaatctcaacccggtctgacatatacagcttaggcgtactaatcatggagatcgcaactggacagaagaactctatgaatgacaaagacatgtctggaagggactttgtagatcaggttcgtcaaacatggacagatgagcacatagcatccaagtactcatcactggacgcagacagcctccagcaagtaaaaacatgcattgaaactgggctaaaatgtgtggatattgatcagaagaagagaccttctatagttgaaattgttgagaagctcgatggaaggcatgctcgctgaatggtgaagtagtgtatgttgtgcaatgtaaaattgtggtgcatagcatagttcacccatgctgatacactcaagatgcaatcatgcgcacaataattgtatcacttactaatttatgtaatatgttgcttgtgggttagcaattagtactccctccactcagttttatgtgtcgcttcagctgtgaacaatatgacattataatgtcacataaccctgagctcagtgttcattttatgactttactttcaattatgtataatcttatatcctttgtatggccatatatggataacataattgttaatcgttgatcctattcatggatcgatcttagatacaaagcatatataata

SEQ ID NO: 13622 - DNA, 1004 bp, Sorghum bicolor
  Clone ID: SORBI-28MAY03-CLUS31494_1
ccgtcccgacgtaagagccacaagatgaagctattaatgacacataagattccaatattactaacaaatagtcaccttatgcatggagtacagtgactggaaaggtgccatagcctaaaagactagctccaaaattttgggtgcagtcaacaaaataaaaaacaaattcaagtaaccattcttcccgagatcactagcagacgttgtgcacggatgtctccacattgacatatggcaaaaaattctctgcaacacggcatcagttccgtggccgtccccaggttgatgaagaggacgaagagtttgaagaatatcttgatccagggcgccagcgatcagtagacggaggcgggccatcttggcgggttgggggtgcatcctgtcgtgcaggcccatcttgcctgagcggacgcacatctgggcgtgagcgctcttcacgtgaaccccagcgatcttcatcgcgtggacgcacatctgttggtctctggctaccagaagagctgctgctgctatcaccaccgcgtttaaacttgggaacatatttactaggagctggagcagctgcagccgcagcagcagcagcagcaggcgctgctgctgactctcgaggtggcagtgcaacaggtgaagagtcaggagcgcgcacagcctcagatccctttaagagcttctccctgctcgcctttgccttctcctccaactctatctctctctgtcgctgcttttcagcaatagcatcaagcttagctttcctttcagcctccgccctccgccccctctcccccccgtcccctttgcctgcgtcctctccctcgcggccggcggagtcctataagcaacatccgccgatccctggtcggcatcgtttatggttgagactaggacggtatctgatcgtcttcgagcccccaactttcgttcttgattaatgaaaacatccttggcaaatgctttcgcagttgttcgtctttcataaatccaagaatttcacctctgcctcgtgc

SEQ ID NO: 13623 - DNA, 1710 bp, Sorghum bicolor
  Clone ID: SORBI-28MAY03-CLUS33348_1
gcacgactcatttcagactcagcaaccacctgcatcatctttctatcgatatcatcttgtcccagccctagcatagcaagcctagaacagtaaagtctcatcaataattccatactgtttctagctagcggcgaatactatccatcacaggccgcagagctgcagcaggcagtagagtacccaagcaaaaaagcaagaaaccaaaggcagcaagactccagggagcagcgcgagctgtagctctagctcatctcatcatgggtatcgagagcatgagccccacggcggcgccggcggaggattcctcctcctcctcctcgcgcttctccgccgcgtccacagccaccacggagtccggcgccgcgcagccacgggctgcttctgcagcaccgggcggcggcgcggtcgttgtcggccgggacgcctctctggcggacgagcaggccgtgacgtcgcagccgttggcggcgtcgacggcaccggccgtggcgcagggttcgccgcggttcacgggggtcctgccgcagcccaacgggcggtggggcgcgcagatctacgagcgccacgcgcgggtgtggctcggcacgttcgccgacgaggaagccgcggcgcgcgcctacgacggggccgcgctccgctaccgcggccgcgaggcccccccccacttcccgggcgcccccgccccggcgcccgagctcaccttcctggcggcgcactcaaaggcggagatcgtcgacatgctacggaagcacaccttcgccgacgagctccgccagggcctgcggcgagggcgcggcatgggcgcccgcgcgcagcccacgccggcatgggcgcgctcgctgctgttcgagaaggcggtcacgcccagcgacgtcggcaagctcaaccgcctcgtggtccccaagcagcacgccgagaagcacttcccgctgaagcgcgcgccggaggcatcggcggcggcggccaccacaggcaagggcgtgctcctcaacttcgaggacggcgagggcaaggtgtggcggttccggtactcgtactggaacagcagccagagctacgtgctcaccaagggctggagccgcttcgtcagggagaagggcctccgagccggggacaccatcgtcttctcccactccacgtacagctcggagaagcagctcttcatcgactgcaagaagaccaagacgacgacggtcgccaccaccgacggggcgccggtgccggcaccagcggagaagaaaccgagtgaagcccgtgtagtcaggctgttcggcgtcgacatcgccggagacgggtgccagaagcgcgcacggccggtggagattgcgttcgagcatgggccgcagcaggagttgttgaagaagaagcaatgcgtgggcgtggctcatcaccgctctcctgccctaggtgccttcttgttatagcagcgatcgtaatatacacatagtagtagtattctagtcctcctcccccgtttttgttcttgtcgcctgcttcttcatcttgaattcaattactactagctagtgtttgttcttcgtctttgcaaagaacttgtttaagtcatgctgcaaaacgagttgtatgtatgtacaccattaggaagtcttgactcttgagttgctagtatgtagtagttctataagatcatgcaagtttgtgccatctccaagtgcagcaataagtaaatttcgatctgatagctagaga

SEQ ID NO: 13624 - DNA, 1111 bp, Sorghum bicolor
  Clone ID: SORBI-28MAY03-CLUS33831_1
cagggcatgctcgccaccatggagatgcgggcgcggcacgacctgctgtcaaagttcgtcgagctggtcttccctaggaaggacaccatcacgtttgaagtggtaatgaacgaagaggccatggaccatgtgattctggctgtggccaggaagaaggcggccaagactatgcagaaagaggagagggatctgcaaaggtttgccaacgttctcacttcggcccctgctggaaggaagtgggtgtcggatgagcttgctgtggtagccgagtctaaggaggttgctggggatatcatcactgaggctgtgcttgatcaggttcttggtgagaaggcatttgagaaatttggaaagtggttcatctcgcttcatatttcagaccagttggcaggatcctacaagaaggtccttacattcaagtttgtattgccagatgcaagcaaaatgtcagagatgacaagattggttgctcttgtgccatacttcattgatttggttgggcgttataagcttagctctcatgctcgctcaaaaactgatggagctagaacaaaggccgctcaagaggctttcagggaactgcagagtgccaggcaggaggccctgcaaaggaaaaaggctgaaaagaagaaactcatggaggaggcagatgccaaattaagtgctgaggcactcaggaagaaagaggaaaaggaaagggctcggcaaatgaagaagtctgggcccaaagtgaagatgctccgctcttaataataacgtcaagattcaagaatctaccatagcttggcttttgctattcacttgttgattagcatatagttcagtttctgctagactcatttatattcaaattttgggccaccatggtttccctttgtgagaatgagcaaaaaaagatcgaggagaaaagaatcctcactggcgttttggcatttcttgaatgtgtgccagaaatatctgtagcctaattcgcccacacaacttctttgaaaaattggttatgcaggagctgtgttgtatgagaaatagaacttacatgcttcactgtaaaatggtgatagaactacgatatgaaattctatgctcggattacatgctttcaggtttagca

SEQ ID NO: 13625 - DNA, 1385 bp, Sorghum bicolor
  Clone ID: SORBI-28MAY03-CLUS3186_1
ctcgcccccccctctgaaacaccggtggatccatcaacaactcctggttccgcggggacacggccggcccggcggaccccggcccaaaagcgtacgcgcgcgccttttatatccgcgcgccggccaatcgatcggccacagcaccaccgcgccgcaccacaccttagaccacacgcagacgcagcagcttcttgttgccttatgctatactaggtgctgctacgtgctagcgaggcatcgaggccgacgatggaagcggaaggggcggcggcggcggcggagaacggcggcgcgggcaaagggtccgactccggcagcaggttcaggcgggtgtgcgtgttctgcgggagcagctccggcaagcggagcagctaccgggacgccgccgtcgagctcggcaaggagctggtggcgaggaaggtggatttggtgtacggagggggcagcctggggctcatgggggaggtctccgaggccgtgcacaagggcggcggccatgtcattggcgtcataccgaccactctcatgggcaaggagatcaccggggagaccgtgggcgaggtgcgggccgtggccgggatgcaccagcgcaaggcggagatggcgcgcaactccgacgccttcatcgcgctaccaggcgggtacgggacgctggacgagctcctggaggtgatcgcgtgggcgcagctcggcatccacagcaagccggtgggcctgctgaacgtggacgggtactacgacttcctgctggcgttcatcgacaaggcggtggacgacggcttcatcaagccctcccagcgccacatcttcgtcagcgcccccgacgccagcgaactcgtccagaagctcgaggagtacgaggcggtgcaggatgaggacccggcgacgcccaagctgtgttgggagatcgaacaggtcggctacaacgcctcgctcctggccgagatcgctcgctgatccatcgcccggtctccacccatatcgtcgtctgctggccacaccgccaccacctatatctacccatcgatgcgatgatatatatgtatttctctccttaggtagcctaggcatgcaacaagcaagtttgcccgccaaaatgtacgaggcgccgccgagcaaaacgagggaaaggacttggttttgtggtgtgtgcgttctgctcttagtcctagcttagcagcggcttggttgtctgttctgctgctacatgtattctgctccaagccacgtattcgtactagtcatattcctaagctacgtaccctgatcacttgttgtttactacctagtagcaactttagttgtagttagttgtctcctcgatcagtagagaagtcattggtaatctggtaatgtaattgaccaccggctagttgcaagattat

SEQ ID NO: 13626 - DNA, 271 bp, Sorghum bicolor
  unsure (1)..(271): unsure at all n locations
  Clone ID: LIB3481-019-P1-K1-B7
cgtgcgcactaacaactactactcccacaactactgtgtatgtggcgcatgcacacgcaggtgggcctgctgaacgtggacgggtacgacgagtgnctgctggcgttcatcgacaaggcggtggacgactgcttcatcaagccctcccagcgccacatattcgtgagcgcccccggcgcctgcgaactcgtccagaagctcgaggtatgcatggtaaacactagtacatatagtacgagctagtagtactccaggctacagtgacccaatc

SEQ ID NO: 13627 - DNA, 1554 bp, Sorghum bicolor
  Clone ID: SORBI-28MAY03-CLUS3457_1
ccaccgtgcctctctctctcgtctcgtctcgtctctgcgttgcgccgctgcttaaacaaacgccaggagaaggctgcggcacgcgtccccctccgtctccagcctccacccatctcaaaaccctagcaaccgcgcctccatccctacccgaatcccaatccaagcccgatcccccggcggcgaggacccctccgcgccgattcgtccacgcagatcggcgggcgggggcagattcagattcgggttcgcggttcgctcgggtcgtctcgccggggtccaccgcggcggtcggggagcatggtgggaggggggaggcggggcggagcggcggaggaggtgaagctcaacaccggcaacgtgttcgcggcgctcgagtccctcaagaagaagaagaagggcgacaagggcaaggcggccgggtcgtcctccaggaagaagagcggcgagggcgccgcgcagcagcaggagccgccgcagaaggagctcttctgggcgcccgcgccgctcaccaccaagtcctgggcggacgtcgaggacgacgacgacgacgattacttcgccaccaccgcgccgccgcgccccgtctggggcaccgccgacgagcccgtcaaggaggaggaggacgtcgaggatgctgtgcgcgccgcccttcaggaggacattgagagtgatgatgaggacattgatgatgaggctgatgatggagctgaggatgaacctgagcatgaagcggaagatgccccagtcgagcctgctatcaagacagctgcagccccggctgcgccacccaaagatacagaaaggcagctgtctaaaaaggagttgaaaaagaaggaactagcagaacttgatgcagtattggctgagctgggactttctgggaattcgagcagcgccgcacaggatgctgagaagaaaggtgccaaccaaactggtgatgcagagaaaaaggaagatgctcctgccccttcggagagcaagacctcaaagaagaagaaaaggaaggacaagagtttaaaggagggaaaagaaacacaagaagcagctgacgggtcagaggagactgccagtgcaggacctgatgaagataccactgctgtggatgtgaaggagcgcttaaagaagatggcttcaatgaagaagaagaaatcgagcaaagagatggacacagctgccaaaattgccgctgccgaggccgcagcgaggagcgcaaggcttgcagcagccaagaagaaagagaagagtcattacaaccagcagcccgtgcggtaaatgggcataaaattttgggtgctctgagtttgatatccccttgttcgttttggactcacaataaaacttcttttttgagttgtggtatttatgactgggaagtgcctttctgagttttatttcagaattcatgaaaggcctttgtggttgcaaaacggtggtgtaattgtgttttaaattgttcaatccaatgaaaacttcatggccaacatggtcaatcagggctactccggcacctcctgtagtcccagttcccaatttttgcattactgcggggctaca

SEQ ID NO: 13628 - DNA, 1383 bp, Sorghum bicolor
  Clone ID: SORBI-28MAY03-CLUS3657_1
cgacggcaccgcagacactcacacaccacaccacaccacaccacagcgagagcaaggctccccaagcaaccaccactccacagccaaccgcgagaacaagtcgcagccgagaactcgtctccacgtctcccagcgaagccaagcttgccgtgccatgtcttccatggagctgctccacgccgtcatcccggagaagcagagcgaggagctgatggcgcccgcggcggcgacgacgaccacgaccacgagcagcagcgccaccgccatgagcggcgacgaggttgcccacgtgccccaggggtgggccaagaagaagcgctcgcgccgccagcgatcggaggaggagaacctcgcgctctgcctcctcatgctctcccgcggcggcaaccaccgcgtccaggcggcgccgccgctggtcccgtccgcggcgccggtcgccgcggagttcaggtgctccgtctgcggcaagtccttcagctcctaccaggcgctggggggccacaagaccagccaccgtgtcaagctgccgacccctcctgctcctcctgctgctgctgtcccggcagcagtgcccctcgtggaggtggaggcccccgcaccgctcaccgtcatcccgccgcctccagtcgaggtcgtcgtccgtgagccggccacgtcatccaccgccgcgtcctccgacggtgcggcggcgtcgagcagagtccacaggtgctccatctgccacaaggagttcccaaccggccaggcgctcggcgggcacaagaggaagcactacgacggtggcgtcggcggcagcagcgccgcgtccaccgacgtcctggcggccactgccccggcggcaactgctgagacgtccgaggtggggagctccggaaacgggagctccgccgcccgcgcgttcgacctcaacctcccggccgtcccagagttcgtgttccggtgcggcaaggctggcaagatgtgggaggaggacgaggaggtgcagagccctctcgccttcaagaagccccgcctccttatgaccgcgtgagccgctgcgcggatctctcaaccgtccaagattttggtctagatcagctgctgccaagttcggtggtggaacacactattcgttcattcattcgtatggtgtcagtattattgtttgatttgttgctgctcttcttgtacagtacagagagagctagttgtgagagatgcatagtcatcatacacataggtcgatcttcctattcatggaagcgtatacttgtatccttagctgtcagtatactgtagttcatacacacatacttcattctcattaagagatgattgatgaattagtgctttgtaacatacagtaagcttattataaatggattggggattaataggaatcaa

SEQ ID NO: 13629 - DNA, 1131 bp, Sorghum bicolor
  unsure (1)..(1131): unsure at all n locations
  Clone ID: SORBI-28MAY03-CLUS6120_2
ttcggcacgaggaaatctcgttcccttctggttgttatgggtgctacaaacagaccaaacagcattgatccggctcttcgaagatttggaaggtttgaccgggaaattgacattggagttcctgatgaagttggccggcttgaggttctccgcattcacactaagaacatgaaactagctgaagatgttaatttggaactcatttcaaaggatacccatggatatgttggtgctgatcttgctgcgctttgcactgaggctgctctccagtgcattcgtgagaagatggacattatagatcttgaggatgagacaatagatgcagagatattgaactcgatggctgttacaaatgaccacttcaagaccgcgcttggaacaagcaacccatctgctctacgtgaaactgttgtcgaagtcccaaatgtctcttgggaggatattggtgggctggagaatgtcaagagggagctccaggagactgttcaatatcctgtggagcatccagagaagttcgagaagtttggcatgtctccatcgaaaggagttttgttctatggtcctcctggttgcggtaagaccttgttggcaaaggcaattgccaatgagtgccaggctaacttcatcagtgtcaagggtcctgagttgcttaccatgtggtttggtgagagtgaagccaacgtccgtgaaattttcgacaaggctcgccaatctgctccttgtgtcctcttctttgatgagcttgactcgattgctactcagagaggaagcagtgtgggtgatgctggaggtgcggctgatagagtgcttaatcagctactgacagagatggatggcatgaatgccaagaaaactgtgtttattattggggctacaaacaggcctgacatcattgaccctgctctgctgaggccaggacgtcttgaccagctgatctacattccactgcctgatgagcagtctaggctccagatcttcaaggcttgccttaggaagtcccctgtggcgaaggacgtggacttgaatgctcttgctaagtacacgccaagggtcagtggagcagatatcacagaaatttgccagcgtgccttcangtatgcaatcagagagaatattgagaaggacattgag

SEQ ID NO: 13630 - DNA, 906 bp, Sorghum bicolor
  Clone ID: SORBI-28MAY03-CLUS6120_1
cccacgcgtccgggagtcgtcaacagctacatccaagagctatactttcagagaaggtgatagagtgcttaatcagctactgacagagatggatggcatgaatgccaagaaaactgtgtttattattggggctacaaacaggcctgacatcattgaccctgctctgctgaggccaggacgtcttgaccagctgatctacattccactgcctgatgagcagtctaggctccagatcttcaaggcttgccttaggaagtcccctgtggcgaaggacgtggacttgaatgctcttgctaagtacacgcaagggttcagtggagcagatatcacagaaatttgccagcgtgcctgcaagtatgcaatcagagagaatattgagaaggacattgagagggaaaggcggagaaaggacaaccctgaggcgatggaggaagacgaagtggacgagattgctgagatcaaggcggctcactttgaagagtcgatgaagtacgctcggcgtagtgtcagtgatgctgatattcgcaagtaccaggcgtttgcccagacattgcagcagtcccgtgggttcggcagtgagttccgcttctcggagcaatcggcgacagctggtgctgctgcagctgatccgtttgcctctgctggtgctgcggctgatgatgacgatctatacagctaggtgtcctgttgggttggttctgggttgttcaatatcagtctcgtcagtcgtctgtttaaaactgatcatactttagacacggatgtcatgaaatgatatttattttccgtacatttggatgtcgctgagaatgccctctcggcttttgattatttctttcatgccatattctccatgacattttctgggccatgacattttattaatgattgttgtcattgtattgc

SEQ ID NO: 13631 - DNA, 1575 bp, Sorghum bicolor
  Clone ID: SORBI-28MAY03-CLUS6330_1
ctgtgctgcgctcgatgtggccggagtgtttcacaagacacggcgggctcgattacacttttgcgttgcgtgtggtcggagtgtttcagattcagagcagagctgagagcacttgtcgtcgtcgtctcggagctcagatcagatgatggctctgcaggcgcagcaggggaggtggatgtcgtcgctggtcctggcgatcttcttcctggcgggagttccccgcggcggcgaggcgcagccgctggtgccggcggtgctgacgttcggcgactcgacggtggacgtcgggaacaacgactacctccacaccatcctcaaggccaacttccctccctacggcagggacttcgccaaccacgtcgccaccgggaggttctgcaacggcaagctcgcaaccgacatcactgctgacacgttggggttcactacctaccctgcggcgtacctcagcccacaggcgtcagggcagaacctcctgatcggtgccaacttcgcgtccgcggggtctgggtactacgaccacacggcacttatgtatcacgcgatcccgctgtcccagcagctggagtacttcaaggagtaccagtcgaagctggcggcggtggccggcgccgggcaggcccactccatcatcaccggcgcgctctacatcatcagcgccggcgccagcgacttcgtgcagaactactacatcaacccgttcctctacaagacgcagaccgccgaccagttctccgaccgcctcgtccgcatcttccacaacaccgtctcgcaactgtacggcatgggagcacggcggatcggcgtgacgtcgctgccgccgctggggtgcctgccggcggcgatcacgctgttcgggcacggcagcaacgggtgcgtgtcgaggctgaacgcggactcgcagagcttcaaccggaagatgaacgccaccgtggacgcgctgtcgcggcggtacccggacctgaagatcgccgtgttcgacatctacacgccgctctacgacctggccaccgacccgcggtcgcaggggttcacggaggccaggcggggatgctgcgggacgggcaccgtcgagaccacggtgctcctctgcaaccccaagtcggtcgggacgtgccccaacgccacgtcctacgtcttctgggacgccgtccacccgtccgaggcggccaaccaggtcatcgccgactcgctcatcaccgagggtctcatcctcgtcacataattaaaccacgcacgctggatcgatcggagagacggagactgcttgtggggccagccagcgtctgacctaccacgacgagctgaggctgagcatcctgaaatgaaaggaaataacgtcgtcgttgtggttggtttttggtttgcttcaaatcgatcgaaatacacaaaagtcgttaggtgcctactggatcgggctctaaacatatatctgtaaaattgttacttttttcttgtttttcttttaattaatgttttcggaagtacttataaggcacatgagtgaactcctattattgtcaaatttaagttcgatgttggtgtagacacaagagaagaggcagattttatctc

SEQ ID NO: 13632 - DNA, 2062 bp, Sorghum bicolor
  Clone ID: SORBI-28MAY03-CLUS626_1
caggtctgtacagaggaaggtggctgtcatgcaggcattaaatattatgcgttgaacctgccatgttattggcccttgtatcattaacagaaacctgaaatcagacaaaattatgatctttggtgacaagtccattcatagttctgattttggagctgacaggatctaggtgcatccttaggtaatgataacaaaaattgggaaataccgatccatgtgctacgagatgaatccgcatatgctacacatacagcagcttggagactaccggaactttgtcctcctgtgtgagctccgaacgccaaaatgttcgccaggagtagatgataggattccatcttcacatagtgctcattgtcatcttttgggggccgagcagccatcgcgcttagtcgtcctgacttcgctggtatccgatcgcctcgtacatatctctcgacaaagcagttcagcgatattaggggggggttaagatttaacttttttcaacaaccaaggtacacccttctgttgttgctttgcgctgtagctgtgttgcagatccacccactacacatgttagagtccgcggtacatctgcattggagccgctctgaaggcattgtccatgttgtgctgttggatcgaaaaatccaactcagatgcattcaagcgccatttggctagagttgctgatttcctatggattggtgaagatggcatgaaagtgcgggtctgtgctggtcaactatgggatgttgcttttgcagtccaagcaatattagcatgtaatattgcagaagaatatagaagcaccctcaagaaagcgcatgatttcataaaagcctcccagatcatggacaatccttctggtgacttcagcagaaagtaccgtcacatatctaaaggagggtggggcttccaggttgcagatcaggggtggcaggtttcagattgcacagcagaagctcttaaggttttgttaatgctgtccaaattttcatcagacattggtagtgatcagatggaaacatgccgcttatataatgcagtgaatgtattattatccttacagaacccaaacggtggctatggaacttgggagctagctcgcacatatccatggatggagattttcgacatgacagagatatatgcagacatcatggtggcgcatcagcacgtcgagtgtacctcatcagtcatgcaagcattagcattgttcaaggagaagtacccttggcatcgaaaagatgaaatagatcaatgcattaggggagctactgaattcattgagaagttacagaatgatgatggctcatggtttggatcttggggtatttgtttcacatattggcacatggtttgctattgagggtctctcagctgttggacagagttatggtaacagcacttgtatccggaaggcctgtaagtttctcttaacaaagcagctaaacagtggtggatggggtgagagtcatctttcatcaagaaccaagccagacactgttctggagtggccgacgtctcccgtcgtgcgcaccgcgcgggcatcctgggcccgcttgactgccgcccaggtggaggccgacccgtctccactgcacaaagctgcaagacttatcatgagtatgcagctcggcaatggtgacttcccacaggaggaaatgattggaagtttcttgaaaaatggtcccttgtgctacatggcttatcgtaacatatttcctatatgggcgcttggagagtatcagaaattagtcctccagtgtgacctccaacggccaaccttctagccaaaagcagcaaatacaattccatctgctgacagtgctactttgcataatttggtagctgtggtgccatcttgatttgtcgaaaagaattggaaggtatcatatgccttcgagtaaaacaatagtgcaaatagtacagtgtaatcaaggtggtgtgaatatctaaagttttagaacaaaaaatgtacacccataatttgttgcattattttttaccactgtaagagaaccacattcttcagatcttatgtgcaagaggaatgcaaagggtaacagcatttctt

SEQ ID NO: 13633 - DNA, 602 bp, Sorghum bicolor
  unsure (1)..(602): unsure at all n locations
  Clone ID: LIB3481-042-Q6-K1-B5
gcgtccggtcctgtgggagttggtaactgggaatctcccttttgcaaacatgactgcagtgcaagctgcatttgctgtggttaacaagggtgtgcgaccagccataccccacgactgcctccccgcccttggggagatcatgaccaggtgctgggatgcagaccctgaagtccgtcccccattcactgagattgtgaggatgctggaacaggtggagatggaggttctgaccactgtccgtaaggctcggttccgctgttgcgttgcccaaccgatgacgttggactgaatcatccacaatccaggaaaagaacctggagagaggtttaatcctatgtatttataatattaatagacttgtgcttcagaagcagaatgctgactcccctcagtctgccttctgtctttgacatgttatcgtagagtacacctagttgtcatcaccagagtggttgtaatagaggtagctttatgcttgactaaatacccttctgctgtaacaagtgcatgttcttgctgctcgctgtttgtgtgtttatcatcatgcggcaacatgtggaagctttgatgcttcatggtatatataacatgtgttattnagt

SEQ ID NO: 13634 - DNA, 1596 bp, Sorghum bicolor
  Clone ID: SORBI-28MAY03-CLUS5795_1
gcacgaggcgcctggtggttgcgcgaaagccttaccctcgacgccgaaggcctcgtgccttctcttcctgtctcggctcttcctccttgcatggaggaagtagctgtttcccccatggtcgctgccgccgtagtgcttgataacaatggcgccgacacggtctccagcactaccatccctagcgtaacagtaagcatagaggagaaagaagagatcaatggggacgttcccacgatcacctcggccgcaagcaacgaatttgagttgttcaccactcccgtctcctccaggagcccttccactcgcaagaagcgcggcgcgttcggcctcttcagggcgatgttcctgtcctttggccggagcgacagcattaagaagacgggcggcgacaccacgagccccaagaagagagccatcgcggctgatgctgtcgactacaagcccgccggtgacgagtcaccgtcgtggaagaacatcgtggacagcatgcgcccgctccgcctccgcgggcaggagctggagtactacccgccgccgccgccgctgggccacgccgacgtgtaccatgacgtgatcctaccaccgccgtcgccggcacggtccggcttcgagttcgaggaggtgggcatgctttgcaagaagcatgggctcacttattctgcagcctcattctggggcgcaaatgtgcttacatggaagacactcagggctgctgcattgcaggccaggagcgccacaagcggtgccgccccgaagaatttggtctgggaggctttgaacacccatggatgaatgggatgaggatatatgaactgaaggcagcttgtggtgttcagctttgtgcccatgcgattgtctgattgcttctcagttatttagagatactattgatcatttaacccgactgagtcgggttggaattttcgtgttgacaagtgactgtctatccagttgaagagttgatgcttcaattgtctggttgttcgccggctgttctgttctccctatcatggtaactatattatgatccttgctttaagtcatgaacctctgttttaagattatgtccattcgattttgcttgcattgccaagattgtggatgcttgatgttcatgatgttgtaagcttaatgaacggctggttatattatgtagtaccccttattttccagttgctatggcagcttgattgtctatttgaaaaactagtgtgtatatgacaatcagtgatcaaactatcaatattactgcaacttttacattgagtgctatgttcatgacctctgtttttttcgtcctgtaaagtgatgctgactttgtataaataacattcgcttatgcatgactctaatgaaagttgaggtacctgatctggaccctgcccgccgacgacgacgctgggccacgccgacgtgtaccatgacgtgatcctaccaccgccgtcgccggcacggtccggcttcgagttcgaggaggtgggcatgaccagccgctacgcgtgcggtgatgatctttaccagatggacatcgccgacgacgaagaggttgccctggctgttgaaggtggcaactaccgtgacagcagttgcccacac

SEQ ID NO: 13635 - DNA, 507 bp, Sorghum bicolor
  unsure (1)..(507): unsure at all n locations
  Clone ID: LIB3476-010-P1-K1-H6
gctttaccatctgcgggattcagcacgtccagttctgcctcaaccacttctcgtccgatgtctatgtcggcccacccaagggcaatgactggtttgagaagcagacggcaggcacgctcgacatcctgtgccctccctggatggattggttccatggtggtctgcaattccagattgagcaccatctgtttccccgcctacctcggtgccaccttcgcaaggtcgcgccggccgtgcgtgacctttgcaagaagcatgggctcacttattctgcagcctcattctggggcgcaaatgtgcttacatggaagacactcagggctgctgcattgcaggccaggagcgccacaagcggtgccgccccgaagaatttggtctgggaggcttttaacacccatggatgaatgggatgaggatatatgaactgaaggcagcttgtggtgttcagctttgtgcccatgcgatngtctgattgcttctcagttatttagagatacctatgatcat

SEQ ID NO: 13636 - DNA, 801 bp, Sorghum bicolor
  unsure (1)..(801): unsure at all n locations
  Clone ID: SORBI-28MAY03-CLUS4108_1
gaggcctcgtcgacggcctcgcctccgcggcccgccccgctggctctcgcccacgcgcacccgattcccccgcttgcctttccccacctgtcgcggcgctcgccagtctagggtttcgccccccttcgcccgccgatccgcccccgccggccatgtcgaagcaaggagggaaggccaagccgctgaaggcgcccaaggtcgacaagaaggagtacgacgagagtgatcttgcttatttgcagaagaagaaagatgaggaaaaggcactgaaggagctgaaggccaaggcacagaagggcgcaattggaggctcgggtctcaagaaaagtggaaagaaatgagcctggtcacctgtctctaatacttagagaatgataaggtggctgcttatctgtgttgcgcttcactatatgtgattgtaaccgtgctacctattgtgttctgtgttttgcaaattgcaatgttgcagttggttgcttgatccgaaaatgtttcagcctcgcatctgctatctatgaaactgatggttccctgataataatgatgacattatgtgatgaaaaaaaaaaaaaaaaaaggcccctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13637 - DNA, 629 bp, Sorghum bicolor
  Clone ID: SORBI-28MAY03-CLUS42000_1
gcagcacgaggctcacctctgctcccctccctgcccagaggaactcaggcagtagcgtagtctaccaaaaagttgcaaagctctgatcttgtcgcctcccacgcaatcttctctccatctccgttcgtccgtccgttcttcgtgtcgtcgcaagataacagaactcacaagaagttaaagcctcagggaatgctgaaagatgtgctttcgtagaagagattcctgttgcgacatcaaggaccttgctgctccgcaagggctgctgatctgctcaactcttgatgacctgaccttcatcaattctacgcccttcagactgcgacacgaccaggccataagaattctgttcaccatcatggatcatgacatgggggaggagggctaactctttgtgcagtccacctgattggcagccaaaagtgtagccctgtgaattgtgatttactcttgaagaaagatatggaatcgagaggaaagattttgatgaagcggtatgagctggggaggttgctggggaaaggcacatttggcaaggtgcactatgcaaggaaccttgagtccaaccagagtgttgctattaagatgatggacaaggacaaagtgctcaacgttggactttcagagcagat

SEQ ID NO: 13638 - DNA, 1148 bp, Sorghum bicolor
  Clone ID: SORBI-28MAY03-CLUS42186_1
gcacgaggatagttcacaggggaactccatttaccagcttgatatgataaagtttgccaagaagatgtacccggaggtggatttgattgggggtaatgtggtgacaattgcacaggcccagaatttgattcaagctggtgcagatggtttgcgtgttggaatgggttctggctcaatttgtaccactcaggaggtttgtgctgttggaagaggacaggcaacagcggtgtataaggtttcatcttatgccaaggatcacaatgtaccagttattgctgatggtggaatttcaaactctggacatatcgtgaaagctctgtcactgggggcatccactgttatgatgggcagctttttagccggcagtcacgaagctcctggtacttatgagtacaaggacgggcgtcgagtcaaaaaatacagaggcatgggctctcttgaagccatgacaaaagggagtgatgcaaggtaccttggtgatactctcaagctcaaagtcgcccaaggcgttgttggagcagtagctgacaaaggttctgtactgaggttcattccttacacaatgcaagcagttaagcaaggattccaagatcttggtgcagattctctccagtcagctcatgatcttttgcgatcagagactctcagattagaggtgagaaccggcgctgcccaggttgaaggtggaatccatgggctggtttcatacgagaagaaggcattctagttccataaccaaacaaggaagaattggaacaagagtggttagctgcatgatatggaagggacgatgctcatcatccttcctggcaaaagctcagcagcttgtcagcaaagcttgtcgatttgggcagcaggtgtaccatctattgtagcgtaatataataataaacctccggctttggaattgccggataagctcacggcttgtcatcaaaactttgtccccagttttgctcagagtaatactgctatttaaatatttaacaatgatttggatctggtgatcgatgtactctgtcctgccatgttgggttgtacacttgtagtccccgtgtttgaagaatgctgtcatggctagtatgccactttaccagactgcttcaacaaatttgagcagcccaaattatgagttgtgcttgcaactg

SEQ ID NO: 13639 - DNA, 814 bp, Sorghum bicolor
  Clone ID: SORBI-28MAY03-CLUS44257_1
gcacgagccacactccaagccagtgctagctagcctcctttccccttgcttgtgagagagacagtacagtagaactgccatggctcagggaaggggcagtgctcgtggcagcaacgccgtcgtgctggcgctggtcctcctctgcgtgctcctccacggcgagttcgccgagtcggcggtgtacaccgtcggcgaccgcagcgggtggagcttcaacaccgccaactggcccaagggcaagcgcttccgcgccggcgacgtgctcgtgttcaagtacaacgccaaggcgcacaacgtggtgcccgtgagcgcggcggggtacaggtcgtgcagcgcgccgaggggcgtgagggcgctcaccacaggcaacgaccgcgtcacgcttaagcgcggcgccaactacttcatctgcagcttcccaggccactgccagggcggcatgaagatcgccgtcaccgccgcgtgaggcgtggtgatcgaggcacgcggccggccgatcaggtcagccggcggccggcgaccgcgccgcgccgcgcgcatggacacgggctcgatcggtggccagcttactactactattaatttcctctcttcaaagtaaagcacgtagctaactagacggtgccgctctgtatctctgttgttcaataatacccgtgtcgtgtcgtcgcgtacttaacctgcgtgttaggagtgttgttaggtgtttggagactggcactatagagaagggtcagatcgagtgatgtactactgatgcgtgtatttgtgtgtttatgtgaagaacaataaaggcatacggcgtttgtgtgct

SEQ ID NO: 13640 - DNA, 904 bp, Sorghum bicolor
  Clone ID: SORBI-28MAY03-CLUS44533_1
ccgacaagtacgactacgcgatcgtggtggtgggcgagccgccgtacgcggagacgttcggcgacaacctgaacctgacgatcccggcgcccgggccgagcgtgatccagtcggtgtgcaaggcgaccaagtgcgtggtggtgctcatctccgggaggcccctggtggtggagccgtacgtgggcgacatggacgcgttcgtggcggcgtggctgccggggtcggaggggcagggcgtggcggacgtgctgttcggcgactacgggttcacggggaagctgtcgcggacgtggttcaagtcggtggaccagctgcccatgaacgtgggcgacaagcactacgacccgctcttcccgttcggcttcgggctcaccaccaagggcgcgaaatgagtacgagacggcctgtgagtggcctgtgagtgactgagtgaattgtgtgcttgtgggggggcgtgacgaggctttcgaattagttgggggccaggtgagtagggaacgaacgccgcacacattgggcagcgttggggcctgtgggtaataacagtggtgcattcttgaggcggtggttgttagtgagtgggttgtttggaatgaacaataagagatcaggcgcgttacgttcgcgctggtatgcagtatgctacctcccccgtcctggctgagagtcacggtcagtgtcaagtatgggttggatcctctaccgcctctattgttctctcagtcgtcggcttctgcgctccatcgcgctactctgcttgcaaaggaaaggggaaaaaatgctgccataggcgcggagaaactgctcagtgtagcgcgtgcacgatctctactcctgtgttataaagtctccagtgggttgcaactggaatagagaaaattccgtaatggtttcagttggataa

SEQ ID NO: 13641 - DNA, 1184 bp, Sorghum bicolor
  Clone ID: SORBI-28MAY03-CLUS4506_1
gccggccgggctcgggggccaccaatggccacccccaccgccaccgcgctcacctgctcctgccgcccctcgccctcgccctcgccctcgccctcgtcctccgtcgcctcccgccggctgaacatattcgcccccctgtctcctcgccgccgccgcctcctccgtctcgcgccgttgcacgtcgtcgatgactccagcaccgatctcccggaggagaggtctcggacggataagatggtcgacggcatggacttcggggagctctgcaacgacttcgaatgcataagtagcccctacgtggagtccacggcgaggcagatcgcgcgggacatcctcgagctccgcgacgacaaccgcgcattcaactgctacgctgtctccgtcaagtacaaggacccactcaggacatttgttgggcgtgagaagtacaagaggccattatggatcaccaaggcattggaaaagcctgtagtgacagtccaagaaatgtcaatgcaatcgacaagcaatctgaccattaaatgggcattcagagggaagcctaagaatccgttctttgcgaccatgggaggagatgtcattgtccgtgttgtatcacagttcgtcttgaaccagataagtggacaagtactcgaacaggtagactcctgggacctctctgcctcgtcttttccagctcaggcctacttttggctgtccagaagggtttactccaccgttgagtccgggaaggatacaatcgaagctgctaagagcacgacatctgggctaacaaagggagatcagaatttcgaggcttatccagatccttctagtgatcctacaaagttctttcaaaggccagatgatggattcaatcaagacgtgtaccagattgggtttctcctggccgtgatctacttcattgtacagtttttgagaacggttctgtgactgcagaccaacttcatcgtgagtcgcaacctgtcgaatcctcctgtgtgtatacatatgcatgtaactatgtctaacaaaataatataatacaagcattctgccatctgacttgcgtgtccgtatgagcaagtgtacggtgtctgtagcatttgcatgtgtactgtatttgaattagtaatatccgagtgtgtacagaatgacttgataggatttccaatctatagtaagctgacatttttgttgtctgg

SEQ ID NO: 13642 - DNA, 1018 bp, Sorghum bicolor
  Clone ID: SORBI-28MAY03-CLUS4606_1
gtctcgccggcgggctgcgcctcctctcccggcacgtgcgtgtccgggcccgtcgtgtactcgtgtgtgccatctgccaagaagacccaagagtaggaggaggaggaggagcaaagtagagatggcgtgccctgcgcagtccatgctctccctctccgccagcggcggcatcttcctgaggagcaagcctcaggcggccgcggcctgccatgtgcgtgggggcatcatcatcggcggtggcagcagcaggccgttcctgctcacctgcaacgcttcctcgccgccggcgccgacgcaggaggaccccgactgcaacgaggaggagtgcgccccggagaaggaggtcgggagcctgagcgccgagtggctggccgaggagaggacccaggtcgtcggcactttccctcccaagaagagaaagtggggctacgtcgagaaggacaccgcaggccagaccaacatctactccgtcgagccgatggtgtacgtggccgagagcgccatcagctccggcacggcgggcacgtcggcggagggcgccgagaacacggccgccatcgccgcggggctcgtcctcatcaccgtcgccgcggcctcgtccatcctcatccaggtgaacaagagccagcctaaggtgacgccggaagccgcctacaacggcccgccgctcagctactacgtcgccaagttccaaccggcggcggtggcgcagaccctcgaggcccccgcccccgccgaggcggtagaggcagcggcgccagaggcgacgacgtccaccgtcgacgcctctgcggctccggaggcgcagcagctgtcgtcgtgagctggttcggttttgtcgtcgtgagctgagcctgtagtgcatgatgatggaagatatgtatacatgatacacatgagagcatttcggaattgtatcaagtttcatgtttatacatatatatatatatatatacacatattatatacatatgcattcagctcgcctatgctggatgcttatttgaatcccaacaac

SEQ ID NO: 13643 - DNA, 1968 bp, Sorghum bicolor
  Clone ID: SORBI-28MAY03-CLUS7319_1
tactggttaagcacatgttgatgatgggtcactggcatgtgggcccgctctttcttccctcgtctcctccttccctcgtcgccttccctctagctctgggcctcggcggcgttcgaggagcgttccgttgcttctggttcttgggaagtcgttgccagcgggcagccttgccaggtgcttgccagaatcggaccccagccgccgcacgccgacctcgtctcgcttctcctctccccgtgaagaatcgtgatgcggagaacagccgccgctgccctcgttttcattcccctcctcgctgcggcggtgcagacctcctccctgcccttcatcgtcctgcacgggattggggaccagtgcgccaaccatggcgtcgccaagttcactaaacttctcgccggttggtccggctccgacggtcactgcctagagatcggcagaggaacatgggactcttgggtcatgcctcttcaacaacaggctgatatcatctgcaacaaggtcaaggaaatgaaacaactgagagacggctacaacatagttggtctgtctcagggaaacttgattggtcgagcagtagttgagtattgtgatgatggaccgccggtcaagaacttcatctctcttggaggtcctcatgctggtaccgcttctgtgccgctttgtggttctggtattttgtgcattcttgttgacgctctgatcaaattggagatctactcagactatgtgcaggaacatcttgcacctagtggctacctcaaaatcccaactgatatggcagattatctgaagagttgcaggtttcttccaaaacttaacaatgagattccagaaaaaagaaatgccacctacaaggaaaggtttagcagcttagagaatttggttctgatcatgtttcaggatgatgcagtcctgatacctcgagaaacagcatggttcggttactaccctgatggagcctttgatcctgttctaccacctcagaagacgaagctgtatgaggaagactggatcggtttgaagacactggataaagcagggcgggtgaagtttgtgtctgtggcgggaggtcacctcggcatctccaaaagtgacatgaagaagtacattgtgccttacctgacaagcaaagcatcggtgaagaccctcctccggtggagcctttctgatttgctaggtggcacttggcacgctgcgctggggctgatggagggtgatggtgctgtgcttgattcgccatcgtcgtgattaatcatatgatgtgatttgatggacttggggtctggtttccaacagtgggttgctgtgaagcttgattgttacgctctacttggtcgatttatggcgtgggccttgtttagttccgaaaagtgaaaagatttcggtactgtagcactttcgtttgtctgtgacaaatattatccaatcattgactaactaggatcaaaagattcgtcttgtgatttacagctaaactgtgtaattagtttttgttttcgtctatatttactgtttcatgcatgtgccacaagattcgatatgacggggaatcttgaaaacttttttgttttcagggtgaactaaacaaggccataatcatgcatctgtaatatgattttgtctagattttacttgcttgcatagagaaataaaggacgcccaaaatctattgatcacaaacagcaagcttgctattcatggaaactgcgcctagtccctaagcaattgaaatggctatgctggttggacagaaatcaagatagccagactaaactattgtaacaggtaaattatgcatttgagatctaggccaaccaatatctcattggcaagatagcagaagtaacctctctacttgcagatctacatgcagctaggaatacaactactataacagattacctaaaggtataacatcataagggttatctcctcttggtaggaaaccatagaatgtaaccctcgtgc

SEQ ID NO: 13644 - DNA, 1172 bp, Sorghum bicolor
  Clone ID: SORBI-28MAY03-CLUS7371_1
tgaggcttatgggtcgtgctgcttctcacattacattggaatgcgctttgcaaactcaccccaatgctgcactcattggggaagaggttgctgaaaagaagcaaacccttaagaatgtcacaaactacatcactgatatcatctgcaagcgtgcagatctcggttacaactatggtgttatccttataccagaaggcctaattgatttcatcccagaggttcaaaaactcatcgcagaattgaatgaaattttggcacatgatgttgttgatgaggcaggggcctggaaaagcaagcttcagcctgaatcaaaggagctgtttgagtttctgcccaaaactattcaggagcaacttatgcttgaaagggatccccatggcaatgttcaggttgcaaaaattgaaactgagaaaatgcttattagcatggtggaaactgaactggagaagagaaaagctgaggggagatactctgcacatttcagaggacaagctcatttctttgggtatgaaggaagatgtggccttcctactaattttgattctaactattgctatgcattaggctatggtgctggtgcccttctccaaagtgggaagacaggacttatttcatcggttggcaaccttgcggctccagtacaagaatggactgttggtggaacagcattgacatcactgatggatgttgagaggaggcacggcaagttcaagccagtgatcaagaaggctatggtggaacttgatgctgcacctttcaagaaatatgcatcaatgcgggatgagtgggccatcaagaacagatacatcagccctggccccatccagttcagtggccctggaagtgatgactcgaaccacactttgatgctggaactcggtgctgagttatagagatgcggctttttttttttacttatttttgttcttacagttttgggagtggagactgggtacacgggggtctcctggagcagcctgcagtctccatattgtgaattgtttaataagtgcttcgatgggagttttctgcttagcggactggatgtggtagcaaataagaactggtttaagttttttgtgtgatctacacaccaactgacttctcttgtaaccctgttcccctggttgcaatctcgtgaatgaactaatgaagttgagccaaaaaaaaaa

SEQ ID NO: 13645 - DNA, 1242 bp, Sorghum bicolor
  Clone ID: SORBI-28MAY03-CLUS74_1
gcacgaggattgctttggtctgtggaaactgtgttgtctggaaaggtgccccaacgactccactgatcactattgcaatgactaaaatagtggctagcgtattggagaagaacaacttgccaggcgcaattttcacatccttttgtggtggcactgaaattggtcaagcaattgccgttgacactaggatacctttggtttcattcactggaagtacaagggctggtctgatggttcaacaacaagttaatgcaagatttggtaaatgccttcttgaacttagcggaaacaatgccatcattgttatggatgacgcagatatccagctagctgtacgttctgtcttgtttgctgctgttggtacagcaggacaacgctgcactacatgccgtaggctgattcttcatgaaagcatatatcaaactttccttgatcaacttgttgaggtatacaaacaagtccgaattggggatccgttggagaagggcaccttactgggaccactgcacactcctgcttcaaaagagaactttttgaaaggcgttcaaaccattaaatctcagggagggaaaatcctttttggaggatctgccattgaatcagaaggaaacttcgtgcaaccaacaattgtggaaattacaccttctgcagcagttgtgaaagaagaactctttggtcctgtcctttatgttatgaaatttcagagcttgaaggaagcaattgaaatcaataactctgttcctcaaggattgagcagttctatatttacaaagaggccagaaattatttttaagtggctcgggccccatggtagtgattgtggtatagtgaatgtgaacatacctactaacggtgctgaaatcggtggagcatttggtggagaaaaggcaactggtggtggacgagaagcagggagtgattcctggaagcagtacatgaggagggcgacttgtacaatcaactatggaagcgagctacctctagcccagggaatcaattttggttaatcctgcaggaatgttgccctgcaaccgcatttgagatctctgcatagactcgagcagtgtttgtcggcgtcagtcgtcaaacctaaattgcaggggcatgtgtacataaaataagatgtttgttgctcgtgggcagagacgtctactaagctgtctctgtctcttctaaaagagtaaatcttcccatgtaaccttcaacagttaataagtaaacattctcattcagaattatggt

SEQ ID NO: 13646 - DNA, 1005 bp, Sorghum bicolor
  unsure (1)..(1005): unsure at all n locations
  Clone ID: SORBI-28MAY03-CLUS805_1
ccgcgangatggtggtgagtgatagaatcttccttctggttcatatgtattcttgcaattggaaaaggaggagattttagcaccacatactcatttctgcttgatctgtggtaagggtttcaaaagagatgctaacctaaggatgcacatgaggggccatggagatgagtacaagactccagctgctcttgccaagcccacaaaggattctggtgcagatcatgcaccggttacaaggtactcatgcccatttgtgggttgcaaacggaacaaagagcacaagaagttccagcctctcaaaacaatattgtgtgtgaagaaccattacaagagaagccattgtgacaagagctacacctgcagccgttgcaacaccaagaagttctctgtcattgccgacttgaagactcatgagaagcactgtggtcgtgataagtggctctgttcttgtggaacaaccttctccaggaaggacaagctttttgggcatgttgcccttttccaaggccacacacctgcgctccccatggaagatgtgaaggtatcagaagcatcagagctacctcaggacagtgagccaacgaatgaaatggcgaggagcatggtgtatagcttccccagtagctcgtctgatggtatatcgaacctcgacatgaaaatggctgatgatgtgcgtggttatttctcgccactgaactttgatccttgctttggtgcgcttgacgacttcactcgccctgggtttgacatctctgagaaccccttctccttcctgccttcaggatcttgcagttatgggcagcaaaacggagatagctaatgggtgccgccatcgatgatgacgacaatagcactgtcaacattttatgtatgttgttgcatgatgctagtttggttctacctctgttcgagagccattttaggttatgccttttatactttcctcaagtgtacttacatttgtggtcattaataatgataaaggacttctagcatttcttataa

SEQ ID NO: 13647 - DNA, 626 bp, Sorghum bicolor
  Clone ID: SORBI-28MAY03-CLUS716_2
gccggccgggccggggatcgcagcataaagaagcacaataacaagccacacttgcccgccagagcatcattatctcgtcatcaactgatttgcagtttcaattcgcgaccgacgacaaccggccaccatgagctccacggcagcggcggcaccggagtgcggcggcgccaagacgtcgtggccggaggtggtcgggaagagcgtggaggaagccaagaaagtgatcctaaaggacaagcccgacgccgacatcgtcgtgctgcccgtcggctcgccggtgaccatggattaccgcaccaaccgcgtccggatcttcgtcgacacagtcgcccagacgccccatgtcggctgattagctagctgcttctgctgctgcatgtcagtgctacttccttcgcgcctccctccagaacatgaataaaatacgacgatcgaataacgcggacacatgccatgtatgcatgtcagtgcatctgccgaaaaaataatggatgtatacgtgtttctttcatactataaattatcactacataatggcatcgttcttatagatataaataaatgtatcagaatgtcgttcatccttgcacgaatggatatatatacaaaaaaaggcccctcaaata

SEQ ID NO: 13648 - DNA, 579 bp, Sorghum bicolor
  Clone ID: SORBI-28MAY03-CLUS716_1
gccggccgggcttccgaatcaggccgggagctgagcagcataaagaagcacaataacaagcagccacacttgccctttcaattcgcgaccgacaaccggccggccaccatgagctccacggcagcggcggcaccggagtgcggcggcgccaagacgtcgtggccggaggtggtcgggaagagcgtggaggaagccaagaaagtgatcctaaaggacaagcccgacgccgacatcgtcgtgctgcccgtcggctcgccggtgaccatggattaccgcaccaaccgcgtccggatcttcgtcgacacagtcgcccagacgccccatgtcggctgataagctagctagctgcttctgctgctgcatgtctcagtgctgcttccttcgctcctcgctccagaacatcaataaaatacgatgatcgaataacgcgcggacatgccatgtatgcatgtcagtgcatctgccgaaaaaataatggatgtatacgtgtttctttcatactataaattatcactacataatgacatcgttcttatataaataaatgtatctgaaaaaaaaaaaaaaaaaaggccccta

SEQ ID NO: 13649 - DNA, 628 bp, Sorghum bicolor
  Clone ID: LIB5051-004-A1-XP1-E8
gccggccgggctgcatagcagtagtctgtttccttttttgttcgtcatcgatcaactgacgatttcgcagtttcaattcgcgaccgacaaccgacgacgatgagctccacggcgacggcggcggattgcggcggcgccaagacgtcgtggccggaggtggtcgggaagagcgtggaggaagcaaagaaggtgatcctcaaggacaagcctgacgccgacatcgtcgtgctgcccgtcggcacgatcgtgaccgcagattttgtgcccaaccgcgtccggatcttcgtcgacaccgtcgcccagacaccccacatcggctgattaagaggctggctgatgcctagctagctttgattccttcctttgctccagaactgaatattctgtaaaatgaataagtcggacatgttatatatgtattcatgtccgtgtatctgacgaataatggatgtgtacctactataaacttatgcactaaataatggcatcgctgttgcataaataaatatgtatcaaagtgtgttgtccatcctagcacgaatgaatatgtgaaaggggatcagttgtttgttttcactttctatcattaaaaaatagttgtccaaaaaaaaaaaaaaaaaggccccta

SEQ ID NO: 13650 - DNA, 575 bp, Sorghum bicolor
  Clone ID: LIB5047-008-R1-XP1-A12
gccggccgggccggaatcagtagtttgttaatttccttttaattcagaggccagagcatcattatctcgtcatcaactgatttgcagtttcaattcgcgaccgacaaccggccggccaccatgagctccacggcagcggcggcaccggagtgcggcggcgccaagacgtcgtggccggaggtggtcgggaagagcgtggaggaagccaagaaagtgatcctcaaggacaagcccgacgccgacatcgtcgtgctgcccgtcggctcgccggtgaccatggattaccgcaccaaccgcgtccggatcttcgtcgacacagtcgcccagacgccccatgtcggctgataagctagctagctgcttctgctgctgcatgtctcagtgctgcttccttcgctcctcgctccagaacatcaataaaatacgatgatcgaataacgcgcggacatgccatgtatgcatgtcagtgcatctgccgaaaaaataatggatgtatacgtgtttctttcgtactataaattatcactacataatgacatcgttcttaggaaaaaaaaaaaaaaaaaaggccccta

SEQ ID NO: 13651 - DNA, 342 bp, Sorghum bicolor
  unsure (1)..(342): unsure at all n locations
  Clone ID: LIB3481-016-P1-K1-D11
cgtgcgcanagccacacttgccctttcaattcgcgaccgacaactcgccgaccatgagctccacggcgacggcggcaccagagtgcggcggcgccaagacgtcgtggccggaggtggtcgggaagagcgtggaggaagccaagaaagtgatcctcaaggacaagcccgacgccgacatcgtcgtgctgtccgtcggctcgccggtgaccatggattaccgcaccaaccgcgtccggatcttcgtcgacacagtcgcccagactccccatgttggctgataaagctagctagctgcttctgttgctgcatgtcttagagcttgtttctttgcttcttgtttca

SEQ ID NO: 13652 - DNA, 1590 bp, Sorghum bicolor
  Clone ID: SORBI-28MAY03-CLUS82653_1
acccgccgaagggcaccgcccggctcgacctcgactccgccactccgccggctcggcgctgccagtcctcgcgtagcagcgtataggctgagaggcaagccgcaatgaggagcggtccgcgcatgtcggcggcgcttggcgcggtggtgtggtcttcgtccgcgcgggcgtcggcagcgaagctgagcagctacaatgcggccttcgaccgcggcggctccctgaccgacatcgggaacttatgctctaacgggaggcgttgttggttctccttcacccggccgccctacgccgagacctaattctccacgccggcgtctcgatcccgcgcccgccccgccttcccgcaattcctaggccctagcttatgacttccgctcatcccccctacggcgagacctacttcggcccgccgacgtgccgctgctccgacggccgcgtcgtcgtcgacttcctcagcactcagttcgggctgccgttcccgcccccgcccgagccgggccgccccgccctccagctgcccgccgcagtggttccagcaaatctcctccgccgtctgcggcaacgactgcgagagctacctgggcaactccctgttcgtgttcggcgagttcgggggcaacgactacaacgcgatgctgtgcgcgccaccgccgtctgcggacaaagctgtaagagctacctggccaactccctgttcgtgttcggcgagttcggcggcaacgactacaacgccatgatcttcggtggatacaccatcgagcaggccaggaaatacacacccaagatcgtcaacaccatctctagaggcattgataaactgatcggactgggcgcgacggacatcgtcgtcccgggtgtcttgcccatcgggtgcttcccgatctacctgaccatctaccagagctccaacagcagcgactacgacgacctcggctgcctcaagagcttcaacgacctgtccacgtaccacaacaccctgctgcagaagagggtggacatcatccagagcaggcacaggaagacggcgcgcatcatgtacgccgacttctactccgccgtctacgacatggtccggaacccacagacctacgggttcagctcggtgttcgagacgtgctgcggatcaggcggcggcaagtacaactaccagaacagcgcgcggtgcggcatgtcgggcgcgtccgcgtgcgccaacccggcgacgcacctcagctgggacggcatccacctcaccgaggccgcgtacaagcagatcaccgacggctggctcaaggggccctactgccgcccgcccatcctgcacaactaattccactcatggatagatggatgctttgcatggaggcggcgcgttattttttataaataatttatttatttgtatttatatccatataattagcttggttggattaattggattaatcgcggcgggggttaaatattattgcgttggttggtccttcgttcgaccatttttgtttgtttggaggaggtgtttattaattgcgttgctcaaaaaaataattaatggcaattgtgatatatatatatatatgagatgacactatcgtgttcattatagtc

SEQ ID NO: 13653 - DNA, 2037 bp, Sorghum bicolor
  Clone ID: SORBI-28MAY03-CLUS791_1
aggaaaaaatcgggaaaaatccgaaatggccgctagtggcctcggcctctccacctcgttcctccccggccacgacaccctcctccggcgccggcgccggcggccggcgagcccctccaccgcgtcgttccggccggtgacggcggagctcggcggcgtcgcggcggggctgggccggcagctggtggaggcggtgggcgtggggctcccctgcaccgtcatgcagtgcggcgacgtcatctaccgcagcacccgcccccagcccgatgggccccccgtcgccgcccccgcccccccgcgcgccccccccgccgtgtcgtacctctgggccacgcccggcgtcgcgccggggttcttcgacatgttcgtcctcgccttcgccgagcgcctcttccgccctaccttccgcaaggatgacttcgtgctcgggaagaagcttggggagggcgcattcggggtcgtgtataaggcgtcactggcgaaccccgaagcggctaagaagcaaggggatgtggtcgtgaagaaggcaacagagtatggagcagtggagatttggatgaatgaacgtgtcaggagggcatgtgccagtagttgtgcggattttctttatggctttcgcgagaccaaagcaaagggtaagggagctgaagaatactggattatttggcgttttgaaggcgaggatacactttatgatctcatgcaaagcaaggaattcccttacaatgtggagacaaaaattcttggcaatgtccaggacttgccaaaaggtatagcgagagagaataagatcattcaaacggtgatgagacaactcttgtttgctcttgatggacttcattcgacagggattgttcacagagatataaaacctcaaaatgtgatattttcagagggatcacgaaccttcaaaattattgatcttggagcagcagctgacttacgggtaggaattaactatattcctaaagagttccttttggatccaaggtatgctgcaccagagcaatatattatgagcacgcaaaccccatctgctccttctgttccagttgcaacaactttgtctccagttctgtggcagctgaatcttcctgacagattcgacatatatagcttggggctcatattcttgcagatggcattcccttcactacgaactgacagcagcctcatacaatttaatcgccaactgaagagatgcgactatgacttacaagcctggaggaatctggtggagccacgagcgactgctgagcttcggaggggctttgacatcatggatctagacaatggtatcggatgggaactcctcacgtcgatggtccggtacaaagcacggcaaaggaccagtgctgagggtgcattggcacacccatactttaaccgtgaggggctccttggcctctctgtcatgcaaaacgcacgactgcaactgttccgggcaacccagaaggactacagtgaagccgctcggtgggttatcggcctcatggcaaggtcaggaactgaagaagtgggaggctttacagaagcacagcttcaagagcttagggaaataaaaccgaagaaaggcaacgcccagcggaacgtgcttgcctccgtgctgcgcctgcagaagaagatcgtgaaaacgatcaacgagagcatggacgagctcgccagccagcgcaaaagcatctggtggagccggtggatacccagggaggagtaggccgccggccgccggcgcacctgtacattgtccacttttgctgtataaaacgtcgcccagtagcactggtgatggtatactacactatcctacggtacttcgtacagtacatgctgatgactggtgagtaaagtttgtctgaaaagatcggagtaacacggtgtatagctgtaaatatttgctattgaagcatcatgatttttgagatccctgtcctaagttcgtaggcactttcatcaaaaagtaggaggttagttcatcataagcactcagctctgctctgcctgaatatcctgtgattggaggttgccgaagctttctgc

SEQ ID NO: 13654 - DNA, 482 bp, Sorghum bicolor
  Clone ID: LIB3478-048-P1-K1-C3
cccatttgcatgcctatcgttctgtctgcggccctgtctgtatcttttgctgtctcctcgggcgccgccgcgcgctggtgatccccgtggtcatcgaccagcagcagcagcagcagcagccatgtcaggctcccagctgtgcaccgactggtcctcctcggcgctcgccagcagggtctccaccacccagcggcgcggaagatccggcccaagctcgggccccggggtgggcgctgtggtgcgattcccttcactacgaactgacagcagcctcatacaatttaatagccaactgaagagatgcgactatgacttacaagcctggaggaatctggtggagccacgagcgactgctgagcttaggaagggctttgacatcatggatctagacaatggaatcggatgggaactcctcacgtcaaagggccgggacaaagcacggcaaaggaccaatgctgagggtgcaatggcacacccatact

SEQ ID NO: 13655 - DNA, 2119 bp, Sorghum bicolor
  Clone ID: SORBI-28MAY03-CLUS9039_1
gcacgaggctcgcttcatccagtgcgctgcccacctcactcccgtcgtcctcttcctcctcccggacctcgtcgcggagcggagcggagcggaggcgcgcgttcctggacgccacgggagtacgggacaagagcggaggtgagtgagcccgagcccgagccccacgtggattgctgattcggtggtcggatcttgtggagtagccccctggtttttcttgttacgaggtcccgatatctcacgccagcagtttgtgcgcccgcagccaacgcgtgactcgccccttgctccctcgcttcatccagtgcgctgcccacctcactcccgtcgtcctcttcctcctcccggacctcgtcgcggagcggagcggagcggaggcgcgcgttcctggacgccacgggagtacgggacaagagcggaggaagctcatctgggtattggagtcatccaaaggtacaagctgaggaatggggcaaaaggactccaagccttcatatggatatggatactcttatgattacggcagtacttcgtcaggatataactcgagaaatactggaaatacgtcctccggttatagcgcgaggtatgcgccttcttcagagaacaatgtacagccagaaacaaccgcaaggttgcagaggaagtattccaggattggggatgactatcgttctttgagtcaggtgactgaagctttggcacaagcaggtcttgaatcttcaaatcttatcgtaggcattgattttacaaagagcaatgaatggacaggtaaaatttccttcaatcgtcgctgcctgcatgatattggaaacactccaaacccatatgagcaagctatatctattattggaaggacactttcagcatttgatgaagataatttgattccctgctttggatttggcgacgcatcaactcatgatcaggaggtattcagcttttacccagagaaccgcccatgcaacggatttgaagaggcgctagacagatacagagaaattgttccaactcttcgattagcaggtcctacatctttcgctccaataattgagacagcagttggaattgttgacagcactggtggtcaatatcatgttcttctgataattgcagatggacaggtcacccgaagcgtcgatacacaatctggacaattaagtccacaggagcgggctactattgatgcaatagtaagagcgagccagttccccttgtcaattgttcttgttggggttggtgatggaccatgggacatgatgcaccagtttgatgacaatatacctgctcggtcatttgacaatttccagtttgtgaatttcacggagattatgtcaaagagtgtagcagctgacagaaaggaggcagaatttgcattgtcagcactgatggaaatccctacacagtacaaagcaacacttgatctccaactcttaggccgccgccaaagaataactccaagaattgctctgccaccaccaataaggaatgcttattcacggtctactagctttagccaacagtctggtgtttattcacgatcaagtagctttgaccaacagacaagtggttttcaacaacgttcggagagcttgaaacagcagcagcctgcagccccaaagagacctgacactgacacttatgcatcagaaagagctttagaggacagaattctgtgccccatctgcatgtataaatcgaaggaccttgcatttggatgtggacatcagacttgctatgaatgcgggaagaatttggagcgctgccctctatgccagcagcacataaccacaaggatcaggctctactgatttgaaacctatggattggaaaatgttggaacagactcccttgcaaaatgttcagaaccagctttgttgctattgtgcttcattttgtaattggtatgttagtcttactgcactggcatataagaacgccaattagttatagtgctggtgtcactgtctcagtagttatgccaaaagaaagcgcaccagaaaataatgtacatatttcccctccttttcctttgtgtcttttgttgttaagtaaataagtttaacagcaggaaagttctggatgagatgatgaatattgggaagcaaaaatattgccc

SEQ ID NO: 13656 - DNA, 1265 bp, Sorghum bicolor
  Clone ID: SORBI-28MAY03-CLUS9171_1
gcacgagggccggtttccgccgcctcgtctcgtctcttccctttcccgtttccccgttcagttcagcttcggttggctcgccgtgcacgggctattcctcgcccggcctcgctttcttcctccgcagatcctcgtctcgaattcgctcgcggcgggaggaatcggggcgcgaggatgaccgtgatcgacatcctcacgcgggtggacgcgatctgccagaagtacgacaagtacgacgtcgacaagctcaacggcgccaacgtcgccggcgacgaccccttcgcccgcctctacgcgtccgtcgacgcggacatcaaccaatgcgtcgagaaagcagaaacggcaaagcaagagaagaaccgcgccgcggtggtggcgcttaacgccgagatccggcgcaccaaggccaagctcatcgaggaggacctgcccaagctgcagcgcctcgccgtgaagaaggtgaaagggctcacaagagaagaaattgcgacccgtagtgatctggttgccgccttacctgacagaatacaatctatcccagatggtagttctaccgccacaaagaaaaatggaacttgggggggagcctcaggatctcgtactggaggagccataaagttcgactctactgctgatgggaactttgatgacgagtactttaaggggacagaagaatctaatcagttccgtcgggaatatgagatgcggagaatgaaacaggatgaaggtttggacgttattggtgaaggactggaaactttgaaaaacatggcatctgatatgaatgaggaattggatagacaagtccctctgatggacgaaatggatgacaaggtggatagagccaatgcagatttgaagaataccaatgtgagactgaaggagactgttcttcagcttagatcaagccgcaacttctgcatcgacatcatccttctgtgtgtcattcttggtattgcggcctacctttacaatgttctaaaaaagtgaggcggaatcttgccttggaaccacacatgtcgtggtccctttgtcaccatggttctacccagttctttgagcgatttgcgtgcaccagccatttgtgttgtcttatatctgtattattatggtgtccaagttgaaccttgactaggcttgttgaagagacactggtaacatatctgctgtatatctgggaataaatttcgtagcgaggaaagagtacacggcatcattcttatcgtcttattatcgaaccatgtaagcgtgctcagtaatcatcc

SEQ ID NO: 13657 - DNA, 814 bp, Sorghum bicolor
  Clone ID: SORBI-28MAY03-CLUS949_1
gcacgaggcccgatcccccaaatctcctcccaaaccctctcccgacccagatcgaaacccagggactcgattcgtcgtcggaggcggccatggcgctggagtgggtggtgctgggctacgcggcgggcgcggaggccatcatgctgctgctgctgacgctgccgggcctcgacggcctgcgccggggcatgatctccgtggtgcggagcgcgctcaagcccatgatgtcggtggtgcccttctgcctcttcctgctcatggacatctactggaagtacgagacgcgccccacctgcgacgacgagcacgcctgcacaccctccgagcacctccgccaccaaaagtccatcatgaagtcgcagcggaacgcgctcctcatcgccgccgcgctgctcctctactggatcctcttctccgtcacccagctcgtcgtcaggctcgagcagatgcagcagcgtgtcgacaagctcaagaagcgcgacgactgatagatgggccggccggatcccagtttcatcgcgttctcctatccgcatccgtccatccggtggtctcgttcttccccctgcctttgtgtttcttgtttagtatgttgtagtgcggatgttttagatatcgaatcgtgatttgagacctgctcgtagaatctgcttcctttgtcttgctgtcttcagataaaaagtacaacactcttggaaatgatgatatgtttaggttgtctggacaaatggaatcgtaattggcgtttttgcccaaaaaaaaaaaaaaaaaaggcccctagcactcaaatatatactgtgagatattggtctaa

SEQ ID NO: 13658 - DNA, 1229 bp, Sorghum bicolor
  Clone ID: SORBI-28MAY03-CLUS11651_1
gcacgaggaaggcacgcgcccctcgcctccccaccgccgccgttgtacgcttttggctccatcgccccctccacttcggagcctctctttcggcggcggcgcaagaagagatggcggagcggctgacccgtatcgccatcgtcagcgaggacaagtgcaagcccaagaagtgccgccaggagtgcaagaagagctgccccgtcgtcaagactgggaagctatgcattgaagtgacttcggcgtcgaaactcgctttcatttctgaggagctgtgcatcggttgtggtatctgtgtaaagaaatgcccatttgatgccattgaaatcatcaaccttccaaaggacttggaaaaggataccactcaccgatatgggcctaataccttcaagctgcacaggttgcctgtcccgaggcctggtcaggttttgggccttgttggaacaaacggaattggaaagtcgacagctcttaaagtgttggctggcaagctgaaacctaacttggggcgcttcaaaaacccgcccgattggcaggaaattctcacatatttccgtgggtctgaacttcagaactacttcacacgcatattggaagataacctgaaggcaatcatcaaacctcagtatgttgaccacatcccaaaagctgtccaagggaatgtaggacaagtacttgaacagaaggatgagagggatatgaaagctgaactgtgtgttgaccttgaattaaaccaagttattgaccgaaatgtaggagatctttctggtggtgagctacagagatttgcaatagcagttgttgctgtgcaaaatgcggaaatctacatgttcgatgagccatcaagttaccttgatgtgaagcagaggctgaaagctgcacaagtcattaggtccttgcttaggcccaacagctatgtcatcgttgtggaacatgacttgagtgtcttggattacttgtccgacttcatttgctgtttatatggcaagccaggtgcttatggtgtggttaccttgccattctcagtccgagagggtatcaatattttcttggctggatttgttccaacagaaaatcttcggttccgagacgaatctcttacatttaagattgcagagactcaagaaagtgctgaggagattgagacgtatcagcggtacaagtaccctactatgagcaaaacacagggaaatttcaagcttactgttgttgagggtgaatttactgattcc

SEQ ID NO: 13659 - DNA, 726 bp, Sorghum bicolor
  Clone ID: SORBI-28MAY03-CLUS13382_1
gtgcggcgctcgaggggcacgaggatcggaggctttacttcgtttatccacggaacacttccggtgccggcggcgaccacttgtgtgctcggggaggcgatcgatcgtcaccatgtcctcggagaaggaggcggcgctcgccgccgtgcccaacgacagcccaaccatatttgacaagatcatcaaaaaggaaataccttctactgtggtttatgaggatgagaaggtactggctttcagggacataaaccctcaagctccaacacacatcctcatcatccccaaagtcaaggatggactaactggcctgtcaaaggctgaagagaggcacatagagatacttggctatcttctctatgttgccaaggttgttgcaaagcaggaaggacttgaagatggctatcgcgttgtcatcaatgatggcccaagtggatgtcaatctgtctaccacattcacgttcatctcctcggaggcaggcaaatgaactggcccccaggctaagaatatcttgttgttgatcagtcttcgtggcaaggattgctactccatttctccagaataatccctgtaatttccataaaagctagtgccaccttgtgctgtatttgtggaattaccggaagcatcctgctgtgatctatgaatgaacacaagaaacttgtacctggtatcatggattgacttatccttattgatcagctggaggttgtccactggccttgttc

SEQ ID NO: 13660 - DNA, 1212 bp, Sorghum bicolor
  Clone ID: SORBI-28MAY03-CLUS1368_1
gagagtctctccgcccgcgcatgcccatctcctcctcctcctaaaccctcctcctctccgtctcctccaatggcggcggcggctgccacctccttcgccaccctcgccgtcgcgcgctcggcggggcagcggtccctcctcgcctccaaggccgccccctcgccgctcctctccctccgcagcgccggcctcccctcgcaggccgtctccttctccgggggcctcgcggcgtcgacctcccacagccgagcgcgcttcgcaacatccgccagcgccgagcccaaggaagcagaccttcagtctaaaatcacaaacaaggtgtactttgacataagcattgggaaccctgtggggaagaatgttgggaggattgtcatcggcctatatggggatgatgttccacaaacagcggagaacttccgtgctctttgcactggagagaaagggtttggatacaagggatccagtttccaccgtgttatcagcgacttcatgattcagggcggagattttgacaagggcaacggtaccggtgggaaaagcatatatggacgcaccttcaaagatgagaacttcaaattggttcacactggacctggagtggtcagcatggctaatgctggaccgaacaccaacggcagccagtttttcatttgcactgtcaagacaccttggttggacggaaggcatgttgtgtttggccaggtcctggaagggatggacatcgtaaagttgatcgagtcacaggagactgacagaggtgaccgcccgaagaagaaagtagtcatcagcgagtgtggggagcttccagtggtttaagtgttgctcatctgttgtccgtcttacctcggatggatggtgatatctccccctgagtttactggttctgatgctatgaccttgtcttgctatctctatgctagttatagagatattcaagtaagatcccaaatctgaggcatactgttgctgctcggctggaataaatgtgctactttccccttgcccagtttagggaaagggttttgttcacgaagtcaccctgtaaccttgtatgtttcatactcggaatgaaggttcagggaaatcatgatacaaaaatattctgttgccttgcctgcaagagctgttgatcgtccagagcaatgtatatggcctgtttggtttatgcccaaatttgccatacctaacttttggcaaactgtagcaaag

SEQ ID NO: 13661 - DNA, 1189 bp, Sorghum bicolor
  Clone ID: SORBI-28MAY03-CLUS64739_1
gcacgaggtgacagcagagcccgggttggatggcacatccacttagtgccagtcagtcgctgatgcttgaactatgtcccagcccatactaactagcactaaggcatcttcctcggcatgatcacccgcggcgcaagctctctgccgggccggcacggcctctggcgctcgttgtcggaatggctaatgacaaggagcgtctcctgtgtttgctgagcagcttgtctcaggttgaacgcctgacaacgtgctaccgacggaggcgagcatcgccatggcatcgccagagcaaccaccctcgcgagaaagactcaacttcctaggcgggaggagccagtttctgacagcagaggaagcatcagtactcgatcggggcgcatccactgtactcatcgatggagcatatatgagggcatctgcaaaggccttatcagaagtgaaagaaaccatcagaccataacaggcttccagcgcttgttgtcagcatggctaatgacaaggagcatcttgcgattgctgagcagcttcactcaggccaaatgcctgcctgacgtcgtgctactgacagaggcatcgcatcgctggaggaacctaccgccacgacgccagcagcctcgtccctgaaagaatcatggatagctgtggcacacgaccaggtgcatcgagtgcgtggacatccattggcggcatcgatcagcggcgccgaaaccccagagtgcattgacatttgacaggttggccggtccatcgtcgagctccgcaaggaaggccgtgtgtcatcaggaataagagaggaaggagatgcctactgtagggcatccgacaatgggagtgcgcgatggcagatgcgggcgcccgcgcccgcgcctcgtctcggctgcgtcgccggctccatcccttcgtcttgcctgctgtactgcaacagctgggggcgctggcgttaggggaagagcgacctggaagctgcactgcactgaggtaggccgtagggagtggtgggtggtgatgctgaagctgtacctgccggctcctgattcctgatgatccgagggacaattcgagatgggggaaaaaatgtcaaatgtctttctctttttctctcatagatattgctgatttattgtttgagagaaatattagtgaacgaatgacagattgagcttatcagtgctttctctcgtgccaacct
